United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 23

SEQ ID NO: 946959 - DNA, 18 bp, Homo sapiens
tcgccagtcactgctgca

SEQ ID NO: 946960 - DNA, 22 bp, Homo sapiens
tcgccagtcactgctgcaaggt

SEQ ID NO: 946961 - DNA, 13 bp, Homo sapiens
tcgccataggcca

SEQ ID NO: 946962 - DNA, 15 bp, Homo sapiens
tcgccataggccaag

SEQ ID NO: 946963 - DNA, 17 bp, Homo sapiens
tcgccataggccaaggt

SEQ ID NO: 946964 - DNA, 19 bp, Homo sapiens
tcgccatcaaggtccagtg

SEQ ID NO: 946965 - DNA, 14 bp, Homo sapiens
tcgccatcttcttc

SEQ ID NO: 946966 - DNA, 14 bp, Homo sapiens
tcgccatgccgggg

SEQ ID NO: 946967 - DNA, 17 bp, Homo sapiens
tcgcccaaagccagaca

SEQ ID NO: 946968 - DNA, 14 bp, Homo sapiens
tcgcccacccagct

SEQ ID NO: 946969 - DNA, 16 bp, Homo sapiens
tcgcccacccagctgg

SEQ ID NO: 946970 - DNA, 12 bp, Homo sapiens
tcgcccagcagg

SEQ ID NO: 946971 - DNA, 13 bp, Homo sapiens
tcgcccagcagga

SEQ ID NO: 946972 - DNA, 14 bp, Homo sapiens
tcgcccagcaggag

SEQ ID NO: 946973 - DNA, 15 bp, Homo sapiens
tcgcccagcaggaga

SEQ ID NO: 946974 - DNA, 11 bp, Homo sapiens
tcgccccaccc

SEQ ID NO: 946975 - DNA, 12 bp, Homo sapiens
tcgccccaccca

SEQ ID NO: 946976 - DNA, 13 bp, Homo sapiens
tcgccccacccag

SEQ ID NO: 946977 - DNA, 20 bp, Homo sapiens
tcgccccagcaggtgctgac

SEQ ID NO: 946978 - DNA, 13 bp, Homo sapiens
tcgccccaggccc

SEQ ID NO: 946979 - DNA, 20 bp, Homo sapiens
tcgccccagtggcactgaag

SEQ ID NO: 946980 - DNA, 12 bp, Homo sapiens
tcgcccctccag

SEQ ID NO: 946981 - DNA, 13 bp, Homo sapiens
tcgcccctccagt

SEQ ID NO: 946982 - DNA, 13 bp, Homo sapiens
tcgcccctcccct

SEQ ID NO: 946983 - DNA, 15 bp, Homo sapiens
tcgcccctcccctca

SEQ ID NO: 946984 - DNA, 16 bp, Homo sapiens
tcgcccctcccctcag

SEQ ID NO: 946985 - DNA, 11 bp, Homo sapiens
tcgcccgccca

SEQ ID NO: 946986 - DNA, 20 bp, Homo sapiens
tcgcccgcccactgtcctgg

SEQ ID NO: 946987 - DNA, 14 bp, Homo sapiens
tcgccctcccaggc

SEQ ID NO: 946988 - DNA, 15 bp, Homo sapiens
tcgccctcctttccc

SEQ ID NO: 946989 - DNA, 17 bp, Homo sapiens
tcgccctcctttccctt

SEQ ID NO: 946990 - DNA, 16 bp, Homo sapiens
tcgccctcctttctgt

SEQ ID NO: 946991 - DNA, 15 bp, Homo sapiens
tcgccctgagaagat

SEQ ID NO: 946992 - DNA, 14 bp, Homo sapiens
tcgcccttctcccg

SEQ ID NO: 946993 - DNA, 22 bp, Homo sapiens
tcgcccttctcccggccctcac

SEQ ID NO: 946994 - DNA, 16 bp, Homo sapiens
tcgccgcaacctgcag

SEQ ID NO: 946995 - DNA, 16 bp, Homo sapiens
tcgccggatctgaggg

SEQ ID NO: 946996 - DNA, 23 bp, Homo sapiens
tcgccgtgtctcagcctctgcca

SEQ ID NO: 946997 - DNA, 22 bp, Homo sapiens
tcgcctcactttccaccaagtg

SEQ ID NO: 946998 - DNA, 18 bp, Homo sapiens
tcgcctccccaccctcct

SEQ ID NO: 946999 - DNA, 20 bp, Homo sapiens
tcgcctgtggagctcagccc

SEQ ID NO: 947000 - DNA, 21 bp, Homo sapiens
tcgcctgtggagctcagcccc

SEQ ID NO: 947001 - DNA, 14 bp, Homo sapiens
tcgccttccctcct

SEQ ID NO: 947002 - DNA, 11 bp, Homo sapiens
gcggctctgag

SEQ ID NO: 947003 - DNA, 19 bp, Homo sapiens
gcggctctgagcaggggca

SEQ ID NO: 947004 - DNA, 14 bp, Homo sapiens
gcggctctgcccac

SEQ ID NO: 947005 - DNA, 19 bp, Homo sapiens
gcggctctggtcctcggag

SEQ ID NO: 947006 - DNA, 16 bp, Homo sapiens
gcggctgagagcccca

SEQ ID NO: 947007 - DNA, 23 bp, Homo sapiens
gcggctgagtcatgatctccctg

SEQ ID NO: 947008 - DNA, 14 bp, Homo sapiens
gcggctgccgactc

SEQ ID NO: 947009 - DNA, 21 bp, Homo sapiens
gcggctgccgactcccccaac

SEQ ID NO: 947010 - DNA, 22 bp, Homo sapiens
gcggctttatcattcctttcca

SEQ ID NO: 947011 - DNA, 21 bp, Homo sapiens
gcggctttctctgcctctggg

SEQ ID NO: 947012 - DNA, 13 bp, Homo sapiens
gcgggaaggaggg

SEQ ID NO: 947013 - DNA, 21 bp, Homo sapiens
gcgggacgtccctgcccatgt

SEQ ID NO: 947014 - DNA, 18 bp, Homo sapiens
gcgggactcagtgagctg

SEQ ID NO: 947015 - DNA, 16 bp, Homo sapiens
gcgggagacctgtgct

SEQ ID NO: 947016 - DNA, 12 bp, Homo sapiens
gcgggaggcacc

SEQ ID NO: 947017 - DNA, 13 bp, Homo sapiens
gcgggaggcacca

SEQ ID NO: 947018 - DNA, 15 bp, Homo sapiens
gcgggaggcaccagc

SEQ ID NO: 947019 - DNA, 17 bp, Homo sapiens
gcgggaggcaccagctc

SEQ ID NO: 947020 - DNA, 19 bp, Homo sapiens
gcgggaggcaccagctctg

SEQ ID NO: 947021 - DNA, 22 bp, Homo sapiens
gcgggaggctggggccccatct

SEQ ID NO: 947022 - DNA, 12 bp, Homo sapiens
gcgggagggagt

SEQ ID NO: 947023 - DNA, 18 bp, Homo sapiens
gcgggagggagtctcagg

SEQ ID NO: 947024 - DNA, 20 bp, Homo sapiens
gcgggagggagtctcaggag

SEQ ID NO: 947025 - DNA, 22 bp, Homo sapiens
gcgggagggagtctcaggagga

SEQ ID NO: 947026 - DNA, 20 bp, Homo sapiens
gcgggagggttccgccactc

SEQ ID NO: 947027 - DNA, 17 bp, Homo sapiens
gcgggatcctccacaga

SEQ ID NO: 947028 - DNA, 20 bp, Homo sapiens
gcgggcacctatagtcccag

SEQ ID NO: 947029 - DNA, 17 bp, Homo sapiens
gcgggcagagggctgga

SEQ ID NO: 947030 - DNA, 21 bp, Homo sapiens
gcgggcagcaccctccgaccc

SEQ ID NO: 947031 - DNA, 10 bp, Homo sapiens
gcgggcaggg

SEQ ID NO: 947032 - DNA, 17 bp, Homo sapiens
gcgggccaaggactgcc

SEQ ID NO: 947033 - DNA, 20 bp, Homo sapiens
gcgggccaaggactgccgac

SEQ ID NO: 947034 - DNA, 16 bp, Homo sapiens
gcgggccacagggcaa

SEQ ID NO: 947035 - DNA, 11 bp, Homo sapiens
gcgggccaggg

SEQ ID NO: 947036 - DNA, 12 bp, Homo sapiens
gcgggccagggt

SEQ ID NO: 947037 - DNA, 16 bp, Homo sapiens
gcgggccagggtcctg

SEQ ID NO: 947038 - DNA, 14 bp, Homo sapiens
gcgggccagggtgg

SEQ ID NO: 947039 - DNA, 15 bp, Homo sapiens
gcgggccagggtggg

SEQ ID NO: 947040 - DNA, 12 bp, Homo sapiens
gcgggcctggac

SEQ ID NO: 947041 - DNA, 19 bp, Homo sapiens
gcgggcggctgggtctgtg

SEQ ID NO: 947042 - DNA, 15 bp, Homo sapiens
gcgggctcagagctt

SEQ ID NO: 947043 - DNA, 20 bp, Homo sapiens
gcgggctgggggtagcctgg

SEQ ID NO: 947044 - DNA, 17 bp, Homo sapiens
gcgggctgtgcccggcc

SEQ ID NO: 947045 - DNA, 15 bp, Homo sapiens
gcggggactgctggc

SEQ ID NO: 947046 - DNA, 16 bp, Homo sapiens
gcggggactgctggct

SEQ ID NO: 947047 - DNA, 21 bp, Homo sapiens
gcggggagaagatagggaaca

SEQ ID NO: 947048 - DNA, 21 bp, Homo sapiens
gcggggcccaggcagcctccg

SEQ ID NO: 947049 - DNA, 18 bp, Homo sapiens
gcggggccttttgcccgg

SEQ ID NO: 947050 - DNA, 16 bp, Homo sapiens
gcgggggcggaggagg

SEQ ID NO: 947051 - DNA, 11 bp, Homo sapiens
gcggggggagg

SEQ ID NO: 947052 - DNA, 19 bp, Homo sapiens
gcggggtcccctctgtgct

SEQ ID NO: 947053 - DNA, 14 bp, Homo sapiens
gcgggtctcctccc

SEQ ID NO: 947054 - DNA, 17 bp, Homo sapiens
gcgggtgacgcccacct

SEQ ID NO: 947055 - DNA, 22 bp, Homo sapiens
gcgggtgcacagagacggtctg

SEQ ID NO: 947056 - DNA, 19 bp, Homo sapiens
gcgggtggatcacgaggtc

SEQ ID NO: 947057 - DNA, 15 bp, Homo sapiens
gcggtagccagcaca

SEQ ID NO: 947058 - DNA, 17 bp, Homo sapiens
gcggtcatgtgtgcatg

SEQ ID NO: 947059 - DNA, 19 bp, Homo sapiens
gcggtccccatccccacca

SEQ ID NO: 947060 - DNA, 20 bp, Homo sapiens
gcggtccccatccccaccag

SEQ ID NO: 947061 - DNA, 18 bp, Homo sapiens
gcggtccctgtccctcta

SEQ ID NO: 947062 - DNA, 12 bp, Homo sapiens
gcggtgctctgg

SEQ ID NO: 947063 - DNA, 14 bp, Homo sapiens
gcggtgctctggcg

SEQ ID NO: 947064 - DNA, 21 bp, Homo sapiens
gcggtgctctggcggcttcct

SEQ ID NO: 947065 - DNA, 16 bp, Homo sapiens
tcggagcatcccggag

SEQ ID NO: 947066 - DNA, 23 bp, Homo sapiens
tcggagcatcccggaggaaatct

SEQ ID NO: 947067 - DNA, 12 bp, Homo sapiens
tcggagccaaca

SEQ ID NO: 947068 - DNA, 17 bp, Homo sapiens
tcggagctgcctgcagc

SEQ ID NO: 947069 - DNA, 20 bp, Homo sapiens
tcggagctgcctgcagcaca

SEQ ID NO: 947070 - DNA, 14 bp, Homo sapiens
tcggagctggctgt

SEQ ID NO: 947071 - DNA, 19 bp, Homo sapiens
tcggagctggctgtgcctg

SEQ ID NO: 947072 - DNA, 20 bp, Homo sapiens
tcggagctggctgtgcctgc

SEQ ID NO: 947073 - DNA, 20 bp, Homo sapiens
tcggagggatggagaaagaa

SEQ ID NO: 947074 - DNA, 18 bp, Homo sapiens
tcggagggccgcagggcc

SEQ ID NO: 947075 - DNA, 13 bp, Homo sapiens
tcggagtttctta

SEQ ID NO: 947076 - DNA, 20 bp, Homo sapiens
tcggatctggggctctggga

SEQ ID NO: 947077 - DNA, 19 bp, Homo sapiens
tcggatgacaccctggcct

SEQ ID NO: 947078 - DNA, 13 bp, Homo sapiens
tcggatgaccaaa

SEQ ID NO: 947079 - DNA, 22 bp, Homo sapiens
tcggatgaccaaaccagccttc

SEQ ID NO: 947080 - DNA, 23 bp, Homo sapiens
tcggatgaccaaaccagccttcg

SEQ ID NO: 947081 - DNA, 23 bp, Homo sapiens
tcggatggaccaacctgctctgt

SEQ ID NO: 947082 - DNA, 13 bp, Homo sapiens
tcggattttttcc

SEQ ID NO: 947083 - DNA, 18 bp, Homo sapiens
tcggcagaactctctgtc

SEQ ID NO: 947084 - DNA, 22 bp, Homo sapiens
tcggcaggagagtgtgtgggca

SEQ ID NO: 947085 - DNA, 23 bp, Homo sapiens
tcggcaggagagtgtgtgggcag

SEQ ID NO: 947086 - DNA, 17 bp, Homo sapiens
tcggcatgccaggaccc

SEQ ID NO: 947087 - DNA, 20 bp, Homo sapiens
tcggcatttaacttacattt

SEQ ID NO: 947088 - DNA, 13 bp, Homo sapiens
tcggccactgtgt

SEQ ID NO: 947089 - DNA, 18 bp, Homo sapiens
tcggccactgtgtctctg

SEQ ID NO: 947090 - DNA, 15 bp, Homo sapiens
tcggccagaggggct

SEQ ID NO: 947091 - DNA, 19 bp, Homo sapiens
tcggcccacagctcccacc

SEQ ID NO: 947092 - DNA, 23 bp, Homo sapiens
tcggcccacagctcccaccccac

SEQ ID NO: 947093 - DNA, 13 bp, Homo sapiens
tcggccccatcgc

SEQ ID NO: 947094 - DNA, 18 bp, Homo sapiens
tcggccccatcgccccac

SEQ ID NO: 947095 - DNA, 14 bp, Homo sapiens
tcggcccctctgat

SEQ ID NO: 947096 - DNA, 15 bp, Homo sapiens
tcggcccggagcagc

SEQ ID NO: 947097 - DNA, 17 bp, Homo sapiens
tcggcccggagcagcag

SEQ ID NO: 947098 - DNA, 18 bp, Homo sapiens
tcggcccggagcagcagg

SEQ ID NO: 947099 - DNA, 11 bp, Homo sapiens
tcggccctgaa

SEQ ID NO: 947100 - DNA, 23 bp, Homo sapiens
tcggccctgaaccacgaggctgc

SEQ ID NO: 947101 - DNA, 13 bp, Homo sapiens
tcggccctgccca

SEQ ID NO: 947102 - DNA, 20 bp, Homo sapiens
tcggccctgcgtcggccctg

SEQ ID NO: 947103 - DNA, 17 bp, Homo sapiens
tcggccctgtcccctgg

SEQ ID NO: 947104 - DNA, 14 bp, Homo sapiens
tcggccgaggcctg

SEQ ID NO: 947105 - DNA, 17 bp, Homo sapiens
tcggcctccgaggctcc

SEQ ID NO: 947106 - DNA, 20 bp, Homo sapiens
tcggcctccgaggctccccg

SEQ ID NO: 947107 - DNA, 16 bp, Homo sapiens
tcggcgttagtcccta

SEQ ID NO: 947108 - DNA, 23 bp, Homo sapiens
tcggctacccctcgactcagcac

SEQ ID NO: 947109 - DNA, 14 bp, Homo sapiens
tcggctcacaaatt

SEQ ID NO: 947110 - DNA, 12 bp, Homo sapiens
tcggctccctgg

SEQ ID NO: 947111 - DNA, 12 bp, Homo sapiens
tcggctggaaga

SEQ ID NO: 947112 - DNA, 14 bp, Homo sapiens
tcggcttcctgtgg

SEQ ID NO: 947113 - DNA, 20 bp, Homo sapiens
tcggcttcttggaccttggc

SEQ ID NO: 947114 - DNA, 16 bp, Homo sapiens
tcggcttgtgggctgg

SEQ ID NO: 947115 - DNA, 23 bp, Homo sapiens
tcggcttgtgggctggtgcccca

SEQ ID NO: 947116 - DNA, 14 bp, Homo sapiens
tcgggaacagtgtt

SEQ ID NO: 947117 - DNA, 15 bp, Homo sapiens
tcgggaagggagggg

SEQ ID NO: 947118 - DNA, 16 bp, Homo sapiens
tcgggacacctgccct

SEQ ID NO: 947119 - DNA, 19 bp, Homo sapiens
tcgggacacctgccctgcc

SEQ ID NO: 947120 - DNA, 16 bp, Homo sapiens
tcgggaccacatctgt

SEQ ID NO: 947121 - DNA, 16 bp, Homo sapiens
tcgggagacagcatca

SEQ ID NO: 947122 - DNA, 21 bp, Homo sapiens
tcgggagacagcatcagggtt

SEQ ID NO: 947123 - DNA, 18 bp, Homo sapiens
tcgggagcacccagagca

SEQ ID NO: 947124 - DNA, 12 bp, Homo sapiens
tcgggagctgca

SEQ ID NO: 947125 - DNA, 14 bp, Homo sapiens
tcgggagctgcaca

SEQ ID NO: 947126 - DNA, 23 bp, Homo sapiens
tcgggaggctgaggcaggagact

SEQ ID NO: 947127 - DNA, 17 bp, Homo sapiens
tcgggaggtcgaggcag

SEQ ID NO: 947128 - DNA, 21 bp, Homo sapiens
tcgggagtcctctagcaggcc

SEQ ID NO: 947129 - DNA, 15 bp, Homo sapiens
gcgtggaggagagga

SEQ ID NO: 947130 - DNA, 14 bp, Homo sapiens
gcgtggccttggga

SEQ ID NO: 947131 - DNA, 18 bp, Homo sapiens
gcgtggctgtggcacaga

SEQ ID NO: 947132 - DNA, 15 bp, Homo sapiens
gcgtgggagccagcc

SEQ ID NO: 947133 - DNA, 16 bp, Homo sapiens
gcgtgggagccagcct

SEQ ID NO: 947134 - DNA, 19 bp, Homo sapiens
gcgtgggaggcagaaacct

SEQ ID NO: 947135 - DNA, 22 bp, Homo sapiens
gcgtgggtttttgtatccagag

SEQ ID NO: 947136 - DNA, 21 bp, Homo sapiens
gcgtggtataatctccatttc

SEQ ID NO: 947137 - DNA, 17 bp, Homo sapiens
gcgtgtcacctgtgctt

SEQ ID NO: 947138 - DNA, 17 bp, Homo sapiens
gcgtgtccgtctgtctg

SEQ ID NO: 947139 - DNA, 22 bp, Homo sapiens
gcgtgtgaagaacacctcctcc

SEQ ID NO: 947140 - DNA, 16 bp, Homo sapiens
gcgtgtgcaggccgac

SEQ ID NO: 947141 - DNA, 14 bp, Homo sapiens
gcgtgtgccaggca

SEQ ID NO: 947142 - DNA, 15 bp, Homo sapiens
gcgtgtgccaggcag

SEQ ID NO: 947143 - DNA, 17 bp, Homo sapiens
gcgtgtggagcagagct

SEQ ID NO: 947144 - DNA, 14 bp, Homo sapiens
gcgtgtggcagcca

SEQ ID NO: 947145 - DNA, 13 bp, Homo sapiens
gcgtgtggctcac

SEQ ID NO: 947146 - DNA, 19 bp, Homo sapiens
gcgtgttagtgtgtgtgca

SEQ ID NO: 947147 - DNA, 22 bp, Homo sapiens
gcgtgttagtgtgtgtgcatgt

SEQ ID NO: 947148 - DNA, 17 bp, Homo sapiens
gcgtgttcagcagaacc

SEQ ID NO: 947149 - DNA, 22 bp, Homo sapiens
gcgttaatcagttcaaaaggag

SEQ ID NO: 947150 - DNA, 16 bp, Homo sapiens
gcgttactaattggcc

SEQ ID NO: 947151 - DNA, 19 bp, Homo sapiens
gcgttatggcagcccggct

SEQ ID NO: 947152 - DNA, 22 bp, Homo sapiens
gcgttatggcagcccggctgct

SEQ ID NO: 947153 - DNA, 13 bp, Homo sapiens
gcgttcagcccct

SEQ ID NO: 947154 - DNA, 18 bp, Homo sapiens
gcgttcagcccctgatct

SEQ ID NO: 947155 - DNA, 22 bp, Homo sapiens
gcgttcagcccctgatctctga

SEQ ID NO: 947156 - DNA, 14 bp, Homo sapiens
gcgttcctggcctt

SEQ ID NO: 947157 - DNA, 21 bp, Homo sapiens
gcgttccttcgcacactgtga

SEQ ID NO: 947158 - DNA, 14 bp, Homo sapiens
gcgttctcaagaat

SEQ ID NO: 947159 - DNA, 20 bp, Homo sapiens
gcgttctggactctgcccca

SEQ ID NO: 947160 - DNA, 17 bp, Homo sapiens
gcgttcttgtaatttta

SEQ ID NO: 947161 - DNA, 22 bp, Homo sapiens
gcgttggatttaaaaatgccaa

SEQ ID NO: 947162 - DNA, 23 bp, Homo sapiens
gcgttggatttaaaaatgccaaa

SEQ ID NO: 947163 - DNA, 15 bp, Homo sapiens
gcgttgggagcctag

SEQ ID NO: 947164 - DNA, 22 bp, Homo sapiens
gcgttggtccagagcggaggct

SEQ ID NO: 947165 - DNA, 15 bp, Homo sapiens
gcgttggtgccactt

SEQ ID NO: 947166 - DNA, 19 bp, Homo sapiens
gcgttgtaaaatatagctg

SEQ ID NO: 947167 - DNA, 20 bp, Homo sapiens
gcgtttcaccatgttggcca

SEQ ID NO: 947168 - DNA, 13 bp, Homo sapiens
gcgtttgctgtgc

SEQ ID NO: 947169 - DNA, 21 bp, Homo sapiens
gcgtttgctgtgccaggaggc

SEQ ID NO: 947170 - DNA, 12 bp, Homo sapiens
gcgttttctccg

SEQ ID NO: 947171 - DNA, 16 bp, Homo sapiens
gcgttttgttgtagat

SEQ ID NO: 947172 - DNA, 19 bp, Homo sapiens
gcgttttttaaatgtatac

SEQ ID NO: 947173 - DNA, 12 bp, Homo sapiens
gctaaaaaataa

SEQ ID NO: 947174 - DNA, 20 bp, Homo sapiens
gctaaaaaataaataaaagc

SEQ ID NO: 947175 - DNA, 14 bp, Homo sapiens
gctaaaaagcaaca

SEQ ID NO: 947176 - DNA, 18 bp, Homo sapiens
gctaaaacaccttggctt

SEQ ID NO: 947177 - DNA, 16 bp, Homo sapiens
gctaaaagaaactttc

SEQ ID NO: 947178 - DNA, 16 bp, Homo sapiens
gctaaaagaagagagg

SEQ ID NO: 947179 - DNA, 19 bp, Homo sapiens
gctaaaagtgcatttaagg

SEQ ID NO: 947180 - DNA, 23 bp, Homo sapiens
gctaaaagtgcatttaaggagat

SEQ ID NO: 947181 - DNA, 23 bp, Homo sapiens
gctaaaattaaaaagaaaatatt

SEQ ID NO: 947182 - DNA, 22 bp, Homo sapiens
gctaaactccttcctggcctga

SEQ ID NO: 947183 - DNA, 19 bp, Homo sapiens
gctaaagaagtttgaacat

SEQ ID NO: 947184 - DNA, 20 bp, Homo sapiens
gctaaagaagtttgaacatt

SEQ ID NO: 947185 - DNA, 22 bp, Homo sapiens
gctaaagagcccttgcctcccc

SEQ ID NO: 947186 - DNA, 17 bp, Homo sapiens
tcgtgaagtatactgta

SEQ ID NO: 947187 - DNA, 18 bp, Homo sapiens
tcgtgacccttcagggcc

SEQ ID NO: 947188 - DNA, 20 bp, Homo sapiens
tcgtgagctggggactcagg

SEQ ID NO: 947189 - DNA, 20 bp, Homo sapiens
tcgtgatgtggaggaagagc

SEQ ID NO: 947190 - DNA, 14 bp, Homo sapiens
tcgtgccagcagcc

SEQ ID NO: 947191 - DNA, 18 bp, Homo sapiens
tcgtgccatgatctgtat

SEQ ID NO: 947192 - DNA, 20 bp, Homo sapiens
tcgtgccgttactctccaac

SEQ ID NO: 947193 - DNA, 14 bp, Homo sapiens
tcgtgcctgtgtcc

SEQ ID NO: 947194 - DNA, 15 bp, Homo sapiens
tcgtgcctgtgtcca

SEQ ID NO: 947195 - DNA, 17 bp, Homo sapiens
tcgtggacacacacaga

SEQ ID NO: 947196 - DNA, 20 bp, Homo sapiens
tcgtggactgagtgggaagc

SEQ ID NO: 947197 - DNA, 17 bp, Homo sapiens
tcgtggactgtgctggt

SEQ ID NO: 947198 - DNA, 17 bp, Homo sapiens
tcgtggagctcgcccct

SEQ ID NO: 947199 - DNA, 21 bp, Homo sapiens
tcgtggcagataatcagcctc

SEQ ID NO: 947200 - DNA, 15 bp, Homo sapiens
tcgtggccaaaagtt

SEQ ID NO: 947201 - DNA, 13 bp, Homo sapiens
tcgtggccagccc

SEQ ID NO: 947202 - DNA, 15 bp, Homo sapiens
tcgtggccagcccgg

SEQ ID NO: 947203 - DNA, 17 bp, Homo sapiens
tcgtggccagcccggct

SEQ ID NO: 947204 - DNA, 18 bp, Homo sapiens
tcgtggccagcccggctg

SEQ ID NO: 947205 - DNA, 15 bp, Homo sapiens
tcgtgggtgtgtgta

SEQ ID NO: 947206 - DNA, 17 bp, Homo sapiens
tcgtggtagaagccagt

SEQ ID NO: 947207 - DNA, 15 bp, Homo sapiens
tcgtggtatgtatgg

SEQ ID NO: 947208 - DNA, 19 bp, Homo sapiens
tcgtgtagtggaagagcag

SEQ ID NO: 947209 - DNA, 13 bp, Homo sapiens
tcgtgtatcctgg

SEQ ID NO: 947210 - DNA, 14 bp, Homo sapiens
tcgtgtatcctggg

SEQ ID NO: 947211 - DNA, 16 bp, Homo sapiens
tcgtgtatcctggggc

SEQ ID NO: 947212 - DNA, 14 bp, Homo sapiens
tcgtgtcagctcag

SEQ ID NO: 947213 - DNA, 17 bp, Homo sapiens
tcgtgtgcaacagacaa

SEQ ID NO: 947214 - DNA, 14 bp, Homo sapiens
tcgtgtgctgctgc

SEQ ID NO: 947215 - DNA, 15 bp, Homo sapiens
tcgtgtgctgctgct

SEQ ID NO: 947216 - DNA, 17 bp, Homo sapiens
tcgtgtgctgctgctgc

SEQ ID NO: 947217 - DNA, 22 bp, Homo sapiens
tcgtgtgctgctgctgctattg

SEQ ID NO: 947218 - DNA, 13 bp, Homo sapiens
tcgtgtggctcct

SEQ ID NO: 947219 - DNA, 14 bp, Homo sapiens
tcgtgttatgaatc

SEQ ID NO: 947220 - DNA, 19 bp, Homo sapiens
tcgtgttatgaatctgtgc

SEQ ID NO: 947221 - DNA, 21 bp, Homo sapiens
tcgtgttatgaatctgtgctg

SEQ ID NO: 947222 - DNA, 20 bp, Homo sapiens
tcgtgttggaaaatgtgtct

SEQ ID NO: 947223 - DNA, 21 bp, Homo sapiens
tcgtgttggaaaatgtgtctc

SEQ ID NO: 947224 - DNA, 23 bp, Homo sapiens
tcgtgtttgcttaaaatatgtga

SEQ ID NO: 947225 - DNA, 17 bp, Homo sapiens
tcgttaaaaagttgttt

SEQ ID NO: 947226 - DNA, 12 bp, Homo sapiens
tcgttaacattg

SEQ ID NO: 947227 - DNA, 14 bp, Homo sapiens
tcgttaacattgac

SEQ ID NO: 947228 - DNA, 17 bp, Homo sapiens
tcgttaacattgaccaa

SEQ ID NO: 947229 - DNA, 21 bp, Homo sapiens
tcgttaactgtgtatgtacat

SEQ ID NO: 947230 - DNA, 19 bp, Homo sapiens
tcgttagtatctaacatgt

SEQ ID NO: 947231 - DNA, 21 bp, Homo sapiens
tcgttcctatacatttctgtt

SEQ ID NO: 947232 - DNA, 12 bp, Homo sapiens
tcgttcctttct

SEQ ID NO: 947233 - DNA, 22 bp, Homo sapiens
tcgttctctgggtggccggctt

SEQ ID NO: 947234 - DNA, 23 bp, Homo sapiens
tcgttctgctgaccaaatggcca

SEQ ID NO: 947235 - DNA, 11 bp, Homo sapiens
tcgttctgtgg

SEQ ID NO: 947236 - DNA, 18 bp, Homo sapiens
tcgttgcagcactgccca

SEQ ID NO: 947237 - DNA, 12 bp, Homo sapiens
tcgttggagagc

SEQ ID NO: 947238 - DNA, 19 bp, Homo sapiens
tcgtttattttcaagaata

SEQ ID NO: 947239 - DNA, 18 bp, Homo sapiens
tcgtttttatattaatgt

SEQ ID NO: 947240 - DNA, 21 bp, Homo sapiens
tctaaaaaaaaaaataaatgt

SEQ ID NO: 947241 - DNA, 14 bp, Homo sapiens
tctaaaaagtcaga

SEQ ID NO: 947242 - DNA, 15 bp, Homo sapiens
tctaaaaagtcagat

SEQ ID NO: 947243 - DNA, 15 bp, Homo sapiens
tctaaaaataaagct

SEQ ID NO: 947244 - DNA, 16 bp, Homo sapiens
tctaaaaattgataga

SEQ ID NO: 947245 - DNA, 16 bp, Homo sapiens
tctaaaacaaaatctg

SEQ ID NO: 947246 - DNA, 19 bp, Homo sapiens
tctaaaacaaaatctgaac

SEQ ID NO: 947247 - DNA, 16 bp, Homo sapiens
tctaaaacattcccct

SEQ ID NO: 947248 - DNA, 22 bp, Homo sapiens
tctaaaacattcccctccccac

SEQ ID NO: 947249 - DNA, 13 bp, Homo sapiens
tctaaaactatgg

SEQ ID NO: 947250 - DNA, 19 bp, Homo sapiens
tctaaaactatggttccca

SEQ ID NO: 947251 - DNA, 21 bp, Homo sapiens
tctaaaactatggttcccaat

SEQ ID NO: 947252 - DNA, 11 bp, Homo sapiens
tctaaaagaaa

SEQ ID NO: 947253 - DNA, 17 bp, Homo sapiens
tctaaaagatccttttt

SEQ ID NO: 947254 - DNA, 19 bp, Homo sapiens
tctaaaatctaaaatttca

SEQ ID NO: 947255 - DNA, 12 bp, Homo sapiens
tctaaaatgatt

SEQ ID NO: 947256 - DNA, 22 bp, Homo sapiens
tctaaaatgcctcagtgtattt

SEQ ID NO: 947257 - DNA, 21 bp, Homo sapiens
gctacaggatggtgggcagga

SEQ ID NO: 947258 - DNA, 13 bp, Homo sapiens
gctacagtaataa

SEQ ID NO: 947259 - DNA, 14 bp, Homo sapiens
gctacagtaataaa

SEQ ID NO: 947260 - DNA, 15 bp, Homo sapiens
gctacagtaataaat

SEQ ID NO: 947261 - DNA, 13 bp, Homo sapiens
gctacataattta

SEQ ID NO: 947262 - DNA, 16 bp, Homo sapiens
gctacatgctggggtc

SEQ ID NO: 947263 - DNA, 21 bp, Homo sapiens
gctacattaaactcaaatgta

SEQ ID NO: 947264 - DNA, 11 bp, Homo sapiens
gctacattcct

SEQ ID NO: 947265 - DNA, 16 bp, Homo sapiens
gctacattcctcagct

SEQ ID NO: 947266 - DNA, 20 bp, Homo sapiens
gctacattcctcagctgcca

SEQ ID NO: 947267 - DNA, 16 bp, Homo sapiens
gctaccaggatgctaa

SEQ ID NO: 947268 - DNA, 13 bp, Homo sapiens
gctaccagtattt

SEQ ID NO: 947269 - DNA, 14 bp, Homo sapiens
gctaccagtattta

SEQ ID NO: 947270 - DNA, 23 bp, Homo sapiens
gctacccctcgactcagcaccac

SEQ ID NO: 947271 - DNA, 16 bp, Homo sapiens
gctaccctgagctgag

SEQ ID NO: 947272 - DNA, 19 bp, Homo sapiens
gctaccctttttctccagc

SEQ ID NO: 947273 - DNA, 20 bp, Homo sapiens
gctaccctttttctccagct

SEQ ID NO: 947274 - DNA, 14 bp, Homo sapiens
gctaccgccctggg

SEQ ID NO: 947275 - DNA, 18 bp, Homo sapiens
gctaccgccctgggctgg

SEQ ID NO: 947276 - DNA, 14 bp, Homo sapiens
gctaccgttgactt

SEQ ID NO: 947277 - DNA, 13 bp, Homo sapiens
gctacctccctcc

SEQ ID NO: 947278 - DNA, 15 bp, Homo sapiens
gctacctctctgtcc

SEQ ID NO: 947279 - DNA, 16 bp, Homo sapiens
gctacctttgtattct

SEQ ID NO: 947280 - DNA, 14 bp, Homo sapiens
gctacgaatcttcc

SEQ ID NO: 947281 - DNA, 21 bp, Homo sapiens
gctacggggaaaatgcatttt

SEQ ID NO: 947282 - DNA, 22 bp, Homo sapiens
gctactaagttcacattagaat

SEQ ID NO: 947283 - DNA, 16 bp, Homo sapiens
gctactagcaaaataa

SEQ ID NO: 947284 - DNA, 15 bp, Homo sapiens
gctactataaagaga

SEQ ID NO: 947285 - DNA, 16 bp, Homo sapiens
gctactataaagagaa

SEQ ID NO: 947286 - DNA, 16 bp, Homo sapiens
gctactcagaagcctg

SEQ ID NO: 947287 - DNA, 21 bp, Homo sapiens
gctactcagaagcctgaggct

SEQ ID NO: 947288 - DNA, 11 bp, Homo sapiens
gctactcagca

SEQ ID NO: 947289 - DNA, 16 bp, Homo sapiens
gctactcagcagccct

SEQ ID NO: 947290 - DNA, 19 bp, Homo sapiens
gctactcagcagccctcct

SEQ ID NO: 947291 - DNA, 14 bp, Homo sapiens
gctactcaggaggc

SEQ ID NO: 947292 - DNA, 19 bp, Homo sapiens
gctactcgatagcctgagg

SEQ ID NO: 947293 - DNA, 18 bp, Homo sapiens
gctactctgtccaggcca

SEQ ID NO: 947294 - DNA, 16 bp, Homo sapiens
gctactgatttttgtg

SEQ ID NO: 947295 - DNA, 20 bp, Homo sapiens
gctactgcactccagcctgg

SEQ ID NO: 947296 - DNA, 19 bp, Homo sapiens
gctactgcagctttacatg

SEQ ID NO: 947297 - DNA, 15 bp, Homo sapiens
gctactgcccctctc

SEQ ID NO: 947298 - DNA, 16 bp, Homo sapiens
gctactgcccctctcc

SEQ ID NO: 947299 - DNA, 15 bp, Homo sapiens
gctactggattctta

SEQ ID NO: 947300 - DNA, 23 bp, Homo sapiens
gctactggcaaaaggatctttgt

SEQ ID NO: 947301 - DNA, 13 bp, Homo sapiens
gctactgtaactt

SEQ ID NO: 947302 - DNA, 16 bp, Homo sapiens
gctactgtaacttttt

SEQ ID NO: 947303 - DNA, 12 bp, Homo sapiens
gctactgtctca

SEQ ID NO: 947304 - DNA, 14 bp, Homo sapiens
gctactgtcttact

SEQ ID NO: 947305 - DNA, 15 bp, Homo sapiens
gctactgtgtgtgtg

SEQ ID NO: 947306 - DNA, 20 bp, Homo sapiens
gctacttatcatttttgtat

SEQ ID NO: 947307 - DNA, 23 bp, Homo sapiens
gctacttatcatttttgtataaa

SEQ ID NO: 947308 - DNA, 19 bp, Homo sapiens
gctacttcctcctccccac

SEQ ID NO: 947309 - DNA, 13 bp, Homo sapiens
tctacctgttctg

SEQ ID NO: 947310 - DNA, 16 bp, Homo sapiens
tctaccttcctgtccc

SEQ ID NO: 947311 - DNA, 20 bp, Homo sapiens
tctacgccaaagtgcagccc

SEQ ID NO: 947312 - DNA, 14 bp, Homo sapiens
tctacgtcatgtat

SEQ ID NO: 947313 - DNA, 17 bp, Homo sapiens
tctacgtcatgtatttt

SEQ ID NO: 947314 - DNA, 19 bp, Homo sapiens
tctacgtcatgtattttat

SEQ ID NO: 947315 - DNA, 20 bp, Homo sapiens
tctacgtcatgtattttatg

SEQ ID NO: 947316 - DNA, 14 bp, Homo sapiens
tctactaaaaagaa

SEQ ID NO: 947317 - DNA, 12 bp, Homo sapiens
tctactaaaaat

SEQ ID NO: 947318 - DNA, 15 bp, Homo sapiens
tctactaaaaataca

SEQ ID NO: 947319 - DNA, 15 bp, Homo sapiens
tctactaaaaatgca

SEQ ID NO: 947320 - DNA, 16 bp, Homo sapiens
tctactaaaaatgcaa

SEQ ID NO: 947321 - DNA, 19 bp, Homo sapiens
tctactaatgcctcttcat

SEQ ID NO: 947322 - DNA, 18 bp, Homo sapiens
tctactaattccacacct

SEQ ID NO: 947323 - DNA, 14 bp, Homo sapiens
tctactacccccac

SEQ ID NO: 947324 - DNA, 18 bp, Homo sapiens
tctactacctacgtttgc

SEQ ID NO: 947325 - DNA, 16 bp, Homo sapiens
tctactatatacatat

SEQ ID NO: 947326 - DNA, 18 bp, Homo sapiens
tctactatatacatatat

SEQ ID NO: 947327 - DNA, 19 bp, Homo sapiens
tctactcctagaagaacca

SEQ ID NO: 947328 - DNA, 12 bp, Homo sapiens
tctactcctccc

SEQ ID NO: 947329 - DNA, 18 bp, Homo sapiens
tctactctgaagaccttt

SEQ ID NO: 947330 - DNA, 12 bp, Homo sapiens
tctactcttcct

SEQ ID NO: 947331 - DNA, 21 bp, Homo sapiens
tctactggaaatgtagcactt

SEQ ID NO: 947332 - DNA, 20 bp, Homo sapiens
tctactgtaagaagagccat

SEQ ID NO: 947333 - DNA, 15 bp, Homo sapiens
tctactgttgcacag

SEQ ID NO: 947334 - DNA, 13 bp, Homo sapiens
tctacttaataaa

SEQ ID NO: 947335 - DNA, 12 bp, Homo sapiens
tctacttcccct

SEQ ID NO: 947336 - DNA, 15 bp, Homo sapiens
tctacttcccctggg

SEQ ID NO: 947337 - DNA, 17 bp, Homo sapiens
tctacttcccctgggat

SEQ ID NO: 947338 - DNA, 17 bp, Homo sapiens
tctacttgttcatttgg

SEQ ID NO: 947339 - DNA, 19 bp, Homo sapiens
tctacttgttttcaatgtg

SEQ ID NO: 947340 - DNA, 16 bp, Homo sapiens
tctactttaagcacta

SEQ ID NO: 947341 - DNA, 14 bp, Homo sapiens
tctactttattaat

SEQ ID NO: 947342 - DNA, 21 bp, Homo sapiens
tctactttattaattgttttg

SEQ ID NO: 947343 - DNA, 17 bp, Homo sapiens
tctactttcatcttaaa

SEQ ID NO: 947344 - DNA, 15 bp, Homo sapiens
tctactttgattctg

SEQ ID NO: 947345 - DNA, 16 bp, Homo sapiens
tctactttgattctga

SEQ ID NO: 947346 - DNA, 21 bp, Homo sapiens
tctactttttaatttttaaga

SEQ ID NO: 947347 - DNA, 21 bp, Homo sapiens
tctactttttgaacttttcat

SEQ ID NO: 947348 - DNA, 14 bp, Homo sapiens
tctagaaactctgg

SEQ ID NO: 947349 - DNA, 19 bp, Homo sapiens
tctagaaataggttaaact

SEQ ID NO: 947350 - DNA, 17 bp, Homo sapiens
tctagaacatgcacatt

SEQ ID NO: 947351 - DNA, 18 bp, Homo sapiens
tctagaagagtctattgt

SEQ ID NO: 947352 - DNA, 22 bp, Homo sapiens
tctagaatgtctgaagtacaaa

SEQ ID NO: 947353 - DNA, 14 bp, Homo sapiens
tctagacaagatat

SEQ ID NO: 947354 - DNA, 23 bp, Homo sapiens
tctagacaatatacaagccaaag

SEQ ID NO: 947355 - DNA, 14 bp, Homo sapiens
tctagacactgcca

SEQ ID NO: 947356 - DNA, 22 bp, Homo sapiens
tctagacagtattgccacctct

SEQ ID NO: 947357 - DNA, 16 bp, Homo sapiens
tctagacgcccctccc

SEQ ID NO: 947358 - DNA, 16 bp, Homo sapiens
tctagactataaatgt

SEQ ID NO: 947359 - DNA, 18 bp, Homo sapiens
tctagacttccccatccc

SEQ ID NO: 947360 - DNA, 19 bp, Homo sapiens
tctagacttccccatcccg

SEQ ID NO: 947361 - DNA, 14 bp, Homo sapiens
tctagactttctca

SEQ ID NO: 947362 - DNA, 12 bp, Homo sapiens
tctagagagagg

SEQ ID NO: 947363 - DNA, 17 bp, Homo sapiens
tctagagagagggagaa

SEQ ID NO: 947364 - DNA, 20 bp, Homo sapiens
tctagagagatgagaagcca

SEQ ID NO: 947365 - DNA, 22 bp, Homo sapiens
tctagagagatgagaagccagg

SEQ ID NO: 947366 - DNA, 13 bp, Homo sapiens
tctagaggcctca

SEQ ID NO: 947367 - DNA, 21 bp, Homo sapiens
tctagagggttgctgcctttc

SEQ ID NO: 947368 - DNA, 15 bp, Homo sapiens
tctagagtcatgtga

SEQ ID NO: 947369 - DNA, 19 bp, Homo sapiens
tctagagttatcttcttta

SEQ ID NO: 947370 - DNA, 20 bp, Homo sapiens
tctagatacaataaattgct

SEQ ID NO: 947371 - DNA, 13 bp, Homo sapiens
tctagatactgta

SEQ ID NO: 947372 - DNA, 24 bp, Homo sapiens
tctagatactgtatcatgacaaag

SEQ ID NO: 947373 - DNA, 20 bp, Homo sapiens
tctagatgaagttttacatt

SEQ ID NO: 947374 - DNA, 14 bp, Homo sapiens
tctagatgattttt

SEQ ID NO: 947375 - DNA, 22 bp, Homo sapiens
tctagatgattttttgaaagtt

SEQ ID NO: 947376 - DNA, 19 bp, Homo sapiens
tctagatggctcctctcag

SEQ ID NO: 947377 - DNA, 20 bp, Homo sapiens
tctagatggctcctctcagt

SEQ ID NO: 947378 - DNA, 15 bp, Homo sapiens
tctagattgagagaa

SEQ ID NO: 947379 - DNA, 15 bp, Homo sapiens
tctagcaaatgttat

SEQ ID NO: 947380 - DNA, 16 bp, Homo sapiens
tctagcaaatgttatg

SEQ ID NO: 947381 - DNA, 23 bp, Homo sapiens
tctagcaatcacaacactggctg

SEQ ID NO: 947382 - DNA, 16 bp, Homo sapiens
tctagcaattttcttt

SEQ ID NO: 947383 - DNA, 18 bp, Homo sapiens
tctagcaattttctttgt

SEQ ID NO: 947384 - DNA, 21 bp, Homo sapiens
tctagcaattttctttgtttc

SEQ ID NO: 947385 - DNA, 14 bp, Homo sapiens
tctagcagctggcc

SEQ ID NO: 947386 - DNA, 15 bp, Homo sapiens
tctagcagctggcct

SEQ ID NO: 947387 - DNA, 16 bp, Homo sapiens
tctagcagctggccta

SEQ ID NO: 947388 - DNA, 19 bp, Homo sapiens
tctagcagtaaaagataaa

SEQ ID NO: 947389 - DNA, 17 bp, Homo sapiens
tctagcagtaaatactt

SEQ ID NO: 947390 - DNA, 23 bp, Homo sapiens
tctagcagtaaatacttgcagtt

SEQ ID NO: 947391 - DNA, 14 bp, Homo sapiens
gctcactggctggg

SEQ ID NO: 947392 - DNA, 16 bp, Homo sapiens
gctcactggctgggag

SEQ ID NO: 947393 - DNA, 17 bp, Homo sapiens
gctcactggctgggagt

SEQ ID NO: 947394 - DNA, 19 bp, Homo sapiens
gctcactgtggtgtctgtg

SEQ ID NO: 947395 - DNA, 20 bp, Homo sapiens
gctcactttattatccctat

SEQ ID NO: 947396 - DNA, 15 bp, Homo sapiens
gctcagaacccaggg

SEQ ID NO: 947397 - DNA, 22 bp, Homo sapiens
gctcagaacccagggctctgcc

SEQ ID NO: 947398 - DNA, 16 bp, Homo sapiens
gctcagaacttgctgc

SEQ ID NO: 947399 - DNA, 20 bp, Homo sapiens
gctcagaacttgctgctgtc

SEQ ID NO: 947400 - DNA, 13 bp, Homo sapiens
gctcagaagagca

SEQ ID NO: 947401 - DNA, 18 bp, Homo sapiens
gctcagaatccaagtgaa

SEQ ID NO: 947402 - DNA, 16 bp, Homo sapiens
gctcagacatgttttc

SEQ ID NO: 947403 - DNA, 23 bp, Homo sapiens
gctcagacccccactctcattcc

SEQ ID NO: 947404 - DNA, 24 bp, Homo sapiens
gctcagactctgggtccctcggag

SEQ ID NO: 947405 - DNA, 17 bp, Homo sapiens
gctcagagaaggaaaag

SEQ ID NO: 947406 - DNA, 18 bp, Homo sapiens
gctcagagcttgaagatt

SEQ ID NO: 947407 - DNA, 16 bp, Homo sapiens
gctcagagctttaaaa

SEQ ID NO: 947408 - DNA, 13 bp, Homo sapiens
gctcagagctttg

SEQ ID NO: 947409 - DNA, 16 bp, Homo sapiens
gctcagagctttgtca

SEQ ID NO: 947410 - DNA, 17 bp, Homo sapiens
gctcagagctttgtcac

SEQ ID NO: 947411 - DNA, 19 bp, Homo sapiens
gctcagagctttgtcactt

SEQ ID NO: 947412 - DNA, 17 bp, Homo sapiens
gctcagagtaggtgggt

SEQ ID NO: 947413 - DNA, 16 bp, Homo sapiens
gctcagagtgaccctc

SEQ ID NO: 947414 - DNA, 15 bp, Homo sapiens
gctcagatagaatga

SEQ ID NO: 947415 - DNA, 19 bp, Homo sapiens
gctcagatgacatttcgtt

SEQ ID NO: 947416 - DNA, 17 bp, Homo sapiens
gctcagcaaaagatgct

SEQ ID NO: 947417 - DNA, 18 bp, Homo sapiens
gctcagcaattcagaccc

SEQ ID NO: 947418 - DNA, 23 bp, Homo sapiens
gctcagcagccagtctcagagac

SEQ ID NO: 947419 - DNA, 17 bp, Homo sapiens
gctcagccaaatttcct

SEQ ID NO: 947420 - DNA, 18 bp, Homo sapiens
gctcagccacagcctgac

SEQ ID NO: 947421 - DNA, 12 bp, Homo sapiens
gctcagccagca

SEQ ID NO: 947422 - DNA, 14 bp, Homo sapiens
gctcagccagcact

SEQ ID NO: 947423 - DNA, 15 bp, Homo sapiens
gctcagccagcactt

SEQ ID NO: 947424 - DNA, 18 bp, Homo sapiens
gctcagcccgctgagtgg

SEQ ID NO: 947425 - DNA, 17 bp, Homo sapiens
gctcagccctccctgcc

SEQ ID NO: 947426 - DNA, 16 bp, Homo sapiens
gctcagccctgactgg

SEQ ID NO: 947427 - DNA, 21 bp, Homo sapiens
gctcagccctgactggtgcta

SEQ ID NO: 947428 - DNA, 17 bp, Homo sapiens
gctcagccctggcctgg

SEQ ID NO: 947429 - DNA, 20 bp, Homo sapiens
gctcagccctggcctggctg

SEQ ID NO: 947430 - DNA, 11 bp, Homo sapiens
gctcagcctgg

SEQ ID NO: 947431 - DNA, 23 bp, Homo sapiens
gctccaggatgcattctgatagg

SEQ ID NO: 947432 - DNA, 12 bp, Homo sapiens
gctccaggccca

SEQ ID NO: 947433 - DNA, 21 bp, Homo sapiens
gctccagggaatccaagcctc

SEQ ID NO: 947434 - DNA, 23 bp, Homo sapiens
gctccagggaatccaagcctcca

SEQ ID NO: 947435 - DNA, 23 bp, Homo sapiens
gctccagggatgattcaagccat

SEQ ID NO: 947436 - DNA, 21 bp, Homo sapiens
gctccaggggcccttgggaca

SEQ ID NO: 947437 - DNA, 22 bp, Homo sapiens
gctccaggggcccttgggacag

SEQ ID NO: 947438 - DNA, 14 bp, Homo sapiens
gctccagggtcttg

SEQ ID NO: 947439 - DNA, 17 bp, Homo sapiens
gctccagggtcttgggc

SEQ ID NO: 947440 - DNA, 16 bp, Homo sapiens
gctccaggtggctctg

SEQ ID NO: 947441 - DNA, 18 bp, Homo sapiens
gctccagtctgctgccct

SEQ ID NO: 947442 - DNA, 21 bp, Homo sapiens
gctccagtctgctgccctcca

SEQ ID NO: 947443 - DNA, 22 bp, Homo sapiens
gctccagtgccgctcctgcttc

SEQ ID NO: 947444 - DNA, 20 bp, Homo sapiens
gctccatatttgatttctaa

SEQ ID NO: 947445 - DNA, 21 bp, Homo sapiens
gctccatatttgatttctaat

SEQ ID NO: 947446 - DNA, 18 bp, Homo sapiens
gctccatccccctgcctc

SEQ ID NO: 947447 - DNA, 19 bp, Homo sapiens
gctccatcgcccaggcctg

SEQ ID NO: 947448 - DNA, 22 bp, Homo sapiens
gctccatcgcgccagcgacctc

SEQ ID NO: 947449 - DNA, 14 bp, Homo sapiens
gctccatctccact

SEQ ID NO: 947450 - DNA, 21 bp, Homo sapiens
gctccatgactggctgtctgc

SEQ ID NO: 947451 - DNA, 14 bp, Homo sapiens
gctccatgcctctg

SEQ ID NO: 947452 - DNA, 15 bp, Homo sapiens
gctccatgcctctgg

SEQ ID NO: 947453 - DNA, 18 bp, Homo sapiens
gctccatgtgccccctct

SEQ ID NO: 947454 - DNA, 20 bp, Homo sapiens
gctccatttataaccccagc

SEQ ID NO: 947455 - DNA, 22 bp, Homo sapiens
gctccatttataaccccagcct

SEQ ID NO: 947456 - DNA, 14 bp, Homo sapiens
gctccattttttct

SEQ ID NO: 947457 - DNA, 20 bp, Homo sapiens
gctcccaacccccctcctgc

SEQ ID NO: 947458 - DNA, 20 bp, Homo sapiens
gctcccaacgagcctcctca

SEQ ID NO: 947459 - DNA, 22 bp, Homo sapiens
gctcccaacgagcctcctcagg

SEQ ID NO: 947460 - DNA, 23 bp, Homo sapiens
gctcccaacgagcctcctcaggg

SEQ ID NO: 947461 - DNA, 17 bp, Homo sapiens
gctcccaatcagctttt

SEQ ID NO: 947462 - DNA, 18 bp, Homo sapiens
gctcccacacttgtgcca

SEQ ID NO: 947463 - DNA, 16 bp, Homo sapiens
gctcccacattctgat

SEQ ID NO: 947464 - DNA, 15 bp, Homo sapiens
gctcccacccacctg

SEQ ID NO: 947465 - DNA, 21 bp, Homo sapiens
gctcccaccccacccccttca

SEQ ID NO: 947466 - DNA, 16 bp, Homo sapiens
gctcccaccccagaaa

SEQ ID NO: 947467 - DNA, 15 bp, Homo sapiens
gctcccaccgccccc

SEQ ID NO: 947468 - DNA, 12 bp, Homo sapiens
gctcccacctgt

SEQ ID NO: 947469 - DNA, 12 bp, Homo sapiens
gctcccagcagc

SEQ ID NO: 947470 - DNA, 13 bp, Homo sapiens
gctcccagcctgc

SEQ ID NO: 947471 - DNA, 12 bp, Homo sapiens
gctcccaggaac

SEQ ID NO: 947472 - DNA, 20 bp, Homo sapiens
gctcccaggggtctccctgg

SEQ ID NO: 947473 - DNA, 21 bp, Homo sapiens
gctcccatcattccttctggc

SEQ ID NO: 947474 - DNA, 13 bp, Homo sapiens
gctcccatctcct

SEQ ID NO: 947475 - DNA, 15 bp, Homo sapiens
gctcccatctcctga

SEQ ID NO: 947476 - DNA, 16 bp, Homo sapiens
gctcccatctcctgat

SEQ ID NO: 947477 - DNA, 17 bp, Homo sapiens
gctcccattcctccctc

SEQ ID NO: 947478 - DNA, 20 bp, Homo sapiens
gctccccacagcgtccctgg

SEQ ID NO: 947479 - DNA, 21 bp, Homo sapiens
gctccccacagctttgcaccc

SEQ ID NO: 947480 - DNA, 13 bp, Homo sapiens
gctccccacccct

SEQ ID NO: 947481 - DNA, 14 bp, Homo sapiens
gctccccacctgga

SEQ ID NO: 947482 - DNA, 23 bp, Homo sapiens
gctccccacgagtcacctgcaag

SEQ ID NO: 947483 - DNA, 23 bp, Homo sapiens
gctccccagaactggctgggccc

SEQ ID NO: 947484 - DNA, 14 bp, Homo sapiens
gctccccagcccag

SEQ ID NO: 947485 - DNA, 18 bp, Homo sapiens
gctccccagccctggctc

SEQ ID NO: 947486 - DNA, 20 bp, Homo sapiens
gctccccagccctggctctg

SEQ ID NO: 947487 - DNA, 14 bp, Homo sapiens
gctcccccaccccc

SEQ ID NO: 947488 - DNA, 16 bp, Homo sapiens
gctcccccatcctccc

SEQ ID NO: 947489 - DNA, 16 bp, Homo sapiens
gctccccccgcccacc

SEQ ID NO: 947490 - DNA, 19 bp, Homo sapiens
gctcccccgcagtccccag

SEQ ID NO: 947491 - DNA, 19 bp, Homo sapiens
gctccccctccccaggctg

SEQ ID NO: 947492 - DNA, 21 bp, Homo sapiens
gctccccctccccaggctgga

SEQ ID NO: 947493 - DNA, 18 bp, Homo sapiens
gctccccctctgcttctc

SEQ ID NO: 947494 - DNA, 18 bp, Homo sapiens
gctcccctaaccctactt

SEQ ID NO: 947495 - DNA, 20 bp, Homo sapiens
gctcccctccacagctgcag

SEQ ID NO: 947496 - DNA, 15 bp, Homo sapiens
gctcccctcccaggg

SEQ ID NO: 947497 - DNA, 21 bp, Homo sapiens
gctcccctctatttagcatga

SEQ ID NO: 947498 - DNA, 15 bp, Homo sapiens
gctcccctctcctcc

SEQ ID NO: 947499 - DNA, 23 bp, Homo sapiens
gctcccctgtttgcatgagaaaa

SEQ ID NO: 947500 - DNA, 16 bp, Homo sapiens
gctccccttggacctc

SEQ ID NO: 947501 - DNA, 21 bp, Homo sapiens
gctccccttggacctccaggg

SEQ ID NO: 947502 - DNA, 17 bp, Homo sapiens
gctcccgagctactctc

SEQ ID NO: 947503 - DNA, 15 bp, Homo sapiens
gctcccgaggaagca

SEQ ID NO: 947504 - DNA, 15 bp, Homo sapiens
gctcccgcagggctg

SEQ ID NO: 947505 - DNA, 12 bp, Homo sapiens
gctcccgcccgt

SEQ ID NO: 947506 - DNA, 14 bp, Homo sapiens
gctcccgctcccag

SEQ ID NO: 947507 - DNA, 13 bp, Homo sapiens
gctcccggcccgc

SEQ ID NO: 947508 - DNA, 18 bp, Homo sapiens
gctcccgggtccttggcc

SEQ ID NO: 947509 - DNA, 22 bp, Homo sapiens
gctcccgggtccttggccccct

SEQ ID NO: 947510 - DNA, 18 bp, Homo sapiens
gctccctcccatcctcca

SEQ ID NO: 947511 - DNA, 11 bp, Homo sapiens
gctccctcctc

SEQ ID NO: 947512 - DNA, 16 bp, Homo sapiens
gctccctcctccaggc

SEQ ID NO: 947513 - DNA, 18 bp, Homo sapiens
gctccctcctctggcagg

SEQ ID NO: 947514 - DNA, 15 bp, Homo sapiens
gctccctcctgcaca

SEQ ID NO: 947515 - DNA, 17 bp, Homo sapiens
gctccctctctggtttc

SEQ ID NO: 947516 - DNA, 18 bp, Homo sapiens
gctccctctctggtttcc

SEQ ID NO: 947517 - DNA, 15 bp, Homo sapiens
gctccctctgttagg

SEQ ID NO: 947518 - DNA, 23 bp, Homo sapiens
gctccctcttcctctccatacct

SEQ ID NO: 947519 - DNA, 14 bp, Homo sapiens
tctatcttccaaat

SEQ ID NO: 947520 - DNA, 11 bp, Homo sapiens
tctatgaagtt

SEQ ID NO: 947521 - DNA, 14 bp, Homo sapiens
tctatgacaaattc

SEQ ID NO: 947522 - DNA, 15 bp, Homo sapiens
tctatgatccttttt

SEQ ID NO: 947523 - DNA, 22 bp, Homo sapiens
tctatgcaaagcactctctgca

SEQ ID NO: 947524 - DNA, 13 bp, Homo sapiens
tctatgcaggcag

SEQ ID NO: 947525 - DNA, 16 bp, Homo sapiens
tctatgccaaagatca

SEQ ID NO: 947526 - DNA, 21 bp, Homo sapiens
tctatgccaaagatcacttgt

SEQ ID NO: 947527 - DNA, 14 bp, Homo sapiens
tctatgccagctca

SEQ ID NO: 947528 - DNA, 14 bp, Homo sapiens
tctatgccctgcag

SEQ ID NO: 947529 - DNA, 19 bp, Homo sapiens
tctatgccctgcagagcaa

SEQ ID NO: 947530 - DNA, 23 bp, Homo sapiens
tctatgccctgcagagcaataac

SEQ ID NO: 947531 - DNA, 13 bp, Homo sapiens
tctatgcctgtct

SEQ ID NO: 947532 - DNA, 18 bp, Homo sapiens
tctatgctggcttttcac

SEQ ID NO: 947533 - DNA, 21 bp, Homo sapiens
tctatgctgtttgtagtgaaa

SEQ ID NO: 947534 - DNA, 19 bp, Homo sapiens
tctatggaaatgtgagaaa

SEQ ID NO: 947535 - DNA, 14 bp, Homo sapiens
tctatggagacttt

SEQ ID NO: 947536 - DNA, 11 bp, Homo sapiens
tctatggcttt

SEQ ID NO: 947537 - DNA, 17 bp, Homo sapiens
tctatggctttaaataa

SEQ ID NO: 947538 - DNA, 18 bp, Homo sapiens
tctatgtaaattattgta

SEQ ID NO: 947539 - DNA, 22 bp, Homo sapiens
tctatgtaaattattgtaaact

SEQ ID NO: 947540 - DNA, 13 bp, Homo sapiens
tctatgtacctct

SEQ ID NO: 947541 - DNA, 21 bp, Homo sapiens
tctatgtcatttttaatgtat

SEQ ID NO: 947542 - DNA, 16 bp, Homo sapiens
tctatgtgtttctgta

SEQ ID NO: 947543 - DNA, 21 bp, Homo sapiens
tctatgtgtttctgtaacaaa

SEQ ID NO: 947544 - DNA, 17 bp, Homo sapiens
tctatgttaaatactgt

SEQ ID NO: 947545 - DNA, 18 bp, Homo sapiens
tctatgttaaatactgtg

SEQ ID NO: 947546 - DNA, 18 bp, Homo sapiens
tctatgttcaaagactgt

SEQ ID NO: 947547 - DNA, 12 bp, Homo sapiens
tctatgttgcta

SEQ ID NO: 947548 - DNA, 18 bp, Homo sapiens
tctatgttggtttcagtg

SEQ ID NO: 947549 - DNA, 13 bp, Homo sapiens
tctattaaagtga

SEQ ID NO: 947550 - DNA, 17 bp, Homo sapiens
tctattaagatttccaa

SEQ ID NO: 947551 - DNA, 12 bp, Homo sapiens
tctattaatata

SEQ ID NO: 947552 - DNA, 21 bp, Homo sapiens
tctattaatcaagagaaactt

SEQ ID NO: 947553 - DNA, 23 bp, Homo sapiens
tctcagaatctaaacgtggtcac

SEQ ID NO: 947554 - DNA, 17 bp, Homo sapiens
tctcagaatctcaaata

SEQ ID NO: 947555 - DNA, 22 bp, Homo sapiens
tctcagaattcggtgtgctgcc

SEQ ID NO: 947556 - DNA, 16 bp, Homo sapiens
tctcagacccagatgt

SEQ ID NO: 947557 - DNA, 17 bp, Homo sapiens
tctcagacccagatgtg

SEQ ID NO: 947558 - DNA, 17 bp, Homo sapiens
tctcagaccctttagcc

SEQ ID NO: 947559 - DNA, 21 bp, Homo sapiens
tctcagacctttactgatact

SEQ ID NO: 947560 - DNA, 16 bp, Homo sapiens
tctcagagaccagcac

SEQ ID NO: 947561 - DNA, 19 bp, Homo sapiens
tctcagagaccagcactca

SEQ ID NO: 947562 - DNA, 11 bp, Homo sapiens
tctcagagcct

SEQ ID NO: 947563 - DNA, 20 bp, Homo sapiens
tctcagaggcctgctgccag

SEQ ID NO: 947564 - DNA, 18 bp, Homo sapiens
tctcagagtccactgtgg

SEQ ID NO: 947565 - DNA, 19 bp, Homo sapiens
tctcagagtccactgtggc

SEQ ID NO: 947566 - DNA, 18 bp, Homo sapiens
tctcagagtgacagtcat

SEQ ID NO: 947567 - DNA, 19 bp, Homo sapiens
tctcagagtgacagtcata

SEQ ID NO: 947568 - DNA, 18 bp, Homo sapiens
tctcagatgttaaaataa

SEQ ID NO: 947569 - DNA, 21 bp, Homo sapiens
tctcagatgttgaaactttga

SEQ ID NO: 947570 - DNA, 17 bp, Homo sapiens
tctcagatttctgagga

SEQ ID NO: 947571 - DNA, 16 bp, Homo sapiens
tctcagattttctaag

SEQ ID NO: 947572 - DNA, 15 bp, Homo sapiens
tctcagccaacgagt

SEQ ID NO: 947573 - DNA, 22 bp, Homo sapiens
tctcagccccatcgccccaact

SEQ ID NO: 947574 - DNA, 21 bp, Homo sapiens
tctcagccgcttctgactgct

SEQ ID NO: 947575 - DNA, 13 bp, Homo sapiens
tctcagcctccca

SEQ ID NO: 947576 - DNA, 20 bp, Homo sapiens
tctcagcctcctgagcctgt

SEQ ID NO: 947577 - DNA, 19 bp, Homo sapiens
tctcaggaagtccagccac

SEQ ID NO: 947578 - DNA, 23 bp, Homo sapiens
tctcaggaccaaagctttcatgt

SEQ ID NO: 947579 - DNA, 22 bp, Homo sapiens
tctcaggacctctgtaggcagc

SEQ ID NO: 947580 - DNA, 16 bp, Homo sapiens
tctcaggagagtgtgc

SEQ ID NO: 947581 - DNA, 17 bp, Homo sapiens
tctcaggagagtgtgca

SEQ ID NO: 947582 - DNA, 16 bp, Homo sapiens
tctcaggagatttcat

SEQ ID NO: 947583 - DNA, 15 bp, Homo sapiens
tctcaggagcacagg

SEQ ID NO: 947584 - DNA, 16 bp, Homo sapiens
tctcaggagcacaggc

SEQ ID NO: 947585 - DNA, 20 bp, Homo sapiens
tctcaggagcacaggcagct

SEQ ID NO: 947586 - DNA, 15 bp, Homo sapiens
tctcaggagtatctt

SEQ ID NO: 947587 - DNA, 16 bp, Homo sapiens
tctcaggagtctctgg

SEQ ID NO: 947588 - DNA, 23 bp, Homo sapiens
tctcaggatatccttatcagagc

SEQ ID NO: 947589 - DNA, 22 bp, Homo sapiens
tctcaggcagcaccacactggg

SEQ ID NO: 947590 - DNA, 18 bp, Homo sapiens
tctcaggcatgcctgtgt

SEQ ID NO: 947591 - DNA, 21 bp, Homo sapiens
tctcaggcatgcctgtgtgac

SEQ ID NO: 947592 - DNA, 17 bp, Homo sapiens
tctcaggcgcttctcca

SEQ ID NO: 947593 - DNA, 20 bp, Homo sapiens
tctcagggagggaaggggat

SEQ ID NO: 947594 - DNA, 23 bp, Homo sapiens
tctcagggagggaaggggatgga

SEQ ID NO: 947595 - DNA, 12 bp, Homo sapiens
tctcagggcctg

SEQ ID NO: 947596 - DNA, 17 bp, Homo sapiens
tctcagggtcactgtcc

SEQ ID NO: 947597 - DNA, 15 bp, Homo sapiens
tctcaggtccctgca

SEQ ID NO: 947598 - DNA, 20 bp, Homo sapiens
tctcaggtgacgtgattcta

SEQ ID NO: 947599 - DNA, 14 bp, Homo sapiens
tctcaggtgccact

SEQ ID NO: 947600 - DNA, 15 bp, Homo sapiens
tctcaggtgccactc

SEQ ID NO: 947601 - DNA, 16 bp, Homo sapiens
tctcaggtgccactcc

SEQ ID NO: 947602 - DNA, 18 bp, Homo sapiens
tctcaggtgccactccct

SEQ ID NO: 947603 - DNA, 23 bp, Homo sapiens
tctcaggtgccactccctgagct

SEQ ID NO: 947604 - DNA, 21 bp, Homo sapiens
tctcaggtgggttagagatgg

SEQ ID NO: 947605 - DNA, 20 bp, Homo sapiens
tctcaggtttgttttgtgaa

SEQ ID NO: 947606 - DNA, 11 bp, Homo sapiens
tctcagtctct

SEQ ID NO: 947607 - DNA, 18 bp, Homo sapiens
tctcagtctctgagcagt

SEQ ID NO: 947608 - DNA, 16 bp, Homo sapiens
tctcagtgaagaatac

SEQ ID NO: 947609 - DNA, 18 bp, Homo sapiens
tctcagtgatttcctaca

SEQ ID NO: 947610 - DNA, 14 bp, Homo sapiens
tctcagtgccctcc

SEQ ID NO: 947611 - DNA, 15 bp, Homo sapiens
tctcagtggtgcagg

SEQ ID NO: 947612 - DNA, 16 bp, Homo sapiens
tctcagtggtgcagga

SEQ ID NO: 947613 - DNA, 12 bp, Homo sapiens
tctcagtgtttt

SEQ ID NO: 947614 - DNA, 22 bp, Homo sapiens
tctcagttatgtagtttcttgt

SEQ ID NO: 947615 - DNA, 16 bp, Homo sapiens
tctcagttctcttgct

SEQ ID NO: 947616 - DNA, 23 bp, Homo sapiens
tctcagttctcttgctttcacat

SEQ ID NO: 947617 - DNA, 17 bp, Homo sapiens
tctcagtttgtgtgtct

SEQ ID NO: 947618 - DNA, 19 bp, Homo sapiens
tctcagtttgtgtgtctta

SEQ ID NO: 947619 - DNA, 15 bp, Homo sapiens
tctcagttttcataa

SEQ ID NO: 947620 - DNA, 12 bp, Homo sapiens
tctcataaaact

SEQ ID NO: 947621 - DNA, 18 bp, Homo sapiens
tctcataattcctacagc

SEQ ID NO: 947622 - DNA, 13 bp, Homo sapiens
tctcatactgtct

SEQ ID NO: 947623 - DNA, 18 bp, Homo sapiens
tctcatactgtctgggat

SEQ ID NO: 947624 - DNA, 19 bp, Homo sapiens
tctcatagggatgctgtga

SEQ ID NO: 947625 - DNA, 17 bp, Homo sapiens
tctcataggttaaaaaa

SEQ ID NO: 947626 - DNA, 14 bp, Homo sapiens
tctcatcatattgt

SEQ ID NO: 947627 - DNA, 16 bp, Homo sapiens
tctcatcatattgtat

SEQ ID NO: 947628 - DNA, 22 bp, Homo sapiens
tctcatcatttgcattgggcat

SEQ ID NO: 947629 - DNA, 14 bp, Homo sapiens
tctcatccatcatc

SEQ ID NO: 947630 - DNA, 19 bp, Homo sapiens
tctcatcccacgcactcca

SEQ ID NO: 947631 - DNA, 22 bp, Homo sapiens
tctcatccccaggggtcccagc

SEQ ID NO: 947632 - DNA, 15 bp, Homo sapiens
tctcatcctcctgga

SEQ ID NO: 947633 - DNA, 14 bp, Homo sapiens
tctcatcctttcct

SEQ ID NO: 947634 - DNA, 12 bp, Homo sapiens
tctcatctcctg

SEQ ID NO: 947635 - DNA, 14 bp, Homo sapiens
tctcatctcctgac

SEQ ID NO: 947636 - DNA, 17 bp, Homo sapiens
tctcatctcctgaccct

SEQ ID NO: 947637 - DNA, 20 bp, Homo sapiens
tctcatctgatcacttcatg

SEQ ID NO: 947638 - DNA, 13 bp, Homo sapiens
tctcatcttctct

SEQ ID NO: 947639 - DNA, 14 bp, Homo sapiens
tctcatcttttatc

SEQ ID NO: 947640 - DNA, 20 bp, Homo sapiens
tctcatgaagctaataaaat

SEQ ID NO: 947641 - DNA, 16 bp, Homo sapiens
tctcatgaggggagag

SEQ ID NO: 947642 - DNA, 22 bp, Homo sapiens
tctcatgaggggagaggagacg

SEQ ID NO: 947643 - DNA, 23 bp, Homo sapiens
tctcatgataccacctttactgt

SEQ ID NO: 947644 - DNA, 15 bp, Homo sapiens
tctcatgatttacag

SEQ ID NO: 947645 - DNA, 21 bp, Homo sapiens
tctcatgcccctggctgggac

SEQ ID NO: 947646 - DNA, 16 bp, Homo sapiens
tctcatgggaagggga

SEQ ID NO: 947647 - DNA, 17 bp, Homo sapiens
tctcatgggaaggggag

SEQ ID NO: 947648 - DNA, 12 bp, Homo sapiens
tctcatgtatct

SEQ ID NO: 947649 - DNA, 15 bp, Homo sapiens
tctcatgtccccttc

SEQ ID NO: 947650 - DNA, 23 bp, Homo sapiens
tctcatgtccccttcctgttctt

SEQ ID NO: 947651 - DNA, 14 bp, Homo sapiens
gctccttgcagcag

SEQ ID NO: 947652 - DNA, 18 bp, Homo sapiens
gctccttgcagcagggct

SEQ ID NO: 947653 - DNA, 17 bp, Homo sapiens
gctccttgctgcattga

SEQ ID NO: 947654 - DNA, 17 bp, Homo sapiens
gctccttggagcaggca

SEQ ID NO: 947655 - DNA, 19 bp, Homo sapiens
gctccttggcacccccatg

SEQ ID NO: 947656 - DNA, 21 bp, Homo sapiens
gctccttggcacccccatgct

SEQ ID NO: 947657 - DNA, 14 bp, Homo sapiens
gctccttggcggac

SEQ ID NO: 947658 - DNA, 20 bp, Homo sapiens
gctccttggcggacactggg

SEQ ID NO: 947659 - DNA, 17 bp, Homo sapiens
gctccttggctgcagcc

SEQ ID NO: 947660 - DNA, 14 bp, Homo sapiens
gctccttgggccct

SEQ ID NO: 947661 - DNA, 20 bp, Homo sapiens
gctccttgtcaatactgagc

SEQ ID NO: 947662 - DNA, 22 bp, Homo sapiens
gctccttgtcaatactgagcca

SEQ ID NO: 947663 - DNA, 17 bp, Homo sapiens
gctcctttaccctcttg

SEQ ID NO: 947664 - DNA, 19 bp, Homo sapiens
gctcctttctccagccagc

SEQ ID NO: 947665 - DNA, 20 bp, Homo sapiens
gctccttttgtatcttcctt

SEQ ID NO: 947666 - DNA, 23 bp, Homo sapiens
gctccttttgtatcttcctttct

SEQ ID NO: 947667 - DNA, 20 bp, Homo sapiens
gctccttttgtccccagggc

SEQ ID NO: 947668 - DNA, 23 bp, Homo sapiens
gctccttttgtccccagggcccc

SEQ ID NO: 947669 - DNA, 14 bp, Homo sapiens
gctcctttttctcc

SEQ ID NO: 947670 - DNA, 20 bp, Homo sapiens
gctcctttttctccctctgg

SEQ ID NO: 947671 - DNA, 20 bp, Homo sapiens
gctcgagcagtcctgcctca

SEQ ID NO: 947672 - DNA, 16 bp, Homo sapiens
gctcgaggggtgggct

SEQ ID NO: 947673 - DNA, 15 bp, Homo sapiens
gctcgatgcctttgc

SEQ ID NO: 947674 - DNA, 18 bp, Homo sapiens
tttctcaatgtcttccca

SEQ ID NO: 947675 - DNA, 13 bp, Homo sapiens
tttctcacaaaaa

SEQ ID NO: 947676 - DNA, 22 bp, Homo sapiens
tttctcacactctaactgtata

SEQ ID NO: 947677 - DNA, 14 bp, Homo sapiens
tttctcatgaagct

SEQ ID NO: 947678 - DNA, 15 bp, Homo sapiens
tttctcatgtatctt

SEQ ID NO: 947679 - DNA, 20 bp, Homo sapiens
tttctcattgcctcttctac

SEQ ID NO: 947680 - DNA, 15 bp, Homo sapiens
tttctccaagagcta

SEQ ID NO: 947681 - DNA, 17 bp, Homo sapiens
tttctccaatatcagtg

SEQ ID NO: 947682 - DNA, 20 bp, Homo sapiens
tttctccacaacagcctggg

SEQ ID NO: 947683 - DNA, 11 bp, Homo sapiens
tttctccagac

SEQ ID NO: 947684 - DNA, 12 bp, Homo sapiens
tttctccagacc

SEQ ID NO: 947685 - DNA, 14 bp, Homo sapiens
tttctccagaccca

SEQ ID NO: 947686 - DNA, 13 bp, Homo sapiens
tttctccatatca

SEQ ID NO: 947687 - DNA, 17 bp, Homo sapiens
tttctccatcccctccc

SEQ ID NO: 947688 - DNA, 20 bp, Homo sapiens
tttctccatcccctccctgc

SEQ ID NO: 947689 - DNA, 22 bp, Homo sapiens
tttctccatcccctccctgcct

SEQ ID NO: 947690 - DNA, 15 bp, Homo sapiens
tttctccatctttat

SEQ ID NO: 947691 - DNA, 19 bp, Homo sapiens
tttctccatttgtcatcgt

SEQ ID NO: 947692 - DNA, 12 bp, Homo sapiens
tttctcccagct

SEQ ID NO: 947693 - DNA, 21 bp, Homo sapiens
tttctcccccgacactgctgc

SEQ ID NO: 947694 - DNA, 14 bp, Homo sapiens
tttctccccctggg

SEQ ID NO: 947695 - DNA, 15 bp, Homo sapiens
tttctccctcaccca

SEQ ID NO: 947696 - DNA, 15 bp, Homo sapiens
tttctccctgtccct

SEQ ID NO: 947697 - DNA, 20 bp, Homo sapiens
tttctccctttatgtatctc

SEQ ID NO: 947698 - DNA, 20 bp, Homo sapiens
tttctccggggtctgtgctg

SEQ ID NO: 947699 - DNA, 15 bp, Homo sapiens
tttctcctccgcctg

SEQ ID NO: 947700 - DNA, 23 bp, Homo sapiens
tttctcctccgcctgtgtccatc

SEQ ID NO: 947701 - DNA, 15 bp, Homo sapiens
tttctcctctgctat

SEQ ID NO: 947702 - DNA, 17 bp, Homo sapiens
tttctcctctgcttctt

SEQ ID NO: 947703 - DNA, 12 bp, Homo sapiens
tttctcctgtgc

SEQ ID NO: 947704 - DNA, 23 bp, Homo sapiens
tttctccttgaatatctttcgat

SEQ ID NO: 947705 - DNA, 12 bp, Homo sapiens
tttctccttggt

SEQ ID NO: 947706 - DNA, 19 bp, Homo sapiens
tttctcctttaattgtaaa

SEQ ID NO: 947707 - DNA, 17 bp, Homo sapiens
tttctctaataataaat

SEQ ID NO: 947708 - DNA, 16 bp, Homo sapiens
tttctctattaaaatg

SEQ ID NO: 947709 - DNA, 13 bp, Homo sapiens
tttctctcctggc

SEQ ID NO: 947710 - DNA, 18 bp, Homo sapiens
tttctctctcctctctgc

SEQ ID NO: 947711 - DNA, 12 bp, Homo sapiens
tttctctctgga

SEQ ID NO: 947712 - DNA, 14 bp, Homo sapiens
tttctctcttccct

SEQ ID NO: 947713 - DNA, 21 bp, Homo sapiens
tttctctgcagaaactactga

SEQ ID NO: 947714 - DNA, 22 bp, Homo sapiens
tttctctgcatttaaaaaaatc

SEQ ID NO: 947715 - DNA, 23 bp, Homo sapiens
tttctctgccgctacctccctcc

SEQ ID NO: 947716 - DNA, 23 bp, Homo sapiens
tttctctgcctctgggcagcctg

SEQ ID NO: 947717 - DNA, 17 bp, Homo sapiens
tttctctgcttaccctt

SEQ ID NO: 947718 - DNA, 18 bp, Homo sapiens
tttctctgtacttttcat

SEQ ID NO: 947719 - DNA, 11 bp, Homo sapiens
tttctctgtgc

SEQ ID NO: 947720 - DNA, 18 bp, Homo sapiens
tttctcttacctgttatt

SEQ ID NO: 947721 - DNA, 11 bp, Homo sapiens
tttctcttcac

SEQ ID NO: 947722 - DNA, 11 bp, Homo sapiens
tttctcttcat

SEQ ID NO: 947723 - DNA, 18 bp, Homo sapiens
tttctcttccccttcctg

SEQ ID NO: 947724 - DNA, 14 bp, Homo sapiens
tttctcttctcagc

SEQ ID NO: 947725 - DNA, 15 bp, Homo sapiens
tttctcttctgtcca

SEQ ID NO: 947726 - DNA, 22 bp, Homo sapiens
tttctcttctgtccatcagtgc

SEQ ID NO: 947727 - DNA, 15 bp, Homo sapiens
tttctcttctgttct

SEQ ID NO: 947728 - DNA, 15 bp, Homo sapiens
tttctcttgagctgg

SEQ ID NO: 947729 - DNA, 18 bp, Homo sapiens
tttctcttgagctggcct

SEQ ID NO: 947730 - DNA, 13 bp, Homo sapiens
tttctcttgggct

SEQ ID NO: 947731 - DNA, 14 bp, Homo sapiens
tttctcttgtcctt

SEQ ID NO: 947732 - DNA, 14 bp, Homo sapiens
tttctctttctcct

SEQ ID NO: 947733 - DNA, 16 bp, Homo sapiens
tttctctttctctcct

SEQ ID NO: 947734 - DNA, 12 bp, Homo sapiens
tttctctttctt

SEQ ID NO: 947735 - DNA, 15 bp, Homo sapiens
tttctctttcttcct

SEQ ID NO: 947736 - DNA, 13 bp, Homo sapiens
tttctctttgtct

SEQ ID NO: 947737 - DNA, 12 bp, Homo sapiens
tttctcttttaa

SEQ ID NO: 947738 - DNA, 19 bp, Homo sapiens
tttctcttttattctgtta

SEQ ID NO: 947739 - DNA, 13 bp, Homo sapiens
tttctcttttgct

SEQ ID NO: 947740 - DNA, 17 bp, Homo sapiens
tttctcttttgctttct

SEQ ID NO: 947741 - DNA, 18 bp, Homo sapiens
tttctgaaaattccagaa

SEQ ID NO: 947742 - DNA, 14 bp, Homo sapiens
tttctgaaacacac

SEQ ID NO: 947743 - DNA, 21 bp, Homo sapiens
tttctgaaggaagagaagaca

SEQ ID NO: 947744 - DNA, 12 bp, Homo sapiens
tttctgaataaa

SEQ ID NO: 947745 - DNA, 18 bp, Homo sapiens
tttctgaataaaaaagat

SEQ ID NO: 947746 - DNA, 19 bp, Homo sapiens
tttctgaataaaaaagatt

SEQ ID NO: 947747 - DNA, 22 bp, Homo sapiens
tttctgaataaaaaagattcta

SEQ ID NO: 947748 - DNA, 21 bp, Homo sapiens
tttctgaatattttaaatctt

SEQ ID NO: 947749 - DNA, 14 bp, Homo sapiens
tttctgaattgttg

SEQ ID NO: 947750 - DNA, 23 bp, Homo sapiens
tcacagaacctactgttcctttc

SEQ ID NO: 947751 - DNA, 11 bp, Homo sapiens
tcacagaagaa

SEQ ID NO: 947752 - DNA, 17 bp, Homo sapiens
tcacagagtgtgctgct

SEQ ID NO: 947753 - DNA, 20 bp, Homo sapiens
tcacagatgggtattaaact

SEQ ID NO: 947754 - DNA, 16 bp, Homo sapiens
tcacagcatggaggag

SEQ ID NO: 947755 - DNA, 17 bp, Homo sapiens
tcacagcatggaggagg

SEQ ID NO: 947756 - DNA, 16 bp, Homo sapiens
tcacagcatggcctct

SEQ ID NO: 947757 - DNA, 16 bp, Homo sapiens
tcacagccacacctgg

SEQ ID NO: 947758 - DNA, 21 bp, Homo sapiens
tcacagccacacctggactga

SEQ ID NO: 947759 - DNA, 12 bp, Homo sapiens
tcacagcccaga

SEQ ID NO: 947760 - DNA, 23 bp, Homo sapiens
tcacagccctgcttaccagataa

SEQ ID NO: 947761 - DNA, 13 bp, Homo sapiens
tcacagcctctga

SEQ ID NO: 947762 - DNA, 13 bp, Homo sapiens
tcacagcggaggt

SEQ ID NO: 947763 - DNA, 15 bp, Homo sapiens
tcacagctgcagctg

SEQ ID NO: 947764 - DNA, 16 bp, Homo sapiens
tcacagctgcagctgg

SEQ ID NO: 947765 - DNA, 17 bp, Homo sapiens
tcacagctgcagctggg

SEQ ID NO: 947766 - DNA, 20 bp, Homo sapiens
tcacagctgcagctgggccc

SEQ ID NO: 947767 - DNA, 23 bp, Homo sapiens
tcacagctggaccctgcttcacc

SEQ ID NO: 947768 - DNA, 18 bp, Homo sapiens
tcacagcttctccaagca

SEQ ID NO: 947769 - DNA, 23 bp, Homo sapiens
tcacaggaaaatgtatccagagg

SEQ ID NO: 947770 - DNA, 19 bp, Homo sapiens
tcacaggactctgcctcct

SEQ ID NO: 947771 - DNA, 20 bp, Homo sapiens
tcacaggagcaatcacagga

SEQ ID NO: 947772 - DNA, 14 bp, Homo sapiens
tcacaggctgagaa

SEQ ID NO: 947773 - DNA, 14 bp, Homo sapiens
tcacagggatgctg

SEQ ID NO: 947774 - DNA, 15 bp, Homo sapiens
tcacagggatgctgg

SEQ ID NO: 947775 - DNA, 19 bp, Homo sapiens
tcacagggatgctggtggc

SEQ ID NO: 947776 - DNA, 11 bp, Homo sapiens
tcacagggcag

SEQ ID NO: 947777 - DNA, 18 bp, Homo sapiens
tcacagggcagagccggg

SEQ ID NO: 947778 - DNA, 19 bp, Homo sapiens
tcacagggcagagccggga

SEQ ID NO: 947779 - DNA, 15 bp, Homo sapiens
tcacagggcaggcct

SEQ ID NO: 947780 - DNA, 20 bp, Homo sapiens
tcacagggcaggccttgctg

SEQ ID NO: 947781 - DNA, 22 bp, Homo sapiens
tcacagggcaggccttgctggg

SEQ ID NO: 947782 - DNA, 12 bp, Homo sapiens
tcacagggccaa

SEQ ID NO: 947783 - DNA, 14 bp, Homo sapiens
tcacagggccaact

SEQ ID NO: 947784 - DNA, 22 bp, Homo sapiens
tcacagggccaacttgagggcc

SEQ ID NO: 947785 - DNA, 16 bp, Homo sapiens
tcacagggttgggccc

SEQ ID NO: 947786 - DNA, 20 bp, Homo sapiens
tcacaggtggacaaatgttg

SEQ ID NO: 947787 - DNA, 14 bp, Homo sapiens
tcacaggtgtggga

SEQ ID NO: 947788 - DNA, 17 bp, Homo sapiens
tcacagtaatgcaagca

SEQ ID NO: 947789 - DNA, 19 bp, Homo sapiens
tcacagtacagcatgtgcc

SEQ ID NO: 947790 - DNA, 20 bp, Homo sapiens
tcacagtacagcatgtgcct

SEQ ID NO: 947791 - DNA, 23 bp, Homo sapiens
tcacagtacctatgactttttta

SEQ ID NO: 947792 - DNA, 18 bp, Homo sapiens
tcacagtagagccagctt

SEQ ID NO: 947793 - DNA, 15 bp, Homo sapiens
tcacagtccaaccag

SEQ ID NO: 947794 - DNA, 22 bp, Homo sapiens
tcacagtcctatgtacagagct

SEQ ID NO: 947795 - DNA, 22 bp, Homo sapiens
tcacagtgcagcttgcagtccg

SEQ ID NO: 947796 - DNA, 15 bp, Homo sapiens
tcacagtgcccaaga

SEQ ID NO: 947797 - DNA, 13 bp, Homo sapiens
tcaccccctcctg

SEQ ID NO: 947798 - DNA, 14 bp, Homo sapiens
tcaccccctcctgg

SEQ ID NO: 947799 - DNA, 14 bp, Homo sapiens
tcaccccctgagat

SEQ ID NO: 947800 - DNA, 22 bp, Homo sapiens
tcacccccttctccatccacat

SEQ ID NO: 947801 - DNA, 15 bp, Homo sapiens
tcaccccctttgctg

SEQ ID NO: 947802 - DNA, 14 bp, Homo sapiens
tcaccccgtctggg

SEQ ID NO: 947803 - DNA, 20 bp, Homo sapiens
tcacccctcgccacctttca

SEQ ID NO: 947804 - DNA, 19 bp, Homo sapiens
tcacccctgacatgtaccc

SEQ ID NO: 947805 - DNA, 12 bp, Homo sapiens
tcacccctgggc

SEQ ID NO: 947806 - DNA, 13 bp, Homo sapiens
tcacccctgggca

SEQ ID NO: 947807 - DNA, 14 bp, Homo sapiens
tcacccctgggcag

SEQ ID NO: 947808 - DNA, 18 bp, Homo sapiens
tcaccctactctggatgg

SEQ ID NO: 947809 - DNA, 13 bp, Homo sapiens
tcaccctcaccca

SEQ ID NO: 947810 - DNA, 16 bp, Homo sapiens
tcaccctcacccactc

SEQ ID NO: 947811 - DNA, 13 bp, Homo sapiens
tcaccctccacct

SEQ ID NO: 947812 - DNA, 20 bp, Homo sapiens
tcaccctccacctcttcacc

SEQ ID NO: 947813 - DNA, 14 bp, Homo sapiens
tcaccctccacttc

SEQ ID NO: 947814 - DNA, 12 bp, Homo sapiens
tcaccctctgtc

SEQ ID NO: 947815 - DNA, 13 bp, Homo sapiens
tcaccctgagccc

SEQ ID NO: 947816 - DNA, 21 bp, Homo sapiens
tcaccctgagccccttccttg

SEQ ID NO: 947817 - DNA, 15 bp, Homo sapiens
tcaccctgcagagct

SEQ ID NO: 947818 - DNA, 16 bp, Homo sapiens
tcaccctgcaggactt

SEQ ID NO: 947819 - DNA, 15 bp, Homo sapiens
tcaccctgcccgctc

SEQ ID NO: 947820 - DNA, 13 bp, Homo sapiens
tcaccctgcctta

SEQ ID NO: 947821 - DNA, 12 bp, Homo sapiens
tcaccctggcct

SEQ ID NO: 947822 - DNA, 13 bp, Homo sapiens
tcaccctgggagc

SEQ ID NO: 947823 - DNA, 21 bp, Homo sapiens
tcaccctgggagtttcctgag

SEQ ID NO: 947824 - DNA, 20 bp, Homo sapiens
tcaccctgtgaccctctcac

SEQ ID NO: 947825 - DNA, 13 bp, Homo sapiens
tcaccctgtggga

SEQ ID NO: 947826 - DNA, 15 bp, Homo sapiens
tcaccctgtgggacc

SEQ ID NO: 947827 - DNA, 16 bp, Homo sapiens
tcaccctgtgggaccg

SEQ ID NO: 947828 - DNA, 22 bp, Homo sapiens
tcaccctgtgggaccgcctggc

SEQ ID NO: 947829 - DNA, 21 bp, Homo sapiens
tcaccctgtgggtgtctccct

SEQ ID NO: 947830 - DNA, 20 bp, Homo sapiens
tcacccttcctggcccaggc

SEQ ID NO: 947831 - DNA, 21 bp, Homo sapiens
tcacccttcctggcccaggcc

SEQ ID NO: 947832 - DNA, 13 bp, Homo sapiens
tcaccgcccatca

SEQ ID NO: 947833 - DNA, 15 bp, Homo sapiens
tcaccgcccatcagg

SEQ ID NO: 947834 - DNA, 20 bp, Homo sapiens
tcaccgcccatcagggttct

SEQ ID NO: 947835 - DNA, 19 bp, Homo sapiens
tcaccgcggacgtgctggc

SEQ ID NO: 947836 - DNA, 21 bp, Homo sapiens
tcaccgcggacgtgctggcct

SEQ ID NO: 947837 - DNA, 14 bp, Homo sapiens
tcaccgctggccct

SEQ ID NO: 947838 - DNA, 13 bp, Homo sapiens
tcaccgctgggtg

SEQ ID NO: 947839 - DNA, 15 bp, Homo sapiens
tcaccgctgggtggt

SEQ ID NO: 947840 - DNA, 23 bp, Homo sapiens
tcaccggagctttcaaagaagga

SEQ ID NO: 947841 - DNA, 18 bp, Homo sapiens
tcaccggggtggtttagt

SEQ ID NO: 947842 - DNA, 15 bp, Homo sapiens
tcaccggtcagtgcc

SEQ ID NO: 947843 - DNA, 20 bp, Homo sapiens
tcaccgtggaccttcctgcc

SEQ ID NO: 947844 - DNA, 16 bp, Homo sapiens
tcacctaagcacttct

SEQ ID NO: 947845 - DNA, 20 bp, Homo sapiens
tcacctaagcacttctagaa

SEQ ID NO: 947846 - DNA, 15 bp, Homo sapiens
tcacctactttgtaa

SEQ ID NO: 947847 - DNA, 23 bp, Homo sapiens
tcacctatgttattttgtgtaca

SEQ ID NO: 947848 - DNA, 20 bp, Homo sapiens
tcacctatttccattcaaca

SEQ ID NO: 947849 - DNA, 12 bp, Homo sapiens
tcacctcagagt

SEQ ID NO: 947850 - DNA, 22 bp, Homo sapiens
tcacctcagagtggagttgaaa

SEQ ID NO: 947851 - DNA, 19 bp, Homo sapiens
tcacctcagcctggagagg

SEQ ID NO: 947852 - DNA, 20 bp, Homo sapiens
tcacctcagcctggagaggc

SEQ ID NO: 947853 - DNA, 23 bp, Homo sapiens
tcacctcagcctggagaggcctg

SEQ ID NO: 947854 - DNA, 16 bp, Homo sapiens
tcacctcagtagaaaa

SEQ ID NO: 947855 - DNA, 20 bp, Homo sapiens
tcacctccaagcatttcatg

SEQ ID NO: 947856 - DNA, 13 bp, Homo sapiens
tcacctcccccat

SEQ ID NO: 947857 - DNA, 14 bp, Homo sapiens
tcacctcccctcct

SEQ ID NO: 947858 - DNA, 15 bp, Homo sapiens
tcacctcccctcctt

SEQ ID NO: 947859 - DNA, 20 bp, Homo sapiens
tcacctccctgctcagtgct

SEQ ID NO: 947860 - DNA, 16 bp, Homo sapiens
tcacctcctaaaacaa

SEQ ID NO: 947861 - DNA, 17 bp, Homo sapiens
tcacctcctccactcac

SEQ ID NO: 947862 - DNA, 24 bp, Homo sapiens
tcacctcgagaagtaattatcagt

SEQ ID NO: 947863 - DNA, 20 bp, Homo sapiens
tcacctctaatagaggcagt

SEQ ID NO: 947864 - DNA, 21 bp, Homo sapiens
tcacctctaatagaggcagtg

SEQ ID NO: 947865 - DNA, 14 bp, Homo sapiens
tcacctctcttcag

SEQ ID NO: 947866 - DNA, 16 bp, Homo sapiens
tcacctctcttcagcc

SEQ ID NO: 947867 - DNA, 22 bp, Homo sapiens
tcacctctcttcagcccctagt

SEQ ID NO: 947868 - DNA, 13 bp, Homo sapiens
tcacctctgcctc

SEQ ID NO: 947869 - DNA, 18 bp, Homo sapiens
tcacctctggactggcta

SEQ ID NO: 947870 - DNA, 19 bp, Homo sapiens
tcacctctggactggctag

SEQ ID NO: 947871 - DNA, 17 bp, Homo sapiens
tcacctcttccactcct

SEQ ID NO: 947872 - DNA, 20 bp, Homo sapiens
tcacctcttccactccttct

SEQ ID NO: 947873 - DNA, 17 bp, Homo sapiens
tcacctcttcctctggt

SEQ ID NO: 947874 - DNA, 16 bp, Homo sapiens
tcacctcttggggacc

SEQ ID NO: 947875 - DNA, 14 bp, Homo sapiens
tcacctgaaacact

SEQ ID NO: 947876 - DNA, 15 bp, Homo sapiens
tcacctgaaacactg

SEQ ID NO: 947877 - DNA, 16 bp, Homo sapiens
tcacctgaaacactgg

SEQ ID NO: 947878 - DNA, 21 bp, Homo sapiens
tcacctgaaacactggacctg

SEQ ID NO: 947879 - DNA, 21 bp, Homo sapiens
tcacctgagcccggatgcttc

SEQ ID NO: 947880 - DNA, 22 bp, Homo sapiens
tttctttgaccagatctttctc

SEQ ID NO: 947881 - DNA, 23 bp, Homo sapiens
tttctttgaccagatctttctct

SEQ ID NO: 947882 - DNA, 14 bp, Homo sapiens
tttctttgcaaagt

SEQ ID NO: 947883 - DNA, 18 bp, Homo sapiens
tttctttgcaccaaagac

SEQ ID NO: 947884 - DNA, 16 bp, Homo sapiens
tttctttgggaccctg

SEQ ID NO: 947885 - DNA, 22 bp, Homo sapiens
tttctttgggggtggaaaagga

SEQ ID NO: 947886 - DNA, 19 bp, Homo sapiens
tttctttgtctttttccta

SEQ ID NO: 947887 - DNA, 15 bp, Homo sapiens
tttctttgtgtagct

SEQ ID NO: 947888 - DNA, 14 bp, Homo sapiens
tttcttttatacct

SEQ ID NO: 947889 - DNA, 14 bp, Homo sapiens
tttcttttattatc

SEQ ID NO: 947890 - DNA, 22 bp, Homo sapiens
tttcttttgcccttcacagtgt

SEQ ID NO: 947891 - DNA, 16 bp, Homo sapiens
tttcttttgtaaatgt

SEQ ID NO: 947892 - DNA, 14 bp, Homo sapiens
tttcttttgtaatt

SEQ ID NO: 947893 - DNA, 14 bp, Homo sapiens
tttcttttgttgta

SEQ ID NO: 947894 - DNA, 17 bp, Homo sapiens
tttctttttacagcatt

SEQ ID NO: 947895 - DNA, 16 bp, Homo sapiens
tttctttttctggaaa

SEQ ID NO: 947896 - DNA, 17 bp, Homo sapiens
tttctttttctggaaat

SEQ ID NO: 947897 - DNA, 15 bp, Homo sapiens
tttcttttttatctt

SEQ ID NO: 947898 - DNA, 19 bp, Homo sapiens
tttcttttttgctttcttg

SEQ ID NO: 947899 - DNA, 14 bp, Homo sapiens
tttctttttttcct

SEQ ID NO: 947900 - DNA, 18 bp, Homo sapiens
tttctttttttttaagtt

SEQ ID NO: 947901 - DNA, 24 bp, Homo sapiens
tttgaaaaacttttaggttgttac

SEQ ID NO: 947902 - DNA, 15 bp, Homo sapiens
tttgaaaaagcgaaa

SEQ ID NO: 947903 - DNA, 20 bp, Homo sapiens
tttgaaaaagcgaaaaaatc

SEQ ID NO: 947904 - DNA, 17 bp, Homo sapiens
tttgaaaaagttccata

SEQ ID NO: 947905 - DNA, 12 bp, Homo sapiens
tttgaaaaatat

SEQ ID NO: 947906 - DNA, 18 bp, Homo sapiens
tttgaaaaatattgctaa

SEQ ID NO: 947907 - DNA, 19 bp, Homo sapiens
tttgaaaaattacagcttc

SEQ ID NO: 947908 - DNA, 17 bp, Homo sapiens
tttgaaaacaattcagt

SEQ ID NO: 947909 - DNA, 17 bp, Homo sapiens
tttgaaaacatgtttat

SEQ ID NO: 947910 - DNA, 13 bp, Homo sapiens
tttgaaaacttca

SEQ ID NO: 947911 - DNA, 18 bp, Homo sapiens
tttgaaaagaccaagact

SEQ ID NO: 947912 - DNA, 15 bp, Homo sapiens
tttgaaaagagaagc

SEQ ID NO: 947913 - DNA, 20 bp, Homo sapiens
tttgaaaaggcggtactagt

SEQ ID NO: 947914 - DNA, 14 bp, Homo sapiens
tttgaaaagttgga

SEQ ID NO: 947915 - DNA, 15 bp, Homo sapiens
tttgaaaatatttct

SEQ ID NO: 947916 - DNA, 17 bp, Homo sapiens
tttgaaaatatttctat

SEQ ID NO: 947917 - DNA, 22 bp, Homo sapiens
tttgaaaatgctcttaaaatat

SEQ ID NO: 947918 - DNA, 24 bp, Homo sapiens
tttgaaaattatgcaaaagcagct

SEQ ID NO: 947919 - DNA, 20 bp, Homo sapiens
tttgaaacaaagtactcttt

SEQ ID NO: 947920 - DNA, 22 bp, Homo sapiens
tttgaaacccctgtaggcctca

SEQ ID NO: 947921 - DNA, 23 bp, Homo sapiens
tttgaaagtaaaaacctgcttgg

SEQ ID NO: 947922 - DNA, 17 bp, Homo sapiens
tttgaaagtagagctag

SEQ ID NO: 947923 - DNA, 23 bp, Homo sapiens
tttgaaagtagagctagctgcca

SEQ ID NO: 947924 - DNA, 17 bp, Homo sapiens
tttgaaagtttaacaaa

SEQ ID NO: 947925 - DNA, 18 bp, Homo sapiens
tttgaaagtttaacaaat

SEQ ID NO: 947926 - DNA, 16 bp, Homo sapiens
tttgaaatatcatgtt

SEQ ID NO: 947927 - DNA, 14 bp, Homo sapiens
tttgaaatcgttgg

SEQ ID NO: 947928 - DNA, 18 bp, Homo sapiens
tttgaaatcgttggaaaa

SEQ ID NO: 947929 - DNA, 20 bp, Homo sapiens
tttgaaatgaggtctgttta

SEQ ID NO: 947930 - DNA, 22 bp, Homo sapiens
tttgaaatgggcatttatttta

SEQ ID NO: 947931 - DNA, 18 bp, Homo sapiens
tttgaaattaacctctca

SEQ ID NO: 947932 - DNA, 15 bp, Homo sapiens
tttgaaattatgtga

SEQ ID NO: 947933 - DNA, 17 bp, Homo sapiens
tttgaaattatgtgaca

SEQ ID NO: 947934 - DNA, 22 bp, Homo sapiens
tttgaaattatgtgacatttta

SEQ ID NO: 947935 - DNA, 22 bp, Homo sapiens
tttgaacaactaggcttcagca

SEQ ID NO: 947936 - DNA, 16 bp, Homo sapiens
tttgaacacttactgt

SEQ ID NO: 947937 - DNA, 17 bp, Homo sapiens
tttgaaccaacatcttt

SEQ ID NO: 947938 - DNA, 15 bp, Homo sapiens
tttgaacccctgtgt

SEQ ID NO: 947939 - DNA, 18 bp, Homo sapiens
tttgaacgcttaagtcat

SEQ ID NO: 947940 - DNA, 15 bp, Homo sapiens
tttgaactaataaaa

SEQ ID NO: 947941 - DNA, 18 bp, Homo sapiens
tttgaactgaaacttttc

SEQ ID NO: 947942 - DNA, 21 bp, Homo sapiens
tttgaactgaaacttttctaa

SEQ ID NO: 947943 - DNA, 22 bp, Homo sapiens
tttgaactgaaacttttctaaa

SEQ ID NO: 947944 - DNA, 22 bp, Homo sapiens
tttgaactggcaattgtctatt

SEQ ID NO: 947945 - DNA, 16 bp, Homo sapiens
tttgaactttagtttg

SEQ ID NO: 947946 - DNA, 12 bp, Homo sapiens
tttgaacttttt

SEQ ID NO: 947947 - DNA, 20 bp, Homo sapiens
tttgaagaaaagaaaaaaca

SEQ ID NO: 947948 - DNA, 22 bp, Homo sapiens
tttgaagatgccgcatttggat

SEQ ID NO: 947949 - DNA, 17 bp, Homo sapiens
tttgaagccttttgttt

SEQ ID NO: 947950 - DNA, 13 bp, Homo sapiens
tttgaaggaaaca

SEQ ID NO: 947951 - DNA, 20 bp, Homo sapiens
tttgaaggaaacagttaata

SEQ ID NO: 947952 - DNA, 12 bp, Homo sapiens
tttgaaggcaaa

SEQ ID NO: 947953 - DNA, 19 bp, Homo sapiens
tttgaaggtttcagatgag

SEQ ID NO: 947954 - DNA, 22 bp, Homo sapiens
tttgaagtaatcccgccaccta

SEQ ID NO: 947955 - DNA, 20 bp, Homo sapiens
tttgaagtgctgtttattaa

SEQ ID NO: 947956 - DNA, 15 bp, Homo sapiens
tttgaataaatgtgt

SEQ ID NO: 947957 - DNA, 19 bp, Homo sapiens
tttgaatatgtagtatcta

SEQ ID NO: 947958 - DNA, 21 bp, Homo sapiens
tttgaatatttgttttaatac

SEQ ID NO: 947959 - DNA, 15 bp, Homo sapiens
tttgaatattttttg

SEQ ID NO: 947960 - DNA, 13 bp, Homo sapiens
tttgaatgaaaaa

SEQ ID NO: 947961 - DNA, 14 bp, Homo sapiens
tttgaatgaaaaat

SEQ ID NO: 947962 - DNA, 21 bp, Homo sapiens
tttgaatgaaaaatttaagca

SEQ ID NO: 947963 - DNA, 22 bp, Homo sapiens
tttgaatgaaaaatttaagcat

SEQ ID NO: 947964 - DNA, 24 bp, Homo sapiens
tttgaatgaaaaatttaagcattg

SEQ ID NO: 947965 - DNA, 22 bp, Homo sapiens
tttgaatgctaagaatgcatta

SEQ ID NO: 947966 - DNA, 12 bp, Homo sapiens
tttgaatgttaa

SEQ ID NO: 947967 - DNA, 23 bp, Homo sapiens
tttgaatgttaagaattgaccat

SEQ ID NO: 947968 - DNA, 16 bp, Homo sapiens
tttgaattatcagcaa

SEQ ID NO: 947969 - DNA, 16 bp, Homo sapiens
tttgaattgttttctt

SEQ ID NO: 947970 - DNA, 15 bp, Homo sapiens
tttgaatttaaataa

SEQ ID NO: 947971 - DNA, 14 bp, Homo sapiens
tttgaattttgttt

SEQ ID NO: 947972 - DNA, 19 bp, Homo sapiens
tttgaatttttacatttgt

SEQ ID NO: 947973 - DNA, 17 bp, Homo sapiens
tttgacaaagtgcctca

SEQ ID NO: 947974 - DNA, 20 bp, Homo sapiens
tttgacaacgtttcagcgac

SEQ ID NO: 947975 - DNA, 14 bp, Homo sapiens
tttgacaactaaaa

SEQ ID NO: 947976 - DNA, 13 bp, Homo sapiens
tttgacaattact

SEQ ID NO: 947977 - DNA, 22 bp, Homo sapiens
tttgacactgaaagttttgtaa

SEQ ID NO: 947978 - DNA, 15 bp, Homo sapiens
tttgacactgctcta

SEQ ID NO: 947979 - DNA, 19 bp, Homo sapiens
tttgacacttttaaaaaac

SEQ ID NO: 947980 - DNA, 18 bp, Homo sapiens
tttgacagttattttgat

SEQ ID NO: 947981 - DNA, 23 bp, Homo sapiens
tttgacatcattcatgacaacat

SEQ ID NO: 947982 - DNA, 13 bp, Homo sapiens
tttgacatgtgaa

SEQ ID NO: 947983 - DNA, 20 bp, Homo sapiens
tttgacatttggtggtactt

SEQ ID NO: 947984 - DNA, 12 bp, Homo sapiens
tttgaccaaatc

SEQ ID NO: 947985 - DNA, 21 bp, Homo sapiens
tttgaccccgatatattttag

SEQ ID NO: 947986 - DNA, 19 bp, Homo sapiens
tttgaccttttatgtagta

SEQ ID NO: 947987 - DNA, 16 bp, Homo sapiens
tttgactaagaatttt

SEQ ID NO: 947988 - DNA, 14 bp, Homo sapiens
tttgactaatttta

SEQ ID NO: 947989 - DNA, 17 bp, Homo sapiens
tttgactaattttacat

SEQ ID NO: 947990 - DNA, 21 bp, Homo sapiens
tttgactaattttacatgttt

SEQ ID NO: 947991 - DNA, 21 bp, Homo sapiens
tttgactctggcaaagctttt

SEQ ID NO: 947992 - DNA, 17 bp, Homo sapiens
tttgactcttccgtgca

SEQ ID NO: 947993 - DNA, 14 bp, Homo sapiens
tttgactctttcaa

SEQ ID NO: 947994 - DNA, 12 bp, Homo sapiens
tttgactctttt

SEQ ID NO: 947995 - DNA, 14 bp, Homo sapiens
tttgacttaatgtg

SEQ ID NO: 947996 - DNA, 14 bp, Homo sapiens
tttgacttcttgct

SEQ ID NO: 947997 - DNA, 15 bp, Homo sapiens
tttgactttcttctg

SEQ ID NO: 947998 - DNA, 22 bp, Homo sapiens
tttgactttcttctgaatattt

SEQ ID NO: 947999 - DNA, 12 bp, Homo sapiens
tttgacttttct

SEQ ID NO: 948000 - DNA, 14 bp, Homo sapiens
tttgacttttctgt

SEQ ID NO: 948001 - DNA, 17 bp, Homo sapiens
tttgacttttctgtaat

SEQ ID NO: 948002 - DNA, 21 bp, Homo sapiens
tttgagaaacaacaatttcta

SEQ ID NO: 948003 - DNA, 19 bp, Homo sapiens
tttgagaattttgtttcaa

SEQ ID NO: 948004 - DNA, 17 bp, Homo sapiens
tcacctgaggtcgggag

SEQ ID NO: 948005 - DNA, 19 bp, Homo sapiens
tcacctgagtcaccctacc

SEQ ID NO: 948006 - DNA, 20 bp, Homo sapiens
tcacctgcaagccccagggc

SEQ ID NO: 948007 - DNA, 23 bp, Homo sapiens
tcacctgccccgtagagaatgtg

SEQ ID NO: 948008 - DNA, 13 bp, Homo sapiens
tcacctgcccctc

SEQ ID NO: 948009 - DNA, 17 bp, Homo sapiens
tcacctgcccctctgtt

SEQ ID NO: 948010 - DNA, 18 bp, Homo sapiens
tcacctgcccctctgttc

SEQ ID NO: 948011 - DNA, 19 bp, Homo sapiens
tcacctgcccctctgttct

SEQ ID NO: 948012 - DNA, 14 bp, Homo sapiens
tcacctgctcacag

SEQ ID NO: 948013 - DNA, 18 bp, Homo sapiens
tcacctgctcacagggat

SEQ ID NO: 948014 - DNA, 22 bp, Homo sapiens
tcacctgctcacagggatgctg

SEQ ID NO: 948015 - DNA, 14 bp, Homo sapiens
tcacctgctccaga

SEQ ID NO: 948016 - DNA, 19 bp, Homo sapiens
tcacctgctggcccctcac

SEQ ID NO: 948017 - DNA, 22 bp, Homo sapiens
tcacctggacttaagcatctgg

SEQ ID NO: 948018 - DNA, 19 bp, Homo sapiens
tcacctggccctgcttcct

SEQ ID NO: 948019 - DNA, 16 bp, Homo sapiens
tcacctgggcctttcc

SEQ ID NO: 948020 - DNA, 17 bp, Homo sapiens
tcacctgggcctttcct

SEQ ID NO: 948021 - DNA, 15 bp, Homo sapiens
tcacctggttgaccc

SEQ ID NO: 948022 - DNA, 16 bp, Homo sapiens
tcacctgtaaaacttt

SEQ ID NO: 948023 - DNA, 16 bp, Homo sapiens
tcacctgtaaacctga

SEQ ID NO: 948024 - DNA, 17 bp, Homo sapiens
tcacctgtaaacctgag

SEQ ID NO: 948025 - DNA, 15 bp, Homo sapiens
tcacctgtactattg

SEQ ID NO: 948026 - DNA, 23 bp, Homo sapiens
tcacctgtactattgcagacctg

SEQ ID NO: 948027 - DNA, 15 bp, Homo sapiens
tcacctgtactcttc

SEQ ID NO: 948028 - DNA, 16 bp, Homo sapiens
tcacctgtactcttcc

SEQ ID NO: 948029 - DNA, 20 bp, Homo sapiens
tcacctgtgcttcgggccct

SEQ ID NO: 948030 - DNA, 19 bp, Homo sapiens
tcacctgtttttaagctgt

SEQ ID NO: 948031 - DNA, 23 bp, Homo sapiens
tcaccttagggtggctttaattg

SEQ ID NO: 948032 - DNA, 12 bp, Homo sapiens
tcaccttccctc

SEQ ID NO: 948033 - DNA, 16 bp, Homo sapiens
tcaccttcccttgcca

SEQ ID NO: 948034 - DNA, 18 bp, Homo sapiens
tcaccttgcaacacacag

SEQ ID NO: 948035 - DNA, 21 bp, Homo sapiens
tcaccttgcaacacacagaca

SEQ ID NO: 948036 - DNA, 21 bp, Homo sapiens
tcaccttgcactcctcacaca

SEQ ID NO: 948037 - DNA, 21 bp, Homo sapiens
tcaccttgccgagagaggcgc

SEQ ID NO: 948038 - DNA, 13 bp, Homo sapiens
tcaccttggaagg

SEQ ID NO: 948039 - DNA, 16 bp, Homo sapiens
tcaccttggaagggcg

SEQ ID NO: 948040 - DNA, 15 bp, Homo sapiens
tcactctctccgtct

SEQ ID NO: 948041 - DNA, 22 bp, Homo sapiens
tcactctctggggaagtcaggg

SEQ ID NO: 948042 - DNA, 13 bp, Homo sapiens
tcactctgccctc

SEQ ID NO: 948043 - DNA, 18 bp, Homo sapiens
tcactctgccctctgctg

SEQ ID NO: 948044 - DNA, 19 bp, Homo sapiens
tcactctgccctctgctgc

SEQ ID NO: 948045 - DNA, 23 bp, Homo sapiens
tcactctgccctctgctgctgcc

SEQ ID NO: 948046 - DNA, 14 bp, Homo sapiens
tcactctgctgctt

SEQ ID NO: 948047 - DNA, 13 bp, Homo sapiens
tcactctgggctg

SEQ ID NO: 948048 - DNA, 23 bp, Homo sapiens
tcactctgtcagccagccgccct

SEQ ID NO: 948049 - DNA, 14 bp, Homo sapiens
tcactctgtccctg

SEQ ID NO: 948050 - DNA, 20 bp, Homo sapiens
tcactctgtcgctcaggctg

SEQ ID NO: 948051 - DNA, 22 bp, Homo sapiens
tcactctgtcgctcaggctgga

SEQ ID NO: 948052 - DNA, 20 bp, Homo sapiens
tcactcttattgtccttcta

SEQ ID NO: 948053 - DNA, 15 bp, Homo sapiens
tcactcttccagaat

SEQ ID NO: 948054 - DNA, 17 bp, Homo sapiens
tcactcttcctcatcct

SEQ ID NO: 948055 - DNA, 18 bp, Homo sapiens
tcactcttcctgcaagga

SEQ ID NO: 948056 - DNA, 19 bp, Homo sapiens
tcactcttcctgcaaggac

SEQ ID NO: 948057 - DNA, 19 bp, Homo sapiens
tcactcttgtactgcctgc

SEQ ID NO: 948058 - DNA, 17 bp, Homo sapiens
tcactgaaatgtttgga

SEQ ID NO: 948059 - DNA, 14 bp, Homo sapiens
tcactgaacaaaac

SEQ ID NO: 948060 - DNA, 12 bp, Homo sapiens
tcactgaacatg

SEQ ID NO: 948061 - DNA, 14 bp, Homo sapiens
tcactgaactccac

SEQ ID NO: 948062 - DNA, 16 bp, Homo sapiens
tcactgaactccaccg

SEQ ID NO: 948063 - DNA, 11 bp, Homo sapiens
tcactgaagcc

SEQ ID NO: 948064 - DNA, 15 bp, Homo sapiens
tcactgactctgact

SEQ ID NO: 948065 - DNA, 16 bp, Homo sapiens
tcactgagagctgcct

SEQ ID NO: 948066 - DNA, 17 bp, Homo sapiens
tcactgagaggcctgga

SEQ ID NO: 948067 - DNA, 18 bp, Homo sapiens
tcactgagcacagtcagg

SEQ ID NO: 948068 - DNA, 22 bp, Homo sapiens
tcactgagctccccagatctcc

SEQ ID NO: 948069 - DNA, 19 bp, Homo sapiens
tcactgaggccatcagggc

SEQ ID NO: 948070 - DNA, 20 bp, Homo sapiens
tcactgaggccatcagggcc

SEQ ID NO: 948071 - DNA, 16 bp, Homo sapiens
tcactgatgggaaaac

SEQ ID NO: 948072 - DNA, 19 bp, Homo sapiens
tcactgcaaatctccgcct

SEQ ID NO: 948073 - DNA, 15 bp, Homo sapiens
tcactgcaaccttca

SEQ ID NO: 948074 - DNA, 16 bp, Homo sapiens
tcactgcaaccttcac

SEQ ID NO: 948075 - DNA, 18 bp, Homo sapiens
tcactgcaacttctgcct

SEQ ID NO: 948076 - DNA, 14 bp, Homo sapiens
tcactgcagccttg

SEQ ID NO: 948077 - DNA, 23 bp, Homo sapiens
tcactgcagccttgtcctcccag

SEQ ID NO: 948078 - DNA, 15 bp, Homo sapiens
tcactgccacactct

SEQ ID NO: 948079 - DNA, 16 bp, Homo sapiens
tcactgccaggccagc

SEQ ID NO: 948080 - DNA, 18 bp, Homo sapiens
tcactgccaggccagcct

SEQ ID NO: 948081 - DNA, 20 bp, Homo sapiens
tcactgccaggccagcctcc

SEQ ID NO: 948082 - DNA, 13 bp, Homo sapiens
tcactgccatgat

SEQ ID NO: 948083 - DNA, 15 bp, Homo sapiens
tcactgcccaccaaa

SEQ ID NO: 948084 - DNA, 21 bp, Homo sapiens
tcactgccccacttctggcat

SEQ ID NO: 948085 - DNA, 23 bp, Homo sapiens
tcactgcctaggaggctggccaa

SEQ ID NO: 948086 - DNA, 14 bp, Homo sapiens
tcactgccttcctc

SEQ ID NO: 948087 - DNA, 18 bp, Homo sapiens
tcactgcgaagaccctct

SEQ ID NO: 948088 - DNA, 16 bp, Homo sapiens
tcactgcgccactgct

SEQ ID NO: 948089 - DNA, 11 bp, Homo sapiens
tcactgctgct

SEQ ID NO: 948090 - DNA, 17 bp, Homo sapiens
tcactgctgctactgcc

SEQ ID NO: 948091 - DNA, 21 bp, Homo sapiens
tcactgctgctcctctttccc

SEQ ID NO: 948092 - DNA, 15 bp, Homo sapiens
tcactgctggctgcc

SEQ ID NO: 948093 - DNA, 17 bp, Homo sapiens
tcactgctggctgcctt

SEQ ID NO: 948094 - DNA, 17 bp, Homo sapiens
tcactgcttaacttcac

SEQ ID NO: 948095 - DNA, 17 bp, Homo sapiens
tcactggaaaggggaga

SEQ ID NO: 948096 - DNA, 13 bp, Homo sapiens
tcactggactgca

SEQ ID NO: 948097 - DNA, 17 bp, Homo sapiens
tcactggagcaccaggc

SEQ ID NO: 948098 - DNA, 18 bp, Homo sapiens
tcactggagcaccaggca

SEQ ID NO: 948099 - DNA, 13 bp, Homo sapiens
tcactggatgaaa

SEQ ID NO: 948100 - DNA, 15 bp, Homo sapiens
tcactggcagagcac

SEQ ID NO: 948101 - DNA, 17 bp, Homo sapiens
tcactggcagagcacag

SEQ ID NO: 948102 - DNA, 21 bp, Homo sapiens
tcactggccacagttgtttga

SEQ ID NO: 948103 - DNA, 18 bp, Homo sapiens
tcactggctcatgcccct

SEQ ID NO: 948104 - DNA, 20 bp, Homo sapiens
tcactggctctccaagtgcc

SEQ ID NO: 948105 - DNA, 11 bp, Homo sapiens
tcactggctgg

SEQ ID NO: 948106 - DNA, 19 bp, Homo sapiens
tcactggctggcctgagca

SEQ ID NO: 948107 - DNA, 19 bp, Homo sapiens
tcactgggcctttccagag

SEQ ID NO: 948108 - DNA, 18 bp, Homo sapiens
tcactggggatggtggca

SEQ ID NO: 948109 - DNA, 19 bp, Homo sapiens
tcactggggatggtggcac

SEQ ID NO: 948110 - DNA, 16 bp, Homo sapiens
tcactggggtcctggg

SEQ ID NO: 948111 - DNA, 19 bp, Homo sapiens
tcactggggtcctggggcc

SEQ ID NO: 948112 - DNA, 21 bp, Homo sapiens
tcactggggtcctggggcctc

SEQ ID NO: 948113 - DNA, 18 bp, Homo sapiens
tcactggtagaccaaaat

SEQ ID NO: 948114 - DNA, 12 bp, Homo sapiens
tcactggtcagg

SEQ ID NO: 948115 - DNA, 18 bp, Homo sapiens
tcactggtcagggcagtg

SEQ ID NO: 948116 - DNA, 20 bp, Homo sapiens
tcactgtaaagacaaataaa

SEQ ID NO: 948117 - DNA, 16 bp, Homo sapiens
tcactgtaagtttatt

SEQ ID NO: 948118 - DNA, 15 bp, Homo sapiens
tcactgtactgcatg

SEQ ID NO: 948119 - DNA, 16 bp, Homo sapiens
tcactgtactgcatgt

SEQ ID NO: 948120 - DNA, 18 bp, Homo sapiens
tcactgtactgcatgtga

SEQ ID NO: 948121 - DNA, 21 bp, Homo sapiens
tcactgtactgcatgtgactt

SEQ ID NO: 948122 - DNA, 22 bp, Homo sapiens
tcactgtagtttagttctgttg

SEQ ID NO: 948123 - DNA, 23 bp, Homo sapiens
tcactgtagtttagttctgttga

SEQ ID NO: 948124 - DNA, 15 bp, Homo sapiens
tcactgtagttttga

SEQ ID NO: 948125 - DNA, 16 bp, Homo sapiens
tcactgtagttttgag

SEQ ID NO: 948126 - DNA, 18 bp, Homo sapiens
tcactgtatagacatgct

SEQ ID NO: 948127 - DNA, 14 bp, Homo sapiens
tcactgtcactgcc

SEQ ID NO: 948128 - DNA, 17 bp, Homo sapiens
tcactgtctatttaagt

SEQ ID NO: 948129 - DNA, 19 bp, Homo sapiens
tcactgtctatttaagtgc

SEQ ID NO: 948130 - DNA, 20 bp, Homo sapiens
tcactgtctttaattctgta

SEQ ID NO: 948131 - DNA, 21 bp, Homo sapiens
tcactgtcttttgattcttga

SEQ ID NO: 948132 - DNA, 21 bp, Homo sapiens
tcactgtgaaatttcatgatt

SEQ ID NO: 948133 - DNA, 20 bp, Homo sapiens
tcactgtgaggggaaggcct

SEQ ID NO: 948134 - DNA, 18 bp, Homo sapiens
tttgcccgttgaccagat

SEQ ID NO: 948135 - DNA, 13 bp, Homo sapiens
tttgccctcctgc

SEQ ID NO: 948136 - DNA, 15 bp, Homo sapiens
tttgccgttattaaa

SEQ ID NO: 948137 - DNA, 20 bp, Homo sapiens
tttgcctacgtgacaacaca

SEQ ID NO: 948138 - DNA, 16 bp, Homo sapiens
tttgcctatctttaaa

SEQ ID NO: 948139 - DNA, 10 bp, Homo sapiens
tttgcctcaa

SEQ ID NO: 948140 - DNA, 13 bp, Homo sapiens
tttgcctcctgga

SEQ ID NO: 948141 - DNA, 12 bp, Homo sapiens
tttgcctctgtc

SEQ ID NO: 948142 - DNA, 22 bp, Homo sapiens
tttgcctctgtcctcccatccc

SEQ ID NO: 948143 - DNA, 17 bp, Homo sapiens
tttgcctcttccagtct

SEQ ID NO: 948144 - DNA, 23 bp, Homo sapiens
tttgcctgcagtttcttgtgtag

SEQ ID NO: 948145 - DNA, 13 bp, Homo sapiens
tttgcctggctgt

SEQ ID NO: 948146 - DNA, 23 bp, Homo sapiens
tttgcctggctgtggaggcctga

SEQ ID NO: 948147 - DNA, 19 bp, Homo sapiens
tttgccttaaacctgaaga

SEQ ID NO: 948148 - DNA, 14 bp, Homo sapiens
tttgccttgcagaa

SEQ ID NO: 948149 - DNA, 17 bp, Homo sapiens
tttgccttgcagaactg

SEQ ID NO: 948150 - DNA, 19 bp, Homo sapiens
tttgcctttcttctgccct

SEQ ID NO: 948151 - DNA, 20 bp, Homo sapiens
tttgcgcttatttggaaatt

SEQ ID NO: 948152 - DNA, 21 bp, Homo sapiens
tttgcggatgagggcatgtgc

SEQ ID NO: 948153 - DNA, 21 bp, Homo sapiens
tttgctaatttttattaattt

SEQ ID NO: 948154 - DNA, 22 bp, Homo sapiens
tttgctacaaatttatgcattt

SEQ ID NO: 948155 - DNA, 14 bp, Homo sapiens
tttgctactaagtt

SEQ ID NO: 948156 - DNA, 21 bp, Homo sapiens
tttgctagactctagacaaga

SEQ ID NO: 948157 - DNA, 20 bp, Homo sapiens
tttgctagcagtaaaagatg

SEQ ID NO: 948158 - DNA, 21 bp, Homo sapiens
tttgctagttctgctgccctc

SEQ ID NO: 948159 - DNA, 22 bp, Homo sapiens
tttgctagttctgctgccctct

SEQ ID NO: 948160 - DNA, 14 bp, Homo sapiens
tttgctataatcat

SEQ ID NO: 948161 - DNA, 17 bp, Homo sapiens
tttgctataatcattag

SEQ ID NO: 948162 - DNA, 22 bp, Homo sapiens
tttgggataggaaaaatgagta

SEQ ID NO: 948163 - DNA, 18 bp, Homo sapiens
tttgggatttaatttcca

SEQ ID NO: 948164 - DNA, 21 bp, Homo sapiens
tttgggcagcaatttaaatgt

SEQ ID NO: 948165 - DNA, 22 bp, Homo sapiens
tttgggcctccatgccccagct

SEQ ID NO: 948166 - DNA, 20 bp, Homo sapiens
tttggggacagggggtggga

SEQ ID NO: 948167 - DNA, 19 bp, Homo sapiens
tttggggagggggaagaga

SEQ ID NO: 948168 - DNA, 22 bp, Homo sapiens
tttggggagggggaagagaaat

SEQ ID NO: 948169 - DNA, 18 bp, Homo sapiens
tttggggcagaaaggact

SEQ ID NO: 948170 - DNA, 15 bp, Homo sapiens
tttgggggaaaaaaa

SEQ ID NO: 948171 - DNA, 21 bp, Homo sapiens
tttgggggctcatttttgctg

SEQ ID NO: 948172 - DNA, 19 bp, Homo sapiens
tttgggggtggaaaaggaa

SEQ ID NO: 948173 - DNA, 23 bp, Homo sapiens
tttggggtgcctaggttggtttc

SEQ ID NO: 948174 - DNA, 15 bp, Homo sapiens
tttggggtgggcgtt

SEQ ID NO: 948175 - DNA, 22 bp, Homo sapiens
tttgggtatgtttaatctgtta

SEQ ID NO: 948176 - DNA, 22 bp, Homo sapiens
tttgggtctacaagtatatgtg

SEQ ID NO: 948177 - DNA, 16 bp, Homo sapiens
tttgggttctttctgg

SEQ ID NO: 948178 - DNA, 22 bp, Homo sapiens
tttgggttggttccaagtcttt

SEQ ID NO: 948179 - DNA, 18 bp, Homo sapiens
tttgggtttttttccttt

SEQ ID NO: 948180 - DNA, 14 bp, Homo sapiens
tttggtaaaaatgc

SEQ ID NO: 948181 - DNA, 16 bp, Homo sapiens
tttggtaaaaatgctg

SEQ ID NO: 948182 - DNA, 19 bp, Homo sapiens
tttggtaaaaatgctgctc

SEQ ID NO: 948183 - DNA, 20 bp, Homo sapiens
tttggtaaaatacttcttga

SEQ ID NO: 948184 - DNA, 18 bp, Homo sapiens
tttggtaattttttttgt

SEQ ID NO: 948185 - DNA, 14 bp, Homo sapiens
tttggtacccccaa

SEQ ID NO: 948186 - DNA, 18 bp, Homo sapiens
tttggtacttattactgc

SEQ ID NO: 948187 - DNA, 18 bp, Homo sapiens
tttggtagatcttcaatt

SEQ ID NO: 948188 - DNA, 21 bp, Homo sapiens
tttggtatgttgggataagga

SEQ ID NO: 948189 - DNA, 19 bp, Homo sapiens
tttggtcccctccctcgtg

SEQ ID NO: 948190 - DNA, 18 bp, Homo sapiens
tttggtcgagtctttgtg

SEQ ID NO: 948191 - DNA, 15 bp, Homo sapiens
tttggtctccctggg

SEQ ID NO: 948192 - DNA, 22 bp, Homo sapiens
tttggtctggactgacagcatg

SEQ ID NO: 948193 - DNA, 22 bp, Homo sapiens
tttggtcttcagcctccctcag

SEQ ID NO: 948194 - DNA, 13 bp, Homo sapiens
tttggtgaattcc

SEQ ID NO: 948195 - DNA, 14 bp, Homo sapiens
tttggtgaattcct

SEQ ID NO: 948196 - DNA, 17 bp, Homo sapiens
tttggtgcctatttgaa

SEQ ID NO: 948197 - DNA, 15 bp, Homo sapiens
tttggtgtacagact

SEQ ID NO: 948198 - DNA, 19 bp, Homo sapiens
tttggtgtgtggagatgca

SEQ ID NO: 948199 - DNA, 13 bp, Homo sapiens
tttggttaaagta

SEQ ID NO: 948200 - DNA, 16 bp, Homo sapiens
tttggttattggtttt

SEQ ID NO: 948201 - DNA, 20 bp, Homo sapiens
tttggttccttctctgggtc

SEQ ID NO: 948202 - DNA, 13 bp, Homo sapiens
tttggttctgggg

SEQ ID NO: 948203 - DNA, 14 bp, Homo sapiens
tttggttctggggc

SEQ ID NO: 948204 - DNA, 21 bp, Homo sapiens
tttggttcttagttctcactg

SEQ ID NO: 948205 - DNA, 15 bp, Homo sapiens
tttggttgaataaac

SEQ ID NO: 948206 - DNA, 19 bp, Homo sapiens
tttggttgcactttagaca

SEQ ID NO: 948207 - DNA, 15 bp, Homo sapiens
tttggtttatgactt

SEQ ID NO: 948208 - DNA, 21 bp, Homo sapiens
tttggtttcccaagagctacg

SEQ ID NO: 948209 - DNA, 16 bp, Homo sapiens
tttggtttttttgtac

SEQ ID NO: 948210 - DNA, 21 bp, Homo sapiens
tttgtaaaaacagcattgctt

SEQ ID NO: 948211 - DNA, 22 bp, Homo sapiens
tttgtaaaaacagcattgcttt

SEQ ID NO: 948212 - DNA, 16 bp, Homo sapiens
tttgtaaaaactgaag

SEQ ID NO: 948213 - DNA, 21 bp, Homo sapiens
tttgtaaaaactgaagaattt

SEQ ID NO: 948214 - DNA, 23 bp, Homo sapiens
tttgtaaaaactgaagaattttg

SEQ ID NO: 948215 - DNA, 14 bp, Homo sapiens
tttgtaaaaatgag

SEQ ID NO: 948216 - DNA, 18 bp, Homo sapiens
tttgtaaaatattatgtt

SEQ ID NO: 948217 - DNA, 20 bp, Homo sapiens
tttgtaaaatattatgtttg

SEQ ID NO: 948218 - DNA, 16 bp, Homo sapiens
tttgtaaactcaaaat

SEQ ID NO: 948219 - DNA, 22 bp, Homo sapiens
tttgtaaactcaaaatatttgt

SEQ ID NO: 948220 - DNA, 13 bp, Homo sapiens
tttgtaaacttct

SEQ ID NO: 948221 - DNA, 21 bp, Homo sapiens
tttgtaaagttggttggataa

SEQ ID NO: 948222 - DNA, 15 bp, Homo sapiens
tttgtaaatactgct

SEQ ID NO: 948223 - DNA, 17 bp, Homo sapiens
tttgtaaatactgcttg

SEQ ID NO: 948224 - DNA, 14 bp, Homo sapiens
tttgtaaataggat

SEQ ID NO: 948225 - DNA, 14 bp, Homo sapiens
tttgtaaatgattt

SEQ ID NO: 948226 - DNA, 17 bp, Homo sapiens
tttgtaaattaactttt

SEQ ID NO: 948227 - DNA, 11 bp, Homo sapiens
tttgtaaattc

SEQ ID NO: 948228 - DNA, 16 bp, Homo sapiens
tttgtaaatttagtgt

SEQ ID NO: 948229 - DNA, 20 bp, Homo sapiens
tttgtaaccacaactttcac

SEQ ID NO: 948230 - DNA, 20 bp, Homo sapiens
tttgtaacccagattttgct

SEQ ID NO: 948231 - DNA, 16 bp, Homo sapiens
tttgtaacctcagctc

SEQ ID NO: 948232 - DNA, 18 bp, Homo sapiens
tttgtaacctcagctctg

SEQ ID NO: 948233 - DNA, 21 bp, Homo sapiens
tttgtaactacaaagctttgc

SEQ ID NO: 948234 - DNA, 16 bp, Homo sapiens
tttgtaacttagcttt

SEQ ID NO: 948235 - DNA, 20 bp, Homo sapiens
tttgtaagaaggcaatatta

SEQ ID NO: 948236 - DNA, 17 bp, Homo sapiens
tttgtaagacatttgta

SEQ ID NO: 948237 - DNA, 21 bp, Homo sapiens
tttgtaagacatttgtatatt

SEQ ID NO: 948238 - DNA, 21 bp, Homo sapiens
tttgtaagtaacaatatgtaa

SEQ ID NO: 948239 - DNA, 20 bp, Homo sapiens
tttgtaagtgtaaaaaatgt

SEQ ID NO: 948240 - DNA, 13 bp, Homo sapiens
tttgtaagttatt

SEQ ID NO: 948241 - DNA, 17 bp, Homo sapiens
tttgtaatattctgttt

SEQ ID NO: 948242 - DNA, 16 bp, Homo sapiens
tttgtaatattttcca

SEQ ID NO: 948243 - DNA, 20 bp, Homo sapiens
tttgtaatgaattcctagaa

SEQ ID NO: 948244 - DNA, 15 bp, Homo sapiens
tttgtaatgtgtgaa

SEQ ID NO: 948245 - DNA, 18 bp, Homo sapiens
tttgtaattgcttacatt

SEQ ID NO: 948246 - DNA, 13 bp, Homo sapiens
tttgtaattgtgt

SEQ ID NO: 948247 - DNA, 20 bp, Homo sapiens
tttgtacaaggtaattgttt

SEQ ID NO: 948248 - DNA, 21 bp, Homo sapiens
tttgtacaatatgaaaaggat

SEQ ID NO: 948249 - DNA, 16 bp, Homo sapiens
tttgtacaatggttta

SEQ ID NO: 948250 - DNA, 20 bp, Homo sapiens
tttgtacaggggccatgccc

SEQ ID NO: 948251 - DNA, 23 bp, Homo sapiens
tttgtacatactgtatttttact

SEQ ID NO: 948252 - DNA, 19 bp, Homo sapiens
tttgtacatatgtaaaata

SEQ ID NO: 948253 - DNA, 18 bp, Homo sapiens
tttgtacatttgggagtt

SEQ ID NO: 948254 - DNA, 14 bp, Homo sapiens
tttgtaccatggtg

SEQ ID NO: 948255 - DNA, 19 bp, Homo sapiens
tttgtaccattttaaagtt

SEQ ID NO: 948256 - DNA, 15 bp, Homo sapiens
tttgtactgaaaaat

SEQ ID NO: 948257 - DNA, 15 bp, Homo sapiens
tttgtactgaatttt

SEQ ID NO: 948258 - DNA, 15 bp, Homo sapiens
tttgtacttcttatt

SEQ ID NO: 948259 - DNA, 23 bp, Homo sapiens
tttgtacttttctggttccaaac

SEQ ID NO: 948260 - DNA, 16 bp, Homo sapiens
tttgtagaatctcttc

SEQ ID NO: 948261 - DNA, 14 bp, Homo sapiens
tttgtagactgttt

SEQ ID NO: 948262 - DNA, 22 bp, Homo sapiens
tttgtagagagagctgtattaa

SEQ ID NO: 948263 - DNA, 17 bp, Homo sapiens
tttgtagcataactgta

SEQ ID NO: 948264 - DNA, 17 bp, Homo sapiens
tcagaactaactttggt

SEQ ID NO: 948265 - DNA, 13 bp, Homo sapiens
tcagaactgccct

SEQ ID NO: 948266 - DNA, 16 bp, Homo sapiens
tcagaactgcccttgc

SEQ ID NO: 948267 - DNA, 19 bp, Homo sapiens
tcagaactgcccttgctgc

SEQ ID NO: 948268 - DNA, 17 bp, Homo sapiens
tcagaagaaaaagaagc

SEQ ID NO: 948269 - DNA, 16 bp, Homo sapiens
tcagaagaagtgggag

SEQ ID NO: 948270 - DNA, 20 bp, Homo sapiens
tcagaagaagtgggagcagc

SEQ ID NO: 948271 - DNA, 23 bp, Homo sapiens
tcagaagagaaatacagctggct

SEQ ID NO: 948272 - DNA, 17 bp, Homo sapiens
tcagaagagaggggaag

SEQ ID NO: 948273 - DNA, 19 bp, Homo sapiens
tcagaagaggaaatgactc

SEQ ID NO: 948274 - DNA, 13 bp, Homo sapiens
tcagaagatagtc

SEQ ID NO: 948275 - DNA, 15 bp, Homo sapiens
tcagaagatggtgaa

SEQ ID NO: 948276 - DNA, 18 bp, Homo sapiens
tcagaagcacagaatatt

SEQ ID NO: 948277 - DNA, 18 bp, Homo sapiens
tcagaagcaggttcttga

SEQ ID NO: 948278 - DNA, 15 bp, Homo sapiens
tcagaagcctccaag

SEQ ID NO: 948279 - DNA, 15 bp, Homo sapiens
tcagaagcctgaggc

SEQ ID NO: 948280 - DNA, 20 bp, Homo sapiens
tcagaagcctgaggctggga

SEQ ID NO: 948281 - DNA, 15 bp, Homo sapiens
tcagaagctattttt

SEQ ID NO: 948282 - DNA, 12 bp, Homo sapiens
tcagaaggagaa

SEQ ID NO: 948283 - DNA, 22 bp, Homo sapiens
tcagagggtttggaccacatct

SEQ ID NO: 948284 - DNA, 23 bp, Homo sapiens
tcagaggtttacctagagaacag

SEQ ID NO: 948285 - DNA, 24 bp, Homo sapiens
tcagagtaggtgggtaggagccct

SEQ ID NO: 948286 - DNA, 14 bp, Homo sapiens
tcagagtccaggcc

SEQ ID NO: 948287 - DNA, 17 bp, Homo sapiens
tcagagtccaggcccca

SEQ ID NO: 948288 - DNA, 19 bp, Homo sapiens
tcagagtccagtgctctgc

SEQ ID NO: 948289 - DNA, 22 bp, Homo sapiens
tcagagtccagtgctctgcctc

SEQ ID NO: 948290 - DNA, 16 bp, Homo sapiens
tcagagtgaccctcag

SEQ ID NO: 948291 - DNA, 23 bp, Homo sapiens
tcagagtgcaagcccctgctcca

SEQ ID NO: 948292 - DNA, 13 bp, Homo sapiens
tcagagtggagtt

SEQ ID NO: 948293 - DNA, 23 bp, Homo sapiens
tcagagtggagttgaaactgcta

SEQ ID NO: 948294 - DNA, 20 bp, Homo sapiens
tcagagtggcgtgagctgcc

SEQ ID NO: 948295 - DNA, 18 bp, Homo sapiens
tcagagtggctcactggc

SEQ ID NO: 948296 - DNA, 22 bp, Homo sapiens
tcagagtggctcactggctggg

SEQ ID NO: 948297 - DNA, 18 bp, Homo sapiens
tcagagttctgaagaaaa

SEQ ID NO: 948298 - DNA, 21 bp, Homo sapiens
tcagagttgctgcaaacctga

SEQ ID NO: 948299 - DNA, 16 bp, Homo sapiens
tcagagtttgtgtgta

SEQ ID NO: 948300 - DNA, 20 bp, Homo sapiens
tcagagtttgtgtgtatttg

SEQ ID NO: 948301 - DNA, 14 bp, Homo sapiens
tcagataacaactg

SEQ ID NO: 948302 - DNA, 23 bp, Homo sapiens
tcagataattagatgattatata

SEQ ID NO: 948303 - DNA, 19 bp, Homo sapiens
tcagatacagggtgctcct

SEQ ID NO: 948304 - DNA, 17 bp, Homo sapiens
tcagatacatcactgct

SEQ ID NO: 948305 - DNA, 22 bp, Homo sapiens
tcagatacccagtggaattcca

SEQ ID NO: 948306 - DNA, 17 bp, Homo sapiens
tcagatagaatgacagt

SEQ ID NO: 948307 - DNA, 14 bp, Homo sapiens
tcagatataaaaga

SEQ ID NO: 948308 - DNA, 17 bp, Homo sapiens
tcagatataaaagactg

SEQ ID NO: 948309 - DNA, 22 bp, Homo sapiens
tcagatataagagaagtctcat

SEQ ID NO: 948310 - DNA, 20 bp, Homo sapiens
tcagatatagatcctgagct

SEQ ID NO: 948311 - DNA, 18 bp, Homo sapiens
tcagatatatttttcaca

SEQ ID NO: 948312 - DNA, 15 bp, Homo sapiens
tcagatatcaaaatt

SEQ ID NO: 948313 - DNA, 18 bp, Homo sapiens
tcagatattctgctctat

SEQ ID NO: 948314 - DNA, 13 bp, Homo sapiens
tcagatatttata

SEQ ID NO: 948315 - DNA, 22 bp, Homo sapiens
tcagatattttttcagaaatat

SEQ ID NO: 948316 - DNA, 23 bp, Homo sapiens
tcagatattttttcagaaatatg

SEQ ID NO: 948317 - DNA, 22 bp, Homo sapiens
tcagatcaaaatgcctttcagg

SEQ ID NO: 948318 - DNA, 21 bp, Homo sapiens
tcagatcatttcaaaactcat

SEQ ID NO: 948319 - DNA, 22 bp, Homo sapiens
tcagatccccagctttctcctc

SEQ ID NO: 948320 - DNA, 13 bp, Homo sapiens
tcagatcctgtta

SEQ ID NO: 948321 - DNA, 17 bp, Homo sapiens
tcagatcctgttacttg

SEQ ID NO: 948322 - DNA, 18 bp, Homo sapiens
tcagatcggccacagggc

SEQ ID NO: 948323 - DNA, 14 bp, Homo sapiens
tcagatctgaacac

SEQ ID NO: 948324 - DNA, 13 bp, Homo sapiens
tcagatctgaggt

SEQ ID NO: 948325 - DNA, 18 bp, Homo sapiens
tcagatgactctctccaa

SEQ ID NO: 948326 - DNA, 14 bp, Homo sapiens
tcagatgagaacaa

SEQ ID NO: 948327 - DNA, 17 bp, Homo sapiens
tcagatgagaacaaagc

SEQ ID NO: 948328 - DNA, 15 bp, Homo sapiens
tcagatgaggacaga

SEQ ID NO: 948329 - DNA, 20 bp, Homo sapiens
tcagatgatggccatttcta

SEQ ID NO: 948330 - DNA, 18 bp, Homo sapiens
tcagatgatttcccccct

SEQ ID NO: 948331 - DNA, 16 bp, Homo sapiens
tcagatgcagtttgga

SEQ ID NO: 948332 - DNA, 22 bp, Homo sapiens
tcagatgcccagagggcccagg

SEQ ID NO: 948333 - DNA, 20 bp, Homo sapiens
tcagatgcgtgcccagctct

SEQ ID NO: 948334 - DNA, 18 bp, Homo sapiens
tcagatgcgttcgcctct

SEQ ID NO: 948335 - DNA, 13 bp, Homo sapiens
tcagatggaggtt

SEQ ID NO: 948336 - DNA, 15 bp, Homo sapiens
tcagatgggaacagt

SEQ ID NO: 948337 - DNA, 17 bp, Homo sapiens
tcagatgggtctgatat

SEQ ID NO: 948338 - DNA, 13 bp, Homo sapiens
tcagatgtaatgt

SEQ ID NO: 948339 - DNA, 14 bp, Homo sapiens
tcagatgtcttctg

SEQ ID NO: 948340 - DNA, 17 bp, Homo sapiens
tcagatgtcttctgcct

SEQ ID NO: 948341 - DNA, 16 bp, Homo sapiens
tcagatgtgcaataat

SEQ ID NO: 948342 - DNA, 12 bp, Homo sapiens
tcagatgtgcat

SEQ ID NO: 948343 - DNA, 24 bp, Homo sapiens
tcagatgtgttcctccattttctt

SEQ ID NO: 948344 - DNA, 12 bp, Homo sapiens
tcagatgtttga

SEQ ID NO: 948345 - DNA, 17 bp, Homo sapiens
tcagatgttttggtcaa

SEQ ID NO: 948346 - DNA, 16 bp, Homo sapiens
tcagattcaataatga

SEQ ID NO: 948347 - DNA, 18 bp, Homo sapiens
tcagattgactaaataaa

SEQ ID NO: 948348 - DNA, 22 bp, Homo sapiens
tcagattgactaaataaaaagt

SEQ ID NO: 948349 - DNA, 23 bp, Homo sapiens
tcagattgtggaatgttggataa

SEQ ID NO: 948350 - DNA, 23 bp, Homo sapiens
tcagatttccattgtgtggcctg

SEQ ID NO: 948351 - DNA, 15 bp, Homo sapiens
tcagatttctgagga

SEQ ID NO: 948352 - DNA, 13 bp, Homo sapiens
tcagatttctggt

SEQ ID NO: 948353 - DNA, 18 bp, Homo sapiens
tcagattttatattttct

SEQ ID NO: 948354 - DNA, 14 bp, Homo sapiens
tcagattttttaaa

SEQ ID NO: 948355 - DNA, 14 bp, Homo sapiens
tcagattttttcct

SEQ ID NO: 948356 - DNA, 13 bp, Homo sapiens
tcagcaaaaagca

SEQ ID NO: 948357 - DNA, 14 bp, Homo sapiens
tcagcaaaaagcaa

SEQ ID NO: 948358 - DNA, 16 bp, Homo sapiens
tcagcaaaaagcaaaa

SEQ ID NO: 948359 - DNA, 15 bp, Homo sapiens
tcagcaaaagatgct

SEQ ID NO: 948360 - DNA, 15 bp, Homo sapiens
tcagcaaacaggatc

SEQ ID NO: 948361 - DNA, 21 bp, Homo sapiens
tcagcaaacaggatcagttaa

SEQ ID NO: 948362 - DNA, 13 bp, Homo sapiens
tcagcaaaccatt

SEQ ID NO: 948363 - DNA, 15 bp, Homo sapiens
tcagcaaagaaaaaa

SEQ ID NO: 948364 - DNA, 20 bp, Homo sapiens
tcagcaaagctacaggactg

SEQ ID NO: 948365 - DNA, 18 bp, Homo sapiens
tcagcaaatttaagagaa

SEQ ID NO: 948366 - DNA, 23 bp, Homo sapiens
tcagcaacaagactgccaggtgg

SEQ ID NO: 948367 - DNA, 12 bp, Homo sapiens
tcagcaagactt

SEQ ID NO: 948368 - DNA, 21 bp, Homo sapiens
tcagcaagccctacagagctg

SEQ ID NO: 948369 - DNA, 19 bp, Homo sapiens
tcagcaagttagaactagc

SEQ ID NO: 948370 - DNA, 15 bp, Homo sapiens
tcagcaatattgcct

SEQ ID NO: 948371 - DNA, 22 bp, Homo sapiens
tcagcacattcgggaccaatat

SEQ ID NO: 948372 - DNA, 15 bp, Homo sapiens
tcagcaccaccctag

SEQ ID NO: 948373 - DNA, 17 bp, Homo sapiens
tcagcacccccacccac

SEQ ID NO: 948374 - DNA, 19 bp, Homo sapiens
tcagcacccccacccacct

SEQ ID NO: 948375 - DNA, 17 bp, Homo sapiens
tcagcaccccttccatg

SEQ ID NO: 948376 - DNA, 12 bp, Homo sapiens
tcagcaccctgg

SEQ ID NO: 948377 - DNA, 14 bp, Homo sapiens
tcagcaccctgggt

SEQ ID NO: 948378 - DNA, 16 bp, Homo sapiens
tcagcaccctgggtgc

SEQ ID NO: 948379 - DNA, 20 bp, Homo sapiens
tcagcacctacagtgtacag

SEQ ID NO: 948380 - DNA, 21 bp, Homo sapiens
tcagcacctacagtgtacagt

SEQ ID NO: 948381 - DNA, 22 bp, Homo sapiens
tcagcacctacagtgtacagtc

SEQ ID NO: 948382 - DNA, 14 bp, Homo sapiens
tcagcaccttggcc

SEQ ID NO: 948383 - DNA, 20 bp, Homo sapiens
tcagcaccttggcccaggag

SEQ ID NO: 948384 - DNA, 19 bp, Homo sapiens
tcagcactgatggaaaata

SEQ ID NO: 948385 - DNA, 20 bp, Homo sapiens
tcagcactgatttcacaaca

SEQ ID NO: 948386 - DNA, 12 bp, Homo sapiens
tcagcactgtcc

SEQ ID NO: 948387 - DNA, 21 bp, Homo sapiens
tcagcagaacctgcacacagg

SEQ ID NO: 948388 - DNA, 22 bp, Homo sapiens
tcagcagaacctgcacacagga

SEQ ID NO: 948389 - DNA, 18 bp, Homo sapiens
tcagcagcaaattttcag

SEQ ID NO: 948390 - DNA, 18 bp, Homo sapiens
tcagcagccctcctcacc

SEQ ID NO: 948391 - DNA, 13 bp, Homo sapiens
tcagcaggcaggc

SEQ ID NO: 948392 - DNA, 14 bp, Homo sapiens
tcagcaggcaggct

SEQ ID NO: 948393 - DNA, 16 bp, Homo sapiens
tcagcaggcaggctgg

SEQ ID NO: 948394 - DNA, 19 bp, Homo sapiens
tttgttaaccttaaataca

SEQ ID NO: 948395 - DNA, 21 bp, Homo sapiens
tttgttaaccttaaatacact

SEQ ID NO: 948396 - DNA, 12 bp, Homo sapiens
tttgttaattta

SEQ ID NO: 948397 - DNA, 22 bp, Homo sapiens
tttgttaccatactgtctctgg

SEQ ID NO: 948398 - DNA, 10 bp, Homo sapiens
tttgttactg

SEQ ID NO: 948399 - DNA, 16 bp, Homo sapiens
tttgttactgattcaa

SEQ ID NO: 948400 - DNA, 23 bp, Homo sapiens
tttgttactgattcaattataat

SEQ ID NO: 948401 - DNA, 15 bp, Homo sapiens
tttgttactgtttta

SEQ ID NO: 948402 - DNA, 16 bp, Homo sapiens
tttgttactgttttaa

SEQ ID NO: 948403 - DNA, 22 bp, Homo sapiens
tttgttaggattttcacattct

SEQ ID NO: 948404 - DNA, 9 bp, Homo sapiens
ttttaaagt

SEQ ID NO: 948405 - DNA, 14 bp, Homo sapiens
ttttaaagtaaact

SEQ ID NO: 948406 - DNA, 14 bp, Homo sapiens
ttttaaagtgatta

SEQ ID NO: 948407 - DNA, 18 bp, Homo sapiens
ttttaaagttcattgcaa

SEQ ID NO: 948408 - DNA, 15 bp, Homo sapiens
ttttaaataaaagca

SEQ ID NO: 948409 - DNA, 21 bp, Homo sapiens
ttttaaataacctctggccct

SEQ ID NO: 948410 - DNA, 12 bp, Homo sapiens
ttttaaatcatc

SEQ ID NO: 948411 - DNA, 19 bp, Homo sapiens
ttttaaatgattccaaata

SEQ ID NO: 948412 - DNA, 11 bp, Homo sapiens
ttttaaatgca

SEQ ID NO: 948413 - DNA, 12 bp, Homo sapiens
ttttaaatgcac

SEQ ID NO: 948414 - DNA, 21 bp, Homo sapiens
ttttaaatgcacctggaatat

SEQ ID NO: 948415 - DNA, 14 bp, Homo sapiens
ttttaaatgtacag

SEQ ID NO: 948416 - DNA, 23 bp, Homo sapiens
ttttaaattaagacaaaaagcct

SEQ ID NO: 948417 - DNA, 22 bp, Homo sapiens
ttttaaattgtttcatatctgg

SEQ ID NO: 948418 - DNA, 23 bp, Homo sapiens
ttttaaatttcagtcaattctga

SEQ ID NO: 948419 - DNA, 17 bp, Homo sapiens
ttttaaattttgtaatg

SEQ ID NO: 948420 - DNA, 18 bp, Homo sapiens
ttttaaattttgtaatga

SEQ ID NO: 948421 - DNA, 18 bp, Homo sapiens
ttttaacaactgctctta

SEQ ID NO: 948422 - DNA, 21 bp, Homo sapiens
ttttaacaataactactgtgt

SEQ ID NO: 948423 - DNA, 13 bp, Homo sapiens
ttttaacacttaa

SEQ ID NO: 948424 - DNA, 19 bp, Homo sapiens
ttttaacacttaaatttct

SEQ ID NO: 948425 - DNA, 12 bp, Homo sapiens
ttttaacagcat

SEQ ID NO: 948426 - DNA, 15 bp, Homo sapiens
ttttaaccaaaggtg

SEQ ID NO: 948427 - DNA, 16 bp, Homo sapiens
ttttaaccaaaggtga

SEQ ID NO: 948428 - DNA, 21 bp, Homo sapiens
ttttaaccaaaggtgaaggaa

SEQ ID NO: 948429 - DNA, 17 bp, Homo sapiens
ttttaaccatccttaaa

SEQ ID NO: 948430 - DNA, 21 bp, Homo sapiens
ttttaacctgttttgttaatg

SEQ ID NO: 948431 - DNA, 19 bp, Homo sapiens
ttttaactctggattttga

SEQ ID NO: 948432 - DNA, 13 bp, Homo sapiens
ttttaacttcttt

SEQ ID NO: 948433 - DNA, 16 bp, Homo sapiens
ttttaactttaagttt

SEQ ID NO: 948434 - DNA, 16 bp, Homo sapiens
ttttaactttgaaagt

SEQ ID NO: 948435 - DNA, 19 bp, Homo sapiens
ttttaacttttggaatcat

SEQ ID NO: 948436 - DNA, 19 bp, Homo sapiens
ttttaagaaaaattcacaa

SEQ ID NO: 948437 - DNA, 23 bp, Homo sapiens
ttttaagaaagagaatgaactgt

SEQ ID NO: 948438 - DNA, 16 bp, Homo sapiens
ttttaagaagacatga

SEQ ID NO: 948439 - DNA, 13 bp, Homo sapiens
ttttaagagacag

SEQ ID NO: 948440 - DNA, 22 bp, Homo sapiens
ttttaagataaattataagtta

SEQ ID NO: 948441 - DNA, 14 bp, Homo sapiens
ttttaagatagtgt

SEQ ID NO: 948442 - DNA, 23 bp, Homo sapiens
ttttaagcatttgtatattaaaa

SEQ ID NO: 948443 - DNA, 21 bp, Homo sapiens
ttttaagccatctcagattct

SEQ ID NO: 948444 - DNA, 21 bp, Homo sapiens
ttttaagcgtaattttgccaa

SEQ ID NO: 948445 - DNA, 17 bp, Homo sapiens
ttttaagctatcagcaa

SEQ ID NO: 948446 - DNA, 20 bp, Homo sapiens
ttttaagggtttgtggaaaa

SEQ ID NO: 948447 - DNA, 15 bp, Homo sapiens
ttttaagtaacttaa

SEQ ID NO: 948448 - DNA, 21 bp, Homo sapiens
ttttaagtattgcatctgtat

SEQ ID NO: 948449 - DNA, 15 bp, Homo sapiens
ttttaagtatttagg

SEQ ID NO: 948450 - DNA, 17 bp, Homo sapiens
ttttaagtatttatata

SEQ ID NO: 948451 - DNA, 20 bp, Homo sapiens
ttttaagtccagcttggcca

SEQ ID NO: 948452 - DNA, 17 bp, Homo sapiens
ttttaagtgcttacatt

SEQ ID NO: 948453 - DNA, 23 bp, Homo sapiens
ttttaagttaatagattttttca

SEQ ID NO: 948454 - DNA, 21 bp, Homo sapiens
ttttaagttacacatttttca

SEQ ID NO: 948455 - DNA, 16 bp, Homo sapiens
ttttaagtttgaaact

SEQ ID NO: 948456 - DNA, 14 bp, Homo sapiens
ttttaagtttttca

SEQ ID NO: 948457 - DNA, 12 bp, Homo sapiens
ttttaataaact

SEQ ID NO: 948458 - DNA, 19 bp, Homo sapiens
ttttaataaactgcagggt

SEQ ID NO: 948459 - DNA, 14 bp, Homo sapiens
ttttaataaacttt

SEQ ID NO: 948460 - DNA, 18 bp, Homo sapiens
ttttaataaccacaaaca

SEQ ID NO: 948461 - DNA, 19 bp, Homo sapiens
ttttaataccacagctatt

SEQ ID NO: 948462 - DNA, 18 bp, Homo sapiens
ttttaatagaataaaata

SEQ ID NO: 948463 - DNA, 21 bp, Homo sapiens
ttttaatagaatataattatc

SEQ ID NO: 948464 - DNA, 23 bp, Homo sapiens
ttttaatattaacttttaatggt

SEQ ID NO: 948465 - DNA, 18 bp, Homo sapiens
ttttaatattcttttgtt

SEQ ID NO: 948466 - DNA, 22 bp, Homo sapiens
ttttaatattcttttgtttcca

SEQ ID NO: 948467 - DNA, 22 bp, Homo sapiens
ttttaatcagacaaagtaattc

SEQ ID NO: 948468 - DNA, 15 bp, Homo sapiens
ttttaatgaaaagga

SEQ ID NO: 948469 - DNA, 13 bp, Homo sapiens
ttttaatgaattt

SEQ ID NO: 948470 - DNA, 19 bp, Homo sapiens
ttttaatgatggtgttaaa

SEQ ID NO: 948471 - DNA, 13 bp, Homo sapiens
ttttaatggaaag

SEQ ID NO: 948472 - DNA, 13 bp, Homo sapiens
ttttaatggttaa

SEQ ID NO: 948473 - DNA, 20 bp, Homo sapiens
ttttaatgtatatttgctgc

SEQ ID NO: 948474 - DNA, 22 bp, Homo sapiens
ttttaatgtatatttgctgcaa

SEQ ID NO: 948475 - DNA, 14 bp, Homo sapiens
ttttaatgtatcta

SEQ ID NO: 948476 - DNA, 12 bp, Homo sapiens
ttttaatgtgaa

SEQ ID NO: 948477 - DNA, 14 bp, Homo sapiens
ttttaatgtgaaga

SEQ ID NO: 948478 - DNA, 19 bp, Homo sapiens
ttttaattaaaaactttaa

SEQ ID NO: 948479 - DNA, 16 bp, Homo sapiens
ttttaattaagcagaa

SEQ ID NO: 948480 - DNA, 17 bp, Homo sapiens
ttttaattattattctt

SEQ ID NO: 948481 - DNA, 23 bp, Homo sapiens
ttttaattattatttatatatgt

SEQ ID NO: 948482 - DNA, 18 bp, Homo sapiens
ttttaattattttaaaat

SEQ ID NO: 948483 - DNA, 22 bp, Homo sapiens
ttttaattccaatatgatgact

SEQ ID NO: 948484 - DNA, 19 bp, Homo sapiens
ttttaattgaaaagaagta

SEQ ID NO: 948485 - DNA, 23 bp, Homo sapiens
ttttaatttatgagtttttgata

SEQ ID NO: 948486 - DNA, 21 bp, Homo sapiens
ttttaatttatttatactatt

SEQ ID NO: 948487 - DNA, 21 bp, Homo sapiens
ttttaatttatttcatccagt

SEQ ID NO: 948488 - DNA, 15 bp, Homo sapiens
ttttaatttatttgt

SEQ ID NO: 948489 - DNA, 11 bp, Homo sapiens
ttttaatttca

SEQ ID NO: 948490 - DNA, 21 bp, Homo sapiens
ttttaatttcaggaaaatgta

SEQ ID NO: 948491 - DNA, 12 bp, Homo sapiens
ttttaatttcca

SEQ ID NO: 948492 - DNA, 14 bp, Homo sapiens
ttttaattttaacc

SEQ ID NO: 948493 - DNA, 23 bp, Homo sapiens
ttttaattttgatatacattgtg

SEQ ID NO: 948494 - DNA, 12 bp, Homo sapiens
ttttacaaagcc

SEQ ID NO: 948495 - DNA, 17 bp, Homo sapiens
ttttacaagaagtttat

SEQ ID NO: 948496 - DNA, 17 bp, Homo sapiens
ttttacaagtaacaaaa

SEQ ID NO: 948497 - DNA, 20 bp, Homo sapiens
ttttacaagtataacagttt

SEQ ID NO: 948498 - DNA, 20 bp, Homo sapiens
ttttacaatctgtatctttg

SEQ ID NO: 948499 - DNA, 16 bp, Homo sapiens
ttttacaattgaaatg

SEQ ID NO: 948500 - DNA, 22 bp, Homo sapiens
ttttacactattgtgaatattt

SEQ ID NO: 948501 - DNA, 22 bp, Homo sapiens
ttttacagaatgcattaaaaaa

SEQ ID NO: 948502 - DNA, 23 bp, Homo sapiens
ttttacagttagggttttgcaat

SEQ ID NO: 948503 - DNA, 23 bp, Homo sapiens
ttttacatgctggttacctgttc

SEQ ID NO: 948504 - DNA, 15 bp, Homo sapiens
ttttacatggagaaa

SEQ ID NO: 948505 - DNA, 18 bp, Homo sapiens
ttttacatgtttataaat

SEQ ID NO: 948506 - DNA, 21 bp, Homo sapiens
ttttacattatgcaaataaaa

SEQ ID NO: 948507 - DNA, 13 bp, Homo sapiens
ttttacattctgt

SEQ ID NO: 948508 - DNA, 17 bp, Homo sapiens
ttttacatttagagtat

SEQ ID NO: 948509 - DNA, 17 bp, Homo sapiens
ttttaccaaagcatcaa

SEQ ID NO: 948510 - DNA, 12 bp, Homo sapiens
ttttaccaactt

SEQ ID NO: 948511 - DNA, 18 bp, Homo sapiens
ttttaccaataaactgag

SEQ ID NO: 948512 - DNA, 16 bp, Homo sapiens
ttttaccataatctta

SEQ ID NO: 948513 - DNA, 23 bp, Homo sapiens
ttttaccatcacacatgttcaga

SEQ ID NO: 948514 - DNA, 17 bp, Homo sapiens
ttttacccctgcacagt

SEQ ID NO: 948515 - DNA, 18 bp, Homo sapiens
ttttaccctgtgtcagag

SEQ ID NO: 948516 - DNA, 21 bp, Homo sapiens
ttttaccctgtgtcagagcct

SEQ ID NO: 948517 - DNA, 19 bp, Homo sapiens
ttttacctaccacagtgtc

SEQ ID NO: 948518 - DNA, 20 bp, Homo sapiens
ttttacctaccacagtgtct

SEQ ID NO: 948519 - DNA, 21 bp, Homo sapiens
ttttacctaccacagtgtctg

SEQ ID NO: 948520 - DNA, 16 bp, Homo sapiens
ttttacctctctctgg

SEQ ID NO: 948521 - DNA, 15 bp, Homo sapiens
ttttacgtgcaaaca

SEQ ID NO: 948522 - DNA, 23 bp, Homo sapiens
ttttacgtgcaaacaacctgaat

SEQ ID NO: 948523 - DNA, 15 bp, Homo sapiens
ttttactattgaact

SEQ ID NO: 948524 - DNA, 21 bp, Homo sapiens
tcagctcatttaatcccagga

SEQ ID NO: 948525 - DNA, 22 bp, Homo sapiens
tcagctccagggaatccaagcc

SEQ ID NO: 948526 - DNA, 20 bp, Homo sapiens
tcagctccccggcactgcag

SEQ ID NO: 948527 - DNA, 21 bp, Homo sapiens
tcagctccccggcactgcagt

SEQ ID NO: 948528 - DNA, 14 bp, Homo sapiens
tcagctcctgagta

SEQ ID NO: 948529 - DNA, 19 bp, Homo sapiens
tcagctcctgagtagctgg

SEQ ID NO: 948530 - DNA, 14 bp, Homo sapiens
tcagctccttcctg

SEQ ID NO: 948531 - DNA, 16 bp, Homo sapiens
tcagctccttcctgga

SEQ ID NO: 948532 - DNA, 14 bp, Homo sapiens
tcagctctctgctg

SEQ ID NO: 948533 - DNA, 16 bp, Homo sapiens
tcagctctctgctggg

SEQ ID NO: 948534 - DNA, 17 bp, Homo sapiens
tcagctctctgctgggt

SEQ ID NO: 948535 - DNA, 22 bp, Homo sapiens
tcagctctgacattctgattcg

SEQ ID NO: 948536 - DNA, 12 bp, Homo sapiens
tcagctctggga

SEQ ID NO: 948537 - DNA, 12 bp, Homo sapiens
tcagctcttcca

SEQ ID NO: 948538 - DNA, 16 bp, Homo sapiens
tcagctgaaattatat

SEQ ID NO: 948539 - DNA, 20 bp, Homo sapiens
tcagctgcaaggtactctgg

SEQ ID NO: 948540 - DNA, 22 bp, Homo sapiens
tcagctgcacattcctggcccc

SEQ ID NO: 948541 - DNA, 18 bp, Homo sapiens
tcagctgcattccgcagc

SEQ ID NO: 948542 - DNA, 19 bp, Homo sapiens
tcagctgccacaacaccag

SEQ ID NO: 948543 - DNA, 16 bp, Homo sapiens
tcagctgccccacagg

SEQ ID NO: 948544 - DNA, 13 bp, Homo sapiens
tcagctgctccca

SEQ ID NO: 948545 - DNA, 19 bp, Homo sapiens
tcagctgctccctggcatt

SEQ ID NO: 948546 - DNA, 21 bp, Homo sapiens
tcagctgctgactggcagggc

SEQ ID NO: 948547 - DNA, 12 bp, Homo sapiens
tcagctgcttct

SEQ ID NO: 948548 - DNA, 21 bp, Homo sapiens
tcagctggctgagacactgaa

SEQ ID NO: 948549 - DNA, 16 bp, Homo sapiens
tcagctgggagccagt

SEQ ID NO: 948550 - DNA, 18 bp, Homo sapiens
tcagctgggagccagtgt

SEQ ID NO: 948551 - DNA, 12 bp, Homo sapiens
tcagctgtcacc

SEQ ID NO: 948552 - DNA, 18 bp, Homo sapiens
tcagctgtcacctgctca

SEQ ID NO: 948553 - DNA, 21 bp, Homo sapiens
tcagctgtcacctgctcacag

SEQ ID NO: 948554 - DNA, 17 bp, Homo sapiens
tcagctgtcctgcagca

SEQ ID NO: 948555 - DNA, 18 bp, Homo sapiens
tcagctgtcctgcagcaa

SEQ ID NO: 948556 - DNA, 16 bp, Homo sapiens
tcagctgtttgtcata

SEQ ID NO: 948557 - DNA, 16 bp, Homo sapiens
tcagcttaattctcct

SEQ ID NO: 948558 - DNA, 22 bp, Homo sapiens
tcagcttacatccctgagcagg

SEQ ID NO: 948559 - DNA, 16 bp, Homo sapiens
tcagcttataatgaaa

SEQ ID NO: 948560 - DNA, 22 bp, Homo sapiens
tcagcttatgggatccttgtct

SEQ ID NO: 948561 - DNA, 23 bp, Homo sapiens
tcagcttcagaatggcattgtac

SEQ ID NO: 948562 - DNA, 16 bp, Homo sapiens
tcagcttcatttgtgt

SEQ ID NO: 948563 - DNA, 21 bp, Homo sapiens
tcagcttcatttgtgtcaatg

SEQ ID NO: 948564 - DNA, 18 bp, Homo sapiens
tcagcttgggcttcttcc

SEQ ID NO: 948565 - DNA, 16 bp, Homo sapiens
tcagctttcagagcca

SEQ ID NO: 948566 - DNA, 18 bp, Homo sapiens
tcagctttcagagccagt

SEQ ID NO: 948567 - DNA, 16 bp, Homo sapiens
tcagctttgccttcca

SEQ ID NO: 948568 - DNA, 18 bp, Homo sapiens
tcagcttttgttctagac

SEQ ID NO: 948569 - DNA, 19 bp, Homo sapiens
tcagcttttgttctagact

SEQ ID NO: 948570 - DNA, 18 bp, Homo sapiens
tcagcttttgttgtttat

SEQ ID NO: 948571 - DNA, 22 bp, Homo sapiens
tcaggaaaactgacagaggagg

SEQ ID NO: 948572 - DNA, 15 bp, Homo sapiens
tcaggaaaaggttga

SEQ ID NO: 948573 - DNA, 21 bp, Homo sapiens
tcaggaaaatgtattgattca

SEQ ID NO: 948574 - DNA, 18 bp, Homo sapiens
tcaggaaaattgaatgca

SEQ ID NO: 948575 - DNA, 18 bp, Homo sapiens
tcaggaaatatatatgtg

SEQ ID NO: 948576 - DNA, 19 bp, Homo sapiens
tcaggaaatatatatgtgt

SEQ ID NO: 948577 - DNA, 20 bp, Homo sapiens
tcaggaaatatatatgtgtg

SEQ ID NO: 948578 - DNA, 18 bp, Homo sapiens
tcaggaacaagtaatgta

SEQ ID NO: 948579 - DNA, 14 bp, Homo sapiens
tcaggaacagaagg

SEQ ID NO: 948580 - DNA, 17 bp, Homo sapiens
tcaggaacagtggctgg

SEQ ID NO: 948581 - DNA, 15 bp, Homo sapiens
tcaggaaccagggcc

SEQ ID NO: 948582 - DNA, 16 bp, Homo sapiens
tcaggaaccagggcct

SEQ ID NO: 948583 - DNA, 18 bp, Homo sapiens
tcaggaaccagggcctcc

SEQ ID NO: 948584 - DNA, 19 bp, Homo sapiens
tcaggaaccagggcctccc

SEQ ID NO: 948585 - DNA, 23 bp, Homo sapiens
tcaggaaccagggcctccctgtt

SEQ ID NO: 948586 - DNA, 23 bp, Homo sapiens
tcaggaagagctatggcccagaa

SEQ ID NO: 948587 - DNA, 13 bp, Homo sapiens
tcaggaaggacat

SEQ ID NO: 948588 - DNA, 20 bp, Homo sapiens
tcaggaatttaaaattaagt

SEQ ID NO: 948589 - DNA, 23 bp, Homo sapiens
tcaggaccaaaaaacctcactgg

SEQ ID NO: 948590 - DNA, 19 bp, Homo sapiens
tcaggacccagaggaaggg

SEQ ID NO: 948591 - DNA, 13 bp, Homo sapiens
tcaggacccaggc

SEQ ID NO: 948592 - DNA, 14 bp, Homo sapiens
tcaggacccaggcc

SEQ ID NO: 948593 - DNA, 15 bp, Homo sapiens
tcaggacccaggccc

SEQ ID NO: 948594 - DNA, 17 bp, Homo sapiens
tcaggacctgggacctc

SEQ ID NO: 948595 - DNA, 17 bp, Homo sapiens
tcaggacggctcctcag

SEQ ID NO: 948596 - DNA, 19 bp, Homo sapiens
tcaggacggctcctcagag

SEQ ID NO: 948597 - DNA, 23 bp, Homo sapiens
tcaggagagggatacaagagagg

SEQ ID NO: 948598 - DNA, 18 bp, Homo sapiens
tcaggagaggggcagaac

SEQ ID NO: 948599 - DNA, 20 bp, Homo sapiens
tcaggagagtgtgcaactgg

SEQ ID NO: 948600 - DNA, 23 bp, Homo sapiens
tcaggagatggagggcttggccc

SEQ ID NO: 948601 - DNA, 11 bp, Homo sapiens
tcaggagcccc

SEQ ID NO: 948602 - DNA, 23 bp, Homo sapiens
tcaggagcccccaacacaggcaa

SEQ ID NO: 948603 - DNA, 21 bp, Homo sapiens
tcaggagcttgggcagtgccc

SEQ ID NO: 948604 - DNA, 18 bp, Homo sapiens
tcaggaggaggctgccct

SEQ ID NO: 948605 - DNA, 18 bp, Homo sapiens
tcaggaggccctggtgtc

SEQ ID NO: 948606 - DNA, 12 bp, Homo sapiens
tcaggaggcgcc

SEQ ID NO: 948607 - DNA, 20 bp, Homo sapiens
tcaggaggctgaggcagaag

SEQ ID NO: 948608 - DNA, 18 bp, Homo sapiens
tcaggaggctgaggcagg

SEQ ID NO: 948609 - DNA, 13 bp, Homo sapiens
tcaggaggctgga

SEQ ID NO: 948610 - DNA, 14 bp, Homo sapiens
tcaggaggctggag

SEQ ID NO: 948611 - DNA, 20 bp, Homo sapiens
tcaggagggtgacgcccagc

SEQ ID NO: 948612 - DNA, 14 bp, Homo sapiens
tcaggagtctgcca

SEQ ID NO: 948613 - DNA, 15 bp, Homo sapiens
tcaggagtctgccac

SEQ ID NO: 948614 - DNA, 19 bp, Homo sapiens
tcaggagtctgccacttgt

SEQ ID NO: 948615 - DNA, 12 bp, Homo sapiens
tcaggagttcct

SEQ ID NO: 948616 - DNA, 19 bp, Homo sapiens
tcaggagttttactgcctg

SEQ ID NO: 948617 - DNA, 15 bp, Homo sapiens
tcaggatacatgtgc

SEQ ID NO: 948618 - DNA, 22 bp, Homo sapiens
tcaggatattggttcttcccct

SEQ ID NO: 948619 - DNA, 17 bp, Homo sapiens
tcaggatccagtgacat

SEQ ID NO: 948620 - DNA, 17 bp, Homo sapiens
tcaggatgcacatttct

SEQ ID NO: 948621 - DNA, 22 bp, Homo sapiens
tcaggatgggccaaacccagac

SEQ ID NO: 948622 - DNA, 23 bp, Homo sapiens
tcaggattgtctggttaaatagt

SEQ ID NO: 948623 - DNA, 16 bp, Homo sapiens
tcaggatttaaaaact

SEQ ID NO: 948624 - DNA, 20 bp, Homo sapiens
tcaggatttaaaaactggaa

SEQ ID NO: 948625 - DNA, 21 bp, Homo sapiens
tcaggatttcaccagaagtta

SEQ ID NO: 948626 - DNA, 15 bp, Homo sapiens
tcaggcaaagtgctt

SEQ ID NO: 948627 - DNA, 23 bp, Homo sapiens
tcaggcacccggggccagagaca

SEQ ID NO: 948628 - DNA, 16 bp, Homo sapiens
tcaggcactggtggca

SEQ ID NO: 948629 - DNA, 20 bp, Homo sapiens
tcaggcagacaagagctgct

SEQ ID NO: 948630 - DNA, 22 bp, Homo sapiens
tcaggcagacaagagctgctgt

SEQ ID NO: 948631 - DNA, 23 bp, Homo sapiens
tcaggcagacaagagctgctgtc

SEQ ID NO: 948632 - DNA, 13 bp, Homo sapiens
tcaggcagaggca

SEQ ID NO: 948633 - DNA, 18 bp, Homo sapiens
tcaggcagcaccacactg

SEQ ID NO: 948634 - DNA, 22 bp, Homo sapiens
tcaggcagcaccacactgggtg

SEQ ID NO: 948635 - DNA, 12 bp, Homo sapiens
tcaggcagccag

SEQ ID NO: 948636 - DNA, 23 bp, Homo sapiens
tcaggcaggcgggccggggcagg

SEQ ID NO: 948637 - DNA, 15 bp, Homo sapiens
tcaggcataggcctg

SEQ ID NO: 948638 - DNA, 20 bp, Homo sapiens
tcaggcataggcctgggtgc

SEQ ID NO: 948639 - DNA, 12 bp, Homo sapiens
tcaggcatggct

SEQ ID NO: 948640 - DNA, 12 bp, Homo sapiens
tcaggccagccc

SEQ ID NO: 948641 - DNA, 13 bp, Homo sapiens
tcaggccagccca

SEQ ID NO: 948642 - DNA, 16 bp, Homo sapiens
tcaggccagcccagcc

SEQ ID NO: 948643 - DNA, 18 bp, Homo sapiens
tcaggccagcccagccag

SEQ ID NO: 948644 - DNA, 12 bp, Homo sapiens
tcaggccagggc

SEQ ID NO: 948645 - DNA, 11 bp, Homo sapiens
tcaggccaggt

SEQ ID NO: 948646 - DNA, 18 bp, Homo sapiens
ttttcctgcatgttctgt

SEQ ID NO: 948647 - DNA, 16 bp, Homo sapiens
ttttcctggcagctgc

SEQ ID NO: 948648 - DNA, 18 bp, Homo sapiens
ttttccttaagagctatt

SEQ ID NO: 948649 - DNA, 19 bp, Homo sapiens
ttttccttcctttttattc

SEQ ID NO: 948650 - DNA, 15 bp, Homo sapiens
ttttccttcttcagc

SEQ ID NO: 948651 - DNA, 15 bp, Homo sapiens
ttttcctttggactg

SEQ ID NO: 948652 - DNA, 16 bp, Homo sapiens
ttttccttttcttaaa

SEQ ID NO: 948653 - DNA, 20 bp, Homo sapiens
tgtagcacgctgcctgccaa

SEQ ID NO: 948654 - DNA, 12 bp, Homo sapiens
tgtagcacttac

SEQ ID NO: 948655 - DNA, 15 bp, Homo sapiens
tgtagcacttactgg

SEQ ID NO: 948656 - DNA, 12 bp, Homo sapiens
tgtagcagaaag

SEQ ID NO: 948657 - DNA, 23 bp, Homo sapiens
tgtagcagtgagaaaaagctcct

SEQ ID NO: 948658 - DNA, 16 bp, Homo sapiens
tgtagcatcttcctct

SEQ ID NO: 948659 - DNA, 18 bp, Homo sapiens
tgtagcatcttcctctgc

SEQ ID NO: 948660 - DNA, 19 bp, Homo sapiens
tgtagcatcttcctctgca

SEQ ID NO: 948661 - DNA, 14 bp, Homo sapiens
tgtagcatgttcta

SEQ ID NO: 948662 - DNA, 12 bp, Homo sapiens
tgtagcattgtt

SEQ ID NO: 948663 - DNA, 15 bp, Homo sapiens
tgtagcattgttcca

SEQ ID NO: 948664 - DNA, 14 bp, Homo sapiens
tgtagcattttcct

SEQ ID NO: 948665 - DNA, 19 bp, Homo sapiens
tgtagcattttcctgttta

SEQ ID NO: 948666 - DNA, 10 bp, Homo sapiens
tgtagccaag

SEQ ID NO: 948667 - DNA, 16 bp, Homo sapiens
tgtagccacagctgct

SEQ ID NO: 948668 - DNA, 20 bp, Homo sapiens
tgtagccaggtactgcattc

SEQ ID NO: 948669 - DNA, 14 bp, Homo sapiens
tgtagcccacactt

SEQ ID NO: 948670 - DNA, 23 bp, Homo sapiens
tgtagcccatccttccctttgga

SEQ ID NO: 948671 - DNA, 18 bp, Homo sapiens
tgtagccccctggcctct

SEQ ID NO: 948672 - DNA, 18 bp, Homo sapiens
tgtagcctaaagggcagg

SEQ ID NO: 948673 - DNA, 23 bp, Homo sapiens
tgtagcctcaatcgagtgagaca

SEQ ID NO: 948674 - DNA, 14 bp, Homo sapiens
tgtagcctcctttg

SEQ ID NO: 948675 - DNA, 23 bp, Homo sapiens
tgtagcctggatattattcttgt

SEQ ID NO: 948676 - DNA, 13 bp, Homo sapiens
tgtagcctttttg

SEQ ID NO: 948677 - DNA, 17 bp, Homo sapiens
tgtagcgaccccagact

SEQ ID NO: 948678 - DNA, 18 bp, Homo sapiens
tgtagcgaccccagactg

SEQ ID NO: 948679 - DNA, 16 bp, Homo sapiens
tgtagcgtcctgagga

SEQ ID NO: 948680 - DNA, 18 bp, Homo sapiens
tgtagcgtcctgaggaat

SEQ ID NO: 948681 - DNA, 23 bp, Homo sapiens
tgtagctattagcggctcctcgc

SEQ ID NO: 948682 - DNA, 15 bp, Homo sapiens
tgtagctatttttct

SEQ ID NO: 948683 - DNA, 11 bp, Homo sapiens
tgtagctcagt

SEQ ID NO: 948684 - DNA, 22 bp, Homo sapiens
tgtagctcagtcatcaaagcag

SEQ ID NO: 948685 - DNA, 23 bp, Homo sapiens
tgtagctcccctgctgaggcagt

SEQ ID NO: 948686 - DNA, 19 bp, Homo sapiens
tgtagctgaaaataaaatg

SEQ ID NO: 948687 - DNA, 13 bp, Homo sapiens
tgtagctgaagca

SEQ ID NO: 948688 - DNA, 15 bp, Homo sapiens
tgtagctgagctgtg

SEQ ID NO: 948689 - DNA, 21 bp, Homo sapiens
tgtagctgtaagggcagtgcc

SEQ ID NO: 948690 - DNA, 20 bp, Homo sapiens
tgtagctgtgtggctttcct

SEQ ID NO: 948691 - DNA, 13 bp, Homo sapiens
tgtagcttccacc

SEQ ID NO: 948692 - DNA, 20 bp, Homo sapiens
tgtagctttaaaaccacagc

SEQ ID NO: 948693 - DNA, 15 bp, Homo sapiens
tgtagctttatcctt

SEQ ID NO: 948694 - DNA, 22 bp, Homo sapiens
tgtagcttttggggagggaggg

SEQ ID NO: 948695 - DNA, 18 bp, Homo sapiens
tgtaggaaggttaatgtt

SEQ ID NO: 948696 - DNA, 20 bp, Homo sapiens
tgtaggaaggttaatgttca

SEQ ID NO: 948697 - DNA, 16 bp, Homo sapiens
tgtaggaatctgcctt

SEQ ID NO: 948698 - DNA, 18 bp, Homo sapiens
tgtaggaatctgccttcc

SEQ ID NO: 948699 - DNA, 20 bp, Homo sapiens
tgtaggaattcttttgggga

SEQ ID NO: 948700 - DNA, 14 bp, Homo sapiens
tgtaggatctactt

SEQ ID NO: 948701 - DNA, 18 bp, Homo sapiens
tgtaggcacagagctgca

SEQ ID NO: 948702 - DNA, 17 bp, Homo sapiens
tgtaggcacttttattt

SEQ ID NO: 948703 - DNA, 22 bp, Homo sapiens
tgtaggcacttttattttcatt

SEQ ID NO: 948704 - DNA, 13 bp, Homo sapiens
tgtaggcagacac

SEQ ID NO: 948705 - DNA, 14 bp, Homo sapiens
tgtaggcagacaca

SEQ ID NO: 948706 - DNA, 15 bp, Homo sapiens
tgtaggcagacacag

SEQ ID NO: 948707 - DNA, 23 bp, Homo sapiens
tgtaggccaccattataatttat

SEQ ID NO: 948708 - DNA, 13 bp, Homo sapiens
tgtaggctgtggg

SEQ ID NO: 948709 - DNA, 14 bp, Homo sapiens
tgtaggctgtgggg

SEQ ID NO: 948710 - DNA, 17 bp, Homo sapiens
tgtaggctgttcccttt

SEQ ID NO: 948711 - DNA, 12 bp, Homo sapiens
tgtagggaactc

SEQ ID NO: 948712 - DNA, 22 bp, Homo sapiens
tgtagggcaagggtgcctcagg

SEQ ID NO: 948713 - DNA, 15 bp, Homo sapiens
tgtagggctggacct

SEQ ID NO: 948714 - DNA, 16 bp, Homo sapiens
tgtagggctggaccta

SEQ ID NO: 948715 - DNA, 17 bp, Homo sapiens
tgtaggggccacctcct

SEQ ID NO: 948716 - DNA, 19 bp, Homo sapiens
tgtaggggccacctcctcc

SEQ ID NO: 948717 - DNA, 22 bp, Homo sapiens
tgtaggggccacctcctccccc

SEQ ID NO: 948718 - DNA, 15 bp, Homo sapiens
tgtagggggccttgc

SEQ ID NO: 948719 - DNA, 15 bp, Homo sapiens
tgtaggtcaggacca

SEQ ID NO: 948720 - DNA, 20 bp, Homo sapiens
tgtaggtcaggaccatcaga

SEQ ID NO: 948721 - DNA, 12 bp, Homo sapiens
tgtaggtgactt

SEQ ID NO: 948722 - DNA, 18 bp, Homo sapiens
tgtaggtgagcctgggca

SEQ ID NO: 948723 - DNA, 19 bp, Homo sapiens
tgtaggtgagcctgggcag

SEQ ID NO: 948724 - DNA, 14 bp, Homo sapiens
tgtaggtgtctctg

SEQ ID NO: 948725 - DNA, 16 bp, Homo sapiens
tgtaggtgtctctggg

SEQ ID NO: 948726 - DNA, 17 bp, Homo sapiens
tgtaggtgtctctgggc

SEQ ID NO: 948727 - DNA, 17 bp, Homo sapiens
gtgctgtgggcagcacc

SEQ ID NO: 948728 - DNA, 19 bp, Homo sapiens
gtgctgtgggcagcaccct

SEQ ID NO: 948729 - DNA, 14 bp, Homo sapiens
gtgctgtgggcctc

SEQ ID NO: 948730 - DNA, 13 bp, Homo sapiens
gtgctgtttaagc

SEQ ID NO: 948731 - DNA, 17 bp, Homo sapiens
gtgctgtttgaaaataa

SEQ ID NO: 948732 - DNA, 22 bp, Homo sapiens
gtgcttaagcagaagcattaac

SEQ ID NO: 948733 - DNA, 15 bp, Homo sapiens
gtgcttagttggctt

SEQ ID NO: 948734 - DNA, 21 bp, Homo sapiens
gtgcttatcccatagccagga

SEQ ID NO: 948735 - DNA, 20 bp, Homo sapiens
gtgcttcccccacccctcca

SEQ ID NO: 948736 - DNA, 20 bp, Homo sapiens
gtgcttcgactactgctcct

SEQ ID NO: 948737 - DNA, 14 bp, Homo sapiens
gtgcttctggaaac

SEQ ID NO: 948738 - DNA, 18 bp, Homo sapiens
gtgcttgaaggccctgct

SEQ ID NO: 948739 - DNA, 20 bp, Homo sapiens
gtgcttgaaggccctgctga

SEQ ID NO: 948740 - DNA, 16 bp, Homo sapiens
gtgcttgaatgtgagt

SEQ ID NO: 948741 - DNA, 15 bp, Homo sapiens
gtgcttgactctcac

SEQ ID NO: 948742 - DNA, 16 bp, Homo sapiens
gtgcttgactctcact

SEQ ID NO: 948743 - DNA, 21 bp, Homo sapiens
gtgcttgcatcctatttggtg

SEQ ID NO: 948744 - DNA, 23 bp, Homo sapiens
gtgcttgcttagagtgcccagca

SEQ ID NO: 948745 - DNA, 11 bp, Homo sapiens
gtgcttggatt

SEQ ID NO: 948746 - DNA, 13 bp, Homo sapiens
gtgcttgggctcc

SEQ ID NO: 948747 - DNA, 21 bp, Homo sapiens
gtgcttgggtggtgggtgctg

SEQ ID NO: 948748 - DNA, 19 bp, Homo sapiens
gtgcttgtcattccagagt

SEQ ID NO: 948749 - DNA, 21 bp, Homo sapiens
gtgcttgttagagagaaagag

SEQ ID NO: 948750 - DNA, 22 bp, Homo sapiens
gtgcttgttagagagaaagaga

SEQ ID NO: 948751 - DNA, 21 bp, Homo sapiens
gtgctttattgaattagaaaa

SEQ ID NO: 948752 - DNA, 12 bp, Homo sapiens
gtgctttctgca

SEQ ID NO: 948753 - DNA, 13 bp, Homo sapiens
gtgctttctgcat

SEQ ID NO: 948754 - DNA, 18 bp, Homo sapiens
gtgcttttatagaggcta

SEQ ID NO: 948755 - DNA, 19 bp, Homo sapiens
gtgcttttatagaggctag

SEQ ID NO: 948756 - DNA, 17 bp, Homo sapiens
gtgcttttcctatttgt

SEQ ID NO: 948757 - DNA, 13 bp, Homo sapiens
gtgcttttctgtt

SEQ ID NO: 948758 - DNA, 16 bp, Homo sapiens
gtgctttttccttttc

SEQ ID NO: 948759 - DNA, 20 bp, Homo sapiens
gtgctttttccttttcatct

SEQ ID NO: 948760 - DNA, 16 bp, Homo sapiens
gtgctttttttgtgtg

SEQ ID NO: 948761 - DNA, 20 bp, Homo sapiens
gtggaaaagaatccctgcag

SEQ ID NO: 948762 - DNA, 15 bp, Homo sapiens
gtggaaaaggaaaac

SEQ ID NO: 948763 - DNA, 22 bp, Homo sapiens
gtggaaagataataaattgatt

SEQ ID NO: 948764 - DNA, 19 bp, Homo sapiens
gtggaaagtgaatttgaat

SEQ ID NO: 948765 - DNA, 20 bp, Homo sapiens
gtggaaattaagaagaaact

SEQ ID NO: 948766 - DNA, 20 bp, Homo sapiens
gtggaaattaagactttatg

SEQ ID NO: 948767 - DNA, 16 bp, Homo sapiens
gtggaacatctataga

SEQ ID NO: 948768 - DNA, 15 bp, Homo sapiens
gtggaacctctgtct

SEQ ID NO: 948769 - DNA, 16 bp, Homo sapiens
gtggaacgaaaatgaa

SEQ ID NO: 948770 - DNA, 16 bp, Homo sapiens
gtggaactaataaata

SEQ ID NO: 948771 - DNA, 18 bp, Homo sapiens
gtggaagaagggagaaga

SEQ ID NO: 948772 - DNA, 15 bp, Homo sapiens
gtggaagagcagcct

SEQ ID NO: 948773 - DNA, 17 bp, Homo sapiens
gtggaaggcagagaaat

SEQ ID NO: 948774 - DNA, 19 bp, Homo sapiens
gtggaaggcctccctctgt

SEQ ID NO: 948775 - DNA, 19 bp, Homo sapiens
tgtataattaacttaactg

SEQ ID NO: 948776 - DNA, 20 bp, Homo sapiens
tgtataattcaaagcaccaa

SEQ ID NO: 948777 - DNA, 18 bp, Homo sapiens
tgtataattggatttcct

SEQ ID NO: 948778 - DNA, 16 bp, Homo sapiens
tgtatacaaccctggc

SEQ ID NO: 948779 - DNA, 18 bp, Homo sapiens
tgtatacaagtactggta

SEQ ID NO: 948780 - DNA, 23 bp, Homo sapiens
tgtatacacacatatacatatat

SEQ ID NO: 948781 - DNA, 17 bp, Homo sapiens
tgtatacatgtgtgggt

SEQ ID NO: 948782 - DNA, 22 bp, Homo sapiens
tgtatacattttgttatagaat

SEQ ID NO: 948783 - DNA, 23 bp, Homo sapiens
tgtataccaatgtgttttctgta

SEQ ID NO: 948784 - DNA, 19 bp, Homo sapiens
tgtatactatagtaccagt

SEQ ID NO: 948785 - DNA, 17 bp, Homo sapiens
tgtatactcctgtcacc

SEQ ID NO: 948786 - DNA, 21 bp, Homo sapiens
tgtatactgtaaaagttataa

SEQ ID NO: 948787 - DNA, 23 bp, Homo sapiens
tgtatagaccaaagcaaagaaaa

SEQ ID NO: 948788 - DNA, 22 bp, Homo sapiens
tgtataggccatctgtaaatat

SEQ ID NO: 948789 - DNA, 21 bp, Homo sapiens
tgtatagtactggcatggtac

SEQ ID NO: 948790 - DNA, 14 bp, Homo sapiens
tgtatagtatctgt

SEQ ID NO: 948791 - DNA, 17 bp, Homo sapiens
tgtatagtatctgtata

SEQ ID NO: 948792 - DNA, 17 bp, Homo sapiens
tgtatagtattggaaaa

SEQ ID NO: 948793 - DNA, 19 bp, Homo sapiens
tgtatagtgcctaaaattg

SEQ ID NO: 948794 - DNA, 21 bp, Homo sapiens
tgtatagtgtctattatcaca

SEQ ID NO: 948795 - DNA, 11 bp, Homo sapiens
tgtatagtgtt

SEQ ID NO: 948796 - DNA, 20 bp, Homo sapiens
tgtatagtgttcacaaactg

SEQ ID NO: 948797 - DNA, 23 bp, Homo sapiens
tgtatagtgttcacaaactgtga

SEQ ID NO: 948798 - DNA, 20 bp, Homo sapiens
tgtatagttaggatagcatt

SEQ ID NO: 948799 - DNA, 18 bp, Homo sapiens
tgtatagttatatgtaca

SEQ ID NO: 948800 - DNA, 18 bp, Homo sapiens
tgtatagttgcttgcctg

SEQ ID NO: 948801 - DNA, 16 bp, Homo sapiens
tgtatataaaaatggc

SEQ ID NO: 948802 - DNA, 17 bp, Homo sapiens
tgtatataagttgctgt

SEQ ID NO: 948803 - DNA, 16 bp, Homo sapiens
tgtatatacaataaca

SEQ ID NO: 948804 - DNA, 18 bp, Homo sapiens
tgtatatacaataacata

SEQ ID NO: 948805 - DNA, 21 bp, Homo sapiens
tgtatatacgcatctataaat

SEQ ID NO: 948806 - DNA, 13 bp, Homo sapiens
tgtatatactttt

SEQ ID NO: 948807 - DNA, 21 bp, Homo sapiens
tgtatatagagattgtacatt

SEQ ID NO: 948808 - DNA, 14 bp, Homo sapiens
tgtatatatatata

SEQ ID NO: 948809 - DNA, 17 bp, Homo sapiens
tgtatatatattaagag

SEQ ID NO: 948810 - DNA, 17 bp, Homo sapiens
tgtatatatctgcttca

SEQ ID NO: 948811 - DNA, 20 bp, Homo sapiens
tgtatatatcttataactgt

SEQ ID NO: 948812 - DNA, 12 bp, Homo sapiens
tgtatatatgtg

SEQ ID NO: 948813 - DNA, 20 bp, Homo sapiens
tgtatatattattataatct

SEQ ID NO: 948814 - DNA, 18 bp, Homo sapiens
tgtatatcatgaagcctt

SEQ ID NO: 948815 - DNA, 18 bp, Homo sapiens
tgtatatcattctacaga

SEQ ID NO: 948816 - DNA, 20 bp, Homo sapiens
tgtatatcctatataggaaa

SEQ ID NO: 948817 - DNA, 17 bp, Homo sapiens
tgtatatccttccaaaa

SEQ ID NO: 948818 - DNA, 13 bp, Homo sapiens
tgtatatgatcta

SEQ ID NO: 948819 - DNA, 13 bp, Homo sapiens
tgtatatgattat

SEQ ID NO: 948820 - DNA, 21 bp, Homo sapiens
tgtatatgtagatgtatgcac

SEQ ID NO: 948821 - DNA, 17 bp, Homo sapiens
tgtatatgtattccctt

SEQ ID NO: 948822 - DNA, 13 bp, Homo sapiens
tgtatatgtattt

SEQ ID NO: 948823 - DNA, 19 bp, Homo sapiens
tgtatatgtttatatactg

SEQ ID NO: 948824 - DNA, 20 bp, Homo sapiens
tgtatattaaaatagcatac

SEQ ID NO: 948825 - DNA, 14 bp, Homo sapiens
tgtatattacaatg

SEQ ID NO: 948826 - DNA, 19 bp, Homo sapiens
tgtatattacaatgatcac

SEQ ID NO: 948827 - DNA, 16 bp, Homo sapiens
tgtatattccaccatt

SEQ ID NO: 948828 - DNA, 22 bp, Homo sapiens
tgtatattccaccattcacatt

SEQ ID NO: 948829 - DNA, 14 bp, Homo sapiens
tgtatattcctttg

SEQ ID NO: 948830 - DNA, 17 bp, Homo sapiens
tgtatattggtgtatat

SEQ ID NO: 948831 - DNA, 19 bp, Homo sapiens
tgtatatttaattaaagca

SEQ ID NO: 948832 - DNA, 22 bp, Homo sapiens
tgtatatttgcaaaccctttgt

SEQ ID NO: 948833 - DNA, 18 bp, Homo sapiens
tgtatatttgctgcaaag

SEQ ID NO: 948834 - DNA, 21 bp, Homo sapiens
tgtatatttgctgcaaagaga

SEQ ID NO: 948835 - DNA, 16 bp, Homo sapiens
tgtatatttgcttcaa

SEQ ID NO: 948836 - DNA, 14 bp, Homo sapiens
tgtatatttgtaca

SEQ ID NO: 948837 - DNA, 18 bp, Homo sapiens
tgtatatttgtatgatat

SEQ ID NO: 948838 - DNA, 15 bp, Homo sapiens
tgtatatttgtcatg

SEQ ID NO: 948839 - DNA, 18 bp, Homo sapiens
tgtatatttttaaagaat

SEQ ID NO: 948840 - DNA, 20 bp, Homo sapiens
tgtatatttttaaagaatgt

SEQ ID NO: 948841 - DNA, 21 bp, Homo sapiens
tgtatatttttaaagaatgtt

SEQ ID NO: 948842 - DNA, 12 bp, Homo sapiens
tgtatcaaatgt

SEQ ID NO: 948843 - DNA, 19 bp, Homo sapiens
tgtatcagaagagagggga

SEQ ID NO: 948844 - DNA, 19 bp, Homo sapiens
tgtatcagccagccttccc

SEQ ID NO: 948845 - DNA, 14 bp, Homo sapiens
tgtatcagctctct

SEQ ID NO: 948846 - DNA, 22 bp, Homo sapiens
tgtatcagctctctgctgggtc

SEQ ID NO: 948847 - DNA, 23 bp, Homo sapiens
tgtatcattaaaatatatgttct

SEQ ID NO: 948848 - DNA, 17 bp, Homo sapiens
tgtatcatttgaacaac

SEQ ID NO: 948849 - DNA, 16 bp, Homo sapiens
tgtatcatttttgtgc

SEQ ID NO: 948850 - DNA, 20 bp, Homo sapiens
tgtatcatttttgtgcacag

SEQ ID NO: 948851 - DNA, 16 bp, Homo sapiens
tgtatccagaggaatt

SEQ ID NO: 948852 - DNA, 22 bp, Homo sapiens
tgtatcccccccctgtatagtt

SEQ ID NO: 948853 - DNA, 21 bp, Homo sapiens
gtggagtgagagcctttgcct

SEQ ID NO: 948854 - DNA, 14 bp, Homo sapiens
gtggagttcctgct

SEQ ID NO: 948855 - DNA, 14 bp, Homo sapiens
gtggagttggggct

SEQ ID NO: 948856 - DNA, 13 bp, Homo sapiens
gtggagtttgaca

SEQ ID NO: 948857 - DNA, 17 bp, Homo sapiens
gtggataactagccaga

SEQ ID NO: 948858 - DNA, 12 bp, Homo sapiens
gtggataatcag

SEQ ID NO: 948859 - DNA, 15 bp, Homo sapiens
gtggataatcaggaa

SEQ ID NO: 948860 - DNA, 21 bp, Homo sapiens
gtggataatcaggaaaaatga

SEQ ID NO: 948861 - DNA, 18 bp, Homo sapiens
gtggatacagtgcccacc

SEQ ID NO: 948862 - DNA, 17 bp, Homo sapiens
gtggatacgtgtcaatg

SEQ ID NO: 948863 - DNA, 16 bp, Homo sapiens
gtggatatttgtataa

SEQ ID NO: 948864 - DNA, 18 bp, Homo sapiens
gtggatcacaaggtcaag

SEQ ID NO: 948865 - DNA, 14 bp, Homo sapiens
gtggatcttcagaa

SEQ ID NO: 948866 - DNA, 16 bp, Homo sapiens
gtggatgacagggcag

SEQ ID NO: 948867 - DNA, 17 bp, Homo sapiens
gtggatgacagggcaga

SEQ ID NO: 948868 - DNA, 13 bp, Homo sapiens
gtggatgactgtt

SEQ ID NO: 948869 - DNA, 18 bp, Homo sapiens
gtggatgccgatttctgt

SEQ ID NO: 948870 - DNA, 20 bp, Homo sapiens
gtggatgccgatttctgtaa

SEQ ID NO: 948871 - DNA, 17 bp, Homo sapiens
gtggatgctagtgctgt

SEQ ID NO: 948872 - DNA, 21 bp, Homo sapiens
gtggatgctccagggcagcct

SEQ ID NO: 948873 - DNA, 22 bp, Homo sapiens
gtggatggcccagcaggcaggc

SEQ ID NO: 948874 - DNA, 22 bp, Homo sapiens
gtggatggccccagcacagctt

SEQ ID NO: 948875 - DNA, 18 bp, Homo sapiens
gtggatggccgtggatgc

SEQ ID NO: 948876 - DNA, 15 bp, Homo sapiens
gtggatgggaatttg

SEQ ID NO: 948877 - DNA, 15 bp, Homo sapiens
gtggatgttatgaac

SEQ ID NO: 948878 - DNA, 17 bp, Homo sapiens
gtggatgttatgaacag

SEQ ID NO: 948879 - DNA, 14 bp, Homo sapiens
gtggattggctttg

SEQ ID NO: 948880 - DNA, 16 bp, Homo sapiens
gtggattggctttgtg

SEQ ID NO: 948881 - DNA, 19 bp, Homo sapiens
gtggatttaacagaaatgt

SEQ ID NO: 948882 - DNA, 20 bp, Homo sapiens
gtggatttggagaccgaaga

SEQ ID NO: 948883 - DNA, 16 bp, Homo sapiens
gtggcaaagtgctgta

SEQ ID NO: 948884 - DNA, 18 bp, Homo sapiens
gtggcaactgagatgtca

SEQ ID NO: 948885 - DNA, 17 bp, Homo sapiens
gtggcaagagtgtggag

SEQ ID NO: 948886 - DNA, 21 bp, Homo sapiens
gtggcaagctgtgacttctcc

SEQ ID NO: 948887 - DNA, 21 bp, Homo sapiens
gtggcaatgcttaaactaaat

SEQ ID NO: 948888 - DNA, 13 bp, Homo sapiens
gtggcaattagtg

SEQ ID NO: 948889 - DNA, 17 bp, Homo sapiens
gtggcacagatgcccac

SEQ ID NO: 948890 - DNA, 13 bp, Homo sapiens
gtggcacagctgg

SEQ ID NO: 948891 - DNA, 15 bp, Homo sapiens
gtggcacaggcactg

SEQ ID NO: 948892 - DNA, 16 bp, Homo sapiens
gtggcacaggcactga

SEQ ID NO: 948893 - DNA, 13 bp, Homo sapiens
gtggcaccagcag

SEQ ID NO: 948894 - DNA, 14 bp, Homo sapiens
gtggcacctcctga

SEQ ID NO: 948895 - DNA, 15 bp, Homo sapiens
gtggcacctcctgag

SEQ ID NO: 948896 - DNA, 22 bp, Homo sapiens
tgtatgattactggcctttttc

SEQ ID NO: 948897 - DNA, 15 bp, Homo sapiens
tgtatgatttataaa

SEQ ID NO: 948898 - DNA, 13 bp, Homo sapiens
tgtatgatttgtt

SEQ ID NO: 948899 - DNA, 19 bp, Homo sapiens
tgtatgatttgttttgaat

SEQ ID NO: 948900 - DNA, 17 bp, Homo sapiens
tgtatgcacacacatat

SEQ ID NO: 948901 - DNA, 21 bp, Homo sapiens
tgtatgcacacacatatatta

SEQ ID NO: 948902 - DNA, 15 bp, Homo sapiens
tgtatgcactgctca

SEQ ID NO: 948903 - DNA, 18 bp, Homo sapiens
tgtatgcatcagataaca

SEQ ID NO: 948904 - DNA, 19 bp, Homo sapiens
tgtatgcatcagataacaa

SEQ ID NO: 948905 - DNA, 15 bp, Homo sapiens
tgtatgccttctgta

SEQ ID NO: 948906 - DNA, 23 bp, Homo sapiens
tgtatgcctttaaatctgtgatg

SEQ ID NO: 948907 - DNA, 22 bp, Homo sapiens
tgtatgcgtgtccgtctgtctg

SEQ ID NO: 948908 - DNA, 14 bp, Homo sapiens
tgtatgctgatcat

SEQ ID NO: 948909 - DNA, 13 bp, Homo sapiens
tgtatgctgcttt

SEQ ID NO: 948910 - DNA, 12 bp, Homo sapiens
tgtatgctggac

SEQ ID NO: 948911 - DNA, 18 bp, Homo sapiens
tgtatggaaataaatgta

SEQ ID NO: 948912 - DNA, 23 bp, Homo sapiens
tgtatggaaataaatgtatcata

SEQ ID NO: 948913 - DNA, 18 bp, Homo sapiens
tgtatggaatacagtgtt

SEQ ID NO: 948914 - DNA, 19 bp, Homo sapiens
tgtatggaatcccactgta

SEQ ID NO: 948915 - DNA, 15 bp, Homo sapiens
tgtatggcccaggca

SEQ ID NO: 948916 - DNA, 18 bp, Homo sapiens
tgtatggcccaggcagcc

SEQ ID NO: 948917 - DNA, 19 bp, Homo sapiens
tgtatgggagatggcagca

SEQ ID NO: 948918 - DNA, 22 bp, Homo sapiens
tgtatgggtagggtaaatcagt

SEQ ID NO: 948919 - DNA, 10 bp, Homo sapiens
tgtatgtaaa

SEQ ID NO: 948920 - DNA, 15 bp, Homo sapiens
tgtatgtaaatgtgc

SEQ ID NO: 948921 - DNA, 22 bp, Homo sapiens
tgtatgtaaatgtgcattcttt

SEQ ID NO: 948922 - DNA, 21 bp, Homo sapiens
tgtatgtaacaattgtttgtt

SEQ ID NO: 948923 - DNA, 23 bp, Homo sapiens
tgtatgtaagtaattgcatttct

SEQ ID NO: 948924 - DNA, 15 bp, Homo sapiens
tgtatgtacaataca

SEQ ID NO: 948925 - DNA, 19 bp, Homo sapiens
tgtatgtacaatacaatgt

SEQ ID NO: 948926 - DNA, 20 bp, Homo sapiens
tgtatgtacaatacaatgta

SEQ ID NO: 948927 - DNA, 13 bp, Homo sapiens
tgtatgtacatat

SEQ ID NO: 948928 - DNA, 17 bp, Homo sapiens
tgtatgtacttagctgt

SEQ ID NO: 948929 - DNA, 12 bp, Homo sapiens
tgtatgtataat

SEQ ID NO: 948930 - DNA, 11 bp, Homo sapiens
tgtatgtatac

SEQ ID NO: 948931 - DNA, 21 bp, Homo sapiens
tgtatgtcagacatccatgtt

SEQ ID NO: 948932 - DNA, 18 bp, Homo sapiens
tgtatgtctcgtggtagg

SEQ ID NO: 948933 - DNA, 18 bp, Homo sapiens
tgtatgtgagagattctg

SEQ ID NO: 948934 - DNA, 19 bp, Homo sapiens
tgtatgtgcactgtcactt

SEQ ID NO: 948935 - DNA, 17 bp, Homo sapiens
tgtatgtgcgtgtgtgc

SEQ ID NO: 948936 - DNA, 17 bp, Homo sapiens
tgtatgtgtaataaata

SEQ ID NO: 948937 - DNA, 21 bp, Homo sapiens
tgtatgtgtctgctaatgtaa

SEQ ID NO: 948938 - DNA, 19 bp, Homo sapiens
tgtatgtgtggctgtgggt

SEQ ID NO: 948939 - DNA, 14 bp, Homo sapiens
tgtatgtgtgtgag

SEQ ID NO: 948940 - DNA, 15 bp, Homo sapiens
tgtatgttatgaaca

SEQ ID NO: 948941 - DNA, 17 bp, Homo sapiens
tgtatgttatgaacatg

SEQ ID NO: 948942 - DNA, 13 bp, Homo sapiens
tgtatgtttacat

SEQ ID NO: 948943 - DNA, 15 bp, Homo sapiens
tgtatgtttacatat

SEQ ID NO: 948944 - DNA, 13 bp, Homo sapiens
tgtatgtttctct

SEQ ID NO: 948945 - DNA, 18 bp, Homo sapiens
tgtatgttttatatcaaa

SEQ ID NO: 948946 - DNA, 20 bp, Homo sapiens
tgtattaaaaaaaacaaaaa

SEQ ID NO: 948947 - DNA, 22 bp, Homo sapiens
tgtattaaaaaaaacaaaaaga

SEQ ID NO: 948948 - DNA, 12 bp, Homo sapiens
tgtattaaatct

SEQ ID NO: 948949 - DNA, 15 bp, Homo sapiens
tgtattaaatggttt

SEQ ID NO: 948950 - DNA, 18 bp, Homo sapiens
tgtattaagccaaacatg

SEQ ID NO: 948951 - DNA, 19 bp, Homo sapiens
tgtattaagccaaacatga

SEQ ID NO: 948952 - DNA, 14 bp, Homo sapiens
tgtattaagccact

SEQ ID NO: 948953 - DNA, 14 bp, Homo sapiens
tgtattaataaagc

SEQ ID NO: 948954 - DNA, 18 bp, Homo sapiens
tgtattacataaataaat

SEQ ID NO: 948955 - DNA, 21 bp, Homo sapiens
tgtattacataaataaattaa

SEQ ID NO: 948956 - DNA, 20 bp, Homo sapiens
tgtattatgaaaaagattat

SEQ ID NO: 948957 - DNA, 14 bp, Homo sapiens
tgtattattacaaa

SEQ ID NO: 948958 - DNA, 20 bp, Homo sapiens
tgtattattattaaagaaaa

SEQ ID NO: 948959 - DNA, 16 bp, Homo sapiens
tgtattattgttctca

SEQ ID NO: 948960 - DNA, 18 bp, Homo sapiens
tgtattatttacatttaa

SEQ ID NO: 948961 - DNA, 21 bp, Homo sapiens
tgtattatttacatttaatag

SEQ ID NO: 948962 - DNA, 14 bp, Homo sapiens
tgtattatttataa

SEQ ID NO: 948963 - DNA, 14 bp, Homo sapiens
tgtattatttggag

SEQ ID NO: 948964 - DNA, 16 bp, Homo sapiens
tgtattatttggagtt

SEQ ID NO: 948965 - DNA, 15 bp, Homo sapiens
tgtattccaagacat

SEQ ID NO: 948966 - DNA, 20 bp, Homo sapiens
tgtattccaagacatgtctg

SEQ ID NO: 948967 - DNA, 13 bp, Homo sapiens
tgtattcccttca

SEQ ID NO: 948968 - DNA, 17 bp, Homo sapiens
tgtattcccttgtattt

SEQ ID NO: 948969 - DNA, 22 bp, Homo sapiens
tgtattcccttgtattttgtta

SEQ ID NO: 948970 - DNA, 17 bp, Homo sapiens
tgtattcgtgcattttt

SEQ ID NO: 948971 - DNA, 20 bp, Homo sapiens
tgtattctctcctgtacctc

SEQ ID NO: 948972 - DNA, 14 bp, Homo sapiens
tgtattctctgagc

SEQ ID NO: 948973 - DNA, 18 bp, Homo sapiens
tgtattcttgttcccgaa

SEQ ID NO: 948974 - DNA, 15 bp, Homo sapiens
tgtattcttgtttga

SEQ ID NO: 948975 - DNA, 17 bp, Homo sapiens
tgtattctttactaaag

SEQ ID NO: 948976 - DNA, 19 bp, Homo sapiens
tgtattcttttccaagctc

SEQ ID NO: 948977 - DNA, 16 bp, Homo sapiens
tgtattgaaaacactt

SEQ ID NO: 948978 - DNA, 22 bp, Homo sapiens
tgtattgaacttggaaagaaat

SEQ ID NO: 948979 - DNA, 22 bp, Homo sapiens
tgtattgactttatgttgtatg

SEQ ID NO: 948980 - DNA, 20 bp, Homo sapiens
tgtattgagatttcttaaat

SEQ ID NO: 948981 - DNA, 13 bp, Homo sapiens
gtggcctccctgg

SEQ ID NO: 948982 - DNA, 19 bp, Homo sapiens
gtggcctctctctctctcc

SEQ ID NO: 948983 - DNA, 20 bp, Homo sapiens
gtggcctcttgagcagtggc

SEQ ID NO: 948984 - DNA, 22 bp, Homo sapiens
gtggcctgctaaggctcctcct

SEQ ID NO: 948985 - DNA, 16 bp, Homo sapiens
gtggcctggcatctgt

SEQ ID NO: 948986 - DNA, 19 bp, Homo sapiens
gtggcctggcatctgtgtg

SEQ ID NO: 948987 - DNA, 12 bp, Homo sapiens
gtggcctggcca

SEQ ID NO: 948988 - DNA, 15 bp, Homo sapiens
gtggcctgggcttgg

SEQ ID NO: 948989 - DNA, 16 bp, Homo sapiens
gtggcctgggcttggc

SEQ ID NO: 948990 - DNA, 17 bp, Homo sapiens
gtggcctgtgtccagca

SEQ ID NO: 948991 - DNA, 23 bp, Homo sapiens
gtggcctgtgtccagcagctgcg

SEQ ID NO: 948992 - DNA, 20 bp, Homo sapiens
gtggcctgtttctgcagccc

SEQ ID NO: 948993 - DNA, 21 bp, Homo sapiens
gtggcctgtttctgcagccct

SEQ ID NO: 948994 - DNA, 18 bp, Homo sapiens
gtggccttccccagcatg

SEQ ID NO: 948995 - DNA, 23 bp, Homo sapiens
gtggccttccccttttgcctggc

SEQ ID NO: 948996 - DNA, 15 bp, Homo sapiens
gtggccttgcccgcc

SEQ ID NO: 948997 - DNA, 23 bp, Homo sapiens
gtggccttgcccgccagcctcag

SEQ ID NO: 948998 - DNA, 19 bp, Homo sapiens
gtggccttgggaggacatg

SEQ ID NO: 948999 - DNA, 16 bp, Homo sapiens
gtggccttgggccttg

SEQ ID NO: 949000 - DNA, 24 bp, Homo sapiens
gtggcctttcagtgtagcgggagg

SEQ ID NO: 949001 - DNA, 20 bp, Homo sapiens
gtggccttttttataactaa

SEQ ID NO: 949002 - DNA, 21 bp, Homo sapiens
gtggcgccgtctccaggggct

SEQ ID NO: 949003 - DNA, 22 bp, Homo sapiens
gtggcgccgtctccaggggctg

SEQ ID NO: 949004 - DNA, 13 bp, Homo sapiens
gtggcgctggtgc

SEQ ID NO: 949005 - DNA, 17 bp, Homo sapiens
gtggcggctgcacaaca

SEQ ID NO: 949006 - DNA, 19 bp, Homo sapiens
gtggcggctgcacaacagc

SEQ ID NO: 949007 - DNA, 15 bp, Homo sapiens
gtggcgtctccctcg

SEQ ID NO: 949008 - DNA, 15 bp, Homo sapiens
gtggcgtggcctccc

SEQ ID NO: 949009 - DNA, 18 bp, Homo sapiens
gtggcgtgggagccagcc

SEQ ID NO: 949010 - DNA, 19 bp, Homo sapiens
gtggctaattataattcag

SEQ ID NO: 949011 - DNA, 18 bp, Homo sapiens
gtggctagtcaagctcct

SEQ ID NO: 949012 - DNA, 20 bp, Homo sapiens
gtggctagtcaagctcctcc

SEQ ID NO: 949013 - DNA, 21 bp, Homo sapiens
gtggctagtcaagctcctcct

SEQ ID NO: 949014 - DNA, 17 bp, Homo sapiens
gtggctagtcagagaga

SEQ ID NO: 949015 - DNA, 14 bp, Homo sapiens
gtggctcacgcctg

SEQ ID NO: 949016 - DNA, 17 bp, Homo sapiens
gtggctcagtgccacct

SEQ ID NO: 949017 - DNA, 17 bp, Homo sapiens
tgtatttgctaattttt

SEQ ID NO: 949018 - DNA, 20 bp, Homo sapiens
tgtatttgctgccagacact

SEQ ID NO: 949019 - DNA, 12 bp, Homo sapiens
tgtatttggaaa

SEQ ID NO: 949020 - DNA, 21 bp, Homo sapiens
tgtatttggaaataaagtcag

SEQ ID NO: 949021 - DNA, 22 bp, Homo sapiens
tgtatttggctgggctacaatt

SEQ ID NO: 949022 - DNA, 14 bp, Homo sapiens
tgtatttgtattaa

SEQ ID NO: 949023 - DNA, 15 bp, Homo sapiens
tgtattttaacactt

SEQ ID NO: 949024 - DNA, 19 bp, Homo sapiens
tgtattttaacactttgta

SEQ ID NO: 949025 - DNA, 18 bp, Homo sapiens
tgtattttatttagacaa

SEQ ID NO: 949026 - DNA, 22 bp, Homo sapiens
tgtattttatttagacaagaga

SEQ ID NO: 949027 - DNA, 16 bp, Homo sapiens
tgtattttctttctct

SEQ ID NO: 949028 - DNA, 14 bp, Homo sapiens
tgtattttgaaaaa

SEQ ID NO: 949029 - DNA, 18 bp, Homo sapiens
tgtattttgaaaaagaga

SEQ ID NO: 949030 - DNA, 19 bp, Homo sapiens
tgtattttggctttctccc

SEQ ID NO: 949031 - DNA, 14 bp, Homo sapiens
tgtattttgtgtga

SEQ ID NO: 949032 - DNA, 19 bp, Homo sapiens
tgtatttttcaataaagca

SEQ ID NO: 949033 - DNA, 18 bp, Homo sapiens
tgtatttttcaataataa

SEQ ID NO: 949034 - DNA, 23 bp, Homo sapiens
tgtatttttcttgctgttcagtg

SEQ ID NO: 949035 - DNA, 18 bp, Homo sapiens
tgtatttttgtaaaaaat

SEQ ID NO: 949036 - DNA, 18 bp, Homo sapiens
tgtattttttaaaacact

SEQ ID NO: 949037 - DNA, 21 bp, Homo sapiens
tgtattttttaaaacactaaa

SEQ ID NO: 949038 - DNA, 15 bp, Homo sapiens
tgtattttttaaaat

SEQ ID NO: 949039 - DNA, 22 bp, Homo sapiens
tgtattttttaaaattgatttt

SEQ ID NO: 949040 - DNA, 18 bp, Homo sapiens
tgtattttttatttacat

SEQ ID NO: 949041 - DNA, 20 bp, Homo sapiens
tgtattttttatttacattt

SEQ ID NO: 949042 - DNA, 13 bp, Homo sapiens
tgtattttttcct

SEQ ID NO: 949043 - DNA, 21 bp, Homo sapiens
tgtattttttccttaagagct

SEQ ID NO: 949044 - DNA, 21 bp, Homo sapiens
tgtatttttttttctaagaga

SEQ ID NO: 949045 - DNA, 22 bp, Homo sapiens
tgtatttttttttctaagagaa

SEQ ID NO: 949046 - DNA, 21 bp, Homo sapiens
tgtcaaaaagggcttgaggtg

SEQ ID NO: 949047 - DNA, 13 bp, Homo sapiens
tgtcaaaacactg

SEQ ID NO: 949048 - DNA, 16 bp, Homo sapiens
tgtcaaaacactgtgg

SEQ ID NO: 949049 - DNA, 19 bp, Homo sapiens
tgtcaaaactactgacagg

SEQ ID NO: 949050 - DNA, 16 bp, Homo sapiens
tgtcaaactgtagaaa

SEQ ID NO: 949051 - DNA, 14 bp, Homo sapiens
tgtcaaagatgccc

SEQ ID NO: 949052 - DNA, 19 bp, Homo sapiens
tgtcaaatatttagatgta

SEQ ID NO: 949053 - DNA, 16 bp, Homo sapiens
tgtcaaatgaactttt

SEQ ID NO: 949054 - DNA, 17 bp, Homo sapiens
tgtcaaatgaactttta

SEQ ID NO: 949055 - DNA, 17 bp, Homo sapiens
tgtcaaatgatgtgcaa

SEQ ID NO: 949056 - DNA, 15 bp, Homo sapiens
tgtcaacagtataag

SEQ ID NO: 949057 - DNA, 20 bp, Homo sapiens
tgtcaacatgcattgccatg

SEQ ID NO: 949058 - DNA, 13 bp, Homo sapiens
tgtcaacattgtg

SEQ ID NO: 949059 - DNA, 18 bp, Homo sapiens
tgtcaacttctggctcct

SEQ ID NO: 949060 - DNA, 20 bp, Homo sapiens
tgtcaacttctggctcctca

SEQ ID NO: 949061 - DNA, 17 bp, Homo sapiens
tgtcaacttttaacttt

SEQ ID NO: 949062 - DNA, 21 bp, Homo sapiens
tgtcaagaatagcattgtaaa

SEQ ID NO: 949063 - DNA, 16 bp, Homo sapiens
tgtcaagcctgtgcaa

SEQ ID NO: 949064 - DNA, 17 bp, Homo sapiens
tgtcaagcctgtgcaaa

SEQ ID NO: 949065 - DNA, 19 bp, Homo sapiens
tgtcaagctgctctgagcc

SEQ ID NO: 949066 - DNA, 15 bp, Homo sapiens
tgtcaagcttactac

SEQ ID NO: 949067 - DNA, 18 bp, Homo sapiens
tgtcaagcttactacagt

SEQ ID NO: 949068 - DNA, 21 bp, Homo sapiens
tgtcaaggccgagggccaggc

SEQ ID NO: 949069 - DNA, 23 bp, Homo sapiens
tgtcaaggccgagggccaggcag

SEQ ID NO: 949070 - DNA, 18 bp, Homo sapiens
tgtcaaggctgcttagaa

SEQ ID NO: 949071 - DNA, 19 bp, Homo sapiens
tgtcaagtacaagcaagac

SEQ ID NO: 949072 - DNA, 18 bp, Homo sapiens
tgtcaagtctctgctggc

SEQ ID NO: 949073 - DNA, 20 bp, Homo sapiens
tgtcaagttaacaaggaatg

SEQ ID NO: 949074 - DNA, 12 bp, Homo sapiens
tgtcaataaaca

SEQ ID NO: 949075 - DNA, 18 bp, Homo sapiens
tgtcaataaatgacaccc

SEQ ID NO: 949076 - DNA, 19 bp, Homo sapiens
tgtcaatattaaatacaga

SEQ ID NO: 949077 - DNA, 23 bp, Homo sapiens
tgtcaatattaaatacagacact

SEQ ID NO: 949078 - DNA, 13 bp, Homo sapiens
tgtcaatgtgtgc

SEQ ID NO: 949079 - DNA, 23 bp, Homo sapiens
tgtcaatttccctgactcctcta

SEQ ID NO: 949080 - DNA, 16 bp, Homo sapiens
tgtcaatttgtatatc

SEQ ID NO: 949081 - DNA, 13 bp, Homo sapiens
tgtcacaataaag

SEQ ID NO: 949082 - DNA, 16 bp, Homo sapiens
tgtcacaataaagttt

SEQ ID NO: 949083 - DNA, 19 bp, Homo sapiens
tgtcacaataaagtttatt

SEQ ID NO: 949084 - DNA, 20 bp, Homo sapiens
tgtcacaataaatggccagt

SEQ ID NO: 949085 - DNA, 21 bp, Homo sapiens
tgtcacaatgagattgaattt

SEQ ID NO: 949086 - DNA, 14 bp, Homo sapiens
tgtcacacactgga

SEQ ID NO: 949087 - DNA, 18 bp, Homo sapiens
tgtcacactggtgctgag

SEQ ID NO: 949088 - DNA, 14 bp, Homo sapiens
tgtcacagaaatca

SEQ ID NO: 949089 - DNA, 11 bp, Homo sapiens
tgtcacagggc

SEQ ID NO: 949090 - DNA, 13 bp, Homo sapiens
tgtcacagggcca

SEQ ID NO: 949091 - DNA, 14 bp, Homo sapiens
tgtcacagggccaa

SEQ ID NO: 949092 - DNA, 20 bp, Homo sapiens
tgtcacagtccaaccagaaa

SEQ ID NO: 949093 - DNA, 22 bp, Homo sapiens
tgtcacagtccaaccagaaaca

SEQ ID NO: 949094 - DNA, 12 bp, Homo sapiens
tgtcacagttct

SEQ ID NO: 949095 - DNA, 18 bp, Homo sapiens
tgtcacatggtgccccta

SEQ ID NO: 949096 - DNA, 20 bp, Homo sapiens
tgtcacatggtgcccctagc

SEQ ID NO: 949097 - DNA, 18 bp, Homo sapiens
tgtcacatttgaattctt

SEQ ID NO: 949098 - DNA, 14 bp, Homo sapiens
tgtcaccaaggaaa

SEQ ID NO: 949099 - DNA, 16 bp, Homo sapiens
tgtcaccaccttccca

SEQ ID NO: 949100 - DNA, 18 bp, Homo sapiens
tgtcaccagttaaaagca

SEQ ID NO: 949101 - DNA, 17 bp, Homo sapiens
tgtcaccctgcagagct

SEQ ID NO: 949102 - DNA, 15 bp, Homo sapiens
tgtcaccctgtgggt

SEQ ID NO: 949103 - DNA, 22 bp, Homo sapiens
tgtcaccgtgagcagctttgga

SEQ ID NO: 949104 - DNA, 19 bp, Homo sapiens
tgtcaccgtggaccttcct

SEQ ID NO: 949105 - DNA, 17 bp, Homo sapiens
tgtcacctgctcacagg

SEQ ID NO: 949106 - DNA, 14 bp, Homo sapiens
tgtcacctggctgc

SEQ ID NO: 949107 - DNA, 16 bp, Homo sapiens
gtgggatcctccctca

SEQ ID NO: 949108 - DNA, 24 bp, Homo sapiens
gtgggatgttcagcactgtccctt

SEQ ID NO: 949109 - DNA, 15 bp, Homo sapiens
gtgggcaaaggcagg

SEQ ID NO: 949110 - DNA, 17 bp, Homo sapiens
gtgggcaaaggcagggc

SEQ ID NO: 949111 - DNA, 16 bp, Homo sapiens
gtgggcacccaccctg

SEQ ID NO: 949112 - DNA, 20 bp, Homo sapiens
gtgggcacccaccctgggac

SEQ ID NO: 949113 - DNA, 16 bp, Homo sapiens
gtgggcagcaccctcc

SEQ ID NO: 949114 - DNA, 21 bp, Homo sapiens
gtgggcagcagcatcccagcc

SEQ ID NO: 949115 - DNA, 17 bp, Homo sapiens
gtgggcagcatgcccag

SEQ ID NO: 949116 - DNA, 16 bp, Homo sapiens
gtgggcagctgggccc

SEQ ID NO: 949117 - DNA, 18 bp, Homo sapiens
gtgggcaggcaagccctt

SEQ ID NO: 949118 - DNA, 17 bp, Homo sapiens
gtgggcaggtggtggca

SEQ ID NO: 949119 - DNA, 18 bp, Homo sapiens
gtgggcaggtggtggcac

SEQ ID NO: 949120 - DNA, 12 bp, Homo sapiens
gtgggccagagc

SEQ ID NO: 949121 - DNA, 13 bp, Homo sapiens
gtgggccagagct

SEQ ID NO: 949122 - DNA, 14 bp, Homo sapiens
gtgggccagagctg

SEQ ID NO: 949123 - DNA, 21 bp, Homo sapiens
gtgggccagggctgccctgag

SEQ ID NO: 949124 - DNA, 17 bp, Homo sapiens
gtgggccagtctgtgga

SEQ ID NO: 949125 - DNA, 19 bp, Homo sapiens
gtgggcccagaactgcccc

SEQ ID NO: 949126 - DNA, 20 bp, Homo sapiens
gtgggcccaggaccagctgg

SEQ ID NO: 949127 - DNA, 21 bp, Homo sapiens
gtgggcccaggaccagctggg

SEQ ID NO: 949128 - DNA, 23 bp, Homo sapiens
gtgggcccggagtaatcaggcag

SEQ ID NO: 949129 - DNA, 14 bp, Homo sapiens
gtgggccctgcagg

SEQ ID NO: 949130 - DNA, 15 bp, Homo sapiens
gtgggccctgcaggc

SEQ ID NO: 949131 - DNA, 18 bp, Homo sapiens
gtgggccgggaggcagtg

SEQ ID NO: 949132 - DNA, 18 bp, Homo sapiens
gtgggccgtggcttgggc

SEQ ID NO: 949133 - DNA, 23 bp, Homo sapiens
gtgggcctcacctgcccctctgt

SEQ ID NO: 949134 - DNA, 11 bp, Homo sapiens
gtgggcctgac

SEQ ID NO: 949135 - DNA, 12 bp, Homo sapiens
gtgggcctggcc

SEQ ID NO: 949136 - DNA, 17 bp, Homo sapiens
gtgggcctggcggcctg

SEQ ID NO: 949137 - DNA, 18 bp, Homo sapiens
gtgggcctggtagcacat

SEQ ID NO: 949138 - DNA, 17 bp, Homo sapiens
gtgggcctgtcgtgcca

SEQ ID NO: 949139 - DNA, 15 bp, Homo sapiens
tgtcagaagctggga

SEQ ID NO: 949140 - DNA, 18 bp, Homo sapiens
tgtcagaatcctttacat

SEQ ID NO: 949141 - DNA, 15 bp, Homo sapiens
tgtcagaatggaatc

SEQ ID NO: 949142 - DNA, 17 bp, Homo sapiens
tgtcagaatggaatcca

SEQ ID NO: 949143 - DNA, 20 bp, Homo sapiens
tgtcagaatggaatccatct

SEQ ID NO: 949144 - DNA, 22 bp, Homo sapiens
tgtcagaatggaatccatctgt

SEQ ID NO: 949145 - DNA, 17 bp, Homo sapiens
tgtcagaatttctttgt

SEQ ID NO: 949146 - DNA, 12 bp, Homo sapiens
tgtcagacacag

SEQ ID NO: 949147 - DNA, 21 bp, Homo sapiens
tgtcagacagaacttgaatgt

SEQ ID NO: 949148 - DNA, 16 bp, Homo sapiens
tgtcagaccctggagg

SEQ ID NO: 949149 - DNA, 23 bp, Homo sapiens
tgtcagactttaaagaataatat

SEQ ID NO: 949150 - DNA, 21 bp, Homo sapiens
tgtcagactttgctgcatttt

SEQ ID NO: 949151 - DNA, 21 bp, Homo sapiens
tgtcagagcctaccttcacca

SEQ ID NO: 949152 - DNA, 19 bp, Homo sapiens
tgtcagaggaccccagggt

SEQ ID NO: 949153 - DNA, 12 bp, Homo sapiens
tgtcagaggcta

SEQ ID NO: 949154 - DNA, 15 bp, Homo sapiens
tgtcagatatgatat

SEQ ID NO: 949155 - DNA, 23 bp, Homo sapiens
tgtcagatattttttcagaaata

SEQ ID NO: 949156 - DNA, 16 bp, Homo sapiens
tgtcagatcgttcatt

SEQ ID NO: 949157 - DNA, 20 bp, Homo sapiens
tgtcagatgagaacaaagct

SEQ ID NO: 949158 - DNA, 13 bp, Homo sapiens
tgtcagatttctg

SEQ ID NO: 949159 - DNA, 16 bp, Homo sapiens
tgtcagatttctggtt

SEQ ID NO: 949160 - DNA, 22 bp, Homo sapiens
tgtcagcaaaaagcaaaatcat

SEQ ID NO: 949161 - DNA, 23 bp, Homo sapiens
tgtcagcaaaaagcaaaatcatt

SEQ ID NO: 949162 - DNA, 12 bp, Homo sapiens
tgtcagcaggca

SEQ ID NO: 949163 - DNA, 15 bp, Homo sapiens
tgtcagcatagaagt

SEQ ID NO: 949164 - DNA, 23 bp, Homo sapiens
tgtcagcatctggctgtctagaa

SEQ ID NO: 949165 - DNA, 13 bp, Homo sapiens
tgtcagccacctc

SEQ ID NO: 949166 - DNA, 13 bp, Homo sapiens
tgtcagccagccg

SEQ ID NO: 949167 - DNA, 16 bp, Homo sapiens
tgtcagccagccgccc

SEQ ID NO: 949168 - DNA, 18 bp, Homo sapiens
tgtcagccagccgccctg

SEQ ID NO: 949169 - DNA, 20 bp, Homo sapiens
tgtcagccagccgccctggg

SEQ ID NO: 949170 - DNA, 19 bp, Homo sapiens
tgtcagccatcgtcctggg

SEQ ID NO: 949171 - DNA, 20 bp, Homo sapiens
tgtcagccatcgtcctggga

SEQ ID NO: 949172 - DNA, 21 bp, Homo sapiens
tgtcagccatcgtcctgggac

SEQ ID NO: 949173 - DNA, 22 bp, Homo sapiens
tgtcagccatcgtcctgggact

SEQ ID NO: 949174 - DNA, 18 bp, Homo sapiens
tgtcagcccctcttccct

SEQ ID NO: 949175 - DNA, 11 bp, Homo sapiens
tgtcagcctga

SEQ ID NO: 949176 - DNA, 14 bp, Homo sapiens
tgtcagcctttgtt

SEQ ID NO: 949177 - DNA, 20 bp, Homo sapiens
tgtcagcgttctaccaggca

SEQ ID NO: 949178 - DNA, 20 bp, Homo sapiens
tgtcagctaaagaagtttga

SEQ ID NO: 949179 - DNA, 13 bp, Homo sapiens
tgtcagctgaggc

SEQ ID NO: 949180 - DNA, 19 bp, Homo sapiens
tgtcagctgaggctggggg

SEQ ID NO: 949181 - DNA, 17 bp, Homo sapiens
tgtcagctgttgtcaca

SEQ ID NO: 949182 - DNA, 14 bp, Homo sapiens
tgtcagctttgact

SEQ ID NO: 949183 - DNA, 17 bp, Homo sapiens
tgtcaggaacagaagga

SEQ ID NO: 949184 - DNA, 20 bp, Homo sapiens
tgtcaggaacagaaggatga

SEQ ID NO: 949185 - DNA, 21 bp, Homo sapiens
tgtcaggaagtaaaataaata

SEQ ID NO: 949186 - DNA, 22 bp, Homo sapiens
tgtcaggcatggctcagagctt

SEQ ID NO: 949187 - DNA, 21 bp, Homo sapiens
tgtcaggcccgtcggagctgc

SEQ ID NO: 949188 - DNA, 23 bp, Homo sapiens
tgtcaggcccgtcggagctgcct

SEQ ID NO: 949189 - DNA, 19 bp, Homo sapiens
tgtcaggccctctgcctgc

SEQ ID NO: 949190 - DNA, 18 bp, Homo sapiens
tgtcaggctacaaggtag

SEQ ID NO: 949191 - DNA, 15 bp, Homo sapiens
tgtcagggagggcca

SEQ ID NO: 949192 - DNA, 16 bp, Homo sapiens
tgtcagggagggccag

SEQ ID NO: 949193 - DNA, 22 bp, Homo sapiens
tgtcagggagggccagggaggc

SEQ ID NO: 949194 - DNA, 23 bp, Homo sapiens
tgtcagggagggccagggaggca

SEQ ID NO: 949195 - DNA, 12 bp, Homo sapiens
tgtcagggatga

SEQ ID NO: 949196 - DNA, 19 bp, Homo sapiens
tgtcagggatgagttgagg

SEQ ID NO: 949197 - DNA, 21 bp, Homo sapiens
tgtcagggatttagcccatga

SEQ ID NO: 949198 - DNA, 15 bp, Homo sapiens
tgtcaggtcccagcg

SEQ ID NO: 949199 - DNA, 18 bp, Homo sapiens
tgtcaggtcccagcgagc

SEQ ID NO: 949200 - DNA, 14 bp, Homo sapiens
tgtcagtatttact

SEQ ID NO: 949201 - DNA, 16 bp, Homo sapiens
tgtcagtatttttgcc

SEQ ID NO: 949202 - DNA, 17 bp, Homo sapiens
tgtcagtatttttgccg

SEQ ID NO: 949203 - DNA, 15 bp, Homo sapiens
tgtcagtcacagcca

SEQ ID NO: 949204 - DNA, 14 bp, Homo sapiens
tgtcagtggggacc

SEQ ID NO: 949205 - DNA, 15 bp, Homo sapiens
tgtcagtggtttcta

SEQ ID NO: 949206 - DNA, 18 bp, Homo sapiens
tgtcagttcaactttcag

SEQ ID NO: 949207 - DNA, 21 bp, Homo sapiens
tgtcagttcttggtgctctgt

SEQ ID NO: 949208 - DNA, 16 bp, Homo sapiens
tgtcagttttgttcac

SEQ ID NO: 949209 - DNA, 15 bp, Homo sapiens
tgtcataaaatgcat

SEQ ID NO: 949210 - DNA, 16 bp, Homo sapiens
tgtcataaactttctc

SEQ ID NO: 949211 - DNA, 18 bp, Homo sapiens
tgtcataaactttctcca

SEQ ID NO: 949212 - DNA, 18 bp, Homo sapiens
tgtcataaagtgagaaaa

SEQ ID NO: 949213 - DNA, 22 bp, Homo sapiens
tgtcataaagtgagaaaactgt

SEQ ID NO: 949214 - DNA, 13 bp, Homo sapiens
tgtcataaattac

SEQ ID NO: 949215 - DNA, 16 bp, Homo sapiens
tgtcataacatttaaa

SEQ ID NO: 949216 - DNA, 19 bp, Homo sapiens
tgtcataacatttaaagag

SEQ ID NO: 949217 - DNA, 15 bp, Homo sapiens
tgtcataagaatgaa

SEQ ID NO: 949218 - DNA, 16 bp, Homo sapiens
tgtcataagaatgaat

SEQ ID NO: 949219 - DNA, 16 bp, Homo sapiens
tgtcataagtaaacct

SEQ ID NO: 949220 - DNA, 14 bp, Homo sapiens
tgtcataataaagt

SEQ ID NO: 949221 - DNA, 17 bp, Homo sapiens
tgtcatagaaagtgcca

SEQ ID NO: 949222 - DNA, 22 bp, Homo sapiens
tgtcatagaaagtgccagaaag

SEQ ID NO: 949223 - DNA, 16 bp, Homo sapiens
tgtcatagaaattaca

SEQ ID NO: 949224 - DNA, 20 bp, Homo sapiens
tgtcatagggattgtccctg

SEQ ID NO: 949225 - DNA, 22 bp, Homo sapiens
tgtcatatatggggggccaaca

SEQ ID NO: 949226 - DNA, 15 bp, Homo sapiens
tgtcatatgactgat

SEQ ID NO: 949227 - DNA, 20 bp, Homo sapiens
tgtcatatgtagccttcaca

SEQ ID NO: 949228 - DNA, 17 bp, Homo sapiens
tgtcatcaatgttcagt

SEQ ID NO: 949229 - DNA, 15 bp, Homo sapiens
tgtcatcactccctg

SEQ ID NO: 949230 - DNA, 18 bp, Homo sapiens
tgtcatcactccctggat

SEQ ID NO: 949231 - DNA, 17 bp, Homo sapiens
tgtcatcagaagataac

SEQ ID NO: 949232 - DNA, 13 bp, Homo sapiens
tgtcatcagaggg

SEQ ID NO: 949233 - DNA, 20 bp, Homo sapiens
tgtcatcagaggggagcagc

SEQ ID NO: 949234 - DNA, 16 bp, Homo sapiens
gtgggtctttaataaa

SEQ ID NO: 949235 - DNA, 21 bp, Homo sapiens
gtgggtctttaataaaacaac

SEQ ID NO: 949236 - DNA, 13 bp, Homo sapiens
gtgggtgagagag

SEQ ID NO: 949237 - DNA, 14 bp, Homo sapiens
gtgggtgagagaga

SEQ ID NO: 949238 - DNA, 14 bp, Homo sapiens
gtgggtgctgccct

SEQ ID NO: 949239 - DNA, 19 bp, Homo sapiens
gtgggtggaaccaggaacc

SEQ ID NO: 949240 - DNA, 15 bp, Homo sapiens
gtgggtgggcaggga

SEQ ID NO: 949241 - DNA, 13 bp, Homo sapiens
gtgggtgggccct

SEQ ID NO: 949242 - DNA, 18 bp, Homo sapiens
gtgggtggggaggccctg

SEQ ID NO: 949243 - DNA, 19 bp, Homo sapiens
gtgggtggggtacaggcag

SEQ ID NO: 949244 - DNA, 16 bp, Homo sapiens
gtgggtggtggatctg

SEQ ID NO: 949245 - DNA, 14 bp, Homo sapiens
gtgggtggtgggga

SEQ ID NO: 949246 - DNA, 16 bp, Homo sapiens
gtgggtggtggggagg

SEQ ID NO: 949247 - DNA, 15 bp, Homo sapiens
gtgggtgtctccctc

SEQ ID NO: 949248 - DNA, 15 bp, Homo sapiens
gtgggtgtggccagc

SEQ ID NO: 949249 - DNA, 23 bp, Homo sapiens
gtgggtgtgtgcgcctgagtgag

SEQ ID NO: 949250 - DNA, 17 bp, Homo sapiens
gtgggtgttctttcctg

SEQ ID NO: 949251 - DNA, 20 bp, Homo sapiens
gtgggttagtcgggtgccag

SEQ ID NO: 949252 - DNA, 22 bp, Homo sapiens
gtgggttagtcgggtgccagga

SEQ ID NO: 949253 - DNA, 19 bp, Homo sapiens
gtgggtttctctgtgctct

SEQ ID NO: 949254 - DNA, 22 bp, Homo sapiens
gtgggtttgggtgcctcctgca

SEQ ID NO: 949255 - DNA, 16 bp, Homo sapiens
gtggtaaatactgtga

SEQ ID NO: 949256 - DNA, 16 bp, Homo sapiens
gtggtaactttgcagg

SEQ ID NO: 949257 - DNA, 19 bp, Homo sapiens
gtggtacccccccttttct

SEQ ID NO: 949258 - DNA, 16 bp, Homo sapiens
gtggtaccttcagccc

SEQ ID NO: 949259 - DNA, 18 bp, Homo sapiens
gtggtaccttcagccctg

SEQ ID NO: 949260 - DNA, 21 bp, Homo sapiens
gtggtactttattcttgctgg

SEQ ID NO: 949261 - DNA, 16 bp, Homo sapiens
gtggtaggggcaggga

SEQ ID NO: 949262 - DNA, 16 bp, Homo sapiens
gtggtatcctgtgaca

SEQ ID NO: 949263 - DNA, 21 bp, Homo sapiens
gtggtatgtaatttatgcaag

SEQ ID NO: 949264 - DNA, 16 bp, Homo sapiens
gtggtatgtatgggag

SEQ ID NO: 949265 - DNA, 18 bp, Homo sapiens
gtggtcacagcggaggtg

SEQ ID NO: 949266 - DNA, 13 bp, Homo sapiens
gtggtcaccttcg

SEQ ID NO: 949267 - DNA, 18 bp, Homo sapiens
gtggtcactggtcagggc

SEQ ID NO: 949268 - DNA, 22 bp, Homo sapiens
gtggtcagcagatgccagtgaa

SEQ ID NO: 949269 - DNA, 22 bp, Homo sapiens
gtggtcataaaatagaataatt

SEQ ID NO: 949270 - DNA, 15 bp, Homo sapiens
gtggtcctgagacct

SEQ ID NO: 949271 - DNA, 21 bp, Homo sapiens
gtggtctataaaataaacttc

SEQ ID NO: 949272 - DNA, 12 bp, Homo sapiens
gtggtctcagga

SEQ ID NO: 949273 - DNA, 17 bp, Homo sapiens
gtggtctgaatgttctg

SEQ ID NO: 949274 - DNA, 13 bp, Homo sapiens
gtggtctgttggc

SEQ ID NO: 949275 - DNA, 20 bp, Homo sapiens
gtggtctgttggcaggctgg

SEQ ID NO: 949276 - DNA, 23 bp, Homo sapiens
gtggtctgttggcaggctggcca

SEQ ID NO: 949277 - DNA, 12 bp, Homo sapiens
gtggtcttcctt

SEQ ID NO: 949278 - DNA, 21 bp, Homo sapiens
gtggtcttctccaccagcccc

SEQ ID NO: 949279 - DNA, 15 bp, Homo sapiens
gtggtctttgctgct

SEQ ID NO: 949280 - DNA, 15 bp, Homo sapiens
gtggtgaagaaaact

SEQ ID NO: 949281 - DNA, 17 bp, Homo sapiens
gtggtgaagtgtggctg

SEQ ID NO: 949282 - DNA, 21 bp, Homo sapiens
gtggtgaagtgtggctggtgt

SEQ ID NO: 949283 - DNA, 22 bp, Homo sapiens
gtggtgaagtgtggctggtgtc

SEQ ID NO: 949284 - DNA, 15 bp, Homo sapiens
gtggtgagtggaagg

SEQ ID NO: 949285 - DNA, 14 bp, Homo sapiens
gtggtggagccagg

SEQ ID NO: 949286 - DNA, 17 bp, Homo sapiens
gtggtggagtggagtga

SEQ ID NO: 949287 - DNA, 23 bp, Homo sapiens
gtggtggcatacgcctgtagtcc

SEQ ID NO: 949288 - DNA, 14 bp, Homo sapiens
gtggtggcctcagc

SEQ ID NO: 949289 - DNA, 19 bp, Homo sapiens
gtggtggcgttatggcagc

SEQ ID NO: 949290 - DNA, 18 bp, Homo sapiens
gtggtgggacagggaccc

SEQ ID NO: 949291 - DNA, 16 bp, Homo sapiens
gtggtgggcggggaga

SEQ ID NO: 949292 - DNA, 15 bp, Homo sapiens
gtggtgggcttctgc

SEQ ID NO: 949293 - DNA, 23 bp, Homo sapiens
gtggtgggggaggagcctctggc

SEQ ID NO: 949294 - DNA, 19 bp, Homo sapiens
gtggtggtaaccctggtgg

SEQ ID NO: 949295 - DNA, 17 bp, Homo sapiens
gtggtggtattctgtca

SEQ ID NO: 949296 - DNA, 14 bp, Homo sapiens
gtggtggtgttttt

SEQ ID NO: 949297 - DNA, 18 bp, Homo sapiens
gtggtgtgaccatgttca

SEQ ID NO: 949298 - DNA, 21 bp, Homo sapiens
gtggtgtgaccatgttcatta

SEQ ID NO: 949299 - DNA, 14 bp, Homo sapiens
gtggtgttgggaag

SEQ ID NO: 949300 - DNA, 21 bp, Homo sapiens
gtggtgtttgtaggctgtggg

SEQ ID NO: 949301 - DNA, 21 bp, Homo sapiens
gtggttacagtgcagacaggc

SEQ ID NO: 949302 - DNA, 21 bp, Homo sapiens
gtggttagaatcttgttttgt

SEQ ID NO: 949303 - DNA, 20 bp, Homo sapiens
gtggttcagtgccttcctct

SEQ ID NO: 949304 - DNA, 22 bp, Homo sapiens
gtggttccaagaaagatccacc

SEQ ID NO: 949305 - DNA, 23 bp, Homo sapiens
gtggttccaagaaagatccaccc

SEQ ID NO: 949306 - DNA, 16 bp, Homo sapiens
gtggttcctctgctca

SEQ ID NO: 949307 - DNA, 13 bp, Homo sapiens
gtggttcctgtgg

SEQ ID NO: 949308 - DNA, 13 bp, Homo sapiens
gtggttctatttt

SEQ ID NO: 949309 - DNA, 23 bp, Homo sapiens
gtggttctattttactttgtact

SEQ ID NO: 949310 - DNA, 17 bp, Homo sapiens
gtggttggaaaactttt

SEQ ID NO: 949311 - DNA, 20 bp, Homo sapiens
gtggttggggccctgccctg

SEQ ID NO: 949312 - DNA, 15 bp, Homo sapiens
gtggttgtgcctttt

SEQ ID NO: 949313 - DNA, 21 bp, Homo sapiens
gtggtttctacttcccctggg

SEQ ID NO: 949314 - DNA, 12 bp, Homo sapiens
gtggtttggaat

SEQ ID NO: 949315 - DNA, 17 bp, Homo sapiens
gtggttttcagagcagg

SEQ ID NO: 949316 - DNA, 18 bp, Homo sapiens
gtggttttcccctccctg

SEQ ID NO: 949317 - DNA, 17 bp, Homo sapiens
gtggttttctgttcttt

SEQ ID NO: 949318 - DNA, 17 bp, Homo sapiens
gtggtttttcagctccc

SEQ ID NO: 949319 - DNA, 18 bp, Homo sapiens
gtgtaaaaaatggaaaaa

SEQ ID NO: 949320 - DNA, 19 bp, Homo sapiens
gtgtaaaaaatggaaaaaa

SEQ ID NO: 949321 - DNA, 21 bp, Homo sapiens
gtgtaaaaaatggaaaaaaac

SEQ ID NO: 949322 - DNA, 14 bp, Homo sapiens
gtgtaaaaaatgtc

SEQ ID NO: 949323 - DNA, 23 bp, Homo sapiens
gtgtaaaacgagaatccacccat

SEQ ID NO: 949324 - DNA, 19 bp, Homo sapiens
gtgtaaaatattttgaatc

SEQ ID NO: 949325 - DNA, 14 bp, Homo sapiens
gtgtaaacacatct

SEQ ID NO: 949326 - DNA, 19 bp, Homo sapiens
gtgtaaaccacataatttt

SEQ ID NO: 949327 - DNA, 21 bp, Homo sapiens
gtgtaaagacttgagaagtct

SEQ ID NO: 949328 - DNA, 17 bp, Homo sapiens
gtgtaaagatttataca

SEQ ID NO: 949329 - DNA, 14 bp, Homo sapiens
gtgtaaataattta

SEQ ID NO: 949330 - DNA, 23 bp, Homo sapiens
gtgtaacaattgtgtagcctttt

SEQ ID NO: 949331 - DNA, 12 bp, Homo sapiens
gtgtaacagctg

SEQ ID NO: 949332 - DNA, 23 bp, Homo sapiens
gtgtaactgtcagccgggccctg

SEQ ID NO: 949333 - DNA, 13 bp, Homo sapiens
gtgtaacttcctg

SEQ ID NO: 949334 - DNA, 15 bp, Homo sapiens
gtgtaacttcctgct

SEQ ID NO: 949335 - DNA, 18 bp, Homo sapiens
gtgtaacttcctgctgca

SEQ ID NO: 949336 - DNA, 15 bp, Homo sapiens
gtgtaacttgcttaa

SEQ ID NO: 949337 - DNA, 20 bp, Homo sapiens
gtgtaacttgcttaaatttc

SEQ ID NO: 949338 - DNA, 21 bp, Homo sapiens
gtgtaacttgcttaaatttct

SEQ ID NO: 949339 - DNA, 20 bp, Homo sapiens
gtgtaactttcataccactt

SEQ ID NO: 949340 - DNA, 15 bp, Homo sapiens
gtgtaagaactgtac

SEQ ID NO: 949341 - DNA, 18 bp, Homo sapiens
gtgtaagaactgtacatt

SEQ ID NO: 949342 - DNA, 22 bp, Homo sapiens
gtgtaagaactgtacattgtga

SEQ ID NO: 949343 - DNA, 23 bp, Homo sapiens
gtgtaaggagtttttttgtcaga

SEQ ID NO: 949344 - DNA, 22 bp, Homo sapiens
gtgtaagtgtgagtaagagctg

SEQ ID NO: 949345 - DNA, 15 bp, Homo sapiens
gtgtaataagaaagt

SEQ ID NO: 949346 - DNA, 20 bp, Homo sapiens
gtgtaatagatctgaataaa

SEQ ID NO: 949347 - DNA, 14 bp, Homo sapiens
gtgtaatatgaaat

SEQ ID NO: 949348 - DNA, 23 bp, Homo sapiens
gtgtaatcatttcttgggccctc

SEQ ID NO: 949349 - DNA, 14 bp, Homo sapiens
gtgtaatcatttta

SEQ ID NO: 949350 - DNA, 22 bp, Homo sapiens
gtgtaatcattttaaattccac

SEQ ID NO: 949351 - DNA, 18 bp, Homo sapiens
gtgtaattgagaaggaaa

SEQ ID NO: 949352 - DNA, 23 bp, Homo sapiens
gtgtaattttgttctagttttca

SEQ ID NO: 949353 - DNA, 12 bp, Homo sapiens
gtgtacaaattg

SEQ ID NO: 949354 - DNA, 12 bp, Homo sapiens
gtgtacacctgc

SEQ ID NO: 949355 - DNA, 21 bp, Homo sapiens
gtgtacacgggactgacgcaa

SEQ ID NO: 949356 - DNA, 19 bp, Homo sapiens
gtgtacacgtctggacccc

SEQ ID NO: 949357 - DNA, 12 bp, Homo sapiens
gtgtacagcaca

SEQ ID NO: 949358 - DNA, 21 bp, Homo sapiens
tgtcatcagccaccatcctat

SEQ ID NO: 949359 - DNA, 21 bp, Homo sapiens
tgtcatcatgcttatgttaaa

SEQ ID NO: 949360 - DNA, 21 bp, Homo sapiens
tgtcatcctcaaagaaagtgt

SEQ ID NO: 949361 - DNA, 17 bp, Homo sapiens
tgtcatcgttccccacc

SEQ ID NO: 949362 - DNA, 16 bp, Homo sapiens
tgtcatctctctgggg

SEQ ID NO: 949363 - DNA, 15 bp, Homo sapiens
tgtcatctgaggagt

SEQ ID NO: 949364 - DNA, 18 bp, Homo sapiens
tgtcatctgcatgtctac

SEQ ID NO: 949365 - DNA, 13 bp, Homo sapiens
tgtcatctgtgca

SEQ ID NO: 949366 - DNA, 23 bp, Homo sapiens
tgtcatctttcttctattttatt

SEQ ID NO: 949367 - DNA, 13 bp, Homo sapiens
tgtcatcttttca

SEQ ID NO: 949368 - DNA, 16 bp, Homo sapiens
tgtcatctttttctag

SEQ ID NO: 949369 - DNA, 20 bp, Homo sapiens
tgtcatgaagaatgtttctg

SEQ ID NO: 949370 - DNA, 20 bp, Homo sapiens
tgtcatgacagtgcttgcat

SEQ ID NO: 949371 - DNA, 15 bp, Homo sapiens
tgtcatgcccccctc

SEQ ID NO: 949372 - DNA, 16 bp, Homo sapiens
tgtcatgcccccctca

SEQ ID NO: 949373 - DNA, 17 bp, Homo sapiens
tgtcatgcccccctcaa

SEQ ID NO: 949374 - DNA, 21 bp, Homo sapiens
tgtcatgcctcactttcttct

SEQ ID NO: 949375 - DNA, 20 bp, Homo sapiens
tgtcatgctgggatttccaa

SEQ ID NO: 949376 - DNA, 22 bp, Homo sapiens
tgtcatggaaaatgtcctgtgg

SEQ ID NO: 949377 - DNA, 12 bp, Homo sapiens
tgtcatggctga

SEQ ID NO: 949378 - DNA, 22 bp, Homo sapiens
tgtcatggctgaagttggccac

SEQ ID NO: 949379 - DNA, 14 bp, Homo sapiens
tgtcatggtgacca

SEQ ID NO: 949380 - DNA, 17 bp, Homo sapiens
tgtcatgtaccatcaat

SEQ ID NO: 949381 - DNA, 19 bp, Homo sapiens
tgtcatgtacttcctgtgt

SEQ ID NO: 949382 - DNA, 14 bp, Homo sapiens
gtgtagctgtgaaa

SEQ ID NO: 949383 - DNA, 16 bp, Homo sapiens
gtgtagctgtgaaatc

SEQ ID NO: 949384 - DNA, 12 bp, Homo sapiens
gtgtaggcagac

SEQ ID NO: 949385 - DNA, 20 bp, Homo sapiens
gtgtagggcaagggtgcctc

SEQ ID NO: 949386 - DNA, 12 bp, Homo sapiens
gtgtagggggcc

SEQ ID NO: 949387 - DNA, 17 bp, Homo sapiens
gtgtagtggaagagcag

SEQ ID NO: 949388 - DNA, 19 bp, Homo sapiens
gtgtagtggaagagcagcc

SEQ ID NO: 949389 - DNA, 21 bp, Homo sapiens
gtgtagtggaagagcagcctg

SEQ ID NO: 949390 - DNA, 23 bp, Homo sapiens
gtgtagtggaagagcagcctgat

SEQ ID NO: 949391 - DNA, 14 bp, Homo sapiens
gtgtataaatgtac

SEQ ID NO: 949392 - DNA, 16 bp, Homo sapiens
gtgtataaatgtacat

SEQ ID NO: 949393 - DNA, 15 bp, Homo sapiens
gtgtataccacctgt

SEQ ID NO: 949394 - DNA, 19 bp, Homo sapiens
gtgtataccacctgtacat

SEQ ID NO: 949395 - DNA, 14 bp, Homo sapiens
gtgtatagtgccta

SEQ ID NO: 949396 - DNA, 17 bp, Homo sapiens
gtgtatagtgttcacaa

SEQ ID NO: 949397 - DNA, 22 bp, Homo sapiens
gtgtatagtgttcacaaactgt

SEQ ID NO: 949398 - DNA, 14 bp, Homo sapiens
gtgtatataatttt

SEQ ID NO: 949399 - DNA, 15 bp, Homo sapiens
gtgtatataatttta

SEQ ID NO: 949400 - DNA, 13 bp, Homo sapiens
gtgtatatatctt

SEQ ID NO: 949401 - DNA, 12 bp, Homo sapiens
gtgtatatcatg

SEQ ID NO: 949402 - DNA, 12 bp, Homo sapiens
gtgtatcattaa

SEQ ID NO: 949403 - DNA, 15 bp, Homo sapiens
gtgtatcattaaaat

SEQ ID NO: 949404 - DNA, 22 bp, Homo sapiens
gtgtatcattaaaatatatgtt

SEQ ID NO: 949405 - DNA, 22 bp, Homo sapiens
gtgtatcccccccctgtatagt

SEQ ID NO: 949406 - DNA, 12 bp, Homo sapiens
gtgtatcctggc

SEQ ID NO: 949407 - DNA, 14 bp, Homo sapiens
gtgtatcctggccc

SEQ ID NO: 949408 - DNA, 14 bp, Homo sapiens
gtgtatcctggggc

SEQ ID NO: 949409 - DNA, 20 bp, Homo sapiens
gtgtatcctggggctccctt

SEQ ID NO: 949410 - DNA, 21 bp, Homo sapiens
gtgtatctagcttcttcagag

SEQ ID NO: 949411 - DNA, 14 bp, Homo sapiens
gtgtatgcacagta

SEQ ID NO: 949412 - DNA, 16 bp, Homo sapiens
gtgtatgcactgctca

SEQ ID NO: 949413 - DNA, 20 bp, Homo sapiens
gtgtatgccacacctggcct

SEQ ID NO: 949414 - DNA, 23 bp, Homo sapiens
gtgtatgcgaaaaggtttttagg

SEQ ID NO: 949415 - DNA, 21 bp, Homo sapiens
gtgtatggaaaaaccatttga

SEQ ID NO: 949416 - DNA, 19 bp, Homo sapiens
gtgtatggcgttggtttgt

SEQ ID NO: 949417 - DNA, 18 bp, Homo sapiens
gtgtatgtttgcacactt

SEQ ID NO: 949418 - DNA, 21 bp, Homo sapiens
gtgtattacaacaatctggag

SEQ ID NO: 949419 - DNA, 16 bp, Homo sapiens
gtgtattcagaggcag

SEQ ID NO: 949420 - DNA, 14 bp, Homo sapiens
gtgtattctctgta

SEQ ID NO: 949421 - DNA, 12 bp, Homo sapiens
gtgtattgttcc

SEQ ID NO: 949422 - DNA, 18 bp, Homo sapiens
gtgtatttaacagggagg

SEQ ID NO: 949423 - DNA, 14 bp, Homo sapiens
gtgtatttatataa

SEQ ID NO: 949424 - DNA, 15 bp, Homo sapiens
gtgtatttattacat

SEQ ID NO: 949425 - DNA, 16 bp, Homo sapiens
gtgtatttattacatt

SEQ ID NO: 949426 - DNA, 12 bp, Homo sapiens
gtgtatttattt

SEQ ID NO: 949427 - DNA, 11 bp, Homo sapiens
gtgtatttcta

SEQ ID NO: 949428 - DNA, 12 bp, Homo sapiens
gtgtatttctaa

SEQ ID NO: 949429 - DNA, 14 bp, Homo sapiens
gtgtatttgctttt

SEQ ID NO: 949430 - DNA, 19 bp, Homo sapiens
gtgtatttggaaataaagt

SEQ ID NO: 949431 - DNA, 13 bp, Homo sapiens
gtgtatttgtatt

SEQ ID NO: 949432 - DNA, 14 bp, Homo sapiens
gtgtatttgtatta

SEQ ID NO: 949433 - DNA, 19 bp, Homo sapiens
gtgtatttgtattaataaa

SEQ ID NO: 949434 - DNA, 20 bp, Homo sapiens
gtgtatttgtattaataaag

SEQ ID NO: 949435 - DNA, 14 bp, Homo sapiens
gtgtattttcagtc

SEQ ID NO: 949436 - DNA, 23 bp, Homo sapiens
gtgtatttttcaataaagcattt

SEQ ID NO: 949437 - DNA, 16 bp, Homo sapiens
gtgtcaagaaggaaga

SEQ ID NO: 949438 - DNA, 15 bp, Homo sapiens
gtgtcaccctgcaga

SEQ ID NO: 949439 - DNA, 18 bp, Homo sapiens
gtgtcaccctgcagagct

SEQ ID NO: 949440 - DNA, 20 bp, Homo sapiens
gtgtcagaccctggaggccc

SEQ ID NO: 949441 - DNA, 14 bp, Homo sapiens
gtgtcagagcccag

SEQ ID NO: 949442 - DNA, 15 bp, Homo sapiens
gtgtcagagcccagg

SEQ ID NO: 949443 - DNA, 19 bp, Homo sapiens
gtgtcagagcccaggggag

SEQ ID NO: 949444 - DNA, 15 bp, Homo sapiens
gtgtcagagtgttgt

SEQ ID NO: 949445 - DNA, 16 bp, Homo sapiens
gtgtcagcccctcttc

SEQ ID NO: 949446 - DNA, 19 bp, Homo sapiens
gtgtcagcccctcttccct

SEQ ID NO: 949447 - DNA, 14 bp, Homo sapiens
gtgtcagctcaggc

SEQ ID NO: 949448 - DNA, 20 bp, Homo sapiens
gtgtcaggcccgtcggagct

SEQ ID NO: 949449 - DNA, 15 bp, Homo sapiens
gtgtcaggccctctg

SEQ ID NO: 949450 - DNA, 19 bp, Homo sapiens
gtgtcaggccctctgcctg

SEQ ID NO: 949451 - DNA, 16 bp, Homo sapiens
gtgtcagtaatttata

SEQ ID NO: 949452 - DNA, 20 bp, Homo sapiens
gtgtcagttcaactttcaga

SEQ ID NO: 949453 - DNA, 21 bp, Homo sapiens
gtgtcagttcaactttcagaa

SEQ ID NO: 949454 - DNA, 20 bp, Homo sapiens
gtgtcatatgactgattact

SEQ ID NO: 949455 - DNA, 16 bp, Homo sapiens
gtgtcatgaagaatgt

SEQ ID NO: 949456 - DNA, 18 bp, Homo sapiens
gtgtcattctgcctgctc

SEQ ID NO: 949457 - DNA, 16 bp, Homo sapiens
gtgtcatttcattcca

SEQ ID NO: 949458 - DNA, 15 bp, Homo sapiens
gtgtccacctgtggg

SEQ ID NO: 949459 - DNA, 19 bp, Homo sapiens
gtgtccaggctctgggcac

SEQ ID NO: 949460 - DNA, 13 bp, Homo sapiens
gtgtccagggtcc

SEQ ID NO: 949461 - DNA, 18 bp, Homo sapiens
gtgtccatgcgctcaggg

SEQ ID NO: 949462 - DNA, 19 bp, Homo sapiens
gtgtccatgcgctcagggc

SEQ ID NO: 949463 - DNA, 20 bp, Homo sapiens
gtgtccatgcgctcagggcc

SEQ ID NO: 949464 - DNA, 22 bp, Homo sapiens
gtgtccatgtgtatgcgtgtcc

SEQ ID NO: 949465 - DNA, 14 bp, Homo sapiens
gtgtccatgtgtgt

SEQ ID NO: 949466 - DNA, 16 bp, Homo sapiens
gtgtccattttgcaaa

SEQ ID NO: 949467 - DNA, 20 bp, Homo sapiens
gtgtcccaaaatcccctcag

SEQ ID NO: 949468 - DNA, 21 bp, Homo sapiens
gtgtcccaaaatcccctcagc

SEQ ID NO: 949469 - DNA, 20 bp, Homo sapiens
gtgtccccaacgtcccctcc

SEQ ID NO: 949470 - DNA, 20 bp, Homo sapiens
gtgtccccccttgaagcaat

SEQ ID NO: 949471 - DNA, 18 bp, Homo sapiens
gtgtccccctctgtccag

SEQ ID NO: 949472 - DNA, 15 bp, Homo sapiens
gtgtcccctatcctc

SEQ ID NO: 949473 - DNA, 18 bp, Homo sapiens
gtgtcccctatcctcccc

SEQ ID NO: 949474 - DNA, 19 bp, Homo sapiens
gtgtcccctatcctcccct

SEQ ID NO: 949475 - DNA, 23 bp, Homo sapiens
gtgtcccctcacgcaagtgccag

SEQ ID NO: 949476 - DNA, 23 bp, Homo sapiens
gtgtcccctcactctgtcagcca

SEQ ID NO: 949477 - DNA, 18 bp, Homo sapiens
gtgtcccctgacctgtcc

SEQ ID NO: 949478 - DNA, 19 bp, Homo sapiens
gtgtcccctgacctgtcca

SEQ ID NO: 949479 - DNA, 15 bp, Homo sapiens
gtgtccccttcccct

SEQ ID NO: 949480 - DNA, 18 bp, Homo sapiens
gtgtccccttcccctgct

SEQ ID NO: 949481 - DNA, 23 bp, Homo sapiens
gtgtccccttcccctgctgacct

SEQ ID NO: 949482 - DNA, 20 bp, Homo sapiens
gtgtccgccatccagggtct

SEQ ID NO: 949483 - DNA, 18 bp, Homo sapiens
gtgtccgtccacccttcc

SEQ ID NO: 949484 - DNA, 13 bp, Homo sapiens
gtgtcctccctcc

SEQ ID NO: 949485 - DNA, 14 bp, Homo sapiens
gtgtcctccctccc

SEQ ID NO: 949486 - DNA, 16 bp, Homo sapiens
tgtcccatccccaggt

SEQ ID NO: 949487 - DNA, 18 bp, Homo sapiens
tgtcccatgacccacccc

SEQ ID NO: 949488 - DNA, 21 bp, Homo sapiens
tgtcccatgacccacccctgt

SEQ ID NO: 949489 - DNA, 17 bp, Homo sapiens
tgtcccatgcaggccct

SEQ ID NO: 949490 - DNA, 18 bp, Homo sapiens
tgtcccatggacactcca

SEQ ID NO: 949491 - DNA, 17 bp, Homo sapiens
tgtcccattccctggga

SEQ ID NO: 949492 - DNA, 17 bp, Homo sapiens
tgtcccattctagatcc

SEQ ID NO: 949493 - DNA, 23 bp, Homo sapiens
tgtcccattctagatcctgcacc

SEQ ID NO: 949494 - DNA, 18 bp, Homo sapiens
tgtccccaaacaggacag

SEQ ID NO: 949495 - DNA, 24 bp, Homo sapiens
tgtccccaaaggacgcctgcagga

SEQ ID NO: 949496 - DNA, 19 bp, Homo sapiens
tgtccccaacgtcccctcc

SEQ ID NO: 949497 - DNA, 14 bp, Homo sapiens
tgtccccacacagc

SEQ ID NO: 949498 - DNA, 19 bp, Homo sapiens
tgtccccaccctccactca

SEQ ID NO: 949499 - DNA, 12 bp, Homo sapiens
tgtccccactcc

SEQ ID NO: 949500 - DNA, 19 bp, Homo sapiens
tgtccccagaccaaccctg

SEQ ID NO: 949501 - DNA, 22 bp, Homo sapiens
tgtccccagaccaaccctggga

SEQ ID NO: 949502 - DNA, 21 bp, Homo sapiens
tgtccccagccctgtcctggt

SEQ ID NO: 949503 - DNA, 12 bp, Homo sapiens
tgtccccaggcc

SEQ ID NO: 949504 - DNA, 15 bp, Homo sapiens
gtgtcgtagccaagg

SEQ ID NO: 949505 - DNA, 17 bp, Homo sapiens
gtgtctcagcctctgcc

SEQ ID NO: 949506 - DNA, 18 bp, Homo sapiens
gtgtctcccaacatggga

SEQ ID NO: 949507 - DNA, 12 bp, Homo sapiens
gtgtctctccca

SEQ ID NO: 949508 - DNA, 12 bp, Homo sapiens
gtgtctctgggc

SEQ ID NO: 949509 - DNA, 22 bp, Homo sapiens
gtgtctcttttctctttctcct

SEQ ID NO: 949510 - DNA, 14 bp, Homo sapiens
gtgtctgcacccag

SEQ ID NO: 949511 - DNA, 21 bp, Homo sapiens
gtgtctgcacccaggggtggg

SEQ ID NO: 949512 - DNA, 15 bp, Homo sapiens
gtgtctgctcagtaa

SEQ ID NO: 949513 - DNA, 18 bp, Homo sapiens
gtgtctggaattgtggct

SEQ ID NO: 949514 - DNA, 13 bp, Homo sapiens
gtgtctgggagag

SEQ ID NO: 949515 - DNA, 19 bp, Homo sapiens
gtgtctgggagagcctggc

SEQ ID NO: 949516 - DNA, 22 bp, Homo sapiens
gtgtctgggtttggcccaagac

SEQ ID NO: 949517 - DNA, 21 bp, Homo sapiens
gtgtctgtaggtgtctctggg

SEQ ID NO: 949518 - DNA, 21 bp, Homo sapiens
gtgtctgtatttcatgtggct

SEQ ID NO: 949519 - DNA, 18 bp, Homo sapiens
gtgtctgtcacaggctgg

SEQ ID NO: 949520 - DNA, 12 bp, Homo sapiens
gtgtctgtcagc

SEQ ID NO: 949521 - DNA, 20 bp, Homo sapiens
gtgtctgtccatctgtctgt

SEQ ID NO: 949522 - DNA, 16 bp, Homo sapiens
gtgtctgtctttgtgg

SEQ ID NO: 949523 - DNA, 11 bp, Homo sapiens
gtgtctgtgtt

SEQ ID NO: 949524 - DNA, 15 bp, Homo sapiens
gtgtctgttgcttgt

SEQ ID NO: 949525 - DNA, 12 bp, Homo sapiens
gtgtctgtttgg

SEQ ID NO: 949526 - DNA, 16 bp, Homo sapiens
gtgtctgttttgagct

SEQ ID NO: 949527 - DNA, 15 bp, Homo sapiens
gtgtcttaattatta

SEQ ID NO: 949528 - DNA, 19 bp, Homo sapiens
gtgtcttaattattatttg

SEQ ID NO: 949529 - DNA, 11 bp, Homo sapiens
gtgtcttctgt

SEQ ID NO: 949530 - DNA, 20 bp, Homo sapiens
gtgtcttgggcagagctggc

SEQ ID NO: 949531 - DNA, 17 bp, Homo sapiens
gtgtctttagatagccc

SEQ ID NO: 949532 - DNA, 19 bp, Homo sapiens
gtgtctttgtctggccaca

SEQ ID NO: 949533 - DNA, 15 bp, Homo sapiens
gtgtcttttgacatt

SEQ ID NO: 949534 - DNA, 14 bp, Homo sapiens
gtgtgaaaaaagaa

SEQ ID NO: 949535 - DNA, 17 bp, Homo sapiens
gtgtgaaaaaagaaaat

SEQ ID NO: 949536 - DNA, 13 bp, Homo sapiens
gtgtgaaaatggg

SEQ ID NO: 949537 - DNA, 20 bp, Homo sapiens
gtgtgaactcaccctgggag

SEQ ID NO: 949538 - DNA, 13 bp, Homo sapiens
gtgtgaacttttc

SEQ ID NO: 949539 - DNA, 13 bp, Homo sapiens
gtgtgaagaaagc

SEQ ID NO: 949540 - DNA, 11 bp, Homo sapiens
gtgtgaatgtg

SEQ ID NO: 949541 - DNA, 15 bp, Homo sapiens
gtgtgaatgtgggca

SEQ ID NO: 949542 - DNA, 17 bp, Homo sapiens
gtgtgaattctgcaact

SEQ ID NO: 949543 - DNA, 23 bp, Homo sapiens
gtgtgacagggccagtggggcct

SEQ ID NO: 949544 - DNA, 17 bp, Homo sapiens
gtgtgacagtttccaaa

SEQ ID NO: 949545 - DNA, 20 bp, Homo sapiens
gtgtgacatcagtggcatgg

SEQ ID NO: 949546 - DNA, 15 bp, Homo sapiens
gtgtgaccaactgtg

SEQ ID NO: 949547 - DNA, 16 bp, Homo sapiens
gtgtgaccatgttcat

SEQ ID NO: 949548 - DNA, 23 bp, Homo sapiens
gtgtgaccggcgctaggaaatga

SEQ ID NO: 949549 - DNA, 18 bp, Homo sapiens
gtgtgactcgggagctgc

SEQ ID NO: 949550 - DNA, 20 bp, Homo sapiens
gtgtgactcgggagctgcac

SEQ ID NO: 949551 - DNA, 12 bp, Homo sapiens
gtgtgagactgg

SEQ ID NO: 949552 - DNA, 20 bp, Homo sapiens
gtgtgagagtgtgagcaggg

SEQ ID NO: 949553 - DNA, 15 bp, Homo sapiens
gtgtgagatcctctt

SEQ ID NO: 949554 - DNA, 20 bp, Homo sapiens
gtgtgagccactgcgcccag

SEQ ID NO: 949555 - DNA, 17 bp, Homo sapiens
gtgtgagcgcttctgca

SEQ ID NO: 949556 - DNA, 16 bp, Homo sapiens
gtgtgaggagctgctg

SEQ ID NO: 949557 - DNA, 18 bp, Homo sapiens
gtgtgaggagctgctggc

SEQ ID NO: 949558 - DNA, 14 bp, Homo sapiens
gtgtgaggccaggg

SEQ ID NO: 949559 - DNA, 17 bp, Homo sapiens
gtgtgaggccagggcag

SEQ ID NO: 949560 - DNA, 15 bp, Homo sapiens
gtgtgaggctgtgtc

SEQ ID NO: 949561 - DNA, 14 bp, Homo sapiens
gtgtgagggcagca

SEQ ID NO: 949562 - DNA, 14 bp, Homo sapiens
gtgtgagtggcagc

SEQ ID NO: 949563 - DNA, 11 bp, Homo sapiens
gtgtgagtgtg

SEQ ID NO: 949564 - DNA, 19 bp, Homo sapiens
gtgtgagtgtgacagggcc

SEQ ID NO: 949565 - DNA, 18 bp, Homo sapiens
gtgtgataaatcagtcaa

SEQ ID NO: 949566 - DNA, 14 bp, Homo sapiens
gtgtgatccagccc

SEQ ID NO: 949567 - DNA, 23 bp, Homo sapiens
gtgtgattgacagctttgctgct

SEQ ID NO: 949568 - DNA, 17 bp, Homo sapiens
gtgtgatttcctaaaca

SEQ ID NO: 949569 - DNA, 22 bp, Homo sapiens
gtgtgcaactaactgactctgt

SEQ ID NO: 949570 - DNA, 17 bp, Homo sapiens
gtgtgcaactggccagc

SEQ ID NO: 949571 - DNA, 17 bp, Homo sapiens
gtgtgcaagggcagtga

SEQ ID NO: 949572 - DNA, 16 bp, Homo sapiens
gtgtgcaagtgtgtgc

SEQ ID NO: 949573 - DNA, 15 bp, Homo sapiens
gtgtgcacagaaaac

SEQ ID NO: 949574 - DNA, 14 bp, Homo sapiens
gtgtgcagactgat

SEQ ID NO: 949575 - DNA, 20 bp, Homo sapiens
gtgtgcaggagcctccctgc

SEQ ID NO: 949576 - DNA, 20 bp, Homo sapiens
gtgtgcatagcgtcctgccc

SEQ ID NO: 949577 - DNA, 21 bp, Homo sapiens
gtgtgcatagcgtcctgccct

SEQ ID NO: 949578 - DNA, 11 bp, Homo sapiens
gtgtgcatgtg

SEQ ID NO: 949579 - DNA, 18 bp, Homo sapiens
gtgtgcatgtgtgtgctc

SEQ ID NO: 949580 - DNA, 22 bp, Homo sapiens
gtgtgccagacaaataggagtg

SEQ ID NO: 949581 - DNA, 14 bp, Homo sapiens
gtgtgcccaagtgg

SEQ ID NO: 949582 - DNA, 13 bp, Homo sapiens
gtgtgccctgggc

SEQ ID NO: 949583 - DNA, 14 bp, Homo sapiens
gtgtgccctgggcc

SEQ ID NO: 949584 - DNA, 21 bp, Homo sapiens
gtgtgccctgggccaggcagg

SEQ ID NO: 949585 - DNA, 22 bp, Homo sapiens
gtgtgccctgggccaggcaggc

SEQ ID NO: 949586 - DNA, 22 bp, Homo sapiens
gtgtgcctcagtatatttaaac

SEQ ID NO: 949587 - DNA, 16 bp, Homo sapiens
gtgtgcctgcagcccc

SEQ ID NO: 949588 - DNA, 15 bp, Homo sapiens
gtgtgcctgccctgg

SEQ ID NO: 949589 - DNA, 13 bp, Homo sapiens
gtgtgcctgtctg

SEQ ID NO: 949590 - DNA, 14 bp, Homo sapiens
gtgtgcctgtggca

SEQ ID NO: 949591 - DNA, 15 bp, Homo sapiens
gtgtgcctgtggcag

SEQ ID NO: 949592 - DNA, 16 bp, Homo sapiens
gtgtgcggaggcagga

SEQ ID NO: 949593 - DNA, 19 bp, Homo sapiens
gtgtgcgtgcgtgtgcgtg

SEQ ID NO: 949594 - DNA, 23 bp, Homo sapiens
gtgtgctctccccggcaggcctg

SEQ ID NO: 949595 - DNA, 19 bp, Homo sapiens
gtgtgctctttttttaaaa

SEQ ID NO: 949596 - DNA, 11 bp, Homo sapiens
gtgtgctggga

SEQ ID NO: 949597 - DNA, 18 bp, Homo sapiens
gtgtgctgtatggcccag

SEQ ID NO: 949598 - DNA, 14 bp, Homo sapiens
gtgtgctgtttgaa

SEQ ID NO: 949599 - DNA, 18 bp, Homo sapiens
gtgtggactcaagtcctt

SEQ ID NO: 949600 - DNA, 15 bp, Homo sapiens
gtgtggactgtgatg

SEQ ID NO: 949601 - DNA, 16 bp, Homo sapiens
gtgtggagaccctgcc

SEQ ID NO: 949602 - DNA, 14 bp, Homo sapiens
gtgtggagaggggt

SEQ ID NO: 949603 - DNA, 12 bp, Homo sapiens
gtgtggcagtgg

SEQ ID NO: 949604 - DNA, 14 bp, Homo sapiens
gtgtggcagtggtt

SEQ ID NO: 949605 - DNA, 17 bp, Homo sapiens
gtgtggccaaccaggac

SEQ ID NO: 949606 - DNA, 11 bp, Homo sapiens
gtgtggccagc

SEQ ID NO: 949607 - DNA, 22 bp, Homo sapiens
gtgtggccatcactcagcccct

SEQ ID NO: 949608 - DNA, 15 bp, Homo sapiens
gtgtggccccttcac

SEQ ID NO: 949609 - DNA, 15 bp, Homo sapiens
gtgtggcctcagccc

SEQ ID NO: 949610 - DNA, 16 bp, Homo sapiens
gtgtggcctcagccct

SEQ ID NO: 949611 - DNA, 15 bp, Homo sapiens
gtgtggcctccctgg

SEQ ID NO: 949612 - DNA, 17 bp, Homo sapiens
gtgtggcctccctggct

SEQ ID NO: 949613 - DNA, 18 bp, Homo sapiens
gtgtggcctggtgggtca

SEQ ID NO: 949614 - DNA, 15 bp, Homo sapiens
tgtcctgcccaccct

SEQ ID NO: 949615 - DNA, 11 bp, Homo sapiens
tgtcctgcctc

SEQ ID NO: 949616 - DNA, 14 bp, Homo sapiens
tgtcctgcctcctc

SEQ ID NO: 949617 - DNA, 15 bp, Homo sapiens
tgtcctgcctcctca

SEQ ID NO: 949618 - DNA, 16 bp, Homo sapiens
tgtcctgcctcctcat

SEQ ID NO: 949619 - DNA, 15 bp, Homo sapiens
tgtcctgcgttttct

SEQ ID NO: 949620 - DNA, 13 bp, Homo sapiens
tgtcctgctctgt

SEQ ID NO: 949621 - DNA, 11 bp, Homo sapiens
tgtcctggccc

SEQ ID NO: 949622 - DNA, 13 bp, Homo sapiens
tgtcctggccctt

SEQ ID NO: 949623 - DNA, 16 bp, Homo sapiens
tgtcctggcccttcag

SEQ ID NO: 949624 - DNA, 19 bp, Homo sapiens
tgtcctggcccttcagtct

SEQ ID NO: 949625 - DNA, 10 bp, Homo sapiens
tgtcctgggc

SEQ ID NO: 949626 - DNA, 11 bp, Homo sapiens
tgtcctgggcg

SEQ ID NO: 949627 - DNA, 16 bp, Homo sapiens
tgtcctgggcgccctg

SEQ ID NO: 949628 - DNA, 13 bp, Homo sapiens
gtgtggggcatgg

SEQ ID NO: 949629 - DNA, 23 bp, Homo sapiens
gtgtggggccatgcctcctcagg

SEQ ID NO: 949630 - DNA, 11 bp, Homo sapiens
gtgtgggggag

SEQ ID NO: 949631 - DNA, 17 bp, Homo sapiens
gtgtgggggagattctg

SEQ ID NO: 949632 - DNA, 20 bp, Homo sapiens
gtgtgggggagattctgggt

SEQ ID NO: 949633 - DNA, 17 bp, Homo sapiens
gtgtggggggctggggg

SEQ ID NO: 949634 - DNA, 18 bp, Homo sapiens
gtgtgggtgctgataatt

SEQ ID NO: 949635 - DNA, 14 bp, Homo sapiens
gtgtgggtgtcctg

SEQ ID NO: 949636 - DNA, 13 bp, Homo sapiens
gtgtgggtgtgtg

SEQ ID NO: 949637 - DNA, 23 bp, Homo sapiens
gtgtggtaccttcagccctggcc

SEQ ID NO: 949638 - DNA, 16 bp, Homo sapiens
gtgtggtgaggggctt

SEQ ID NO: 949639 - DNA, 18 bp, Homo sapiens
gtgtggtgcagtgtgaaa

SEQ ID NO: 949640 - DNA, 22 bp, Homo sapiens
gtgtggtgtttgtaggctgtgg

SEQ ID NO: 949641 - DNA, 15 bp, Homo sapiens
gtgtggttatgaact

SEQ ID NO: 949642 - DNA, 20 bp, Homo sapiens
gtgtggtttccctgcccctg

SEQ ID NO: 949643 - DNA, 17 bp, Homo sapiens
gtgtgtatatgtattta

SEQ ID NO: 949644 - DNA, 19 bp, Homo sapiens
gtgtgtatctaaaggatgg

SEQ ID NO: 949645 - DNA, 21 bp, Homo sapiens
gtgtgtatgactaaagagaga

SEQ ID NO: 949646 - DNA, 20 bp, Homo sapiens
gtgtgtatgtatacacacat

SEQ ID NO: 949647 - DNA, 15 bp, Homo sapiens
gtgtgtattgttccc

SEQ ID NO: 949648 - DNA, 11 bp, Homo sapiens
gtgtgtatttc

SEQ ID NO: 949649 - DNA, 15 bp, Homo sapiens
gtgtgtatttctaag

SEQ ID NO: 949650 - DNA, 12 bp, Homo sapiens
gtgtgtatttgt

SEQ ID NO: 949651 - DNA, 23 bp, Homo sapiens
gtgtgtatttgtattaataaagc

SEQ ID NO: 949652 - DNA, 18 bp, Homo sapiens
gtgtgtccaaaactgcct

SEQ ID NO: 949653 - DNA, 18 bp, Homo sapiens
gtgtgtccccctctgtcc

SEQ ID NO: 949654 - DNA, 19 bp, Homo sapiens
gtgtgtcctctgtgcccac

SEQ ID NO: 949655 - DNA, 12 bp, Homo sapiens
gtgtgtctctgt

SEQ ID NO: 949656 - DNA, 13 bp, Homo sapiens
gtgtgtctgctga

SEQ ID NO: 949657 - DNA, 17 bp, Homo sapiens
gtgtgtctgtctttgtg

SEQ ID NO: 949658 - DNA, 15 bp, Homo sapiens
gtgtgtctgttcact

SEQ ID NO: 949659 - DNA, 22 bp, Homo sapiens
gtgtgtctgttcacttttcctc

SEQ ID NO: 949660 - DNA, 17 bp, Homo sapiens
gtgtgtgaatgaacact

SEQ ID NO: 949661 - DNA, 18 bp, Homo sapiens
gtgtgtgccctgggccag

SEQ ID NO: 949662 - DNA, 20 bp, Homo sapiens
gtgtgtgcgcctgagtgagt

SEQ ID NO: 949663 - DNA, 13 bp, Homo sapiens
gtgtgtggcaggg

SEQ ID NO: 949664 - DNA, 17 bp, Homo sapiens
gtgtgtgggtgtgtgcg

SEQ ID NO: 949665 - DNA, 18 bp, Homo sapiens
gtgtgtggtgaggggctt

SEQ ID NO: 949666 - DNA, 15 bp, Homo sapiens
gtgtgtgtatatata

SEQ ID NO: 949667 - DNA, 15 bp, Homo sapiens
gtgtgtgtatgtata

SEQ ID NO: 949668 - DNA, 13 bp, Homo sapiens
gtgtgtgtatgtg

SEQ ID NO: 949669 - DNA, 12 bp, Homo sapiens
gtgtgtgtgtat

SEQ ID NO: 949670 - DNA, 12 bp, Homo sapiens
gtgtgtgtgtgt

SEQ ID NO: 949671 - DNA, 14 bp, Homo sapiens
gtgtgtgtgtgtgc

SEQ ID NO: 949672 - DNA, 15 bp, Homo sapiens
gtgtgtgtgtgtgca

SEQ ID NO: 949673 - DNA, 15 bp, Homo sapiens
gtgtgtgtgtgtgta

SEQ ID NO: 949674 - DNA, 18 bp, Homo sapiens
gtgtgttatattccaagg

SEQ ID NO: 949675 - DNA, 22 bp, Homo sapiens
gtgtgttcaccttcaaaatgtt

SEQ ID NO: 949676 - DNA, 22 bp, Homo sapiens
gtgtgttcttttgagtccttgt

SEQ ID NO: 949677 - DNA, 16 bp, Homo sapiens
gtgtgttgtcttgaaa

SEQ ID NO: 949678 - DNA, 18 bp, Homo sapiens
gtgtgttgtcttgaaaga

SEQ ID NO: 949679 - DNA, 19 bp, Homo sapiens
gtgtgttgtgtccattttg

SEQ ID NO: 949680 - DNA, 16 bp, Homo sapiens
gtgtgtttaaataaag

SEQ ID NO: 949681 - DNA, 22 bp, Homo sapiens
gtgtgtttaaataaagtatcat

SEQ ID NO: 949682 - DNA, 22 bp, Homo sapiens
gtgtgtttaacattcacagccc

SEQ ID NO: 949683 - DNA, 22 bp, Homo sapiens
gtgtgtttagaagggttcagga

SEQ ID NO: 949684 - DNA, 16 bp, Homo sapiens
gtgtgtttgacatgtg

SEQ ID NO: 949685 - DNA, 20 bp, Homo sapiens
gtgtgtttggcttggccttg

SEQ ID NO: 949686 - DNA, 16 bp, Homo sapiens
gtgtgtttgtgtgtgt

SEQ ID NO: 949687 - DNA, 21 bp, Homo sapiens
gtgtgttttgagagtatatta

SEQ ID NO: 949688 - DNA, 17 bp, Homo sapiens
gtgttaaagctgtacac

SEQ ID NO: 949689 - DNA, 13 bp, Homo sapiens
gtgttaaattcat

SEQ ID NO: 949690 - DNA, 23 bp, Homo sapiens
gtgttacacagcccaagaggact

SEQ ID NO: 949691 - DNA, 18 bp, Homo sapiens
gtgttactgctttgcaaa

SEQ ID NO: 949692 - DNA, 19 bp, Homo sapiens
gtgttactgtaattcctca

SEQ ID NO: 949693 - DNA, 13 bp, Homo sapiens
gtgttagaaaagt

SEQ ID NO: 949694 - DNA, 19 bp, Homo sapiens
gtgttaggaggctgcatgc

SEQ ID NO: 949695 - DNA, 21 bp, Homo sapiens
gtgttaggaggctgcatgctc

SEQ ID NO: 949696 - DNA, 22 bp, Homo sapiens
gtgttagggaagggcctgccac

SEQ ID NO: 949697 - DNA, 17 bp, Homo sapiens
gtgttagtgtctgtcca

SEQ ID NO: 949698 - DNA, 13 bp, Homo sapiens
gtgttatattcca

SEQ ID NO: 949699 - DNA, 17 bp, Homo sapiens
gtgttatcttttgaatt

SEQ ID NO: 949700 - DNA, 22 bp, Homo sapiens
gtgttatgaacatccaagtctt

SEQ ID NO: 949701 - DNA, 13 bp, Homo sapiens
gtgttatgaatct

SEQ ID NO: 949702 - DNA, 17 bp, Homo sapiens
gtgttatttaaatgagt

SEQ ID NO: 949703 - DNA, 20 bp, Homo sapiens
gtgttcaaactactgtacat

SEQ ID NO: 949704 - DNA, 14 bp, Homo sapiens
gtgttcaagaaata

SEQ ID NO: 949705 - DNA, 18 bp, Homo sapiens
gtgttcacaaactgtgaa

SEQ ID NO: 949706 - DNA, 16 bp, Homo sapiens
gtgttcagcagaacct

SEQ ID NO: 949707 - DNA, 21 bp, Homo sapiens
gtgttcagctctttccaaatt

SEQ ID NO: 949708 - DNA, 23 bp, Homo sapiens
gtgttcagctctttccaaattaa

SEQ ID NO: 949709 - DNA, 17 bp, Homo sapiens
gtgttcatacatttgag

SEQ ID NO: 949710 - DNA, 14 bp, Homo sapiens
gtgttcattgtttc

SEQ ID NO: 949711 - DNA, 14 bp, Homo sapiens
gtgttcatttcatt

SEQ ID NO: 949712 - DNA, 17 bp, Homo sapiens
gtgttcccatttcagct

SEQ ID NO: 949713 - DNA, 21 bp, Homo sapiens
gtgttcccatttcagctgatc

SEQ ID NO: 949714 - DNA, 18 bp, Homo sapiens
gtgttccccaagcgcctg

SEQ ID NO: 949715 - DNA, 19 bp, Homo sapiens
gtgttccccatctgggtcc

SEQ ID NO: 949716 - DNA, 15 bp, Homo sapiens
gtgttcctgaagctg

SEQ ID NO: 949717 - DNA, 14 bp, Homo sapiens
gtgttcctggaagc

SEQ ID NO: 949718 - DNA, 15 bp, Homo sapiens
gtgttcctggaagca

SEQ ID NO: 949719 - DNA, 14 bp, Homo sapiens
gtgttcctggctga

SEQ ID NO: 949720 - DNA, 20 bp, Homo sapiens
gtgttcctttttaaatgtga

SEQ ID NO: 949721 - DNA, 14 bp, Homo sapiens
gtgttcgtttccat

SEQ ID NO: 949722 - DNA, 17 bp, Homo sapiens
gtgttcgtttccatcat

SEQ ID NO: 949723 - DNA, 20 bp, Homo sapiens
gtgttcgtttccatcatgtc

SEQ ID NO: 949724 - DNA, 23 bp, Homo sapiens
gtgttcgtttccatcatgtctgt

SEQ ID NO: 949725 - DNA, 11 bp, Homo sapiens
gtgttctcctt

SEQ ID NO: 949726 - DNA, 12 bp, Homo sapiens
gtgttctgctcc

SEQ ID NO: 949727 - DNA, 14 bp, Homo sapiens
gtgttctgctcctg

SEQ ID NO: 949728 - DNA, 21 bp, Homo sapiens
gtgttctgctcctgcttttct

SEQ ID NO: 949729 - DNA, 22 bp, Homo sapiens
gtgttctgctcctgcttttctg

SEQ ID NO: 949730 - DNA, 23 bp, Homo sapiens
gtgttctgctcctgcttttctgt

SEQ ID NO: 949731 - DNA, 12 bp, Homo sapiens
gtgttctgggct

SEQ ID NO: 949732 - DNA, 14 bp, Homo sapiens
gtgttctgttgaag

SEQ ID NO: 949733 - DNA, 23 bp, Homo sapiens
gtgttctgtttgttattgttttg

SEQ ID NO: 949734 - DNA, 15 bp, Homo sapiens
gtgttctttcctgcc

SEQ ID NO: 949735 - DNA, 16 bp, Homo sapiens
gtgttctttcctgccc

SEQ ID NO: 949736 - DNA, 17 bp, Homo sapiens
gtgttctttcctgccct

SEQ ID NO: 949737 - DNA, 14 bp, Homo sapiens
gtgttgacacatat

SEQ ID NO: 949738 - DNA, 14 bp, Homo sapiens
gtgttgactgctgc

SEQ ID NO: 949739 - DNA, 17 bp, Homo sapiens
gtgttgactgctgctcc

SEQ ID NO: 949740 - DNA, 21 bp, Homo sapiens
gtgttgagaagaatcaggaga

SEQ ID NO: 949741 - DNA, 17 bp, Homo sapiens
gtgttgcactgaacagg

SEQ ID NO: 949742 - DNA, 14 bp, Homo sapiens
gtgttgccatttct

SEQ ID NO: 949743 - DNA, 23 bp, Homo sapiens
tgtctccctcgggggctcttccc

SEQ ID NO: 949744 - DNA, 19 bp, Homo sapiens
tgtctccctggttgcctct

SEQ ID NO: 949745 - DNA, 20 bp, Homo sapiens
tgtctccctggttgcctctc

SEQ ID NO: 949746 - DNA, 22 bp, Homo sapiens
tgtctcctacctgctgctgcta

SEQ ID NO: 949747 - DNA, 18 bp, Homo sapiens
tgtctcctactctgtgta

SEQ ID NO: 949748 - DNA, 13 bp, Homo sapiens
tgtctcctcaagc

SEQ ID NO: 949749 - DNA, 19 bp, Homo sapiens
tgtctcctcaagcctgtgg

SEQ ID NO: 949750 - DNA, 18 bp, Homo sapiens
tgtcttaaatgctcataa

SEQ ID NO: 949751 - DNA, 19 bp, Homo sapiens
tgtcttaaatgctcataaa

SEQ ID NO: 949752 - DNA, 18 bp, Homo sapiens
tgtcttaatcgatctggt

SEQ ID NO: 949753 - DNA, 18 bp, Homo sapiens
tgtcttagaagaaattaa

SEQ ID NO: 949754 - DNA, 13 bp, Homo sapiens
tgtcttagttgat

SEQ ID NO: 949755 - DNA, 13 bp, Homo sapiens
tgtcttatatata

SEQ ID NO: 949756 - DNA, 21 bp, Homo sapiens
tgtcttatgtgaaaaattaac

SEQ ID NO: 949757 - DNA, 22 bp, Homo sapiens
tgtcttatgtgaaaaattaact

SEQ ID NO: 949758 - DNA, 12 bp, Homo sapiens
tgtcttattctt

SEQ ID NO: 949759 - DNA, 13 bp, Homo sapiens
tgtcttattctta

SEQ ID NO: 949760 - DNA, 14 bp, Homo sapiens
tgtcttattgaaaa

SEQ ID NO: 949761 - DNA, 16 bp, Homo sapiens
tgtcttcaaactgtga

SEQ ID NO: 949762 - DNA, 20 bp, Homo sapiens
tgtcttcaatttgtataaaa

SEQ ID NO: 949763 - DNA, 22 bp, Homo sapiens
tgtcttcagcagtcaatacaaa

SEQ ID NO: 949764 - DNA, 16 bp, Homo sapiens
tgtcttcatcacttct

SEQ ID NO: 949765 - DNA, 16 bp, Homo sapiens
tgtcttcatttcattg

SEQ ID NO: 949766 - DNA, 20 bp, Homo sapiens
tgtcttccaggtccaaaccc

SEQ ID NO: 949767 - DNA, 16 bp, Homo sapiens
tgtcttccatgtatct

SEQ ID NO: 949768 - DNA, 15 bp, Homo sapiens
tgtcttcccccctct

SEQ ID NO: 949769 - DNA, 13 bp, Homo sapiens
tgtcttcccctga

SEQ ID NO: 949770 - DNA, 15 bp, Homo sapiens
tgtcttccctgggct

SEQ ID NO: 949771 - DNA, 15 bp, Homo sapiens
tgtcttcctagaatt

SEQ ID NO: 949772 - DNA, 14 bp, Homo sapiens
tgtcttccttggag

SEQ ID NO: 949773 - DNA, 19 bp, Homo sapiens
tgtcttctctatcctctct

SEQ ID NO: 949774 - DNA, 14 bp, Homo sapiens
tgtcttctctccac

SEQ ID NO: 949775 - DNA, 12 bp, Homo sapiens
tgtcttctgcct

SEQ ID NO: 949776 - DNA, 13 bp, Homo sapiens
tgtcttctgctgt

SEQ ID NO: 949777 - DNA, 14 bp, Homo sapiens
tgtcttctgctgtt

SEQ ID NO: 949778 - DNA, 22 bp, Homo sapiens
tgtcttctgttcccaaggaagc

SEQ ID NO: 949779 - DNA, 16 bp, Homo sapiens
tgtcttcttttgtggt

SEQ ID NO: 949780 - DNA, 19 bp, Homo sapiens
tgtcttgaaagattcaggt

SEQ ID NO: 949781 - DNA, 17 bp, Homo sapiens
tgtcttgaatgtctttt

SEQ ID NO: 949782 - DNA, 12 bp, Homo sapiens
tgtcttgatttt

SEQ ID NO: 949783 - DNA, 13 bp, Homo sapiens
tgtcttgcaactt

SEQ ID NO: 949784 - DNA, 14 bp, Homo sapiens
tgtcttgcaagtta

SEQ ID NO: 949785 - DNA, 13 bp, Homo sapiens
tgtcttgctcctg

SEQ ID NO: 949786 - DNA, 19 bp, Homo sapiens
tgtcttgctgttgacatat

SEQ ID NO: 949787 - DNA, 22 bp, Homo sapiens
tgtcttgggcagagctggctct

SEQ ID NO: 949788 - DNA, 12 bp, Homo sapiens
tgtcttgtactt

SEQ ID NO: 949789 - DNA, 13 bp, Homo sapiens
tgtcttgtacttc

SEQ ID NO: 949790 - DNA, 19 bp, Homo sapiens
tgtcttgtacttctgtgtt

SEQ ID NO: 949791 - DNA, 18 bp, Homo sapiens
tgtcttgttcattttgag

SEQ ID NO: 949792 - DNA, 22 bp, Homo sapiens
tgtcttgttcattttgagtatt

SEQ ID NO: 949793 - DNA, 14 bp, Homo sapiens
tgtcttgtttcagt

SEQ ID NO: 949794 - DNA, 15 bp, Homo sapiens
tgtctttaagaacta

SEQ ID NO: 949795 - DNA, 18 bp, Homo sapiens
tgtctttagatagccctg

SEQ ID NO: 949796 - DNA, 19 bp, Homo sapiens
tgtctttaggcagcagctt

SEQ ID NO: 949797 - DNA, 21 bp, Homo sapiens
tgtctttaggcagcagctttt

SEQ ID NO: 949798 - DNA, 13 bp, Homo sapiens
tgtctttattctt

SEQ ID NO: 949799 - DNA, 15 bp, Homo sapiens
tgtctttcagataca

SEQ ID NO: 949800 - DNA, 19 bp, Homo sapiens
tgtctttcagatacatggt

SEQ ID NO: 949801 - DNA, 19 bp, Homo sapiens
tgtctttcagcattaggct

SEQ ID NO: 949802 - DNA, 12 bp, Homo sapiens
tgtctttctgag

SEQ ID NO: 949803 - DNA, 12 bp, Homo sapiens
tgtctttgaatc

SEQ ID NO: 949804 - DNA, 12 bp, Homo sapiens
tgtctttgctgt

SEQ ID NO: 949805 - DNA, 21 bp, Homo sapiens
tgtctttgctgtactcttgct

SEQ ID NO: 949806 - DNA, 20 bp, Homo sapiens
tgtctttgtaatattttcca

SEQ ID NO: 949807 - DNA, 13 bp, Homo sapiens
tgtctttgtggga

SEQ ID NO: 949808 - DNA, 18 bp, Homo sapiens
tgtcttttaatgcttcat

SEQ ID NO: 949809 - DNA, 14 bp, Homo sapiens
tgtcttttagacaa

SEQ ID NO: 949810 - DNA, 13 bp, Homo sapiens
tgtcttttcaagt

SEQ ID NO: 949811 - DNA, 19 bp, Homo sapiens
tgtcttttcaagtaatttt

SEQ ID NO: 949812 - DNA, 23 bp, Homo sapiens
tgtcttttcagaagcaagccaga

SEQ ID NO: 949813 - DNA, 20 bp, Homo sapiens
tgtctttttctggactgaag

SEQ ID NO: 949814 - DNA, 15 bp, Homo sapiens
tgtctttttgttgta

SEQ ID NO: 949815 - DNA, 14 bp, Homo sapiens
tgtctttttttgta

SEQ ID NO: 949816 - DNA, 16 bp, Homo sapiens
tgtctttttttgtata

SEQ ID NO: 949817 - DNA, 23 bp, Homo sapiens
tgtctttttttgtatagttaaca

SEQ ID NO: 949818 - DNA, 17 bp, Homo sapiens
tgtcttttttttcatcc

SEQ ID NO: 949819 - DNA, 13 bp, Homo sapiens
tgtgaaaaaagaa

SEQ ID NO: 949820 - DNA, 22 bp, Homo sapiens
tgtgaaaaagatgccaattatt

SEQ ID NO: 949821 - DNA, 13 bp, Homo sapiens
tgtgaaaaaggaa

SEQ ID NO: 949822 - DNA, 12 bp, Homo sapiens
tgtgaaaaatta

SEQ ID NO: 949823 - DNA, 17 bp, Homo sapiens
tgtgaaaaattaacttt

SEQ ID NO: 949824 - DNA, 14 bp, Homo sapiens
tgtgaaaacaatat

SEQ ID NO: 949825 - DNA, 17 bp, Homo sapiens
tgtgaaaacatatttgt

SEQ ID NO: 949826 - DNA, 21 bp, Homo sapiens
tgtgaaaagaaaaatgagcct

SEQ ID NO: 949827 - DNA, 16 bp, Homo sapiens
tgtgaaaagagtatgt

SEQ ID NO: 949828 - DNA, 23 bp, Homo sapiens
tgtgaaaagcacagctgtatata

SEQ ID NO: 949829 - DNA, 23 bp, Homo sapiens
tgtgaaaagcttaataaattcca

SEQ ID NO: 949830 - DNA, 18 bp, Homo sapiens
tgtgaaaatatctgctca

SEQ ID NO: 949831 - DNA, 13 bp, Homo sapiens
tgtgaaaatgggt

SEQ ID NO: 949832 - DNA, 15 bp, Homo sapiens
tgtgaaacatcttct

SEQ ID NO: 949833 - DNA, 18 bp, Homo sapiens
tgtgaaactctaccctga

SEQ ID NO: 949834 - DNA, 14 bp, Homo sapiens
tgtgaaactttcat

SEQ ID NO: 949835 - DNA, 15 bp, Homo sapiens
tgtgaaactttcatt

SEQ ID NO: 949836 - DNA, 21 bp, Homo sapiens
tgtgaaagtcagatgcccaga

SEQ ID NO: 949837 - DNA, 21 bp, Homo sapiens
tgtgaaatagttcaaagccaa

SEQ ID NO: 949838 - DNA, 14 bp, Homo sapiens
tgtgaaatatcatc

SEQ ID NO: 949839 - DNA, 15 bp, Homo sapiens
tgtgaaatgtaacat

SEQ ID NO: 949840 - DNA, 13 bp, Homo sapiens
tgtgaacagcttg

SEQ ID NO: 949841 - DNA, 16 bp, Homo sapiens
tgtgaacagcttgctg

SEQ ID NO: 949842 - DNA, 12 bp, Homo sapiens
tgtgaacgctgt

SEQ ID NO: 949843 - DNA, 22 bp, Homo sapiens
tgtgaacgtccttccttgactg

SEQ ID NO: 949844 - DNA, 14 bp, Homo sapiens
tgtgaactcaccct

SEQ ID NO: 949845 - DNA, 15 bp, Homo sapiens
tgtgaactgacaggc

SEQ ID NO: 949846 - DNA, 17 bp, Homo sapiens
tgtgaactgctttcaag

SEQ ID NO: 949847 - DNA, 13 bp, Homo sapiens
tgtgaactttcat

SEQ ID NO: 949848 - DNA, 14 bp, Homo sapiens
tgtgaagaaaaaga

SEQ ID NO: 949849 - DNA, 13 bp, Homo sapiens
tgtgaagaaagcc

SEQ ID NO: 949850 - DNA, 22 bp, Homo sapiens
tgtgaagatgatatactatttt

SEQ ID NO: 949851 - DNA, 13 bp, Homo sapiens
tgtgaagcaccta

SEQ ID NO: 949852 - DNA, 22 bp, Homo sapiens
tgtgaagcatgctttgctgcta

SEQ ID NO: 949853 - DNA, 15 bp, Homo sapiens
tgtgaagcatttaca

SEQ ID NO: 949854 - DNA, 10 bp, Homo sapiens
tgtgaagcca

SEQ ID NO: 949855 - DNA, 12 bp, Homo sapiens
tgtgaaggccca

SEQ ID NO: 949856 - DNA, 21 bp, Homo sapiens
tgtgaaggcccaagagcagag

SEQ ID NO: 949857 - DNA, 12 bp, Homo sapiens
tgtgaataaatt

SEQ ID NO: 949858 - DNA, 12 bp, Homo sapiens
tgtgaatacaat

SEQ ID NO: 949859 - DNA, 17 bp, Homo sapiens
tgtgaatacaattaaag

SEQ ID NO: 949860 - DNA, 15 bp, Homo sapiens
tgtgaatagcctggc

SEQ ID NO: 949861 - DNA, 13 bp, Homo sapiens
tgtgaatattcct

SEQ ID NO: 949862 - DNA, 15 bp, Homo sapiens
tgtgaatcagaccct

SEQ ID NO: 949863 - DNA, 19 bp, Homo sapiens
tgtgaatcgcagctgtggg

SEQ ID NO: 949864 - DNA, 17 bp, Homo sapiens
tgtgaatgaacactctt

SEQ ID NO: 949865 - DNA, 18 bp, Homo sapiens
tgtgaattaaaaaagctc

SEQ ID NO: 949866 - DNA, 22 bp, Homo sapiens
tgtgaattaacacagtgtttca

SEQ ID NO: 949867 - DNA, 23 bp, Homo sapiens
tgtgaattaggctgtaactactt

SEQ ID NO: 949868 - DNA, 24 bp, Homo sapiens
tgtgaattaggctgtaactacttt

SEQ ID NO: 949869 - DNA, 18 bp, Homo sapiens
tgtgaattgcctgcagag

SEQ ID NO: 949870 - DNA, 19 bp, Homo sapiens
tgtgaattgtttttgtaca

SEQ ID NO: 949871 - DNA, 12 bp, Homo sapiens
tgtgaatttcaa

SEQ ID NO: 949872 - DNA, 23 bp, Homo sapiens
tgtgaatttcttcactgttgaaa

SEQ ID NO: 949873 - DNA, 15 bp, Homo sapiens
tgtgaatttttgcct

SEQ ID NO: 949874 - DNA, 12 bp, Homo sapiens
gttagtcatttg

SEQ ID NO: 949875 - DNA, 22 bp, Homo sapiens
gttagtctcttgtattaaactc

SEQ ID NO: 949876 - DNA, 14 bp, Homo sapiens
gttagtgatgcagt

SEQ ID NO: 949877 - DNA, 15 bp, Homo sapiens
gttagtgtgtgtgca

SEQ ID NO: 949878 - DNA, 19 bp, Homo sapiens
gttagtgtgtgtgcatgtg

SEQ ID NO: 949879 - DNA, 17 bp, Homo sapiens
gttagttaatccctttg

SEQ ID NO: 949880 - DNA, 21 bp, Homo sapiens
gttagtttgtatatattatta

SEQ ID NO: 949881 - DNA, 15 bp, Homo sapiens
gttataaaaaatggt

SEQ ID NO: 949882 - DNA, 12 bp, Homo sapiens
gttataaataaa

SEQ ID NO: 949883 - DNA, 16 bp, Homo sapiens
gttataataactgaac

SEQ ID NO: 949884 - DNA, 17 bp, Homo sapiens
gttataataactgaact

SEQ ID NO: 949885 - DNA, 18 bp, Homo sapiens
tgtgatgtaaggcactgt

SEQ ID NO: 949886 - DNA, 13 bp, Homo sapiens
tgtgatgtcatga

SEQ ID NO: 949887 - DNA, 15 bp, Homo sapiens
tgtgatgtgaagcca

SEQ ID NO: 949888 - DNA, 13 bp, Homo sapiens
tgtgattagatca

SEQ ID NO: 949889 - DNA, 18 bp, Homo sapiens
tgtgattatttcacttta

SEQ ID NO: 949890 - DNA, 15 bp, Homo sapiens
tgtgattcaatctgt

SEQ ID NO: 949891 - DNA, 20 bp, Homo sapiens
tgtgattcagaaaatgttct

SEQ ID NO: 949892 - DNA, 12 bp, Homo sapiens
tgtgattctgtt

SEQ ID NO: 949893 - DNA, 15 bp, Homo sapiens
tgtgattcttctaaa

SEQ ID NO: 949894 - DNA, 16 bp, Homo sapiens
tgtgattgcacagaat

SEQ ID NO: 949895 - DNA, 17 bp, Homo sapiens
tgtgatttagaactgta

SEQ ID NO: 949896 - DNA, 18 bp, Homo sapiens
tgtgatttagaactgtat

SEQ ID NO: 949897 - DNA, 13 bp, Homo sapiens
tgtgatttccatt

SEQ ID NO: 949898 - DNA, 17 bp, Homo sapiens
tgtgatttccatttctg

SEQ ID NO: 949899 - DNA, 19 bp, Homo sapiens
tgtgatttcctaatatgat

SEQ ID NO: 949900 - DNA, 16 bp, Homo sapiens
tgtgatttcttctccc

SEQ ID NO: 949901 - DNA, 20 bp, Homo sapiens
tgtgatttcttctccctcct

SEQ ID NO: 949902 - DNA, 21 bp, Homo sapiens
tgtgatttctttaaaagaatg

SEQ ID NO: 949903 - DNA, 15 bp, Homo sapiens
tgtgatttctttctt

SEQ ID NO: 949904 - DNA, 16 bp, Homo sapiens
tgtgatttgaattctg

SEQ ID NO: 949905 - DNA, 15 bp, Homo sapiens
tgtgatttggttgca

SEQ ID NO: 949906 - DNA, 17 bp, Homo sapiens
tgtgattttgccctcct

SEQ ID NO: 949907 - DNA, 18 bp, Homo sapiens
tgtgattttgccctcctg

SEQ ID NO: 949908 - DNA, 17 bp, Homo sapiens
tgtgatttttataatac

SEQ ID NO: 949909 - DNA, 18 bp, Homo sapiens
tgtgatttttataataca

SEQ ID NO: 949910 - DNA, 11 bp, Homo sapiens
tgtgatttttt

SEQ ID NO: 949911 - DNA, 17 bp, Homo sapiens
tgtgcaaaaaaattaaa

SEQ ID NO: 949912 - DNA, 20 bp, Homo sapiens
tgtgcaaaaaaattaaaatg

SEQ ID NO: 949913 - DNA, 23 bp, Homo sapiens
tgtgcaaaaaaattaaaatggat

SEQ ID NO: 949914 - DNA, 19 bp, Homo sapiens
tgtgcaaatctgacaatat

SEQ ID NO: 949915 - DNA, 18 bp, Homo sapiens
tgtgcaacagggtatgga

SEQ ID NO: 949916 - DNA, 15 bp, Homo sapiens
tgtgcaacctgtggc

SEQ ID NO: 949917 - DNA, 15 bp, Homo sapiens
tgtgcaactggccag

SEQ ID NO: 949918 - DNA, 23 bp, Homo sapiens
tgtgcaagcgacgacagatgcta

SEQ ID NO: 949919 - DNA, 17 bp, Homo sapiens
tgtgcaagtatgtgagt

SEQ ID NO: 949920 - DNA, 15 bp, Homo sapiens
tgtgcaagtgtctgt

SEQ ID NO: 949921 - DNA, 20 bp, Homo sapiens
tgtgcaagtgtctgtgtgca

SEQ ID NO: 949922 - DNA, 14 bp, Homo sapiens
tgtgcaataatttg

SEQ ID NO: 949923 - DNA, 22 bp, Homo sapiens
tgtgcaataatttgtacaatgg

SEQ ID NO: 949924 - DNA, 14 bp, Homo sapiens
tgtgcaataggtga

SEQ ID NO: 949925 - DNA, 18 bp, Homo sapiens
tgtgcacacgtgtgtatg

SEQ ID NO: 949926 - DNA, 15 bp, Homo sapiens
tgtgcacagaaaacc

SEQ ID NO: 949927 - DNA, 17 bp, Homo sapiens
tgtgcacatctgtgtct

SEQ ID NO: 949928 - DNA, 20 bp, Homo sapiens
tgtgcacatctgtgtcttgt

SEQ ID NO: 949929 - DNA, 21 bp, Homo sapiens
tgtgcacatctgtgtcttgtt

SEQ ID NO: 949930 - DNA, 18 bp, Homo sapiens
tgtgcacatgtgtgcgtg

SEQ ID NO: 949931 - DNA, 14 bp, Homo sapiens
tgtgcaccagggtt

SEQ ID NO: 949932 - DNA, 19 bp, Homo sapiens
tgtgcacgtggcatgtggc

SEQ ID NO: 949933 - DNA, 17 bp, Homo sapiens
tgtgcactaaggggccc

SEQ ID NO: 949934 - DNA, 21 bp, Homo sapiens
tgtgcactgcccatggacagg

SEQ ID NO: 949935 - DNA, 14 bp, Homo sapiens
tgtgcactgtcact

SEQ ID NO: 949936 - DNA, 17 bp, Homo sapiens
tgtgcactgtcactttg

SEQ ID NO: 949937 - DNA, 20 bp, Homo sapiens
tgtgcagaaaagctcagagt

SEQ ID NO: 949938 - DNA, 12 bp, Homo sapiens
tgtgcagaataa

SEQ ID NO: 949939 - DNA, 15 bp, Homo sapiens
tgtgcagaataatgg

SEQ ID NO: 949940 - DNA, 22 bp, Homo sapiens
tgtgcagatgctgctgaagaga

SEQ ID NO: 949941 - DNA, 12 bp, Homo sapiens
tgtgcagcagcc

SEQ ID NO: 949942 - DNA, 20 bp, Homo sapiens
tgtgcagcagcccagcttcc

SEQ ID NO: 949943 - DNA, 17 bp, Homo sapiens
tgtgcagcgacccttgg

SEQ ID NO: 949944 - DNA, 21 bp, Homo sapiens
tgtgcagcttcgaggacagga

SEQ ID NO: 949945 - DNA, 14 bp, Homo sapiens
tgtgcaggagcctc

SEQ ID NO: 949946 - DNA, 15 bp, Homo sapiens
tgtgcaggagcctcc

SEQ ID NO: 949947 - DNA, 19 bp, Homo sapiens
tgtgcaggagcctccctgc

SEQ ID NO: 949948 - DNA, 20 bp, Homo sapiens
tgtgcaggagcctccctgca

SEQ ID NO: 949949 - DNA, 20 bp, Homo sapiens
tgtgcagggatattgcctta

SEQ ID NO: 949950 - DNA, 17 bp, Homo sapiens
tgtgcaggtttgttaca

SEQ ID NO: 949951 - DNA, 20 bp, Homo sapiens
tgtgcatagcgtcctgccct

SEQ ID NO: 949952 - DNA, 12 bp, Homo sapiens
tgtgcatataaa

SEQ ID NO: 949953 - DNA, 15 bp, Homo sapiens
tgtgcatctggtgta

SEQ ID NO: 949954 - DNA, 19 bp, Homo sapiens
tgtgcatggaggccctcct

SEQ ID NO: 949955 - DNA, 19 bp, Homo sapiens
tgtgcatgggtgaagggag

SEQ ID NO: 949956 - DNA, 14 bp, Homo sapiens
tgtgcatgtgagca

SEQ ID NO: 949957 - DNA, 22 bp, Homo sapiens
tgtgcatgtgtgcgagtgtgtg

SEQ ID NO: 949958 - DNA, 22 bp, Homo sapiens
tgtgcatgtgtgtaagtgtgtg

SEQ ID NO: 949959 - DNA, 14 bp, Homo sapiens
tgtgcattatctag

SEQ ID NO: 949960 - DNA, 19 bp, Homo sapiens
tgtgcattatctagatact

SEQ ID NO: 949961 - DNA, 21 bp, Homo sapiens
tgtgcattatctagatactgt

SEQ ID NO: 949962 - DNA, 13 bp, Homo sapiens
tgtgcattctttg

SEQ ID NO: 949963 - DNA, 14 bp, Homo sapiens
tgtgcattctttgg

SEQ ID NO: 949964 - DNA, 19 bp, Homo sapiens
tgtgcattctttggtaatt

SEQ ID NO: 949965 - DNA, 23 bp, Homo sapiens
tgtgcattcttttaaaagacaag

SEQ ID NO: 949966 - DNA, 20 bp, Homo sapiens
tgtgcatttcacctgtgaca

SEQ ID NO: 949967 - DNA, 14 bp, Homo sapiens
tgtgcatttgtaaa

SEQ ID NO: 949968 - DNA, 19 bp, Homo sapiens
tgtgcattttgtggaattt

SEQ ID NO: 949969 - DNA, 14 bp, Homo sapiens
tgtgccaacctgtt

SEQ ID NO: 949970 - DNA, 17 bp, Homo sapiens
tgtgccaacctgttctt

SEQ ID NO: 949971 - DNA, 16 bp, Homo sapiens
tgtgccaatatgtatt

SEQ ID NO: 949972 - DNA, 13 bp, Homo sapiens
tgtgccacacagt

SEQ ID NO: 949973 - DNA, 22 bp, Homo sapiens
tgtgccacacgcatgggcattg

SEQ ID NO: 949974 - DNA, 14 bp, Homo sapiens
tgtgccaccacgcc

SEQ ID NO: 949975 - DNA, 20 bp, Homo sapiens
tgtgccacctgtccggccca

SEQ ID NO: 949976 - DNA, 21 bp, Homo sapiens
tgtgccacctgtccggcccag

SEQ ID NO: 949977 - DNA, 20 bp, Homo sapiens
tgtgccagaggaatcctggc

SEQ ID NO: 949978 - DNA, 14 bp, Homo sapiens
tgtgccagcccgga

SEQ ID NO: 949979 - DNA, 20 bp, Homo sapiens
tgtgccaggaggcggcagct

SEQ ID NO: 949980 - DNA, 12 bp, Homo sapiens
tgtgccaggctg

SEQ ID NO: 949981 - DNA, 13 bp, Homo sapiens
tgtgccaggctga

SEQ ID NO: 949982 - DNA, 15 bp, Homo sapiens
tgtgccaggcttgcc

SEQ ID NO: 949983 - DNA, 16 bp, Homo sapiens
tgtgccagttcctgta

SEQ ID NO: 949984 - DNA, 14 bp, Homo sapiens
tgtgccatgctggg

SEQ ID NO: 949985 - DNA, 17 bp, Homo sapiens
tgtgccatggcccccca

SEQ ID NO: 949986 - DNA, 18 bp, Homo sapiens
tgtgccattatatttgca

SEQ ID NO: 949987 - DNA, 22 bp, Homo sapiens
tgtgccattttaaaaaaaaagg

SEQ ID NO: 949988 - DNA, 20 bp, Homo sapiens
tgtgcccacatcccaggctt

SEQ ID NO: 949989 - DNA, 22 bp, Homo sapiens
tgtgcccacccgtcttcaatct

SEQ ID NO: 949990 - DNA, 23 bp, Homo sapiens
tgtgcccacggtctgagctagct

SEQ ID NO: 949991 - DNA, 14 bp, Homo sapiens
tgtgccccagctgc

SEQ ID NO: 949992 - DNA, 19 bp, Homo sapiens
tgtgccccatgcctgtcca

SEQ ID NO: 949993 - DNA, 23 bp, Homo sapiens
tgtgccccatgcctgtccagcct

SEQ ID NO: 949994 - DNA, 16 bp, Homo sapiens
tgtgccccgcgggctt

SEQ ID NO: 949995 - DNA, 14 bp, Homo sapiens
tgtgcccctggccc

SEQ ID NO: 949996 - DNA, 16 bp, Homo sapiens
tgtggactaaatatct

SEQ ID NO: 949997 - DNA, 24 bp, Homo sapiens
tgtggactgtcctgaggagccctg

SEQ ID NO: 949998 - DNA, 12 bp, Homo sapiens
tgtggagaagcg

SEQ ID NO: 949999 - DNA, 22 bp, Homo sapiens
tgtggagaccctgccacagcca

SEQ ID NO: 950000 - DNA, 21 bp, Homo sapiens
tgtggagaggggtgcacccac

SEQ ID NO: 950001 - DNA, 18 bp, Homo sapiens
tgtggagcaaaaggcagc

SEQ ID NO: 950002 - DNA, 22 bp, Homo sapiens
tgtggagcaaaaggcagctcac

SEQ ID NO: 950003 - DNA, 18 bp, Homo sapiens
tgtggagcacgtggagat

SEQ ID NO: 950004 - DNA, 19 bp, Homo sapiens
tgtggagcccgcaccccca

SEQ ID NO: 950005 - DNA, 19 bp, Homo sapiens
tgtggagctactgatgaaa

SEQ ID NO: 950006 - DNA, 22 bp, Homo sapiens
tgtggaggaagagccacctgca

SEQ ID NO: 950007 - DNA, 18 bp, Homo sapiens
tgtggagttcaccttgga

SEQ ID NO: 950008 - DNA, 20 bp, Homo sapiens
tgtggagttcaccttggaag

SEQ ID NO: 950009 - DNA, 18 bp, Homo sapiens
tgtggagttcctgctccg

SEQ ID NO: 950010 - DNA, 16 bp, Homo sapiens
tgtggagttggggctg

SEQ ID NO: 950011 - DNA, 17 bp, Homo sapiens
tgtggataagggagagt

SEQ ID NO: 950012 - DNA, 18 bp, Homo sapiens
tgtggatacagtgcccac

SEQ ID NO: 950013 - DNA, 15 bp, Homo sapiens
tgtggatataaaatg

SEQ ID NO: 950014 - DNA, 22 bp, Homo sapiens
tgtggatatcagggtataaatt

SEQ ID NO: 950015 - DNA, 18 bp, Homo sapiens
gttcagtttcttctgcgc

SEQ ID NO: 950016 - DNA, 12 bp, Homo sapiens
gttcataaatga

SEQ ID NO: 950017 - DNA, 13 bp, Homo sapiens
gttcataaatgaa

SEQ ID NO: 950018 - DNA, 14 bp, Homo sapiens
gttcataggggcag

SEQ ID NO: 950019 - DNA, 15 bp, Homo sapiens
gttcataggggcagg

SEQ ID NO: 950020 - DNA, 20 bp, Homo sapiens
gttcatatatcaagaagtct

SEQ ID NO: 950021 - DNA, 19 bp, Homo sapiens
gttcatattccatatttat

SEQ ID NO: 950022 - DNA, 13 bp, Homo sapiens
gttcatattggat

SEQ ID NO: 950023 - DNA, 17 bp, Homo sapiens
gttcatatttattgatt

SEQ ID NO: 950024 - DNA, 17 bp, Homo sapiens
gttcatcacctgctaga

SEQ ID NO: 950025 - DNA, 13 bp, Homo sapiens
gttcatcagtgtt

SEQ ID NO: 950026 - DNA, 17 bp, Homo sapiens
gttcatcatcctaagct

SEQ ID NO: 950027 - DNA, 17 bp, Homo sapiens
gttcatccaaggctgtt

SEQ ID NO: 950028 - DNA, 15 bp, Homo sapiens
gttcatccaatcctc

SEQ ID NO: 950029 - DNA, 20 bp, Homo sapiens
gttcatctgagcaagagctg

SEQ ID NO: 950030 - DNA, 19 bp, Homo sapiens
gttcatgagaatctatatt

SEQ ID NO: 950031 - DNA, 16 bp, Homo sapiens
gttcatgccaccatgg

SEQ ID NO: 950032 - DNA, 17 bp, Homo sapiens
gttcatgctccaagact

SEQ ID NO: 950033 - DNA, 19 bp, Homo sapiens
gttcatggggatctggggg

SEQ ID NO: 950034 - DNA, 19 bp, Homo sapiens
gttcatgtagagaaaagca

SEQ ID NO: 950035 - DNA, 15 bp, Homo sapiens
gttcatgtttgcttc

SEQ ID NO: 950036 - DNA, 15 bp, Homo sapiens
gttcatgtttgtaaa

SEQ ID NO: 950037 - DNA, 18 bp, Homo sapiens
gttcatgtttgtaaatta

SEQ ID NO: 950038 - DNA, 19 bp, Homo sapiens
gttcattagaaatatttta

SEQ ID NO: 950039 - DNA, 18 bp, Homo sapiens
gttcattataatctcaaa

SEQ ID NO: 950040 - DNA, 14 bp, Homo sapiens
gttcattattttgt

SEQ ID NO: 950041 - DNA, 18 bp, Homo sapiens
gttcattattttgtggtt

SEQ ID NO: 950042 - DNA, 16 bp, Homo sapiens
gttcattcaagctatt

SEQ ID NO: 950043 - DNA, 18 bp, Homo sapiens
gttcattgcaattaaact

SEQ ID NO: 950044 - DNA, 18 bp, Homo sapiens
gttcattgcctttccagg

SEQ ID NO: 950045 - DNA, 21 bp, Homo sapiens
gttcatttggtgttcctggaa

SEQ ID NO: 950046 - DNA, 15 bp, Homo sapiens
gttcatttgtttgtt

SEQ ID NO: 950047 - DNA, 13 bp, Homo sapiens
gttcattttagtg

SEQ ID NO: 950048 - DNA, 17 bp, Homo sapiens
gttcattttgagctgaa

SEQ ID NO: 950049 - DNA, 15 bp, Homo sapiens
gttccaaattcagtt

SEQ ID NO: 950050 - DNA, 20 bp, Homo sapiens
gttccaaattcagtttcata

SEQ ID NO: 950051 - DNA, 17 bp, Homo sapiens
gttccaaccactgaatc

SEQ ID NO: 950052 - DNA, 14 bp, Homo sapiens
gttccaagacattg

SEQ ID NO: 950053 - DNA, 15 bp, Homo sapiens
gttccaagacattgt

SEQ ID NO: 950054 - DNA, 17 bp, Homo sapiens
gttccaagacattgtca

SEQ ID NO: 950055 - DNA, 21 bp, Homo sapiens
gttccacgtccccctggggct

SEQ ID NO: 950056 - DNA, 13 bp, Homo sapiens
gttccactgagct

SEQ ID NO: 950057 - DNA, 15 bp, Homo sapiens
gttccactgagctcc

SEQ ID NO: 950058 - DNA, 18 bp, Homo sapiens
gttccactgagctccatg

SEQ ID NO: 950059 - DNA, 17 bp, Homo sapiens
gttccagaacagccctc

SEQ ID NO: 950060 - DNA, 11 bp, Homo sapiens
gttccagaggc

SEQ ID NO: 950061 - DNA, 19 bp, Homo sapiens
gttccagaggtattcctct

SEQ ID NO: 950062 - DNA, 13 bp, Homo sapiens
gttccagcagagg

SEQ ID NO: 950063 - DNA, 12 bp, Homo sapiens
gttccagctctt

SEQ ID NO: 950064 - DNA, 16 bp, Homo sapiens
gttccagctctttgaa

SEQ ID NO: 950065 - DNA, 19 bp, Homo sapiens
gttccaggccctccagtgg

SEQ ID NO: 950066 - DNA, 17 bp, Homo sapiens
gttccagggtccctctg

SEQ ID NO: 950067 - DNA, 20 bp, Homo sapiens
gttccagggtccctctgtgt

SEQ ID NO: 950068 - DNA, 21 bp, Homo sapiens
gttccagggtccctctgtgta

SEQ ID NO: 950069 - DNA, 17 bp, Homo sapiens
gttccagtttctccttg

SEQ ID NO: 950070 - DNA, 18 bp, Homo sapiens
gttccagtttctccttga

SEQ ID NO: 950071 - DNA, 23 bp, Homo sapiens
gttccatctcctataatctgtca

SEQ ID NO: 950072 - DNA, 20 bp, Homo sapiens
gttccatggcctcttcagat

SEQ ID NO: 950073 - DNA, 22 bp, Homo sapiens
gttcccaagaaaggaaaccttt

SEQ ID NO: 950074 - DNA, 14 bp, Homo sapiens
gttcccaaggacat

SEQ ID NO: 950075 - DNA, 18 bp, Homo sapiens
gttcccaataaaagtgac

SEQ ID NO: 950076 - DNA, 17 bp, Homo sapiens
gttcccacattaaagaa

SEQ ID NO: 950077 - DNA, 21 bp, Homo sapiens
gttcccagctccccccgccca

SEQ ID NO: 950078 - DNA, 15 bp, Homo sapiens
gttccccaaatacaa

SEQ ID NO: 950079 - DNA, 16 bp, Homo sapiens
gttccccacacagggc

SEQ ID NO: 950080 - DNA, 18 bp, Homo sapiens
gttccccacacagggcac

SEQ ID NO: 950081 - DNA, 20 bp, Homo sapiens
gttccccacacagggcactg

SEQ ID NO: 950082 - DNA, 23 bp, Homo sapiens
gttccccatctgggtccttgcac

SEQ ID NO: 950083 - DNA, 13 bp, Homo sapiens
gttcccccagccc

SEQ ID NO: 950084 - DNA, 17 bp, Homo sapiens
gttcccccagccctgtg

SEQ ID NO: 950085 - DNA, 20 bp, Homo sapiens
gttcccccagccctgtggaa

SEQ ID NO: 950086 - DNA, 19 bp, Homo sapiens
gttcccccagtacctccaa

SEQ ID NO: 950087 - DNA, 17 bp, Homo sapiens
gttcccctcacccaaaa

SEQ ID NO: 950088 - DNA, 14 bp, Homo sapiens
gttcccctctccct

SEQ ID NO: 950089 - DNA, 18 bp, Homo sapiens
gttcccctcttgtctccc

SEQ ID NO: 950090 - DNA, 21 bp, Homo sapiens
gttcccctcttgtctcccctg

SEQ ID NO: 950091 - DNA, 19 bp, Homo sapiens
gttcccgagggagctgctg

SEQ ID NO: 950092 - DNA, 22 bp, Homo sapiens
gttcccgatggtctctctccct

SEQ ID NO: 950093 - DNA, 15 bp, Homo sapiens
gttcccggagcacag

SEQ ID NO: 950094 - DNA, 17 bp, Homo sapiens
gttcccggagcacagcc

SEQ ID NO: 950095 - DNA, 22 bp, Homo sapiens
gttcccggagcacagccctggg

SEQ ID NO: 950096 - DNA, 17 bp, Homo sapiens
gttccctcctagctctc

SEQ ID NO: 950097 - DNA, 21 bp, Homo sapiens
gttccctcctagctctcccag

SEQ ID NO: 950098 - DNA, 17 bp, Homo sapiens
gttccctcctgcccagg

SEQ ID NO: 950099 - DNA, 17 bp, Homo sapiens
gttccctcctggtcctg

SEQ ID NO: 950100 - DNA, 19 bp, Homo sapiens
gttccctcctggtcctgga

SEQ ID NO: 950101 - DNA, 22 bp, Homo sapiens
gttccctcctggtcctggacac

SEQ ID NO: 950102 - DNA, 21 bp, Homo sapiens
gttccctctgctcctggagcc

SEQ ID NO: 950103 - DNA, 12 bp, Homo sapiens
gttccctgcacc

SEQ ID NO: 950104 - DNA, 13 bp, Homo sapiens
gttccctgcaccc

SEQ ID NO: 950105 - DNA, 14 bp, Homo sapiens
gttccctgcaccct

SEQ ID NO: 950106 - DNA, 13 bp, Homo sapiens
gttccctgggctg

SEQ ID NO: 950107 - DNA, 17 bp, Homo sapiens
gttccctgttctggtat

SEQ ID NO: 950108 - DNA, 14 bp, Homo sapiens
gttcccttcctcac

SEQ ID NO: 950109 - DNA, 15 bp, Homo sapiens
gttcccttcctcacc

SEQ ID NO: 950110 - DNA, 20 bp, Homo sapiens
gttcccttcctcttcctgcc

SEQ ID NO: 950111 - DNA, 13 bp, Homo sapiens
gttcccttctccc

SEQ ID NO: 950112 - DNA, 14 bp, Homo sapiens
gttcccttggcctc

SEQ ID NO: 950113 - DNA, 15 bp, Homo sapiens
gttcccttggcctca

SEQ ID NO: 950114 - DNA, 16 bp, Homo sapiens
gttcccttggcctcag

SEQ ID NO: 950115 - DNA, 15 bp, Homo sapiens
gttcccttgtaaaga

SEQ ID NO: 950116 - DNA, 19 bp, Homo sapiens
gttccctttgccttaaacc

SEQ ID NO: 950117 - DNA, 19 bp, Homo sapiens
gttccggcctgggcaccag

SEQ ID NO: 950118 - DNA, 18 bp, Homo sapiens
gtttattctgtggttcta

SEQ ID NO: 950119 - DNA, 21 bp, Homo sapiens
gtttattctgtggttctataa

SEQ ID NO: 950120 - DNA, 19 bp, Homo sapiens
gtttattgtttgatgtttt

SEQ ID NO: 950121 - DNA, 14 bp, Homo sapiens
gtttatttatcagt

SEQ ID NO: 950122 - DNA, 19 bp, Homo sapiens
gtttatttatcagtgacag

SEQ ID NO: 950123 - DNA, 12 bp, Homo sapiens
gtttatttccaa

SEQ ID NO: 950124 - DNA, 21 bp, Homo sapiens
gtttatttccactattttcaa

SEQ ID NO: 950125 - DNA, 15 bp, Homo sapiens
gtttatttgagaaaa

SEQ ID NO: 950126 - DNA, 13 bp, Homo sapiens
gtttattttaaga

SEQ ID NO: 950127 - DNA, 23 bp, Homo sapiens
gtttattttgagtcctaggactt

SEQ ID NO: 950128 - DNA, 14 bp, Homo sapiens
gtttatttttcata

SEQ ID NO: 950129 - DNA, 16 bp, Homo sapiens
gtttatttttcatatt

SEQ ID NO: 950130 - DNA, 17 bp, Homo sapiens
gtttatttttctgttac

SEQ ID NO: 950131 - DNA, 18 bp, Homo sapiens
gtttattttttttggcct

SEQ ID NO: 950132 - DNA, 15 bp, Homo sapiens
gtttcaaatctgtaa

SEQ ID NO: 950133 - DNA, 13 bp, Homo sapiens
gtttcaagaaaat

SEQ ID NO: 950134 - DNA, 14 bp, Homo sapiens
gtttcaagaaaatc

SEQ ID NO: 950135 - DNA, 17 bp, Homo sapiens
gtttcaagttattcaaa

SEQ ID NO: 950136 - DNA, 18 bp, Homo sapiens
gtttcaattctgtaatta

SEQ ID NO: 950137 - DNA, 17 bp, Homo sapiens
gtttcaattgcatctcc

SEQ ID NO: 950138 - DNA, 14 bp, Homo sapiens
gtttcacagaaaat

SEQ ID NO: 950139 - DNA, 21 bp, Homo sapiens
gtttcacagagtgtgctgcta

SEQ ID NO: 950140 - DNA, 21 bp, Homo sapiens
gtttcacaggtcaataaactt

SEQ ID NO: 950141 - DNA, 21 bp, Homo sapiens
gtttcaccatgttggtcaggc

SEQ ID NO: 950142 - DNA, 21 bp, Homo sapiens
gtttcacccttaacccaagga

SEQ ID NO: 950143 - DNA, 22 bp, Homo sapiens
gtttcaccttccatgtcaggcc

SEQ ID NO: 950144 - DNA, 17 bp, Homo sapiens
gtttcacgtaaatattc

SEQ ID NO: 950145 - DNA, 14 bp, Homo sapiens
gtttcactccctct

SEQ ID NO: 950146 - DNA, 14 bp, Homo sapiens
gtttcactcctgct

SEQ ID NO: 950147 - DNA, 23 bp, Homo sapiens
gtttcactgagagctgcctcctg

SEQ ID NO: 950148 - DNA, 19 bp, Homo sapiens
gtttcactgtactgcatgt

SEQ ID NO: 950149 - DNA, 20 bp, Homo sapiens
gtttcactgtactgcatgtg

SEQ ID NO: 950150 - DNA, 21 bp, Homo sapiens
gtttcactttcacatagatgt

SEQ ID NO: 950151 - DNA, 14 bp, Homo sapiens
gtttcagaaatgtg

SEQ ID NO: 950152 - DNA, 12 bp, Homo sapiens
gtttcagacagg

SEQ ID NO: 950153 - DNA, 22 bp, Homo sapiens
gtttcagacagggtctgaagga

SEQ ID NO: 950154 - DNA, 15 bp, Homo sapiens
gtttcagaccccccc

SEQ ID NO: 950155 - DNA, 17 bp, Homo sapiens
gtttcagagcataaaac

SEQ ID NO: 950156 - DNA, 14 bp, Homo sapiens
gtttcagatgaggt

SEQ ID NO: 950157 - DNA, 21 bp, Homo sapiens
gtttcagccaaggggctgcgc

SEQ ID NO: 950158 - DNA, 14 bp, Homo sapiens
gtttcagtaaataa

SEQ ID NO: 950159 - DNA, 14 bp, Homo sapiens
gtttcatatctggt

SEQ ID NO: 950160 - DNA, 17 bp, Homo sapiens
gtttcatgtaaagaaaa

SEQ ID NO: 950161 - DNA, 18 bp, Homo sapiens
gtttcatgtaatcctcaa

SEQ ID NO: 950162 - DNA, 15 bp, Homo sapiens
gtttcatgtatgtat

SEQ ID NO: 950163 - DNA, 18 bp, Homo sapiens
gtttcatgttttgtgact

SEQ ID NO: 950164 - DNA, 24 bp, Homo sapiens
gtttcattcactgtgcactttgct

SEQ ID NO: 950165 - DNA, 15 bp, Homo sapiens
gtttcattctcctgc

SEQ ID NO: 950166 - DNA, 16 bp, Homo sapiens
gtttcattctcctgcc

SEQ ID NO: 950167 - DNA, 19 bp, Homo sapiens
gtttcattggtctctatct

SEQ ID NO: 950168 - DNA, 18 bp, Homo sapiens
tgttccaatttcacgctt

SEQ ID NO: 950169 - DNA, 19 bp, Homo sapiens
tgttccacaagttaaataa

SEQ ID NO: 950170 - DNA, 16 bp, Homo sapiens
tgttccacctgccaca

SEQ ID NO: 950171 - DNA, 21 bp, Homo sapiens
tgttccactgcaaataaagcc

SEQ ID NO: 950172 - DNA, 17 bp, Homo sapiens
tgttccagattcctatg

SEQ ID NO: 950173 - DNA, 14 bp, Homo sapiens
tgttccagctcttt

SEQ ID NO: 950174 - DNA, 19 bp, Homo sapiens
tgttccaggccctccagtg

SEQ ID NO: 950175 - DNA, 18 bp, Homo sapiens
tgttccagtaatctaata

SEQ ID NO: 950176 - DNA, 21 bp, Homo sapiens
tgttccagtgaggaaccctga

SEQ ID NO: 950177 - DNA, 16 bp, Homo sapiens
tgttcccagaggcagg

SEQ ID NO: 950178 - DNA, 22 bp, Homo sapiens
tgttcccagtgacacttcagag

SEQ ID NO: 950179 - DNA, 17 bp, Homo sapiens
tgttccccaaataattg

SEQ ID NO: 950180 - DNA, 13 bp, Homo sapiens
tgttccccatctg

SEQ ID NO: 950181 - DNA, 15 bp, Homo sapiens
tgttccccctgtgca

SEQ ID NO: 950182 - DNA, 17 bp, Homo sapiens
tgttcccctaagtggat

SEQ ID NO: 950183 - DNA, 14 bp, Homo sapiens
tgttcccctctccc

SEQ ID NO: 950184 - DNA, 16 bp, Homo sapiens
tgttcccctctccctt

SEQ ID NO: 950185 - DNA, 15 bp, Homo sapiens
tgttcccctcttgtc

SEQ ID NO: 950186 - DNA, 19 bp, Homo sapiens
tgttcccctcttgtctccc

SEQ ID NO: 950187 - DNA, 14 bp, Homo sapiens
tgttccccttccac

SEQ ID NO: 950188 - DNA, 24 bp, Homo sapiens
tgttcccgatggtctctctccctc

SEQ ID NO: 950189 - DNA, 19 bp, Homo sapiens
tgttccctcctggtcctgg

SEQ ID NO: 950190 - DNA, 12 bp, Homo sapiens
tgttccctctgg

SEQ ID NO: 950191 - DNA, 12 bp, Homo sapiens
tgttccctgcac

SEQ ID NO: 950192 - DNA, 13 bp, Homo sapiens
tgttccctgcacc

SEQ ID NO: 950193 - DNA, 15 bp, Homo sapiens
tgttccctgcaccct

SEQ ID NO: 950194 - DNA, 16 bp, Homo sapiens
tgttccctgcaccctg

SEQ ID NO: 950195 - DNA, 22 bp, Homo sapiens
tgttcccttcctcttcctgccc

SEQ ID NO: 950196 - DNA, 23 bp, Homo sapiens
tgttcccttcctcttcctgccct

SEQ ID NO: 950197 - DNA, 16 bp, Homo sapiens
tgttcccttgaccatt

SEQ ID NO: 950198 - DNA, 16 bp, Homo sapiens
tgttcccttgtggctt

SEQ ID NO: 950199 - DNA, 14 bp, Homo sapiens
tgttccctttgcct

SEQ ID NO: 950200 - DNA, 15 bp, Homo sapiens
tgttccctttgcctt

SEQ ID NO: 950201 - DNA, 16 bp, Homo sapiens
tgttcctaacaaaatg

SEQ ID NO: 950202 - DNA, 19 bp, Homo sapiens
tgttcctacagcccctttt

SEQ ID NO: 950203 - DNA, 15 bp, Homo sapiens
tgttcctacgggctt

SEQ ID NO: 950204 - DNA, 16 bp, Homo sapiens
tgttcctccattttct

SEQ ID NO: 950205 - DNA, 21 bp, Homo sapiens
tgttcctcggtgggccagagc

SEQ ID NO: 950206 - DNA, 24 bp, Homo sapiens
tgttcctcggtgggccagagctga

SEQ ID NO: 950207 - DNA, 14 bp, Homo sapiens
tgttcctgaagctg

SEQ ID NO: 950208 - DNA, 19 bp, Homo sapiens
tgttcctgaagctgctgtg

SEQ ID NO: 950209 - DNA, 20 bp, Homo sapiens
tgttcctgaagctgctgtgt

SEQ ID NO: 950210 - DNA, 21 bp, Homo sapiens
tgttcctgaagctgctgtgtc

SEQ ID NO: 950211 - DNA, 21 bp, Homo sapiens
tgttcctgcagccccagaaga

SEQ ID NO: 950212 - DNA, 19 bp, Homo sapiens
tgttcctgctccatgactg

SEQ ID NO: 950213 - DNA, 11 bp, Homo sapiens
tgttcctggaa

SEQ ID NO: 950214 - DNA, 21 bp, Homo sapiens
tgttcctggagttttgatttg

SEQ ID NO: 950215 - DNA, 17 bp, Homo sapiens
tgttccttatttctctc

SEQ ID NO: 950216 - DNA, 19 bp, Homo sapiens
tgttccttatttctctctc

SEQ ID NO: 950217 - DNA, 18 bp, Homo sapiens
tgttcctttgttaaattt

SEQ ID NO: 950218 - DNA, 17 bp, Homo sapiens
tgttcctttttaaatgt

SEQ ID NO: 950219 - DNA, 20 bp, Homo sapiens
tgttcctttttaaatgtgaa

SEQ ID NO: 950220 - DNA, 22 bp, Homo sapiens
tgttccttttttcaatatgcaa

SEQ ID NO: 950221 - DNA, 22 bp, Homo sapiens
tgttcgcatggtcacacactga

SEQ ID NO: 950222 - DNA, 23 bp, Homo sapiens
tgttcgcatggtcacacactgat

SEQ ID NO: 950223 - DNA, 21 bp, Homo sapiens
tgttcggaaggggttcctcaa

SEQ ID NO: 950224 - DNA, 21 bp, Homo sapiens
tgttcgtttcatcaggctctg

SEQ ID NO: 950225 - DNA, 16 bp, Homo sapiens
tgttctaacatgtaat

SEQ ID NO: 950226 - DNA, 19 bp, Homo sapiens
tgttctaatgcaacagaaa

SEQ ID NO: 950227 - DNA, 16 bp, Homo sapiens
tgttctacatgaggac

SEQ ID NO: 950228 - DNA, 22 bp, Homo sapiens
tgttctagtaacaatacatgag

SEQ ID NO: 950229 - DNA, 15 bp, Homo sapiens
tgttctagtactgta

SEQ ID NO: 950230 - DNA, 17 bp, Homo sapiens
tgttctagtactgtatt

SEQ ID NO: 950231 - DNA, 22 bp, Homo sapiens
tgttctagttttcagtttgtat

SEQ ID NO: 950232 - DNA, 21 bp, Homo sapiens
tgttctagttttttacttttg

SEQ ID NO: 950233 - DNA, 13 bp, Homo sapiens
tgttctatacgag

SEQ ID NO: 950234 - DNA, 15 bp, Homo sapiens
tgttctatgaacaac

SEQ ID NO: 950235 - DNA, 16 bp, Homo sapiens
tgttctatttttcaat

SEQ ID NO: 950236 - DNA, 22 bp, Homo sapiens
tgttctcagaatcccttaacag

SEQ ID NO: 950237 - DNA, 20 bp, Homo sapiens
tgttctccctttctctctcc

SEQ ID NO: 950238 - DNA, 23 bp, Homo sapiens
tgttctccgggtgtggcctcagc

SEQ ID NO: 950239 - DNA, 13 bp, Homo sapiens
gtttctgtagaaa

SEQ ID NO: 950240 - DNA, 22 bp, Homo sapiens
gtttctgtagaaaagaaaacat

SEQ ID NO: 950241 - DNA, 12 bp, Homo sapiens
gtttctgtatat

SEQ ID NO: 950242 - DNA, 22 bp, Homo sapiens
gtttctgtatatgattctctgt

SEQ ID NO: 950243 - DNA, 19 bp, Homo sapiens
gtttctgtcctgtaactgt

SEQ ID NO: 950244 - DNA, 16 bp, Homo sapiens
gtttctgtttcttgct

SEQ ID NO: 950245 - DNA, 19 bp, Homo sapiens
gtttctgtttcttgctctc

SEQ ID NO: 950246 - DNA, 17 bp, Homo sapiens
gtttcttaagggcacac

SEQ ID NO: 950247 - DNA, 18 bp, Homo sapiens
gtttcttcaagagctgag

SEQ ID NO: 950248 - DNA, 12 bp, Homo sapiens
gtttcttcattt

SEQ ID NO: 950249 - DNA, 18 bp, Homo sapiens
gtttcttcatttctctgc

SEQ ID NO: 950250 - DNA, 12 bp, Homo sapiens
gtttcttcccca

SEQ ID NO: 950251 - DNA, 13 bp, Homo sapiens
gtttcttccccaa

SEQ ID NO: 950252 - DNA, 16 bp, Homo sapiens
gtttcttcctgccagc

SEQ ID NO: 950253 - DNA, 20 bp, Homo sapiens
gtttcttctgcgcctcaggc

SEQ ID NO: 950254 - DNA, 23 bp, Homo sapiens
gtttcttcttcatgcttttgctt

SEQ ID NO: 950255 - DNA, 17 bp, Homo sapiens
gtttcttctttctagag

SEQ ID NO: 950256 - DNA, 15 bp, Homo sapiens
gtttcttgacaagct

SEQ ID NO: 950257 - DNA, 12 bp, Homo sapiens
gtttcttgtctt

SEQ ID NO: 950258 - DNA, 17 bp, Homo sapiens
gtttctttaagaaagta

SEQ ID NO: 950259 - DNA, 13 bp, Homo sapiens
gtttctttcccca

SEQ ID NO: 950260 - DNA, 21 bp, Homo sapiens
gtttctttgtggtctgtgtca

SEQ ID NO: 950261 - DNA, 17 bp, Homo sapiens
gtttcttttgtatgtaa

SEQ ID NO: 950262 - DNA, 21 bp, Homo sapiens
gtttcttttgtatgtaaatgt

SEQ ID NO: 950263 - DNA, 21 bp, Homo sapiens
gtttgaaaacaaaaaaaatgt

SEQ ID NO: 950264 - DNA, 14 bp, Homo sapiens
gtttgaaaacttca

SEQ ID NO: 950265 - DNA, 18 bp, Homo sapiens
gtttgaaaacttcagaag

SEQ ID NO: 950266 - DNA, 17 bp, Homo sapiens
gtttgaaaatgctctta

SEQ ID NO: 950267 - DNA, 22 bp, Homo sapiens
gtttgaaactaaaataaattaa

SEQ ID NO: 950268 - DNA, 15 bp, Homo sapiens
gtttgaaagattatg

SEQ ID NO: 950269 - DNA, 16 bp, Homo sapiens
gtttgaaagtaaaaac

SEQ ID NO: 950270 - DNA, 14 bp, Homo sapiens
gtttgaaatctttt

SEQ ID NO: 950271 - DNA, 20 bp, Homo sapiens
gtttgaaatgaggtctgttt

SEQ ID NO: 950272 - DNA, 22 bp, Homo sapiens
gtttgaaatgaggtctgtttaa

SEQ ID NO: 950273 - DNA, 22 bp, Homo sapiens
gtttgaagacacagcctccccc

SEQ ID NO: 950274 - DNA, 23 bp, Homo sapiens
gtttgaagacacagcctcccccg

SEQ ID NO: 950275 - DNA, 21 bp, Homo sapiens
gtttgaagattatatgaagtt

SEQ ID NO: 950276 - DNA, 17 bp, Homo sapiens
gtttgaattcctcctct

SEQ ID NO: 950277 - DNA, 17 bp, Homo sapiens
gtttgacactaagaaaa

SEQ ID NO: 950278 - DNA, 21 bp, Homo sapiens
gtttgacatgtgaagctattt

SEQ ID NO: 950279 - DNA, 16 bp, Homo sapiens
gtttgactagatgatg

SEQ ID NO: 950280 - DNA, 19 bp, Homo sapiens
gtttgactagatgatggat

SEQ ID NO: 950281 - DNA, 11 bp, Homo sapiens
gtttgagaaat

SEQ ID NO: 950282 - DNA, 20 bp, Homo sapiens
gtttgagacaagccctggca

SEQ ID NO: 950283 - DNA, 22 bp, Homo sapiens
gtttgagacaagccctggcaac

SEQ ID NO: 950284 - DNA, 17 bp, Homo sapiens
gtttgagatcagcctgg

SEQ ID NO: 950285 - DNA, 15 bp, Homo sapiens
gtttgagattctcaa

SEQ ID NO: 950286 - DNA, 20 bp, Homo sapiens
gtttgaggcaaattaactgt

SEQ ID NO: 950287 - DNA, 22 bp, Homo sapiens
gtttgaggcaaattaactgtat

SEQ ID NO: 950288 - DNA, 19 bp, Homo sapiens
gtttgatcagacagcttga

SEQ ID NO: 950289 - DNA, 15 bp, Homo sapiens
gtttgatgtatgtgt

SEQ ID NO: 950290 - DNA, 17 bp, Homo sapiens
gtttgatgtatgtgtga

SEQ ID NO: 950291 - DNA, 21 bp, Homo sapiens
gtttgatgtatgtgtgaaaca

SEQ ID NO: 950292 - DNA, 19 bp, Homo sapiens
gtttgattaaattcttgca

SEQ ID NO: 950293 - DNA, 18 bp, Homo sapiens
gtttgattgaggagctgc

SEQ ID NO: 950294 - DNA, 13 bp, Homo sapiens
gtttgatttcaac

SEQ ID NO: 950295 - DNA, 23 bp, Homo sapiens
tgttcttggttcctgtttgaaac

SEQ ID NO: 950296 - DNA, 18 bp, Homo sapiens
tgttcttggtttgtaaat

SEQ ID NO: 950297 - DNA, 20 bp, Homo sapiens
tgttcttggtttgtaaatta

SEQ ID NO: 950298 - DNA, 10 bp, Homo sapiens
tgttcttgta

SEQ ID NO: 950299 - DNA, 14 bp, Homo sapiens
tgttcttgtattta

SEQ ID NO: 950300 - DNA, 14 bp, Homo sapiens
tgttcttgtcataa

SEQ ID NO: 950301 - DNA, 15 bp, Homo sapiens
tgttctttaggagat

SEQ ID NO: 950302 - DNA, 13 bp, Homo sapiens
tgttctttccaaa

SEQ ID NO: 950303 - DNA, 14 bp, Homo sapiens
tgttctttccaaag

SEQ ID NO: 950304 - DNA, 15 bp, Homo sapiens
tgttctttcctcaca

SEQ ID NO: 950305 - DNA, 15 bp, Homo sapiens
tgttctttcctgccc

SEQ ID NO: 950306 - DNA, 14 bp, Homo sapiens
tgttctttctggct

SEQ ID NO: 950307 - DNA, 18 bp, Homo sapiens
tgttctttgtgttttagg

SEQ ID NO: 950308 - DNA, 20 bp, Homo sapiens
tgttcttttaaatgattgaa

SEQ ID NO: 950309 - DNA, 13 bp, Homo sapiens
tgttcttttctcc

SEQ ID NO: 950310 - DNA, 13 bp, Homo sapiens
tgttgaaaaaatt

SEQ ID NO: 950311 - DNA, 20 bp, Homo sapiens
tgttgaaaatggtttcaagt

SEQ ID NO: 950312 - DNA, 19 bp, Homo sapiens
tgttgaaagctgaaaagca

SEQ ID NO: 950313 - DNA, 15 bp, Homo sapiens
tgttgaaatatgcat

SEQ ID NO: 950314 - DNA, 19 bp, Homo sapiens
tgttgaaatatgcatacta

SEQ ID NO: 950315 - DNA, 13 bp, Homo sapiens
tgttgaacttttt

SEQ ID NO: 950316 - DNA, 14 bp, Homo sapiens
tgttgaagacttcc

SEQ ID NO: 950317 - DNA, 17 bp, Homo sapiens
tgttgaaggtgccattt

SEQ ID NO: 950318 - DNA, 17 bp, Homo sapiens
tgttgaagtctcaggag

SEQ ID NO: 950319 - DNA, 14 bp, Homo sapiens
tgttgacactgttt

SEQ ID NO: 950320 - DNA, 19 bp, Homo sapiens
tgttgacactgttttcctt

SEQ ID NO: 950321 - DNA, 17 bp, Homo sapiens
tgttgacagttcatatg

SEQ ID NO: 950322 - DNA, 11 bp, Homo sapiens
tgttgactgtg

SEQ ID NO: 950323 - DNA, 13 bp, Homo sapiens
tgttgactgtgat

SEQ ID NO: 950324 - DNA, 14 bp, Homo sapiens
tgttgactgtgatt

SEQ ID NO: 950325 - DNA, 22 bp, Homo sapiens
tgttgacttattttctctgtgt

SEQ ID NO: 950326 - DNA, 14 bp, Homo sapiens
tgttgagcaagcag

SEQ ID NO: 950327 - DNA, 20 bp, Homo sapiens
tgttgagcatgacagcctgc

SEQ ID NO: 950328 - DNA, 20 bp, Homo sapiens
tgttgagccccagtgctgga

SEQ ID NO: 950329 - DNA, 19 bp, Homo sapiens
tgttgagggcaagccacca

SEQ ID NO: 950330 - DNA, 19 bp, Homo sapiens
tgttgaggtggtctgaatg

SEQ ID NO: 950331 - DNA, 21 bp, Homo sapiens
tgttgaggtggtctgaatgtt

SEQ ID NO: 950332 - DNA, 18 bp, Homo sapiens
tgttgagtgttcatttta

SEQ ID NO: 950333 - DNA, 19 bp, Homo sapiens
tgttgataaattccactgg

SEQ ID NO: 950334 - DNA, 14 bp, Homo sapiens
tgttgataatatat

SEQ ID NO: 950335 - DNA, 13 bp, Homo sapiens
tgttgatacaaac

SEQ ID NO: 950336 - DNA, 23 bp, Homo sapiens
tgttgatacaaaccactgtgaac

SEQ ID NO: 950337 - DNA, 17 bp, Homo sapiens
tgttgatattttccctt

SEQ ID NO: 950338 - DNA, 15 bp, Homo sapiens
tgttgatcaaccatt

SEQ ID NO: 950339 - DNA, 12 bp, Homo sapiens
tgttgatcccaa

SEQ ID NO: 950340 - DNA, 20 bp, Homo sapiens
tgttgatcccacttcactgt

SEQ ID NO: 950341 - DNA, 22 bp, Homo sapiens
tgttgatctgcatatttctgta

SEQ ID NO: 950342 - DNA, 21 bp, Homo sapiens
tgttgatgactcgaaactgac

SEQ ID NO: 950343 - DNA, 19 bp, Homo sapiens
tgttgatgtatctgagttg

SEQ ID NO: 950344 - DNA, 21 bp, Homo sapiens
tgttgatgtatctgagttgcc

SEQ ID NO: 950345 - DNA, 13 bp, Homo sapiens
tgttgattgtgcc

SEQ ID NO: 950346 - DNA, 18 bp, Homo sapiens
tgttgattttctgttgta

SEQ ID NO: 950347 - DNA, 16 bp, Homo sapiens
tgttgcaagcccctct

SEQ ID NO: 950348 - DNA, 21 bp, Homo sapiens
tgttgcaatgtgaaaaatctg

SEQ ID NO: 950349 - DNA, 14 bp, Homo sapiens
tgttgcatggatgt

SEQ ID NO: 950350 - DNA, 19 bp, Homo sapiens
tgttgccaaatatgtcctg

SEQ ID NO: 950351 - DNA, 17 bp, Homo sapiens
tgttgccaactaagccc

SEQ ID NO: 950352 - DNA, 19 bp, Homo sapiens
tgttgccatgtgcaccttg

SEQ ID NO: 950353 - DNA, 18 bp, Homo sapiens
tgttgccatttctctgct

SEQ ID NO: 950354 - DNA, 16 bp, Homo sapiens
tgttgcccaggctgga

SEQ ID NO: 950355 - DNA, 13 bp, Homo sapiens
tgttgccctgagt

SEQ ID NO: 950356 - DNA, 16 bp, Homo sapiens
tgttgcctcctcccat

SEQ ID NO: 950357 - DNA, 18 bp, Homo sapiens
tgttgccttatttctcat

SEQ ID NO: 950358 - DNA, 20 bp, Homo sapiens
tgttgccttgaaccacttcc

SEQ ID NO: 950359 - DNA, 18 bp, Homo sapiens
tgttgcctttatggtttc

SEQ ID NO: 950360 - DNA, 14 bp, Homo sapiens
tgttgcgttccttt

SEQ ID NO: 950361 - DNA, 18 bp, Homo sapiens
tgtttaacaacatggctt

SEQ ID NO: 950362 - DNA, 16 bp, Homo sapiens
tgtttaactggcatgg

SEQ ID NO: 950363 - DNA, 16 bp, Homo sapiens
tgtttaagctgagcca

SEQ ID NO: 950364 - DNA, 16 bp, Homo sapiens
tgtttaatattgagaa

SEQ ID NO: 950365 - DNA, 20 bp, Homo sapiens
tgtttaatattgagaaagaa

SEQ ID NO: 950366 - DNA, 14 bp, Homo sapiens
tgtttaatgttcat

SEQ ID NO: 950367 - DNA, 15 bp, Homo sapiens
tgtttaatgttcatt

SEQ ID NO: 950368 - DNA, 16 bp, Homo sapiens
tgtttaatgttctgtg

SEQ ID NO: 950369 - DNA, 15 bp, Homo sapiens
tgtttaatttgcttc

SEQ ID NO: 950370 - DNA, 21 bp, Homo sapiens
tgtttaatttttatttcttcc

SEQ ID NO: 950371 - DNA, 21 bp, Homo sapiens
tgtttacaaaaatttctgtaa

SEQ ID NO: 950372 - DNA, 12 bp, Homo sapiens
tgtttacaaaca

SEQ ID NO: 950373 - DNA, 23 bp, Homo sapiens
tgtttacaaacatggaaaacaga

SEQ ID NO: 950374 - DNA, 15 bp, Homo sapiens
tgtttacaagaaaaa

SEQ ID NO: 950375 - DNA, 21 bp, Homo sapiens
tgtttacagcactactctgtg

SEQ ID NO: 950376 - DNA, 23 bp, Homo sapiens
tgtttacatggcgccctgcctcc

SEQ ID NO: 950377 - DNA, 22 bp, Homo sapiens
tgtttacatttgatgcatgtct

SEQ ID NO: 950378 - DNA, 21 bp, Homo sapiens
tgtttacgatttcactaggac

SEQ ID NO: 950379 - DNA, 22 bp, Homo sapiens
tgtttacgatttcactaggact

SEQ ID NO: 950380 - DNA, 14 bp, Homo sapiens
tgtttacgtttgat

SEQ ID NO: 950381 - DNA, 13 bp, Homo sapiens
tgtttactaggga

SEQ ID NO: 950382 - DNA, 23 bp, Homo sapiens
tgtttactcaaagtctaacatat

SEQ ID NO: 950383 - DNA, 21 bp, Homo sapiens
tgtttactcccttctgtagtt

SEQ ID NO: 950384 - DNA, 12 bp, Homo sapiens
tgtttactgatt

SEQ ID NO: 950385 - DNA, 19 bp, Homo sapiens
tgtttactgcttttcatta

SEQ ID NO: 950386 - DNA, 22 bp, Homo sapiens
tgtttagaaaaaaaactgaaga

SEQ ID NO: 950387 - DNA, 20 bp, Homo sapiens
tgtttagataatacaccact

SEQ ID NO: 950388 - DNA, 16 bp, Homo sapiens
tgtttagattccagga

SEQ ID NO: 950389 - DNA, 17 bp, Homo sapiens
tgtttagattccaggat

SEQ ID NO: 950390 - DNA, 20 bp, Homo sapiens
tgtttagctacctttttata

SEQ ID NO: 950391 - DNA, 13 bp, Homo sapiens
tgtttagcttcct

SEQ ID NO: 950392 - DNA, 16 bp, Homo sapiens
tgtttagtagcagtga

SEQ ID NO: 950393 - DNA, 17 bp, Homo sapiens
tgtttagttgcaaggat

SEQ ID NO: 950394 - DNA, 15 bp, Homo sapiens
tgtttataaaacaat

SEQ ID NO: 950395 - DNA, 21 bp, Homo sapiens
tgtttataactctagggatat

SEQ ID NO: 950396 - DNA, 14 bp, Homo sapiens
tgtttataatctga

SEQ ID NO: 950397 - DNA, 17 bp, Homo sapiens
tgtttataatctgaaga

SEQ ID NO: 950398 - DNA, 20 bp, Homo sapiens
tgtttatacacaactttgca

SEQ ID NO: 950399 - DNA, 21 bp, Homo sapiens
tgtttatagcaaacttggaat

SEQ ID NO: 950400 - DNA, 18 bp, Homo sapiens
tgtttatatactgggttc

SEQ ID NO: 950401 - DNA, 16 bp, Homo sapiens
tgtttatatattgaaa

SEQ ID NO: 950402 - DNA, 22 bp, Homo sapiens
tgtttatatctgcaaaaaacct

SEQ ID NO: 950403 - DNA, 20 bp, Homo sapiens
tgtttatattgggaagatat

SEQ ID NO: 950404 - DNA, 15 bp, Homo sapiens
tgtttatcagataca

SEQ ID NO: 950405 - DNA, 23 bp, Homo sapiens
tgtttatcagatacatcactgct

SEQ ID NO: 950406 - DNA, 17 bp, Homo sapiens
tgtttatcctttcatat

SEQ ID NO: 950407 - DNA, 14 bp, Homo sapiens
tgtttatgagccag

SEQ ID NO: 950408 - DNA, 19 bp, Homo sapiens
tgtttatgatatttcttgc

SEQ ID NO: 950409 - DNA, 12 bp, Homo sapiens
tgtttatgcata

SEQ ID NO: 950410 - DNA, 22 bp, Homo sapiens
tgtttatggcaatttaacatgt

SEQ ID NO: 950411 - DNA, 24 bp, Homo sapiens
tgtttatggcctcagctgcctcac

SEQ ID NO: 950412 - DNA, 14 bp, Homo sapiens
tgtttatgtaatag

SEQ ID NO: 950413 - DNA, 15 bp, Homo sapiens
tgtttatgtaatttc

SEQ ID NO: 950414 - DNA, 16 bp, Homo sapiens
tgtttatgtaatttca

SEQ ID NO: 950415 - DNA, 17 bp, Homo sapiens
tgtttatgtaatttcag

SEQ ID NO: 950416 - DNA, 17 bp, Homo sapiens
tgtttatgtgctattaa

SEQ ID NO: 950417 - DNA, 18 bp, Homo sapiens
tgtttatgtgttatgaac

SEQ ID NO: 950418 - DNA, 19 bp, Homo sapiens
tgtttatgtgttatgaaca

SEQ ID NO: 950419 - DNA, 21 bp, Homo sapiens
tgtttatgtgttatgaacatc

SEQ ID NO: 950420 - DNA, 18 bp, Homo sapiens
tgtttatgttgtttataa

SEQ ID NO: 950421 - DNA, 13 bp, Homo sapiens
tgtttattaaata

SEQ ID NO: 950422 - DNA, 19 bp, Homo sapiens
tgtttattaacaaattatg

SEQ ID NO: 950423 - DNA, 18 bp, Homo sapiens
tgtttattaactactgaa

SEQ ID NO: 950424 - DNA, 15 bp, Homo sapiens
tgtttattaatctta

SEQ ID NO: 950425 - DNA, 20 bp, Homo sapiens
gttttaattccatgtcagat

SEQ ID NO: 950426 - DNA, 21 bp, Homo sapiens
gttttaattccatgtcagata

SEQ ID NO: 950427 - DNA, 21 bp, Homo sapiens
gttttaatttaaacacctcct

SEQ ID NO: 950428 - DNA, 11 bp, Homo sapiens
gttttacaata

SEQ ID NO: 950429 - DNA, 13 bp, Homo sapiens
gttttacaatagt

SEQ ID NO: 950430 - DNA, 19 bp, Homo sapiens
gttttacattccatttcat

SEQ ID NO: 950431 - DNA, 21 bp, Homo sapiens
gttttacattgttgagctatt

SEQ ID NO: 950432 - DNA, 20 bp, Homo sapiens
gttttaccaagtgctgtctt

SEQ ID NO: 950433 - DNA, 17 bp, Homo sapiens
gttttaccaataaactg

SEQ ID NO: 950434 - DNA, 13 bp, Homo sapiens
gttttactgcctg

SEQ ID NO: 950435 - DNA, 17 bp, Homo sapiens
gttttactgttttaatt

SEQ ID NO: 950436 - DNA, 20 bp, Homo sapiens
gttttactgttttaattgta

SEQ ID NO: 950437 - DNA, 20 bp, Homo sapiens
gttttacttttttaacatgt

SEQ ID NO: 950438 - DNA, 18 bp, Homo sapiens
gttttagaatcttttaaa

SEQ ID NO: 950439 - DNA, 21 bp, Homo sapiens
gttttaggaaaagtgaatctt

SEQ ID NO: 950440 - DNA, 23 bp, Homo sapiens
gttttagggagtggttcctgtgg

SEQ ID NO: 950441 - DNA, 16 bp, Homo sapiens
gttttataatgaaccc

SEQ ID NO: 950442 - DNA, 13 bp, Homo sapiens
gttttataatttg

SEQ ID NO: 950443 - DNA, 15 bp, Homo sapiens
gttttatactgaagg

SEQ ID NO: 950444 - DNA, 23 bp, Homo sapiens
gttttatactgtacttaataaat

SEQ ID NO: 950445 - DNA, 14 bp, Homo sapiens
gttttatcatgaca

SEQ ID NO: 950446 - DNA, 16 bp, Homo sapiens
gttttatcttttaagt

SEQ ID NO: 950447 - DNA, 17 bp, Homo sapiens
gttttatggcatgattt

SEQ ID NO: 950448 - DNA, 23 bp, Homo sapiens
gttttattattatcgctttatgt

SEQ ID NO: 950449 - DNA, 14 bp, Homo sapiens
gttttattcctgta

SEQ ID NO: 950450 - DNA, 20 bp, Homo sapiens
gttttattcctgtatgttgt

SEQ ID NO: 950451 - DNA, 17 bp, Homo sapiens
gttttattcttggtttt

SEQ ID NO: 950452 - DNA, 23 bp, Homo sapiens
gttttattggggaattaaatagt

SEQ ID NO: 950453 - DNA, 15 bp, Homo sapiens
gttttatttacattt

SEQ ID NO: 950454 - DNA, 12 bp, Homo sapiens
gttttatttcat

SEQ ID NO: 950455 - DNA, 17 bp, Homo sapiens
gttttattttggaattg

SEQ ID NO: 950456 - DNA, 17 bp, Homo sapiens
gttttatttttaagaaa

SEQ ID NO: 950457 - DNA, 21 bp, Homo sapiens
gttttattttttattgttttc

SEQ ID NO: 950458 - DNA, 16 bp, Homo sapiens
gttttcaaaacacata

SEQ ID NO: 950459 - DNA, 21 bp, Homo sapiens
gttttcaaactgctgcatact

SEQ ID NO: 950460 - DNA, 19 bp, Homo sapiens
gttttcaaggaagaaaacg

SEQ ID NO: 950461 - DNA, 15 bp, Homo sapiens
gttttcaagtcaaat

SEQ ID NO: 950462 - DNA, 14 bp, Homo sapiens
gttttcaatgtgaa

SEQ ID NO: 950463 - DNA, 23 bp, Homo sapiens
gttttcaatgtgaaacacatgcc

SEQ ID NO: 950464 - DNA, 14 bp, Homo sapiens
gttttcacactgct

SEQ ID NO: 950465 - DNA, 17 bp, Homo sapiens
gttttcacttgtattga

SEQ ID NO: 950466 - DNA, 16 bp, Homo sapiens
gttttcacttgtctcc

SEQ ID NO: 950467 - DNA, 12 bp, Homo sapiens
gttttcagaaaa

SEQ ID NO: 950468 - DNA, 19 bp, Homo sapiens
gttttcagaaaaagaaatg

SEQ ID NO: 950469 - DNA, 18 bp, Homo sapiens
gttttcagaagaaataaa

SEQ ID NO: 950470 - DNA, 18 bp, Homo sapiens
gttttcagagcaggaggc

SEQ ID NO: 950471 - DNA, 16 bp, Homo sapiens
gttttcataacttgct

SEQ ID NO: 950472 - DNA, 19 bp, Homo sapiens
gttttcataacttgctgaa

SEQ ID NO: 950473 - DNA, 24 bp, Homo sapiens
gttttcataacttgctgaatttca

SEQ ID NO: 950474 - DNA, 20 bp, Homo sapiens
gttttcatccataactgaac

SEQ ID NO: 950475 - DNA, 16 bp, Homo sapiens
gttttcatcctggcct

SEQ ID NO: 950476 - DNA, 22 bp, Homo sapiens
gttttcatggtgaaaatgtact

SEQ ID NO: 950477 - DNA, 23 bp, Homo sapiens
gttttcatggtgaaaatgtactg

SEQ ID NO: 950478 - DNA, 16 bp, Homo sapiens
gttttccaccctggaa

SEQ ID NO: 950479 - DNA, 20 bp, Homo sapiens
gttttccaggtttaagctgt

SEQ ID NO: 950480 - DNA, 16 bp, Homo sapiens
gttttccagtattgaa

SEQ ID NO: 950481 - DNA, 13 bp, Homo sapiens
gttttccatgaaa

SEQ ID NO: 950482 - DNA, 12 bp, Homo sapiens
gtttttggctga

SEQ ID NO: 950483 - DNA, 16 bp, Homo sapiens
gtttttggggacactg

SEQ ID NO: 950484 - DNA, 20 bp, Homo sapiens
gtttttggtcttttataatt

SEQ ID NO: 950485 - DNA, 11 bp, Homo sapiens
gtttttgtaat

SEQ ID NO: 950486 - DNA, 17 bp, Homo sapiens
gtttttgtatccagagc

SEQ ID NO: 950487 - DNA, 13 bp, Homo sapiens
gtttttgtatctt

SEQ ID NO: 950488 - DNA, 14 bp, Homo sapiens
gtttttgtatcttg

SEQ ID NO: 950489 - DNA, 12 bp, Homo sapiens
gtttttgtgctg

SEQ ID NO: 950490 - DNA, 21 bp, Homo sapiens
gttttttaaaatatttatctg

SEQ ID NO: 950491 - DNA, 19 bp, Homo sapiens
gttttttaagatagtgtaa

SEQ ID NO: 950492 - DNA, 12 bp, Homo sapiens
gttttttaagtc

SEQ ID NO: 950493 - DNA, 23 bp, Homo sapiens
gttttttactttggtttagtctt

SEQ ID NO: 950494 - DNA, 16 bp, Homo sapiens
gttttttatgaagtgc

SEQ ID NO: 950495 - DNA, 16 bp, Homo sapiens
gttttttccacgcagc

SEQ ID NO: 950496 - DNA, 16 bp, Homo sapiens
gttttttcctttgctc

SEQ ID NO: 950497 - DNA, 12 bp, Homo sapiens
gttttttgaaaa

SEQ ID NO: 950498 - DNA, 9 bp, Homo sapiens
gttttttgg

SEQ ID NO: 950499 - DNA, 14 bp, Homo sapiens
gttttttgttactg

SEQ ID NO: 950500 - DNA, 13 bp, Homo sapiens
gtttttttaatga

SEQ ID NO: 950501 - DNA, 18 bp, Homo sapiens
gtttttttacaacattca

SEQ ID NO: 950502 - DNA, 14 bp, Homo sapiens
gtttttttatttct

SEQ ID NO: 950503 - DNA, 20 bp, Homo sapiens
gtttttttcctcatgtaaca

SEQ ID NO: 950504 - DNA, 19 bp, Homo sapiens
gtttttttcttctgtattt

SEQ ID NO: 950505 - DNA, 11 bp, Homo sapiens
gtttttttgcc

SEQ ID NO: 950506 - DNA, 17 bp, Homo sapiens
gtttttttgttattaaa

SEQ ID NO: 950507 - DNA, 17 bp, Homo sapiens
gttttttttaatgtgaa

SEQ ID NO: 950508 - DNA, 18 bp, Homo sapiens
gttttttttaatgtgaat

SEQ ID NO: 950509 - DNA, 15 bp, Homo sapiens
gttttttttttaagt

SEQ ID NO: 950510 - DNA, 19 bp, Homo sapiens
gttttttttttaagtgcaa

SEQ ID NO: 950511 - DNA, 17 bp, Homo sapiens
gttttttttttctgaat

SEQ ID NO: 950512 - DNA, 19 bp, Homo sapiens
gttttttttttctgaataa

SEQ ID NO: 950513 - DNA, 17 bp, Homo sapiens
gttttttttttcttgtc

SEQ ID NO: 950514 - DNA, 20 bp, Homo sapiens
gttttttttttttttatgtg

SEQ ID NO: 950515 - DNA, 23 bp, Homo sapiens
gttttttttttttttatgtgatc

SEQ ID NO: 950516 - DNA, 21 bp, Homo sapiens
gttttttttttttttttggct

SEQ ID NO: 950517 - DNA, 19 bp, Homo sapiens
taaaaaaaaaaggatgaaa

SEQ ID NO: 950518 - DNA, 15 bp, Homo sapiens
taaaaaaaaaagtca

SEQ ID NO: 950519 - DNA, 20 bp, Homo sapiens
taaaaaaaaaatcagtgttt

SEQ ID NO: 950520 - DNA, 14 bp, Homo sapiens
taaaaaaaaagtca

SEQ ID NO: 950521 - DNA, 19 bp, Homo sapiens
taaaaaaaaagtcagagac

SEQ ID NO: 950522 - DNA, 17 bp, Homo sapiens
taaaaaaaaatactctt

SEQ ID NO: 950523 - DNA, 16 bp, Homo sapiens
taaaaaaaagaaaaaa

SEQ ID NO: 950524 - DNA, 16 bp, Homo sapiens
taaaaaaaagaaatga

SEQ ID NO: 950525 - DNA, 15 bp, Homo sapiens
taaaaaaaagatgaa

SEQ ID NO: 950526 - DNA, 13 bp, Homo sapiens
taaaaaaaatcag

SEQ ID NO: 950527 - DNA, 18 bp, Homo sapiens
taaaaaaaatccttgtga

SEQ ID NO: 950528 - DNA, 11 bp, Homo sapiens
taaaaaaacaa

SEQ ID NO: 950529 - DNA, 23 bp, Homo sapiens
taaaaaaacaaacagaaacacaa

SEQ ID NO: 950530 - DNA, 21 bp, Homo sapiens
taaaaaaactggccttttgat

SEQ ID NO: 950531 - DNA, 12 bp, Homo sapiens
taaaaaaataga

SEQ ID NO: 950532 - DNA, 12 bp, Homo sapiens
taaaaaaatttt

SEQ ID NO: 950533 - DNA, 21 bp, Homo sapiens
taaaaaaatttttataaatta

SEQ ID NO: 950534 - DNA, 11 bp, Homo sapiens
taaaaaacaac

SEQ ID NO: 950535 - DNA, 20 bp, Homo sapiens
taaaaaactgctgactgttt

SEQ ID NO: 950536 - DNA, 23 bp, Homo sapiens
taaaaaactgctgactgttttct

SEQ ID NO: 950537 - DNA, 15 bp, Homo sapiens
taaaaaacttgtaaa

SEQ ID NO: 950538 - DNA, 14 bp, Homo sapiens
taaaaaagaaagaa

SEQ ID NO: 950539 - DNA, 19 bp, Homo sapiens
taaaaaagatatattaaaa

SEQ ID NO: 950540 - DNA, 14 bp, Homo sapiens
taaaaaagattcta

SEQ ID NO: 950541 - DNA, 13 bp, Homo sapiens
taaaaaagcaaaa

SEQ ID NO: 950542 - DNA, 18 bp, Homo sapiens
taaaaaagcttaaaactt

SEQ ID NO: 950543 - DNA, 17 bp, Homo sapiens
taaaaaataatctattt

SEQ ID NO: 950544 - DNA, 18 bp, Homo sapiens
taaaaaataccattgaaa

SEQ ID NO: 950545 - DNA, 20 bp, Homo sapiens
taaaaaataccattgaaatc

SEQ ID NO: 950546 - DNA, 13 bp, Homo sapiens
taaaaaatatttt

SEQ ID NO: 950547 - DNA, 15 bp, Homo sapiens
taaaaaatattttaa

SEQ ID NO: 950548 - DNA, 21 bp, Homo sapiens
taaaaaatattttaagaaaga

SEQ ID NO: 950549 - DNA, 12 bp, Homo sapiens
taaaaaatcaat

SEQ ID NO: 950550 - DNA, 15 bp, Homo sapiens
taaaaaatcaatcaa

SEQ ID NO: 950551 - DNA, 19 bp, Homo sapiens
taaaaaatcaatcaatggt

SEQ ID NO: 950552 - DNA, 11 bp, Homo sapiens
taaaaaatgga

SEQ ID NO: 950553 - DNA, 16 bp, Homo sapiens
taaaaaatggagctca

SEQ ID NO: 950554 - DNA, 18 bp, Homo sapiens
taaaaaattaaaaatgaa

SEQ ID NO: 950555 - DNA, 16 bp, Homo sapiens
taaaaacagattctga

SEQ ID NO: 950556 - DNA, 22 bp, Homo sapiens
taaaaacagcattgctttctga

SEQ ID NO: 950557 - DNA, 18 bp, Homo sapiens
taaaaacattttgaagtg

SEQ ID NO: 950558 - DNA, 13 bp, Homo sapiens
taaaaaccctgta

SEQ ID NO: 950559 - DNA, 17 bp, Homo sapiens
taaaaaccgaataaatg

SEQ ID NO: 950560 - DNA, 20 bp, Homo sapiens
taaaaaccgaataaatgttt

SEQ ID NO: 950561 - DNA, 17 bp, Homo sapiens
taaaaaccttaagtgct

SEQ ID NO: 950562 - DNA, 20 bp, Homo sapiens
taaaaaccttaagtgctgca

SEQ ID NO: 950563 - DNA, 15 bp, Homo sapiens
taaaaactcctgggc

SEQ ID NO: 950564 - DNA, 17 bp, Homo sapiens
taaaaactgaagaattt

SEQ ID NO: 950565 - DNA, 14 bp, Homo sapiens
taaaaactgtgtat

SEQ ID NO: 950566 - DNA, 15 bp, Homo sapiens
taaaaactgtgtatc

SEQ ID NO: 950567 - DNA, 22 bp, Homo sapiens
taaaaactgtgtatcattaaaa

SEQ ID NO: 950568 - DNA, 22 bp, Homo sapiens
taaaaactttcagagaattact

SEQ ID NO: 950569 - DNA, 17 bp, Homo sapiens
taaaaagaaaagataaa

SEQ ID NO: 950570 - DNA, 23 bp, Homo sapiens
taaaaagaaaagataaagatgat

SEQ ID NO: 950571 - DNA, 21 bp, Homo sapiens
taaaaagacacttatattttg

SEQ ID NO: 950572 - DNA, 20 bp, Homo sapiens
taaaaagattgaagtatttt

SEQ ID NO: 950573 - DNA, 20 bp, Homo sapiens
taaaaagccagggctggaga

SEQ ID NO: 950574 - DNA, 12 bp, Homo sapiens
taaaaagctcac

SEQ ID NO: 950575 - DNA, 12 bp, Homo sapiens
taaaaaggaaat

SEQ ID NO: 950576 - DNA, 18 bp, Homo sapiens
taaaaaggaaatttgttt

SEQ ID NO: 950577 - DNA, 22 bp, Homo sapiens
taaaaaggaaatttgtttgtat

SEQ ID NO: 950578 - DNA, 12 bp, Homo sapiens
taaaaaggaagg

SEQ ID NO: 950579 - DNA, 21 bp, Homo sapiens
taaaaaggaagtggggacaga

SEQ ID NO: 950580 - DNA, 23 bp, Homo sapiens
taaaaaggaagtggggacagatt

SEQ ID NO: 950581 - DNA, 17 bp, Homo sapiens
taaaaagggagaaagaa

SEQ ID NO: 950582 - DNA, 17 bp, Homo sapiens
taaaaaggggaggagaa

SEQ ID NO: 950583 - DNA, 15 bp, Homo sapiens
taaaaagtaagttaa

SEQ ID NO: 950584 - DNA, 18 bp, Homo sapiens
taaaaagtattttttcaa

SEQ ID NO: 950585 - DNA, 21 bp, Homo sapiens
taaaaagtctgtatggcatga

SEQ ID NO: 950586 - DNA, 14 bp, Homo sapiens
taaaaagtcttcac

SEQ ID NO: 950587 - DNA, 15 bp, Homo sapiens
taaaaagtgaacttt

SEQ ID NO: 950588 - DNA, 16 bp, Homo sapiens
taaaaagtgaactttt

SEQ ID NO: 950589 - DNA, 22 bp, Homo sapiens
taaaaagtgaacttttgtaatt

SEQ ID NO: 950590 - DNA, 23 bp, Homo sapiens
taaaaagtgaacttttgtaattt

SEQ ID NO: 950591 - DNA, 18 bp, Homo sapiens
taaaaagtgacacagcag

SEQ ID NO: 950592 - DNA, 15 bp, Homo sapiens
taaaaagtggaaaaa

SEQ ID NO: 950593 - DNA, 15 bp, Homo sapiens
taaaaagtggctgcg

SEQ ID NO: 950594 - DNA, 17 bp, Homo sapiens
taaaaagttcagagttc

SEQ ID NO: 950595 - DNA, 18 bp, Homo sapiens
taaaaagtttcacgtctt

SEQ ID NO: 950596 - DNA, 20 bp, Homo sapiens
taaaaataaaacatcataaa

SEQ ID NO: 950597 - DNA, 16 bp, Homo sapiens
taaaaataagtcaaca

SEQ ID NO: 950598 - DNA, 14 bp, Homo sapiens
taaaaatagacagt

SEQ ID NO: 950599 - DNA, 10 bp, Homo sapiens
taaaaatata

SEQ ID NO: 950600 - DNA, 19 bp, Homo sapiens
taaaaatattgtttctgca

SEQ ID NO: 950601 - DNA, 13 bp, Homo sapiens
taaaaatcatgtg

SEQ ID NO: 950602 - DNA, 16 bp, Homo sapiens
taaaaatctcaaattt

SEQ ID NO: 950603 - DNA, 17 bp, Homo sapiens
taaaaatctcaaatttc

SEQ ID NO: 950604 - DNA, 19 bp, Homo sapiens
taaaaatctcaaatttcta

SEQ ID NO: 950605 - DNA, 20 bp, Homo sapiens
tgttttcatgtaaataaata

SEQ ID NO: 950606 - DNA, 18 bp, Homo sapiens
tgttttcattatgttcat

SEQ ID NO: 950607 - DNA, 15 bp, Homo sapiens
tgttttcccccagca

SEQ ID NO: 950608 - DNA, 16 bp, Homo sapiens
tgttttccctgacctc

SEQ ID NO: 950609 - DNA, 21 bp, Homo sapiens
tgttttcccttaacttttcct

SEQ ID NO: 950610 - DNA, 19 bp, Homo sapiens
tgttttcctgctttacaaa

SEQ ID NO: 950611 - DNA, 16 bp, Homo sapiens
tgttttctaagatgtt

SEQ ID NO: 950612 - DNA, 14 bp, Homo sapiens
tgttttctcagaac

SEQ ID NO: 950613 - DNA, 20 bp, Homo sapiens
tgttttctcagaacagctga

SEQ ID NO: 950614 - DNA, 18 bp, Homo sapiens
tgttttctgactagttta

SEQ ID NO: 950615 - DNA, 21 bp, Homo sapiens
tgttttctgtagactctaaga

SEQ ID NO: 950616 - DNA, 17 bp, Homo sapiens
tgttttctgtttgtaaa

SEQ ID NO: 950617 - DNA, 12 bp, Homo sapiens
tgttttcttaaa

SEQ ID NO: 950618 - DNA, 12 bp, Homo sapiens
tgttttcttcaa

SEQ ID NO: 950619 - DNA, 14 bp, Homo sapiens
tgttttctttgagg

SEQ ID NO: 950620 - DNA, 12 bp, Homo sapiens
tgttttgaaagt

SEQ ID NO: 950621 - DNA, 16 bp, Homo sapiens
tgttttgaaatgatat

SEQ ID NO: 950622 - DNA, 22 bp, Homo sapiens
tgttttgaatggtgttgtatgc

SEQ ID NO: 950623 - DNA, 15 bp, Homo sapiens
tgttttgaattttgt

SEQ ID NO: 950624 - DNA, 18 bp, Homo sapiens
tgttttgagctttccatg

SEQ ID NO: 950625 - DNA, 20 bp, Homo sapiens
tgttttgatatttatttcct

SEQ ID NO: 950626 - DNA, 20 bp, Homo sapiens
tgttttgatgtttgtggcct

SEQ ID NO: 950627 - DNA, 15 bp, Homo sapiens
tgttttgcaagtgct

SEQ ID NO: 950628 - DNA, 13 bp, Homo sapiens
tgttttgcacttt

SEQ ID NO: 950629 - DNA, 14 bp, Homo sapiens
tgttttgcactttt

SEQ ID NO: 950630 - DNA, 17 bp, Homo sapiens
tgttttgctcaatagat

SEQ ID NO: 950631 - DNA, 16 bp, Homo sapiens
tgttttgcttaaacta

SEQ ID NO: 950632 - DNA, 23 bp, Homo sapiens
tgttttgcttaaactaatgaaca

SEQ ID NO: 950633 - DNA, 17 bp, Homo sapiens
tgttttgggactttttt

SEQ ID NO: 950634 - DNA, 17 bp, Homo sapiens
tgttttgggcctccatg

SEQ ID NO: 950635 - DNA, 22 bp, Homo sapiens
tgttttggtgtattgtcagcca

SEQ ID NO: 950636 - DNA, 15 bp, Homo sapiens
tgttttggttaataa

SEQ ID NO: 950637 - DNA, 15 bp, Homo sapiens
tgttttgtacaatta

SEQ ID NO: 950638 - DNA, 18 bp, Homo sapiens
tgttttgtacatagattt

SEQ ID NO: 950639 - DNA, 10 bp, Homo sapiens
tgttttgtag

SEQ ID NO: 950640 - DNA, 19 bp, Homo sapiens
tgttttgtcagacttccaa

SEQ ID NO: 950641 - DNA, 23 bp, Homo sapiens
tgttttgtcctgcctcttgtttc

SEQ ID NO: 950642 - DNA, 17 bp, Homo sapiens
tgttttgtgaattttct

SEQ ID NO: 950643 - DNA, 13 bp, Homo sapiens
tgttttgtgcatt

SEQ ID NO: 950644 - DNA, 14 bp, Homo sapiens
tgttttgtgtatat

SEQ ID NO: 950645 - DNA, 16 bp, Homo sapiens
tgttttgttaatatac

SEQ ID NO: 950646 - DNA, 18 bp, Homo sapiens
tgttttgttttgtagatg

SEQ ID NO: 950647 - DNA, 18 bp, Homo sapiens
tgtttttaaactgtacag

SEQ ID NO: 950648 - DNA, 19 bp, Homo sapiens
tgtttttaaactgtacagt

SEQ ID NO: 950649 - DNA, 15 bp, Homo sapiens
tgtttttaagctgtt

SEQ ID NO: 950650 - DNA, 22 bp, Homo sapiens
tgtttttaagctgtttccatag

SEQ ID NO: 950651 - DNA, 17 bp, Homo sapiens
tgtttttaatctcctgt

SEQ ID NO: 950652 - DNA, 11 bp, Homo sapiens
tgtttttcatt

SEQ ID NO: 950653 - DNA, 14 bp, Homo sapiens
tgtttttcattcat

SEQ ID NO: 950654 - DNA, 23 bp, Homo sapiens
tgtttttctatagaaaaagtaaa

SEQ ID NO: 950655 - DNA, 11 bp, Homo sapiens
tgtttttctca

SEQ ID NO: 950656 - DNA, 21 bp, Homo sapiens
tgtttttgaatttaaataaag

SEQ ID NO: 950657 - DNA, 13 bp, Homo sapiens
tgtttttgcatga

SEQ ID NO: 950658 - DNA, 12 bp, Homo sapiens
tgtttttgtaat

SEQ ID NO: 950659 - DNA, 13 bp, Homo sapiens
tgtttttgtatct

SEQ ID NO: 950660 - DNA, 14 bp, Homo sapiens
tgttttttaaaaaa

SEQ ID NO: 950661 - DNA, 14 bp, Homo sapiens
tgttttttaagata

SEQ ID NO: 950662 - DNA, 20 bp, Homo sapiens
tgttttttaagatagtgtaa

SEQ ID NO: 950663 - DNA, 19 bp, Homo sapiens
tgttttttaagatggcaat

SEQ ID NO: 950664 - DNA, 11 bp, Homo sapiens
tgttttttaat

SEQ ID NO: 950665 - DNA, 23 bp, Homo sapiens
tgttttttcaaaatagaaaagtt

SEQ ID NO: 950666 - DNA, 19 bp, Homo sapiens
tgttttttgccacagcttt

SEQ ID NO: 950667 - DNA, 11 bp, Homo sapiens
tgttttttggg

SEQ ID NO: 950668 - DNA, 16 bp, Homo sapiens
tgttttttggtctttt

SEQ ID NO: 950669 - DNA, 16 bp, Homo sapiens
tgtttttttctaaaaa

SEQ ID NO: 950670 - DNA, 22 bp, Homo sapiens
tgtttttttctttttttataaa

SEQ ID NO: 950671 - DNA, 17 bp, Homo sapiens
tgttttttttcagccac

SEQ ID NO: 950672 - DNA, 21 bp, Homo sapiens
tgttttttttgactaaagcta

SEQ ID NO: 950673 - DNA, 15 bp, Homo sapiens
ttaaaaaaaaaagtc

SEQ ID NO: 950674 - DNA, 19 bp, Homo sapiens
ttaaaaaaaaaatcagtgt

SEQ ID NO: 950675 - DNA, 13 bp, Homo sapiens
ttaaaaaaaaaga

SEQ ID NO: 950676 - DNA, 23 bp, Homo sapiens
ttaaaaaaaacaaaaagaacaaa

SEQ ID NO: 950677 - DNA, 12 bp, Homo sapiens
ttaaaaaaaaga

SEQ ID NO: 950678 - DNA, 13 bp, Homo sapiens
ttaaaaaaaatcc

SEQ ID NO: 950679 - DNA, 12 bp, Homo sapiens
ttaaaaaaacaa

SEQ ID NO: 950680 - DNA, 14 bp, Homo sapiens
ttaaaaaaactgaa

SEQ ID NO: 950681 - DNA, 19 bp, Homo sapiens
ttaaaaaaactgaaggttt

SEQ ID NO: 950682 - DNA, 17 bp, Homo sapiens
ttaaaaaaatcacaaaa

SEQ ID NO: 950683 - DNA, 23 bp, Homo sapiens
ttaaaaaaatcacaaaaatttga

SEQ ID NO: 950684 - DNA, 15 bp, Homo sapiens
taaaactttccaaat

SEQ ID NO: 950685 - DNA, 17 bp, Homo sapiens
taaaactttcctcgcct

SEQ ID NO: 950686 - DNA, 15 bp, Homo sapiens
taaaactttgaagtt

SEQ ID NO: 950687 - DNA, 15 bp, Homo sapiens
taaaagaaaaaatga

SEQ ID NO: 950688 - DNA, 14 bp, Homo sapiens
taaaagaaaataaa

SEQ ID NO: 950689 - DNA, 18 bp, Homo sapiens
taaaagaaatatattttt

SEQ ID NO: 950690 - DNA, 21 bp, Homo sapiens
taaaagaacaatgacaaacac

SEQ ID NO: 950691 - DNA, 17 bp, Homo sapiens
taaaagaacagtaaaca

SEQ ID NO: 950692 - DNA, 15 bp, Homo sapiens
taaaagaacatgctt

SEQ ID NO: 950693 - DNA, 18 bp, Homo sapiens
taaaagaagagaggggaa

SEQ ID NO: 950694 - DNA, 21 bp, Homo sapiens
taaaagaagagaggggaagaa

SEQ ID NO: 950695 - DNA, 22 bp, Homo sapiens
taaaagaagagaggggaagaat

SEQ ID NO: 950696 - DNA, 15 bp, Homo sapiens
taaaagacaagactt

SEQ ID NO: 950697 - DNA, 13 bp, Homo sapiens
taaaagacttttt

SEQ ID NO: 950698 - DNA, 23 bp, Homo sapiens
taaaagagaccacccatatcatg

SEQ ID NO: 950699 - DNA, 16 bp, Homo sapiens
taaaagagagagagag

SEQ ID NO: 950700 - DNA, 18 bp, Homo sapiens
taaaagagatctgggcat

SEQ ID NO: 950701 - DNA, 14 bp, Homo sapiens
taaaagagctgtct

SEQ ID NO: 950702 - DNA, 19 bp, Homo sapiens
taaaagagctgtctgactg

SEQ ID NO: 950703 - DNA, 12 bp, Homo sapiens
taaaagagcttt

SEQ ID NO: 950704 - DNA, 14 bp, Homo sapiens
taaaagagtagaat

SEQ ID NO: 950705 - DNA, 21 bp, Homo sapiens
taaaagataaatttgttgaat

SEQ ID NO: 950706 - DNA, 21 bp, Homo sapiens
taaaagatggttgtagcattt

SEQ ID NO: 950707 - DNA, 19 bp, Homo sapiens
taaaagatttacattccac

SEQ ID NO: 950708 - DNA, 12 bp, Homo sapiens
taaaagcaaaaa

SEQ ID NO: 950709 - DNA, 17 bp, Homo sapiens
taaaagcaaaaaagaaa

SEQ ID NO: 950710 - DNA, 14 bp, Homo sapiens
taaaagcaaatcat

SEQ ID NO: 950711 - DNA, 11 bp, Homo sapiens
taaaagcacac

SEQ ID NO: 950712 - DNA, 15 bp, Homo sapiens
taaaagcatgaaaca

SEQ ID NO: 950713 - DNA, 14 bp, Homo sapiens
taaaagcattgtct

SEQ ID NO: 950714 - DNA, 21 bp, Homo sapiens
taaaagccacaggtgttgatt

SEQ ID NO: 950715 - DNA, 16 bp, Homo sapiens
taaaagcccactgtgg

SEQ ID NO: 950716 - DNA, 12 bp, Homo sapiens
taaaagcctgct

SEQ ID NO: 950717 - DNA, 16 bp, Homo sapiens
taaaagccttattcta

SEQ ID NO: 950718 - DNA, 20 bp, Homo sapiens
taaaagcgacctctcttgag

SEQ ID NO: 950719 - DNA, 21 bp, Homo sapiens
taaaaggaaagaaaacatctt

SEQ ID NO: 950720 - DNA, 14 bp, Homo sapiens
taaaaggaagccaa

SEQ ID NO: 950721 - DNA, 14 bp, Homo sapiens
taaaaggagagaag

SEQ ID NO: 950722 - DNA, 16 bp, Homo sapiens
taaaaggagagaagaa

SEQ ID NO: 950723 - DNA, 16 bp, Homo sapiens
taaaaggatgtataaa

SEQ ID NO: 950724 - DNA, 20 bp, Homo sapiens
taaaaggatgttacaagttt

SEQ ID NO: 950725 - DNA, 14 bp, Homo sapiens
taaaaggccctgtg

SEQ ID NO: 950726 - DNA, 15 bp, Homo sapiens
taaaagggaacacaa

SEQ ID NO: 950727 - DNA, 15 bp, Homo sapiens
taaaagggatacaca

SEQ ID NO: 950728 - DNA, 17 bp, Homo sapiens
ttaaaccgccaaggctg

SEQ ID NO: 950729 - DNA, 19 bp, Homo sapiens
ttaaaccgctaaaagaaac

SEQ ID NO: 950730 - DNA, 19 bp, Homo sapiens
ttaaacctgaagatgtctc

SEQ ID NO: 950731 - DNA, 15 bp, Homo sapiens
ttaaacctgtctcca

SEQ ID NO: 950732 - DNA, 21 bp, Homo sapiens
ttaaacctgtctccactgtgc

SEQ ID NO: 950733 - DNA, 15 bp, Homo sapiens
ttaaacctttcataa

SEQ ID NO: 950734 - DNA, 18 bp, Homo sapiens
ttaaacgtatgcatgtga

SEQ ID NO: 950735 - DNA, 20 bp, Homo sapiens
ttaaacgtatgcatgtgaag

SEQ ID NO: 950736 - DNA, 14 bp, Homo sapiens
ttaaacgtgcagac

SEQ ID NO: 950737 - DNA, 22 bp, Homo sapiens
ttaaactaaaaaaaaaaaggcc

SEQ ID NO: 950738 - DNA, 20 bp, Homo sapiens
ttaaactaaataatgaataa

SEQ ID NO: 950739 - DNA, 14 bp, Homo sapiens
ttaaactaaatgtg

SEQ ID NO: 950740 - DNA, 17 bp, Homo sapiens
ttaaactaaattactgt

SEQ ID NO: 950741 - DNA, 18 bp, Homo sapiens
ttaaactaagatctgtta

SEQ ID NO: 950742 - DNA, 14 bp, Homo sapiens
ttaaactatcttgt

SEQ ID NO: 950743 - DNA, 20 bp, Homo sapiens
ttaaactattagagtatttc

SEQ ID NO: 950744 - DNA, 13 bp, Homo sapiens
ttaaactcaggga

SEQ ID NO: 950745 - DNA, 15 bp, Homo sapiens
ttaaactctgccaga

SEQ ID NO: 950746 - DNA, 13 bp, Homo sapiens
ttaaactgtacag

SEQ ID NO: 950747 - DNA, 14 bp, Homo sapiens
ttaaactgtacagt

SEQ ID NO: 950748 - DNA, 16 bp, Homo sapiens
ttaaactgtacagtgt

SEQ ID NO: 950749 - DNA, 20 bp, Homo sapiens
ttaaactgtacagtgtcttt

SEQ ID NO: 950750 - DNA, 12 bp, Homo sapiens
ttaaactgtgta

SEQ ID NO: 950751 - DNA, 20 bp, Homo sapiens
ttaaactgtgtggactgtga

SEQ ID NO: 950752 - DNA, 21 bp, Homo sapiens
ttaaactgtgtggactgtgat

SEQ ID NO: 950753 - DNA, 16 bp, Homo sapiens
ttaaactgttagcact

SEQ ID NO: 950754 - DNA, 20 bp, Homo sapiens
ttaaactgttagcactgttg

SEQ ID NO: 950755 - DNA, 22 bp, Homo sapiens
ttaaactgttagcactgttgat

SEQ ID NO: 950756 - DNA, 20 bp, Homo sapiens
ttaaacttaatctaaatgga

SEQ ID NO: 950757 - DNA, 16 bp, Homo sapiens
ttaaacttccaaagaa

SEQ ID NO: 950758 - DNA, 21 bp, Homo sapiens
ttaaacttgaaatatataata

SEQ ID NO: 950759 - DNA, 17 bp, Homo sapiens
ttaaacttgtcagaatt

SEQ ID NO: 950760 - DNA, 20 bp, Homo sapiens
ttaaagaaaaaaattgaaat

SEQ ID NO: 950761 - DNA, 13 bp, Homo sapiens
ttaaagaaaaata

SEQ ID NO: 950762 - DNA, 15 bp, Homo sapiens
ttaaagaaaagatga

SEQ ID NO: 950763 - DNA, 19 bp, Homo sapiens
ttaaagaaaattgcatgaa

SEQ ID NO: 950764 - DNA, 16 bp, Homo sapiens
ttaaagaaacagcttt

SEQ ID NO: 950765 - DNA, 21 bp, Homo sapiens
ttaaagaaacagctttcaagt

SEQ ID NO: 950766 - DNA, 11 bp, Homo sapiens
ttaaagaaagt

SEQ ID NO: 950767 - DNA, 12 bp, Homo sapiens
ttaaagaaagtg

SEQ ID NO: 950768 - DNA, 17 bp, Homo sapiens
ttaaagaaagtgtattt

SEQ ID NO: 950769 - DNA, 17 bp, Homo sapiens
ttaaagaagctgcatgt

SEQ ID NO: 950770 - DNA, 19 bp, Homo sapiens
ttaaagaagtatttttaga

SEQ ID NO: 950771 - DNA, 12 bp, Homo sapiens
ttaaagaataaa

SEQ ID NO: 950772 - DNA, 19 bp, Homo sapiens
ttaaagaatgagaaacata

SEQ ID NO: 950773 - DNA, 19 bp, Homo sapiens
ttaaagaatgttagtaaag

SEQ ID NO: 950774 - DNA, 11 bp, Homo sapiens
ttaaagacaga

SEQ ID NO: 950775 - DNA, 18 bp, Homo sapiens
ttaaagacaggagacaaa

SEQ ID NO: 950776 - DNA, 19 bp, Homo sapiens
ttaaagacccaacttgcca

SEQ ID NO: 950777 - DNA, 17 bp, Homo sapiens
ttaaagagatttccctt

SEQ ID NO: 950778 - DNA, 19 bp, Homo sapiens
ttaaagaggagaaggaaaa

SEQ ID NO: 950779 - DNA, 18 bp, Homo sapiens
ttaaagataagtctacat

SEQ ID NO: 950780 - DNA, 22 bp, Homo sapiens
ttaaagatctgtaagtaacttc

SEQ ID NO: 950781 - DNA, 15 bp, Homo sapiens
ttaaagatgccatag

SEQ ID NO: 950782 - DNA, 22 bp, Homo sapiens
ttaaagattattgtgacttcac

SEQ ID NO: 950783 - DNA, 16 bp, Homo sapiens
ttaaagcaaaatagta

SEQ ID NO: 950784 - DNA, 21 bp, Homo sapiens
ttaaagcagagggactttgta

SEQ ID NO: 950785 - DNA, 22 bp, Homo sapiens
ttaaagcagagggactttgtat

SEQ ID NO: 950786 - DNA, 18 bp, Homo sapiens
ttaaagcattacagtatt

SEQ ID NO: 950787 - DNA, 22 bp, Homo sapiens
ttaaagccacaaccacatacaa

SEQ ID NO: 950788 - DNA, 16 bp, Homo sapiens
ttaaagcctggcttct

SEQ ID NO: 950789 - DNA, 14 bp, Homo sapiens
ttaaagctaaattt

SEQ ID NO: 950790 - DNA, 14 bp, Homo sapiens
ttaaagctgcctgt

SEQ ID NO: 950791 - DNA, 15 bp, Homo sapiens
ttaaagctgcctgta

SEQ ID NO: 950792 - DNA, 18 bp, Homo sapiens
ttaaagctgcctgtagtt

SEQ ID NO: 950793 - DNA, 11 bp, Homo sapiens
ttaaagctgta

SEQ ID NO: 950794 - DNA, 14 bp, Homo sapiens
ttaaagctgtacac

SEQ ID NO: 950795 - DNA, 17 bp, Homo sapiens
ttaaagcttaaactgaa

SEQ ID NO: 950796 - DNA, 18 bp, Homo sapiens
ttaaagcttaaactgaat

SEQ ID NO: 950797 - DNA, 18 bp, Homo sapiens
ttaaagcttatttttatg

SEQ ID NO: 950798 - DNA, 20 bp, Homo sapiens
ttaaagcttatttttatgtg

SEQ ID NO: 950799 - DNA, 23 bp, Homo sapiens
ttaaagcttccctctcagctgct

SEQ ID NO: 950800 - DNA, 14 bp, Homo sapiens
ttaaagcttgattt

SEQ ID NO: 950801 - DNA, 18 bp, Homo sapiens
ttaaagctttcaacatgt

SEQ ID NO: 950802 - DNA, 16 bp, Homo sapiens
ttaaaggaaaaaatgt

SEQ ID NO: 950803 - DNA, 15 bp, Homo sapiens
ttaaaggaaacacta

SEQ ID NO: 950804 - DNA, 18 bp, Homo sapiens
ttaaaggaatgtgaaatt

SEQ ID NO: 950805 - DNA, 21 bp, Homo sapiens
ttaaaggacaggaggaggaga

SEQ ID NO: 950806 - DNA, 12 bp, Homo sapiens
ttaaaggagtta

SEQ ID NO: 950807 - DNA, 20 bp, Homo sapiens
ttaaaggataattatccaat

SEQ ID NO: 950808 - DNA, 21 bp, Homo sapiens
ttaaaggcagtattttgtgtc

SEQ ID NO: 950809 - DNA, 17 bp, Homo sapiens
ttaaagggcccaatgaa

SEQ ID NO: 950810 - DNA, 19 bp, Homo sapiens
ttaaagggtgtacttatat

SEQ ID NO: 950811 - DNA, 17 bp, Homo sapiens
ttaaaggtcctgccctc

SEQ ID NO: 950812 - DNA, 19 bp, Homo sapiens
ttaaaggtttttgaaatcc

SEQ ID NO: 950813 - DNA, 19 bp, Homo sapiens
ttaaagtaaacttgtgtat

SEQ ID NO: 950814 - DNA, 17 bp, Homo sapiens
ttaaagtaaaggcctca

SEQ ID NO: 950815 - DNA, 12 bp, Homo sapiens
ttaaagtaaatt

SEQ ID NO: 950816 - DNA, 15 bp, Homo sapiens
ttaaagtaaattatt

SEQ ID NO: 950817 - DNA, 18 bp, Homo sapiens
ttaaagtatgttattgca

SEQ ID NO: 950818 - DNA, 14 bp, Homo sapiens
ttaaagtgaaggaa

SEQ ID NO: 950819 - DNA, 14 bp, Homo sapiens
taaacaatgtataa

SEQ ID NO: 950820 - DNA, 15 bp, Homo sapiens
taaacaatgtataaa

SEQ ID NO: 950821 - DNA, 16 bp, Homo sapiens
taaacaatgtataaag

SEQ ID NO: 950822 - DNA, 24 bp, Homo sapiens
taaacaatttattttattttagca

SEQ ID NO: 950823 - DNA, 15 bp, Homo sapiens
taaacaattttgtta

SEQ ID NO: 950824 - DNA, 23 bp, Homo sapiens
taaacacaacaataacttttata

SEQ ID NO: 950825 - DNA, 16 bp, Homo sapiens
taaacacaagaaggaa

SEQ ID NO: 950826 - DNA, 18 bp, Homo sapiens
taaacacaagaaggaatc

SEQ ID NO: 950827 - DNA, 18 bp, Homo sapiens
taaacacacagatacaca

SEQ ID NO: 950828 - DNA, 20 bp, Homo sapiens
taaacacatagattcacctg

SEQ ID NO: 950829 - DNA, 15 bp, Homo sapiens
taaacacattgaatg

SEQ ID NO: 950830 - DNA, 23 bp, Homo sapiens
taaacacccatgaatcaaagaca

SEQ ID NO: 950831 - DNA, 15 bp, Homo sapiens
taaacacgtgtctat

SEQ ID NO: 950832 - DNA, 14 bp, Homo sapiens
taaacactcacctt

SEQ ID NO: 950833 - DNA, 17 bp, Homo sapiens
taaacactgtaatctta

SEQ ID NO: 950834 - DNA, 24 bp, Homo sapiens
taaacagaactcccttcaaaagcc

SEQ ID NO: 950835 - DNA, 19 bp, Homo sapiens
taaacagacaggaatttag

SEQ ID NO: 950836 - DNA, 16 bp, Homo sapiens
taaacagactgttaat

SEQ ID NO: 950837 - DNA, 22 bp, Homo sapiens
taaacagatgtattatgctgtt

SEQ ID NO: 950838 - DNA, 13 bp, Homo sapiens
taaacagcagtgt

SEQ ID NO: 950839 - DNA, 17 bp, Homo sapiens
taaacagcagtgttccc

SEQ ID NO: 950840 - DNA, 18 bp, Homo sapiens
taaacaggagacaggaag

SEQ ID NO: 950841 - DNA, 14 bp, Homo sapiens
taaacaggcccagc

SEQ ID NO: 950842 - DNA, 12 bp, Homo sapiens
taaacagggtct

SEQ ID NO: 950843 - DNA, 16 bp, Homo sapiens
taaacagtgagcatat

SEQ ID NO: 950844 - DNA, 20 bp, Homo sapiens
taaacagtgagcctgaattt

SEQ ID NO: 950845 - DNA, 18 bp, Homo sapiens
taaacagtgcctgctgaa

SEQ ID NO: 950846 - DNA, 20 bp, Homo sapiens
taaacataattcttgtatat

SEQ ID NO: 950847 - DNA, 14 bp, Homo sapiens
taaacataattgtg

SEQ ID NO: 950848 - DNA, 15 bp, Homo sapiens
taaacataattgtgg

SEQ ID NO: 950849 - DNA, 15 bp, Homo sapiens
taaacatatggcttt

SEQ ID NO: 950850 - DNA, 19 bp, Homo sapiens
taaacatatttttatactt

SEQ ID NO: 950851 - DNA, 20 bp, Homo sapiens
taaacatatttttatacttt

SEQ ID NO: 950852 - DNA, 22 bp, Homo sapiens
taaacatatttttatactttat

SEQ ID NO: 950853 - DNA, 15 bp, Homo sapiens
taaacatcacacaca

SEQ ID NO: 950854 - DNA, 15 bp, Homo sapiens
taaacatcattcatt

SEQ ID NO: 950855 - DNA, 17 bp, Homo sapiens
taaacatcattcatttt

SEQ ID NO: 950856 - DNA, 17 bp, Homo sapiens
taaacatccaatatttt

SEQ ID NO: 950857 - DNA, 17 bp, Homo sapiens
taaacatccttcaagaa

SEQ ID NO: 950858 - DNA, 20 bp, Homo sapiens
taaacatctagcagtaaata

SEQ ID NO: 950859 - DNA, 22 bp, Homo sapiens
taaacatgaaaacacttgaaat

SEQ ID NO: 950860 - DNA, 16 bp, Homo sapiens
taaacatggttacaat

SEQ ID NO: 950861 - DNA, 15 bp, Homo sapiens
taaacatgtgtttta

SEQ ID NO: 950862 - DNA, 20 bp, Homo sapiens
taaacattaaacactgtaat

SEQ ID NO: 950863 - DNA, 20 bp, Homo sapiens
taaacattaatagcagcctt

SEQ ID NO: 950864 - DNA, 18 bp, Homo sapiens
taaacattaattttgtgc

SEQ ID NO: 950865 - DNA, 22 bp, Homo sapiens
taaacattaattttgtgcattc

SEQ ID NO: 950866 - DNA, 23 bp, Homo sapiens
taaacattaattttgtgcattct

SEQ ID NO: 950867 - DNA, 21 bp, Homo sapiens
taaacattattttttatttct

SEQ ID NO: 950868 - DNA, 21 bp, Homo sapiens
taaacattcctccagcctccc

SEQ ID NO: 950869 - DNA, 14 bp, Homo sapiens
taaacattctttta

SEQ ID NO: 950870 - DNA, 16 bp, Homo sapiens
taaacatttgttcctg

SEQ ID NO: 950871 - DNA, 17 bp, Homo sapiens
taaaccaaaacacccca

SEQ ID NO: 950872 - DNA, 14 bp, Homo sapiens
taaaccaaaaccaa

SEQ ID NO: 950873 - DNA, 21 bp, Homo sapiens
taaaccaaacccagccactgc

SEQ ID NO: 950874 - DNA, 19 bp, Homo sapiens
taaaccaagttatttttct

SEQ ID NO: 950875 - DNA, 14 bp, Homo sapiens
taaaccacataatt

SEQ ID NO: 950876 - DNA, 20 bp, Homo sapiens
taaaccactgaaaaaatata

SEQ ID NO: 950877 - DNA, 14 bp, Homo sapiens
taaaccaggaaaaa

SEQ ID NO: 950878 - DNA, 21 bp, Homo sapiens
taaaccaggtttagacagtat

SEQ ID NO: 950879 - DNA, 13 bp, Homo sapiens
taaaccattgtaa

SEQ ID NO: 950880 - DNA, 19 bp, Homo sapiens
taaacccaatcagatgcct

SEQ ID NO: 950881 - DNA, 15 bp, Homo sapiens
taaacccctgtccca

SEQ ID NO: 950882 - DNA, 23 bp, Homo sapiens
taaaccctttagtgctttgtgat

SEQ ID NO: 950883 - DNA, 13 bp, Homo sapiens
taaacctaaaaaa

SEQ ID NO: 950884 - DNA, 16 bp, Homo sapiens
taaacctaaaaaagat

SEQ ID NO: 950885 - DNA, 18 bp, Homo sapiens
taaacctaaaaaagatat

SEQ ID NO: 950886 - DNA, 15 bp, Homo sapiens
taaacctcagttatt

SEQ ID NO: 950887 - DNA, 14 bp, Homo sapiens
taaacctgaagatg

SEQ ID NO: 950888 - DNA, 13 bp, Homo sapiens
taaacctgcactg

SEQ ID NO: 950889 - DNA, 18 bp, Homo sapiens
taaacctgggctcagcct

SEQ ID NO: 950890 - DNA, 12 bp, Homo sapiens
taaaccttaata

SEQ ID NO: 950891 - DNA, 21 bp, Homo sapiens
taaacgcgtgatgaagacaga

SEQ ID NO: 950892 - DNA, 21 bp, Homo sapiens
taaacggtgcccatcctgcca

SEQ ID NO: 950893 - DNA, 21 bp, Homo sapiens
taaacggttcagtttcttctg

SEQ ID NO: 950894 - DNA, 12 bp, Homo sapiens
taaactaaaaaa

SEQ ID NO: 950895 - DNA, 13 bp, Homo sapiens
taaactaaataat

SEQ ID NO: 950896 - DNA, 13 bp, Homo sapiens
taaactaaattac

SEQ ID NO: 950897 - DNA, 16 bp, Homo sapiens
taaactaaattactgt

SEQ ID NO: 950898 - DNA, 17 bp, Homo sapiens
taaactaataattgcag

SEQ ID NO: 950899 - DNA, 18 bp, Homo sapiens
taaactacaaagtaaaat

SEQ ID NO: 950900 - DNA, 16 bp, Homo sapiens
taaactactctttgat

SEQ ID NO: 950901 - DNA, 18 bp, Homo sapiens
taaactagtttttcctat

SEQ ID NO: 950902 - DNA, 23 bp, Homo sapiens
taaactattagagtatttccctt

SEQ ID NO: 950903 - DNA, 15 bp, Homo sapiens
taaactcaaaactta

SEQ ID NO: 950904 - DNA, 14 bp, Homo sapiens
taaactcaaaatat

SEQ ID NO: 950905 - DNA, 16 bp, Homo sapiens
taaactcaaaatattt

SEQ ID NO: 950906 - DNA, 19 bp, Homo sapiens
taaactcaaaatatttgta

SEQ ID NO: 950907 - DNA, 21 bp, Homo sapiens
taaactcaaaatatttgtaca

SEQ ID NO: 950908 - DNA, 23 bp, Homo sapiens
taaactcaaaatatttgtacata

SEQ ID NO: 950909 - DNA, 22 bp, Homo sapiens
taaactcaagatttgaccaaat

SEQ ID NO: 950910 - DNA, 15 bp, Homo sapiens
taaactcagatctga

SEQ ID NO: 950911 - DNA, 23 bp, Homo sapiens
taaactcagattgactaaataaa

SEQ ID NO: 950912 - DNA, 19 bp, Homo sapiens
taaactccaggatttataa

SEQ ID NO: 950913 - DNA, 15 bp, Homo sapiens
taaactccttcctgg

SEQ ID NO: 950914 - DNA, 21 bp, Homo sapiens
taaactccttcctggcctgag

SEQ ID NO: 950915 - DNA, 21 bp, Homo sapiens
taaactcgggggtgctggggc

SEQ ID NO: 950916 - DNA, 15 bp, Homo sapiens
taaactctaaacatt

SEQ ID NO: 950917 - DNA, 12 bp, Homo sapiens
taaactctctag

SEQ ID NO: 950918 - DNA, 18 bp, Homo sapiens
taaactctgcatccagag

SEQ ID NO: 950919 - DNA, 15 bp, Homo sapiens
taaactctgccagaa

SEQ ID NO: 950920 - DNA, 14 bp, Homo sapiens
taaactctggggct

SEQ ID NO: 950921 - DNA, 19 bp, Homo sapiens
taaactctgttgtaagtaa

SEQ ID NO: 950922 - DNA, 20 bp, Homo sapiens
taaactcttcacaaaatctg

SEQ ID NO: 950923 - DNA, 20 bp, Homo sapiens
taaactgaatattttggaaa

SEQ ID NO: 950924 - DNA, 15 bp, Homo sapiens
taaactgactttatc

SEQ ID NO: 950925 - DNA, 12 bp, Homo sapiens
taaactgagcct

SEQ ID NO: 950926 - DNA, 11 bp, Homo sapiens
taaactgagcg

SEQ ID NO: 950927 - DNA, 14 bp, Homo sapiens
taaactgagcgacc

SEQ ID NO: 950928 - DNA, 18 bp, Homo sapiens
taaactgagctcgcagcc

SEQ ID NO: 950929 - DNA, 19 bp, Homo sapiens
taaactgagctgaatgttt

SEQ ID NO: 950930 - DNA, 22 bp, Homo sapiens
taaactgattagtattcaggca

SEQ ID NO: 950931 - DNA, 10 bp, Homo sapiens
taaactgcag

SEQ ID NO: 950932 - DNA, 12 bp, Homo sapiens
taaactgcagcc

SEQ ID NO: 950933 - DNA, 16 bp, Homo sapiens
taaactgcagcctctc

SEQ ID NO: 950934 - DNA, 10 bp, Homo sapiens
taaactgcat

SEQ ID NO: 950935 - DNA, 16 bp, Homo sapiens
taaactgcattagaaa

SEQ ID NO: 950936 - DNA, 13 bp, Homo sapiens
taaactgccatat

SEQ ID NO: 950937 - DNA, 20 bp, Homo sapiens
taaactgctgtcaataaatg

SEQ ID NO: 950938 - DNA, 12 bp, Homo sapiens
taaactgtacag

SEQ ID NO: 950939 - DNA, 13 bp, Homo sapiens
taaactgtacagt

SEQ ID NO: 950940 - DNA, 14 bp, Homo sapiens
taaactgtacagtg

SEQ ID NO: 950941 - DNA, 18 bp, Homo sapiens
taaactgtacagtgtctt

SEQ ID NO: 950942 - DNA, 19 bp, Homo sapiens
taaactgtacagtgtcttt

SEQ ID NO: 950943 - DNA, 12 bp, Homo sapiens
taaactgtatta

SEQ ID NO: 950944 - DNA, 15 bp, Homo sapiens
ttaaagtgaaggaaa

SEQ ID NO: 950945 - DNA, 16 bp, Homo sapiens
ttaaagtgaaggaaat

SEQ ID NO: 950946 - DNA, 12 bp, Homo sapiens
ttaaagtgactt

SEQ ID NO: 950947 - DNA, 13 bp, Homo sapiens
ttaaagtgccagt

SEQ ID NO: 950948 - DNA, 18 bp, Homo sapiens
ttaaagttcttattttag

SEQ ID NO: 950949 - DNA, 22 bp, Homo sapiens
ttaaagttgattttgaactttt

SEQ ID NO: 950950 - DNA, 13 bp, Homo sapiens
ttaaagtttaatg

SEQ ID NO: 950951 - DNA, 15 bp, Homo sapiens
ttaaataaaaataat

SEQ ID NO: 950952 - DNA, 13 bp, Homo sapiens
ttaaataaaagaa

SEQ ID NO: 950953 - DNA, 19 bp, Homo sapiens
ttaaataaaagcacaagta

SEQ ID NO: 950954 - DNA, 20 bp, Homo sapiens
ttaaataaaagtgatcaata

SEQ ID NO: 950955 - DNA, 13 bp, Homo sapiens
ttaaataaagtta

SEQ ID NO: 950956 - DNA, 13 bp, Homo sapiens
ttaaataaatttg

SEQ ID NO: 950957 - DNA, 19 bp, Homo sapiens
ttaaataacctctggccct

SEQ ID NO: 950958 - DNA, 20 bp, Homo sapiens
ttaaataacctctggccctt

SEQ ID NO: 950959 - DNA, 21 bp, Homo sapiens
ttaaataacctctggcccttg

SEQ ID NO: 950960 - DNA, 17 bp, Homo sapiens
ttaaataagaaactttt

SEQ ID NO: 950961 - DNA, 24 bp, Homo sapiens
ttaaataatatggctatgcttaaa

SEQ ID NO: 950962 - DNA, 16 bp, Homo sapiens
ttaaataatgtgaaac

SEQ ID NO: 950963 - DNA, 18 bp, Homo sapiens
ttaaataatgtgaaactg

SEQ ID NO: 950964 - DNA, 19 bp, Homo sapiens
ttaaataatgtgaaactgg

SEQ ID NO: 950965 - DNA, 23 bp, Homo sapiens
ttaaatacactgaattgaatcta

SEQ ID NO: 950966 - DNA, 19 bp, Homo sapiens
ttaaatacagataattcat

SEQ ID NO: 950967 - DNA, 14 bp, Homo sapiens
ttaaatacaggaaa

SEQ ID NO: 950968 - DNA, 15 bp, Homo sapiens
ttaaatacaggaaac

SEQ ID NO: 950969 - DNA, 18 bp, Homo sapiens
ttaaatacatatggatgt

SEQ ID NO: 950970 - DNA, 19 bp, Homo sapiens
ttaaatacatatggatgtt

SEQ ID NO: 950971 - DNA, 21 bp, Homo sapiens
ttaaatactgtgcagaataat

SEQ ID NO: 950972 - DNA, 17 bp, Homo sapiens
ttaaccatttaataaag

SEQ ID NO: 950973 - DNA, 15 bp, Homo sapiens
ttaaccattttaacc

SEQ ID NO: 950974 - DNA, 18 bp, Homo sapiens
ttaacccaaggagcacag

SEQ ID NO: 950975 - DNA, 21 bp, Homo sapiens
ttaaccccttggtactgaaaa

SEQ ID NO: 950976 - DNA, 14 bp, Homo sapiens
ttaaccctcccctt

SEQ ID NO: 950977 - DNA, 21 bp, Homo sapiens
ttaacccttcatcttcctgtg

SEQ ID NO: 950978 - DNA, 12 bp, Homo sapiens
ttaacctctgca

SEQ ID NO: 950979 - DNA, 15 bp, Homo sapiens
ttaaccttaaataca

SEQ ID NO: 950980 - DNA, 19 bp, Homo sapiens
ttaaccttaaatacactga

SEQ ID NO: 950981 - DNA, 21 bp, Homo sapiens
ttaaccttccaagactgaaga

SEQ ID NO: 950982 - DNA, 17 bp, Homo sapiens
ttaacctttccgctgtc

SEQ ID NO: 950983 - DNA, 14 bp, Homo sapiens
ttaacgatgtccaa

SEQ ID NO: 950984 - DNA, 18 bp, Homo sapiens
ttaacgggcatgtattat

SEQ ID NO: 950985 - DNA, 20 bp, Homo sapiens
ttaacgtttctcattaaaat

SEQ ID NO: 950986 - DNA, 18 bp, Homo sapiens
ttaactacataaaaatag

SEQ ID NO: 950987 - DNA, 19 bp, Homo sapiens
ttaactactatattgattg

SEQ ID NO: 950988 - DNA, 21 bp, Homo sapiens
ttaactagaatttattcaatt

SEQ ID NO: 950989 - DNA, 14 bp, Homo sapiens
ttaactatgatcat

SEQ ID NO: 950990 - DNA, 15 bp, Homo sapiens
ttaactcattagact

SEQ ID NO: 950991 - DNA, 17 bp, Homo sapiens
ttaactcattagactgg

SEQ ID NO: 950992 - DNA, 15 bp, Homo sapiens
ttaactccactgctt

SEQ ID NO: 950993 - DNA, 20 bp, Homo sapiens
ttaactccactgcttaccta

SEQ ID NO: 950994 - DNA, 16 bp, Homo sapiens
ttaactccctccacca

SEQ ID NO: 950995 - DNA, 18 bp, Homo sapiens
ttaactccctccaccagc

SEQ ID NO: 950996 - DNA, 19 bp, Homo sapiens
ttaactccctccaccagcc

SEQ ID NO: 950997 - DNA, 19 bp, Homo sapiens
ttaactctaaccctgtgga

SEQ ID NO: 950998 - DNA, 21 bp, Homo sapiens
ttaactgacaagccatcttga

SEQ ID NO: 950999 - DNA, 22 bp, Homo sapiens
ttaactggcatggattaataga

SEQ ID NO: 951000 - DNA, 20 bp, Homo sapiens
ttaactggtgcactttgtaa

SEQ ID NO: 951001 - DNA, 14 bp, Homo sapiens
ttaactgtatttca

SEQ ID NO: 951002 - DNA, 19 bp, Homo sapiens
ttaactgtgtatgtacata

SEQ ID NO: 951003 - DNA, 13 bp, Homo sapiens
ttaacttacattt

SEQ ID NO: 951004 - DNA, 14 bp, Homo sapiens
ttaacttacatttg

SEQ ID NO: 951005 - DNA, 21 bp, Homo sapiens
ttaacttacatttgtacttta

SEQ ID NO: 951006 - DNA, 17 bp, Homo sapiens
ttaacttatttagagat

SEQ ID NO: 951007 - DNA, 16 bp, Homo sapiens
ttaacttcacatattg

SEQ ID NO: 951008 - DNA, 22 bp, Homo sapiens
ttaacttgtcaaaaaacaaaaa

SEQ ID NO: 951009 - DNA, 16 bp, Homo sapiens
ttaactttaacttttg

SEQ ID NO: 951010 - DNA, 16 bp, Homo sapiens
ttaactttaagtttca

SEQ ID NO: 951011 - DNA, 23 bp, Homo sapiens
ttaactttatcacattatttgca

SEQ ID NO: 951012 - DNA, 15 bp, Homo sapiens
ttaacttttaatggt

SEQ ID NO: 951013 - DNA, 23 bp, Homo sapiens
ttaacttttataaactttacctt

SEQ ID NO: 951014 - DNA, 22 bp, Homo sapiens
ttaacttttccttgtatgttct

SEQ ID NO: 951015 - DNA, 18 bp, Homo sapiens
ttaactttttttcttcta

SEQ ID NO: 951016 - DNA, 22 bp, Homo sapiens
ttaactttttttcttctacttt

SEQ ID NO: 951017 - DNA, 22 bp, Homo sapiens
ttaagaaaacaagtatataatt

SEQ ID NO: 951018 - DNA, 14 bp, Homo sapiens
ttaagaaaatcata

SEQ ID NO: 951019 - DNA, 19 bp, Homo sapiens
ttaagaaaatttacaaaat

SEQ ID NO: 951020 - DNA, 12 bp, Homo sapiens
ttaagaaagaga

SEQ ID NO: 951021 - DNA, 23 bp, Homo sapiens
ttaagaaagagaatgaactgtgg

SEQ ID NO: 951022 - DNA, 24 bp, Homo sapiens
ttaagaaagagaatgaactgtgga

SEQ ID NO: 951023 - DNA, 20 bp, Homo sapiens
ttaagaaaggatataaaagg

SEQ ID NO: 951024 - DNA, 15 bp, Homo sapiens
ttaagaaatagaatt

SEQ ID NO: 951025 - DNA, 18 bp, Homo sapiens
ttaagaactgcttcatgt

SEQ ID NO: 951026 - DNA, 20 bp, Homo sapiens
ttaagaagccctgcagagca

SEQ ID NO: 951027 - DNA, 22 bp, Homo sapiens
ttaagaagccctgcagagcaca

SEQ ID NO: 951028 - DNA, 14 bp, Homo sapiens
ttaagaaggcaaaa

SEQ ID NO: 951029 - DNA, 22 bp, Homo sapiens
ttaagaatacacaggatatttt

SEQ ID NO: 951030 - DNA, 16 bp, Homo sapiens
ttaagaatatgtttcc

SEQ ID NO: 951031 - DNA, 20 bp, Homo sapiens
ttaagaatcttagataactt

SEQ ID NO: 951032 - DNA, 14 bp, Homo sapiens
ttaagaattgacca

SEQ ID NO: 951033 - DNA, 21 bp, Homo sapiens
ttaagaattgaccatctgctt

SEQ ID NO: 951034 - DNA, 15 bp, Homo sapiens
ttaagacactgtgag

SEQ ID NO: 951035 - DNA, 14 bp, Homo sapiens
ttaagacagtgtac

SEQ ID NO: 951036 - DNA, 15 bp, Homo sapiens
ttaagacagtgtaca

SEQ ID NO: 951037 - DNA, 16 bp, Homo sapiens
ttaagacgtgtttgtg

SEQ ID NO: 951038 - DNA, 17 bp, Homo sapiens
ttaagacgtgtttgtgt

SEQ ID NO: 951039 - DNA, 17 bp, Homo sapiens
ttaagactgtaatgtgt

SEQ ID NO: 951040 - DNA, 16 bp, Homo sapiens
ttaagacttaatgaga

SEQ ID NO: 951041 - DNA, 23 bp, Homo sapiens
ttaagagccatataagtttgaag

SEQ ID NO: 951042 - DNA, 21 bp, Homo sapiens
ttaagagcttgatctgtgatt

SEQ ID NO: 951043 - DNA, 20 bp, Homo sapiens
ttaagataacttactgtata

SEQ ID NO: 951044 - DNA, 14 bp, Homo sapiens
ttaagatacaaatt

SEQ ID NO: 951045 - DNA, 22 bp, Homo sapiens
ttaagatacagtgtaggcattt

SEQ ID NO: 951046 - DNA, 19 bp, Homo sapiens
ttaagatcctaaactctct

SEQ ID NO: 951047 - DNA, 20 bp, Homo sapiens
ttaagatcctaaactctcta

SEQ ID NO: 951048 - DNA, 19 bp, Homo sapiens
ttaagatcttggcttaatt

SEQ ID NO: 951049 - DNA, 14 bp, Homo sapiens
ttaagatggattct

SEQ ID NO: 951050 - DNA, 21 bp, Homo sapiens
ttaagatggattctcagatat

SEQ ID NO: 951051 - DNA, 23 bp, Homo sapiens
ttaagatggattctcagatattt

SEQ ID NO: 951052 - DNA, 13 bp, Homo sapiens
ttaagatggcaat

SEQ ID NO: 951053 - DNA, 17 bp, Homo sapiens
ttaagatgtacatttaa

SEQ ID NO: 951054 - DNA, 21 bp, Homo sapiens
ttaagatgtgtcttcaatttg

SEQ ID NO: 951055 - DNA, 15 bp, Homo sapiens
ttaagcaaattttgt

SEQ ID NO: 951056 - DNA, 14 bp, Homo sapiens
ttaagcaacatctt

SEQ ID NO: 951057 - DNA, 19 bp, Homo sapiens
ttaagcaacatctttttaa

SEQ ID NO: 951058 - DNA, 14 bp, Homo sapiens
ttaagcacacacat

SEQ ID NO: 951059 - DNA, 22 bp, Homo sapiens
ttaagcactacataaactgact

SEQ ID NO: 951060 - DNA, 12 bp, Homo sapiens
ttaagcactttg

SEQ ID NO: 951061 - DNA, 15 bp, Homo sapiens
ttaagcagaagcatt

SEQ ID NO: 951062 - DNA, 22 bp, Homo sapiens
ttaagcagcatggaaaaatggt

SEQ ID NO: 951063 - DNA, 22 bp, Homo sapiens
ttaagcagctaaattttctgaa

SEQ ID NO: 951064 - DNA, 16 bp, Homo sapiens
ttaagcaggtttgttt

SEQ ID NO: 951065 - DNA, 18 bp, Homo sapiens
ttaagcagtaaaaactgt

SEQ ID NO: 951066 - DNA, 22 bp, Homo sapiens
ttaagcatctggctctaattca

SEQ ID NO: 951067 - DNA, 22 bp, Homo sapiens
ttaagcattgtttgcttattgt

SEQ ID NO: 951068 - DNA, 14 bp, Homo sapiens
ttaagcatttattt

SEQ ID NO: 951069 - DNA, 16 bp, Homo sapiens
ttaagccaaagaaaca

SEQ ID NO: 951070 - DNA, 15 bp, Homo sapiens
ttaagccactgcctc

SEQ ID NO: 951071 - DNA, 19 bp, Homo sapiens
ttaagccactgcctctccc

SEQ ID NO: 951072 - DNA, 20 bp, Homo sapiens
ttaagccactgcctctccct

SEQ ID NO: 951073 - DNA, 23 bp, Homo sapiens
taaagcccgcctgacagaaacca

SEQ ID NO: 951074 - DNA, 18 bp, Homo sapiens
taaagcctgaatttggga

SEQ ID NO: 951075 - DNA, 21 bp, Homo sapiens
taaagcctggcttcttatcct

SEQ ID NO: 951076 - DNA, 20 bp, Homo sapiens
taaagccttaactaagactc

SEQ ID NO: 951077 - DNA, 20 bp, Homo sapiens
taaagcctttaaaaccagta

SEQ ID NO: 951078 - DNA, 19 bp, Homo sapiens
taaagccttttaaatcatc

SEQ ID NO: 951079 - DNA, 18 bp, Homo sapiens
taaagccttttgctttat

SEQ ID NO: 951080 - DNA, 16 bp, Homo sapiens
taaagctaaaaatatt

SEQ ID NO: 951081 - DNA, 23 bp, Homo sapiens
taaagctaaaataaagaaataga

SEQ ID NO: 951082 - DNA, 20 bp, Homo sapiens
taaagctaaaatgattttat

SEQ ID NO: 951083 - DNA, 23 bp, Homo sapiens
taaagctaaaatgattttatctg

SEQ ID NO: 951084 - DNA, 13 bp, Homo sapiens
taaagctaaactg

SEQ ID NO: 951085 - DNA, 14 bp, Homo sapiens
taaagctaaactga

SEQ ID NO: 951086 - DNA, 13 bp, Homo sapiens
taaagctaaattt

SEQ ID NO: 951087 - DNA, 17 bp, Homo sapiens
taaagctaccattttac

SEQ ID NO: 951088 - DNA, 19 bp, Homo sapiens
taaagctactgatttcctt

SEQ ID NO: 951089 - DNA, 19 bp, Homo sapiens
taaagctcaaatgaaatgt

SEQ ID NO: 951090 - DNA, 18 bp, Homo sapiens
taaagctgcctgtagtta

SEQ ID NO: 951091 - DNA, 16 bp, Homo sapiens
taaagcttaaactgaa

SEQ ID NO: 951092 - DNA, 13 bp, Homo sapiens
taaagcttaaatt

SEQ ID NO: 951093 - DNA, 22 bp, Homo sapiens
taaagcttactctgtccattta

SEQ ID NO: 951094 - DNA, 11 bp, Homo sapiens
taaagcttcag

SEQ ID NO: 951095 - DNA, 16 bp, Homo sapiens
taaagcttccgggaaa

SEQ ID NO: 951096 - DNA, 18 bp, Homo sapiens
taaagcttgatttgatct

SEQ ID NO: 951097 - DNA, 22 bp, Homo sapiens
taaagcttgatttgatctttgt

SEQ ID NO: 951098 - DNA, 19 bp, Homo sapiens
taaagcttgcaacaaaatt

SEQ ID NO: 951099 - DNA, 11 bp, Homo sapiens
taaagcttgtc

SEQ ID NO: 951100 - DNA, 23 bp, Homo sapiens
taaagcttgtggccccttttact

SEQ ID NO: 951101 - DNA, 17 bp, Homo sapiens
taaagctttatctttgt

SEQ ID NO: 951102 - DNA, 18 bp, Homo sapiens
taaagctttatctttgtg

SEQ ID NO: 951103 - DNA, 18 bp, Homo sapiens
taaaggaaataagagcag

SEQ ID NO: 951104 - DNA, 17 bp, Homo sapiens
taaaggaatgtgaaatt

SEQ ID NO: 951105 - DNA, 17 bp, Homo sapiens
taaaggagaaggcatga

SEQ ID NO: 951106 - DNA, 16 bp, Homo sapiens
taaaggatgtgattgt

SEQ ID NO: 951107 - DNA, 12 bp, Homo sapiens
taaaggcagctg

SEQ ID NO: 951108 - DNA, 19 bp, Homo sapiens
taaaggcagctgcctctgc

SEQ ID NO: 951109 - DNA, 14 bp, Homo sapiens
taaaggcagtccag

SEQ ID NO: 951110 - DNA, 18 bp, Homo sapiens
taaaggcagtccagagct

SEQ ID NO: 951111 - DNA, 14 bp, Homo sapiens
taaaggcagttttc

SEQ ID NO: 951112 - DNA, 17 bp, Homo sapiens
taaaggcagttttctaa

SEQ ID NO: 951113 - DNA, 17 bp, Homo sapiens
taaaggcatccttgtct

SEQ ID NO: 951114 - DNA, 14 bp, Homo sapiens
taaaggccacagga

SEQ ID NO: 951115 - DNA, 17 bp, Homo sapiens
taaaggccacaggagac

SEQ ID NO: 951116 - DNA, 20 bp, Homo sapiens
taaaggcctcatctccttta

SEQ ID NO: 951117 - DNA, 11 bp, Homo sapiens
taaaggcctgg

SEQ ID NO: 951118 - DNA, 19 bp, Homo sapiens
taaaggctacctttgtatt

SEQ ID NO: 951119 - DNA, 22 bp, Homo sapiens
taaaggctcgattttgtatctg

SEQ ID NO: 951120 - DNA, 21 bp, Homo sapiens
taaagggaattcgatgccccc

SEQ ID NO: 951121 - DNA, 16 bp, Homo sapiens
taaagggaccatctgc

SEQ ID NO: 951122 - DNA, 23 bp, Homo sapiens
taaagggaccatctgctgcagtt

SEQ ID NO: 951123 - DNA, 15 bp, Homo sapiens
taaagggagaaatgc

SEQ ID NO: 951124 - DNA, 15 bp, Homo sapiens
taaagggataaagaa

SEQ ID NO: 951125 - DNA, 18 bp, Homo sapiens
taaagggcccaatgaatt

SEQ ID NO: 951126 - DNA, 19 bp, Homo sapiens
taaagggcccaatgaatta

SEQ ID NO: 951127 - DNA, 20 bp, Homo sapiens
taaagggcccaatgaattat

SEQ ID NO: 951128 - DNA, 16 bp, Homo sapiens
taaagggcctgcctgg

SEQ ID NO: 951129 - DNA, 16 bp, Homo sapiens
taaaggggttccaaat

SEQ ID NO: 951130 - DNA, 16 bp, Homo sapiens
taaaggtaaaatcact

SEQ ID NO: 951131 - DNA, 14 bp, Homo sapiens
taaaggtacacatg

SEQ ID NO: 951132 - DNA, 23 bp, Homo sapiens
taaaggtacactggtatttatat

SEQ ID NO: 951133 - DNA, 15 bp, Homo sapiens
taaaggtcctgccct

SEQ ID NO: 951134 - DNA, 16 bp, Homo sapiens
taaaggttatgaaaca

SEQ ID NO: 951135 - DNA, 21 bp, Homo sapiens
taaaggtttttaaattgtttc

SEQ ID NO: 951136 - DNA, 13 bp, Homo sapiens
taaagtaaataca

SEQ ID NO: 951137 - DNA, 21 bp, Homo sapiens
taaagtacaaatgaagaaagt

SEQ ID NO: 951138 - DNA, 18 bp, Homo sapiens
taaagtagaagagggttt

SEQ ID NO: 951139 - DNA, 17 bp, Homo sapiens
taaagtatatatttatt

SEQ ID NO: 951140 - DNA, 16 bp, Homo sapiens
taaagtatcatgcatt

SEQ ID NO: 951141 - DNA, 14 bp, Homo sapiens
taaagtatgaatct

SEQ ID NO: 951142 - DNA, 19 bp, Homo sapiens
taaagtatgaatctatgcc

SEQ ID NO: 951143 - DNA, 22 bp, Homo sapiens
taaagtatgtaaacaggagaca

SEQ ID NO: 951144 - DNA, 21 bp, Homo sapiens
taaagtatgtaaagtatgtaa

SEQ ID NO: 951145 - DNA, 21 bp, Homo sapiens
taaagtatgtgagtagtctta

SEQ ID NO: 951146 - DNA, 13 bp, Homo sapiens
taaagtatgtttt

SEQ ID NO: 951147 - DNA, 15 bp, Homo sapiens
taaagtattccacct

SEQ ID NO: 951148 - DNA, 18 bp, Homo sapiens
taaagtattcttctcttc

SEQ ID NO: 951149 - DNA, 23 bp, Homo sapiens
taaagtattctttttctttttta

SEQ ID NO: 951150 - DNA, 13 bp, Homo sapiens
taaagtatttata

SEQ ID NO: 951151 - DNA, 20 bp, Homo sapiens
taaagtatttataaaaatat

SEQ ID NO: 951152 - DNA, 17 bp, Homo sapiens
taaagtcagatggaaaa

SEQ ID NO: 951153 - DNA, 18 bp, Homo sapiens
taaagtcaggtccaattt

SEQ ID NO: 951154 - DNA, 21 bp, Homo sapiens
taaagtcagttgctcaaaaag

SEQ ID NO: 951155 - DNA, 14 bp, Homo sapiens
taaagtctgaatca

SEQ ID NO: 951156 - DNA, 22 bp, Homo sapiens
taaagtctgttgattaaagatg

SEQ ID NO: 951157 - DNA, 13 bp, Homo sapiens
taaagtgaaggaa

SEQ ID NO: 951158 - DNA, 15 bp, Homo sapiens
taaagtgaaggaaat

SEQ ID NO: 951159 - DNA, 17 bp, Homo sapiens
taaagtgaaggaaataa

SEQ ID NO: 951160 - DNA, 21 bp, Homo sapiens
taaagtgaaggaaataaaggt

SEQ ID NO: 951161 - DNA, 17 bp, Homo sapiens
taaagtgagaaaactgt

SEQ ID NO: 951162 - DNA, 15 bp, Homo sapiens
taaagtgatctgtgt

SEQ ID NO: 951163 - DNA, 13 bp, Homo sapiens
taaagtgatgttt

SEQ ID NO: 951164 - DNA, 18 bp, Homo sapiens
taaagtgccagtatttta

SEQ ID NO: 951165 - DNA, 23 bp, Homo sapiens
taaagtgccagtattttaaaata

SEQ ID NO: 951166 - DNA, 17 bp, Homo sapiens
taaagtggcaatttctt

SEQ ID NO: 951167 - DNA, 13 bp, Homo sapiens
taaagtgttactt

SEQ ID NO: 951168 - DNA, 17 bp, Homo sapiens
taaagtgttactttttg

SEQ ID NO: 951169 - DNA, 16 bp, Homo sapiens
taaagtgttggtcttt

SEQ ID NO: 951170 - DNA, 19 bp, Homo sapiens
taaagtgttggtctttcta

SEQ ID NO: 951171 - DNA, 20 bp, Homo sapiens
taaagtgttggtctttctaa

SEQ ID NO: 951172 - DNA, 16 bp, Homo sapiens
taaagtgtttagctgt

SEQ ID NO: 951173 - DNA, 17 bp, Homo sapiens
taaagtgtttctgttat

SEQ ID NO: 951174 - DNA, 18 bp, Homo sapiens
taaagtgtttctgttatt

SEQ ID NO: 951175 - DNA, 14 bp, Homo sapiens
taaagttactactg

SEQ ID NO: 951176 - DNA, 17 bp, Homo sapiens
taaagttacttgaattt

SEQ ID NO: 951177 - DNA, 13 bp, Homo sapiens
taaagttatattt

SEQ ID NO: 951178 - DNA, 16 bp, Homo sapiens
taaagttatatttcag

SEQ ID NO: 951179 - DNA, 18 bp, Homo sapiens
taaagttgattttgaact

SEQ ID NO: 951180 - DNA, 17 bp, Homo sapiens
taaagttggtattaata

SEQ ID NO: 951181 - DNA, 16 bp, Homo sapiens
taaagttggttggata

SEQ ID NO: 951182 - DNA, 18 bp, Homo sapiens
taaagttggttggataag

SEQ ID NO: 951183 - DNA, 13 bp, Homo sapiens
taaagttgtaaat

SEQ ID NO: 951184 - DNA, 14 bp, Homo sapiens
taaagttgtaaata

SEQ ID NO: 951185 - DNA, 23 bp, Homo sapiens
taaagttgtaaataattttctaa

SEQ ID NO: 951186 - DNA, 17 bp, Homo sapiens
taaagttgtaacaaata

SEQ ID NO: 951187 - DNA, 21 bp, Homo sapiens
taaagttgttttatcttttaa

SEQ ID NO: 951188 - DNA, 22 bp, Homo sapiens
taaagttgttttatcttttaag

SEQ ID NO: 951189 - DNA, 20 bp, Homo sapiens
taaagtttggtattgtaaaa

SEQ ID NO: 951190 - DNA, 22 bp, Homo sapiens
taaagtttggtattgtaaaaca

SEQ ID NO: 951191 - DNA, 17 bp, Homo sapiens
taaagttttgcaacaat

SEQ ID NO: 951192 - DNA, 16 bp, Homo sapiens
taaataaaaagaaagg

SEQ ID NO: 951193 - DNA, 17 bp, Homo sapiens
taaataaaaagaaaggc

SEQ ID NO: 951194 - DNA, 23 bp, Homo sapiens
taaataaaaagtacaaagggcac

SEQ ID NO: 951195 - DNA, 15 bp, Homo sapiens
taaataaaaatatgt

SEQ ID NO: 951196 - DNA, 21 bp, Homo sapiens
taaataaaaatatgtaatttc

SEQ ID NO: 951197 - DNA, 16 bp, Homo sapiens
ttaagccagagtgtat

SEQ ID NO: 951198 - DNA, 20 bp, Homo sapiens
ttaagccctttgctctggag

SEQ ID NO: 951199 - DNA, 19 bp, Homo sapiens
ttaagcctaccgtatttca

SEQ ID NO: 951200 - DNA, 21 bp, Homo sapiens
ttaagcctcatatttaaagac

SEQ ID NO: 951201 - DNA, 13 bp, Homo sapiens
ttaagccttcatt

SEQ ID NO: 951202 - DNA, 14 bp, Homo sapiens
ttaagctacttatt

SEQ ID NO: 951203 - DNA, 21 bp, Homo sapiens
ttaagctgttcctgttcagta

SEQ ID NO: 951204 - DNA, 14 bp, Homo sapiens
ttaagcttctattt

SEQ ID NO: 951205 - DNA, 18 bp, Homo sapiens
ttaagctttattgtgatt

SEQ ID NO: 951206 - DNA, 14 bp, Homo sapiens
ttaagcttttattt

SEQ ID NO: 951207 - DNA, 12 bp, Homo sapiens
ttaaggaaacaa

SEQ ID NO: 951208 - DNA, 21 bp, Homo sapiens
ttaaggaagacaatgtgaaaa

SEQ ID NO: 951209 - DNA, 23 bp, Homo sapiens
ttaaggaatcaaatcttacaaaa

SEQ ID NO: 951210 - DNA, 14 bp, Homo sapiens
ttaaggaatttgat

SEQ ID NO: 951211 - DNA, 14 bp, Homo sapiens
ttaaggaattttgt

SEQ ID NO: 951212 - DNA, 17 bp, Homo sapiens
ttaaggacttctgcagc

SEQ ID NO: 951213 - DNA, 22 bp, Homo sapiens
ttaaggagcaaaaatctgagaa

SEQ ID NO: 951214 - DNA, 17 bp, Homo sapiens
ttaaggagggagaaagg

SEQ ID NO: 951215 - DNA, 17 bp, Homo sapiens
ttaatcaagttgaattg

SEQ ID NO: 951216 - DNA, 15 bp, Homo sapiens
ttaatcaccaaagta

SEQ ID NO: 951217 - DNA, 17 bp, Homo sapiens
ttaatcaccatgggaaa

SEQ ID NO: 951218 - DNA, 16 bp, Homo sapiens
ttaatcagacaaagta

SEQ ID NO: 951219 - DNA, 17 bp, Homo sapiens
ttaatcagatagatatt

SEQ ID NO: 951220 - DNA, 20 bp, Homo sapiens
ttaatcagcaatattgcctg

SEQ ID NO: 951221 - DNA, 20 bp, Homo sapiens
ttaatcaggtcctcagagaa

SEQ ID NO: 951222 - DNA, 15 bp, Homo sapiens
ttaatcatacaaact

SEQ ID NO: 951223 - DNA, 14 bp, Homo sapiens
ttaatcatagatta

SEQ ID NO: 951224 - DNA, 16 bp, Homo sapiens
ttaatcatagattatt

SEQ ID NO: 951225 - DNA, 21 bp, Homo sapiens
ttaatcatagattattataaa

SEQ ID NO: 951226 - DNA, 18 bp, Homo sapiens
ttaatcatctataaagaa

SEQ ID NO: 951227 - DNA, 13 bp, Homo sapiens
ttaatcattaggt

SEQ ID NO: 951228 - DNA, 23 bp, Homo sapiens
ttaatcattaggtgtgactgaat

SEQ ID NO: 951229 - DNA, 13 bp, Homo sapiens
ttaatcattttca

SEQ ID NO: 951230 - DNA, 19 bp, Homo sapiens
ttaatcattttcattccta

SEQ ID NO: 951231 - DNA, 17 bp, Homo sapiens
ttaatccacacatcagt

SEQ ID NO: 951232 - DNA, 18 bp, Homo sapiens
ttaatcccattgcaaaca

SEQ ID NO: 951233 - DNA, 15 bp, Homo sapiens
ttaatcctttaactc

SEQ ID NO: 951234 - DNA, 23 bp, Homo sapiens
ttaatcctttgttttctgactaa

SEQ ID NO: 951235 - DNA, 20 bp, Homo sapiens
ttaatctactttttgtattt

SEQ ID NO: 951236 - DNA, 20 bp, Homo sapiens
ttaatctagacaatatacaa

SEQ ID NO: 951237 - DNA, 20 bp, Homo sapiens
ttaatctgtaacccccaagg

SEQ ID NO: 951238 - DNA, 12 bp, Homo sapiens
ttaatctttaaa

SEQ ID NO: 951239 - DNA, 21 bp, Homo sapiens
ttaatctttctttacctgaga

SEQ ID NO: 951240 - DNA, 15 bp, Homo sapiens
ttaatgacattcccc

SEQ ID NO: 951241 - DNA, 12 bp, Homo sapiens
ttaatgagaaaa

SEQ ID NO: 951242 - DNA, 16 bp, Homo sapiens
ttaatgaggtctttaa

SEQ ID NO: 951243 - DNA, 17 bp, Homo sapiens
ttaatgaggtctttaaa

SEQ ID NO: 951244 - DNA, 19 bp, Homo sapiens
ttaatgatatactgatctt

SEQ ID NO: 951245 - DNA, 21 bp, Homo sapiens
ttaatgatatgcttgtaacta

SEQ ID NO: 951246 - DNA, 16 bp, Homo sapiens
ttaatgatggtgttaa

SEQ ID NO: 951247 - DNA, 13 bp, Homo sapiens
ttaatgcactttc

SEQ ID NO: 951248 - DNA, 14 bp, Homo sapiens
ttaatgcactttct

SEQ ID NO: 951249 - DNA, 20 bp, Homo sapiens
ttaatgcattaaacctgtct

SEQ ID NO: 951250 - DNA, 23 bp, Homo sapiens
ttaatgcccagccagccacccct

SEQ ID NO: 951251 - DNA, 23 bp, Homo sapiens
ttaatgccgatatactctagatg

SEQ ID NO: 951252 - DNA, 16 bp, Homo sapiens
ttaatgcctgcttttt

SEQ ID NO: 951253 - DNA, 19 bp, Homo sapiens
ttaatgcctgctttttgga

SEQ ID NO: 951254 - DNA, 14 bp, Homo sapiens
ttaatgctatttga

SEQ ID NO: 951255 - DNA, 20 bp, Homo sapiens
ttaatgctatttgaacaagt

SEQ ID NO: 951256 - DNA, 16 bp, Homo sapiens
ttaatgctgccttttc

SEQ ID NO: 951257 - DNA, 13 bp, Homo sapiens
ttaatgctgtctt

SEQ ID NO: 951258 - DNA, 15 bp, Homo sapiens
ttaatgctgtttcta

SEQ ID NO: 951259 - DNA, 19 bp, Homo sapiens
ttaatgctgtttctaagaa

SEQ ID NO: 951260 - DNA, 18 bp, Homo sapiens
ttaatgcttttatatttt

SEQ ID NO: 951261 - DNA, 14 bp, Homo sapiens
ttaatggactgtga

SEQ ID NO: 951262 - DNA, 16 bp, Homo sapiens
ttaatggactgtgaat

SEQ ID NO: 951263 - DNA, 13 bp, Homo sapiens
ttaatggatattt

SEQ ID NO: 951264 - DNA, 23 bp, Homo sapiens
ttaatggcaaggcagccctgtct

SEQ ID NO: 951265 - DNA, 22 bp, Homo sapiens
ttaatggccggctggaaatgct

SEQ ID NO: 951266 - DNA, 17 bp, Homo sapiens
ttaatggcttccctctt

SEQ ID NO: 951267 - DNA, 16 bp, Homo sapiens
ttaatggggtctgtaa

SEQ ID NO: 951268 - DNA, 18 bp, Homo sapiens
ttaatggggtctgtaaat

SEQ ID NO: 951269 - DNA, 14 bp, Homo sapiens
ttaatggtagcatt

SEQ ID NO: 951270 - DNA, 19 bp, Homo sapiens
ttaatggtagcattcttct

SEQ ID NO: 951271 - DNA, 22 bp, Homo sapiens
ttaatggtatcctactgagcat

SEQ ID NO: 951272 - DNA, 23 bp, Homo sapiens
ttaatggtatcctactgagcatt

SEQ ID NO: 951273 - DNA, 20 bp, Homo sapiens
ttaatggttaagaactgtga

SEQ ID NO: 951274 - DNA, 19 bp, Homo sapiens
ttaatgtacaagttttgta

SEQ ID NO: 951275 - DNA, 11 bp, Homo sapiens
ttaatgtagta

SEQ ID NO: 951276 - DNA, 14 bp, Homo sapiens
ttaatgtatatttg

SEQ ID NO: 951277 - DNA, 15 bp, Homo sapiens
ttaatgtatctattt

SEQ ID NO: 951278 - DNA, 18 bp, Homo sapiens
ttaatgtatctatttgta

SEQ ID NO: 951279 - DNA, 20 bp, Homo sapiens
ttaatgtatctatttgtaca

SEQ ID NO: 951280 - DNA, 21 bp, Homo sapiens
ttaatgtatctatttgtacaa

SEQ ID NO: 951281 - DNA, 23 bp, Homo sapiens
ttaatgtatctatttgtacaatt

SEQ ID NO: 951282 - DNA, 13 bp, Homo sapiens
ttaatgtatgtta

SEQ ID NO: 951283 - DNA, 15 bp, Homo sapiens
ttaatgtatgttacc

SEQ ID NO: 951284 - DNA, 21 bp, Homo sapiens
ttaatgtattaatctgtttgt

SEQ ID NO: 951285 - DNA, 12 bp, Homo sapiens
ttaatgtattcc

SEQ ID NO: 951286 - DNA, 12 bp, Homo sapiens
ttaatgtgaatt

SEQ ID NO: 951287 - DNA, 15 bp, Homo sapiens
ttaatgtgaattttt

SEQ ID NO: 951288 - DNA, 16 bp, Homo sapiens
ttaatgtgaatttttg

SEQ ID NO: 951289 - DNA, 13 bp, Homo sapiens
ttaatgtgagttt

SEQ ID NO: 951290 - DNA, 23 bp, Homo sapiens
ttaatgtgatggatggcacaatg

SEQ ID NO: 951291 - DNA, 16 bp, Homo sapiens
ttaatgttatgaggac

SEQ ID NO: 951292 - DNA, 11 bp, Homo sapiens
ttaatgtttct

SEQ ID NO: 951293 - DNA, 10 bp, Homo sapiens
ttaatgtttt

SEQ ID NO: 951294 - DNA, 17 bp, Homo sapiens
ttaattaaatgtattta

SEQ ID NO: 951295 - DNA, 22 bp, Homo sapiens
ttaattaaccccataattagat

SEQ ID NO: 951296 - DNA, 16 bp, Homo sapiens
ttaattaagactgaaa

SEQ ID NO: 951297 - DNA, 16 bp, Homo sapiens
ttaattacatacagat

SEQ ID NO: 951298 - DNA, 17 bp, Homo sapiens
ttaattacatacagatt

SEQ ID NO: 951299 - DNA, 16 bp, Homo sapiens
ttaattaccaacctgt

SEQ ID NO: 951300 - DNA, 21 bp, Homo sapiens
ttaattattatttgtgtttta

SEQ ID NO: 951301 - DNA, 17 bp, Homo sapiens
ttaattcacctatgtta

SEQ ID NO: 951302 - DNA, 19 bp, Homo sapiens
ttaattcacctatgttatt

SEQ ID NO: 951303 - DNA, 22 bp, Homo sapiens
ttaattcagatgttttacgcaa

SEQ ID NO: 951304 - DNA, 23 bp, Homo sapiens
ttaattcaggtatgtaaaagact

SEQ ID NO: 951305 - DNA, 19 bp, Homo sapiens
ttaattccaatatgatgac

SEQ ID NO: 951306 - DNA, 18 bp, Homo sapiens
ttaattccatgtcagata

SEQ ID NO: 951307 - DNA, 13 bp, Homo sapiens
ttaattctcattt

SEQ ID NO: 951308 - DNA, 18 bp, Homo sapiens
ttaattctccttcccaga

SEQ ID NO: 951309 - DNA, 19 bp, Homo sapiens
ttaattcttcacctttgta

SEQ ID NO: 951310 - DNA, 17 bp, Homo sapiens
ttaattctttgttctgt

SEQ ID NO: 951311 - DNA, 13 bp, Homo sapiens
ttaattgaaaaga

SEQ ID NO: 951312 - DNA, 23 bp, Homo sapiens
ttaattgaaaagaagtagtgtct

SEQ ID NO: 951313 - DNA, 19 bp, Homo sapiens
ttaattgcctgttaaatat

SEQ ID NO: 951314 - DNA, 12 bp, Homo sapiens
ttaattgctttg

SEQ ID NO: 951315 - DNA, 22 bp, Homo sapiens
ttaattgggccagcttttcaaa

SEQ ID NO: 951316 - DNA, 14 bp, Homo sapiens
ttaattgtaatctg

SEQ ID NO: 951317 - DNA, 22 bp, Homo sapiens
ttaattgtagttctgtgtactt

SEQ ID NO: 951318 - DNA, 15 bp, Homo sapiens
ttaattgttcatttt

SEQ ID NO: 951319 - DNA, 16 bp, Homo sapiens
ttaatttaaagcttac

SEQ ID NO: 951320 - DNA, 21 bp, Homo sapiens
ttaatttaaagcttactctgt

SEQ ID NO: 951321 - DNA, 18 bp, Homo sapiens
ttaatttagtaaatgtta

SEQ ID NO: 951322 - DNA, 16 bp, Homo sapiens
ttaatttataatgtat

SEQ ID NO: 951323 - DNA, 21 bp, Homo sapiens
ttaatttataatgtatttgaa

SEQ ID NO: 951324 - DNA, 20 bp, Homo sapiens
ttaatttatgagtttttgat

SEQ ID NO: 951325 - DNA, 14 bp, Homo sapiens
ttaatttatttcat

SEQ ID NO: 951326 - DNA, 21 bp, Homo sapiens
ttaatttattttgctccctct

SEQ ID NO: 951327 - DNA, 13 bp, Homo sapiens
taaatcttaaaca

SEQ ID NO: 951328 - DNA, 16 bp, Homo sapiens
taaatcttaaacaatg

SEQ ID NO: 951329 - DNA, 17 bp, Homo sapiens
taaatcttaaacaatgt

SEQ ID NO: 951330 - DNA, 14 bp, Homo sapiens
taaatcttttacaa

SEQ ID NO: 951331 - DNA, 23 bp, Homo sapiens
taaatcttttataggatttattt

SEQ ID NO: 951332 - DNA, 24 bp, Homo sapiens
taaatctttttgcttctactttca

SEQ ID NO: 951333 - DNA, 15 bp, Homo sapiens
taaatgaaaaacaca

SEQ ID NO: 951334 - DNA, 14 bp, Homo sapiens
taaatgaaattgta

SEQ ID NO: 951335 - DNA, 16 bp, Homo sapiens
taaatgaaattgtaaa

SEQ ID NO: 951336 - DNA, 23 bp, Homo sapiens
taaatgaagcagctttaaacaaa

SEQ ID NO: 951337 - DNA, 18 bp, Homo sapiens
ttaatttgatgaaagctg

SEQ ID NO: 951338 - DNA, 14 bp, Homo sapiens
ttaatttgtaaact

SEQ ID NO: 951339 - DNA, 16 bp, Homo sapiens
ttaatttgtgaatttg

SEQ ID NO: 951340 - DNA, 17 bp, Homo sapiens
ttaattttactccataa

SEQ ID NO: 951341 - DNA, 19 bp, Homo sapiens
ttaattttctctttgtatg

SEQ ID NO: 951342 - DNA, 17 bp, Homo sapiens
ttaattttctttatgga

SEQ ID NO: 951343 - DNA, 20 bp, Homo sapiens
ttaattttgaagtgctgttt

SEQ ID NO: 951344 - DNA, 20 bp, Homo sapiens
ttaattttgacactgaaata

SEQ ID NO: 951345 - DNA, 18 bp, Homo sapiens
ttaattttgtgcattctt

SEQ ID NO: 951346 - DNA, 14 bp, Homo sapiens
ttaatttttaagag

SEQ ID NO: 951347 - DNA, 19 bp, Homo sapiens
ttaatttttacatggagaa

SEQ ID NO: 951348 - DNA, 13 bp, Homo sapiens
ttaatttttccaa

SEQ ID NO: 951349 - DNA, 15 bp, Homo sapiens
ttaatttttccaact

SEQ ID NO: 951350 - DNA, 13 bp, Homo sapiens
ttaatttttccta

SEQ ID NO: 951351 - DNA, 18 bp, Homo sapiens
ttaattttttctctttgt

SEQ ID NO: 951352 - DNA, 17 bp, Homo sapiens
ttaattttttggtacaa

SEQ ID NO: 951353 - DNA, 20 bp, Homo sapiens
ttaatttttttaaatttcag

SEQ ID NO: 951354 - DNA, 18 bp, Homo sapiens
ttaatttttttaaccaaa

SEQ ID NO: 951355 - DNA, 23 bp, Homo sapiens
ttaatttttttaaccaaaggtga

SEQ ID NO: 951356 - DNA, 14 bp, Homo sapiens
ttacaaaaacactt

SEQ ID NO: 951357 - DNA, 18 bp, Homo sapiens
ttacaaaaatataaaata

SEQ ID NO: 951358 - DNA, 17 bp, Homo sapiens
ttacaaaactacatgag

SEQ ID NO: 951359 - DNA, 18 bp, Homo sapiens
ttacaaaactacatgaga

SEQ ID NO: 951360 - DNA, 20 bp, Homo sapiens
ttacaaaactacatgagaac

SEQ ID NO: 951361 - DNA, 14 bp, Homo sapiens
ttacaaaactgctt

SEQ ID NO: 951362 - DNA, 15 bp, Homo sapiens
ttacaaaactgcttt

SEQ ID NO: 951363 - DNA, 21 bp, Homo sapiens
ttacaaaactgctttgtgcat

SEQ ID NO: 951364 - DNA, 13 bp, Homo sapiens
ttacaaaagatgt

SEQ ID NO: 951365 - DNA, 18 bp, Homo sapiens
ttacaaaagatgtatcct

SEQ ID NO: 951366 - DNA, 21 bp, Homo sapiens
ttacaaaatcctggaagattt

SEQ ID NO: 951367 - DNA, 15 bp, Homo sapiens
ttacaaaatgccaag

SEQ ID NO: 951368 - DNA, 17 bp, Homo sapiens
ttacaaaatttattctc

SEQ ID NO: 951369 - DNA, 16 bp, Homo sapiens
ttacaaactgaagagt

SEQ ID NO: 951370 - DNA, 12 bp, Homo sapiens
ttacaaactgca

SEQ ID NO: 951371 - DNA, 14 bp, Homo sapiens
ttacaaactgcaat

SEQ ID NO: 951372 - DNA, 22 bp, Homo sapiens
ttacaaactgcaatagagactg

SEQ ID NO: 951373 - DNA, 23 bp, Homo sapiens
ttacaaactgcaatagagactgt

SEQ ID NO: 951374 - DNA, 16 bp, Homo sapiens
ttacaaagcagttact

SEQ ID NO: 951375 - DNA, 18 bp, Homo sapiens
ttacaaagcccttttata

SEQ ID NO: 951376 - DNA, 17 bp, Homo sapiens
ttacaaagtgtgtatta

SEQ ID NO: 951377 - DNA, 18 bp, Homo sapiens
ttacaaagtgtgtattaa

SEQ ID NO: 951378 - DNA, 22 bp, Homo sapiens
ttacaaataaaattggcaccat

SEQ ID NO: 951379 - DNA, 16 bp, Homo sapiens
ttacaaatcagaactt

SEQ ID NO: 951380 - DNA, 22 bp, Homo sapiens
ttacaaattttcactgctgctc

SEQ ID NO: 951381 - DNA, 19 bp, Homo sapiens
ttacaacataatctagttt

SEQ ID NO: 951382 - DNA, 20 bp, Homo sapiens
ttacaacgccgagtgcactg

SEQ ID NO: 951383 - DNA, 15 bp, Homo sapiens
ttacaactaaataac

SEQ ID NO: 951384 - DNA, 23 bp, Homo sapiens
ttacaactgcctcgaaacacaga

SEQ ID NO: 951385 - DNA, 20 bp, Homo sapiens
ttacaacttgattttttcaa

SEQ ID NO: 951386 - DNA, 17 bp, Homo sapiens
ttacaactttctaagag

SEQ ID NO: 951387 - DNA, 21 bp, Homo sapiens
ttacaagaagtttattctcat

SEQ ID NO: 951388 - DNA, 19 bp, Homo sapiens
ttacaagcccccccttcca

SEQ ID NO: 951389 - DNA, 21 bp, Homo sapiens
ttacaagcttaaagcttgatt

SEQ ID NO: 951390 - DNA, 20 bp, Homo sapiens
ttacaagtaacaaaaataaa

SEQ ID NO: 951391 - DNA, 18 bp, Homo sapiens
ttacaagtggtgaccaaa

SEQ ID NO: 951392 - DNA, 23 bp, Homo sapiens
ttacaagtggtgaccaaaatttt

SEQ ID NO: 951393 - DNA, 13 bp, Homo sapiens
ttacaataaatat

SEQ ID NO: 951394 - DNA, 17 bp, Homo sapiens
ttacaatcattgctgaa

SEQ ID NO: 951395 - DNA, 23 bp, Homo sapiens
ttacaatcattgctgaaaatggt

SEQ ID NO: 951396 - DNA, 14 bp, Homo sapiens
ttacaatctgtatc

SEQ ID NO: 951397 - DNA, 21 bp, Homo sapiens
ttacaatgatgccgaacatta

SEQ ID NO: 951398 - DNA, 23 bp, Homo sapiens
ttacaatgtaaaccacatgaact

SEQ ID NO: 951399 - DNA, 15 bp, Homo sapiens
ttacaatgtatcttt

SEQ ID NO: 951400 - DNA, 19 bp, Homo sapiens
ttacaattccctgctgtcg

SEQ ID NO: 951401 - DNA, 13 bp, Homo sapiens
ttacaatttacaa

SEQ ID NO: 951402 - DNA, 11 bp, Homo sapiens
ttacaatttgc

SEQ ID NO: 951403 - DNA, 23 bp, Homo sapiens
ttacaatttgcacaatatttctt

SEQ ID NO: 951404 - DNA, 19 bp, Homo sapiens
ttacaatttttaataaatt

SEQ ID NO: 951405 - DNA, 21 bp, Homo sapiens
ttacaatttttaataaattga

SEQ ID NO: 951406 - DNA, 15 bp, Homo sapiens
ttacacaataaagca

SEQ ID NO: 951407 - DNA, 18 bp, Homo sapiens
ttacacaatggtttttaa

SEQ ID NO: 951408 - DNA, 20 bp, Homo sapiens
ttacacaatggtttttaaat

SEQ ID NO: 951409 - DNA, 15 bp, Homo sapiens
ttacacagcccaaga

SEQ ID NO: 951410 - DNA, 18 bp, Homo sapiens
ttacacatctcagaccct

SEQ ID NO: 951411 - DNA, 17 bp, Homo sapiens
ttacacatcttcaacag

SEQ ID NO: 951412 - DNA, 17 bp, Homo sapiens
ttacacatttttcagat

SEQ ID NO: 951413 - DNA, 20 bp, Homo sapiens
ttacaccctttcttgacaaa

SEQ ID NO: 951414 - DNA, 23 bp, Homo sapiens
ttacacgtggaggaatgctcccc

SEQ ID NO: 951415 - DNA, 18 bp, Homo sapiens
ttacactaatatatggac

SEQ ID NO: 951416 - DNA, 22 bp, Homo sapiens
ttacactctgtattgaaaatgg

SEQ ID NO: 951417 - DNA, 13 bp, Homo sapiens
ttacactgaggac

SEQ ID NO: 951418 - DNA, 12 bp, Homo sapiens
ttacactggtct

SEQ ID NO: 951419 - DNA, 14 bp, Homo sapiens
ttacactgtatttg

SEQ ID NO: 951420 - DNA, 17 bp, Homo sapiens
ttacactgtatttgtat

SEQ ID NO: 951421 - DNA, 14 bp, Homo sapiens
ttacactgtgcctt

SEQ ID NO: 951422 - DNA, 21 bp, Homo sapiens
ttacactgtgccttttcccca

SEQ ID NO: 951423 - DNA, 15 bp, Homo sapiens
ttacacttggagccc

SEQ ID NO: 951424 - DNA, 20 bp, Homo sapiens
ttacactttatgcacaaaat

SEQ ID NO: 951425 - DNA, 15 bp, Homo sapiens
ttacagaaatggact

SEQ ID NO: 951426 - DNA, 17 bp, Homo sapiens
ttacagagaggagaaac

SEQ ID NO: 951427 - DNA, 22 bp, Homo sapiens
ttacagagaggagaaacacatc

SEQ ID NO: 951428 - DNA, 16 bp, Homo sapiens
ttacagaggaagttat

SEQ ID NO: 951429 - DNA, 19 bp, Homo sapiens
ttacagatccagaatttat

SEQ ID NO: 951430 - DNA, 20 bp, Homo sapiens
ttacagatgaatgtatttat

SEQ ID NO: 951431 - DNA, 17 bp, Homo sapiens
ttacagattgcctcctt

SEQ ID NO: 951432 - DNA, 20 bp, Homo sapiens
ttacagcaagtagataaata

SEQ ID NO: 951433 - DNA, 21 bp, Homo sapiens
ttacagcattgtctttgctgt

SEQ ID NO: 951434 - DNA, 14 bp, Homo sapiens
ttacagcctctgac

SEQ ID NO: 951435 - DNA, 19 bp, Homo sapiens
ttacagctcattaaacttt

SEQ ID NO: 951436 - DNA, 22 bp, Homo sapiens
ttacaggaaaaaaaattctgtt

SEQ ID NO: 951437 - DNA, 15 bp, Homo sapiens
ttacaggcaccgaga

SEQ ID NO: 951438 - DNA, 24 bp, Homo sapiens
ttacaggcaccgagaatgttgtat

SEQ ID NO: 951439 - DNA, 19 bp, Homo sapiens
ttacaggcatgtgccacca

SEQ ID NO: 951440 - DNA, 11 bp, Homo sapiens
ttacagggtat

SEQ ID NO: 951441 - DNA, 15 bp, Homo sapiens
ttacagggtgactca

SEQ ID NO: 951442 - DNA, 18 bp, Homo sapiens
ttacaggtggacacacaa

SEQ ID NO: 951443 - DNA, 21 bp, Homo sapiens
ttacagtaaagtatagaaata

SEQ ID NO: 951444 - DNA, 19 bp, Homo sapiens
ttacagtaggagcccagct

SEQ ID NO: 951445 - DNA, 18 bp, Homo sapiens
ttacagtgcagacaggcc

SEQ ID NO: 951446 - DNA, 17 bp, Homo sapiens
ttacagtgtagcttgcc

SEQ ID NO: 951447 - DNA, 22 bp, Homo sapiens
ttacagttctgtggtttcatgt

SEQ ID NO: 951448 - DNA, 16 bp, Homo sapiens
ttacagttctttcctc

SEQ ID NO: 951449 - DNA, 19 bp, Homo sapiens
ttacagttctttcctcttt

SEQ ID NO: 951450 - DNA, 13 bp, Homo sapiens
ttacagttgatgt

SEQ ID NO: 951451 - DNA, 20 bp, Homo sapiens
ttacagtttatattgtggaa

SEQ ID NO: 951452 - DNA, 20 bp, Homo sapiens
ttacataaagctcccttgaa

SEQ ID NO: 951453 - DNA, 16 bp, Homo sapiens
taaattgatgttgctg

SEQ ID NO: 951454 - DNA, 13 bp, Homo sapiens
taaattgattttt

SEQ ID NO: 951455 - DNA, 17 bp, Homo sapiens
taaattgcaacatatta

SEQ ID NO: 951456 - DNA, 13 bp, Homo sapiens
taaattgcacaga

SEQ ID NO: 951457 - DNA, 22 bp, Homo sapiens
taaattgcacagagcacactta

SEQ ID NO: 951458 - DNA, 21 bp, Homo sapiens
ttacataatctgtacaatgaa

SEQ ID NO: 951459 - DNA, 21 bp, Homo sapiens
ttacataatttagttgtttct

SEQ ID NO: 951460 - DNA, 22 bp, Homo sapiens
ttacataatttagttgtttcta

SEQ ID NO: 951461 - DNA, 22 bp, Homo sapiens
ttacatagatcagccattaaaa

SEQ ID NO: 951462 - DNA, 16 bp, Homo sapiens
ttacataggtatatat

SEQ ID NO: 951463 - DNA, 18 bp, Homo sapiens
ttacatagtctgaagtga

SEQ ID NO: 951464 - DNA, 22 bp, Homo sapiens
ttacatagtgcaaaactgtgtc

SEQ ID NO: 951465 - DNA, 22 bp, Homo sapiens
ttacatatcacctcatggccta

SEQ ID NO: 951466 - DNA, 12 bp, Homo sapiens
ttacatcacttt

SEQ ID NO: 951467 - DNA, 13 bp, Homo sapiens
ttacatccttaaa

SEQ ID NO: 951468 - DNA, 13 bp, Homo sapiens
ttacatctaagaa

SEQ ID NO: 951469 - DNA, 16 bp, Homo sapiens
ttacatctaagaattt

SEQ ID NO: 951470 - DNA, 13 bp, Homo sapiens
ttacatctaatgc

SEQ ID NO: 951471 - DNA, 15 bp, Homo sapiens
ttacatcttctgtga

SEQ ID NO: 951472 - DNA, 13 bp, Homo sapiens
ttacatcttttct

SEQ ID NO: 951473 - DNA, 18 bp, Homo sapiens
ttacatcttttctaatca

SEQ ID NO: 951474 - DNA, 22 bp, Homo sapiens
ttacatgcaatttattaaaatg

SEQ ID NO: 951475 - DNA, 19 bp, Homo sapiens
ttacatgctgtgctctttg

SEQ ID NO: 951476 - DNA, 16 bp, Homo sapiens
ttacatgtaatttgat

SEQ ID NO: 951477 - DNA, 20 bp, Homo sapiens
ttacatgtaatttgatgagg

SEQ ID NO: 951478 - DNA, 15 bp, Homo sapiens
ttacatgtatgcctg

SEQ ID NO: 951479 - DNA, 13 bp, Homo sapiens
ttacatgtttgca

SEQ ID NO: 951480 - DNA, 16 bp, Homo sapiens
ttacatgttttaaaga

SEQ ID NO: 951481 - DNA, 18 bp, Homo sapiens
ttacatgttttctttgct

SEQ ID NO: 951482 - DNA, 22 bp, Homo sapiens
ttacatgttttctttgctttaa

SEQ ID NO: 951483 - DNA, 17 bp, Homo sapiens
ttacattaatgcccagc

SEQ ID NO: 951484 - DNA, 19 bp, Homo sapiens
ttacattaatgcccagcca

SEQ ID NO: 951485 - DNA, 14 bp, Homo sapiens
ttacattatgcaaa

SEQ ID NO: 951486 - DNA, 16 bp, Homo sapiens
ttacattatgcaaata

SEQ ID NO: 951487 - DNA, 15 bp, Homo sapiens
ttacattattaaacg

SEQ ID NO: 951488 - DNA, 12 bp, Homo sapiens
ttacattattcc

SEQ ID NO: 951489 - DNA, 17 bp, Homo sapiens
ttacattgtttgtctgt

SEQ ID NO: 951490 - DNA, 18 bp, Homo sapiens
ttacatttacaaactgaa

SEQ ID NO: 951491 - DNA, 15 bp, Homo sapiens
ttacatttatacatc

SEQ ID NO: 951492 - DNA, 18 bp, Homo sapiens
ttacatttcagacatatc

SEQ ID NO: 951493 - DNA, 20 bp, Homo sapiens
ttacatttgatgcatgtctt

SEQ ID NO: 951494 - DNA, 12 bp, Homo sapiens
ttacattttata

SEQ ID NO: 951495 - DNA, 12 bp, Homo sapiens
ttacattttcag

SEQ ID NO: 951496 - DNA, 22 bp, Homo sapiens
ttacatttttaagtgctgcatt

SEQ ID NO: 951497 - DNA, 14 bp, Homo sapiens
ttacatttttacaa

SEQ ID NO: 951498 - DNA, 16 bp, Homo sapiens
ttacatttttacaata

SEQ ID NO: 951499 - DNA, 17 bp, Homo sapiens
ttacatttttacaataa

SEQ ID NO: 951500 - DNA, 18 bp, Homo sapiens
ttacatttttacaataaa

SEQ ID NO: 951501 - DNA, 21 bp, Homo sapiens
ttacatttttacaataaataa

SEQ ID NO: 951502 - DNA, 12 bp, Homo sapiens
ttaccaaaaatt

SEQ ID NO: 951503 - DNA, 20 bp, Homo sapiens
ttaccaaaaccatccatccc

SEQ ID NO: 951504 - DNA, 23 bp, Homo sapiens
ttaccaaaattcactaatcttga

SEQ ID NO: 951505 - DNA, 10 bp, Homo sapiens
ttaccaaagc

SEQ ID NO: 951506 - DNA, 16 bp, Homo sapiens
ttaccaaagtgtcttt

SEQ ID NO: 951507 - DNA, 14 bp, Homo sapiens
ttaccaactttctg

SEQ ID NO: 951508 - DNA, 23 bp, Homo sapiens
ttaccaaggatgaattctttcaa

SEQ ID NO: 951509 - DNA, 11 bp, Homo sapiens
ttaccaataaa

SEQ ID NO: 951510 - DNA, 14 bp, Homo sapiens
ttaccaataaactg

SEQ ID NO: 951511 - DNA, 17 bp, Homo sapiens
ttaccacagacatacta

SEQ ID NO: 951512 - DNA, 17 bp, Homo sapiens
ttaccaccctttcacaa

SEQ ID NO: 951513 - DNA, 22 bp, Homo sapiens
ttaccagagcctctttgctgga

SEQ ID NO: 951514 - DNA, 20 bp, Homo sapiens
ttaccagatgctactggact

SEQ ID NO: 951515 - DNA, 12 bp, Homo sapiens
ttaccagcaaga

SEQ ID NO: 951516 - DNA, 14 bp, Homo sapiens
ttaccagcatttgt

SEQ ID NO: 951517 - DNA, 18 bp, Homo sapiens
ttaccagcatttgtcctt

SEQ ID NO: 951518 - DNA, 21 bp, Homo sapiens
ttaccagtctttaaaggccca

SEQ ID NO: 951519 - DNA, 23 bp, Homo sapiens
ttaccagtctttaaaggcccagc

SEQ ID NO: 951520 - DNA, 23 bp, Homo sapiens
ttaccagtggcgttgttgcatgt

SEQ ID NO: 951521 - DNA, 15 bp, Homo sapiens
ttaccatatgtgctt

SEQ ID NO: 951522 - DNA, 20 bp, Homo sapiens
ttaccatgagaagagggcct

SEQ ID NO: 951523 - DNA, 21 bp, Homo sapiens
ttaccatgagtgaatttatat

SEQ ID NO: 951524 - DNA, 14 bp, Homo sapiens
ttaccattaacatt

SEQ ID NO: 951525 - DNA, 14 bp, Homo sapiens
ttaccatttacatg

SEQ ID NO: 951526 - DNA, 15 bp, Homo sapiens
ttaccatttgtaata

SEQ ID NO: 951527 - DNA, 11 bp, Homo sapiens
ttacccaaagc

SEQ ID NO: 951528 - DNA, 14 bp, Homo sapiens
ttacccaaagcaca

SEQ ID NO: 951529 - DNA, 15 bp, Homo sapiens
ttacccaaagcacat

SEQ ID NO: 951530 - DNA, 15 bp, Homo sapiens
ttacccacctagaac

SEQ ID NO: 951531 - DNA, 22 bp, Homo sapiens
ttacccacctagaacactaact

SEQ ID NO: 951532 - DNA, 11 bp, Homo sapiens
ttaccccatac

SEQ ID NO: 951533 - DNA, 17 bp, Homo sapiens
ttacccctgcacagttt

SEQ ID NO: 951534 - DNA, 19 bp, Homo sapiens
ttaccctcatgttcttaat

SEQ ID NO: 951535 - DNA, 18 bp, Homo sapiens
ttaccctcctagctttcc

SEQ ID NO: 951536 - DNA, 15 bp, Homo sapiens
ttaccctcctctgct

SEQ ID NO: 951537 - DNA, 18 bp, Homo sapiens
ttaccctcctctgctggg

SEQ ID NO: 951538 - DNA, 17 bp, Homo sapiens
ttaccctgtgtcagagc

SEQ ID NO: 951539 - DNA, 21 bp, Homo sapiens
ttacccttcacctttggtgca

SEQ ID NO: 951540 - DNA, 13 bp, Homo sapiens
ttacccttccctg

SEQ ID NO: 951541 - DNA, 16 bp, Homo sapiens
ttaccgcgttgtaaaa

SEQ ID NO: 951542 - DNA, 18 bp, Homo sapiens
ttaccgcgttgtaaaata

SEQ ID NO: 951543 - DNA, 21 bp, Homo sapiens
ttaccgcgttgtaaaatatag

SEQ ID NO: 951544 - DNA, 22 bp, Homo sapiens
ttaccggttgtttagaaacaga

SEQ ID NO: 951545 - DNA, 15 bp, Homo sapiens
ttaccgtagcctccg

SEQ ID NO: 951546 - DNA, 21 bp, Homo sapiens
ttaccgtgagtgacatagcct

SEQ ID NO: 951547 - DNA, 20 bp, Homo sapiens
ttacctaaacagatataaat

SEQ ID NO: 951548 - DNA, 21 bp, Homo sapiens
ttacctaaacagatataaatg

SEQ ID NO: 951549 - DNA, 16 bp, Homo sapiens
ttacctaccacagtgt

SEQ ID NO: 951550 - DNA, 17 bp, Homo sapiens
ttacctaccacagtgtc

SEQ ID NO: 951551 - DNA, 22 bp, Homo sapiens
ttacctaccttactatttaaag

SEQ ID NO: 951552 - DNA, 21 bp, Homo sapiens
ttacctagctaattatttaat

SEQ ID NO: 951553 - DNA, 15 bp, Homo sapiens
ttacctagctgtgcc

SEQ ID NO: 951554 - DNA, 19 bp, Homo sapiens
ttacctagtgaaacttttc

SEQ ID NO: 951555 - DNA, 19 bp, Homo sapiens
ttacctcaggtgtgcctgt

SEQ ID NO: 951556 - DNA, 11 bp, Homo sapiens
ttacctccctc

SEQ ID NO: 951557 - DNA, 13 bp, Homo sapiens
ttacctcctgccc

SEQ ID NO: 951558 - DNA, 15 bp, Homo sapiens
ttacctcctgcccag

SEQ ID NO: 951559 - DNA, 15 bp, Homo sapiens
ttacctctctgtcat

SEQ ID NO: 951560 - DNA, 20 bp, Homo sapiens
ttacctgaaaacactgtgca

SEQ ID NO: 951561 - DNA, 16 bp, Homo sapiens
ttacctgacctcttgc

SEQ ID NO: 951562 - DNA, 15 bp, Homo sapiens
ttacctggatgttct

SEQ ID NO: 951563 - DNA, 21 bp, Homo sapiens
ttacctggcagtggctctcag

SEQ ID NO: 951564 - DNA, 23 bp, Homo sapiens
ttacctggcagtggctctcagag

SEQ ID NO: 951565 - DNA, 15 bp, Homo sapiens
ttacctggtactaaa

SEQ ID NO: 951566 - DNA, 22 bp, Homo sapiens
ttacctgtacactgacttgaga

SEQ ID NO: 951567 - DNA, 18 bp, Homo sapiens
ttacctgtatacagtgca

SEQ ID NO: 951568 - DNA, 13 bp, Homo sapiens
ttacctgtgaaat

SEQ ID NO: 951569 - DNA, 19 bp, Homo sapiens
ttacctgtgaagtgttact

SEQ ID NO: 951570 - DNA, 12 bp, Homo sapiens
ttacctgtggat

SEQ ID NO: 951571 - DNA, 20 bp, Homo sapiens
ttacctgttatatatctctt

SEQ ID NO: 951572 - DNA, 23 bp, Homo sapiens
ttacctgttttcgcacctaccat

SEQ ID NO: 951573 - DNA, 17 bp, Homo sapiens
ttacctttatctttcac

SEQ ID NO: 951574 - DNA, 13 bp, Homo sapiens
ttacctttcatac

SEQ ID NO: 951575 - DNA, 14 bp, Homo sapiens
ttaccttttctata

SEQ ID NO: 951576 - DNA, 15 bp, Homo sapiens
ttaccttttgatgtt

SEQ ID NO: 951577 - DNA, 20 bp, Homo sapiens
ttaccttttttatacataaa

SEQ ID NO: 951578 - DNA, 22 bp, Homo sapiens
ttaccttttttatacataaaca

SEQ ID NO: 951579 - DNA, 14 bp, Homo sapiens
ttacgaaacctctt

SEQ ID NO: 951580 - DNA, 17 bp, Homo sapiens
ttacttaggttattttg

SEQ ID NO: 951581 - DNA, 16 bp, Homo sapiens
ttacttatcttatgcc

SEQ ID NO: 951582 - DNA, 18 bp, Homo sapiens
ttacttctctataaaaaa

SEQ ID NO: 951583 - DNA, 11 bp, Homo sapiens
ttacttctctt

SEQ ID NO: 951584 - DNA, 13 bp, Homo sapiens
ttacttgcaggta

SEQ ID NO: 951585 - DNA, 19 bp, Homo sapiens
ttacttgcattgaatatat

SEQ ID NO: 951586 - DNA, 18 bp, Homo sapiens
taactagaatttattcaa

SEQ ID NO: 951587 - DNA, 15 bp, Homo sapiens
taactaggatatgta

SEQ ID NO: 951588 - DNA, 23 bp, Homo sapiens
taactagtaataccaaagactat

SEQ ID NO: 951589 - DNA, 15 bp, Homo sapiens
taactataaggtgcc

SEQ ID NO: 951590 - DNA, 19 bp, Homo sapiens
taactatatgtacagctct

SEQ ID NO: 951591 - DNA, 20 bp, Homo sapiens
taactatctcacttccagat

SEQ ID NO: 951592 - DNA, 18 bp, Homo sapiens
taactattcctgtgtaaa

SEQ ID NO: 951593 - DNA, 15 bp, Homo sapiens
taactattgcattta

SEQ ID NO: 951594 - DNA, 18 bp, Homo sapiens
taactattttgttttaat

SEQ ID NO: 951595 - DNA, 20 bp, Homo sapiens
taactattttgttttaatct

SEQ ID NO: 951596 - DNA, 23 bp, Homo sapiens
taactattttgttttaatctact

SEQ ID NO: 951597 - DNA, 14 bp, Homo sapiens
taactatttttcct

SEQ ID NO: 951598 - DNA, 22 bp, Homo sapiens
taactcaaggataccttcttat

SEQ ID NO: 951599 - DNA, 21 bp, Homo sapiens
taactcaccagccccactgcc

SEQ ID NO: 951600 - DNA, 17 bp, Homo sapiens
taactcacccctcagca

SEQ ID NO: 951601 - DNA, 12 bp, Homo sapiens
taactcattaga

SEQ ID NO: 951602 - DNA, 16 bp, Homo sapiens
taactcattagactgg

SEQ ID NO: 951603 - DNA, 14 bp, Homo sapiens
taactccaagcaga

SEQ ID NO: 951604 - DNA, 19 bp, Homo sapiens
taactccaagcagactcca

SEQ ID NO: 951605 - DNA, 14 bp, Homo sapiens
taactccactgctt

SEQ ID NO: 951606 - DNA, 14 bp, Homo sapiens
taactcccattacc

SEQ ID NO: 951607 - DNA, 15 bp, Homo sapiens
taactccccacccca

SEQ ID NO: 951608 - DNA, 23 bp, Homo sapiens
taactccgagagcagtgggcagg

SEQ ID NO: 951609 - DNA, 17 bp, Homo sapiens
taactcctgagaaatgt

SEQ ID NO: 951610 - DNA, 17 bp, Homo sapiens
taactctaaaagatcct

SEQ ID NO: 951611 - DNA, 15 bp, Homo sapiens
taactctaaccctgt

SEQ ID NO: 951612 - DNA, 22 bp, Homo sapiens
taactctaattcccattttgca

SEQ ID NO: 951613 - DNA, 15 bp, Homo sapiens
taactctagggatat

SEQ ID NO: 951614 - DNA, 17 bp, Homo sapiens
taactctagggatataa

SEQ ID NO: 951615 - DNA, 21 bp, Homo sapiens
taactctccagccattgtaat

SEQ ID NO: 951616 - DNA, 21 bp, Homo sapiens
taactctgcactactcctctg

SEQ ID NO: 951617 - DNA, 19 bp, Homo sapiens
taactctgcccaccctcct

SEQ ID NO: 951618 - DNA, 19 bp, Homo sapiens
taactctggattttgaatt

SEQ ID NO: 951619 - DNA, 18 bp, Homo sapiens
taactctgtaaaaacact

SEQ ID NO: 951620 - DNA, 16 bp, Homo sapiens
taactctgtataatag

SEQ ID NO: 951621 - DNA, 18 bp, Homo sapiens
taactctgtataatagag

SEQ ID NO: 951622 - DNA, 21 bp, Homo sapiens
taactcttacctaaactgagc

SEQ ID NO: 951623 - DNA, 13 bp, Homo sapiens
taactgaaaatgt

SEQ ID NO: 951624 - DNA, 15 bp, Homo sapiens
taactgaaaatgtaa

SEQ ID NO: 951625 - DNA, 17 bp, Homo sapiens
taactgaaaatgtaaat

SEQ ID NO: 951626 - DNA, 20 bp, Homo sapiens
taactgaaaatgtgctatac

SEQ ID NO: 951627 - DNA, 20 bp, Homo sapiens
taactgaaaattatttaaac

SEQ ID NO: 951628 - DNA, 14 bp, Homo sapiens
taactgaactgttt

SEQ ID NO: 951629 - DNA, 15 bp, Homo sapiens
taactgaactgtttg

SEQ ID NO: 951630 - DNA, 22 bp, Homo sapiens
taactgaagaaaaggttcttct

SEQ ID NO: 951631 - DNA, 16 bp, Homo sapiens
taactgaaggagaagg

SEQ ID NO: 951632 - DNA, 18 bp, Homo sapiens
taactgaatacagtctca

SEQ ID NO: 951633 - DNA, 15 bp, Homo sapiens
taactgaataccact

SEQ ID NO: 951634 - DNA, 21 bp, Homo sapiens
taactgaataccactctgtaa

SEQ ID NO: 951635 - DNA, 22 bp, Homo sapiens
taactgaataccactctgtaat

SEQ ID NO: 951636 - DNA, 17 bp, Homo sapiens
taactgacaagccatct

SEQ ID NO: 951637 - DNA, 15 bp, Homo sapiens
taactgactctgtta

SEQ ID NO: 951638 - DNA, 19 bp, Homo sapiens
taactgactctgttattga

SEQ ID NO: 951639 - DNA, 23 bp, Homo sapiens
taactgagtagctctcctgactt

SEQ ID NO: 951640 - DNA, 13 bp, Homo sapiens
taactgatgaatt

SEQ ID NO: 951641 - DNA, 17 bp, Homo sapiens
taactgattaaaaatac

SEQ ID NO: 951642 - DNA, 12 bp, Homo sapiens
taactgcaattt

SEQ ID NO: 951643 - DNA, 16 bp, Homo sapiens
taactgcacctgggca

SEQ ID NO: 951644 - DNA, 15 bp, Homo sapiens
taactgccaatcctt

SEQ ID NO: 951645 - DNA, 17 bp, Homo sapiens
taactgccgtaatttaa

SEQ ID NO: 951646 - DNA, 17 bp, Homo sapiens
taactgctcagagcttt

SEQ ID NO: 951647 - DNA, 23 bp, Homo sapiens
taactgctcagagctttaaaagt

SEQ ID NO: 951648 - DNA, 14 bp, Homo sapiens
taactgctgagcca

SEQ ID NO: 951649 - DNA, 19 bp, Homo sapiens
taactggaacaaattattt

SEQ ID NO: 951650 - DNA, 15 bp, Homo sapiens
taactggattttgaa

SEQ ID NO: 951651 - DNA, 17 bp, Homo sapiens
taactggattttgaacg

SEQ ID NO: 951652 - DNA, 16 bp, Homo sapiens
taactggcatggatta

SEQ ID NO: 951653 - DNA, 18 bp, Homo sapiens
taactggcttcattttag

SEQ ID NO: 951654 - DNA, 22 bp, Homo sapiens
taactggtgcactttgtaaatt

SEQ ID NO: 951655 - DNA, 15 bp, Homo sapiens
taactgtaaagatgt

SEQ ID NO: 951656 - DNA, 23 bp, Homo sapiens
taactgtaaagatgtttatttca

SEQ ID NO: 951657 - DNA, 21 bp, Homo sapiens
taactgtagctcaagtttaaa

SEQ ID NO: 951658 - DNA, 17 bp, Homo sapiens
taactgtatatttgtat

SEQ ID NO: 951659 - DNA, 17 bp, Homo sapiens
taactgtatttcagtat

SEQ ID NO: 951660 - DNA, 12 bp, Homo sapiens
taactgtatttg

SEQ ID NO: 951661 - DNA, 22 bp, Homo sapiens
taactgtatttgaaataagaat

SEQ ID NO: 951662 - DNA, 23 bp, Homo sapiens
taactgtccgtagtatcagagat

SEQ ID NO: 951663 - DNA, 12 bp, Homo sapiens
taactgtcctgt

SEQ ID NO: 951664 - DNA, 18 bp, Homo sapiens
taactgtgccagttcttt

SEQ ID NO: 951665 - DNA, 14 bp, Homo sapiens
taactgtggaatat

SEQ ID NO: 951666 - DNA, 23 bp, Homo sapiens
taactgtggaatataaatagctg

SEQ ID NO: 951667 - DNA, 11 bp, Homo sapiens
taactgtgtat

SEQ ID NO: 951668 - DNA, 13 bp, Homo sapiens
taactgtgtatgt

SEQ ID NO: 951669 - DNA, 14 bp, Homo sapiens
taactgtgtatgta

SEQ ID NO: 951670 - DNA, 22 bp, Homo sapiens
taactgtgtatgtacatatata

SEQ ID NO: 951671 - DNA, 14 bp, Homo sapiens
taactgttttagaa

SEQ ID NO: 951672 - DNA, 20 bp, Homo sapiens
taacttaaaaatgtaaatat

SEQ ID NO: 951673 - DNA, 21 bp, Homo sapiens
taacttaaaaatgtaaatatt

SEQ ID NO: 951674 - DNA, 16 bp, Homo sapiens
taacttaaatagtatt

SEQ ID NO: 951675 - DNA, 17 bp, Homo sapiens
taacttaactgaagaaa

SEQ ID NO: 951676 - DNA, 16 bp, Homo sapiens
taacttactgtatatg

SEQ ID NO: 951677 - DNA, 12 bp, Homo sapiens
taacttactgtc

SEQ ID NO: 951678 - DNA, 14 bp, Homo sapiens
taacttacttccaa

SEQ ID NO: 951679 - DNA, 21 bp, Homo sapiens
taacttagactctagtattta

SEQ ID NO: 951680 - DNA, 15 bp, Homo sapiens
taacttatattaata

SEQ ID NO: 951681 - DNA, 20 bp, Homo sapiens
taacttatattgtaagaaat

SEQ ID NO: 951682 - DNA, 19 bp, Homo sapiens
taacttatgtacaaggatg

SEQ ID NO: 951683 - DNA, 17 bp, Homo sapiens
taacttattcaaagaga

SEQ ID NO: 951684 - DNA, 21 bp, Homo sapiens
taacttattccaagtgcattt

SEQ ID NO: 951685 - DNA, 16 bp, Homo sapiens
taacttatttagagat

SEQ ID NO: 951686 - DNA, 21 bp, Homo sapiens
taacttatttatgttaaaaga

SEQ ID NO: 951687 - DNA, 22 bp, Homo sapiens
taacttcacattaaaaaatgaa

SEQ ID NO: 951688 - DNA, 14 bp, Homo sapiens
taacttcaccatat

SEQ ID NO: 951689 - DNA, 23 bp, Homo sapiens
taacttcacccgagttcctctgg

SEQ ID NO: 951690 - DNA, 12 bp, Homo sapiens
taacttcctgct

SEQ ID NO: 951691 - DNA, 19 bp, Homo sapiens
taacttcctgctgcaccct

SEQ ID NO: 951692 - DNA, 20 bp, Homo sapiens
taacttcctgtgcctttcct

SEQ ID NO: 951693 - DNA, 22 bp, Homo sapiens
taacttctatattttaatagaa

SEQ ID NO: 951694 - DNA, 14 bp, Homo sapiens
taacttctatgttg

SEQ ID NO: 951695 - DNA, 19 bp, Homo sapiens
taacttcttatggaattga

SEQ ID NO: 951696 - DNA, 13 bp, Homo sapiens
taacttcttcata

SEQ ID NO: 951697 - DNA, 15 bp, Homo sapiens
taacttcttgaaaaa

SEQ ID NO: 951698 - DNA, 21 bp, Homo sapiens
taacttcttgaaaaagatggc

SEQ ID NO: 951699 - DNA, 14 bp, Homo sapiens
taacttgaagagcc

SEQ ID NO: 951700 - DNA, 22 bp, Homo sapiens
taacttgagagtagatggtttg

SEQ ID NO: 951701 - DNA, 15 bp, Homo sapiens
taacttgcgcagaaa

SEQ ID NO: 951702 - DNA, 14 bp, Homo sapiens
taagagctggtgtc

SEQ ID NO: 951703 - DNA, 17 bp, Homo sapiens
taagagctggtgtctga

SEQ ID NO: 951704 - DNA, 19 bp, Homo sapiens
taagaggtaagacttagta

SEQ ID NO: 951705 - DNA, 18 bp, Homo sapiens
taagaggtgttatttgga

SEQ ID NO: 951706 - DNA, 23 bp, Homo sapiens
taagagtattttaagaagacata

SEQ ID NO: 951707 - DNA, 18 bp, Homo sapiens
taagataatagtttacat

SEQ ID NO: 951708 - DNA, 22 bp, Homo sapiens
taagatacaagtttcagacagg

SEQ ID NO: 951709 - DNA, 23 bp, Homo sapiens
taagatacaagtttcagacaggg

SEQ ID NO: 951710 - DNA, 14 bp, Homo sapiens
taagatacactgca

SEQ ID NO: 951711 - DNA, 19 bp, Homo sapiens
taagatacactgcactttg

SEQ ID NO: 951712 - DNA, 15 bp, Homo sapiens
taagatagaacacaa

SEQ ID NO: 951713 - DNA, 20 bp, Homo sapiens
taagatagtgtaacttgctt

SEQ ID NO: 951714 - DNA, 14 bp, Homo sapiens
taagatatatacat

SEQ ID NO: 951715 - DNA, 17 bp, Homo sapiens
taagatatccatctttt

SEQ ID NO: 951716 - DNA, 14 bp, Homo sapiens
ttagcactgttgat

SEQ ID NO: 951717 - DNA, 22 bp, Homo sapiens
ttagcagaatggagaaagtaag

SEQ ID NO: 951718 - DNA, 22 bp, Homo sapiens
ttagcagcacttttgatagatt

SEQ ID NO: 951719 - DNA, 17 bp, Homo sapiens
ttagcagtggctggtgc

SEQ ID NO: 951720 - DNA, 20 bp, Homo sapiens
ttagcagtggctggtgccca

SEQ ID NO: 951721 - DNA, 16 bp, Homo sapiens
ttagcagttctgcaaa

SEQ ID NO: 951722 - DNA, 23 bp, Homo sapiens
ttagcatcagaaggttcacccag

SEQ ID NO: 951723 - DNA, 22 bp, Homo sapiens
ttagcatgacaagccccaggca

SEQ ID NO: 951724 - DNA, 22 bp, Homo sapiens
ttagcatgcaagcttggtcaaa

SEQ ID NO: 951725 - DNA, 17 bp, Homo sapiens
ttagcatgtgttgaaaa

SEQ ID NO: 951726 - DNA, 20 bp, Homo sapiens
ttagcatttttatgcagaca

SEQ ID NO: 951727 - DNA, 18 bp, Homo sapiens
ttagccaagtgtggtaga

SEQ ID NO: 951728 - DNA, 13 bp, Homo sapiens
ttagccacaaaat

SEQ ID NO: 951729 - DNA, 18 bp, Homo sapiens
ttagccatttttcaaagc

SEQ ID NO: 951730 - DNA, 13 bp, Homo sapiens
ttagcccaagagg

SEQ ID NO: 951731 - DNA, 17 bp, Homo sapiens
ttagcccaagaggtctg

SEQ ID NO: 951732 - DNA, 15 bp, Homo sapiens
ttagcccctgaaagc

SEQ ID NO: 951733 - DNA, 21 bp, Homo sapiens
ttagccctcacattagatcta

SEQ ID NO: 951734 - DNA, 11 bp, Homo sapiens
ttagcctcttc

SEQ ID NO: 951735 - DNA, 12 bp, Homo sapiens
ttagcctcttcc

SEQ ID NO: 951736 - DNA, 15 bp, Homo sapiens
ttagcctgcctcacc

SEQ ID NO: 951737 - DNA, 16 bp, Homo sapiens
ttagcctgcctcaccc

SEQ ID NO: 951738 - DNA, 10 bp, Homo sapiens
ttagcctgga

SEQ ID NO: 951739 - DNA, 14 bp, Homo sapiens
ttagcctgtgctgg

SEQ ID NO: 951740 - DNA, 14 bp, Homo sapiens
ttagccttagacga

SEQ ID NO: 951741 - DNA, 22 bp, Homo sapiens
ttagccttagacgaagaagctg

SEQ ID NO: 951742 - DNA, 17 bp, Homo sapiens
ttagccttgtgccctgc

SEQ ID NO: 951743 - DNA, 18 bp, Homo sapiens
ttagccttgtgccctgcc

SEQ ID NO: 951744 - DNA, 15 bp, Homo sapiens
ttagcggctcctcgc

SEQ ID NO: 951745 - DNA, 23 bp, Homo sapiens
ttagcggctcctcgcccccacca

SEQ ID NO: 951746 - DNA, 17 bp, Homo sapiens
ttagcgtcaagacattt

SEQ ID NO: 951747 - DNA, 18 bp, Homo sapiens
ttagcgtcaagacatttg

SEQ ID NO: 951748 - DNA, 21 bp, Homo sapiens
ttagcgttctggactctgccc

SEQ ID NO: 951749 - DNA, 23 bp, Homo sapiens
ttagcgttctggactctgcccca

SEQ ID NO: 951750 - DNA, 21 bp, Homo sapiens
ttagctaaacggattccaaag

SEQ ID NO: 951751 - DNA, 23 bp, Homo sapiens
ttagctaataaaaagcttttgtc

SEQ ID NO: 951752 - DNA, 20 bp, Homo sapiens
ttagctacctttttatattt

SEQ ID NO: 951753 - DNA, 11 bp, Homo sapiens
ttagctcaggt

SEQ ID NO: 951754 - DNA, 23 bp, Homo sapiens
ttagctcttaattgttcattttg

SEQ ID NO: 951755 - DNA, 10 bp, Homo sapiens
ttagctgagc

SEQ ID NO: 951756 - DNA, 15 bp, Homo sapiens
ttagctggcgcatat

SEQ ID NO: 951757 - DNA, 19 bp, Homo sapiens
ttagctggtgtcagcccct

SEQ ID NO: 951758 - DNA, 15 bp, Homo sapiens
ttagctgtctgctca

SEQ ID NO: 951759 - DNA, 10 bp, Homo sapiens
ttagctgtgc

SEQ ID NO: 951760 - DNA, 15 bp, Homo sapiens
ttagctgtgtgaaat

SEQ ID NO: 951761 - DNA, 16 bp, Homo sapiens
ttagcttagacctcag

SEQ ID NO: 951762 - DNA, 17 bp, Homo sapiens
ttagcttagacctcagc

SEQ ID NO: 951763 - DNA, 13 bp, Homo sapiens
ttagcttatcttt

SEQ ID NO: 951764 - DNA, 13 bp, Homo sapiens
ttagctttaactt

SEQ ID NO: 951765 - DNA, 15 bp, Homo sapiens
ttagctttactgttt

SEQ ID NO: 951766 - DNA, 16 bp, Homo sapiens
ttagctttactgtttg

SEQ ID NO: 951767 - DNA, 17 bp, Homo sapiens
ttagctttactgtttgt

SEQ ID NO: 951768 - DNA, 13 bp, Homo sapiens
ttagctttctcag

SEQ ID NO: 951769 - DNA, 13 bp, Homo sapiens
ttagctttgaaac

SEQ ID NO: 951770 - DNA, 22 bp, Homo sapiens
ttagctttgggtgcctttgcca

SEQ ID NO: 951771 - DNA, 15 bp, Homo sapiens
ttagctttgtgttta

SEQ ID NO: 951772 - DNA, 15 bp, Homo sapiens
ttaggaaataaaacc

SEQ ID NO: 951773 - DNA, 16 bp, Homo sapiens
ttaggaaatttaagac

SEQ ID NO: 951774 - DNA, 17 bp, Homo sapiens
ttaggaacttcagagat

SEQ ID NO: 951775 - DNA, 20 bp, Homo sapiens
ttaggaaggcagcattccat

SEQ ID NO: 951776 - DNA, 18 bp, Homo sapiens
ttaggaagtatggcaaaa

SEQ ID NO: 951777 - DNA, 20 bp, Homo sapiens
ttaggaagtgtaacagctga

SEQ ID NO: 951778 - DNA, 20 bp, Homo sapiens
ttaggaagtgtttatgttgt

SEQ ID NO: 951779 - DNA, 23 bp, Homo sapiens
ttaggaagttgacttatagtaca

SEQ ID NO: 951780 - DNA, 23 bp, Homo sapiens
ttaggaattaagttatctttaaa

SEQ ID NO: 951781 - DNA, 21 bp, Homo sapiens
ttaggacaatcagtcccctcc

SEQ ID NO: 951782 - DNA, 14 bp, Homo sapiens
ttaggactgtataa

SEQ ID NO: 951783 - DNA, 23 bp, Homo sapiens
ttaggagattttaggtgttgatt

SEQ ID NO: 951784 - DNA, 16 bp, Homo sapiens
ttaggagcaagaagaa

SEQ ID NO: 951785 - DNA, 22 bp, Homo sapiens
ttaggagtgggtgacaagagcc

SEQ ID NO: 951786 - DNA, 21 bp, Homo sapiens
ttaggatattgatttaaaatt

SEQ ID NO: 951787 - DNA, 14 bp, Homo sapiens
ttaggatctgcaaa

SEQ ID NO: 951788 - DNA, 14 bp, Homo sapiens
ttaggatttaacag

SEQ ID NO: 951789 - DNA, 22 bp, Homo sapiens
ttaggatttaacagtcatttaa

SEQ ID NO: 951790 - DNA, 16 bp, Homo sapiens
ttaggattttcacatt

SEQ ID NO: 951791 - DNA, 19 bp, Homo sapiens
ttaggcactgttcaatact

SEQ ID NO: 951792 - DNA, 23 bp, Homo sapiens
ttaggcagcagcttttaatacag

SEQ ID NO: 951793 - DNA, 19 bp, Homo sapiens
ttaggcatgtcccacccac

SEQ ID NO: 951794 - DNA, 20 bp, Homo sapiens
ttaggcattatttaatgttt

SEQ ID NO: 951795 - DNA, 20 bp, Homo sapiens
ttaggctatttgtaaatctg

SEQ ID NO: 951796 - DNA, 22 bp, Homo sapiens
ttaggctatttgtaaatctgcc

SEQ ID NO: 951797 - DNA, 19 bp, Homo sapiens
ttaggctggtggcccagga

SEQ ID NO: 951798 - DNA, 20 bp, Homo sapiens
ttaggctgtaactactttat

SEQ ID NO: 951799 - DNA, 16 bp, Homo sapiens
ttagggaacaatttgg

SEQ ID NO: 951800 - DNA, 21 bp, Homo sapiens
ttagggagatgagttgcagtt

SEQ ID NO: 951801 - DNA, 15 bp, Homo sapiens
ttagggccaggcagg

SEQ ID NO: 951802 - DNA, 15 bp, Homo sapiens
ttagggccctggagg

SEQ ID NO: 951803 - DNA, 17 bp, Homo sapiens
ttagggctgcttttctt

SEQ ID NO: 951804 - DNA, 14 bp, Homo sapiens
ttagggcttttatt

SEQ ID NO: 951805 - DNA, 16 bp, Homo sapiens
ttaggggattcttctt

SEQ ID NO: 951806 - DNA, 15 bp, Homo sapiens
ttaggggggaaagtc

SEQ ID NO: 951807 - DNA, 23 bp, Homo sapiens
ttagggtcagccatttttaatga

SEQ ID NO: 951808 - DNA, 16 bp, Homo sapiens
ttagggttctgcctct

SEQ ID NO: 951809 - DNA, 15 bp, Homo sapiens
ttagggttttgcaat

SEQ ID NO: 951810 - DNA, 17 bp, Homo sapiens
ttagggttttgcaataa

SEQ ID NO: 951811 - DNA, 23 bp, Homo sapiens
ttaggtaagaagttttaaaaagc

SEQ ID NO: 951812 - DNA, 15 bp, Homo sapiens
ttaggtagaaaaaca

SEQ ID NO: 951813 - DNA, 17 bp, Homo sapiens
ttaggtagaaactattg

SEQ ID NO: 951814 - DNA, 16 bp, Homo sapiens
ttaggtagactttgct

SEQ ID NO: 951815 - DNA, 17 bp, Homo sapiens
ttaggtagactttgctt

SEQ ID NO: 951816 - DNA, 23 bp, Homo sapiens
ttaggtccctcactccacagagt

SEQ ID NO: 951817 - DNA, 13 bp, Homo sapiens
ttaggtgccaggc

SEQ ID NO: 951818 - DNA, 20 bp, Homo sapiens
ttaggtggccgctcctccct

SEQ ID NO: 951819 - DNA, 22 bp, Homo sapiens
ttaggtggccgctcctccctgc

SEQ ID NO: 951820 - DNA, 18 bp, Homo sapiens
ttaggtggttctcttcat

SEQ ID NO: 951821 - DNA, 19 bp, Homo sapiens
ttaggtgttgattttctgt

SEQ ID NO: 951822 - DNA, 18 bp, Homo sapiens
ttaggttggcaaaaaggc

SEQ ID NO: 951823 - DNA, 19 bp, Homo sapiens
ttataactagacatctgct

SEQ ID NO: 951824 - DNA, 16 bp, Homo sapiens
ttataactcatcataa

SEQ ID NO: 951825 - DNA, 20 bp, Homo sapiens
ttataactcatcataaaata

SEQ ID NO: 951826 - DNA, 22 bp, Homo sapiens
ttataactcatcataaaataaa

SEQ ID NO: 951827 - DNA, 13 bp, Homo sapiens
ttataactgtttt

SEQ ID NO: 951828 - DNA, 21 bp, Homo sapiens
ttataacttaatgaaaacaat

SEQ ID NO: 951829 - DNA, 16 bp, Homo sapiens
ttataagcagatttaa

SEQ ID NO: 951830 - DNA, 17 bp, Homo sapiens
ttataaggaaattttac

SEQ ID NO: 951831 - DNA, 22 bp, Homo sapiens
ttataagggccctgccctgtac

SEQ ID NO: 951832 - DNA, 23 bp, Homo sapiens
ttataagttaaaacaaaggaact

SEQ ID NO: 951833 - DNA, 17 bp, Homo sapiens
ttataataaaaggaaaa

SEQ ID NO: 951834 - DNA, 21 bp, Homo sapiens
ttataataaaaggaaaagcaa

SEQ ID NO: 951835 - DNA, 19 bp, Homo sapiens
ttataataaaggactgtaa

SEQ ID NO: 951836 - DNA, 14 bp, Homo sapiens
ttataataactgaa

SEQ ID NO: 951837 - DNA, 18 bp, Homo sapiens
ttataataatgttaacat

SEQ ID NO: 951838 - DNA, 13 bp, Homo sapiens
ttataatagattt

SEQ ID NO: 951839 - DNA, 11 bp, Homo sapiens
ttataatagca

SEQ ID NO: 951840 - DNA, 13 bp, Homo sapiens
ttataatatacta

SEQ ID NO: 951841 - DNA, 17 bp, Homo sapiens
ttataatcaaagctcat

SEQ ID NO: 951842 - DNA, 24 bp, Homo sapiens
ttataatccttaaatcttaatgtt

SEQ ID NO: 951843 - DNA, 16 bp, Homo sapiens
ttataatctcaaagga

SEQ ID NO: 951844 - DNA, 16 bp, Homo sapiens
ttataatctgaagata

SEQ ID NO: 951845 - DNA, 18 bp, Homo sapiens
ttataatcttataattgt

SEQ ID NO: 951846 - DNA, 17 bp, Homo sapiens
gtcccagggccctggat

SEQ ID NO: 951847 - DNA, 12 bp, Homo sapiens
gtcccagtgccg

SEQ ID NO: 951848 - DNA, 19 bp, Homo sapiens
gtcccagtgggaggggcag

SEQ ID NO: 951849 - DNA, 21 bp, Homo sapiens
gtcccagtgggaggggcaggc

SEQ ID NO: 951850 - DNA, 22 bp, Homo sapiens
gtcccagtgggaggggcaggct

SEQ ID NO: 951851 - DNA, 19 bp, Homo sapiens
gtcccagtgtcagtattta

SEQ ID NO: 951852 - DNA, 17 bp, Homo sapiens
gtcccatccagctacca

SEQ ID NO: 951853 - DNA, 13 bp, Homo sapiens
gtcccatccccag

SEQ ID NO: 951854 - DNA, 16 bp, Homo sapiens
gtcccatctgccctcc

SEQ ID NO: 951855 - DNA, 16 bp, Homo sapiens
gtcccatcttcactct

SEQ ID NO: 951856 - DNA, 23 bp, Homo sapiens
gtcccatcttcactcttcacttg

SEQ ID NO: 951857 - DNA, 16 bp, Homo sapiens
gtcccatgacccaccc

SEQ ID NO: 951858 - DNA, 18 bp, Homo sapiens
gtcccatgacccacccct

SEQ ID NO: 951859 - DNA, 23 bp, Homo sapiens
tgggaagttgcattcctttgtct

SEQ ID NO: 951860 - DNA, 15 bp, Homo sapiens
tgggaataattgctt

SEQ ID NO: 951861 - DNA, 14 bp, Homo sapiens
tgggaatgaggtgg

SEQ ID NO: 951862 - DNA, 16 bp, Homo sapiens
tgggaatgcggcaaga

SEQ ID NO: 951863 - DNA, 16 bp, Homo sapiens
tgggaatggaataact

SEQ ID NO: 951864 - DNA, 13 bp, Homo sapiens
tgggaatgggaga

SEQ ID NO: 951865 - DNA, 16 bp, Homo sapiens
tgggaatgtttgtctc

SEQ ID NO: 951866 - DNA, 22 bp, Homo sapiens
tgggaatgtttgtctcatccca

SEQ ID NO: 951867 - DNA, 14 bp, Homo sapiens
tgggaattggggag

SEQ ID NO: 951868 - DNA, 20 bp, Homo sapiens
tgggaattggggagggagaa

SEQ ID NO: 951869 - DNA, 20 bp, Homo sapiens
tgggacacaaaactccgccc

SEQ ID NO: 951870 - DNA, 12 bp, Homo sapiens
tgggacacacac

SEQ ID NO: 951871 - DNA, 18 bp, Homo sapiens
tgggacaccagggaagaa

SEQ ID NO: 951872 - DNA, 12 bp, Homo sapiens
tgggacacctgg

SEQ ID NO: 951873 - DNA, 14 bp, Homo sapiens
tgggacacctggga

SEQ ID NO: 951874 - DNA, 16 bp, Homo sapiens
tgggacacctgggaga

SEQ ID NO: 951875 - DNA, 16 bp, Homo sapiens
tgggacactgggcagc

SEQ ID NO: 951876 - DNA, 17 bp, Homo sapiens
tgggacactgggcagca

SEQ ID NO: 951877 - DNA, 19 bp, Homo sapiens
tgggacatggcacaggccc

SEQ ID NO: 951878 - DNA, 18 bp, Homo sapiens
tgggaccagggatggggg

SEQ ID NO: 951879 - DNA, 21 bp, Homo sapiens
tgggaccccctcgccagcttg

SEQ ID NO: 951880 - DNA, 14 bp, Homo sapiens
tgggacccctccca

SEQ ID NO: 951881 - DNA, 20 bp, Homo sapiens
tgggacccctcccaacctca

SEQ ID NO: 951882 - DNA, 21 bp, Homo sapiens
tgggacccctcccaacctcaa

SEQ ID NO: 951883 - DNA, 18 bp, Homo sapiens
tgggaccctttccttcct

SEQ ID NO: 951884 - DNA, 23 bp, Homo sapiens
tgggaccgcctggccctccctcc

SEQ ID NO: 951885 - DNA, 22 bp, Homo sapiens
tgggaccgtgccccacctcccc

SEQ ID NO: 951886 - DNA, 23 bp, Homo sapiens
tgggaccgtgccccacctcccca

SEQ ID NO: 951887 - DNA, 18 bp, Homo sapiens
tgggaccgtgcgagctgc

SEQ ID NO: 951888 - DNA, 19 bp, Homo sapiens
tgggacctaggggcgccgc

SEQ ID NO: 951889 - DNA, 16 bp, Homo sapiens
tgggacctcctccctc

SEQ ID NO: 951890 - DNA, 11 bp, Homo sapiens
tgggacctggc

SEQ ID NO: 951891 - DNA, 20 bp, Homo sapiens
tgggacgtggctcagccagc

SEQ ID NO: 951892 - DNA, 21 bp, Homo sapiens
tgggacgtggctcagccagca

SEQ ID NO: 951893 - DNA, 17 bp, Homo sapiens
tgggacgtgtacagcac

SEQ ID NO: 951894 - DNA, 18 bp, Homo sapiens
tgggacgtgtacagcaca

SEQ ID NO: 951895 - DNA, 19 bp, Homo sapiens
tgggacgtgtacagcacag

SEQ ID NO: 951896 - DNA, 23 bp, Homo sapiens
tgggactcagccttcagacagag

SEQ ID NO: 951897 - DNA, 18 bp, Homo sapiens
tgggactccatagctcct

SEQ ID NO: 951898 - DNA, 20 bp, Homo sapiens
tgggactccatgctccttga

SEQ ID NO: 951899 - DNA, 18 bp, Homo sapiens
tgggactcggagactatg

SEQ ID NO: 951900 - DNA, 19 bp, Homo sapiens
tgggactcggtgagccggg

SEQ ID NO: 951901 - DNA, 22 bp, Homo sapiens
tgggactctcctcctcccctcc

SEQ ID NO: 951902 - DNA, 15 bp, Homo sapiens
tgggactgagccagt

SEQ ID NO: 951903 - DNA, 16 bp, Homo sapiens
tgggactgagccagtc

SEQ ID NO: 951904 - DNA, 19 bp, Homo sapiens
tgggactgggtttggaccc

SEQ ID NO: 951905 - DNA, 16 bp, Homo sapiens
tgggactggtgggggt

SEQ ID NO: 951906 - DNA, 14 bp, Homo sapiens
tgggacttaactcc

SEQ ID NO: 951907 - DNA, 17 bp, Homo sapiens
tgggacttccttgctct

SEQ ID NO: 951908 - DNA, 20 bp, Homo sapiens
tgggacttcttacccaaagc

SEQ ID NO: 951909 - DNA, 21 bp, Homo sapiens
tgggacttcttacccaaagca

SEQ ID NO: 951910 - DNA, 23 bp, Homo sapiens
tgggacttcttacccaaagcaca

SEQ ID NO: 951911 - DNA, 20 bp, Homo sapiens
tgggacttggagagcaaagg

SEQ ID NO: 951912 - DNA, 13 bp, Homo sapiens
tgggacttttctt

SEQ ID NO: 951913 - DNA, 22 bp, Homo sapiens
tgggagaaaacgccagtgtgtt

SEQ ID NO: 951914 - DNA, 15 bp, Homo sapiens
tgggagaacctcagg

SEQ ID NO: 951915 - DNA, 23 bp, Homo sapiens
tgggagaacctcaggcttccttg

SEQ ID NO: 951916 - DNA, 18 bp, Homo sapiens
tgggagaaggactatcaa

SEQ ID NO: 951917 - DNA, 20 bp, Homo sapiens
tgggagaaggtctccaaggg

SEQ ID NO: 951918 - DNA, 21 bp, Homo sapiens
tgggagacaagaaatccctgt

SEQ ID NO: 951919 - DNA, 19 bp, Homo sapiens
tgggagacacccaaagggt

SEQ ID NO: 951920 - DNA, 14 bp, Homo sapiens
tgggagacagcagc

SEQ ID NO: 951921 - DNA, 15 bp, Homo sapiens
tgggagacagcagcc

SEQ ID NO: 951922 - DNA, 17 bp, Homo sapiens
tgggagacagcagcctg

SEQ ID NO: 951923 - DNA, 18 bp, Homo sapiens
tgggagacatggaccagc

SEQ ID NO: 951924 - DNA, 14 bp, Homo sapiens
tgggagacatgtga

SEQ ID NO: 951925 - DNA, 22 bp, Homo sapiens
tgggagacctgttggcctgtgg

SEQ ID NO: 951926 - DNA, 14 bp, Homo sapiens
tgggagagcctggc

SEQ ID NO: 951927 - DNA, 18 bp, Homo sapiens
tgggagagctggtggtgc

SEQ ID NO: 951928 - DNA, 20 bp, Homo sapiens
tgggagaggatttttttctg

SEQ ID NO: 951929 - DNA, 23 bp, Homo sapiens
tgggagaggatttttttctgagc

SEQ ID NO: 951930 - DNA, 23 bp, Homo sapiens
tgggagattcaagggacccatga

SEQ ID NO: 951931 - DNA, 20 bp, Homo sapiens
tgggagcaaaataaggaaga

SEQ ID NO: 951932 - DNA, 14 bp, Homo sapiens
tgggagcagaacag

SEQ ID NO: 951933 - DNA, 14 bp, Homo sapiens
tgggagcagcttct

SEQ ID NO: 951934 - DNA, 20 bp, Homo sapiens
tgggagcagcttcttgggct

SEQ ID NO: 951935 - DNA, 23 bp, Homo sapiens
tgggagcagcttcttgggctgag

SEQ ID NO: 951936 - DNA, 12 bp, Homo sapiens
tgggagccagct

SEQ ID NO: 951937 - DNA, 13 bp, Homo sapiens
tgggagccaggct

SEQ ID NO: 951938 - DNA, 14 bp, Homo sapiens
tgggagccccaggg

SEQ ID NO: 951939 - DNA, 23 bp, Homo sapiens
tgggagccccagggtcttcccta

SEQ ID NO: 951940 - DNA, 21 bp, Homo sapiens
tgggagccgggaccctcaggt

SEQ ID NO: 951941 - DNA, 18 bp, Homo sapiens
tgggagcctagctcctgc

SEQ ID NO: 951942 - DNA, 21 bp, Homo sapiens
tgggagcctagctcctgccac

SEQ ID NO: 951943 - DNA, 17 bp, Homo sapiens
tgggagcctcgcccctc

SEQ ID NO: 951944 - DNA, 18 bp, Homo sapiens
tgggagcctcgcccctcc

SEQ ID NO: 951945 - DNA, 19 bp, Homo sapiens
tgggagcctcgcccctcca

SEQ ID NO: 951946 - DNA, 20 bp, Homo sapiens
tgggagcctcgcccctccag

SEQ ID NO: 951947 - DNA, 23 bp, Homo sapiens
tgggagcctcgcccctccagtgt

SEQ ID NO: 951948 - DNA, 20 bp, Homo sapiens
tgggagcctgaggcaggaga

SEQ ID NO: 951949 - DNA, 22 bp, Homo sapiens
tgggagcctgcaaactcactgc

SEQ ID NO: 951950 - DNA, 22 bp, Homo sapiens
tgggagcgtcagggttggtgtg

SEQ ID NO: 951951 - DNA, 14 bp, Homo sapiens
tgggagctgagcag

SEQ ID NO: 951952 - DNA, 14 bp, Homo sapiens
tgggagctgagctg

SEQ ID NO: 951953 - DNA, 18 bp, Homo sapiens
tgggagctgagctggaag

SEQ ID NO: 951954 - DNA, 20 bp, Homo sapiens
tgggagctgcgccggacaga

SEQ ID NO: 951955 - DNA, 21 bp, Homo sapiens
tgggagctgcgccggacagag

SEQ ID NO: 951956 - DNA, 22 bp, Homo sapiens
tgggagctgcgccggacagagt

SEQ ID NO: 951957 - DNA, 16 bp, Homo sapiens
tgggagctgtcaagca

SEQ ID NO: 951958 - DNA, 15 bp, Homo sapiens
tgggaggaaatttga

SEQ ID NO: 951959 - DNA, 17 bp, Homo sapiens
tgggaggacaggcaggc

SEQ ID NO: 951960 - DNA, 18 bp, Homo sapiens
tgggaggagagccactgg

SEQ ID NO: 951961 - DNA, 14 bp, Homo sapiens
tgggaggaggaaga

SEQ ID NO: 951962 - DNA, 15 bp, Homo sapiens
tgggaggaggaagac

SEQ ID NO: 951963 - DNA, 18 bp, Homo sapiens
tgggaggagggagaggga

SEQ ID NO: 951964 - DNA, 21 bp, Homo sapiens
tgggaggatctcttgagcctg

SEQ ID NO: 951965 - DNA, 13 bp, Homo sapiens
tgggaggcaagaa

SEQ ID NO: 951966 - DNA, 19 bp, Homo sapiens
tgggaggccaaggcaggta

SEQ ID NO: 951967 - DNA, 19 bp, Homo sapiens
tgggaggccaaggtgggag

SEQ ID NO: 951968 - DNA, 21 bp, Homo sapiens
tgggaggccaaggtgggcgga

SEQ ID NO: 951969 - DNA, 13 bp, Homo sapiens
tgggaggccaggc

SEQ ID NO: 951970 - DNA, 15 bp, Homo sapiens
tgggaggccaggcga

SEQ ID NO: 951971 - DNA, 18 bp, Homo sapiens
tgggaggccaggcgagcc

SEQ ID NO: 951972 - DNA, 18 bp, Homo sapiens
gtccctcttctctcctca

SEQ ID NO: 951973 - DNA, 16 bp, Homo sapiens
gtccctgaaagagaag

SEQ ID NO: 951974 - DNA, 21 bp, Homo sapiens
gtccctgcacagtgacttctg

SEQ ID NO: 951975 - DNA, 17 bp, Homo sapiens
gtccctgcactgtgccc

SEQ ID NO: 951976 - DNA, 19 bp, Homo sapiens
gtccctgcagaagccagaa

SEQ ID NO: 951977 - DNA, 21 bp, Homo sapiens
gtccctgccaatgctccagct

SEQ ID NO: 951978 - DNA, 17 bp, Homo sapiens
gtccctgccacactcag

SEQ ID NO: 951979 - DNA, 14 bp, Homo sapiens
gtccctgccccgcc

SEQ ID NO: 951980 - DNA, 14 bp, Homo sapiens
tgggaggctgaggt

SEQ ID NO: 951981 - DNA, 14 bp, Homo sapiens
tgggagggaaaagg

SEQ ID NO: 951982 - DNA, 17 bp, Homo sapiens
tgggagggagcagacag

SEQ ID NO: 951983 - DNA, 17 bp, Homo sapiens
tgggagggaggctcagg

SEQ ID NO: 951984 - DNA, 22 bp, Homo sapiens
tgggagggaggctcaggtccct

SEQ ID NO: 951985 - DNA, 15 bp, Homo sapiens
tgggagggatcagcc

SEQ ID NO: 951986 - DNA, 17 bp, Homo sapiens
tgggagggatcagcccc

SEQ ID NO: 951987 - DNA, 19 bp, Homo sapiens
tgggagggcagcagggcta

SEQ ID NO: 951988 - DNA, 16 bp, Homo sapiens
tgggagggcattccat

SEQ ID NO: 951989 - DNA, 18 bp, Homo sapiens
tgggagggcgtcaggcag

SEQ ID NO: 951990 - DNA, 17 bp, Homo sapiens
tgggaggggcaggctga

SEQ ID NO: 951991 - DNA, 23 bp, Homo sapiens
tgggagggggctatttctctccc

SEQ ID NO: 951992 - DNA, 14 bp, Homo sapiens
tgggagggggtgag

SEQ ID NO: 951993 - DNA, 21 bp, Homo sapiens
tgggagggggtgagaggcagg

SEQ ID NO: 951994 - DNA, 23 bp, Homo sapiens
tgggaggtagaaggggaggacac

SEQ ID NO: 951995 - DNA, 17 bp, Homo sapiens
tgggaggtcaaggctgc

SEQ ID NO: 951996 - DNA, 16 bp, Homo sapiens
tgggaggtcaggaaac

SEQ ID NO: 951997 - DNA, 14 bp, Homo sapiens
tgggaggtcttgct

SEQ ID NO: 951998 - DNA, 22 bp, Homo sapiens
tgggaggtgcgtgttcagcaga

SEQ ID NO: 951999 - DNA, 19 bp, Homo sapiens
tgggaggtggaagaaggga

SEQ ID NO: 952000 - DNA, 20 bp, Homo sapiens
tgggaggtgttggctgcacg

SEQ ID NO: 952001 - DNA, 15 bp, Homo sapiens
tgggaggttaaaaag

SEQ ID NO: 952002 - DNA, 17 bp, Homo sapiens
tgggaggttgggaggct

SEQ ID NO: 952003 - DNA, 19 bp, Homo sapiens
tgggagtaacagggcagaa

SEQ ID NO: 952004 - DNA, 15 bp, Homo sapiens
tgggagtcagagccc

SEQ ID NO: 952005 - DNA, 16 bp, Homo sapiens
tgggagtccaaggtgg

SEQ ID NO: 952006 - DNA, 19 bp, Homo sapiens
tgggagtccaggcacagga

SEQ ID NO: 952007 - DNA, 18 bp, Homo sapiens
tgggagtgggcacctcag

SEQ ID NO: 952008 - DNA, 18 bp, Homo sapiens
tgggagtgtgtctgctga

SEQ ID NO: 952009 - DNA, 15 bp, Homo sapiens
tgggagtgttctgtg

SEQ ID NO: 952010 - DNA, 14 bp, Homo sapiens
tgggataaagcaag

SEQ ID NO: 952011 - DNA, 17 bp, Homo sapiens
tgggataaagcaagggg

SEQ ID NO: 952012 - DNA, 22 bp, Homo sapiens
tgggataaagcaaggggacctt

SEQ ID NO: 952013 - DNA, 16 bp, Homo sapiens
tgggataacagaggca

SEQ ID NO: 952014 - DNA, 21 bp, Homo sapiens
tgggataacagaggcaggagt

SEQ ID NO: 952015 - DNA, 16 bp, Homo sapiens
tgggataactggccag

SEQ ID NO: 952016 - DNA, 17 bp, Homo sapiens
tgggatagagaatgttc

SEQ ID NO: 952017 - DNA, 22 bp, Homo sapiens
tgggatagtgttctgctcctgc

SEQ ID NO: 952018 - DNA, 12 bp, Homo sapiens
tgggatatcatt

SEQ ID NO: 952019 - DNA, 15 bp, Homo sapiens
tgggatatcatttta

SEQ ID NO: 952020 - DNA, 18 bp, Homo sapiens
tgggatatggctgcccag

SEQ ID NO: 952021 - DNA, 19 bp, Homo sapiens
tgggatatggctgcccagg

SEQ ID NO: 952022 - DNA, 14 bp, Homo sapiens
tgggatatggtctt

SEQ ID NO: 952023 - DNA, 14 bp, Homo sapiens
tgggatatttaact

SEQ ID NO: 952024 - DNA, 14 bp, Homo sapiens
tgggatcagcctcc

SEQ ID NO: 952025 - DNA, 17 bp, Homo sapiens
tgggatcaggagccccc

SEQ ID NO: 952026 - DNA, 16 bp, Homo sapiens
tgggatcattgcattt

SEQ ID NO: 952027 - DNA, 14 bp, Homo sapiens
tgggatccaagggg

SEQ ID NO: 952028 - DNA, 13 bp, Homo sapiens
tgggatcctccct

SEQ ID NO: 952029 - DNA, 14 bp, Homo sapiens
tgggatcctccctc

SEQ ID NO: 952030 - DNA, 22 bp, Homo sapiens
tgggatcctctccaccctcctc

SEQ ID NO: 952031 - DNA, 16 bp, Homo sapiens
tgggatcgtgcatttg

SEQ ID NO: 952032 - DNA, 16 bp, Homo sapiens
tgggatctaggagagg

SEQ ID NO: 952033 - DNA, 15 bp, Homo sapiens
tgggatctgagctcc

SEQ ID NO: 952034 - DNA, 23 bp, Homo sapiens
tgggatgacaggcgcctgccatc

SEQ ID NO: 952035 - DNA, 16 bp, Homo sapiens
tgggatgacaggtgtg

SEQ ID NO: 952036 - DNA, 13 bp, Homo sapiens
tgggatgaccagg

SEQ ID NO: 952037 - DNA, 20 bp, Homo sapiens
tgggatgctgacccaggaat

SEQ ID NO: 952038 - DNA, 21 bp, Homo sapiens
tgggatgctgacccaggaata

SEQ ID NO: 952039 - DNA, 14 bp, Homo sapiens
tgggatgcttgcct

SEQ ID NO: 952040 - DNA, 20 bp, Homo sapiens
tgggatgcttgcctagggcc

SEQ ID NO: 952041 - DNA, 13 bp, Homo sapiens
tgggatggacagg

SEQ ID NO: 952042 - DNA, 15 bp, Homo sapiens
tgggatggaggggag

SEQ ID NO: 952043 - DNA, 23 bp, Homo sapiens
tgggatggcgatggggactctgc

SEQ ID NO: 952044 - DNA, 18 bp, Homo sapiens
tgggatgtcacagtccaa

SEQ ID NO: 952045 - DNA, 13 bp, Homo sapiens
tgggatgtcctct

SEQ ID NO: 952046 - DNA, 16 bp, Homo sapiens
tgggatgttcagcact

SEQ ID NO: 952047 - DNA, 14 bp, Homo sapiens
tgggattaagggca

SEQ ID NO: 952048 - DNA, 21 bp, Homo sapiens
tgggattacagggatgagcca

SEQ ID NO: 952049 - DNA, 12 bp, Homo sapiens
tgggattattct

SEQ ID NO: 952050 - DNA, 20 bp, Homo sapiens
tgggattcccaccaaggtct

SEQ ID NO: 952051 - DNA, 15 bp, Homo sapiens
tgggattcctgaccc

SEQ ID NO: 952052 - DNA, 23 bp, Homo sapiens
tgggattggcaagtaacttctga

SEQ ID NO: 952053 - DNA, 14 bp, Homo sapiens
tgggattgggggct

SEQ ID NO: 952054 - DNA, 18 bp, Homo sapiens
tgggattgggggctggtg

SEQ ID NO: 952055 - DNA, 18 bp, Homo sapiens
tgggatttcttcgctgct

SEQ ID NO: 952056 - DNA, 21 bp, Homo sapiens
tgggatttcttcgctgctcta

SEQ ID NO: 952057 - DNA, 16 bp, Homo sapiens
tgggattttttccctt

SEQ ID NO: 952058 - DNA, 14 bp, Homo sapiens
tgggcaaacaggca

SEQ ID NO: 952059 - DNA, 15 bp, Homo sapiens
tgggcaaacaggcag

SEQ ID NO: 952060 - DNA, 16 bp, Homo sapiens
tgggcaaacaggcagt

SEQ ID NO: 952061 - DNA, 13 bp, Homo sapiens
tgggcaaagcttg

SEQ ID NO: 952062 - DNA, 14 bp, Homo sapiens
tgggcaacagagca

SEQ ID NO: 952063 - DNA, 11 bp, Homo sapiens
tgggcaacata

SEQ ID NO: 952064 - DNA, 19 bp, Homo sapiens
tgggcaacataccaagacc

SEQ ID NO: 952065 - DNA, 18 bp, Homo sapiens
tgggcaattccagaaatc

SEQ ID NO: 952066 - DNA, 21 bp, Homo sapiens
tgggcacacgcctcccactgg

SEQ ID NO: 952067 - DNA, 19 bp, Homo sapiens
tgggcacagattgaagaat

SEQ ID NO: 952068 - DNA, 16 bp, Homo sapiens
tgggcacagtgctgcc

SEQ ID NO: 952069 - DNA, 23 bp, Homo sapiens
tgggcacagtgctgccccttgca

SEQ ID NO: 952070 - DNA, 21 bp, Homo sapiens
tgggcacagtggtgaccccct

SEQ ID NO: 952071 - DNA, 16 bp, Homo sapiens
tgggcacccaccctgg

SEQ ID NO: 952072 - DNA, 15 bp, Homo sapiens
tgggcacccacctcc

SEQ ID NO: 952073 - DNA, 17 bp, Homo sapiens
tgggcacccacctccac

SEQ ID NO: 952074 - DNA, 18 bp, Homo sapiens
tgggcacccacctccacc

SEQ ID NO: 952075 - DNA, 21 bp, Homo sapiens
tgggcaccgtgtcctcctctg

SEQ ID NO: 952076 - DNA, 19 bp, Homo sapiens
tgggcacctgcgcacaggt

SEQ ID NO: 952077 - DNA, 15 bp, Homo sapiens
tgggcacctggggag

SEQ ID NO: 952078 - DNA, 18 bp, Homo sapiens
tgggcacgcctgctggcc

SEQ ID NO: 952079 - DNA, 17 bp, Homo sapiens
tgggcacggagggggac

SEQ ID NO: 952080 - DNA, 21 bp, Homo sapiens
tgggcactccgcgccgatgcc

SEQ ID NO: 952081 - DNA, 14 bp, Homo sapiens
tgggcactgctcca

SEQ ID NO: 952082 - DNA, 17 bp, Homo sapiens
tgggcactgctccaagg

SEQ ID NO: 952083 - DNA, 14 bp, Homo sapiens
tgggcactggtggg

SEQ ID NO: 952084 - DNA, 17 bp, Homo sapiens
tgggcactggtgggcca

SEQ ID NO: 952085 - DNA, 19 bp, Homo sapiens
tgggcagaagtgagccccc

SEQ ID NO: 952086 - DNA, 20 bp, Homo sapiens
tgggcagaagtgagcccccc

SEQ ID NO: 952087 - DNA, 14 bp, Homo sapiens
tgggcagagcctgt

SEQ ID NO: 952088 - DNA, 15 bp, Homo sapiens
tgggcagagcctgtc

SEQ ID NO: 952089 - DNA, 12 bp, Homo sapiens
tgggcagagctg

SEQ ID NO: 952090 - DNA, 14 bp, Homo sapiens
tgggcagagctggc

SEQ ID NO: 952091 - DNA, 19 bp, Homo sapiens
tgggcagcaatttaaatgt

SEQ ID NO: 952092 - DNA, 16 bp, Homo sapiens
tgggcagcaccctccc

SEQ ID NO: 952093 - DNA, 18 bp, Homo sapiens
tgggcagcaccctccccc

SEQ ID NO: 952094 - DNA, 12 bp, Homo sapiens
tgggcagcagca

SEQ ID NO: 952095 - DNA, 13 bp, Homo sapiens
tgggcagcagcat

SEQ ID NO: 952096 - DNA, 17 bp, Homo sapiens
tgggcagcagcatccca

SEQ ID NO: 952097 - DNA, 18 bp, Homo sapiens
tgggcagcatgcccagat

SEQ ID NO: 952098 - DNA, 13 bp, Homo sapiens
tgggcagccagga

SEQ ID NO: 952099 - DNA, 15 bp, Homo sapiens
tgggcagccaggctg

SEQ ID NO: 952100 - DNA, 12 bp, Homo sapiens
tgggcagcctgc

SEQ ID NO: 952101 - DNA, 11 bp, Homo sapiens
gtcctcctcta

SEQ ID NO: 952102 - DNA, 13 bp, Homo sapiens
gtcctcctctgag

SEQ ID NO: 952103 - DNA, 16 bp, Homo sapiens
gtccttgatgccagag

SEQ ID NO: 952104 - DNA, 21 bp, Homo sapiens
tgggcagcctgctttggcctt

SEQ ID NO: 952105 - DNA, 13 bp, Homo sapiens
tgggcagccttgg

SEQ ID NO: 952106 - DNA, 12 bp, Homo sapiens
tgggcagctcct

SEQ ID NO: 952107 - DNA, 13 bp, Homo sapiens
tgggcagctgagg

SEQ ID NO: 952108 - DNA, 15 bp, Homo sapiens
tgggcagctgggccc

SEQ ID NO: 952109 - DNA, 22 bp, Homo sapiens
tgggcagcttagggccctggag

SEQ ID NO: 952110 - DNA, 23 bp, Homo sapiens
tgggcagcttagggccctggagg

SEQ ID NO: 952111 - DNA, 18 bp, Homo sapiens
tgggcaggaccctgctga

SEQ ID NO: 952112 - DNA, 22 bp, Homo sapiens
tgggcaggatctcaagccagcc

SEQ ID NO: 952113 - DNA, 22 bp, Homo sapiens
tgggcaggcggtccccatcccc

SEQ ID NO: 952114 - DNA, 23 bp, Homo sapiens
tgggcagggacccggggtctcct

SEQ ID NO: 952115 - DNA, 21 bp, Homo sapiens
tgggcagggcagggcagcctg

SEQ ID NO: 952116 - DNA, 12 bp, Homo sapiens
tgggcagggtga

SEQ ID NO: 952117 - DNA, 19 bp, Homo sapiens
tgggcaggtgggagctgaa

SEQ ID NO: 952118 - DNA, 14 bp, Homo sapiens
tgggcaggtggtgg

SEQ ID NO: 952119 - DNA, 21 bp, Homo sapiens
tgggcaggtggtggcactgag

SEQ ID NO: 952120 - DNA, 15 bp, Homo sapiens
tgggcaggttcctgg

SEQ ID NO: 952121 - DNA, 19 bp, Homo sapiens
tgggcaggttcctggggcc

SEQ ID NO: 952122 - DNA, 17 bp, Homo sapiens
tgggcagtgccagccaa

SEQ ID NO: 952123 - DNA, 18 bp, Homo sapiens
tgggcagtgccccaggga

SEQ ID NO: 952124 - DNA, 19 bp, Homo sapiens
tgggcagtgccccagggag

SEQ ID NO: 952125 - DNA, 20 bp, Homo sapiens
tgggcagtgccccagggagt

SEQ ID NO: 952126 - DNA, 15 bp, Homo sapiens
tgggcagttctccca

SEQ ID NO: 952127 - DNA, 23 bp, Homo sapiens
tgggcagttctcccagggagtga

SEQ ID NO: 952128 - DNA, 16 bp, Homo sapiens
tgggcagttggccagg

SEQ ID NO: 952129 - DNA, 19 bp, Homo sapiens
tgggcatactttctctcta

SEQ ID NO: 952130 - DNA, 18 bp, Homo sapiens
tgggcatccacccagtgc

SEQ ID NO: 952131 - DNA, 20 bp, Homo sapiens
tgggcatccacccagtgctg

SEQ ID NO: 952132 - DNA, 21 bp, Homo sapiens
tgggcatccacccagtgctgc

SEQ ID NO: 952133 - DNA, 17 bp, Homo sapiens
tgggcatcccagcttgc

SEQ ID NO: 952134 - DNA, 20 bp, Homo sapiens
tgggcatcccagcttgcccc

SEQ ID NO: 952135 - DNA, 17 bp, Homo sapiens
tgggcatcttctggctt

SEQ ID NO: 952136 - DNA, 18 bp, Homo sapiens
tgggcatcttttgtatta

SEQ ID NO: 952137 - DNA, 15 bp, Homo sapiens
tgggcatgccaccct

SEQ ID NO: 952138 - DNA, 13 bp, Homo sapiens
tgggcatggccgc

SEQ ID NO: 952139 - DNA, 23 bp, Homo sapiens
tgggcattagtgtccccccttga

SEQ ID NO: 952140 - DNA, 12 bp, Homo sapiens
tgggcattgctt

SEQ ID NO: 952141 - DNA, 14 bp, Homo sapiens
tgggcattgctttc

SEQ ID NO: 952142 - DNA, 15 bp, Homo sapiens
tgggcattgctttcc

SEQ ID NO: 952143 - DNA, 20 bp, Homo sapiens
tgggcattgctttccactga

SEQ ID NO: 952144 - DNA, 16 bp, Homo sapiens
tgggcattgggctgac

SEQ ID NO: 952145 - DNA, 17 bp, Homo sapiens
tgggcattgggctgaca

SEQ ID NO: 952146 - DNA, 17 bp, Homo sapiens
tgggcatttattttata

SEQ ID NO: 952147 - DNA, 23 bp, Homo sapiens
tgggcatttggtgagagtcaaag

SEQ ID NO: 952148 - DNA, 15 bp, Homo sapiens
tgggcatttgtgagg

SEQ ID NO: 952149 - DNA, 16 bp, Homo sapiens
tgggcattttcctcct

SEQ ID NO: 952150 - DNA, 23 bp, Homo sapiens
tgggccaaatccgctctcttcct

SEQ ID NO: 952151 - DNA, 19 bp, Homo sapiens
tgggccacacccaggaagg

SEQ ID NO: 952152 - DNA, 21 bp, Homo sapiens
tgggccacacccaggaaggga

SEQ ID NO: 952153 - DNA, 16 bp, Homo sapiens
tgggccacctcctacc

SEQ ID NO: 952154 - DNA, 18 bp, Homo sapiens
tgggccactctcccctcc

SEQ ID NO: 952155 - DNA, 21 bp, Homo sapiens
tgggccactctcccctccctc

SEQ ID NO: 952156 - DNA, 15 bp, Homo sapiens
tgggccactggggac

SEQ ID NO: 952157 - DNA, 21 bp, Homo sapiens
tgggccagaagtaccagacta

SEQ ID NO: 952158 - DNA, 13 bp, Homo sapiens
tgggccagagctg

SEQ ID NO: 952159 - DNA, 14 bp, Homo sapiens
tgggccagcccctc

SEQ ID NO: 952160 - DNA, 23 bp, Homo sapiens
tgggccagcccctcccaccacag

SEQ ID NO: 952161 - DNA, 20 bp, Homo sapiens
tgggccagccctgcagccca

SEQ ID NO: 952162 - DNA, 21 bp, Homo sapiens
tgggccagccctgcagcccaa

SEQ ID NO: 952163 - DNA, 18 bp, Homo sapiens
tgggccagcttttcaaac

SEQ ID NO: 952164 - DNA, 10 bp, Homo sapiens
tgggccaggg

SEQ ID NO: 952165 - DNA, 12 bp, Homo sapiens
tgggccagggct

SEQ ID NO: 952166 - DNA, 22 bp, Homo sapiens
tgggccagggctgccctgagaa

SEQ ID NO: 952167 - DNA, 14 bp, Homo sapiens
tgggccagtgtggg

SEQ ID NO: 952168 - DNA, 18 bp, Homo sapiens
tgggccataattatgaaa

SEQ ID NO: 952169 - DNA, 14 bp, Homo sapiens
tgggccatgcgagg

SEQ ID NO: 952170 - DNA, 19 bp, Homo sapiens
tgggccatgtccaaagagg

SEQ ID NO: 952171 - DNA, 16 bp, Homo sapiens
tgggccattaccccat

SEQ ID NO: 952172 - DNA, 20 bp, Homo sapiens
tgggccattctccacagcaa

SEQ ID NO: 952173 - DNA, 15 bp, Homo sapiens
tgggcccaagaactg

SEQ ID NO: 952174 - DNA, 17 bp, Homo sapiens
tgggcccacagagatgc

SEQ ID NO: 952175 - DNA, 15 bp, Homo sapiens
tgggcccacagagcc

SEQ ID NO: 952176 - DNA, 20 bp, Homo sapiens
tgggcccacagagcctggct

SEQ ID NO: 952177 - DNA, 18 bp, Homo sapiens
tgggcccagaactgcccc

SEQ ID NO: 952178 - DNA, 19 bp, Homo sapiens
tgggcccagaactgccccc

SEQ ID NO: 952179 - DNA, 22 bp, Homo sapiens
tgggcccagaactgcccccact

SEQ ID NO: 952180 - DNA, 12 bp, Homo sapiens
tgggcccagaag

SEQ ID NO: 952181 - DNA, 21 bp, Homo sapiens
tgggcccagaccactgtctcc

SEQ ID NO: 952182 - DNA, 14 bp, Homo sapiens
tgggcccagatctg

SEQ ID NO: 952183 - DNA, 22 bp, Homo sapiens
tgggcccagctgggctctgcca

SEQ ID NO: 952184 - DNA, 19 bp, Homo sapiens
tgggcccaggaccagctgg

SEQ ID NO: 952185 - DNA, 22 bp, Homo sapiens
tgggcccaggaccagctggggc

SEQ ID NO: 952186 - DNA, 16 bp, Homo sapiens
tgggcccatctccctg

SEQ ID NO: 952187 - DNA, 18 bp, Homo sapiens
tgggcccatctccctgct

SEQ ID NO: 952188 - DNA, 17 bp, Homo sapiens
tgggccccaccacctag

SEQ ID NO: 952189 - DNA, 16 bp, Homo sapiens
tgggccccatgctctg

SEQ ID NO: 952190 - DNA, 20 bp, Homo sapiens
tgggccccatgctctgcccc

SEQ ID NO: 952191 - DNA, 15 bp, Homo sapiens
tgggcccctcagagc

SEQ ID NO: 952192 - DNA, 11 bp, Homo sapiens
tgggcccctcc

SEQ ID NO: 952193 - DNA, 13 bp, Homo sapiens
tgggcccctccac

SEQ ID NO: 952194 - DNA, 17 bp, Homo sapiens
tgggcccctccacgcct

SEQ ID NO: 952195 - DNA, 16 bp, Homo sapiens
tgggcccctggggaca

SEQ ID NO: 952196 - DNA, 17 bp, Homo sapiens
tgggcccctggggacag

SEQ ID NO: 952197 - DNA, 22 bp, Homo sapiens
tgggcccctggggacagagcca

SEQ ID NO: 952198 - DNA, 21 bp, Homo sapiens
tgggcccctgtccccagtccc

SEQ ID NO: 952199 - DNA, 14 bp, Homo sapiens
tgggcccgctgcct

SEQ ID NO: 952200 - DNA, 19 bp, Homo sapiens
tgggcccgctgcctcttgg

SEQ ID NO: 952201 - DNA, 18 bp, Homo sapiens
tgggcccgggcaggccag

SEQ ID NO: 952202 - DNA, 13 bp, Homo sapiens
tgggccctctctc

SEQ ID NO: 952203 - DNA, 16 bp, Homo sapiens
tgggccctctctgctc

SEQ ID NO: 952204 - DNA, 15 bp, Homo sapiens
tgggccctcttatct

SEQ ID NO: 952205 - DNA, 13 bp, Homo sapiens
tgggccctgcccg

SEQ ID NO: 952206 - DNA, 11 bp, Homo sapiens
tgggccctgga

SEQ ID NO: 952207 - DNA, 12 bp, Homo sapiens
tgggccctggag

SEQ ID NO: 952208 - DNA, 13 bp, Homo sapiens
tgggccctttgag

SEQ ID NO: 952209 - DNA, 13 bp, Homo sapiens
tgggccgctgcca

SEQ ID NO: 952210 - DNA, 14 bp, Homo sapiens
tgggccgctgccac

SEQ ID NO: 952211 - DNA, 16 bp, Homo sapiens
tgggccggcgaggggg

SEQ ID NO: 952212 - DNA, 21 bp, Homo sapiens
tgggccggcttcatgccagct

SEQ ID NO: 952213 - DNA, 14 bp, Homo sapiens
tgggccgggaggca

SEQ ID NO: 952214 - DNA, 21 bp, Homo sapiens
tgggccggtcggggaggggga

SEQ ID NO: 952215 - DNA, 13 bp, Homo sapiens
tgggccggtgctg

SEQ ID NO: 952216 - DNA, 16 bp, Homo sapiens
tgggccgtcccctctc

SEQ ID NO: 952217 - DNA, 22 bp, Homo sapiens
tgggccgtcccctctccccttg

SEQ ID NO: 952218 - DNA, 19 bp, Homo sapiens
tgggccgtggcacagctgg

SEQ ID NO: 952219 - DNA, 16 bp, Homo sapiens
tgggcctcaaggactt

SEQ ID NO: 952220 - DNA, 16 bp, Homo sapiens
tgggcctcacctgccc

SEQ ID NO: 952221 - DNA, 23 bp, Homo sapiens
tgggcctcacctgcccctctgtt

SEQ ID NO: 952222 - DNA, 20 bp, Homo sapiens
tgggcctcagttcaacctgg

SEQ ID NO: 952223 - DNA, 22 bp, Homo sapiens
tgggcctccatgccccagctct

SEQ ID NO: 952224 - DNA, 15 bp, Homo sapiens
tgggcctcccctggg

SEQ ID NO: 952225 - DNA, 22 bp, Homo sapiens
gtctataatggaaacatttaca

SEQ ID NO: 952226 - DNA, 23 bp, Homo sapiens
gtctatcaaccccagacactggt

SEQ ID NO: 952227 - DNA, 20 bp, Homo sapiens
gtctatgaagttgctgttta

SEQ ID NO: 952228 - DNA, 21 bp, Homo sapiens
gtctatgacttatttccttca

SEQ ID NO: 952229 - DNA, 17 bp, Homo sapiens
gtctattctgagccttg

SEQ ID NO: 952230 - DNA, 11 bp, Homo sapiens
gtctattgtct

SEQ ID NO: 952231 - DNA, 22 bp, Homo sapiens
tgggcctctctgggggaggcag

SEQ ID NO: 952232 - DNA, 21 bp, Homo sapiens
tgggcctctttttgcccttta

SEQ ID NO: 952233 - DNA, 23 bp, Homo sapiens
tgggcctgactgttgccccccag

SEQ ID NO: 952234 - DNA, 12 bp, Homo sapiens
tgggcctgccca

SEQ ID NO: 952235 - DNA, 16 bp, Homo sapiens
tgggcctgcccaatgc

SEQ ID NO: 952236 - DNA, 20 bp, Homo sapiens
tgggcctgctgaggccttct

SEQ ID NO: 952237 - DNA, 19 bp, Homo sapiens
tgggcctgcttttccagga

SEQ ID NO: 952238 - DNA, 21 bp, Homo sapiens
tgggcctgcttttccaggatc

SEQ ID NO: 952239 - DNA, 13 bp, Homo sapiens
tgggcctggagcc

SEQ ID NO: 952240 - DNA, 23 bp, Homo sapiens
tgggcctggagccctgggcggag

SEQ ID NO: 952241 - DNA, 18 bp, Homo sapiens
tgggcctggcctgagctg

SEQ ID NO: 952242 - DNA, 23 bp, Homo sapiens
tgggcctggcctgagctggggcc

SEQ ID NO: 952243 - DNA, 17 bp, Homo sapiens
tgggcctggcggcctgt

SEQ ID NO: 952244 - DNA, 21 bp, Homo sapiens
tgggcctggcggcctgtgggt

SEQ ID NO: 952245 - DNA, 17 bp, Homo sapiens
tgggcctgggcctgctt

SEQ ID NO: 952246 - DNA, 13 bp, Homo sapiens
tgggcctgtcccc

SEQ ID NO: 952247 - DNA, 13 bp, Homo sapiens
tgggcctgtgcag

SEQ ID NO: 952248 - DNA, 15 bp, Homo sapiens
tgggcctgtgcagca

SEQ ID NO: 952249 - DNA, 19 bp, Homo sapiens
tgggcctgtgcagcagccc

SEQ ID NO: 952250 - DNA, 21 bp, Homo sapiens
tgggcctgtgcagcagcccag

SEQ ID NO: 952251 - DNA, 18 bp, Homo sapiens
tgggcctgtgtgtgggtg

SEQ ID NO: 952252 - DNA, 22 bp, Homo sapiens
tgggcctgtgtgtgggtggggt

SEQ ID NO: 952253 - DNA, 17 bp, Homo sapiens
tgggccttggctgggcc

SEQ ID NO: 952254 - DNA, 20 bp, Homo sapiens
tgggccttggctgggcctct

SEQ ID NO: 952255 - DNA, 21 bp, Homo sapiens
tgggcctttaagaaccttaat

SEQ ID NO: 952256 - DNA, 14 bp, Homo sapiens
tgggcctttcagtc

SEQ ID NO: 952257 - DNA, 23 bp, Homo sapiens
tgggcctttccagagaactgcag

SEQ ID NO: 952258 - DNA, 15 bp, Homo sapiens
tgggcgccctggaag

SEQ ID NO: 952259 - DNA, 20 bp, Homo sapiens
tgggcgccgtgctgggcagc

SEQ ID NO: 952260 - DNA, 23 bp, Homo sapiens
tgggcgccgtgctgggcagcccg

SEQ ID NO: 952261 - DNA, 22 bp, Homo sapiens
tgggcgcggtggctcacgcctg

SEQ ID NO: 952262 - DNA, 12 bp, Homo sapiens
tgggcggctgag

SEQ ID NO: 952263 - DNA, 15 bp, Homo sapiens
tgggcggctgagagc

SEQ ID NO: 952264 - DNA, 16 bp, Homo sapiens
tgggcggctgagagcc

SEQ ID NO: 952265 - DNA, 21 bp, Homo sapiens
tgggcggctgagagccccagc

SEQ ID NO: 952266 - DNA, 16 bp, Homo sapiens
tgggcgtctcccccag

SEQ ID NO: 952267 - DNA, 17 bp, Homo sapiens
tgggcgtctcccccaga

SEQ ID NO: 952268 - DNA, 18 bp, Homo sapiens
tgggcgtctcccccagag

SEQ ID NO: 952269 - DNA, 15 bp, Homo sapiens
tgggcgtctgactcc

SEQ ID NO: 952270 - DNA, 16 bp, Homo sapiens
tgggcgtctgactccc

SEQ ID NO: 952271 - DNA, 19 bp, Homo sapiens
tgggcgtctgactccctcc

SEQ ID NO: 952272 - DNA, 14 bp, Homo sapiens
tgggcgtgtgtgac

SEQ ID NO: 952273 - DNA, 18 bp, Homo sapiens
tgggcgtgtgtgacactg

SEQ ID NO: 952274 - DNA, 16 bp, Homo sapiens
tgggcgttgggagcct

SEQ ID NO: 952275 - DNA, 19 bp, Homo sapiens
tgggcgttgggagcctagc

SEQ ID NO: 952276 - DNA, 23 bp, Homo sapiens
tgggctaaacccagatggtttcc

SEQ ID NO: 952277 - DNA, 17 bp, Homo sapiens
tgggctaattaaataaa

SEQ ID NO: 952278 - DNA, 19 bp, Homo sapiens
tgggctacatgctggggtc

SEQ ID NO: 952279 - DNA, 14 bp, Homo sapiens
tgggctactggcag

SEQ ID NO: 952280 - DNA, 16 bp, Homo sapiens
tgggctactggcagct

SEQ ID NO: 952281 - DNA, 17 bp, Homo sapiens
tgggctactggcagctc

SEQ ID NO: 952282 - DNA, 21 bp, Homo sapiens
tgggctagtgtgagtggcagc

SEQ ID NO: 952283 - DNA, 18 bp, Homo sapiens
tgggctatggacacaggg

SEQ ID NO: 952284 - DNA, 22 bp, Homo sapiens
tgggctcaagcaatcctcctgc

SEQ ID NO: 952285 - DNA, 15 bp, Homo sapiens
tgggctcagggctgg

SEQ ID NO: 952286 - DNA, 20 bp, Homo sapiens
tgggctcagggttggccatt

SEQ ID NO: 952287 - DNA, 17 bp, Homo sapiens
tgggctccacgggcagg

SEQ ID NO: 952288 - DNA, 18 bp, Homo sapiens
tgggctccacgggcaggg

SEQ ID NO: 952289 - DNA, 13 bp, Homo sapiens
tgggctcccctct

SEQ ID NO: 952290 - DNA, 14 bp, Homo sapiens
tgggctcccctctt

SEQ ID NO: 952291 - DNA, 16 bp, Homo sapiens
tgggctcccctcttcc

SEQ ID NO: 952292 - DNA, 23 bp, Homo sapiens
tgggctcctccagggtgtgtgct

SEQ ID NO: 952293 - DNA, 13 bp, Homo sapiens
tgggctcctggct

SEQ ID NO: 952294 - DNA, 18 bp, Homo sapiens
tgggctcctggctgccag

SEQ ID NO: 952295 - DNA, 19 bp, Homo sapiens
tgggctcctggctgccagg

SEQ ID NO: 952296 - DNA, 15 bp, Homo sapiens
tgggctctacctctc

SEQ ID NO: 952297 - DNA, 16 bp, Homo sapiens
tgggctctccacctca

SEQ ID NO: 952298 - DNA, 17 bp, Homo sapiens
tgggctctccacctcag

SEQ ID NO: 952299 - DNA, 18 bp, Homo sapiens
tgggctctccacctcagc

SEQ ID NO: 952300 - DNA, 23 bp, Homo sapiens
tgggctctccacctcagccttgg

SEQ ID NO: 952301 - DNA, 13 bp, Homo sapiens
tgggctctccggg

SEQ ID NO: 952302 - DNA, 15 bp, Homo sapiens
tgggctctgccccag

SEQ ID NO: 952303 - DNA, 19 bp, Homo sapiens
tgggctctgccccagctct

SEQ ID NO: 952304 - DNA, 13 bp, Homo sapiens
tgggctctgcctg

SEQ ID NO: 952305 - DNA, 12 bp, Homo sapiens
tgggctctggaa

SEQ ID NO: 952306 - DNA, 19 bp, Homo sapiens
tgggctctggacctcagga

SEQ ID NO: 952307 - DNA, 14 bp, Homo sapiens
tgggctctggctct

SEQ ID NO: 952308 - DNA, 12 bp, Homo sapiens
tgggctctgtgc

SEQ ID NO: 952309 - DNA, 17 bp, Homo sapiens
tgggctctgtgcagtca

SEQ ID NO: 952310 - DNA, 13 bp, Homo sapiens
tgggctcttccaa

SEQ ID NO: 952311 - DNA, 12 bp, Homo sapiens
tgggctctttta

SEQ ID NO: 952312 - DNA, 19 bp, Homo sapiens
tgggctgacacctaccatg

SEQ ID NO: 952313 - DNA, 21 bp, Homo sapiens
tgggctgacacctaccatgct

SEQ ID NO: 952314 - DNA, 15 bp, Homo sapiens
tgggctgacccagca

SEQ ID NO: 952315 - DNA, 16 bp, Homo sapiens
tgggctgacccagcat

SEQ ID NO: 952316 - DNA, 18 bp, Homo sapiens
tgggctgacccagcatct

SEQ ID NO: 952317 - DNA, 23 bp, Homo sapiens
tgggctgagactggatactgccc

SEQ ID NO: 952318 - DNA, 17 bp, Homo sapiens
tgggctgagcccctacc

SEQ ID NO: 952319 - DNA, 18 bp, Homo sapiens
tgggctgagcccctaccc

SEQ ID NO: 952320 - DNA, 17 bp, Homo sapiens
tgggctgagcccctggt

SEQ ID NO: 952321 - DNA, 20 bp, Homo sapiens
tgggctgagcccctggtctt

SEQ ID NO: 952322 - DNA, 22 bp, Homo sapiens
tgggctgagcccctggtcttct

SEQ ID NO: 952323 - DNA, 16 bp, Homo sapiens
tgggctgagccctggc

SEQ ID NO: 952324 - DNA, 17 bp, Homo sapiens
tgggctgagccctggca

SEQ ID NO: 952325 - DNA, 11 bp, Homo sapiens
tgggctgaggg

SEQ ID NO: 952326 - DNA, 16 bp, Homo sapiens
tgggctgagggagcct

SEQ ID NO: 952327 - DNA, 16 bp, Homo sapiens
tgggctgagtgcagcc

SEQ ID NO: 952328 - DNA, 21 bp, Homo sapiens
tgggctgagtgcagccaaagg

SEQ ID NO: 952329 - DNA, 19 bp, Homo sapiens
tgggctgcacgctcccctc

SEQ ID NO: 952330 - DNA, 16 bp, Homo sapiens
tgggctgcagagtctg

SEQ ID NO: 952331 - DNA, 11 bp, Homo sapiens
tgggctgcagc

SEQ ID NO: 952332 - DNA, 16 bp, Homo sapiens
tgggctgcagcagccg

SEQ ID NO: 952333 - DNA, 16 bp, Homo sapiens
tgggctgccaccagcc

SEQ ID NO: 952334 - DNA, 17 bp, Homo sapiens
tgggctgccaccagccc

SEQ ID NO: 952335 - DNA, 16 bp, Homo sapiens
tgggctgccatgtgaa

SEQ ID NO: 952336 - DNA, 14 bp, Homo sapiens
tgggctgccctggt

SEQ ID NO: 952337 - DNA, 19 bp, Homo sapiens
tgggctgccctggtgctgc

SEQ ID NO: 952338 - DNA, 15 bp, Homo sapiens
tgggctgctcctcat

SEQ ID NO: 952339 - DNA, 16 bp, Homo sapiens
tgggctgctcctcatg

SEQ ID NO: 952340 - DNA, 17 bp, Homo sapiens
tgggctgctggccatga

SEQ ID NO: 952341 - DNA, 14 bp, Homo sapiens
tgggctggactgga

SEQ ID NO: 952342 - DNA, 15 bp, Homo sapiens
tgggctggactggcc

SEQ ID NO: 952343 - DNA, 19 bp, Homo sapiens
tgggctggcagtcctggaa

SEQ ID NO: 952344 - DNA, 14 bp, Homo sapiens
tgggctggcccagc

SEQ ID NO: 952345 - DNA, 19 bp, Homo sapiens
tgggctggcgcttggatct

SEQ ID NO: 952346 - DNA, 16 bp, Homo sapiens
tgggctgggacttctt

SEQ ID NO: 952347 - DNA, 16 bp, Homo sapiens
tgggctgggcagcctt

SEQ ID NO: 952348 - DNA, 17 bp, Homo sapiens
tgggctgggcagccttg

SEQ ID NO: 952349 - DNA, 22 bp, Homo sapiens
tgggctgggccctctcttctca

SEQ ID NO: 952350 - DNA, 17 bp, Homo sapiens
tgggctgggctgagccc

SEQ ID NO: 952351 - DNA, 15 bp, Homo sapiens
tgggctggggaggag

SEQ ID NO: 952352 - DNA, 17 bp, Homo sapiens
tgggctggggaggagga

SEQ ID NO: 952353 - DNA, 21 bp, Homo sapiens
tgggctggggaggaggagaga

SEQ ID NO: 952354 - DNA, 11 bp, Homo sapiens
tgggctggggc

SEQ ID NO: 952355 - DNA, 23 bp, Homo sapiens
tgggctggggcaggggcctgggc

SEQ ID NO: 952356 - DNA, 10 bp, Homo sapiens
gtctatttaa

SEQ ID NO: 952357 - DNA, 16 bp, Homo sapiens
gtctattttaaaataa

SEQ ID NO: 952358 - DNA, 18 bp, Homo sapiens
gtctattttgtctatagg

SEQ ID NO: 952359 - DNA, 19 bp, Homo sapiens
gtctcaaaaaaagaaaaag

SEQ ID NO: 952360 - DNA, 17 bp, Homo sapiens
gtctcaaaataaagcaa

SEQ ID NO: 952361 - DNA, 20 bp, Homo sapiens
gtctcaagagggcactggtg

SEQ ID NO: 952362 - DNA, 20 bp, Homo sapiens
gtctcaaggttctcatttct

SEQ ID NO: 952363 - DNA, 14 bp, Homo sapiens
gtctcaatgaaata

SEQ ID NO: 952364 - DNA, 21 bp, Homo sapiens
gtctcacccattatctggaat

SEQ ID NO: 952365 - DNA, 22 bp, Homo sapiens
gtctcacccattatctggaata

SEQ ID NO: 952366 - DNA, 18 bp, Homo sapiens
gtctcaccggctctcacc

SEQ ID NO: 952367 - DNA, 19 bp, Homo sapiens
gtctcaccggctctcacct

SEQ ID NO: 952368 - DNA, 19 bp, Homo sapiens
gtctcacctggacttaagc

SEQ ID NO: 952369 - DNA, 22 bp, Homo sapiens
gtctcacctggaggcaagaggg

SEQ ID NO: 952370 - DNA, 18 bp, Homo sapiens
gtctcactctgtcgctca

SEQ ID NO: 952371 - DNA, 15 bp, Homo sapiens
gtctcactgaaacat

SEQ ID NO: 952372 - DNA, 14 bp, Homo sapiens
gtctcactgtgtgt

SEQ ID NO: 952373 - DNA, 16 bp, Homo sapiens
gtctcactgttctgca

SEQ ID NO: 952374 - DNA, 22 bp, Homo sapiens
gtctcacttgtgcagtgttgac

SEQ ID NO: 952375 - DNA, 17 bp, Homo sapiens
gtctcagagaccagcac

SEQ ID NO: 952376 - DNA, 18 bp, Homo sapiens
gtctcagagaccagcact

SEQ ID NO: 952377 - DNA, 13 bp, Homo sapiens
gtctcagagcctt

SEQ ID NO: 952378 - DNA, 13 bp, Homo sapiens
gtctcagcctctg

SEQ ID NO: 952379 - DNA, 22 bp, Homo sapiens
gtctcagcctctgccagcgcca

SEQ ID NO: 952380 - DNA, 22 bp, Homo sapiens
gtctcagctgctgacacgcagc

SEQ ID NO: 952381 - DNA, 16 bp, Homo sapiens
gtctcaggcagcacca

SEQ ID NO: 952382 - DNA, 22 bp, Homo sapiens
gtctcaggtttgttttgtgaat

SEQ ID NO: 952383 - DNA, 14 bp, Homo sapiens
gtctcatagttgtg

SEQ ID NO: 952384 - DNA, 15 bp, Homo sapiens
gtctcatccatcatc

SEQ ID NO: 952385 - DNA, 16 bp, Homo sapiens
gtctcatccatcatca

SEQ ID NO: 952386 - DNA, 12 bp, Homo sapiens
gtctcatcccat

SEQ ID NO: 952387 - DNA, 14 bp, Homo sapiens
gtctcatccccagg

SEQ ID NO: 952388 - DNA, 19 bp, Homo sapiens
gtctcatcctcctttcagt

SEQ ID NO: 952389 - DNA, 12 bp, Homo sapiens
gtctcatctctt

SEQ ID NO: 952390 - DNA, 19 bp, Homo sapiens
gtctcattccgttgtctgt

SEQ ID NO: 952391 - DNA, 15 bp, Homo sapiens
gtctcattgcttctg

SEQ ID NO: 952392 - DNA, 23 bp, Homo sapiens
gtctccaagggagggtgcagccc

SEQ ID NO: 952393 - DNA, 18 bp, Homo sapiens
gtctccacctgagaccct

SEQ ID NO: 952394 - DNA, 15 bp, Homo sapiens
gtctccagaccccca

SEQ ID NO: 952395 - DNA, 17 bp, Homo sapiens
gtctccagacccccacc

SEQ ID NO: 952396 - DNA, 12 bp, Homo sapiens
gtctccagctgc

SEQ ID NO: 952397 - DNA, 13 bp, Homo sapiens
gtctccagctgcc

SEQ ID NO: 952398 - DNA, 14 bp, Homo sapiens
gtctccagctgcct

SEQ ID NO: 952399 - DNA, 20 bp, Homo sapiens
gtctccagggacccttgcct

SEQ ID NO: 952400 - DNA, 16 bp, Homo sapiens
gtctccaggggctgct

SEQ ID NO: 952401 - DNA, 19 bp, Homo sapiens
gtctccaggggctgcttcc

SEQ ID NO: 952402 - DNA, 21 bp, Homo sapiens
gtctccaggggctgcttcctc

SEQ ID NO: 952403 - DNA, 23 bp, Homo sapiens
gtctccaggggctgcttcctcct

SEQ ID NO: 952404 - DNA, 18 bp, Homo sapiens
gtctccagtggttgctgt

SEQ ID NO: 952405 - DNA, 19 bp, Homo sapiens
gtctccagtggttgctgtt

SEQ ID NO: 952406 - DNA, 21 bp, Homo sapiens
gtctccagttggttatctgaa

SEQ ID NO: 952407 - DNA, 22 bp, Homo sapiens
gtctccagttggttatctgaat

SEQ ID NO: 952408 - DNA, 23 bp, Homo sapiens
gtctccattgtgtgatccagccc

SEQ ID NO: 952409 - DNA, 16 bp, Homo sapiens
gtctcccaacatggga

SEQ ID NO: 952410 - DNA, 18 bp, Homo sapiens
gtctcccacacccaccct

SEQ ID NO: 952411 - DNA, 22 bp, Homo sapiens
gtctcccactgcaacttgtgaa

SEQ ID NO: 952412 - DNA, 23 bp, Homo sapiens
gtctcccactgcaacttgtgaac

SEQ ID NO: 952413 - DNA, 18 bp, Homo sapiens
gtctcccactttctgttc

SEQ ID NO: 952414 - DNA, 19 bp, Homo sapiens
gtctcccaggccccctgca

SEQ ID NO: 952415 - DNA, 23 bp, Homo sapiens
gtctcccaggctgctggagtgca

SEQ ID NO: 952416 - DNA, 14 bp, Homo sapiens
gtctcccaggctgg

SEQ ID NO: 952417 - DNA, 19 bp, Homo sapiens
gtctcccatatgcagaaat

SEQ ID NO: 952418 - DNA, 13 bp, Homo sapiens
gtctcccatcctg

SEQ ID NO: 952419 - DNA, 15 bp, Homo sapiens
gtctcccatcctgat

SEQ ID NO: 952420 - DNA, 13 bp, Homo sapiens
gtctccccactcc

SEQ ID NO: 952421 - DNA, 21 bp, Homo sapiens
gtctcccccagagtgctgtcg

SEQ ID NO: 952422 - DNA, 21 bp, Homo sapiens
gtctcccccgtgttcccctct

SEQ ID NO: 952423 - DNA, 23 bp, Homo sapiens
gtctcccccgtgttcccctcttg

SEQ ID NO: 952424 - DNA, 15 bp, Homo sapiens
gtctcccctcctgca

SEQ ID NO: 952425 - DNA, 23 bp, Homo sapiens
gtctcccctgttcccctctccct

SEQ ID NO: 952426 - DNA, 23 bp, Homo sapiens
gtctccctccccaaatggctgct

SEQ ID NO: 952427 - DNA, 16 bp, Homo sapiens
gtctccctctcctgcc

SEQ ID NO: 952428 - DNA, 21 bp, Homo sapiens
gtctccctctcctgcctactc

SEQ ID NO: 952429 - DNA, 19 bp, Homo sapiens
gtctccctgatggaccctc

SEQ ID NO: 952430 - DNA, 16 bp, Homo sapiens
gtctccctggagtgca

SEQ ID NO: 952431 - DNA, 14 bp, Homo sapiens
gtctccctggtgcc

SEQ ID NO: 952432 - DNA, 21 bp, Homo sapiens
gtctccctggtgcctctgtgc

SEQ ID NO: 952433 - DNA, 19 bp, Homo sapiens
gtctccctggttgcctctc

SEQ ID NO: 952434 - DNA, 15 bp, Homo sapiens
gtctccctgtgttac

SEQ ID NO: 952435 - DNA, 20 bp, Homo sapiens
gtctcccttccgtccatccc

SEQ ID NO: 952436 - DNA, 18 bp, Homo sapiens
gtctccctttcccttctt

SEQ ID NO: 952437 - DNA, 15 bp, Homo sapiens
gtctcctactctgtg

SEQ ID NO: 952438 - DNA, 17 bp, Homo sapiens
gtctcctactctgtgta

SEQ ID NO: 952439 - DNA, 14 bp, Homo sapiens
gtctcctatcctgg

SEQ ID NO: 952440 - DNA, 23 bp, Homo sapiens
gtctcctcaagcctgtgggcagc

SEQ ID NO: 952441 - DNA, 14 bp, Homo sapiens
gtctcctcactctg

SEQ ID NO: 952442 - DNA, 19 bp, Homo sapiens
gtctcctcactctgtccct

SEQ ID NO: 952443 - DNA, 22 bp, Homo sapiens
gtctcctcagggtggggggtga

SEQ ID NO: 952444 - DNA, 23 bp, Homo sapiens
gtctcctcccagcggcctccggc

SEQ ID NO: 952445 - DNA, 16 bp, Homo sapiens
gtctcctctccatttt

SEQ ID NO: 952446 - DNA, 23 bp, Homo sapiens
gtctcctcttaaaaaataaaaac

SEQ ID NO: 952447 - DNA, 22 bp, Homo sapiens
gtctcctgtgcccacatcccag

SEQ ID NO: 952448 - DNA, 20 bp, Homo sapiens
gtctccttactctgagccca

SEQ ID NO: 952449 - DNA, 13 bp, Homo sapiens
gtctcctttctga

SEQ ID NO: 952450 - DNA, 15 bp, Homo sapiens
gtctcctttgcactg

SEQ ID NO: 952451 - DNA, 20 bp, Homo sapiens
gtctcctttgcactgagggc

SEQ ID NO: 952452 - DNA, 22 bp, Homo sapiens
gtctcctttgcactgagggcca

SEQ ID NO: 952453 - DNA, 18 bp, Homo sapiens
gtctcgaatgtaattgga

SEQ ID NO: 952454 - DNA, 15 bp, Homo sapiens
gtctcgatctcctga

SEQ ID NO: 952455 - DNA, 15 bp, Homo sapiens
gtctcgatgcctgat

SEQ ID NO: 952456 - DNA, 22 bp, Homo sapiens
gtctcgcagcctgaagcctgga

SEQ ID NO: 952457 - DNA, 23 bp, Homo sapiens
gtctcgcagcctgaagcctggat

SEQ ID NO: 952458 - DNA, 17 bp, Homo sapiens
gtctcgcgcgactgaga

SEQ ID NO: 952459 - DNA, 22 bp, Homo sapiens
gtctcggatgacaccctggcct

SEQ ID NO: 952460 - DNA, 16 bp, Homo sapiens
gtctcggcccctctga

SEQ ID NO: 952461 - DNA, 19 bp, Homo sapiens
gtctcggcccctctgattg

SEQ ID NO: 952462 - DNA, 13 bp, Homo sapiens
gtctcggccctga

SEQ ID NO: 952463 - DNA, 19 bp, Homo sapiens
gtctcgtgtcagtaattta

SEQ ID NO: 952464 - DNA, 14 bp, Homo sapiens
gtctcgttcctgtt

SEQ ID NO: 952465 - DNA, 19 bp, Homo sapiens
gtctctagagggttgctgc

SEQ ID NO: 952466 - DNA, 16 bp, Homo sapiens
gtctctagtgctgtga

SEQ ID NO: 952467 - DNA, 17 bp, Homo sapiens
gtctctagtgctgtgaa

SEQ ID NO: 952468 - DNA, 22 bp, Homo sapiens
tggggatagtccttcctggcat

SEQ ID NO: 952469 - DNA, 14 bp, Homo sapiens
tggggatctcaggg

SEQ ID NO: 952470 - DNA, 18 bp, Homo sapiens
tggggatctcaggggctg

SEQ ID NO: 952471 - DNA, 14 bp, Homo sapiens
tggggatctggggg

SEQ ID NO: 952472 - DNA, 19 bp, Homo sapiens
tggggatggtggcacaggc

SEQ ID NO: 952473 - DNA, 21 bp, Homo sapiens
tggggatggtggcacaggcac

SEQ ID NO: 952474 - DNA, 19 bp, Homo sapiens
tggggatgtaaccaagctg

SEQ ID NO: 952475 - DNA, 15 bp, Homo sapiens
tggggatgtgggagg

SEQ ID NO: 952476 - DNA, 19 bp, Homo sapiens
tggggcaacgacggtttca

SEQ ID NO: 952477 - DNA, 20 bp, Homo sapiens
tggggcaagacagaaaagtg

SEQ ID NO: 952478 - DNA, 19 bp, Homo sapiens
tggggcaagccagggccca

SEQ ID NO: 952479 - DNA, 22 bp, Homo sapiens
tggggcaagccagggcccagag

SEQ ID NO: 952480 - DNA, 23 bp, Homo sapiens
tggggcaagccagggcccagagc

SEQ ID NO: 952481 - DNA, 19 bp, Homo sapiens
tggggcaagtccctgactc

SEQ ID NO: 952482 - DNA, 22 bp, Homo sapiens
gtctctcgtagtgttaagttat

SEQ ID NO: 952483 - DNA, 15 bp, Homo sapiens
gtctctctccctacc

SEQ ID NO: 952484 - DNA, 16 bp, Homo sapiens
gtctctctccctacct

SEQ ID NO: 952485 - DNA, 22 bp, Homo sapiens
gtctctctccctacctccctcc

SEQ ID NO: 952486 - DNA, 15 bp, Homo sapiens
gtctctctccctctg

SEQ ID NO: 952487 - DNA, 23 bp, Homo sapiens
gtctctctccctctgtcttttct

SEQ ID NO: 952488 - DNA, 15 bp, Homo sapiens
gtctctctctctcta

SEQ ID NO: 952489 - DNA, 19 bp, Homo sapiens
gtctctctctctctacaaa

SEQ ID NO: 952490 - DNA, 14 bp, Homo sapiens
gtctctcttctctc

SEQ ID NO: 952491 - DNA, 19 bp, Homo sapiens
gtctctcttctctccagct

SEQ ID NO: 952492 - DNA, 12 bp, Homo sapiens
gtctctctttct

SEQ ID NO: 952493 - DNA, 17 bp, Homo sapiens
gtctctctttctccctc

SEQ ID NO: 952494 - DNA, 19 bp, Homo sapiens
gtctctctttctccctcac

SEQ ID NO: 952495 - DNA, 20 bp, Homo sapiens
gtctctctttctccctcacc

SEQ ID NO: 952496 - DNA, 19 bp, Homo sapiens
gtctctgaggggctaccag

SEQ ID NO: 952497 - DNA, 15 bp, Homo sapiens
gtctctgccacccac

SEQ ID NO: 952498 - DNA, 22 bp, Homo sapiens
gtctctgccacccactcaggat

SEQ ID NO: 952499 - DNA, 17 bp, Homo sapiens
gtctctgccggctcttt

SEQ ID NO: 952500 - DNA, 12 bp, Homo sapiens
gtctctgctgaa

SEQ ID NO: 952501 - DNA, 13 bp, Homo sapiens
gtctctgctggcc

SEQ ID NO: 952502 - DNA, 16 bp, Homo sapiens
gtctctgctggcccag

SEQ ID NO: 952503 - DNA, 13 bp, Homo sapiens
gtctctgcttcca

SEQ ID NO: 952504 - DNA, 19 bp, Homo sapiens
gtctctgctttccttttct

SEQ ID NO: 952505 - DNA, 11 bp, Homo sapiens
gtctctggagt

SEQ ID NO: 952506 - DNA, 22 bp, Homo sapiens
gtctctggagtgatggtgtcct

SEQ ID NO: 952507 - DNA, 13 bp, Homo sapiens
gtctctgggcctg

SEQ ID NO: 952508 - DNA, 14 bp, Homo sapiens
gtctctgggcctgt

SEQ ID NO: 952509 - DNA, 13 bp, Homo sapiens
gtctctgggctga

SEQ ID NO: 952510 - DNA, 23 bp, Homo sapiens
gtctctgtcccggttcaccttgc

SEQ ID NO: 952511 - DNA, 19 bp, Homo sapiens
gtctctgtcgtggacacgc

SEQ ID NO: 952512 - DNA, 18 bp, Homo sapiens
gtctctgtcgtggagcca

SEQ ID NO: 952513 - DNA, 20 bp, Homo sapiens
gtctctgtcgtggagccatt

SEQ ID NO: 952514 - DNA, 16 bp, Homo sapiens
gtctctgttcagatgt

SEQ ID NO: 952515 - DNA, 21 bp, Homo sapiens
gtctctgttcagatgtgcatt

SEQ ID NO: 952516 - DNA, 21 bp, Homo sapiens
gtctctgttggtccactgtgt

SEQ ID NO: 952517 - DNA, 14 bp, Homo sapiens
gtctctgtttcctg

SEQ ID NO: 952518 - DNA, 17 bp, Homo sapiens
gtctcttaaaaaaataa

SEQ ID NO: 952519 - DNA, 11 bp, Homo sapiens
gtctcttccac

SEQ ID NO: 952520 - DNA, 17 bp, Homo sapiens
gtctcttcctctgttct

SEQ ID NO: 952521 - DNA, 15 bp, Homo sapiens
gtctcttctccactg

SEQ ID NO: 952522 - DNA, 16 bp, Homo sapiens
gtctcttctccactgg

SEQ ID NO: 952523 - DNA, 17 bp, Homo sapiens
gtctcttctccactgga

SEQ ID NO: 952524 - DNA, 16 bp, Homo sapiens
gtctcttgagcatcaa

SEQ ID NO: 952525 - DNA, 24 bp, Homo sapiens
gtctcttgagcatcaatcttgtta

SEQ ID NO: 952526 - DNA, 14 bp, Homo sapiens
gtctcttgtagaag

SEQ ID NO: 952527 - DNA, 20 bp, Homo sapiens
gtctcttgtagaagatggac

SEQ ID NO: 952528 - DNA, 16 bp, Homo sapiens
gtctcttgtattaaac

SEQ ID NO: 952529 - DNA, 23 bp, Homo sapiens
gtctcttgtgactcagcagaggc

SEQ ID NO: 952530 - DNA, 11 bp, Homo sapiens
gtctcttgttt

SEQ ID NO: 952531 - DNA, 14 bp, Homo sapiens
gtctctttccactt

SEQ ID NO: 952532 - DNA, 14 bp, Homo sapiens
gtctctttcttcct

SEQ ID NO: 952533 - DNA, 15 bp, Homo sapiens
gtctctttcttcctt

SEQ ID NO: 952534 - DNA, 21 bp, Homo sapiens
gtctctttgctttctggtggt

SEQ ID NO: 952535 - DNA, 13 bp, Homo sapiens
gtctcttttctct

SEQ ID NO: 952536 - DNA, 22 bp, Homo sapiens
gtctgaaaggctatcctgctga

SEQ ID NO: 952537 - DNA, 13 bp, Homo sapiens
gtctgaaattttt

SEQ ID NO: 952538 - DNA, 15 bp, Homo sapiens
gtctgaacagctgta

SEQ ID NO: 952539 - DNA, 15 bp, Homo sapiens
gtctgaacatagaaa

SEQ ID NO: 952540 - DNA, 20 bp, Homo sapiens
gtctgaaggaatagccagag

SEQ ID NO: 952541 - DNA, 21 bp, Homo sapiens
gtctgaagtgcctactggggg

SEQ ID NO: 952542 - DNA, 14 bp, Homo sapiens
gtctgaatgttctg

SEQ ID NO: 952543 - DNA, 18 bp, Homo sapiens
gtctgaatgttctgacat

SEQ ID NO: 952544 - DNA, 13 bp, Homo sapiens
gtctgaatttatt

SEQ ID NO: 952545 - DNA, 14 bp, Homo sapiens
gtctgaatttattt

SEQ ID NO: 952546 - DNA, 23 bp, Homo sapiens
gtctgacacgcaagtgtgtgagt

SEQ ID NO: 952547 - DNA, 13 bp, Homo sapiens
gtctgaccctctg

SEQ ID NO: 952548 - DNA, 15 bp, Homo sapiens
gtctgaccctctgcg

SEQ ID NO: 952549 - DNA, 14 bp, Homo sapiens
gtctgactccagag

SEQ ID NO: 952550 - DNA, 22 bp, Homo sapiens
gtctgactccagagtctgagcc

SEQ ID NO: 952551 - DNA, 21 bp, Homo sapiens
gtctgagactcacaggaagga

SEQ ID NO: 952552 - DNA, 22 bp, Homo sapiens
gtctgagcaccccctcattccc

SEQ ID NO: 952553 - DNA, 12 bp, Homo sapiens
gtctgagccccc

SEQ ID NO: 952554 - DNA, 16 bp, Homo sapiens
gtctgagcccccggct

SEQ ID NO: 952555 - DNA, 15 bp, Homo sapiens
gtctgagccctggtg

SEQ ID NO: 952556 - DNA, 13 bp, Homo sapiens
gtctgaggactgt

SEQ ID NO: 952557 - DNA, 15 bp, Homo sapiens
gtctgaggactgtcc

SEQ ID NO: 952558 - DNA, 20 bp, Homo sapiens
gtctgaggactgtcctccca

SEQ ID NO: 952559 - DNA, 21 bp, Homo sapiens
gtctgaggagtaagtgtacaa

SEQ ID NO: 952560 - DNA, 14 bp, Homo sapiens
gtctgaggcctcat

SEQ ID NO: 952561 - DNA, 19 bp, Homo sapiens
gtctgaggcctgccccctg

SEQ ID NO: 952562 - DNA, 22 bp, Homo sapiens
gtctgaggcctgccccctgggc

SEQ ID NO: 952563 - DNA, 16 bp, Homo sapiens
gtctgatattaatcaa

SEQ ID NO: 952564 - DNA, 14 bp, Homo sapiens
gtctgatattcaaa

SEQ ID NO: 952565 - DNA, 21 bp, Homo sapiens
gtctgcaaaatgaggaatgta

SEQ ID NO: 952566 - DNA, 18 bp, Homo sapiens
gtctgcaagggcccagag

SEQ ID NO: 952567 - DNA, 20 bp, Homo sapiens
gtctgcaagggcccagagtg

SEQ ID NO: 952568 - DNA, 20 bp, Homo sapiens
gtctgcacaccttgaatctg

SEQ ID NO: 952569 - DNA, 15 bp, Homo sapiens
gtctgcacagagggt

SEQ ID NO: 952570 - DNA, 16 bp, Homo sapiens
gtctgcacatgcagct

SEQ ID NO: 952571 - DNA, 15 bp, Homo sapiens
gtctgcacccagggg

SEQ ID NO: 952572 - DNA, 17 bp, Homo sapiens
gtctgcacccaggggtg

SEQ ID NO: 952573 - DNA, 14 bp, Homo sapiens
gtctgcagcctgct

SEQ ID NO: 952574 - DNA, 16 bp, Homo sapiens
gtctgcagcctgctgg

SEQ ID NO: 952575 - DNA, 19 bp, Homo sapiens
gtctgcagcctgctggggc

SEQ ID NO: 952576 - DNA, 15 bp, Homo sapiens
gtctgcaggggcctg

SEQ ID NO: 952577 - DNA, 23 bp, Homo sapiens
gtctgcagggtgacgcctgagac

SEQ ID NO: 952578 - DNA, 21 bp, Homo sapiens
gtctgcatttcggtggctagt

SEQ ID NO: 952579 - DNA, 14 bp, Homo sapiens
gtctgccaaacaca

SEQ ID NO: 952580 - DNA, 14 bp, Homo sapiens
gtctgccaggcact

SEQ ID NO: 952581 - DNA, 15 bp, Homo sapiens
gtctgccaggcactc

SEQ ID NO: 952582 - DNA, 16 bp, Homo sapiens
gtctgccaggcactct

SEQ ID NO: 952583 - DNA, 13 bp, Homo sapiens
gtctgccaggccc

SEQ ID NO: 952584 - DNA, 22 bp, Homo sapiens
gtctgccaggcccatctcaggt

SEQ ID NO: 952585 - DNA, 16 bp, Homo sapiens
gtctgccatgttgccc

SEQ ID NO: 952586 - DNA, 19 bp, Homo sapiens
gtctgcccacgcagaggac

SEQ ID NO: 952587 - DNA, 14 bp, Homo sapiens
gtctgccccaccct

SEQ ID NO: 952588 - DNA, 20 bp, Homo sapiens
gtctgcccctcggggtgtca

SEQ ID NO: 952589 - DNA, 12 bp, Homo sapiens
gtctgccctgcc

SEQ ID NO: 952590 - DNA, 14 bp, Homo sapiens
tgggggcagggctg

SEQ ID NO: 952591 - DNA, 18 bp, Homo sapiens
tgggggcagtgactggca

SEQ ID NO: 952592 - DNA, 23 bp, Homo sapiens
tgggggcatctcttccccagaga

SEQ ID NO: 952593 - DNA, 17 bp, Homo sapiens
tgggggccagggctgga

SEQ ID NO: 952594 - DNA, 18 bp, Homo sapiens
tgggggccagggctggat

SEQ ID NO: 952595 - DNA, 20 bp, Homo sapiens
tgggggcccgacaggtgggc

SEQ ID NO: 952596 - DNA, 12 bp, Homo sapiens
tgggggcctcct

SEQ ID NO: 952597 - DNA, 13 bp, Homo sapiens
tgggggcctcctc

SEQ ID NO: 952598 - DNA, 14 bp, Homo sapiens
tgggggcctggatt

SEQ ID NO: 952599 - DNA, 22 bp, Homo sapiens
tgggggcgccctctctgctcct

SEQ ID NO: 952600 - DNA, 17 bp, Homo sapiens
tgggggctcggggaggc

SEQ ID NO: 952601 - DNA, 14 bp, Homo sapiens
tgggggctgcagca

SEQ ID NO: 952602 - DNA, 14 bp, Homo sapiens
tgggggctggcctc

SEQ ID NO: 952603 - DNA, 16 bp, Homo sapiens
tgggggctggtgccag

SEQ ID NO: 952604 - DNA, 20 bp, Homo sapiens
tgggggctgtctttgcaggg

SEQ ID NO: 952605 - DNA, 13 bp, Homo sapiens
tgggggctgtggc

SEQ ID NO: 952606 - DNA, 16 bp, Homo sapiens
tgggggctgtggccct

SEQ ID NO: 952607 - DNA, 20 bp, Homo sapiens
tgggggctgtggccctgccc

SEQ ID NO: 952608 - DNA, 15 bp, Homo sapiens
tgggggcttcttcct

SEQ ID NO: 952609 - DNA, 16 bp, Homo sapiens
tgggggcttcttcctc

SEQ ID NO: 952610 - DNA, 19 bp, Homo sapiens
tgggggctttccttttatt

SEQ ID NO: 952611 - DNA, 16 bp, Homo sapiens
gtctggacctccatcc

SEQ ID NO: 952612 - DNA, 17 bp, Homo sapiens
gtctggactgacagcat

SEQ ID NO: 952613 - DNA, 23 bp, Homo sapiens
gtctggagaagctcccaggaaca

SEQ ID NO: 952614 - DNA, 22 bp, Homo sapiens
gtctggatcccgaggtatggca

SEQ ID NO: 952615 - DNA, 13 bp, Homo sapiens
gtctggatgggag

SEQ ID NO: 952616 - DNA, 14 bp, Homo sapiens
gtctggcagagcct

SEQ ID NO: 952617 - DNA, 19 bp, Homo sapiens
gtctggcagagcctctgag

SEQ ID NO: 952618 - DNA, 22 bp, Homo sapiens
gtctggcagcctcccatccagg

SEQ ID NO: 952619 - DNA, 19 bp, Homo sapiens
gtctggcagtttatattta

SEQ ID NO: 952620 - DNA, 11 bp, Homo sapiens
gtctggcctca

SEQ ID NO: 952621 - DNA, 13 bp, Homo sapiens
gtctggcctcacg

SEQ ID NO: 952622 - DNA, 23 bp, Homo sapiens
gtctggctccctgccccttaacc

SEQ ID NO: 952623 - DNA, 21 bp, Homo sapiens
gtctggctcggacccacccca

SEQ ID NO: 952624 - DNA, 19 bp, Homo sapiens
gtctggctgtgtggccaag

SEQ ID NO: 952625 - DNA, 14 bp, Homo sapiens
gtctgggacacaaa

SEQ ID NO: 952626 - DNA, 21 bp, Homo sapiens
gtctgggagagcctggcaagg

SEQ ID NO: 952627 - DNA, 22 bp, Homo sapiens
gtctgggagagcctggcaaggc

SEQ ID NO: 952628 - DNA, 13 bp, Homo sapiens
gtctgggaggggg

SEQ ID NO: 952629 - DNA, 17 bp, Homo sapiens
gtctgggattaagggca

SEQ ID NO: 952630 - DNA, 20 bp, Homo sapiens
gtctgggcaagtagcaggac

SEQ ID NO: 952631 - DNA, 18 bp, Homo sapiens
gtctgggctgggcacctg

SEQ ID NO: 952632 - DNA, 22 bp, Homo sapiens
gtctggggagaaatccctcaga

SEQ ID NO: 952633 - DNA, 10 bp, Homo sapiens
gtctggggct

SEQ ID NO: 952634 - DNA, 18 bp, Homo sapiens
gtctgggtccaggcctgg

SEQ ID NO: 952635 - DNA, 19 bp, Homo sapiens
gtctgggtgtccgccatcc

SEQ ID NO: 952636 - DNA, 17 bp, Homo sapiens
gtctgggtttggcccaa

SEQ ID NO: 952637 - DNA, 19 bp, Homo sapiens
gtctggtgaggtggcccag

SEQ ID NO: 952638 - DNA, 22 bp, Homo sapiens
gtctggtgaggtggcccaggcc

SEQ ID NO: 952639 - DNA, 13 bp, Homo sapiens
gtctggtttctag

SEQ ID NO: 952640 - DNA, 16 bp, Homo sapiens
gtctggttttaacaat

SEQ ID NO: 952641 - DNA, 19 bp, Homo sapiens
gtctgtaaaaaatggagct

SEQ ID NO: 952642 - DNA, 23 bp, Homo sapiens
gtctgtaaaaaatggagctcagt

SEQ ID NO: 952643 - DNA, 18 bp, Homo sapiens
gtctgtaaaatacatgta

SEQ ID NO: 952644 - DNA, 17 bp, Homo sapiens
gtctgtaactgcccagc

SEQ ID NO: 952645 - DNA, 22 bp, Homo sapiens
gtctgtaactttccactcttcc

SEQ ID NO: 952646 - DNA, 15 bp, Homo sapiens
gtctgtacatactgg

SEQ ID NO: 952647 - DNA, 18 bp, Homo sapiens
gtctgtacatactggcct

SEQ ID NO: 952648 - DNA, 21 bp, Homo sapiens
gtctgtacatactggcctctg

SEQ ID NO: 952649 - DNA, 21 bp, Homo sapiens
gtctgtagggagtgaagccac

SEQ ID NO: 952650 - DNA, 22 bp, Homo sapiens
gtctgtaggtgtctctgggcct

SEQ ID NO: 952651 - DNA, 23 bp, Homo sapiens
gtctgtatttatgtgtgaggagc

SEQ ID NO: 952652 - DNA, 20 bp, Homo sapiens
gtctgtatttcatgtggctg

SEQ ID NO: 952653 - DNA, 15 bp, Homo sapiens
gtctgtcacaggctg

SEQ ID NO: 952654 - DNA, 14 bp, Homo sapiens
gtctgtcagctgtg

SEQ ID NO: 952655 - DNA, 17 bp, Homo sapiens
gtctgtcatcctctgga

SEQ ID NO: 952656 - DNA, 15 bp, Homo sapiens
gtctgtccaggccct

SEQ ID NO: 952657 - DNA, 13 bp, Homo sapiens
gtctgtcctaccc

SEQ ID NO: 952658 - DNA, 21 bp, Homo sapiens
gtctgtcctcacgccccctgt

SEQ ID NO: 952659 - DNA, 13 bp, Homo sapiens
gtctgtcctcaga

SEQ ID NO: 952660 - DNA, 15 bp, Homo sapiens
gtctgtcgcccttct

SEQ ID NO: 952661 - DNA, 17 bp, Homo sapiens
gtctgtctactgtggtg

SEQ ID NO: 952662 - DNA, 24 bp, Homo sapiens
gtctgtctccctcccctctcagaa

SEQ ID NO: 952663 - DNA, 18 bp, Homo sapiens
gtctgtctcgatgcctga

SEQ ID NO: 952664 - DNA, 14 bp, Homo sapiens
gtctgtctgctttg

SEQ ID NO: 952665 - DNA, 16 bp, Homo sapiens
gtctgtctgtcgccct

SEQ ID NO: 952666 - DNA, 13 bp, Homo sapiens
gtctgtgactgga

SEQ ID NO: 952667 - DNA, 14 bp, Homo sapiens
gtctgtgactggat

SEQ ID NO: 952668 - DNA, 15 bp, Homo sapiens
gtctgtgccatggat

SEQ ID NO: 952669 - DNA, 12 bp, Homo sapiens
gtctgtgctagg

SEQ ID NO: 952670 - DNA, 14 bp, Homo sapiens
gtctgtgctgtgcc

SEQ ID NO: 952671 - DNA, 20 bp, Homo sapiens
gtctgtggagatggactcag

SEQ ID NO: 952672 - DNA, 22 bp, Homo sapiens
gtctgtggagatggactcagga

SEQ ID NO: 952673 - DNA, 13 bp, Homo sapiens
gtctgtggatttt

SEQ ID NO: 952674 - DNA, 17 bp, Homo sapiens
gtctgtgggcttcagca

SEQ ID NO: 952675 - DNA, 18 bp, Homo sapiens
gtctgtgggcttcagcac

SEQ ID NO: 952676 - DNA, 16 bp, Homo sapiens
gtctgtgtgaatgtgg

SEQ ID NO: 952677 - DNA, 15 bp, Homo sapiens
gtctgtgtgctgttt

SEQ ID NO: 952678 - DNA, 15 bp, Homo sapiens
gtctgtgtggtggga

SEQ ID NO: 952679 - DNA, 14 bp, Homo sapiens
gtctgtgtgtgtgt

SEQ ID NO: 952680 - DNA, 16 bp, Homo sapiens
gtctgtgttgcttcaa

SEQ ID NO: 952681 - DNA, 17 bp, Homo sapiens
gtctgtgttttgaaaga

SEQ ID NO: 952682 - DNA, 16 bp, Homo sapiens
gtctgttatgctgtga

SEQ ID NO: 952683 - DNA, 15 bp, Homo sapiens
gtctgttatttatta

SEQ ID NO: 952684 - DNA, 18 bp, Homo sapiens
gtctgttatttattatta

SEQ ID NO: 952685 - DNA, 21 bp, Homo sapiens
gtctgttcagcaaactaacca

SEQ ID NO: 952686 - DNA, 15 bp, Homo sapiens
gtctgttcttgaagc

SEQ ID NO: 952687 - DNA, 14 bp, Homo sapiens
gtctgttctttcca

SEQ ID NO: 952688 - DNA, 20 bp, Homo sapiens
gtctgtttcaatgacctgta

SEQ ID NO: 952689 - DNA, 19 bp, Homo sapiens
gtctgtttgtctgaacaaa

SEQ ID NO: 952690 - DNA, 19 bp, Homo sapiens
gtctgttttagttggaatg

SEQ ID NO: 952691 - DNA, 16 bp, Homo sapiens
gtctgtttttgtatct

SEQ ID NO: 952692 - DNA, 16 bp, Homo sapiens
gtcttaaaaaatgtga

SEQ ID NO: 952693 - DNA, 21 bp, Homo sapiens
gtcttaaaaagtggaaaaata

SEQ ID NO: 952694 - DNA, 18 bp, Homo sapiens
gtcttaaaaatttataca

SEQ ID NO: 952695 - DNA, 14 bp, Homo sapiens
gtcttaaaaccaga

SEQ ID NO: 952696 - DNA, 21 bp, Homo sapiens
gtcttaaaaccagagaatctt

SEQ ID NO: 952697 - DNA, 22 bp, Homo sapiens
gtcttaaataaaactatttaaa

SEQ ID NO: 952698 - DNA, 21 bp, Homo sapiens
gtcttaatggtatcctactga

SEQ ID NO: 952699 - DNA, 24 bp, Homo sapiens
gtcttaatggtatcctactgagca

SEQ ID NO: 952700 - DNA, 13 bp, Homo sapiens
gtcttaatgttga

SEQ ID NO: 952701 - DNA, 19 bp, Homo sapiens
gtcttaattattatttgtg

SEQ ID NO: 952702 - DNA, 21 bp, Homo sapiens
gtcttaattattatttgtgtt

SEQ ID NO: 952703 - DNA, 19 bp, Homo sapiens
gtcttactctgtctcccag

SEQ ID NO: 952704 - DNA, 23 bp, Homo sapiens
gtcttactctgtctcccaggctg

SEQ ID NO: 952705 - DNA, 19 bp, Homo sapiens
gtcttagaagtggaccagg

SEQ ID NO: 952706 - DNA, 20 bp, Homo sapiens
gtcttagaagtggaccagga

SEQ ID NO: 952707 - DNA, 23 bp, Homo sapiens
gtcttagacttgaaatactactt

SEQ ID NO: 952708 - DNA, 24 bp, Homo sapiens
gtcttagacttgaaatactactta

SEQ ID NO: 952709 - DNA, 15 bp, Homo sapiens
gtcttagatgtatat

SEQ ID NO: 952710 - DNA, 15 bp, Homo sapiens
gtcttagttgatatt

SEQ ID NO: 952711 - DNA, 13 bp, Homo sapiens
tgggtattaaact

SEQ ID NO: 952712 - DNA, 22 bp, Homo sapiens
tgggtattaaacttgtcagaat

SEQ ID NO: 952713 - DNA, 18 bp, Homo sapiens
tgggtattttataatgtt

SEQ ID NO: 952714 - DNA, 18 bp, Homo sapiens
tgggtcaaggacagggct

SEQ ID NO: 952715 - DNA, 19 bp, Homo sapiens
tgggtcaaggacagggctg

SEQ ID NO: 952716 - DNA, 14 bp, Homo sapiens
tgggtcacacacac

SEQ ID NO: 952717 - DNA, 15 bp, Homo sapiens
tgggtcagggccaga

SEQ ID NO: 952718 - DNA, 23 bp, Homo sapiens
tgggtcagggccagactggaaga

SEQ ID NO: 952719 - DNA, 21 bp, Homo sapiens
tgggtcagggggagtctttgc

SEQ ID NO: 952720 - DNA, 13 bp, Homo sapiens
tgggtcaggttct

SEQ ID NO: 952721 - DNA, 18 bp, Homo sapiens
tgggtcaggttcttgcct

SEQ ID NO: 952722 - DNA, 16 bp, Homo sapiens
tgggtcatagaaattc

SEQ ID NO: 952723 - DNA, 19 bp, Homo sapiens
tgggtccaggaaggcagct

SEQ ID NO: 952724 - DNA, 21 bp, Homo sapiens
tgggtccaggaaggcagctgc

SEQ ID NO: 952725 - DNA, 23 bp, Homo sapiens
tgggtccaggaaggcagctgctc

SEQ ID NO: 952726 - DNA, 14 bp, Homo sapiens
tgggtccagggcct

SEQ ID NO: 952727 - DNA, 22 bp, Homo sapiens
tgggtccagggcctgacacccc

SEQ ID NO: 952728 - DNA, 17 bp, Homo sapiens
tgggtccatgggcagag

SEQ ID NO: 952729 - DNA, 14 bp, Homo sapiens
tgggtcccagcctg

SEQ ID NO: 952730 - DNA, 20 bp, Homo sapiens
tgggtccctcggagctgcca

SEQ ID NO: 952731 - DNA, 17 bp, Homo sapiens
tgggtccctgctcccct

SEQ ID NO: 952732 - DNA, 20 bp, Homo sapiens
tgggtcctagcccttccctg

SEQ ID NO: 952733 - DNA, 14 bp, Homo sapiens
tgggtcctgggcag

SEQ ID NO: 952734 - DNA, 15 bp, Homo sapiens
tgggtcctgggcagg

SEQ ID NO: 952735 - DNA, 19 bp, Homo sapiens
tgggtccttgatgccagag

SEQ ID NO: 952736 - DNA, 22 bp, Homo sapiens
tgggtccttggctcccgggggc

SEQ ID NO: 952737 - DNA, 13 bp, Homo sapiens
gtcttccaaggag

SEQ ID NO: 952738 - DNA, 19 bp, Homo sapiens
gtcttccacaaagaaaatt

SEQ ID NO: 952739 - DNA, 15 bp, Homo sapiens
gtcttccatttgcaa

SEQ ID NO: 952740 - DNA, 21 bp, Homo sapiens
gtcttcccagcggttcctgtg

SEQ ID NO: 952741 - DNA, 15 bp, Homo sapiens
gtcttcccccctctc

SEQ ID NO: 952742 - DNA, 21 bp, Homo sapiens
gtcttcccccctctcctccca

SEQ ID NO: 952743 - DNA, 22 bp, Homo sapiens
gtcttcccccctctcctcccag

SEQ ID NO: 952744 - DNA, 23 bp, Homo sapiens
gtcttcccccctctcctcccagc

SEQ ID NO: 952745 - DNA, 14 bp, Homo sapiens
gtcttcccctgaga

SEQ ID NO: 952746 - DNA, 15 bp, Homo sapiens
gtcttccctacctca

SEQ ID NO: 952747 - DNA, 13 bp, Homo sapiens
gtcttccctcaga

SEQ ID NO: 952748 - DNA, 12 bp, Homo sapiens
gtcttccctggg

SEQ ID NO: 952749 - DNA, 19 bp, Homo sapiens
gtcttccgcccctgcctgc

SEQ ID NO: 952750 - DNA, 21 bp, Homo sapiens
gtcttccgcccctgcctgcca

SEQ ID NO: 952751 - DNA, 14 bp, Homo sapiens
gtcttccgtctccc

SEQ ID NO: 952752 - DNA, 14 bp, Homo sapiens
gtcttcctgacact

SEQ ID NO: 952753 - DNA, 19 bp, Homo sapiens
gtcttcctgagtggtgcca

SEQ ID NO: 952754 - DNA, 15 bp, Homo sapiens
gtcttccttaaatga

SEQ ID NO: 952755 - DNA, 15 bp, Homo sapiens
gtcttccttgtctct

SEQ ID NO: 952756 - DNA, 23 bp, Homo sapiens
gtcttcgccctctgaaattaaag

SEQ ID NO: 952757 - DNA, 23 bp, Homo sapiens
gtcttctaaacttccccatcttc

SEQ ID NO: 952758 - DNA, 17 bp, Homo sapiens
gtcttctcatagcatta

SEQ ID NO: 952759 - DNA, 14 bp, Homo sapiens
gtcttctctccact

SEQ ID NO: 952760 - DNA, 18 bp, Homo sapiens
gtcttctgggcacagtgg

SEQ ID NO: 952761 - DNA, 16 bp, Homo sapiens
gtcttcttacatgcat

SEQ ID NO: 952762 - DNA, 15 bp, Homo sapiens
gtcttcttgtgtcct

SEQ ID NO: 952763 - DNA, 17 bp, Homo sapiens
gtcttcttgtgtcctga

SEQ ID NO: 952764 - DNA, 15 bp, Homo sapiens
gtcttgaaaactgtg

SEQ ID NO: 952765 - DNA, 12 bp, Homo sapiens
gtcttgaaagat

SEQ ID NO: 952766 - DNA, 22 bp, Homo sapiens
gtcttgaagttgggtgtttcca

SEQ ID NO: 952767 - DNA, 22 bp, Homo sapiens
gtcttgaatagattttctctgg

SEQ ID NO: 952768 - DNA, 21 bp, Homo sapiens
gtcttgacgggagcattggcc

SEQ ID NO: 952769 - DNA, 19 bp, Homo sapiens
gtcttgactcatggcagct

SEQ ID NO: 952770 - DNA, 20 bp, Homo sapiens
gtcttgactcatggcagctg

SEQ ID NO: 952771 - DNA, 21 bp, Homo sapiens
gtcttgactctaaatgcagtt

SEQ ID NO: 952772 - DNA, 13 bp, Homo sapiens
gtcttgagccagt

SEQ ID NO: 952773 - DNA, 18 bp, Homo sapiens
gtcttgatgaccaaagtc

SEQ ID NO: 952774 - DNA, 17 bp, Homo sapiens
gtcttgatgactgctga

SEQ ID NO: 952775 - DNA, 16 bp, Homo sapiens
gtcttgcccagcagct

SEQ ID NO: 952776 - DNA, 18 bp, Homo sapiens
gtcttgcccagcagctca

SEQ ID NO: 952777 - DNA, 14 bp, Homo sapiens
gtcttgcctaggcc

SEQ ID NO: 952778 - DNA, 14 bp, Homo sapiens
gtcttgctcctggg

SEQ ID NO: 952779 - DNA, 15 bp, Homo sapiens
gtcttgctctgtcac

SEQ ID NO: 952780 - DNA, 16 bp, Homo sapiens
gtcttgctctgtcccc

SEQ ID NO: 952781 - DNA, 14 bp, Homo sapiens
gtcttgctctgtct

SEQ ID NO: 952782 - DNA, 19 bp, Homo sapiens
gtcttgctctgtctcccag

SEQ ID NO: 952783 - DNA, 15 bp, Homo sapiens
gtcttgctgttgaca

SEQ ID NO: 952784 - DNA, 17 bp, Homo sapiens
gtcttggagctgagcct

SEQ ID NO: 952785 - DNA, 12 bp, Homo sapiens
gtcttggccatg

SEQ ID NO: 952786 - DNA, 16 bp, Homo sapiens
gtcttggcggcagcag

SEQ ID NO: 952787 - DNA, 20 bp, Homo sapiens
gtcttggctttcatgttatt

SEQ ID NO: 952788 - DNA, 16 bp, Homo sapiens
gtcttgggctactggc

SEQ ID NO: 952789 - DNA, 14 bp, Homo sapiens
gtcttggttctaaa

SEQ ID NO: 952790 - DNA, 16 bp, Homo sapiens
gtcttggttctaaagg

SEQ ID NO: 952791 - DNA, 18 bp, Homo sapiens
gtcttggtttctctctac

SEQ ID NO: 952792 - DNA, 19 bp, Homo sapiens
gtcttgtaaaaaggggagg

SEQ ID NO: 952793 - DNA, 23 bp, Homo sapiens
gtcttgtaaaaaggggaggagaa

SEQ ID NO: 952794 - DNA, 12 bp, Homo sapiens
gtcttgtacttc

SEQ ID NO: 952795 - DNA, 21 bp, Homo sapiens
gtcttgtacttctgtgttcat

SEQ ID NO: 952796 - DNA, 19 bp, Homo sapiens
gtcttgtcccaattaaaat

SEQ ID NO: 952797 - DNA, 21 bp, Homo sapiens
gtcttgtcccaattaaaatac

SEQ ID NO: 952798 - DNA, 22 bp, Homo sapiens
gtcttgtgcataattcttccaa

SEQ ID NO: 952799 - DNA, 17 bp, Homo sapiens
gtcttgtgtttgctgca

SEQ ID NO: 952800 - DNA, 16 bp, Homo sapiens
gtcttgttatgtacaa

SEQ ID NO: 952801 - DNA, 13 bp, Homo sapiens
gtcttgttcattt

SEQ ID NO: 952802 - DNA, 14 bp, Homo sapiens
gtcttgttcatttt

SEQ ID NO: 952803 - DNA, 17 bp, Homo sapiens
gtcttgttcattttgag

SEQ ID NO: 952804 - DNA, 17 bp, Homo sapiens
gtcttgtttccaggagc

SEQ ID NO: 952805 - DNA, 22 bp, Homo sapiens
gtcttgttttttttttccactt

SEQ ID NO: 952806 - DNA, 19 bp, Homo sapiens
gtctttaaaaactgtttta

SEQ ID NO: 952807 - DNA, 16 bp, Homo sapiens
gtctttaaaggcccag

SEQ ID NO: 952808 - DNA, 14 bp, Homo sapiens
gtctttaagatctt

SEQ ID NO: 952809 - DNA, 16 bp, Homo sapiens
gtctttagatagccct

SEQ ID NO: 952810 - DNA, 22 bp, Homo sapiens
gtctttagatagccctgtcctg

SEQ ID NO: 952811 - DNA, 17 bp, Homo sapiens
gtctttagttttgattt

SEQ ID NO: 952812 - DNA, 18 bp, Homo sapiens
gtctttattcttattact

SEQ ID NO: 952813 - DNA, 16 bp, Homo sapiens
gtctttcacagctcct

SEQ ID NO: 952814 - DNA, 20 bp, Homo sapiens
gtctttcactggaatgaaga

SEQ ID NO: 952815 - DNA, 16 bp, Homo sapiens
gtctttcagtactttt

SEQ ID NO: 952816 - DNA, 17 bp, Homo sapiens
gtctttccacttctctg

SEQ ID NO: 952817 - DNA, 18 bp, Homo sapiens
gtctttccacttctctgg

SEQ ID NO: 952818 - DNA, 16 bp, Homo sapiens
gtctttcctggcacta

SEQ ID NO: 952819 - DNA, 19 bp, Homo sapiens
gtctttctaagaaatcaag

SEQ ID NO: 952820 - DNA, 20 bp, Homo sapiens
gtctttctaatgtagctatt

SEQ ID NO: 952821 - DNA, 20 bp, Homo sapiens
gtctttctagccataataaa

SEQ ID NO: 952822 - DNA, 22 bp, Homo sapiens
gtctttctagccataataaaat

SEQ ID NO: 952823 - DNA, 14 bp, Homo sapiens
gtctttctcctcag

SEQ ID NO: 952824 - DNA, 14 bp, Homo sapiens
gtctttctctcagt

SEQ ID NO: 952825 - DNA, 14 bp, Homo sapiens
gtctttctctctca

SEQ ID NO: 952826 - DNA, 15 bp, Homo sapiens
gtctttcttcttttt

SEQ ID NO: 952827 - DNA, 19 bp, Homo sapiens
gtctttgcacatgtgacca

SEQ ID NO: 952828 - DNA, 21 bp, Homo sapiens
gtctttgctaggcctcttgct

SEQ ID NO: 952829 - DNA, 20 bp, Homo sapiens
gtctttggataataggaatt

SEQ ID NO: 952830 - DNA, 22 bp, Homo sapiens
gtctttggataataggaattca

SEQ ID NO: 952831 - DNA, 16 bp, Homo sapiens
gtctttgtaatgtcac

SEQ ID NO: 952832 - DNA, 14 bp, Homo sapiens
gtctttgtggactg

SEQ ID NO: 952833 - DNA, 12 bp, Homo sapiens
tgggtttgccca

SEQ ID NO: 952834 - DNA, 15 bp, Homo sapiens
tgggtttgcccagtc

SEQ ID NO: 952835 - DNA, 19 bp, Homo sapiens
tgggtttgcccagtcctgg

SEQ ID NO: 952836 - DNA, 22 bp, Homo sapiens
tgggtttgcccagtcctgggtt

SEQ ID NO: 952837 - DNA, 15 bp, Homo sapiens
tgggtttggccaggg

SEQ ID NO: 952838 - DNA, 19 bp, Homo sapiens
tgggtttggccagggaggc

SEQ ID NO: 952839 - DNA, 21 bp, Homo sapiens
tgggtttggccagggaggcgc

SEQ ID NO: 952840 - DNA, 21 bp, Homo sapiens
tgggtttgggtgcctcctgca

SEQ ID NO: 952841 - DNA, 19 bp, Homo sapiens
tgggtttttcctctgttaa

SEQ ID NO: 952842 - DNA, 19 bp, Homo sapiens
tgggtttttgtatccagag

SEQ ID NO: 952843 - DNA, 17 bp, Homo sapiens
tgggttttttctgtttt

SEQ ID NO: 952844 - DNA, 21 bp, Homo sapiens
tggtaaaaacagcagctcata

SEQ ID NO: 952845 - DNA, 18 bp, Homo sapiens
tggtaaaacattacttat

SEQ ID NO: 952846 - DNA, 15 bp, Homo sapiens
tggtaaaactcactg

SEQ ID NO: 952847 - DNA, 20 bp, Homo sapiens
tggtaaaactcactgtgatc

SEQ ID NO: 952848 - DNA, 13 bp, Homo sapiens
tggtaaactattt

SEQ ID NO: 952849 - DNA, 13 bp, Homo sapiens
tggtaaagccatg

SEQ ID NO: 952850 - DNA, 16 bp, Homo sapiens
tggtaaagccatgtta

SEQ ID NO: 952851 - DNA, 23 bp, Homo sapiens
tggtaaagccatgttaaatgact

SEQ ID NO: 952852 - DNA, 17 bp, Homo sapiens
tggtaaatactgtgaaa

SEQ ID NO: 952853 - DNA, 18 bp, Homo sapiens
tggtaaatactgtgaaat

SEQ ID NO: 952854 - DNA, 21 bp, Homo sapiens
tggtaaattagtatttattta

SEQ ID NO: 952855 - DNA, 16 bp, Homo sapiens
tggtaaattctggtat

SEQ ID NO: 952856 - DNA, 18 bp, Homo sapiens
tggtaacagttcatgttt

SEQ ID NO: 952857 - DNA, 19 bp, Homo sapiens
tggtaactgcacctgggca

SEQ ID NO: 952858 - DNA, 14 bp, Homo sapiens
tggtaactgctttc

SEQ ID NO: 952859 - DNA, 24 bp, Homo sapiens
tggtaacttttgtgaattaggctg

SEQ ID NO: 952860 - DNA, 22 bp, Homo sapiens
tggtaagaagccgggaacagac

SEQ ID NO: 952861 - DNA, 12 bp, Homo sapiens
tggtaagagaaa

SEQ ID NO: 952862 - DNA, 17 bp, Homo sapiens
tggtaagatgactctga

SEQ ID NO: 952863 - DNA, 20 bp, Homo sapiens
tggtaagattgttattaaat

SEQ ID NO: 952864 - DNA, 18 bp, Homo sapiens
gtgaaacctttagggcag

SEQ ID NO: 952865 - DNA, 19 bp, Homo sapiens
gtgaaacctttagggcagc

SEQ ID NO: 952866 - DNA, 20 bp, Homo sapiens
gtgaaacctttagggcagct

SEQ ID NO: 952867 - DNA, 19 bp, Homo sapiens
gtgaaacgactcaaaatga

SEQ ID NO: 952868 - DNA, 20 bp, Homo sapiens
gtgaaacgactcaaaatgac

SEQ ID NO: 952869 - DNA, 21 bp, Homo sapiens
gtgaaacgactcaaaatgaca

SEQ ID NO: 952870 - DNA, 17 bp, Homo sapiens
gtgaaactctaccctga

SEQ ID NO: 952871 - DNA, 12 bp, Homo sapiens
gtgaaagaaagc

SEQ ID NO: 952872 - DNA, 21 bp, Homo sapiens
gtgaaagaaagctgagaagaa

SEQ ID NO: 952873 - DNA, 21 bp, Homo sapiens
gtgaaagtcagatgcccagag

SEQ ID NO: 952874 - DNA, 14 bp, Homo sapiens
gtgaaataataaaa

SEQ ID NO: 952875 - DNA, 18 bp, Homo sapiens
gtgaaataataaaatgca

SEQ ID NO: 952876 - DNA, 19 bp, Homo sapiens
gtgaaataataaaatgcaa

SEQ ID NO: 952877 - DNA, 20 bp, Homo sapiens
gtgaaataataaaatgcaaa

SEQ ID NO: 952878 - DNA, 21 bp, Homo sapiens
gtgaaataataaaatgcaaat

SEQ ID NO: 952879 - DNA, 23 bp, Homo sapiens
gtgaaataataaaatgcaaatga

SEQ ID NO: 952880 - DNA, 17 bp, Homo sapiens
gtgaaatagttcaaagc

SEQ ID NO: 952881 - DNA, 14 bp, Homo sapiens
gtgaaatataattg

SEQ ID NO: 952882 - DNA, 17 bp, Homo sapiens
gtgaaatcaaaggtgct

SEQ ID NO: 952883 - DNA, 19 bp, Homo sapiens
gtgaaatggatactacatc

SEQ ID NO: 952884 - DNA, 17 bp, Homo sapiens
gtgaaatgtaacatgaa

SEQ ID NO: 952885 - DNA, 18 bp, Homo sapiens
gtgaaatgtaacatgaag

SEQ ID NO: 952886 - DNA, 11 bp, Homo sapiens
gtgaaattaag

SEQ ID NO: 952887 - DNA, 21 bp, Homo sapiens
gtgaaattcagttataaagtc

SEQ ID NO: 952888 - DNA, 15 bp, Homo sapiens
gtgaaatttcatgat

SEQ ID NO: 952889 - DNA, 15 bp, Homo sapiens
gtgaaattttcttaa

SEQ ID NO: 952890 - DNA, 17 bp, Homo sapiens
gtgaacaaagcagccac

SEQ ID NO: 952891 - DNA, 15 bp, Homo sapiens
gtgaacagctggtgc

SEQ ID NO: 952892 - DNA, 20 bp, Homo sapiens
gtgaacattcccagcccagc

SEQ ID NO: 952893 - DNA, 12 bp, Homo sapiens
gtgaaccaaaga

SEQ ID NO: 952894 - DNA, 13 bp, Homo sapiens
gtgaaccagaggg

SEQ ID NO: 952895 - DNA, 15 bp, Homo sapiens
gtgaaccatgtcagc

SEQ ID NO: 952896 - DNA, 12 bp, Homo sapiens
gtgaacctggag

SEQ ID NO: 952897 - DNA, 13 bp, Homo sapiens
gtgaacgctgtga

SEQ ID NO: 952898 - DNA, 16 bp, Homo sapiens
gtgaacgctgtgatgc

SEQ ID NO: 952899 - DNA, 24 bp, Homo sapiens
gtgaacgtgggagttcagctgctt

SEQ ID NO: 952900 - DNA, 17 bp, Homo sapiens
gtgaactagggaagctc

SEQ ID NO: 952901 - DNA, 14 bp, Homo sapiens
gtgaactcctgcca

SEQ ID NO: 952902 - DNA, 19 bp, Homo sapiens
gtgaactcctgccaggcac

SEQ ID NO: 952903 - DNA, 16 bp, Homo sapiens
gtgaacttgactgggt

SEQ ID NO: 952904 - DNA, 20 bp, Homo sapiens
gtgaacttggggaacaaggg

SEQ ID NO: 952905 - DNA, 20 bp, Homo sapiens
gtgaacttttgtaatttgaa

SEQ ID NO: 952906 - DNA, 23 bp, Homo sapiens
gtgaacttttgtaatttgaattg

SEQ ID NO: 952907 - DNA, 14 bp, Homo sapiens
gtgaactttttgta

SEQ ID NO: 952908 - DNA, 12 bp, Homo sapiens
gtgaagaaagcc

SEQ ID NO: 952909 - DNA, 16 bp, Homo sapiens
gtgaagaaataaatga

SEQ ID NO: 952910 - DNA, 14 bp, Homo sapiens
gtgaagaatacttc

SEQ ID NO: 952911 - DNA, 21 bp, Homo sapiens
gtgaagaatgcacaagaatgg

SEQ ID NO: 952912 - DNA, 23 bp, Homo sapiens
gtgaagacaatgacttactgtac

SEQ ID NO: 952913 - DNA, 12 bp, Homo sapiens
gtgaagaggggc

SEQ ID NO: 952914 - DNA, 16 bp, Homo sapiens
gtgaagaggggcagcc

SEQ ID NO: 952915 - DNA, 22 bp, Homo sapiens
gtgaagatgcaatcagacaagt

SEQ ID NO: 952916 - DNA, 13 bp, Homo sapiens
gtgaagcagcagc

SEQ ID NO: 952917 - DNA, 18 bp, Homo sapiens
gtgaagcagtcagccctt

SEQ ID NO: 952918 - DNA, 16 bp, Homo sapiens
gtgaagcagtgcctcg

SEQ ID NO: 952919 - DNA, 23 bp, Homo sapiens
gtgaagcagtgcctcgaggcacc

SEQ ID NO: 952920 - DNA, 10 bp, Homo sapiens
gtgaagccaa

SEQ ID NO: 952921 - DNA, 14 bp, Homo sapiens
gtgaagcgcctcag

SEQ ID NO: 952922 - DNA, 12 bp, Homo sapiens
gtgaagctattt

SEQ ID NO: 952923 - DNA, 12 bp, Homo sapiens
gtgaaggaaata

SEQ ID NO: 952924 - DNA, 23 bp, Homo sapiens
gtgaaggatccaggaatatgaca

SEQ ID NO: 952925 - DNA, 21 bp, Homo sapiens
gtgaaggattatggaaaaata

SEQ ID NO: 952926 - DNA, 16 bp, Homo sapiens
gtgaagggaaagataa

SEQ ID NO: 952927 - DNA, 18 bp, Homo sapiens
gtgaagggaagagacagc

SEQ ID NO: 952928 - DNA, 17 bp, Homo sapiens
gtgaaggtcctgctatt

SEQ ID NO: 952929 - DNA, 16 bp, Homo sapiens
gtgaaggtgacagcag

SEQ ID NO: 952930 - DNA, 16 bp, Homo sapiens
gtgaagtacacctgtg

SEQ ID NO: 952931 - DNA, 17 bp, Homo sapiens
gtgaagtatactgtatt

SEQ ID NO: 952932 - DNA, 16 bp, Homo sapiens
gtgaagtccttcacct

SEQ ID NO: 952933 - DNA, 18 bp, Homo sapiens
gtgaagtctagaatcata

SEQ ID NO: 952934 - DNA, 13 bp, Homo sapiens
gtgaagtgcttgg

SEQ ID NO: 952935 - DNA, 20 bp, Homo sapiens
gtgaagtgtggctggtgtcc

SEQ ID NO: 952936 - DNA, 17 bp, Homo sapiens
gtgaagttacacaatta

SEQ ID NO: 952937 - DNA, 18 bp, Homo sapiens
gtgaagttgaggcttata

SEQ ID NO: 952938 - DNA, 20 bp, Homo sapiens
gtgaagttttccttgctatt

SEQ ID NO: 952939 - DNA, 13 bp, Homo sapiens
gtgaataaaaacc

SEQ ID NO: 952940 - DNA, 13 bp, Homo sapiens
gtgaataaaggat

SEQ ID NO: 952941 - DNA, 13 bp, Homo sapiens
gtgaataaatgtc

SEQ ID NO: 952942 - DNA, 18 bp, Homo sapiens
gtgaataacctgaggatt

SEQ ID NO: 952943 - DNA, 16 bp, Homo sapiens
gtgaataataaataca

SEQ ID NO: 952944 - DNA, 23 bp, Homo sapiens
gtgaataatacagtatctcaggg

SEQ ID NO: 952945 - DNA, 13 bp, Homo sapiens
gtgaatacaatta

SEQ ID NO: 952946 - DNA, 21 bp, Homo sapiens
gtgaatactcttcccacatac

SEQ ID NO: 952947 - DNA, 14 bp, Homo sapiens
gtgaatagcctggc

SEQ ID NO: 952948 - DNA, 17 bp, Homo sapiens
gtgaatcgcagctgtgg

SEQ ID NO: 952949 - DNA, 21 bp, Homo sapiens
gtgaatctttctcctggtgac

SEQ ID NO: 952950 - DNA, 22 bp, Homo sapiens
gtgaatctttctcctggtgact

SEQ ID NO: 952951 - DNA, 19 bp, Homo sapiens
gtgaatgattcatgttata

SEQ ID NO: 952952 - DNA, 21 bp, Homo sapiens
gtgaatgtagcttccacctca

SEQ ID NO: 952953 - DNA, 14 bp, Homo sapiens
gtgaatgtgggcac

SEQ ID NO: 952954 - DNA, 12 bp, Homo sapiens
gtgaattaaaaa

SEQ ID NO: 952955 - DNA, 20 bp, Homo sapiens
tggtcaaactttttccagca

SEQ ID NO: 952956 - DNA, 16 bp, Homo sapiens
tggtcaacctcctgga

SEQ ID NO: 952957 - DNA, 21 bp, Homo sapiens
tggtcaagaaaggaggggaga

SEQ ID NO: 952958 - DNA, 15 bp, Homo sapiens
tggtcaagattttga

SEQ ID NO: 952959 - DNA, 15 bp, Homo sapiens
tggtcacacactgat

SEQ ID NO: 952960 - DNA, 21 bp, Homo sapiens
tggtcacagcggaggtgtgga

SEQ ID NO: 952961 - DNA, 22 bp, Homo sapiens
tggtcacaggactctgcctcct

SEQ ID NO: 952962 - DNA, 22 bp, Homo sapiens
tggtcacaggcaaagtccagct

SEQ ID NO: 952963 - DNA, 22 bp, Homo sapiens
tggtcacagtcctatgtacaga

SEQ ID NO: 952964 - DNA, 18 bp, Homo sapiens
tggtcaccaaatcagctg

SEQ ID NO: 952965 - DNA, 19 bp, Homo sapiens
tggtcaccaaggcagtgca

SEQ ID NO: 952966 - DNA, 20 bp, Homo sapiens
tggtcaccaaggcagtgcat

SEQ ID NO: 952967 - DNA, 14 bp, Homo sapiens
tggtcaccatgaaa

SEQ ID NO: 952968 - DNA, 18 bp, Homo sapiens
tggtcaccttgcactcct

SEQ ID NO: 952969 - DNA, 19 bp, Homo sapiens
tggtcacgtttggtgcttc

SEQ ID NO: 952970 - DNA, 13 bp, Homo sapiens
tggtcactccagt

SEQ ID NO: 952971 - DNA, 14 bp, Homo sapiens
tggtcactccagta

SEQ ID NO: 952972 - DNA, 21 bp, Homo sapiens
tggtcactctgccctctgctg

SEQ ID NO: 952973 - DNA, 20 bp, Homo sapiens
tggtcactggtcagggcagt

SEQ ID NO: 952974 - DNA, 22 bp, Homo sapiens
tggtcagagagacctcatcctg

SEQ ID NO: 952975 - DNA, 15 bp, Homo sapiens
tggtcagatttgaac

SEQ ID NO: 952976 - DNA, 21 bp, Homo sapiens
tggtcagcagatgccagtgaa

SEQ ID NO: 952977 - DNA, 19 bp, Homo sapiens
tggtcagccctagggtgga

SEQ ID NO: 952978 - DNA, 13 bp, Homo sapiens
tggtcaggctggt

SEQ ID NO: 952979 - DNA, 21 bp, Homo sapiens
tggtcaggctggtctcaaact

SEQ ID NO: 952980 - DNA, 12 bp, Homo sapiens
tggtcaggtccc

SEQ ID NO: 952981 - DNA, 14 bp, Homo sapiens
tggtcaggtcccca

SEQ ID NO: 952982 - DNA, 19 bp, Homo sapiens
tggtcaggtccccatggct

SEQ ID NO: 952983 - DNA, 21 bp, Homo sapiens
tggtcaggttatactcctcct

SEQ ID NO: 952984 - DNA, 20 bp, Homo sapiens
tggtcagtagtttcatgttt

SEQ ID NO: 952985 - DNA, 18 bp, Homo sapiens
tggtcagtctttgctcag

SEQ ID NO: 952986 - DNA, 13 bp, Homo sapiens
tggtcataaaata

SEQ ID NO: 952987 - DNA, 15 bp, Homo sapiens
tggtcataaaataga

SEQ ID NO: 952988 - DNA, 22 bp, Homo sapiens
tggtcatccttggtgctcttgc

SEQ ID NO: 952989 - DNA, 22 bp, Homo sapiens
tggtcatggtagatttttttca

SEQ ID NO: 952990 - DNA, 14 bp, Homo sapiens
tggtcatttcaggc

SEQ ID NO: 952991 - DNA, 15 bp, Homo sapiens
gtgacaggaaagccc

SEQ ID NO: 952992 - DNA, 20 bp, Homo sapiens
gtgacaggctcgtcagccac

SEQ ID NO: 952993 - DNA, 19 bp, Homo sapiens
gtgacagggcaagaccctg

SEQ ID NO: 952994 - DNA, 12 bp, Homo sapiens
gtgacagggcca

SEQ ID NO: 952995 - DNA, 19 bp, Homo sapiens
gtgacagggccagtggggc

SEQ ID NO: 952996 - DNA, 20 bp, Homo sapiens
gtgacagggccagtggggcc

SEQ ID NO: 952997 - DNA, 16 bp, Homo sapiens
gtgacagtcatcatca

SEQ ID NO: 952998 - DNA, 21 bp, Homo sapiens
gtgacagtcatcatcagggcc

SEQ ID NO: 952999 - DNA, 23 bp, Homo sapiens
gtgacagtcatcatcagggcctg

SEQ ID NO: 953000 - DNA, 16 bp, Homo sapiens
gtgacagtcctccatc

SEQ ID NO: 953001 - DNA, 19 bp, Homo sapiens
gtgacagtcctccatccac

SEQ ID NO: 953002 - DNA, 18 bp, Homo sapiens
gtgacagtgcctcttcca

SEQ ID NO: 953003 - DNA, 22 bp, Homo sapiens
gtgacagttgcagcccttgtga

SEQ ID NO: 953004 - DNA, 13 bp, Homo sapiens
gtgacagtttcca

SEQ ID NO: 953005 - DNA, 15 bp, Homo sapiens
gtgacagtttccaaa

SEQ ID NO: 953006 - DNA, 16 bp, Homo sapiens
gtgacagtttccaaat

SEQ ID NO: 953007 - DNA, 20 bp, Homo sapiens
gtgacatcagcgtagtgttt

SEQ ID NO: 953008 - DNA, 14 bp, Homo sapiens
gtgacatcagtggc

SEQ ID NO: 953009 - DNA, 15 bp, Homo sapiens
gtgacatcagtggca

SEQ ID NO: 953010 - DNA, 23 bp, Homo sapiens
gtgacatcctgcttcttcttcca

SEQ ID NO: 953011 - DNA, 19 bp, Homo sapiens
gtgacatcggaaaaataat

SEQ ID NO: 953012 - DNA, 14 bp, Homo sapiens
gtgacatgaagcat

SEQ ID NO: 953013 - DNA, 17 bp, Homo sapiens
gtgacatgcccaaggcc

SEQ ID NO: 953014 - DNA, 13 bp, Homo sapiens
gtgacatgcggct

SEQ ID NO: 953015 - DNA, 15 bp, Homo sapiens
gtgacatgcggctgc

SEQ ID NO: 953016 - DNA, 19 bp, Homo sapiens
gtgacatggggaaggcaga

SEQ ID NO: 953017 - DNA, 20 bp, Homo sapiens
gtgacatggggaaggcagag

SEQ ID NO: 953018 - DNA, 16 bp, Homo sapiens
gtgacatggtgcctga

SEQ ID NO: 953019 - DNA, 22 bp, Homo sapiens
gtgacatggtgcctgagaggca

SEQ ID NO: 953020 - DNA, 15 bp, Homo sapiens
gtgaccaactgtgtt

SEQ ID NO: 953021 - DNA, 17 bp, Homo sapiens
gtgaccaatgatggtca

SEQ ID NO: 953022 - DNA, 17 bp, Homo sapiens
gtgaccactctgtcttg

SEQ ID NO: 953023 - DNA, 22 bp, Homo sapiens
gtgaccagcggaaacaggtgtg

SEQ ID NO: 953024 - DNA, 13 bp, Homo sapiens
gtgaccaggcttt

SEQ ID NO: 953025 - DNA, 13 bp, Homo sapiens
gtgaccatgttca

SEQ ID NO: 953026 - DNA, 16 bp, Homo sapiens
gtgaccattattcaca

SEQ ID NO: 953027 - DNA, 14 bp, Homo sapiens
gtgacccacagctc

SEQ ID NO: 953028 - DNA, 19 bp, Homo sapiens
gtgacccacagctctgggc

SEQ ID NO: 953029 - DNA, 20 bp, Homo sapiens
gtgacccacagctctgggcc

SEQ ID NO: 953030 - DNA, 12 bp, Homo sapiens
gtgacccagcta

SEQ ID NO: 953031 - DNA, 19 bp, Homo sapiens
gtgaccccacgatttgtct

SEQ ID NO: 953032 - DNA, 15 bp, Homo sapiens
gtgaccccagggcct

SEQ ID NO: 953033 - DNA, 16 bp, Homo sapiens
gtgacccgacctggcc

SEQ ID NO: 953034 - DNA, 12 bp, Homo sapiens
gtgaccctccaa

SEQ ID NO: 953035 - DNA, 14 bp, Homo sapiens
gtgaccctctcact

SEQ ID NO: 953036 - DNA, 16 bp, Homo sapiens
gtgacccttcagggcc

SEQ ID NO: 953037 - DNA, 18 bp, Homo sapiens
gtgacccttcagggccag

SEQ ID NO: 953038 - DNA, 19 bp, Homo sapiens
gtgacccttcagggccaga

SEQ ID NO: 953039 - DNA, 19 bp, Homo sapiens
gtgaccggacttttctgca

SEQ ID NO: 953040 - DNA, 18 bp, Homo sapiens
gtgaccgggggctgctgg

SEQ ID NO: 953041 - DNA, 20 bp, Homo sapiens
gtgaccgggggctgctgggc

SEQ ID NO: 953042 - DNA, 22 bp, Homo sapiens
gtgaccgggggctgctgggcgt

SEQ ID NO: 953043 - DNA, 20 bp, Homo sapiens
gtgacctatcagttattaat

SEQ ID NO: 953044 - DNA, 19 bp, Homo sapiens
gtgacctattcaccctcca

SEQ ID NO: 953045 - DNA, 15 bp, Homo sapiens
gtgacctcctgtcac

SEQ ID NO: 953046 - DNA, 23 bp, Homo sapiens
gtgacctgaggatttaagggatg

SEQ ID NO: 953047 - DNA, 18 bp, Homo sapiens
gtgaccttgggaccaaag

SEQ ID NO: 953048 - DNA, 14 bp, Homo sapiens
gtgacgaaaacatt

SEQ ID NO: 953049 - DNA, 19 bp, Homo sapiens
gtgacgatgggtgttgctg

SEQ ID NO: 953050 - DNA, 16 bp, Homo sapiens
gtgacgcccagctccg

SEQ ID NO: 953051 - DNA, 16 bp, Homo sapiens
gtgacggccctcatct

SEQ ID NO: 953052 - DNA, 19 bp, Homo sapiens
gtgacggtcccacactggt

SEQ ID NO: 953053 - DNA, 17 bp, Homo sapiens
gtgactcacttcaatgt

SEQ ID NO: 953054 - DNA, 18 bp, Homo sapiens
gtgactcagcagaggcag

SEQ ID NO: 953055 - DNA, 14 bp, Homo sapiens
gtgactccctggga

SEQ ID NO: 953056 - DNA, 22 bp, Homo sapiens
gtgactcgacaaaggccacagg

SEQ ID NO: 953057 - DNA, 16 bp, Homo sapiens
gtgactcgggagctgc

SEQ ID NO: 953058 - DNA, 16 bp, Homo sapiens
gtgactctgtccagct

SEQ ID NO: 953059 - DNA, 20 bp, Homo sapiens
gtgactctttttagggccag

SEQ ID NO: 953060 - DNA, 15 bp, Homo sapiens
gtgactgaatttctt

SEQ ID NO: 953061 - DNA, 22 bp, Homo sapiens
gtgactgaatttgggcctcttg

SEQ ID NO: 953062 - DNA, 19 bp, Homo sapiens
gtgactggaagttgtggat

SEQ ID NO: 953063 - DNA, 14 bp, Homo sapiens
gtgactggatcttc

SEQ ID NO: 953064 - DNA, 12 bp, Homo sapiens
gtgactggcagg

SEQ ID NO: 953065 - DNA, 15 bp, Homo sapiens
gtgactgggaaagtt

SEQ ID NO: 953066 - DNA, 21 bp, Homo sapiens
gtgactgtcaagtacaagcaa

SEQ ID NO: 953067 - DNA, 13 bp, Homo sapiens
gtgactgtgctgt

SEQ ID NO: 953068 - DNA, 14 bp, Homo sapiens
gtgactgtgctgtg

SEQ ID NO: 953069 - DNA, 23 bp, Homo sapiens
gtgactgttgtagcattttcctg

SEQ ID NO: 953070 - DNA, 14 bp, Homo sapiens
gtgactgtttggct

SEQ ID NO: 953071 - DNA, 15 bp, Homo sapiens
gtgacttcctggtga

SEQ ID NO: 953072 - DNA, 14 bp, Homo sapiens
gtgacttggagata

SEQ ID NO: 953073 - DNA, 23 bp, Homo sapiens
gtgacttgtgtcccatgatccct

SEQ ID NO: 953074 - DNA, 11 bp, Homo sapiens
gtgactttaaa

SEQ ID NO: 953075 - DNA, 13 bp, Homo sapiens
gtgacttttctga

SEQ ID NO: 953076 - DNA, 19 bp, Homo sapiens
gtgacttttctgattaata

SEQ ID NO: 953077 - DNA, 19 bp, Homo sapiens
gtgatatttttatgtgcag

SEQ ID NO: 953078 - DNA, 21 bp, Homo sapiens
gtgatatttttatgtgcagcg

SEQ ID NO: 953079 - DNA, 13 bp, Homo sapiens
gtgatcaaagcca

SEQ ID NO: 953080 - DNA, 18 bp, Homo sapiens
gtgatcaataaaatgtga

SEQ ID NO: 953081 - DNA, 19 bp, Homo sapiens
gtgatcaataaaatgtgat

SEQ ID NO: 953082 - DNA, 20 bp, Homo sapiens
gtgatcaatatttttatatc

SEQ ID NO: 953083 - DNA, 13 bp, Homo sapiens
gtgatcagcattg

SEQ ID NO: 953084 - DNA, 15 bp, Homo sapiens
gtgatcagcattgtg

SEQ ID NO: 953085 - DNA, 14 bp, Homo sapiens
gtgatcatatgagg

SEQ ID NO: 953086 - DNA, 18 bp, Homo sapiens
gtgatcatgtgtggaagt

SEQ ID NO: 953087 - DNA, 12 bp, Homo sapiens
gtgatccagccc

SEQ ID NO: 953088 - DNA, 13 bp, Homo sapiens
gtgatccagccct

SEQ ID NO: 953089 - DNA, 20 bp, Homo sapiens
gtgatccatccatctccagg

SEQ ID NO: 953090 - DNA, 16 bp, Homo sapiens
gtgatcctcacgcctt

SEQ ID NO: 953091 - DNA, 21 bp, Homo sapiens
gtgatcctctcacctcagcct

SEQ ID NO: 953092 - DNA, 22 bp, Homo sapiens
gtgatcggggtcaggcaaagga

SEQ ID NO: 953093 - DNA, 18 bp, Homo sapiens
gtgatctatgtttgtgtg

SEQ ID NO: 953094 - DNA, 14 bp, Homo sapiens
gtgatctcagatca

SEQ ID NO: 953095 - DNA, 15 bp, Homo sapiens
gtgatctcagatcag

SEQ ID NO: 953096 - DNA, 12 bp, Homo sapiens
gtgatctccata

SEQ ID NO: 953097 - DNA, 19 bp, Homo sapiens
gtgatctcggctcactgca

SEQ ID NO: 953098 - DNA, 13 bp, Homo sapiens
gtgatctgggcat

SEQ ID NO: 953099 - DNA, 22 bp, Homo sapiens
gtgatcttggcttactgcagcc

SEQ ID NO: 953100 - DNA, 15 bp, Homo sapiens
gtgatcttttaaagt

SEQ ID NO: 953101 - DNA, 15 bp, Homo sapiens
gtgatgaactttctc

SEQ ID NO: 953102 - DNA, 22 bp, Homo sapiens
gtgatgaagaaaagtgggccag

SEQ ID NO: 953103 - DNA, 23 bp, Homo sapiens
gtgatgaggccgcggcctccccg

SEQ ID NO: 953104 - DNA, 22 bp, Homo sapiens
gtgatgatcagctgtttgtcat

SEQ ID NO: 953105 - DNA, 12 bp, Homo sapiens
gtgatgatgctg

SEQ ID NO: 953106 - DNA, 14 bp, Homo sapiens
gtgatgatgctgtg

SEQ ID NO: 953107 - DNA, 17 bp, Homo sapiens
gtgatgcaatcttggct

SEQ ID NO: 953108 - DNA, 19 bp, Homo sapiens
gtgatgcaatcttggctca

SEQ ID NO: 953109 - DNA, 22 bp, Homo sapiens
gtgatgccaaagatgtttgaaa

SEQ ID NO: 953110 - DNA, 19 bp, Homo sapiens
gtgatgccgggcgccagga

SEQ ID NO: 953111 - DNA, 22 bp, Homo sapiens
gtgatgccgggcgccaggacag

SEQ ID NO: 953112 - DNA, 23 bp, Homo sapiens
gtgatgccgtcctgctggagtga

SEQ ID NO: 953113 - DNA, 13 bp, Homo sapiens
gtgatgctgtgtg

SEQ ID NO: 953114 - DNA, 18 bp, Homo sapiens
gtgatgcttttgctgctg

SEQ ID NO: 953115 - DNA, 20 bp, Homo sapiens
gtgatgcttttgctgctgct

SEQ ID NO: 953116 - DNA, 19 bp, Homo sapiens
gtgatggagaggacagagc

SEQ ID NO: 953117 - DNA, 14 bp, Homo sapiens
gtgatggatggcac

SEQ ID NO: 953118 - DNA, 17 bp, Homo sapiens
gtgatggatggcacaat

SEQ ID NO: 953119 - DNA, 16 bp, Homo sapiens
gtgatggccagcccct

SEQ ID NO: 953120 - DNA, 21 bp, Homo sapiens
gtgatggcgcgggaggcacca

SEQ ID NO: 953121 - DNA, 19 bp, Homo sapiens
gtgatggctatgccttgca

SEQ ID NO: 953122 - DNA, 19 bp, Homo sapiens
tggtgcacagattgctgaa

SEQ ID NO: 953123 - DNA, 23 bp, Homo sapiens
tggtgcacagcacaaattagtta

SEQ ID NO: 953124 - DNA, 22 bp, Homo sapiens
tggtgcagacagaagtctcctc

SEQ ID NO: 953125 - DNA, 23 bp, Homo sapiens
tggtgcagggagacatctgcacc

SEQ ID NO: 953126 - DNA, 13 bp, Homo sapiens
tggtgcatgggct

SEQ ID NO: 953127 - DNA, 19 bp, Homo sapiens
tggtgcattacagagagga

SEQ ID NO: 953128 - DNA, 13 bp, Homo sapiens
tggtgccagcctt

SEQ ID NO: 953129 - DNA, 14 bp, Homo sapiens
tggtgccagccttc

SEQ ID NO: 953130 - DNA, 15 bp, Homo sapiens
tggtgcccacagcag

SEQ ID NO: 953131 - DNA, 19 bp, Homo sapiens
tggtgccctggatgcccag

SEQ ID NO: 953132 - DNA, 19 bp, Homo sapiens
tggtgccgatgttgaactt

SEQ ID NO: 953133 - DNA, 14 bp, Homo sapiens
tggtgcctcctcaa

SEQ ID NO: 953134 - DNA, 18 bp, Homo sapiens
tggtgcctctcttggctc

SEQ ID NO: 953135 - DNA, 18 bp, Homo sapiens
tggtgcgggcacaataaa

SEQ ID NO: 953136 - DNA, 15 bp, Homo sapiens
tggtgcgtgcctgta

SEQ ID NO: 953137 - DNA, 23 bp, Homo sapiens
tggtgctataggctggagaagct

SEQ ID NO: 953138 - DNA, 15 bp, Homo sapiens
tggtgctatttgaag

SEQ ID NO: 953139 - DNA, 16 bp, Homo sapiens
tggtgctatttgaaga

SEQ ID NO: 953140 - DNA, 17 bp, Homo sapiens
tggtgctatttgaagaa

SEQ ID NO: 953141 - DNA, 22 bp, Homo sapiens
tggtgctcacgactcttcctgc

SEQ ID NO: 953142 - DNA, 19 bp, Homo sapiens
tggtgctcctgcccagcca

SEQ ID NO: 953143 - DNA, 21 bp, Homo sapiens
tggtgctcgggaagggagggg

SEQ ID NO: 953144 - DNA, 14 bp, Homo sapiens
tggtgctcttgctt

SEQ ID NO: 953145 - DNA, 14 bp, Homo sapiens
tggtgctgctcagg

SEQ ID NO: 953146 - DNA, 18 bp, Homo sapiens
tggtgctggatattttca

SEQ ID NO: 953147 - DNA, 13 bp, Homo sapiens
tggtgcttagaaa

SEQ ID NO: 953148 - DNA, 20 bp, Homo sapiens
tggtgcttcagccctggccc

SEQ ID NO: 953149 - DNA, 23 bp, Homo sapiens
tggtgcttcccccacccctccac

SEQ ID NO: 953150 - DNA, 14 bp, Homo sapiens
tggtgcttgactct

SEQ ID NO: 953151 - DNA, 16 bp, Homo sapiens
tggtggacagtcctgg

SEQ ID NO: 953152 - DNA, 15 bp, Homo sapiens
tggtggactacaaaa

SEQ ID NO: 953153 - DNA, 16 bp, Homo sapiens
tggtggagcagccaga

SEQ ID NO: 953154 - DNA, 15 bp, Homo sapiens
tggtggagccagggc

SEQ ID NO: 953155 - DNA, 22 bp, Homo sapiens
tggtggaggagctgagggaggg

SEQ ID NO: 953156 - DNA, 16 bp, Homo sapiens
tggtggagtgagagcc

SEQ ID NO: 953157 - DNA, 23 bp, Homo sapiens
tggtggagtgagagcctttgcct

SEQ ID NO: 953158 - DNA, 21 bp, Homo sapiens
tggtggattgttctagtactg

SEQ ID NO: 953159 - DNA, 16 bp, Homo sapiens
tggtggcaagagcccc

SEQ ID NO: 953160 - DNA, 18 bp, Homo sapiens
tggtggcacacgcctgta

SEQ ID NO: 953161 - DNA, 20 bp, Homo sapiens
tggtggcacacgcctgtagt

SEQ ID NO: 953162 - DNA, 13 bp, Homo sapiens
tggtggcacaggc

SEQ ID NO: 953163 - DNA, 15 bp, Homo sapiens
tggtggcatggaagg

SEQ ID NO: 953164 - DNA, 22 bp, Homo sapiens
tggtggccacttcattccagca

SEQ ID NO: 953165 - DNA, 19 bp, Homo sapiens
tggtggccccgacaggtct

SEQ ID NO: 953166 - DNA, 22 bp, Homo sapiens
tggtggccccgacaggtcttcc

SEQ ID NO: 953167 - DNA, 12 bp, Homo sapiens
tggtggccctgt

SEQ ID NO: 953168 - DNA, 18 bp, Homo sapiens
tggtggcctcaagaaagg

SEQ ID NO: 953169 - DNA, 13 bp, Homo sapiens
tggtggcctcagc

SEQ ID NO: 953170 - DNA, 14 bp, Homo sapiens
tggtggccttgggc

SEQ ID NO: 953171 - DNA, 16 bp, Homo sapiens
tggtggcgcaagcctg

SEQ ID NO: 953172 - DNA, 17 bp, Homo sapiens
tggtggcgcaagcctgt

SEQ ID NO: 953173 - DNA, 23 bp, Homo sapiens
tggtggcgctttctcctgtgccc

SEQ ID NO: 953174 - DNA, 17 bp, Homo sapiens
tggtggcggggtggggt

SEQ ID NO: 953175 - DNA, 17 bp, Homo sapiens
tggtggctcatgcctgt

SEQ ID NO: 953176 - DNA, 13 bp, Homo sapiens
tggtggctgtgtc

SEQ ID NO: 953177 - DNA, 15 bp, Homo sapiens
tggtgggagggggag

SEQ ID NO: 953178 - DNA, 22 bp, Homo sapiens
tggtgggcaggatctcaagcca

SEQ ID NO: 953179 - DNA, 15 bp, Homo sapiens
tggtggggaggggcg

SEQ ID NO: 953180 - DNA, 20 bp, Homo sapiens
tggtggggaggggcgctggc

SEQ ID NO: 953181 - DNA, 22 bp, Homo sapiens
tggtggggaggggcgctggccc

SEQ ID NO: 953182 - DNA, 20 bp, Homo sapiens
tggtgggggaggagcctctg

SEQ ID NO: 953183 - DNA, 21 bp, Homo sapiens
tggtgggggtagagctgatcc

SEQ ID NO: 953184 - DNA, 17 bp, Homo sapiens
tggtggggtggcacctg

SEQ ID NO: 953185 - DNA, 17 bp, Homo sapiens
tggtgggtccatgggca

SEQ ID NO: 953186 - DNA, 22 bp, Homo sapiens
tggtgggtctatgttccccagg

SEQ ID NO: 953187 - DNA, 19 bp, Homo sapiens
tggtgggtctgagctggac

SEQ ID NO: 953188 - DNA, 22 bp, Homo sapiens
tggtgggtctttaataaaacaa

SEQ ID NO: 953189 - DNA, 17 bp, Homo sapiens
tggtgggtgtggccagc

SEQ ID NO: 953190 - DNA, 16 bp, Homo sapiens
tggtggtaaccctggt

SEQ ID NO: 953191 - DNA, 17 bp, Homo sapiens
tggtggtaaccctggtg

SEQ ID NO: 953192 - DNA, 18 bp, Homo sapiens
tggtggttaaggccaggg

SEQ ID NO: 953193 - DNA, 15 bp, Homo sapiens
tggtggttgtgcctt

SEQ ID NO: 953194 - DNA, 17 bp, Homo sapiens
tggtggtttcagaaatg

SEQ ID NO: 953195 - DNA, 23 bp, Homo sapiens
tggtggttttcagagcaggaggc

SEQ ID NO: 953196 - DNA, 18 bp, Homo sapiens
tggtgtaaggtactttca

SEQ ID NO: 953197 - DNA, 13 bp, Homo sapiens
tggtgtaatcatt

SEQ ID NO: 953198 - DNA, 18 bp, Homo sapiens
tggtgtaatcattttaaa

SEQ ID NO: 953199 - DNA, 15 bp, Homo sapiens
tggtgtaatttgaag

SEQ ID NO: 953200 - DNA, 17 bp, Homo sapiens
tggtgtagaacactaat

SEQ ID NO: 953201 - DNA, 21 bp, Homo sapiens
tggtgtagccctcccactttg

SEQ ID NO: 953202 - DNA, 21 bp, Homo sapiens
tggtgtatatcatgaagcctt

SEQ ID NO: 953203 - DNA, 22 bp, Homo sapiens
tggtgtatatcatgaagccttg

SEQ ID NO: 953204 - DNA, 14 bp, Homo sapiens
tggtgtatttgaga

SEQ ID NO: 953205 - DNA, 21 bp, Homo sapiens
tggtgtatttttcaggtaggc

SEQ ID NO: 953206 - DNA, 21 bp, Homo sapiens
tggtgtcagcccctcttccct

SEQ ID NO: 953207 - DNA, 16 bp, Homo sapiens
tggtgtcattctgcct

SEQ ID NO: 953208 - DNA, 17 bp, Homo sapiens
tggtgtcattctgcctg

SEQ ID NO: 953209 - DNA, 18 bp, Homo sapiens
tggtgtcattctgcctgc

SEQ ID NO: 953210 - DNA, 13 bp, Homo sapiens
tggtgtccacctg

SEQ ID NO: 953211 - DNA, 18 bp, Homo sapiens
tggtgtccacctggcccc

SEQ ID NO: 953212 - DNA, 20 bp, Homo sapiens
tggtgtccccttcccctgct

SEQ ID NO: 953213 - DNA, 22 bp, Homo sapiens
tggtgtccccttcccctgctga

SEQ ID NO: 953214 - DNA, 20 bp, Homo sapiens
tggtgtcctgaccaccctcc

SEQ ID NO: 953215 - DNA, 14 bp, Homo sapiens
tggtgtccttccct

SEQ ID NO: 953216 - DNA, 15 bp, Homo sapiens
tggtgtccttccctg

SEQ ID NO: 953217 - DNA, 15 bp, Homo sapiens
tggtgtctggtttct

SEQ ID NO: 953218 - DNA, 11 bp, Homo sapiens
tggtgtcttcc

SEQ ID NO: 953219 - DNA, 18 bp, Homo sapiens
tggtgtctttgatcagga

SEQ ID NO: 953220 - DNA, 16 bp, Homo sapiens
tggtgtgaacccggga

SEQ ID NO: 953221 - DNA, 11 bp, Homo sapiens
tggtgtgaagg

SEQ ID NO: 953222 - DNA, 18 bp, Homo sapiens
tggtgtgagatcctcttt

SEQ ID NO: 953223 - DNA, 14 bp, Homo sapiens
tggtgtgctgaggt

SEQ ID NO: 953224 - DNA, 19 bp, Homo sapiens
tggtgtggagttggggctg

SEQ ID NO: 953225 - DNA, 22 bp, Homo sapiens
tggtgtgggtgtcctgcctgtc

SEQ ID NO: 953226 - DNA, 16 bp, Homo sapiens
tggtgtgttggacaga

SEQ ID NO: 953227 - DNA, 14 bp, Homo sapiens
tggtgttaaagctg

SEQ ID NO: 953228 - DNA, 17 bp, Homo sapiens
tggtgttcctggaagca

SEQ ID NO: 953229 - DNA, 20 bp, Homo sapiens
tggtgttcgtttccatcatg

SEQ ID NO: 953230 - DNA, 13 bp, Homo sapiens
tggtgttctgaag

SEQ ID NO: 953231 - DNA, 16 bp, Homo sapiens
tggtgtttgtctgtgt

SEQ ID NO: 953232 - DNA, 18 bp, Homo sapiens
tggtgttttttgttactg

SEQ ID NO: 953233 - DNA, 17 bp, Homo sapiens
tggttaaaaaaaagaat

SEQ ID NO: 953234 - DNA, 17 bp, Homo sapiens
tggttaaaagggaacac

SEQ ID NO: 953235 - DNA, 20 bp, Homo sapiens
tggttaaaataaagcctatt

SEQ ID NO: 953236 - DNA, 12 bp, Homo sapiens
tggttaaatttt

SEQ ID NO: 953237 - DNA, 16 bp, Homo sapiens
tggttaataaaactgc

SEQ ID NO: 953238 - DNA, 19 bp, Homo sapiens
tggttaatacatctttccc

SEQ ID NO: 953239 - DNA, 14 bp, Homo sapiens
tggttaatgtagta

SEQ ID NO: 953240 - DNA, 21 bp, Homo sapiens
tggttacctgacctaaattag

SEQ ID NO: 953241 - DNA, 17 bp, Homo sapiens
tggttacctgttccatt

SEQ ID NO: 953242 - DNA, 20 bp, Homo sapiens
tggttacctgttccattgtt

SEQ ID NO: 953243 - DNA, 13 bp, Homo sapiens
tggttactggtga

SEQ ID NO: 953244 - DNA, 19 bp, Homo sapiens
tggttactggtgatgttga

SEQ ID NO: 953245 - DNA, 13 bp, Homo sapiens
tggttatcacttt

SEQ ID NO: 953246 - DNA, 15 bp, Homo sapiens
gtgatgggccaccgg

SEQ ID NO: 953247 - DNA, 22 bp, Homo sapiens
gtgatggggctgttgagatgcc

SEQ ID NO: 953248 - DNA, 19 bp, Homo sapiens
gtgatggtgtccttccctg

SEQ ID NO: 953249 - DNA, 22 bp, Homo sapiens
gtgatggttcccctgttcactc

SEQ ID NO: 953250 - DNA, 19 bp, Homo sapiens
gtgatgtatattcctttga

SEQ ID NO: 953251 - DNA, 19 bp, Homo sapiens
gtgatgtatgtgtaataaa

SEQ ID NO: 953252 - DNA, 19 bp, Homo sapiens
gtgatgtcagaaacaatga

SEQ ID NO: 953253 - DNA, 16 bp, Homo sapiens
gtgatgtccaaaagat

SEQ ID NO: 953254 - DNA, 10 bp, Homo sapiens
gtgatgtgga

SEQ ID NO: 953255 - DNA, 14 bp, Homo sapiens
gtgatgtggaggaa

SEQ ID NO: 953256 - DNA, 21 bp, Homo sapiens
gtgatgtggaggaagagccac

SEQ ID NO: 953257 - DNA, 14 bp, Homo sapiens
gtgatgtttgctct

SEQ ID NO: 953258 - DNA, 22 bp, Homo sapiens
gtgatgtttggattgatatcgt

SEQ ID NO: 953259 - DNA, 12 bp, Homo sapiens
gtgatgttttgt

SEQ ID NO: 953260 - DNA, 18 bp, Homo sapiens
gtgattaactgtgaataa

SEQ ID NO: 953261 - DNA, 13 bp, Homo sapiens
gtgattacataga

SEQ ID NO: 953262 - DNA, 19 bp, Homo sapiens
gtgattacatagatcagcc

SEQ ID NO: 953263 - DNA, 14 bp, Homo sapiens
gtgattagatcaca

SEQ ID NO: 953264 - DNA, 14 bp, Homo sapiens
gtgattatttttta

SEQ ID NO: 953265 - DNA, 20 bp, Homo sapiens
gtgattcactgccttcctct

SEQ ID NO: 953266 - DNA, 21 bp, Homo sapiens
gtgattcagaaaatgttctgt

SEQ ID NO: 953267 - DNA, 18 bp, Homo sapiens
gtgattcctacccctctt

SEQ ID NO: 953268 - DNA, 22 bp, Homo sapiens
gtgattccttttgatggggaga

SEQ ID NO: 953269 - DNA, 19 bp, Homo sapiens
gtgattcgggggctgacct

SEQ ID NO: 953270 - DNA, 18 bp, Homo sapiens
gtgattctgtttattctt

SEQ ID NO: 953271 - DNA, 21 bp, Homo sapiens
gtgattgacagctttgctgct

SEQ ID NO: 953272 - DNA, 13 bp, Homo sapiens
gtgattgaccctt

SEQ ID NO: 953273 - DNA, 12 bp, Homo sapiens
gtgattgcagct

SEQ ID NO: 953274 - DNA, 22 bp, Homo sapiens
gtgattgcagctttatgttcat

SEQ ID NO: 953275 - DNA, 15 bp, Homo sapiens
gtgattggtaactag

SEQ ID NO: 953276 - DNA, 23 bp, Homo sapiens
gtgatttagaactgtatgtcaga

SEQ ID NO: 953277 - DNA, 17 bp, Homo sapiens
gtgatttagttgtggaa

SEQ ID NO: 953278 - DNA, 19 bp, Homo sapiens
gtgatttcagagagggcag

SEQ ID NO: 953279 - DNA, 12 bp, Homo sapiens
gtgatttccatt

SEQ ID NO: 953280 - DNA, 16 bp, Homo sapiens
gtgatttccatttctg

SEQ ID NO: 953281 - DNA, 15 bp, Homo sapiens
gtgatttcctaaaca

SEQ ID NO: 953282 - DNA, 20 bp, Homo sapiens
gtgatttggaagagaggcac

SEQ ID NO: 953283 - DNA, 14 bp, Homo sapiens
gtgatttggttgca

SEQ ID NO: 953284 - DNA, 12 bp, Homo sapiens
gtgattttcatt

SEQ ID NO: 953285 - DNA, 16 bp, Homo sapiens
gtgattttgccctcct

SEQ ID NO: 953286 - DNA, 21 bp, Homo sapiens
gtgattttgccctcctgccca

SEQ ID NO: 953287 - DNA, 18 bp, Homo sapiens
gtgatttttgtaattttt

SEQ ID NO: 953288 - DNA, 14 bp, Homo sapiens
gtgatttttttctt

SEQ ID NO: 953289 - DNA, 17 bp, Homo sapiens
gtgcaaaaccttttact

SEQ ID NO: 953290 - DNA, 13 bp, Homo sapiens
gtgcaaaactgtg

SEQ ID NO: 953291 - DNA, 16 bp, Homo sapiens
gtgcaaaactgtgtca

SEQ ID NO: 953292 - DNA, 17 bp, Homo sapiens
gtgcaaaactgtgtcac

SEQ ID NO: 953293 - DNA, 21 bp, Homo sapiens
gtgcaaaactgtgtcacagtt

SEQ ID NO: 953294 - DNA, 21 bp, Homo sapiens
gtgcaaaccacttctccatgc

SEQ ID NO: 953295 - DNA, 17 bp, Homo sapiens
gtgcaaagactctgagc

SEQ ID NO: 953296 - DNA, 22 bp, Homo sapiens
gtgcaaagactctgagccaagg

SEQ ID NO: 953297 - DNA, 17 bp, Homo sapiens
gtgcaaagatagatggc

SEQ ID NO: 953298 - DNA, 19 bp, Homo sapiens
gtgcaaagatagatggctg

SEQ ID NO: 953299 - DNA, 18 bp, Homo sapiens
gtgcaaattgtatcttat

SEQ ID NO: 953300 - DNA, 20 bp, Homo sapiens
gtgcaaattttgcatttagt

SEQ ID NO: 953301 - DNA, 22 bp, Homo sapiens
gtgcaacaaggtcctctgtcag

SEQ ID NO: 953302 - DNA, 15 bp, Homo sapiens
gtgcaacagcactgg

SEQ ID NO: 953303 - DNA, 14 bp, Homo sapiens
gtgcaacagggtat

SEQ ID NO: 953304 - DNA, 24 bp, Homo sapiens
gtgcaacagggtatggactatctg

SEQ ID NO: 953305 - DNA, 14 bp, Homo sapiens
gtgcaacatttctg

SEQ ID NO: 953306 - DNA, 23 bp, Homo sapiens
gtgcaacccttaccccttagcct

SEQ ID NO: 953307 - DNA, 16 bp, Homo sapiens
gtgcaacctgtggctc

SEQ ID NO: 953308 - DNA, 16 bp, Homo sapiens
gtgcaactttttaaag

SEQ ID NO: 953309 - DNA, 19 bp, Homo sapiens
gtgcaagcgacgacagatg

SEQ ID NO: 953310 - DNA, 22 bp, Homo sapiens
gtgcaagtgtgtgcacatgtgt

SEQ ID NO: 953311 - DNA, 20 bp, Homo sapiens
gtgcaagtgtgtgcatgtgt

SEQ ID NO: 953312 - DNA, 23 bp, Homo sapiens
gtgcaataatttgtacaatggtt

SEQ ID NO: 953313 - DNA, 15 bp, Homo sapiens
gtgcaataggtgaga

SEQ ID NO: 953314 - DNA, 21 bp, Homo sapiens
gtgcaataggtgagagaatgt

SEQ ID NO: 953315 - DNA, 16 bp, Homo sapiens
gtgcaattaacatatg

SEQ ID NO: 953316 - DNA, 22 bp, Homo sapiens
gtgcaattgtaggggtgtgtgt

SEQ ID NO: 953317 - DNA, 18 bp, Homo sapiens
gtgcacaaaacccagacc

SEQ ID NO: 953318 - DNA, 17 bp, Homo sapiens
gtgcacacatcaccagg

SEQ ID NO: 953319 - DNA, 17 bp, Homo sapiens
gtgcacacgtgtgtatg

SEQ ID NO: 953320 - DNA, 21 bp, Homo sapiens
tggtttgcaaagaccacctcc

SEQ ID NO: 953321 - DNA, 13 bp, Homo sapiens
tggtttgccatgt

SEQ ID NO: 953322 - DNA, 19 bp, Homo sapiens
tggtttgcctgaggctgta

SEQ ID NO: 953323 - DNA, 18 bp, Homo sapiens
tggtttgggggcgccctc

SEQ ID NO: 953324 - DNA, 15 bp, Homo sapiens
tggtttgtaaattaa

SEQ ID NO: 953325 - DNA, 15 bp, Homo sapiens
tggtttgtactcaaa

SEQ ID NO: 953326 - DNA, 21 bp, Homo sapiens
tggtttgtggcgtctccctcg

SEQ ID NO: 953327 - DNA, 15 bp, Homo sapiens
tggtttgtgtgatca

SEQ ID NO: 953328 - DNA, 12 bp, Homo sapiens
tggttttaacaa

SEQ ID NO: 953329 - DNA, 20 bp, Homo sapiens
tggttttaacaactgtgctt

SEQ ID NO: 953330 - DNA, 18 bp, Homo sapiens
tggttttaacaatttcct

SEQ ID NO: 953331 - DNA, 17 bp, Homo sapiens
tggttttaatacttgat

SEQ ID NO: 953332 - DNA, 13 bp, Homo sapiens
tggttttacacag

SEQ ID NO: 953333 - DNA, 17 bp, Homo sapiens
tggttttacacagagaa

SEQ ID NO: 953334 - DNA, 18 bp, Homo sapiens
tggttttacacagagaaa

SEQ ID NO: 953335 - DNA, 12 bp, Homo sapiens
tggttttatgca

SEQ ID NO: 953336 - DNA, 18 bp, Homo sapiens
tggttttcagagcaggag

SEQ ID NO: 953337 - DNA, 16 bp, Homo sapiens
tggttttctctctgga

SEQ ID NO: 953338 - DNA, 17 bp, Homo sapiens
tggttttctctctggat

SEQ ID NO: 953339 - DNA, 13 bp, Homo sapiens
tggttttctgttc

SEQ ID NO: 953340 - DNA, 16 bp, Homo sapiens
tggttttctgttcttt

SEQ ID NO: 953341 - DNA, 21 bp, Homo sapiens
tggtttttaaaaaactgctga

SEQ ID NO: 953342 - DNA, 21 bp, Homo sapiens
tggtttttactgctctgagaa

SEQ ID NO: 953343 - DNA, 16 bp, Homo sapiens
tggtttttcagttttc

SEQ ID NO: 953344 - DNA, 14 bp, Homo sapiens
tggtttttgctctc

SEQ ID NO: 953345 - DNA, 17 bp, Homo sapiens
tggtttttgtagccttc

SEQ ID NO: 953346 - DNA, 22 bp, Homo sapiens
tggtttttgtagccttcctcca

SEQ ID NO: 953347 - DNA, 14 bp, Homo sapiens
tgtaaaaaaagcaa

SEQ ID NO: 953348 - DNA, 16 bp, Homo sapiens
tgtaaaaaaagcaaaa

SEQ ID NO: 953349 - DNA, 19 bp, Homo sapiens
tgtaaaaacagcattgctt

SEQ ID NO: 953350 - DNA, 22 bp, Homo sapiens
tgtaaaaacccaagtccctgtc

SEQ ID NO: 953351 - DNA, 17 bp, Homo sapiens
tgtaaaaactgaagaat

SEQ ID NO: 953352 - DNA, 18 bp, Homo sapiens
tgtaaaaaggggaggaga

SEQ ID NO: 953353 - DNA, 17 bp, Homo sapiens
tgtaaaaatgaaggaat

SEQ ID NO: 953354 - DNA, 12 bp, Homo sapiens
tgtaaaaatgtt

SEQ ID NO: 953355 - DNA, 16 bp, Homo sapiens
tgtaaaacctgtcaat

SEQ ID NO: 953356 - DNA, 18 bp, Homo sapiens
tgtaaaactttattttat

SEQ ID NO: 953357 - DNA, 23 bp, Homo sapiens
tgtaaaactttattttatataat

SEQ ID NO: 953358 - DNA, 16 bp, Homo sapiens
tgtaaaaggattatta

SEQ ID NO: 953359 - DNA, 22 bp, Homo sapiens
tgtaaaagtactctgaaaagca

SEQ ID NO: 953360 - DNA, 16 bp, Homo sapiens
tgtaaaagttataata

SEQ ID NO: 953361 - DNA, 21 bp, Homo sapiens
tgtaaaagttataataactga

SEQ ID NO: 953362 - DNA, 14 bp, Homo sapiens
tgtaaaatagcttg

SEQ ID NO: 953363 - DNA, 15 bp, Homo sapiens
tgtaaaatatgtaaa

SEQ ID NO: 953364 - DNA, 19 bp, Homo sapiens
tgtaaaatattttgaatca

SEQ ID NO: 953365 - DNA, 15 bp, Homo sapiens
tgtaaaatcttgcag

SEQ ID NO: 953366 - DNA, 22 bp, Homo sapiens
tgtaaaatcttggcacagaaac

SEQ ID NO: 953367 - DNA, 15 bp, Homo sapiens
tgtaaaatgtattat

SEQ ID NO: 953368 - DNA, 13 bp, Homo sapiens
tgtaaaatttgga

SEQ ID NO: 953369 - DNA, 22 bp, Homo sapiens
tgtaaacaaaccacagcaggat

SEQ ID NO: 953370 - DNA, 11 bp, Homo sapiens
tgtaaacacag

SEQ ID NO: 953371 - DNA, 20 bp, Homo sapiens
tgtaaacacatctagtagtt

SEQ ID NO: 953372 - DNA, 16 bp, Homo sapiens
tgtaaacagtgcctgc

SEQ ID NO: 953373 - DNA, 19 bp, Homo sapiens
tgtaaacagtgcctgctga

SEQ ID NO: 953374 - DNA, 16 bp, Homo sapiens
gtgcagtccatttcct

SEQ ID NO: 953375 - DNA, 15 bp, Homo sapiens
gtgcagttgacagca

SEQ ID NO: 953376 - DNA, 19 bp, Homo sapiens
gtgcagtttcttttcacat

SEQ ID NO: 953377 - DNA, 14 bp, Homo sapiens
gtgcatagtgctgg

SEQ ID NO: 953378 - DNA, 18 bp, Homo sapiens
gtgcatatgttaaagctt

SEQ ID NO: 953379 - DNA, 19 bp, Homo sapiens
gtgcatcattactgttcca

SEQ ID NO: 953380 - DNA, 12 bp, Homo sapiens
gtgcatccaaag

SEQ ID NO: 953381 - DNA, 16 bp, Homo sapiens
gtgcatcctcctcagc

SEQ ID NO: 953382 - DNA, 21 bp, Homo sapiens
gtgcatcctcctcagccccca

SEQ ID NO: 953383 - DNA, 22 bp, Homo sapiens
gtgcatcctcctcagcccccag

SEQ ID NO: 953384 - DNA, 16 bp, Homo sapiens
gtgcatccttgtaata

SEQ ID NO: 953385 - DNA, 13 bp, Homo sapiens
gtgcatctgcagg

SEQ ID NO: 953386 - DNA, 20 bp, Homo sapiens
gtgcatgacgtttaaggcca

SEQ ID NO: 953387 - DNA, 12 bp, Homo sapiens
gtgcatgcatgt

SEQ ID NO: 953388 - DNA, 13 bp, Homo sapiens
gtgcatgcatgtt

SEQ ID NO: 953389 - DNA, 16 bp, Homo sapiens
gtgcatgcatgttggg

SEQ ID NO: 953390 - DNA, 16 bp, Homo sapiens
gtgcatggaggccctc

SEQ ID NO: 953391 - DNA, 16 bp, Homo sapiens
gtgcattacagagagg

SEQ ID NO: 953392 - DNA, 14 bp, Homo sapiens
gtgcattctccagc

SEQ ID NO: 953393 - DNA, 19 bp, Homo sapiens
gtgcattctgtttcctctt

SEQ ID NO: 953394 - DNA, 22 bp, Homo sapiens
gtgcattgtatagatataatga

SEQ ID NO: 953395 - DNA, 15 bp, Homo sapiens
gtgcatttaaactct

SEQ ID NO: 953396 - DNA, 18 bp, Homo sapiens
gtgcatttgagagaagcc

SEQ ID NO: 953397 - DNA, 19 bp, Homo sapiens
gtgcatttgagagaagcca

SEQ ID NO: 953398 - DNA, 22 bp, Homo sapiens
gtgcatttgagagaagccacgc

SEQ ID NO: 953399 - DNA, 15 bp, Homo sapiens
gtgcatttgaggggc

SEQ ID NO: 953400 - DNA, 13 bp, Homo sapiens
gtgcatttttaaa

SEQ ID NO: 953401 - DNA, 14 bp, Homo sapiens
gtgccaaccccacc

SEQ ID NO: 953402 - DNA, 21 bp, Homo sapiens
gtgccaaccccacccagctcc

SEQ ID NO: 953403 - DNA, 16 bp, Homo sapiens
gtgccaagattctact

SEQ ID NO: 953404 - DNA, 18 bp, Homo sapiens
gtgccaagccttctgtga

SEQ ID NO: 953405 - DNA, 23 bp, Homo sapiens
gtgccaagggccccaggggcagc

SEQ ID NO: 953406 - DNA, 15 bp, Homo sapiens
gtgccaatatgtatt

SEQ ID NO: 953407 - DNA, 21 bp, Homo sapiens
gtgccaatatgtattgtaaac

SEQ ID NO: 953408 - DNA, 18 bp, Homo sapiens
gtgccacacgcatgggca

SEQ ID NO: 953409 - DNA, 19 bp, Homo sapiens
gtgccacacgcatgggcat

SEQ ID NO: 953410 - DNA, 20 bp, Homo sapiens
gtgccacagcctgctggcag

SEQ ID NO: 953411 - DNA, 21 bp, Homo sapiens
gtgccacagcctgctggcagg

SEQ ID NO: 953412 - DNA, 22 bp, Homo sapiens
gtgccacagcctgctggcaggg

SEQ ID NO: 953413 - DNA, 23 bp, Homo sapiens
gtgccacagcctgctggcagggc

SEQ ID NO: 953414 - DNA, 21 bp, Homo sapiens
gtgccaccctcctccctccaa

SEQ ID NO: 953415 - DNA, 17 bp, Homo sapiens
gtgccacctatgcctgt

SEQ ID NO: 953416 - DNA, 13 bp, Homo sapiens
gtgccacctgtcc

SEQ ID NO: 953417 - DNA, 18 bp, Homo sapiens
gtgccactccctgagctt

SEQ ID NO: 953418 - DNA, 17 bp, Homo sapiens
gtgccactgacttgctg

SEQ ID NO: 953419 - DNA, 23 bp, Homo sapiens
gtgccactgccccccgaggctgc

SEQ ID NO: 953420 - DNA, 19 bp, Homo sapiens
gtgccactgcccgagctgg

SEQ ID NO: 953421 - DNA, 20 bp, Homo sapiens
gtgccactgcccgagctggt

SEQ ID NO: 953422 - DNA, 21 bp, Homo sapiens
gtgccactgcccgagctggtg

SEQ ID NO: 953423 - DNA, 18 bp, Homo sapiens
gtgccacttaatgtatgt

SEQ ID NO: 953424 - DNA, 22 bp, Homo sapiens
gtgccacttcttaaaggcctgg

SEQ ID NO: 953425 - DNA, 23 bp, Homo sapiens
gtgccacttcttaaaggcctgga

SEQ ID NO: 953426 - DNA, 18 bp, Homo sapiens
gtgccacttgacattcct

SEQ ID NO: 953427 - DNA, 23 bp, Homo sapiens
gtgccactttacccacctagaac

SEQ ID NO: 953428 - DNA, 14 bp, Homo sapiens
gtgccagaaggaag

SEQ ID NO: 953429 - DNA, 15 bp, Homo sapiens
gtgccagaaggaagg

SEQ ID NO: 953430 - DNA, 20 bp, Homo sapiens
gtgccagacaaataggagtg

SEQ ID NO: 953431 - DNA, 22 bp, Homo sapiens
gtgccagaggaatcctggcagc

SEQ ID NO: 953432 - DNA, 19 bp, Homo sapiens
gtgccagaggtgggcaggt

SEQ ID NO: 953433 - DNA, 18 bp, Homo sapiens
gtgccagatataactgtc

SEQ ID NO: 953434 - DNA, 20 bp, Homo sapiens
gtgccagcaccacagccggt

SEQ ID NO: 953435 - DNA, 12 bp, Homo sapiens
gtgccagcagcc

SEQ ID NO: 953436 - DNA, 13 bp, Homo sapiens
gtgccagcagcct

SEQ ID NO: 953437 - DNA, 22 bp, Homo sapiens
gtgccagccgtgatgctcaggc

SEQ ID NO: 953438 - DNA, 18 bp, Homo sapiens
gtgccagccttcctctgc

SEQ ID NO: 953439 - DNA, 19 bp, Homo sapiens
gtgccagccttcctctgca

SEQ ID NO: 953440 - DNA, 12 bp, Homo sapiens
gtgccagctcca

SEQ ID NO: 953441 - DNA, 15 bp, Homo sapiens
gtgccagctctagtt

SEQ ID NO: 953442 - DNA, 16 bp, Homo sapiens
tgtaaatctgccacaa

SEQ ID NO: 953443 - DNA, 22 bp, Homo sapiens
tgtaaatctttttgcttctact

SEQ ID NO: 953444 - DNA, 14 bp, Homo sapiens
tgtaaatgagaaga

SEQ ID NO: 953445 - DNA, 13 bp, Homo sapiens
tgtaaatgctcgt

SEQ ID NO: 953446 - DNA, 22 bp, Homo sapiens
tgtaaatgctgtcaactatgat

SEQ ID NO: 953447 - DNA, 12 bp, Homo sapiens
tgtaaatgtgtt

SEQ ID NO: 953448 - DNA, 13 bp, Homo sapiens
tgtaaatgtttct

SEQ ID NO: 953449 - DNA, 21 bp, Homo sapiens
tgtaaatgtttcttttccctt

SEQ ID NO: 953450 - DNA, 16 bp, Homo sapiens
tgtaaattaactttta

SEQ ID NO: 953451 - DNA, 17 bp, Homo sapiens
tgtaaattaacttttat

SEQ ID NO: 953452 - DNA, 15 bp, Homo sapiens
tgtaaattatatttg

SEQ ID NO: 953453 - DNA, 20 bp, Homo sapiens
tgtaaattatgtaatgcaaa

SEQ ID NO: 953454 - DNA, 17 bp, Homo sapiens
tgtaaattattgatgat

SEQ ID NO: 953455 - DNA, 16 bp, Homo sapiens
tgtaaattattgtaaa

SEQ ID NO: 953456 - DNA, 18 bp, Homo sapiens
tgtaaattattgtaaact

SEQ ID NO: 953457 - DNA, 22 bp, Homo sapiens
tgtaaattattgtaaacttttt

SEQ ID NO: 953458 - DNA, 16 bp, Homo sapiens
tgtaaattatttgcta

SEQ ID NO: 953459 - DNA, 17 bp, Homo sapiens
tgtaaattgaatcagta

SEQ ID NO: 953460 - DNA, 20 bp, Homo sapiens
tgtaaattgcagaattcaaa

SEQ ID NO: 953461 - DNA, 12 bp, Homo sapiens
tgtaaattggca

SEQ ID NO: 953462 - DNA, 15 bp, Homo sapiens
tgtaaatttagtgtt

SEQ ID NO: 953463 - DNA, 12 bp, Homo sapiens
tgtaaatttgta

SEQ ID NO: 953464 - DNA, 17 bp, Homo sapiens
tgtaaattttagagcat

SEQ ID NO: 953465 - DNA, 15 bp, Homo sapiens
tgtaacacaagccac

SEQ ID NO: 953466 - DNA, 23 bp, Homo sapiens
tgtaacacagctgagagactttt

SEQ ID NO: 953467 - DNA, 20 bp, Homo sapiens
tgtaacacagtcattctagg

SEQ ID NO: 953468 - DNA, 18 bp, Homo sapiens
tgtaacactttacaatgt

SEQ ID NO: 953469 - DNA, 18 bp, Homo sapiens
tgtaacagccaggagtgt

SEQ ID NO: 953470 - DNA, 15 bp, Homo sapiens
tgtaacagctgaggt

SEQ ID NO: 953471 - DNA, 20 bp, Homo sapiens
tgtaacaggtctcctcttaa

SEQ ID NO: 953472 - DNA, 21 bp, Homo sapiens
tgtaacaggtctcctcttaaa

SEQ ID NO: 953473 - DNA, 22 bp, Homo sapiens
tgtaacaggtctcctcttaaaa

SEQ ID NO: 953474 - DNA, 21 bp, Homo sapiens
tgtaacagtcaaatatcattt

SEQ ID NO: 953475 - DNA, 21 bp, Homo sapiens
tgtaacatcataattacattc

SEQ ID NO: 953476 - DNA, 15 bp, Homo sapiens
tgtaacatccagaag

SEQ ID NO: 953477 - DNA, 13 bp, Homo sapiens
tgtaacatgaagc

SEQ ID NO: 953478 - DNA, 18 bp, Homo sapiens
tgtaacatgatgttaact

SEQ ID NO: 953479 - DNA, 15 bp, Homo sapiens
tgtaacattgtaaag

SEQ ID NO: 953480 - DNA, 16 bp, Homo sapiens
tgtaacattgtaaagt

SEQ ID NO: 953481 - DNA, 22 bp, Homo sapiens
tgtaacctgctggatgggactc

SEQ ID NO: 953482 - DNA, 22 bp, Homo sapiens
tgtaacgttttctttcacacac

SEQ ID NO: 953483 - DNA, 14 bp, Homo sapiens
tgtaactaaaataa

SEQ ID NO: 953484 - DNA, 16 bp, Homo sapiens
tgtaactacaaagctt

SEQ ID NO: 953485 - DNA, 21 bp, Homo sapiens
tgtaactacaaagctttgcta

SEQ ID NO: 953486 - DNA, 22 bp, Homo sapiens
tgtaactacaaagctttgctac

SEQ ID NO: 953487 - DNA, 18 bp, Homo sapiens
tgtaactattgggtgaat

SEQ ID NO: 953488 - DNA, 21 bp, Homo sapiens
tgtaactccagatagagaaat

SEQ ID NO: 953489 - DNA, 17 bp, Homo sapiens
tgtaactctaaaagatc

SEQ ID NO: 953490 - DNA, 18 bp, Homo sapiens
tgtaactctccagccatt

SEQ ID NO: 953491 - DNA, 21 bp, Homo sapiens
tgtaactgaggactgtttgca

SEQ ID NO: 953492 - DNA, 18 bp, Homo sapiens
tgtaactgcccagcccct

SEQ ID NO: 953493 - DNA, 14 bp, Homo sapiens
tgtaactgctcaga

SEQ ID NO: 953494 - DNA, 16 bp, Homo sapiens
tgtaactgctcagagc

SEQ ID NO: 953495 - DNA, 19 bp, Homo sapiens
tgtaactgctcagagcttt

SEQ ID NO: 953496 - DNA, 20 bp, Homo sapiens
tgtaactgctcagagcttta

SEQ ID NO: 953497 - DNA, 16 bp, Homo sapiens
tgtaactgttacagta

SEQ ID NO: 953498 - DNA, 18 bp, Homo sapiens
tgtaactgttacagtaat

SEQ ID NO: 953499 - DNA, 14 bp, Homo sapiens
tgtaacttattcca

SEQ ID NO: 953500 - DNA, 12 bp, Homo sapiens
gtgcccctggcc

SEQ ID NO: 953501 - DNA, 13 bp, Homo sapiens
gtgcccctgtccc

SEQ ID NO: 953502 - DNA, 19 bp, Homo sapiens
gtgcccctgtcccacctgg

SEQ ID NO: 953503 - DNA, 21 bp, Homo sapiens
gtgcccctgtgctgcggggcc

SEQ ID NO: 953504 - DNA, 12 bp, Homo sapiens
gtgccccttcac

SEQ ID NO: 953505 - DNA, 17 bp, Homo sapiens
gtgcccctttccttcac

SEQ ID NO: 953506 - DNA, 23 bp, Homo sapiens
gtgcccctttccttcactgcccc

SEQ ID NO: 953507 - DNA, 15 bp, Homo sapiens
gtgcccgcatgtgtg

SEQ ID NO: 953508 - DNA, 19 bp, Homo sapiens
gtgcccgcatgtgtgcctg

SEQ ID NO: 953509 - DNA, 20 bp, Homo sapiens
gtgcccgcctaggagttgag

SEQ ID NO: 953510 - DNA, 20 bp, Homo sapiens
gtgcccggccaagtaaaatg

SEQ ID NO: 953511 - DNA, 13 bp, Homo sapiens
gtgcccggcccca

SEQ ID NO: 953512 - DNA, 23 bp, Homo sapiens
gtgcccgttttaccaataaactg

SEQ ID NO: 953513 - DNA, 15 bp, Homo sapiens
gtgccctcaccacca

SEQ ID NO: 953514 - DNA, 22 bp, Homo sapiens
gtgccctctgctcaggcctccc

SEQ ID NO: 953515 - DNA, 18 bp, Homo sapiens
gtgccctgaaagggccct

SEQ ID NO: 953516 - DNA, 23 bp, Homo sapiens
gtgccctgcaggcacagaggagg

SEQ ID NO: 953517 - DNA, 12 bp, Homo sapiens
gtgccctgcccc

SEQ ID NO: 953518 - DNA, 19 bp, Homo sapiens
gtgccctgcccccatctcc

SEQ ID NO: 953519 - DNA, 18 bp, Homo sapiens
gtgccctggatgcccagg

SEQ ID NO: 953520 - DNA, 17 bp, Homo sapiens
gtgccctgggccaggca

SEQ ID NO: 953521 - DNA, 15 bp, Homo sapiens
gtgccctggtggaga

SEQ ID NO: 953522 - DNA, 22 bp, Homo sapiens
gtgcccttgcccttggagctgc

SEQ ID NO: 953523 - DNA, 17 bp, Homo sapiens
gtgccgaatgactatgt

SEQ ID NO: 953524 - DNA, 21 bp, Homo sapiens
gtgccgaatgactatgtccag

SEQ ID NO: 953525 - DNA, 16 bp, Homo sapiens
gtgccgcactctggcg

SEQ ID NO: 953526 - DNA, 14 bp, Homo sapiens
gtgccgcctgctcc

SEQ ID NO: 953527 - DNA, 13 bp, Homo sapiens
gtgccgcgctccg

SEQ ID NO: 953528 - DNA, 13 bp, Homo sapiens
gtgccgctcctgc

SEQ ID NO: 953529 - DNA, 15 bp, Homo sapiens
gtgccgctcctgctt

SEQ ID NO: 953530 - DNA, 16 bp, Homo sapiens
gtgccgctcctgcttc

SEQ ID NO: 953531 - DNA, 17 bp, Homo sapiens
gtgccggggaggggcag

SEQ ID NO: 953532 - DNA, 19 bp, Homo sapiens
gtgccggggaggggcagag

SEQ ID NO: 953533 - DNA, 22 bp, Homo sapiens
gtgccgtgtcccctgacagggc

SEQ ID NO: 953534 - DNA, 13 bp, Homo sapiens
gtgccgtgtgagt

SEQ ID NO: 953535 - DNA, 22 bp, Homo sapiens
gtgccgttactctccaacctgg

SEQ ID NO: 953536 - DNA, 15 bp, Homo sapiens
gtgcctaaagtgctg

SEQ ID NO: 953537 - DNA, 22 bp, Homo sapiens
gtgcctaagaagttattttctt

SEQ ID NO: 953538 - DNA, 17 bp, Homo sapiens
gtgcctaatggagaaga

SEQ ID NO: 953539 - DNA, 21 bp, Homo sapiens
gtgcctaggttggtttcccct

SEQ ID NO: 953540 - DNA, 19 bp, Homo sapiens
gtgcctatttgtgtggaca

SEQ ID NO: 953541 - DNA, 22 bp, Homo sapiens
gtgcctcacatttttttctacc

SEQ ID NO: 953542 - DNA, 13 bp, Homo sapiens
gtgcctcagagac

SEQ ID NO: 953543 - DNA, 16 bp, Homo sapiens
gtgcctcagagcaggc

SEQ ID NO: 953544 - DNA, 20 bp, Homo sapiens
gtgcctccaagcggccctgt

SEQ ID NO: 953545 - DNA, 22 bp, Homo sapiens
gtgcctccacatgctgcctggc

SEQ ID NO: 953546 - DNA, 23 bp, Homo sapiens
gtgcctccacatgctgcctggca

SEQ ID NO: 953547 - DNA, 20 bp, Homo sapiens
gtgcctccaggaccaggggc

SEQ ID NO: 953548 - DNA, 20 bp, Homo sapiens
gtgcctcccacacttgctgg

SEQ ID NO: 953549 - DNA, 17 bp, Homo sapiens
gtgcctccccccagacc

SEQ ID NO: 953550 - DNA, 18 bp, Homo sapiens
gtgcctccccccagaccc

SEQ ID NO: 953551 - DNA, 17 bp, Homo sapiens
gtgcctcccgagaaatt

SEQ ID NO: 953552 - DNA, 15 bp, Homo sapiens
gtgcctcccttccca

SEQ ID NO: 953553 - DNA, 13 bp, Homo sapiens
gtgcctcctagag

SEQ ID NO: 953554 - DNA, 18 bp, Homo sapiens
gtgcctcctagccccttc

SEQ ID NO: 953555 - DNA, 19 bp, Homo sapiens
gtgcctcctcagaggacag

SEQ ID NO: 953556 - DNA, 22 bp, Homo sapiens
gtgcctccttccacctccctcc

SEQ ID NO: 953557 - DNA, 22 bp, Homo sapiens
gtgcctcgaggcaccggcgctg

SEQ ID NO: 953558 - DNA, 15 bp, Homo sapiens
gtgcctcgcatccta

SEQ ID NO: 953559 - DNA, 12 bp, Homo sapiens
gtgcctctgcct

SEQ ID NO: 953560 - DNA, 14 bp, Homo sapiens
gtgcctctgggact

SEQ ID NO: 953561 - DNA, 14 bp, Homo sapiens
gtgcctctgtgcac

SEQ ID NO: 953562 - DNA, 19 bp, Homo sapiens
gtgcctcttccagtgaaca

SEQ ID NO: 953563 - DNA, 21 bp, Homo sapiens
tgtaatatttacataaagact

SEQ ID NO: 953564 - DNA, 20 bp, Homo sapiens
tgtaatcaatgtttcttcta

SEQ ID NO: 953565 - DNA, 22 bp, Homo sapiens
tgtaatcagctctcctggctcc

SEQ ID NO: 953566 - DNA, 20 bp, Homo sapiens
tgtaatccaggggtgtagat

SEQ ID NO: 953567 - DNA, 20 bp, Homo sapiens
tgtaatcccagctactcagg

SEQ ID NO: 953568 - DNA, 14 bp, Homo sapiens
tgtaatctgaagta

SEQ ID NO: 953569 - DNA, 20 bp, Homo sapiens
tgtaatctttcatccaaaat

SEQ ID NO: 953570 - DNA, 21 bp, Homo sapiens
tgtaatctttcatccaaaata

SEQ ID NO: 953571 - DNA, 20 bp, Homo sapiens
tgtaatctttttctccaccc

SEQ ID NO: 953572 - DNA, 17 bp, Homo sapiens
tgtaatgcaaaaggctg

SEQ ID NO: 953573 - DNA, 12 bp, Homo sapiens
tgtaatgcactg

SEQ ID NO: 953574 - DNA, 16 bp, Homo sapiens
tgtaatgcactgtttt

SEQ ID NO: 953575 - DNA, 17 bp, Homo sapiens
tgtaatgcattaataaa

SEQ ID NO: 953576 - DNA, 20 bp, Homo sapiens
tgtaatggagcatcaagcca

SEQ ID NO: 953577 - DNA, 18 bp, Homo sapiens
tgtaatgggtaattctga

SEQ ID NO: 953578 - DNA, 21 bp, Homo sapiens
tgtaatggtactgactttgct

SEQ ID NO: 953579 - DNA, 12 bp, Homo sapiens
tgtaatgtcaga

SEQ ID NO: 953580 - DNA, 22 bp, Homo sapiens
tgtaatgtcagactttgctgca

SEQ ID NO: 953581 - DNA, 22 bp, Homo sapiens
tgtaatgtccctttcagagaca

SEQ ID NO: 953582 - DNA, 21 bp, Homo sapiens
tgtaatgtgtggtggcctcag

SEQ ID NO: 953583 - DNA, 22 bp, Homo sapiens
tgtaatgtgtggtggcctcagc

SEQ ID NO: 953584 - DNA, 22 bp, Homo sapiens
tgtaattaaactagtttaaggg

SEQ ID NO: 953585 - DNA, 17 bp, Homo sapiens
tgtaattaactgtaaac

SEQ ID NO: 953586 - DNA, 23 bp, Homo sapiens
tgtaattaagtactatgtatcaa

SEQ ID NO: 953587 - DNA, 16 bp, Homo sapiens
tgtaattaatatcttg

SEQ ID NO: 953588 - DNA, 14 bp, Homo sapiens
tgtaattacatatt

SEQ ID NO: 953589 - DNA, 21 bp, Homo sapiens
tgtaattagtgccacttaatg

SEQ ID NO: 953590 - DNA, 23 bp, Homo sapiens
tgtaattagtgccacttaatgta

SEQ ID NO: 953591 - DNA, 13 bp, Homo sapiens
tgtaattctaaat

SEQ ID NO: 953592 - DNA, 14 bp, Homo sapiens
tgtaattctaaatg

SEQ ID NO: 953593 - DNA, 16 bp, Homo sapiens
tgtaattctaaatgaa

SEQ ID NO: 953594 - DNA, 15 bp, Homo sapiens
tgtaattgaataaag

SEQ ID NO: 953595 - DNA, 17 bp, Homo sapiens
tgtaattgcttacattt

SEQ ID NO: 953596 - DNA, 14 bp, Homo sapiens
tgtaattggaatct

SEQ ID NO: 953597 - DNA, 15 bp, Homo sapiens
tgtaattggaatctt

SEQ ID NO: 953598 - DNA, 21 bp, Homo sapiens
tgtaattggaatcttcacctc

SEQ ID NO: 953599 - DNA, 14 bp, Homo sapiens
tgtaattgtgtaaa

SEQ ID NO: 953600 - DNA, 16 bp, Homo sapiens
tgtaattgttcctttt

SEQ ID NO: 953601 - DNA, 14 bp, Homo sapiens
tgtaatttaaacag

SEQ ID NO: 953602 - DNA, 14 bp, Homo sapiens
tgtaatttagaaac

SEQ ID NO: 953603 - DNA, 13 bp, Homo sapiens
tgtaatttcaaaa

SEQ ID NO: 953604 - DNA, 19 bp, Homo sapiens
tgtaatttcaggaggaata

SEQ ID NO: 953605 - DNA, 15 bp, Homo sapiens
tgtaatttcgcctta

SEQ ID NO: 953606 - DNA, 17 bp, Homo sapiens
tgtaatttcgccttaaa

SEQ ID NO: 953607 - DNA, 16 bp, Homo sapiens
tgtaatttgtgataca

SEQ ID NO: 953608 - DNA, 21 bp, Homo sapiens
tgtaattttaaataaaagtga

SEQ ID NO: 953609 - DNA, 17 bp, Homo sapiens
tgtaattttattttaaa

SEQ ID NO: 953610 - DNA, 16 bp, Homo sapiens
tgtaattttgtgtaag

SEQ ID NO: 953611 - DNA, 23 bp, Homo sapiens
tgtaattttgttctagttttcag

SEQ ID NO: 953612 - DNA, 20 bp, Homo sapiens
tgtaatttttttatcgtcac

SEQ ID NO: 953613 - DNA, 16 bp, Homo sapiens
tgtacaaaactgtaaa

SEQ ID NO: 953614 - DNA, 11 bp, Homo sapiens
tgtacaaaagc

SEQ ID NO: 953615 - DNA, 15 bp, Homo sapiens
tgtacaaaagcaatg

SEQ ID NO: 953616 - DNA, 13 bp, Homo sapiens
tgtacaaaataaa

SEQ ID NO: 953617 - DNA, 22 bp, Homo sapiens
tgtacaaaataaacaaataaca

SEQ ID NO: 953618 - DNA, 19 bp, Homo sapiens
tgtacaaaccaagagcttt

SEQ ID NO: 953619 - DNA, 21 bp, Homo sapiens
tgtacaaatataagaataaaa

SEQ ID NO: 953620 - DNA, 20 bp, Homo sapiens
tgtacaaattgtcgttttta

SEQ ID NO: 953621 - DNA, 15 bp, Homo sapiens
tgtacaacttaagtt

SEQ ID NO: 953622 - DNA, 22 bp, Homo sapiens
tgtacaagagtccctttgaaga

SEQ ID NO: 953623 - DNA, 17 bp, Homo sapiens
tgtacaaggatgaaaga

SEQ ID NO: 953624 - DNA, 20 bp, Homo sapiens
tgtacaatacaatgtacaat

SEQ ID NO: 953625 - DNA, 15 bp, Homo sapiens
tgtacaatcatgaac

SEQ ID NO: 953626 - DNA, 16 bp, Homo sapiens
tgtacaattatgtctc

SEQ ID NO: 953627 - DNA, 20 bp, Homo sapiens
gtgctaaagttttcttccca

SEQ ID NO: 953628 - DNA, 13 bp, Homo sapiens
gtgctaaattttc

SEQ ID NO: 953629 - DNA, 14 bp, Homo sapiens
gtgctaggaagagg

SEQ ID NO: 953630 - DNA, 20 bp, Homo sapiens
gtgctagggaaacttcccgt

SEQ ID NO: 953631 - DNA, 20 bp, Homo sapiens
gtgctagtggcaagacagtg

SEQ ID NO: 953632 - DNA, 18 bp, Homo sapiens
gtgctataggctggagaa

SEQ ID NO: 953633 - DNA, 20 bp, Homo sapiens
gtgctatatccagttcctgc

SEQ ID NO: 953634 - DNA, 22 bp, Homo sapiens
gtgctatatccagttcctgctc

SEQ ID NO: 953635 - DNA, 13 bp, Homo sapiens
gtgctatgaattt

SEQ ID NO: 953636 - DNA, 17 bp, Homo sapiens
gtgctattctgtgttga

SEQ ID NO: 953637 - DNA, 13 bp, Homo sapiens
gtgctatttctat

SEQ ID NO: 953638 - DNA, 19 bp, Homo sapiens
gtgctatttctattcctta

SEQ ID NO: 953639 - DNA, 13 bp, Homo sapiens
gtgctatttgaag

SEQ ID NO: 953640 - DNA, 19 bp, Homo sapiens
gtgctatttgaagaaaaaa

SEQ ID NO: 953641 - DNA, 16 bp, Homo sapiens
gtgctcaatagcttga

SEQ ID NO: 953642 - DNA, 20 bp, Homo sapiens
gtgctcacgactcttcctgc

SEQ ID NO: 953643 - DNA, 14 bp, Homo sapiens
gtgctcacgctccc

SEQ ID NO: 953644 - DNA, 22 bp, Homo sapiens
gtgctcacgttaccttgacaca

SEQ ID NO: 953645 - DNA, 15 bp, Homo sapiens
gtgctcagaagagga

SEQ ID NO: 953646 - DNA, 20 bp, Homo sapiens
gtgctcagagacctgaagtg

SEQ ID NO: 953647 - DNA, 15 bp, Homo sapiens
gtgctcagccaaatt

SEQ ID NO: 953648 - DNA, 20 bp, Homo sapiens
gtgctcagccaaatttcctg

SEQ ID NO: 953649 - DNA, 16 bp, Homo sapiens
gtgctcccctgccaca

SEQ ID NO: 953650 - DNA, 21 bp, Homo sapiens
gtgctcccctgccacactgat

SEQ ID NO: 953651 - DNA, 22 bp, Homo sapiens
gtgctccctcccatcctccagc

SEQ ID NO: 953652 - DNA, 13 bp, Homo sapiens
gtgctccgtgcct

SEQ ID NO: 953653 - DNA, 17 bp, Homo sapiens
gtgctccgtgcctccac

SEQ ID NO: 953654 - DNA, 18 bp, Homo sapiens
gtgctccgtgcctccacc

SEQ ID NO: 953655 - DNA, 12 bp, Homo sapiens
gtgctcctctcc

SEQ ID NO: 953656 - DNA, 14 bp, Homo sapiens
gtgctcctctcctt

SEQ ID NO: 953657 - DNA, 19 bp, Homo sapiens
gtgctcctcttgattcctg

SEQ ID NO: 953658 - DNA, 16 bp, Homo sapiens
gtgctcctgcccagcc

SEQ ID NO: 953659 - DNA, 15 bp, Homo sapiens
gtgctcctgctgacc

SEQ ID NO: 953660 - DNA, 20 bp, Homo sapiens
gtgctcgagtcacattctgc

SEQ ID NO: 953661 - DNA, 16 bp, Homo sapiens
gtgctcgggaagggag

SEQ ID NO: 953662 - DNA, 15 bp, Homo sapiens
gtgctcgggatcaaa

SEQ ID NO: 953663 - DNA, 17 bp, Homo sapiens
gtgctctcagctggcag

SEQ ID NO: 953664 - DNA, 18 bp, Homo sapiens
gtgctctccccggcaggc

SEQ ID NO: 953665 - DNA, 21 bp, Homo sapiens
gtgctctccccggcaggcctg

SEQ ID NO: 953666 - DNA, 13 bp, Homo sapiens
gtgctctctgcca

SEQ ID NO: 953667 - DNA, 13 bp, Homo sapiens
gtgctctctttct

SEQ ID NO: 953668 - DNA, 16 bp, Homo sapiens
gtgctctctttctgtc

SEQ ID NO: 953669 - DNA, 13 bp, Homo sapiens
gtgctctggcggc

SEQ ID NO: 953670 - DNA, 18 bp, Homo sapiens
gtgctcttgaacctgtgc

SEQ ID NO: 953671 - DNA, 14 bp, Homo sapiens
gtgctctttcattt

SEQ ID NO: 953672 - DNA, 13 bp, Homo sapiens
gtgctctttgaag

SEQ ID NO: 953673 - DNA, 14 bp, Homo sapiens
gtgctcttttctcc

SEQ ID NO: 953674 - DNA, 20 bp, Homo sapiens
gtgctcttttctcctcactg

SEQ ID NO: 953675 - DNA, 18 bp, Homo sapiens
gtgctgaactgtgcatca

SEQ ID NO: 953676 - DNA, 17 bp, Homo sapiens
gtgctgacagctgctcc

SEQ ID NO: 953677 - DNA, 21 bp, Homo sapiens
gtgctgagtgtacagagtgga

SEQ ID NO: 953678 - DNA, 23 bp, Homo sapiens
gtgctgataattgtgtattttct

SEQ ID NO: 953679 - DNA, 15 bp, Homo sapiens
gtgctgatccggctg

SEQ ID NO: 953680 - DNA, 21 bp, Homo sapiens
gtgctgatcctaagaattttt

SEQ ID NO: 953681 - DNA, 23 bp, Homo sapiens
gtgctgatgggaaggaggggagc

SEQ ID NO: 953682 - DNA, 17 bp, Homo sapiens
gtgctgcacaaaagcag

SEQ ID NO: 953683 - DNA, 16 bp, Homo sapiens
gtgctgcagccaaaga

SEQ ID NO: 953684 - DNA, 23 bp, Homo sapiens
gtgctgcaggagtgtcctgccca

SEQ ID NO: 953685 - DNA, 21 bp, Homo sapiens
tgtacatttatttattactgt

SEQ ID NO: 953686 - DNA, 17 bp, Homo sapiens
tgtacatttttgggggg

SEQ ID NO: 953687 - DNA, 13 bp, Homo sapiens
tgtaccaaaattt

SEQ ID NO: 953688 - DNA, 15 bp, Homo sapiens
tgtaccaaaatttta

SEQ ID NO: 953689 - DNA, 17 bp, Homo sapiens
tgtaccaaaattttaaa

SEQ ID NO: 953690 - DNA, 15 bp, Homo sapiens
tgtaccacagacaca

SEQ ID NO: 953691 - DNA, 18 bp, Homo sapiens
tgtaccacttctgtgggc

SEQ ID NO: 953692 - DNA, 12 bp, Homo sapiens
tgtaccagttaa

SEQ ID NO: 953693 - DNA, 14 bp, Homo sapiens
tgtaccagttaatt

SEQ ID NO: 953694 - DNA, 19 bp, Homo sapiens
tgtaccatagaaaaatgta

SEQ ID NO: 953695 - DNA, 22 bp, Homo sapiens
tgtaccatagaaaaatgtataa

SEQ ID NO: 953696 - DNA, 12 bp, Homo sapiens
tgtaccatcaat

SEQ ID NO: 953697 - DNA, 15 bp, Homo sapiens
tgtaccatcaataaa

SEQ ID NO: 953698 - DNA, 17 bp, Homo sapiens
tgtaccattccttcaaa

SEQ ID NO: 953699 - DNA, 21 bp, Homo sapiens
tgtaccattccttcaaataaa

SEQ ID NO: 953700 - DNA, 12 bp, Homo sapiens
tgtacccacccc

SEQ ID NO: 953701 - DNA, 16 bp, Homo sapiens
tgtacccaccccagca

SEQ ID NO: 953702 - DNA, 21 bp, Homo sapiens
tgtacccaccccagcacagcc

SEQ ID NO: 953703 - DNA, 13 bp, Homo sapiens
tgtacccagctcc

SEQ ID NO: 953704 - DNA, 19 bp, Homo sapiens
tgtacccatctttaattta

SEQ ID NO: 953705 - DNA, 18 bp, Homo sapiens
tgtaccccctttcccttc

SEQ ID NO: 953706 - DNA, 15 bp, Homo sapiens
tgtaccctttaagat

SEQ ID NO: 953707 - DNA, 20 bp, Homo sapiens
tgtaccgtcgacaagaatgt

SEQ ID NO: 953708 - DNA, 23 bp, Homo sapiens
tgtaccgtcgacaagaatgtccc

SEQ ID NO: 953709 - DNA, 24 bp, Homo sapiens
tgtacctatagaaatagaacactg

SEQ ID NO: 953710 - DNA, 14 bp, Homo sapiens
tgtacctatttctg

SEQ ID NO: 953711 - DNA, 16 bp, Homo sapiens
tgtacctatttctgat

SEQ ID NO: 953712 - DNA, 22 bp, Homo sapiens
tgtacctatttctgatgatgtc

SEQ ID NO: 953713 - DNA, 15 bp, Homo sapiens
tgtacctcctctcag

SEQ ID NO: 953714 - DNA, 19 bp, Homo sapiens
tgtacctcctctcagtgtt

SEQ ID NO: 953715 - DNA, 20 bp, Homo sapiens
tgtacctcctctcagtgttt

SEQ ID NO: 953716 - DNA, 19 bp, Homo sapiens
tgtacctctagctgttctt

SEQ ID NO: 953717 - DNA, 18 bp, Homo sapiens
tgtacctgcccccaatcc

SEQ ID NO: 953718 - DNA, 21 bp, Homo sapiens
tgtaccttttgaggagcccca

SEQ ID NO: 953719 - DNA, 18 bp, Homo sapiens
tgtacgtatgaatgatat

SEQ ID NO: 953720 - DNA, 20 bp, Homo sapiens
tgtacgtatgaatgatatct

SEQ ID NO: 953721 - DNA, 22 bp, Homo sapiens
tgtacgtatgaatgatatcttt

SEQ ID NO: 953722 - DNA, 19 bp, Homo sapiens
tgtacgtttgtatgtgtgt

SEQ ID NO: 953723 - DNA, 16 bp, Homo sapiens
tgtactaagccaggag

SEQ ID NO: 953724 - DNA, 17 bp, Homo sapiens
tgtactacctgtgtata

SEQ ID NO: 953725 - DNA, 13 bp, Homo sapiens
tgtactagtttta

SEQ ID NO: 953726 - DNA, 14 bp, Homo sapiens
tgtactcagagcag

SEQ ID NO: 953727 - DNA, 14 bp, Homo sapiens
tgtactccagcctg

SEQ ID NO: 953728 - DNA, 18 bp, Homo sapiens
tgtactccagcctgggtg

SEQ ID NO: 953729 - DNA, 14 bp, Homo sapiens
tgtactcttccgaa

SEQ ID NO: 953730 - DNA, 20 bp, Homo sapiens
tgtactgaaaaatggtaatt

SEQ ID NO: 953731 - DNA, 20 bp, Homo sapiens
tgtactgaatttttttgtaa

SEQ ID NO: 953732 - DNA, 17 bp, Homo sapiens
tgtactgagccttgtaa

SEQ ID NO: 953733 - DNA, 19 bp, Homo sapiens
tgtactgagccttgtaatt

SEQ ID NO: 953734 - DNA, 19 bp, Homo sapiens
tgtactgcatatgaaagga

SEQ ID NO: 953735 - DNA, 16 bp, Homo sapiens
tgtactgcatgtgact

SEQ ID NO: 953736 - DNA, 20 bp, Homo sapiens
tgtactgctcaggctgcagc

SEQ ID NO: 953737 - DNA, 21 bp, Homo sapiens
tgtactggccagtgtcatttt

SEQ ID NO: 953738 - DNA, 16 bp, Homo sapiens
tgtactgtaaagaatt

SEQ ID NO: 953739 - DNA, 20 bp, Homo sapiens
tgtactgtacataaattcca

SEQ ID NO: 953740 - DNA, 22 bp, Homo sapiens
tgtactgtacataaattccaga

SEQ ID NO: 953741 - DNA, 12 bp, Homo sapiens
tgtactgtagtt

SEQ ID NO: 953742 - DNA, 16 bp, Homo sapiens
tgtactgtagtttttc

SEQ ID NO: 953743 - DNA, 19 bp, Homo sapiens
tgtactgttctgtgtcttt

SEQ ID NO: 953744 - DNA, 19 bp, Homo sapiens
tgtactgtttaatgttctg

SEQ ID NO: 953745 - DNA, 24 bp, Homo sapiens
tgtactgtttaatgttctgtgata

SEQ ID NO: 953746 - DNA, 21 bp, Homo sapiens
tgtacttaaatgagttactta

SEQ ID NO: 953747 - DNA, 20 bp, Homo sapiens
tgtacttagccagttcaaag

SEQ ID NO: 953748 - DNA, 21 bp, Homo sapiens
tgtacttcactgtcaggaaga

SEQ ID NO: 953749 - DNA, 21 bp, Homo sapiens
tgtacttcccgggccagggct

SEQ ID NO: 953750 - DNA, 18 bp, Homo sapiens
tgtacttctctgtgtgca

SEQ ID NO: 953751 - DNA, 21 bp, Homo sapiens
tgtacttctctgtgtgcacac

SEQ ID NO: 953752 - DNA, 16 bp, Homo sapiens
tgtacttctgtgttca

SEQ ID NO: 953753 - DNA, 21 bp, Homo sapiens
ggcagtgccctttgagatctg

SEQ ID NO: 953754 - DNA, 15 bp, Homo sapiens
ggcagtggccaagcc

SEQ ID NO: 953755 - DNA, 22 bp, Homo sapiens
ggcagtggctctcagagcagca

SEQ ID NO: 953756 - DNA, 16 bp, Homo sapiens
ggcagtgggcctgctg

SEQ ID NO: 953757 - DNA, 19 bp, Homo sapiens
ggcagtgggcctgctgagg

SEQ ID NO: 953758 - DNA, 13 bp, Homo sapiens
ggcagtgttttgg

SEQ ID NO: 953759 - DNA, 15 bp, Homo sapiens
ggcagttagagcagc

SEQ ID NO: 953760 - DNA, 12 bp, Homo sapiens
ggcagttatatt

SEQ ID NO: 953761 - DNA, 14 bp, Homo sapiens
ggcagttatatttt

SEQ ID NO: 953762 - DNA, 16 bp, Homo sapiens
ggcagttatattttgc

SEQ ID NO: 953763 - DNA, 19 bp, Homo sapiens
ggcagttctcactcctagg

SEQ ID NO: 953764 - DNA, 13 bp, Homo sapiens
ggcagttctccca

SEQ ID NO: 953765 - DNA, 17 bp, Homo sapiens
ggcagttctcccaggga

SEQ ID NO: 953766 - DNA, 17 bp, Homo sapiens
ggcagttggccaggctc

SEQ ID NO: 953767 - DNA, 23 bp, Homo sapiens
ggcagttttaatcttatcttttg

SEQ ID NO: 953768 - DNA, 10 bp, Homo sapiens
ggcagttttt

SEQ ID NO: 953769 - DNA, 16 bp, Homo sapiens
ggcatactttttaaaa

SEQ ID NO: 953770 - DNA, 19 bp, Homo sapiens
ggcataggtctctttgctt

SEQ ID NO: 953771 - DNA, 22 bp, Homo sapiens
ggcatatccaccacctccctca

SEQ ID NO: 953772 - DNA, 21 bp, Homo sapiens
ggcatatgtttccccatctct

SEQ ID NO: 953773 - DNA, 22 bp, Homo sapiens
ggcatatgtttccccatctctg

SEQ ID NO: 953774 - DNA, 11 bp, Homo sapiens
ggcatatttat

SEQ ID NO: 953775 - DNA, 16 bp, Homo sapiens
ggcatcacagggcaga

SEQ ID NO: 953776 - DNA, 14 bp, Homo sapiens
ggcatcaggcactg

SEQ ID NO: 953777 - DNA, 15 bp, Homo sapiens
ggcatcaggcactgg

SEQ ID NO: 953778 - DNA, 18 bp, Homo sapiens
ggcatcaggcactggtgg

SEQ ID NO: 953779 - DNA, 20 bp, Homo sapiens
ggcatcaggcactggtggca

SEQ ID NO: 953780 - DNA, 17 bp, Homo sapiens
ggcatcagggtagggga

SEQ ID NO: 953781 - DNA, 19 bp, Homo sapiens
ggcatcaggtctgggcaag

SEQ ID NO: 953782 - DNA, 18 bp, Homo sapiens
ggcatcagtccctatgta

SEQ ID NO: 953783 - DNA, 20 bp, Homo sapiens
ggcatcagtgtccttggcag

SEQ ID NO: 953784 - DNA, 18 bp, Homo sapiens
ggcatccacccagtgctg

SEQ ID NO: 953785 - DNA, 21 bp, Homo sapiens
ggcatccacccagtgctgcca

SEQ ID NO: 953786 - DNA, 23 bp, Homo sapiens
ggcatccacccagtgctgccatg

SEQ ID NO: 953787 - DNA, 20 bp, Homo sapiens
ggcatcccagcttgcccccg

SEQ ID NO: 953788 - DNA, 15 bp, Homo sapiens
ggcatcccaggggac

SEQ ID NO: 953789 - DNA, 18 bp, Homo sapiens
ggcatcccagtggcctca

SEQ ID NO: 953790 - DNA, 18 bp, Homo sapiens
ggcatccgaaggtgtctc

SEQ ID NO: 953791 - DNA, 12 bp, Homo sapiens
ggcatcctggat

SEQ ID NO: 953792 - DNA, 13 bp, Homo sapiens
ggcatcctgtgaa

SEQ ID NO: 953793 - DNA, 17 bp, Homo sapiens
ggcatccttgcctgtct

SEQ ID NO: 953794 - DNA, 18 bp, Homo sapiens
ggcatccttgcctgtcta

SEQ ID NO: 953795 - DNA, 20 bp, Homo sapiens
ggcatccttgcctgtctaaa

SEQ ID NO: 953796 - DNA, 20 bp, Homo sapiens
ggcatcgcaatgtaagactc

SEQ ID NO: 953797 - DNA, 14 bp, Homo sapiens
ggcatcggcagctg

SEQ ID NO: 953798 - DNA, 16 bp, Homo sapiens
ggcatcgtagaagaga

SEQ ID NO: 953799 - DNA, 15 bp, Homo sapiens
ggcatcgtggtgggg

SEQ ID NO: 953800 - DNA, 16 bp, Homo sapiens
ggcatctcctgtgcat

SEQ ID NO: 953801 - DNA, 15 bp, Homo sapiens
ggcatctctaattgg

SEQ ID NO: 953802 - DNA, 18 bp, Homo sapiens
ggcatctctaattggaag

SEQ ID NO: 953803 - DNA, 22 bp, Homo sapiens
ggcatctctgtcccattccctg

SEQ ID NO: 953804 - DNA, 23 bp, Homo sapiens
ggcatctctgtcccattccctgg

SEQ ID NO: 953805 - DNA, 19 bp, Homo sapiens
ggcatctcttccccagaga

SEQ ID NO: 953806 - DNA, 15 bp, Homo sapiens
ggcatctgacacaaa

SEQ ID NO: 953807 - DNA, 19 bp, Homo sapiens
ggcatctgagtccagctcc

SEQ ID NO: 953808 - DNA, 19 bp, Homo sapiens
ggcatctgcccctccccca

SEQ ID NO: 953809 - DNA, 21 bp, Homo sapiens
ggcatctgtctgtctgtgggc

SEQ ID NO: 953810 - DNA, 13 bp, Homo sapiens
ggcatctgtgtgt

SEQ ID NO: 953811 - DNA, 16 bp, Homo sapiens
ggcatctgttagcaga

SEQ ID NO: 953812 - DNA, 21 bp, Homo sapiens
ggcatctgttagcagagtctg

SEQ ID NO: 953813 - DNA, 22 bp, Homo sapiens
ggcatctgttagcagagtctgt

SEQ ID NO: 953814 - DNA, 21 bp, Homo sapiens
ggcatctttgccttgggctgc

SEQ ID NO: 953815 - DNA, 18 bp, Homo sapiens
ggcatcttttggaggaaa

SEQ ID NO: 953816 - DNA, 17 bp, Homo sapiens
ggcatgaaccctcttgc

SEQ ID NO: 953817 - DNA, 14 bp, Homo sapiens
ggcatgaagctgca

SEQ ID NO: 953818 - DNA, 14 bp, Homo sapiens
ggcatgacactcta

SEQ ID NO: 953819 - DNA, 23 bp, Homo sapiens
ggcatgacactctagtgacttcc

SEQ ID NO: 953820 - DNA, 13 bp, Homo sapiens
ggcatgagaaaga

SEQ ID NO: 953821 - DNA, 13 bp, Homo sapiens
ggcatgagccact

SEQ ID NO: 953822 - DNA, 21 bp, Homo sapiens
ggcatgatctgatccccaaga

SEQ ID NO: 953823 - DNA, 22 bp, Homo sapiens
ggcatgcacacggctggtcact

SEQ ID NO: 953824 - DNA, 18 bp, Homo sapiens
ggcatgcacgggcatgca

SEQ ID NO: 953825 - DNA, 13 bp, Homo sapiens
ggcatgcagctgc

SEQ ID NO: 953826 - DNA, 16 bp, Homo sapiens
ggcatgcagctgcctg

SEQ ID NO: 953827 - DNA, 17 bp, Homo sapiens
tgaggactcatatattt

SEQ ID NO: 953828 - DNA, 15 bp, Homo sapiens
tgaggactcctgagg

SEQ ID NO: 953829 - DNA, 15 bp, Homo sapiens
tgaggactgtcctcc

SEQ ID NO: 953830 - DNA, 23 bp, Homo sapiens
tgaggacttaaaatattcctgca

SEQ ID NO: 953831 - DNA, 17 bp, Homo sapiens
tgaggactttgcccagg

SEQ ID NO: 953832 - DNA, 11 bp, Homo sapiens
tgaggagaagg

SEQ ID NO: 953833 - DNA, 12 bp, Homo sapiens
tgaggagacatc

SEQ ID NO: 953834 - DNA, 19 bp, Homo sapiens
tgaggagatgcggccaaag

SEQ ID NO: 953835 - DNA, 17 bp, Homo sapiens
tgaggagcaagggtggc

SEQ ID NO: 953836 - DNA, 18 bp, Homo sapiens
tgaggagcagccaggacc

SEQ ID NO: 953837 - DNA, 21 bp, Homo sapiens
tgaggagcccatactcagcct

SEQ ID NO: 953838 - DNA, 22 bp, Homo sapiens
tgaggagcccatactcagcctg

SEQ ID NO: 953839 - DNA, 14 bp, Homo sapiens
tgaggagccctgag

SEQ ID NO: 953840 - DNA, 12 bp, Homo sapiens
tgaggagctgct

SEQ ID NO: 953841 - DNA, 15 bp, Homo sapiens
tgaggagctgctggc

SEQ ID NO: 953842 - DNA, 23 bp, Homo sapiens
tgaggaggaggacacagcacaag

SEQ ID NO: 953843 - DNA, 20 bp, Homo sapiens
tgaggaggatgtccctgggc

SEQ ID NO: 953844 - DNA, 21 bp, Homo sapiens
tgaggaggccgcttagtgctg

SEQ ID NO: 953845 - DNA, 22 bp, Homo sapiens
tgaggaggggagggtaaataaa

SEQ ID NO: 953846 - DNA, 13 bp, Homo sapiens
tgaggagggtgga

SEQ ID NO: 953847 - DNA, 20 bp, Homo sapiens
tgaggagggtgggggaggga

SEQ ID NO: 953848 - DNA, 18 bp, Homo sapiens
tgaggagtaagtgtacaa

SEQ ID NO: 953849 - DNA, 21 bp, Homo sapiens
tgaggagtattaagaatgcag

SEQ ID NO: 953850 - DNA, 18 bp, Homo sapiens
tgaggagtctgaggactg

SEQ ID NO: 953851 - DNA, 16 bp, Homo sapiens
tgaggagtgtgagaat

SEQ ID NO: 953852 - DNA, 15 bp, Homo sapiens
tgaggagttgcctga

SEQ ID NO: 953853 - DNA, 21 bp, Homo sapiens
tgaggataaaaaggaaggaga

SEQ ID NO: 953854 - DNA, 20 bp, Homo sapiens
tgaggatagtagttaaataa

SEQ ID NO: 953855 - DNA, 20 bp, Homo sapiens
tgaggatatattttcacttt

SEQ ID NO: 953856 - DNA, 18 bp, Homo sapiens
tgaggatattcagatgta

SEQ ID NO: 953857 - DNA, 13 bp, Homo sapiens
tgaggatgatgta

SEQ ID NO: 953858 - DNA, 13 bp, Homo sapiens
tgaggatgctgca

SEQ ID NO: 953859 - DNA, 17 bp, Homo sapiens
tgaggatggatttagaa

SEQ ID NO: 953860 - DNA, 21 bp, Homo sapiens
tgaggatgtagagagaacagg

SEQ ID NO: 953861 - DNA, 13 bp, Homo sapiens
tgaggattgtgga

SEQ ID NO: 953862 - DNA, 14 bp, Homo sapiens
tgaggattgtggaa

SEQ ID NO: 953863 - DNA, 15 bp, Homo sapiens
tgaggattgtggaaa

SEQ ID NO: 953864 - DNA, 13 bp, Homo sapiens
tgaggatttcaag

SEQ ID NO: 953865 - DNA, 18 bp, Homo sapiens
tgaggatttcctggagtg

SEQ ID NO: 953866 - DNA, 20 bp, Homo sapiens
tgaggcaaattaactgtatg

SEQ ID NO: 953867 - DNA, 15 bp, Homo sapiens
tgaggcaaccccctc

SEQ ID NO: 953868 - DNA, 14 bp, Homo sapiens
tgaggcaagagaat

SEQ ID NO: 953869 - DNA, 20 bp, Homo sapiens
tgaggcaataaaaatcatag

SEQ ID NO: 953870 - DNA, 17 bp, Homo sapiens
tgaggcaatgtcaggaa

SEQ ID NO: 953871 - DNA, 13 bp, Homo sapiens
tgaggcagacagc

SEQ ID NO: 953872 - DNA, 14 bp, Homo sapiens
tgaggcagacagca

SEQ ID NO: 953873 - DNA, 20 bp, Homo sapiens
tgaggcagacagcagctcag

SEQ ID NO: 953874 - DNA, 13 bp, Homo sapiens
tgaggcaggagaa

SEQ ID NO: 953875 - DNA, 15 bp, Homo sapiens
ggcattcctgcttat

SEQ ID NO: 953876 - DNA, 16 bp, Homo sapiens
ggcattctacacctgg

SEQ ID NO: 953877 - DNA, 12 bp, Homo sapiens
ggcattctctga

SEQ ID NO: 953878 - DNA, 16 bp, Homo sapiens
ggcattcttgtacagt

SEQ ID NO: 953879 - DNA, 18 bp, Homo sapiens
ggcattcttgtacagtgt

SEQ ID NO: 953880 - DNA, 15 bp, Homo sapiens
ggcattgggctgaca

SEQ ID NO: 953881 - DNA, 14 bp, Homo sapiens
ggcatttattttat

SEQ ID NO: 953882 - DNA, 18 bp, Homo sapiens
ggcatttcacgaactgtt

SEQ ID NO: 953883 - DNA, 11 bp, Homo sapiens
ggcatttccta

SEQ ID NO: 953884 - DNA, 20 bp, Homo sapiens
ggcatttgctgatttctagt

SEQ ID NO: 953885 - DNA, 13 bp, Homo sapiens
ggcattttcctcc

SEQ ID NO: 953886 - DNA, 14 bp, Homo sapiens
ggcattttcctcct

SEQ ID NO: 953887 - DNA, 16 bp, Homo sapiens
ggcattttcctcctct

SEQ ID NO: 953888 - DNA, 19 bp, Homo sapiens
ggcattttcctcctctgcc

SEQ ID NO: 953889 - DNA, 15 bp, Homo sapiens
ggcatttttatttta

SEQ ID NO: 953890 - DNA, 17 bp, Homo sapiens
ggccaaacatcagacct

SEQ ID NO: 953891 - DNA, 23 bp, Homo sapiens
ggccaaacatcagacctgtcttc

SEQ ID NO: 953892 - DNA, 14 bp, Homo sapiens
ggccaaacccagac

SEQ ID NO: 953893 - DNA, 17 bp, Homo sapiens
ggccaaacccagacaac

SEQ ID NO: 953894 - DNA, 20 bp, Homo sapiens
ggccaaacccttgctttcct

SEQ ID NO: 953895 - DNA, 17 bp, Homo sapiens
ggccaaagaaggcaggg

SEQ ID NO: 953896 - DNA, 12 bp, Homo sapiens
ggccaaagataa

SEQ ID NO: 953897 - DNA, 16 bp, Homo sapiens
ggccaaaggctggtgg

SEQ ID NO: 953898 - DNA, 23 bp, Homo sapiens
ggccaacaatcctttctgcccac

SEQ ID NO: 953899 - DNA, 19 bp, Homo sapiens
ggccaacatcgtgaaaccc

SEQ ID NO: 953900 - DNA, 16 bp, Homo sapiens
ggccaaccaggaccca

SEQ ID NO: 953901 - DNA, 20 bp, Homo sapiens
ggccaaccaggacccagggt

SEQ ID NO: 953902 - DNA, 23 bp, Homo sapiens
ggccaacccttctcctcttgtaa

SEQ ID NO: 953903 - DNA, 22 bp, Homo sapiens
ggccaacttgagggcccagagc

SEQ ID NO: 953904 - DNA, 15 bp, Homo sapiens
ggccaagaagcagtg

SEQ ID NO: 953905 - DNA, 18 bp, Homo sapiens
ggccaagaatacttgaag

SEQ ID NO: 953906 - DNA, 22 bp, Homo sapiens
ggccaagaatattgcaaaatac

SEQ ID NO: 953907 - DNA, 19 bp, Homo sapiens
ggccaagataggaccttgg

SEQ ID NO: 953908 - DNA, 16 bp, Homo sapiens
ggccaagattgtcctt

SEQ ID NO: 953909 - DNA, 13 bp, Homo sapiens
ggccaagcagaaa

SEQ ID NO: 953910 - DNA, 14 bp, Homo sapiens
ggccaagcagaaaa

SEQ ID NO: 953911 - DNA, 19 bp, Homo sapiens
ggccaagcagtgcctgcct

SEQ ID NO: 953912 - DNA, 20 bp, Homo sapiens
ggccaagcgggggcgtggct

SEQ ID NO: 953913 - DNA, 22 bp, Homo sapiens
ggccaagcgggggcgtggctgg

SEQ ID NO: 953914 - DNA, 13 bp, Homo sapiens
ggccaaggactga

SEQ ID NO: 953915 - DNA, 17 bp, Homo sapiens
ggccaaggactgccgac

SEQ ID NO: 953916 - DNA, 14 bp, Homo sapiens
ggccaaggagctgc

SEQ ID NO: 953917 - DNA, 16 bp, Homo sapiens
ggccaaggccttctcc

SEQ ID NO: 953918 - DNA, 23 bp, Homo sapiens
ggccaaggggtgggcctgtgaat

SEQ ID NO: 953919 - DNA, 16 bp, Homo sapiens
ggccaagtccactgtc

SEQ ID NO: 953920 - DNA, 23 bp, Homo sapiens
ggccaagtccgcagaagccctga

SEQ ID NO: 953921 - DNA, 18 bp, Homo sapiens
ggccaagtgcaggctggc

SEQ ID NO: 953922 - DNA, 12 bp, Homo sapiens
ggccaataaaaa

SEQ ID NO: 953923 - DNA, 17 bp, Homo sapiens
ggccaataaaaagttca

SEQ ID NO: 953924 - DNA, 20 bp, Homo sapiens
ggccaataccctactgtggg

SEQ ID NO: 953925 - DNA, 17 bp, Homo sapiens
ggccaatggtgcttccc

SEQ ID NO: 953926 - DNA, 14 bp, Homo sapiens
ggccacaaaaacaa

SEQ ID NO: 953927 - DNA, 22 bp, Homo sapiens
ggccacaaatcaaagcaagggc

SEQ ID NO: 953928 - DNA, 16 bp, Homo sapiens
ggccacacccagcggc

SEQ ID NO: 953929 - DNA, 13 bp, Homo sapiens
ggccacacccagg

SEQ ID NO: 953930 - DNA, 15 bp, Homo sapiens
ggccacacccaggaa

SEQ ID NO: 953931 - DNA, 16 bp, Homo sapiens
ggccacacccaggaag

SEQ ID NO: 953932 - DNA, 19 bp, Homo sapiens
ggccacacctgagcgctgt

SEQ ID NO: 953933 - DNA, 16 bp, Homo sapiens
ggccacactcagcaca

SEQ ID NO: 953934 - DNA, 15 bp, Homo sapiens
ggccacagcgtgctg

SEQ ID NO: 953935 - DNA, 11 bp, Homo sapiens
ggccacaggca

SEQ ID NO: 953936 - DNA, 18 bp, Homo sapiens
ggccacaggcagtccagg

SEQ ID NO: 953937 - DNA, 13 bp, Homo sapiens
ggccacagggcgg

SEQ ID NO: 953938 - DNA, 21 bp, Homo sapiens
ggccacagtggggctgcaggc

SEQ ID NO: 953939 - DNA, 19 bp, Homo sapiens
ggccacatcaaagaggctg

SEQ ID NO: 953940 - DNA, 16 bp, Homo sapiens
ggccacatcagcccca

SEQ ID NO: 953941 - DNA, 19 bp, Homo sapiens
ggccacatcagccccacag

SEQ ID NO: 953942 - DNA, 17 bp, Homo sapiens
ggccacatcattctgtg

SEQ ID NO: 953943 - DNA, 18 bp, Homo sapiens
ggccacatcattctgtgt

SEQ ID NO: 953944 - DNA, 20 bp, Homo sapiens
ggccacatcattctgtgtct

SEQ ID NO: 953945 - DNA, 22 bp, Homo sapiens
ggccacatcattctgtgtctct

SEQ ID NO: 953946 - DNA, 19 bp, Homo sapiens
ggccacatgggaggctcac

SEQ ID NO: 953947 - DNA, 15 bp, Homo sapiens
ggccacattgacagt

SEQ ID NO: 953948 - DNA, 14 bp, Homo sapiens
ggccacatttaata

SEQ ID NO: 953949 - DNA, 16 bp, Homo sapiens
ggccaccaaagctgcc

SEQ ID NO: 953950 - DNA, 18 bp, Homo sapiens
ggccaccaaagctgccca

SEQ ID NO: 953951 - DNA, 19 bp, Homo sapiens
ggccaccacctttggctgg

SEQ ID NO: 953952 - DNA, 14 bp, Homo sapiens
ggccaccactgcag

SEQ ID NO: 953953 - DNA, 20 bp, Homo sapiens
ggccaccagccatcctccct

SEQ ID NO: 953954 - DNA, 21 bp, Homo sapiens
ggccaccagccatcctccctc

SEQ ID NO: 953955 - DNA, 21 bp, Homo sapiens
tgaggggaggaaactcacctg

SEQ ID NO: 953956 - DNA, 22 bp, Homo sapiens
tgaggggaggatcactggagcc

SEQ ID NO: 953957 - DNA, 15 bp, Homo sapiens
tgaggggaggcacct

SEQ ID NO: 953958 - DNA, 23 bp, Homo sapiens
tgaggggaggggcctcccccagc

SEQ ID NO: 953959 - DNA, 16 bp, Homo sapiens
tgaggggcactctccc

SEQ ID NO: 953960 - DNA, 17 bp, Homo sapiens
tgaggggcactctcccc

SEQ ID NO: 953961 - DNA, 23 bp, Homo sapiens
tgaggggccactgacccacctgc

SEQ ID NO: 953962 - DNA, 18 bp, Homo sapiens
tgaggggccctggccagg

SEQ ID NO: 953963 - DNA, 19 bp, Homo sapiens
tgaggggccctggccagga

SEQ ID NO: 953964 - DNA, 23 bp, Homo sapiens
tgaggggcctgcgcccagagctg

SEQ ID NO: 953965 - DNA, 16 bp, Homo sapiens
tgaggggctaccagga

SEQ ID NO: 953966 - DNA, 19 bp, Homo sapiens
tgaggggctaccaggaaag

SEQ ID NO: 953967 - DNA, 15 bp, Homo sapiens
tgaggggctccgggt

SEQ ID NO: 953968 - DNA, 13 bp, Homo sapiens
tgaggggctgggc

SEQ ID NO: 953969 - DNA, 13 bp, Homo sapiens
tgaggggctgtga

SEQ ID NO: 953970 - DNA, 14 bp, Homo sapiens
tgaggggctgtgac

SEQ ID NO: 953971 - DNA, 17 bp, Homo sapiens
tgaggggcttcctgggt

SEQ ID NO: 953972 - DNA, 14 bp, Homo sapiens
tgaggggctttctc

SEQ ID NO: 953973 - DNA, 16 bp, Homo sapiens
tgaggggctttctctt

SEQ ID NO: 953974 - DNA, 22 bp, Homo sapiens
tgagggggaatagtctagatgg

SEQ ID NO: 953975 - DNA, 15 bp, Homo sapiens
tgaggggtctcggat

SEQ ID NO: 953976 - DNA, 14 bp, Homo sapiens
tgagggtcctgcag

SEQ ID NO: 953977 - DNA, 13 bp, Homo sapiens
tgagggtgactgt

SEQ ID NO: 953978 - DNA, 21 bp, Homo sapiens
tgagggtgccccgcctgagtc

SEQ ID NO: 953979 - DNA, 19 bp, Homo sapiens
tgagggtgcccttttccag

SEQ ID NO: 953980 - DNA, 14 bp, Homo sapiens
tgagggtggagact

SEQ ID NO: 953981 - DNA, 15 bp, Homo sapiens
tgagggtgggccagc

SEQ ID NO: 953982 - DNA, 18 bp, Homo sapiens
tgagggtgggccagcata

SEQ ID NO: 953983 - DNA, 14 bp, Homo sapiens
tgagggtgtttctt

SEQ ID NO: 953984 - DNA, 18 bp, Homo sapiens
tgagggtttgtgctacca

SEQ ID NO: 953985 - DNA, 13 bp, Homo sapiens
tgaggtaaaatgt

SEQ ID NO: 953986 - DNA, 16 bp, Homo sapiens
tgaggtactggtccct

SEQ ID NO: 953987 - DNA, 15 bp, Homo sapiens
tgaggtataaagaca

SEQ ID NO: 953988 - DNA, 16 bp, Homo sapiens
tgaggtataaagacaa

SEQ ID NO: 953989 - DNA, 21 bp, Homo sapiens
tgaggtatggccatgccctag

SEQ ID NO: 953990 - DNA, 16 bp, Homo sapiens
tgaggtattttttcct

SEQ ID NO: 953991 - DNA, 19 bp, Homo sapiens
tgaggtcaacacaggtagc

SEQ ID NO: 953992 - DNA, 20 bp, Homo sapiens
tgaggtcaagtaagaagaca

SEQ ID NO: 953993 - DNA, 21 bp, Homo sapiens
tgaggtcaataaagcagagcc

SEQ ID NO: 953994 - DNA, 14 bp, Homo sapiens
tgaggtcagggagt

SEQ ID NO: 953995 - DNA, 15 bp, Homo sapiens
tgaggtcagggagtg

SEQ ID NO: 953996 - DNA, 18 bp, Homo sapiens
tgaggtcagggagtgctg

SEQ ID NO: 953997 - DNA, 13 bp, Homo sapiens
ggccactccgaga

SEQ ID NO: 953998 - DNA, 20 bp, Homo sapiens
ggccactctcccctccctct

SEQ ID NO: 953999 - DNA, 22 bp, Homo sapiens
ggccactctcccctccctcttc

SEQ ID NO: 954000 - DNA, 19 bp, Homo sapiens
ggccactgacccacctgcg

SEQ ID NO: 954001 - DNA, 20 bp, Homo sapiens
ggccactgctccctaagcca

SEQ ID NO: 954002 - DNA, 22 bp, Homo sapiens
ggccactgctccctaagccagc

SEQ ID NO: 954003 - DNA, 20 bp, Homo sapiens
ggccactgtgaagagaacca

SEQ ID NO: 954004 - DNA, 13 bp, Homo sapiens
ggccactgtggcc

SEQ ID NO: 954005 - DNA, 18 bp, Homo sapiens
ggccactgtggccagagc

SEQ ID NO: 954006 - DNA, 21 bp, Homo sapiens
ggccactgtggccagagctgg

SEQ ID NO: 954007 - DNA, 18 bp, Homo sapiens
ggccacttcattccagca

SEQ ID NO: 954008 - DNA, 20 bp, Homo sapiens
ggccacttcattccagcagc

SEQ ID NO: 954009 - DNA, 22 bp, Homo sapiens
ggccacttcattccagcagctg

SEQ ID NO: 954010 - DNA, 17 bp, Homo sapiens
ggccactttcagagccc

SEQ ID NO: 954011 - DNA, 21 bp, Homo sapiens
ggccagaaaccttcctgctga

SEQ ID NO: 954012 - DNA, 22 bp, Homo sapiens
ggccagaaggagggcagagcca

SEQ ID NO: 954013 - DNA, 14 bp, Homo sapiens
ggccagacaagaag

SEQ ID NO: 954014 - DNA, 17 bp, Homo sapiens
ggccagacgctgccgct

SEQ ID NO: 954015 - DNA, 13 bp, Homo sapiens
ggccagactggaa

SEQ ID NO: 954016 - DNA, 15 bp, Homo sapiens
ggccagactggaaga

SEQ ID NO: 954017 - DNA, 21 bp, Homo sapiens
ggccagagagcctggtgctgc

SEQ ID NO: 954018 - DNA, 16 bp, Homo sapiens
ggccagagcctctggc

SEQ ID NO: 954019 - DNA, 17 bp, Homo sapiens
ggccagagcctctggcc

SEQ ID NO: 954020 - DNA, 12 bp, Homo sapiens
ggccagagctga

SEQ ID NO: 954021 - DNA, 14 bp, Homo sapiens
ggccagagctgaac

SEQ ID NO: 954022 - DNA, 15 bp, Homo sapiens
ggccagagctggaag

SEQ ID NO: 954023 - DNA, 23 bp, Homo sapiens
ggccagagctggaaggcagggca

SEQ ID NO: 954024 - DNA, 22 bp, Homo sapiens
ggccagaggaactgtccagaga

SEQ ID NO: 954025 - DNA, 22 bp, Homo sapiens
ggccagaggcccccagcccagg

SEQ ID NO: 954026 - DNA, 19 bp, Homo sapiens
ggccagagtctcccagtgg

SEQ ID NO: 954027 - DNA, 16 bp, Homo sapiens
ggccagagtggcctgg

SEQ ID NO: 954028 - DNA, 22 bp, Homo sapiens
ggccagatgattttcctccctg

SEQ ID NO: 954029 - DNA, 23 bp, Homo sapiens
ggccagatgattttcctccctgg

SEQ ID NO: 954030 - DNA, 23 bp, Homo sapiens
ggccagatgcacatccctggaag

SEQ ID NO: 954031 - DNA, 19 bp, Homo sapiens
ggccagattgtggggtgca

SEQ ID NO: 954032 - DNA, 15 bp, Homo sapiens
ggccagcaaggcagg

SEQ ID NO: 954033 - DNA, 20 bp, Homo sapiens
ggccagcaccctctcctggg

SEQ ID NO: 954034 - DNA, 11 bp, Homo sapiens
ggccagcagag

SEQ ID NO: 954035 - DNA, 12 bp, Homo sapiens
ggccagcagagg

SEQ ID NO: 954036 - DNA, 14 bp, Homo sapiens
ggccagcaggctcc

SEQ ID NO: 954037 - DNA, 21 bp, Homo sapiens
ggccagcaggctcctggctgt

SEQ ID NO: 954038 - DNA, 17 bp, Homo sapiens
ggccagcatagggggga

SEQ ID NO: 954039 - DNA, 19 bp, Homo sapiens
ggccagcataggggggagg

SEQ ID NO: 954040 - DNA, 11 bp, Homo sapiens
ggccagccagg

SEQ ID NO: 954041 - DNA, 17 bp, Homo sapiens
ggccagccagtgccatt

SEQ ID NO: 954042 - DNA, 22 bp, Homo sapiens
ggccagccagtgccattccact

SEQ ID NO: 954043 - DNA, 16 bp, Homo sapiens
ggccagcccagccagg

SEQ ID NO: 954044 - DNA, 18 bp, Homo sapiens
ggccagcccagccaggcc

SEQ ID NO: 954045 - DNA, 15 bp, Homo sapiens
ggccagccccaccca

SEQ ID NO: 954046 - DNA, 21 bp, Homo sapiens
ggccagccccacccccagcca

SEQ ID NO: 954047 - DNA, 20 bp, Homo sapiens
ggccagcccccccacccacc

SEQ ID NO: 954048 - DNA, 21 bp, Homo sapiens
ggccagcccccccacccaccc

SEQ ID NO: 954049 - DNA, 12 bp, Homo sapiens
ggccagcccctc

SEQ ID NO: 954050 - DNA, 14 bp, Homo sapiens
ggccagcccctccc

SEQ ID NO: 954051 - DNA, 18 bp, Homo sapiens
ggccagcccctcccacca

SEQ ID NO: 954052 - DNA, 16 bp, Homo sapiens
ggccagccctgcagcc

SEQ ID NO: 954053 - DNA, 17 bp, Homo sapiens
ggccagccctgcagccc

SEQ ID NO: 954054 - DNA, 18 bp, Homo sapiens
ggccagccctgcagccca

SEQ ID NO: 954055 - DNA, 16 bp, Homo sapiens
ggccagcggggctgct

SEQ ID NO: 954056 - DNA, 22 bp, Homo sapiens
ggccagcggggctgctcaccca

SEQ ID NO: 954057 - DNA, 16 bp, Homo sapiens
ggccagcggtgaccag

SEQ ID NO: 954058 - DNA, 22 bp, Homo sapiens
ggccagcggtgaccagcctgtc

SEQ ID NO: 954059 - DNA, 24 bp, Homo sapiens
ggccagctctgaggggaggcacct

SEQ ID NO: 954060 - DNA, 15 bp, Homo sapiens
ggccagctggggaga

SEQ ID NO: 954061 - DNA, 17 bp, Homo sapiens
ggccagctggggagatg

SEQ ID NO: 954062 - DNA, 23 bp, Homo sapiens
ggccagctggggagatgggggct

SEQ ID NO: 954063 - DNA, 22 bp, Homo sapiens
ggccagcttcgtgctggaggaa

SEQ ID NO: 954064 - DNA, 15 bp, Homo sapiens
ggccaggacaggccc

SEQ ID NO: 954065 - DNA, 13 bp, Homo sapiens
ggccaggagcagg

SEQ ID NO: 954066 - DNA, 21 bp, Homo sapiens
ggccaggagcaggcacgggtg

SEQ ID NO: 954067 - DNA, 13 bp, Homo sapiens
ggccaggagctct

SEQ ID NO: 954068 - DNA, 21 bp, Homo sapiens
ggccaggaggttcccccgacc

SEQ ID NO: 954069 - DNA, 23 bp, Homo sapiens
ggccaggagtttaagaccagcct

SEQ ID NO: 954070 - DNA, 14 bp, Homo sapiens
ggccaggcactgcc

SEQ ID NO: 954071 - DNA, 19 bp, Homo sapiens
ggccaggcagaatggctgc

SEQ ID NO: 954072 - DNA, 21 bp, Homo sapiens
ggccaggcagaatggctgcac

SEQ ID NO: 954073 - DNA, 22 bp, Homo sapiens
ggccaggcagatctgtgcccca

SEQ ID NO: 954074 - DNA, 12 bp, Homo sapiens
ggccaggcaggc

SEQ ID NO: 954075 - DNA, 13 bp, Homo sapiens
ggccaggcaggcg

SEQ ID NO: 954076 - DNA, 11 bp, Homo sapiens
ggccaggccac

SEQ ID NO: 954077 - DNA, 15 bp, Homo sapiens
ggccaggccaccagg

SEQ ID NO: 954078 - DNA, 13 bp, Homo sapiens
ggccaggcctgca

SEQ ID NO: 954079 - DNA, 18 bp, Homo sapiens
ggccaggctgcctcggac

SEQ ID NO: 954080 - DNA, 14 bp, Homo sapiens
ggccagggacccaa

SEQ ID NO: 954081 - DNA, 19 bp, Homo sapiens
tgagtcgtacagaaagctg

SEQ ID NO: 954082 - DNA, 18 bp, Homo sapiens
tgagtcgtcatcactttt

SEQ ID NO: 954083 - DNA, 14 bp, Homo sapiens
tgagtctatgttca

SEQ ID NO: 954084 - DNA, 17 bp, Homo sapiens
tgagtctatgttcaaag

SEQ ID NO: 954085 - DNA, 18 bp, Homo sapiens
tgagtctatgttcaaaga

SEQ ID NO: 954086 - DNA, 20 bp, Homo sapiens
tgagtctggacctccatccc

SEQ ID NO: 954087 - DNA, 16 bp, Homo sapiens
tgagtctggtggagga

SEQ ID NO: 954088 - DNA, 18 bp, Homo sapiens
tgagtctggtggaggagc

SEQ ID NO: 954089 - DNA, 18 bp, Homo sapiens
tgagtctgtaggagcaag

SEQ ID NO: 954090 - DNA, 13 bp, Homo sapiens
tgagtcttaactg

SEQ ID NO: 954091 - DNA, 17 bp, Homo sapiens
tgagtcttaactgtatt

SEQ ID NO: 954092 - DNA, 21 bp, Homo sapiens
tgagtcttaactgtatttcag

SEQ ID NO: 954093 - DNA, 17 bp, Homo sapiens
tgagtcttggcggcagc

SEQ ID NO: 954094 - DNA, 20 bp, Homo sapiens
tgagtgaaaatttttacatt

SEQ ID NO: 954095 - DNA, 15 bp, Homo sapiens
tgagtgaataaatgt

SEQ ID NO: 954096 - DNA, 17 bp, Homo sapiens
tgagtgaatcaaagtgt

SEQ ID NO: 954097 - DNA, 18 bp, Homo sapiens
tgagtgaatcaggcaaag

SEQ ID NO: 954098 - DNA, 20 bp, Homo sapiens
tgagtgaattgtacctattt

SEQ ID NO: 954099 - DNA, 23 bp, Homo sapiens
tgagtgacacaagcactttaatg

SEQ ID NO: 954100 - DNA, 15 bp, Homo sapiens
tgagtgaccgggggc

SEQ ID NO: 954101 - DNA, 15 bp, Homo sapiens
tgagtgagtgtgtgt

SEQ ID NO: 954102 - DNA, 20 bp, Homo sapiens
tgagtgatcctccaacttca

SEQ ID NO: 954103 - DNA, 16 bp, Homo sapiens
tgagtgcactgactgt

SEQ ID NO: 954104 - DNA, 20 bp, Homo sapiens
tgagtgcagccaaaggggag

SEQ ID NO: 954105 - DNA, 12 bp, Homo sapiens
tgagtgccatgc

SEQ ID NO: 954106 - DNA, 22 bp, Homo sapiens
tgagtgccccacttctggccac

SEQ ID NO: 954107 - DNA, 19 bp, Homo sapiens
tgagtgccttttgcagaag

SEQ ID NO: 954108 - DNA, 22 bp, Homo sapiens
tgagtgccttttgcagaagagg

SEQ ID NO: 954109 - DNA, 22 bp, Homo sapiens
tgagtgcgcagatctgtgcctg

SEQ ID NO: 954110 - DNA, 23 bp, Homo sapiens
tgagtgcgcagatctgtgcctgg

SEQ ID NO: 954111 - DNA, 19 bp, Homo sapiens
tgagtgctctgatccctct

SEQ ID NO: 954112 - DNA, 23 bp, Homo sapiens
tgagtgctgattcaaaccaaagc

SEQ ID NO: 954113 - DNA, 20 bp, Homo sapiens
tgagtggaagggaggagcag

SEQ ID NO: 954114 - DNA, 18 bp, Homo sapiens
tgagtggcagccatgcct

SEQ ID NO: 954115 - DNA, 21 bp, Homo sapiens
tgagtggcaggggacaggagt

SEQ ID NO: 954116 - DNA, 12 bp, Homo sapiens
tgagtggccagc

SEQ ID NO: 954117 - DNA, 17 bp, Homo sapiens
tgagtggccagccagtg

SEQ ID NO: 954118 - DNA, 15 bp, Homo sapiens
ggcccaggcctgggt

SEQ ID NO: 954119 - DNA, 14 bp, Homo sapiens
ggcccaggctggga

SEQ ID NO: 954120 - DNA, 10 bp, Homo sapiens
ggcccaggga

SEQ ID NO: 954121 - DNA, 11 bp, Homo sapiens
ggcccagggac

SEQ ID NO: 954122 - DNA, 20 bp, Homo sapiens
ggcccagggagaggccatga

SEQ ID NO: 954123 - DNA, 12 bp, Homo sapiens
ggcccagggagg

SEQ ID NO: 954124 - DNA, 16 bp, Homo sapiens
ggcccagggaggcagc

SEQ ID NO: 954125 - DNA, 17 bp, Homo sapiens
ggcccagggaggcagcg

SEQ ID NO: 954126 - DNA, 20 bp, Homo sapiens
ggcccaggttcgagacccaa

SEQ ID NO: 954127 - DNA, 15 bp, Homo sapiens
ggcccagtgccagct

SEQ ID NO: 954128 - DNA, 15 bp, Homo sapiens
ggcccatcaggcagt

SEQ ID NO: 954129 - DNA, 14 bp, Homo sapiens
ggcccatctcagcc

SEQ ID NO: 954130 - DNA, 20 bp, Homo sapiens
ggcccatctcaggtgccact

SEQ ID NO: 954131 - DNA, 13 bp, Homo sapiens
ggcccatctccct

SEQ ID NO: 954132 - DNA, 15 bp, Homo sapiens
ggcccatctccctgc

SEQ ID NO: 954133 - DNA, 21 bp, Homo sapiens
ggcccatgcccccttcgctcc

SEQ ID NO: 954134 - DNA, 23 bp, Homo sapiens
ggcccattggagcacctgggccc

SEQ ID NO: 954135 - DNA, 19 bp, Homo sapiens
ggccccaaccctgtcctcc

SEQ ID NO: 954136 - DNA, 19 bp, Homo sapiens
ggccccaactcgggctccc

SEQ ID NO: 954137 - DNA, 23 bp, Homo sapiens
ggccccaagaggggcgggctcag

SEQ ID NO: 954138 - DNA, 14 bp, Homo sapiens
ggccccacaggagt

SEQ ID NO: 954139 - DNA, 14 bp, Homo sapiens
ggccccaccaccta

SEQ ID NO: 954140 - DNA, 18 bp, Homo sapiens
ggccccacccaccctctg

SEQ ID NO: 954141 - DNA, 22 bp, Homo sapiens
ggccccacccaccctctggtcc

SEQ ID NO: 954142 - DNA, 17 bp, Homo sapiens
ggccccaccccctgggc

SEQ ID NO: 954143 - DNA, 15 bp, Homo sapiens
ggccccaccctgggc

SEQ ID NO: 954144 - DNA, 21 bp, Homo sapiens
ggccccaccctgggccctggg

SEQ ID NO: 954145 - DNA, 23 bp, Homo sapiens
ggccccaccctgggccctgggct

SEQ ID NO: 954146 - DNA, 18 bp, Homo sapiens
ggccccacctccctgcgc

SEQ ID NO: 954147 - DNA, 22 bp, Homo sapiens
ggccccacctcggcacacactg

SEQ ID NO: 954148 - DNA, 19 bp, Homo sapiens
ggccccactggacaacact

SEQ ID NO: 954149 - DNA, 20 bp, Homo sapiens
ggccccactggacaacactg

SEQ ID NO: 954150 - DNA, 17 bp, Homo sapiens
ggccccactggctggag

SEQ ID NO: 954151 - DNA, 17 bp, Homo sapiens
ggccccactttgaaggg

SEQ ID NO: 954152 - DNA, 17 bp, Homo sapiens
ggccccagacagggtgg

SEQ ID NO: 954153 - DNA, 13 bp, Homo sapiens
ggccccagagact

SEQ ID NO: 954154 - DNA, 13 bp, Homo sapiens
ggccccagagaga

SEQ ID NO: 954155 - DNA, 17 bp, Homo sapiens
ggccccagatctgcctg

SEQ ID NO: 954156 - DNA, 19 bp, Homo sapiens
ggccccagatctgcctggg

SEQ ID NO: 954157 - DNA, 20 bp, Homo sapiens
ggccccagatctgcctgggc

SEQ ID NO: 954158 - DNA, 21 bp, Homo sapiens
ggccccagatctgcctgggcc

SEQ ID NO: 954159 - DNA, 18 bp, Homo sapiens
ggccccagcacagcttga

SEQ ID NO: 954160 - DNA, 10 bp, Homo sapiens
ggccccagcc

SEQ ID NO: 954161 - DNA, 21 bp, Homo sapiens
ggccccagccagagttcctgc

SEQ ID NO: 954162 - DNA, 16 bp, Homo sapiens
ggccccagccctgctg

SEQ ID NO: 954163 - DNA, 18 bp, Homo sapiens
ggccccagcgtctgcagg

SEQ ID NO: 954164 - DNA, 19 bp, Homo sapiens
ggccccagcgtctgcaggg

SEQ ID NO: 954165 - DNA, 13 bp, Homo sapiens
ggccccagggaca

SEQ ID NO: 954166 - DNA, 19 bp, Homo sapiens
ggccccagggacagaggcc

SEQ ID NO: 954167 - DNA, 18 bp, Homo sapiens
ggccccagggctaccctc

SEQ ID NO: 954168 - DNA, 13 bp, Homo sapiens
ggccccaggggca

SEQ ID NO: 954169 - DNA, 14 bp, Homo sapiens
ggccccaggggcag

SEQ ID NO: 954170 - DNA, 18 bp, Homo sapiens
ggccccaggggcagcaag

SEQ ID NO: 954171 - DNA, 22 bp, Homo sapiens
ggccccaggggcagcaaggcct

SEQ ID NO: 954172 - DNA, 14 bp, Homo sapiens
ggccccatgctctg

SEQ ID NO: 954173 - DNA, 17 bp, Homo sapiens
ggccccatgctctgccc

SEQ ID NO: 954174 - DNA, 20 bp, Homo sapiens
ggcccccaacctcagggctc

SEQ ID NO: 954175 - DNA, 15 bp, Homo sapiens
ggcccccaataaagg

SEQ ID NO: 954176 - DNA, 20 bp, Homo sapiens
ggcccccaataaaggcagct

SEQ ID NO: 954177 - DNA, 21 bp, Homo sapiens
ggcccccaataaaggcagctg

SEQ ID NO: 954178 - DNA, 14 bp, Homo sapiens
ggcccccagcccag

SEQ ID NO: 954179 - DNA, 14 bp, Homo sapiens
ggcccccagccctg

SEQ ID NO: 954180 - DNA, 14 bp, Homo sapiens
ggcccccagcctgg

SEQ ID NO: 954181 - DNA, 23 bp, Homo sapiens
ggcccccagcctggccagacaag

SEQ ID NO: 954182 - DNA, 14 bp, Homo sapiens
ggcccccagtgggg

SEQ ID NO: 954183 - DNA, 20 bp, Homo sapiens
ggcccccagtggggacaggg

SEQ ID NO: 954184 - DNA, 24 bp, Homo sapiens
ggcccccagtggggacagggaggg

SEQ ID NO: 954185 - DNA, 14 bp, Homo sapiens
ggcccccatctcat

SEQ ID NO: 954186 - DNA, 15 bp, Homo sapiens
ggcccccatctcatg

SEQ ID NO: 954187 - DNA, 16 bp, Homo sapiens
ggccccccaaatccca

SEQ ID NO: 954188 - DNA, 18 bp, Homo sapiens
ggccccccgcacagccac

SEQ ID NO: 954189 - DNA, 19 bp, Homo sapiens
ggcccccctccccccactt

SEQ ID NO: 954190 - DNA, 13 bp, Homo sapiens
ggcccccgagctg

SEQ ID NO: 954191 - DNA, 15 bp, Homo sapiens
ggcccccgagctggg

SEQ ID NO: 954192 - DNA, 15 bp, Homo sapiens
ggcccccgggcctgc

SEQ ID NO: 954193 - DNA, 20 bp, Homo sapiens
ggcccccgggcctgcacaga

SEQ ID NO: 954194 - DNA, 17 bp, Homo sapiens
ggccccctcaccccagc

SEQ ID NO: 954195 - DNA, 13 bp, Homo sapiens
ggccccctctcct

SEQ ID NO: 954196 - DNA, 20 bp, Homo sapiens
ggccccctctcggccaggca

SEQ ID NO: 954197 - DNA, 13 bp, Homo sapiens
ggccccctgcatc

SEQ ID NO: 954198 - DNA, 19 bp, Homo sapiens
ggccccctttcccgggctg

SEQ ID NO: 954199 - DNA, 13 bp, Homo sapiens
ggccccgccaggg

SEQ ID NO: 954200 - DNA, 15 bp, Homo sapiens
ggccccgccagggct

SEQ ID NO: 954201 - DNA, 17 bp, Homo sapiens
ggccccgccagggctgg

SEQ ID NO: 954202 - DNA, 18 bp, Homo sapiens
ggccccgccagggctggg

SEQ ID NO: 954203 - DNA, 19 bp, Homo sapiens
ggccccgccagggctgggg

SEQ ID NO: 954204 - DNA, 14 bp, Homo sapiens
ggccccgccgcctg

SEQ ID NO: 954205 - DNA, 15 bp, Homo sapiens
ggccccgccgcctgg

SEQ ID NO: 954206 - DNA, 19 bp, Homo sapiens
ggccccgcttgtccagcgc

SEQ ID NO: 954207 - DNA, 21 bp, Homo sapiens
ggccccgcttgtccagcgcct

SEQ ID NO: 954208 - DNA, 18 bp, Homo sapiens
ggccccggatcagagcag

SEQ ID NO: 954209 - DNA, 13 bp, Homo sapiens
ggccccggcccca

SEQ ID NO: 954210 - DNA, 19 bp, Homo sapiens
ggccccgggctctggccac

SEQ ID NO: 954211 - DNA, 23 bp, Homo sapiens
ggccccgggctctggccaccctg

SEQ ID NO: 954212 - DNA, 18 bp, Homo sapiens
ggcccctcaccctctgtc

SEQ ID NO: 954213 - DNA, 12 bp, Homo sapiens
ggcccctccacg

SEQ ID NO: 954214 - DNA, 18 bp, Homo sapiens
tgatcacatctaaagctt

SEQ ID NO: 954215 - DNA, 19 bp, Homo sapiens
tgatcacatctaaagcttt

SEQ ID NO: 954216 - DNA, 21 bp, Homo sapiens
tgatcacatctaaagctttat

SEQ ID NO: 954217 - DNA, 15 bp, Homo sapiens
tgatcacccaatgca

SEQ ID NO: 954218 - DNA, 19 bp, Homo sapiens
tgatcacccaatgcatcac

SEQ ID NO: 954219 - DNA, 15 bp, Homo sapiens
tgatcacctcttggg

SEQ ID NO: 954220 - DNA, 16 bp, Homo sapiens
tgatcacgcctggcta

SEQ ID NO: 954221 - DNA, 22 bp, Homo sapiens
tgatcactccaggtagtttggg

SEQ ID NO: 954222 - DNA, 21 bp, Homo sapiens
tgatcactgagccatcatttc

SEQ ID NO: 954223 - DNA, 22 bp, Homo sapiens
tgatcactgagccatcatttcc

SEQ ID NO: 954224 - DNA, 16 bp, Homo sapiens
tgatcacttatcagtt

SEQ ID NO: 954225 - DNA, 16 bp, Homo sapiens
tgatcagaatcccaaa

SEQ ID NO: 954226 - DNA, 15 bp, Homo sapiens
tgatcagacagcttg

SEQ ID NO: 954227 - DNA, 22 bp, Homo sapiens
tgatcagacatacagctgccta

SEQ ID NO: 954228 - DNA, 21 bp, Homo sapiens
tgatcagagccgtggtccttt

SEQ ID NO: 954229 - DNA, 18 bp, Homo sapiens
tgatcagcattgtgactt

SEQ ID NO: 954230 - DNA, 16 bp, Homo sapiens
tgatcagccccaccct

SEQ ID NO: 954231 - DNA, 17 bp, Homo sapiens
tgatcagctgtttgtca

SEQ ID NO: 954232 - DNA, 12 bp, Homo sapiens
tgatcagtgttg

SEQ ID NO: 954233 - DNA, 15 bp, Homo sapiens
tgatcataagtctaa

SEQ ID NO: 954234 - DNA, 21 bp, Homo sapiens
tgatcatagctcactgcagcc

SEQ ID NO: 954235 - DNA, 22 bp, Homo sapiens
tgatcatagctcactgcagcct

SEQ ID NO: 954236 - DNA, 14 bp, Homo sapiens
tgatcatccctttc

SEQ ID NO: 954237 - DNA, 18 bp, Homo sapiens
tgatcatcgccagaggtg

SEQ ID NO: 954238 - DNA, 14 bp, Homo sapiens
tgatcatgcattgt

SEQ ID NO: 954239 - DNA, 16 bp, Homo sapiens
tgatcatgcattgttg

SEQ ID NO: 954240 - DNA, 21 bp, Homo sapiens
tgatgatcaaaacctgtgcca

SEQ ID NO: 954241 - DNA, 13 bp, Homo sapiens
tgatgatccagaa

SEQ ID NO: 954242 - DNA, 20 bp, Homo sapiens
tgatgatcctaggcatttgc

SEQ ID NO: 954243 - DNA, 15 bp, Homo sapiens
tgatgatgatgaaaa

SEQ ID NO: 954244 - DNA, 15 bp, Homo sapiens
tgatgatgctgtgac

SEQ ID NO: 954245 - DNA, 20 bp, Homo sapiens
tgatgatgtctacagaaaat

SEQ ID NO: 954246 - DNA, 20 bp, Homo sapiens
tgatgatgtcttctggtgtc

SEQ ID NO: 954247 - DNA, 15 bp, Homo sapiens
tgatgatttggggga

SEQ ID NO: 954248 - DNA, 15 bp, Homo sapiens
tgatgattttgtaat

SEQ ID NO: 954249 - DNA, 20 bp, Homo sapiens
tgatgattttgtaattctta

SEQ ID NO: 954250 - DNA, 21 bp, Homo sapiens
tgatgattttgtaattcttat

SEQ ID NO: 954251 - DNA, 14 bp, Homo sapiens
tgatgcaatataag

SEQ ID NO: 954252 - DNA, 13 bp, Homo sapiens
tgatgcacagaga

SEQ ID NO: 954253 - DNA, 16 bp, Homo sapiens
tgatgcacagagaagc

SEQ ID NO: 954254 - DNA, 17 bp, Homo sapiens
tgatgcacagagaagct

SEQ ID NO: 954255 - DNA, 13 bp, Homo sapiens
tgatgcagaaatt

SEQ ID NO: 954256 - DNA, 16 bp, Homo sapiens
tgatgcagctgttgag

SEQ ID NO: 954257 - DNA, 17 bp, Homo sapiens
tgatgcagctgttgaga

SEQ ID NO: 954258 - DNA, 22 bp, Homo sapiens
tgatgcatgctattcacaatta

SEQ ID NO: 954259 - DNA, 13 bp, Homo sapiens
tgatgcatgtctt

SEQ ID NO: 954260 - DNA, 18 bp, Homo sapiens
tgatgcattaaaagaaaa

SEQ ID NO: 954261 - DNA, 19 bp, Homo sapiens
tgatgcattaaaagaaaat

SEQ ID NO: 954262 - DNA, 18 bp, Homo sapiens
tgatgccaaaaaaaaata

SEQ ID NO: 954263 - DNA, 21 bp, Homo sapiens
tgatgccaaagatgtttgaaa

SEQ ID NO: 954264 - DNA, 15 bp, Homo sapiens
tgatgccaacctctg

SEQ ID NO: 954265 - DNA, 13 bp, Homo sapiens
tgatgccagaggg

SEQ ID NO: 954266 - DNA, 15 bp, Homo sapiens
tgatgccagagggcc

SEQ ID NO: 954267 - DNA, 17 bp, Homo sapiens
tgatgccagagggccag

SEQ ID NO: 954268 - DNA, 19 bp, Homo sapiens
tgatgccagagggccagca

SEQ ID NO: 954269 - DNA, 22 bp, Homo sapiens
tgatgccagagggccagcaggc

SEQ ID NO: 954270 - DNA, 23 bp, Homo sapiens
tgatgccatgtttagattccagg

SEQ ID NO: 954271 - DNA, 15 bp, Homo sapiens
tgatgccattacaga

SEQ ID NO: 954272 - DNA, 23 bp, Homo sapiens
tgatgccgaacattaggaattgt

SEQ ID NO: 954273 - DNA, 23 bp, Homo sapiens
tgatgcctttataaatctttctc

SEQ ID NO: 954274 - DNA, 14 bp, Homo sapiens
tgatgcgccttgct

SEQ ID NO: 954275 - DNA, 23 bp, Homo sapiens
tgatgcgccttgctgatggcttg

SEQ ID NO: 954276 - DNA, 15 bp, Homo sapiens
tgatgctatttatgc

SEQ ID NO: 954277 - DNA, 16 bp, Homo sapiens
tgatgctcagagcttt

SEQ ID NO: 954278 - DNA, 15 bp, Homo sapiens
tgatgctcaggcttg

SEQ ID NO: 954279 - DNA, 23 bp, Homo sapiens
tgatgctccctcccctgccctgg

SEQ ID NO: 954280 - DNA, 22 bp, Homo sapiens
tgatgctctggcttgccccagg

SEQ ID NO: 954281 - DNA, 15 bp, Homo sapiens
tgatgctgaggatga

SEQ ID NO: 954282 - DNA, 22 bp, Homo sapiens
tgatgctgccccgttccctgtc

SEQ ID NO: 954283 - DNA, 16 bp, Homo sapiens
tgatgctggagaggtt

SEQ ID NO: 954284 - DNA, 20 bp, Homo sapiens
tgatgctgggagttctaaca

SEQ ID NO: 954285 - DNA, 13 bp, Homo sapiens
tgatgctgtgtgc

SEQ ID NO: 954286 - DNA, 12 bp, Homo sapiens
tgatgcttttgc

SEQ ID NO: 954287 - DNA, 14 bp, Homo sapiens
tgatgcttttgctg

SEQ ID NO: 954288 - DNA, 18 bp, Homo sapiens
tgatgcttttgctgctgc

SEQ ID NO: 954289 - DNA, 14 bp, Homo sapiens
tgatggaaccttaa

SEQ ID NO: 954290 - DNA, 15 bp, Homo sapiens
tgatggaatgtgcca

SEQ ID NO: 954291 - DNA, 19 bp, Homo sapiens
tgatggaatgtgccacctg

SEQ ID NO: 954292 - DNA, 15 bp, Homo sapiens
tgatggacaaaggcc

SEQ ID NO: 954293 - DNA, 19 bp, Homo sapiens
tgatggacactccagggac

SEQ ID NO: 954294 - DNA, 19 bp, Homo sapiens
tgatggaccgggtgggcct

SEQ ID NO: 954295 - DNA, 20 bp, Homo sapiens
tgatggaccgggtgggcctg

SEQ ID NO: 954296 - DNA, 16 bp, Homo sapiens
tgatggacctgccccg

SEQ ID NO: 954297 - DNA, 12 bp, Homo sapiens
tgatggagagga

SEQ ID NO: 954298 - DNA, 23 bp, Homo sapiens
tgatggagaggacagagcagggg

SEQ ID NO: 954299 - DNA, 18 bp, Homo sapiens
tgatggagggtggaaata

SEQ ID NO: 954300 - DNA, 14 bp, Homo sapiens
tgatggagtgctgt

SEQ ID NO: 954301 - DNA, 16 bp, Homo sapiens
tgatggagtgctgttt

SEQ ID NO: 954302 - DNA, 15 bp, Homo sapiens
tgatggagtgtgagc

SEQ ID NO: 954303 - DNA, 15 bp, Homo sapiens
tgatggatcaccatt

SEQ ID NO: 954304 - DNA, 16 bp, Homo sapiens
tgatggatggcacaat

SEQ ID NO: 954305 - DNA, 17 bp, Homo sapiens
tgatggatggcacaatg

SEQ ID NO: 954306 - DNA, 14 bp, Homo sapiens
tgatggatggcaga

SEQ ID NO: 954307 - DNA, 18 bp, Homo sapiens
tgatggatggcagactct

SEQ ID NO: 954308 - DNA, 13 bp, Homo sapiens
tgatggatgtctt

SEQ ID NO: 954309 - DNA, 13 bp, Homo sapiens
tgatggcaaaaaa

SEQ ID NO: 954310 - DNA, 22 bp, Homo sapiens
tgatggcacttagctatcagaa

SEQ ID NO: 954311 - DNA, 14 bp, Homo sapiens
tgatggccagcccc

SEQ ID NO: 954312 - DNA, 15 bp, Homo sapiens
tgatggccatttcta

SEQ ID NO: 954313 - DNA, 19 bp, Homo sapiens
tgatggccttaatttcctt

SEQ ID NO: 954314 - DNA, 14 bp, Homo sapiens
tgatggcctttgga

SEQ ID NO: 954315 - DNA, 18 bp, Homo sapiens
tgatggcctttggaccca

SEQ ID NO: 954316 - DNA, 22 bp, Homo sapiens
tgatggcgattccctctcaccc

SEQ ID NO: 954317 - DNA, 20 bp, Homo sapiens
tgatggcgcgggaggcacca

SEQ ID NO: 954318 - DNA, 21 bp, Homo sapiens
tgatggcgcgggaggcaccag

SEQ ID NO: 954319 - DNA, 23 bp, Homo sapiens
tgatggcgcgggaggcaccagct

SEQ ID NO: 954320 - DNA, 18 bp, Homo sapiens
tgatggcttgacatgtgc

SEQ ID NO: 954321 - DNA, 18 bp, Homo sapiens
tgatgggaaaatatttcc

SEQ ID NO: 954322 - DNA, 16 bp, Homo sapiens
tgatgggaaggagggg

SEQ ID NO: 954323 - DNA, 19 bp, Homo sapiens
tgatgggagagtagatggt

SEQ ID NO: 954324 - DNA, 20 bp, Homo sapiens
tgatgggcagatcttttctt

SEQ ID NO: 954325 - DNA, 22 bp, Homo sapiens
tgatgggcagatcttttcttta

SEQ ID NO: 954326 - DNA, 17 bp, Homo sapiens
tgatgggcagcctgctg

SEQ ID NO: 954327 - DNA, 23 bp, Homo sapiens
tgatgggcttttgttctgagggg

SEQ ID NO: 954328 - DNA, 17 bp, Homo sapiens
tgatgggggagagggtg

SEQ ID NO: 954329 - DNA, 17 bp, Homo sapiens
tgatggggtccagagag

SEQ ID NO: 954330 - DNA, 23 bp, Homo sapiens
tgatggggtgggagactttccat

SEQ ID NO: 954331 - DNA, 17 bp, Homo sapiens
tgatggtaaagccatgt

SEQ ID NO: 954332 - DNA, 21 bp, Homo sapiens
tgatggtcagctcccttctct

SEQ ID NO: 954333 - DNA, 20 bp, Homo sapiens
tgatggtgtcattctgcctg

SEQ ID NO: 954334 - DNA, 21 bp, Homo sapiens
tgatggtgtcattctgcctgc

SEQ ID NO: 954335 - DNA, 17 bp, Homo sapiens
tgatggtgtccttccct

SEQ ID NO: 954336 - DNA, 18 bp, Homo sapiens
tgatggtgtccttccctg

SEQ ID NO: 954337 - DNA, 21 bp, Homo sapiens
tgatggtgttaaagctgtaca

SEQ ID NO: 954338 - DNA, 14 bp, Homo sapiens
tgatggttcccctg

SEQ ID NO: 954339 - DNA, 17 bp, Homo sapiens
tgatgtaaaaatgcttc

SEQ ID NO: 954340 - DNA, 18 bp, Homo sapiens
tgatgtaaaaatgcttcc

SEQ ID NO: 954341 - DNA, 21 bp, Homo sapiens
tgatgtaaggactgtaaacat

SEQ ID NO: 954342 - DNA, 17 bp, Homo sapiens
tgatgtaatctctctgc

SEQ ID NO: 954343 - DNA, 15 bp, Homo sapiens
ggccctggccaggac

SEQ ID NO: 954344 - DNA, 13 bp, Homo sapiens
ggccctggcctcc

SEQ ID NO: 954345 - DNA, 14 bp, Homo sapiens
ggccctggcctccc

SEQ ID NO: 954346 - DNA, 22 bp, Homo sapiens
ggccctggcctgctgggctctc

SEQ ID NO: 954347 - DNA, 15 bp, Homo sapiens
ggccctgggcctcag

SEQ ID NO: 954348 - DNA, 16 bp, Homo sapiens
ggccctgggctgatgg

SEQ ID NO: 954349 - DNA, 15 bp, Homo sapiens
ggccctgggctggaa

SEQ ID NO: 954350 - DNA, 15 bp, Homo sapiens
ggccctgggctgggt

SEQ ID NO: 954351 - DNA, 18 bp, Homo sapiens
ggccctggggaggggtgg

SEQ ID NO: 954352 - DNA, 20 bp, Homo sapiens
ggccctggggatcttcccac

SEQ ID NO: 954353 - DNA, 15 bp, Homo sapiens
ggccctgggggtctg

SEQ ID NO: 954354 - DNA, 18 bp, Homo sapiens
ggccctggggtgtgtctc

SEQ ID NO: 954355 - DNA, 18 bp, Homo sapiens
ggccctggtgtcaggcag

SEQ ID NO: 954356 - DNA, 17 bp, Homo sapiens
ggccctgtccagccccc

SEQ ID NO: 954357 - DNA, 12 bp, Homo sapiens
ggccctgtccca

SEQ ID NO: 954358 - DNA, 17 bp, Homo sapiens
ggccctgtcccaggccg

SEQ ID NO: 954359 - DNA, 14 bp, Homo sapiens
ggccctgtcccctg

SEQ ID NO: 954360 - DNA, 18 bp, Homo sapiens
ggccctgtcccctggagt

SEQ ID NO: 954361 - DNA, 19 bp, Homo sapiens
ggccctgtgcagaccttac

SEQ ID NO: 954362 - DNA, 13 bp, Homo sapiens
ggcctcagcctgg

SEQ ID NO: 954363 - DNA, 17 bp, Homo sapiens
ggcctcagcctggggct

SEQ ID NO: 954364 - DNA, 17 bp, Homo sapiens
ggcctcagctgcctcac

SEQ ID NO: 954365 - DNA, 22 bp, Homo sapiens
ggcctcaggcgtttctgaagtg

SEQ ID NO: 954366 - DNA, 12 bp, Homo sapiens
ggcctcagggtc

SEQ ID NO: 954367 - DNA, 16 bp, Homo sapiens
ggcctcagggtcctgc

SEQ ID NO: 954368 - DNA, 19 bp, Homo sapiens
ggcctcagggtcctgccct

SEQ ID NO: 954369 - DNA, 16 bp, Homo sapiens
ggcctcaggtgctgtc

SEQ ID NO: 954370 - DNA, 18 bp, Homo sapiens
ggcctcaggtgctgtcca

SEQ ID NO: 954371 - DNA, 19 bp, Homo sapiens
ggcctcaggtgctgtccat

SEQ ID NO: 954372 - DNA, 20 bp, Homo sapiens
ggcctcagtggactttccac

SEQ ID NO: 954373 - DNA, 14 bp, Homo sapiens
ggcctcagttccca

SEQ ID NO: 954374 - DNA, 17 bp, Homo sapiens
ggcctcagttcccagct

SEQ ID NO: 954375 - DNA, 18 bp, Homo sapiens
ggcctcatgctggaggga

SEQ ID NO: 954376 - DNA, 20 bp, Homo sapiens
ggcctcatgtggctggaaga

SEQ ID NO: 954377 - DNA, 16 bp, Homo sapiens
ggcctccactccccca

SEQ ID NO: 954378 - DNA, 21 bp, Homo sapiens
ggcctccactcccccacctga

SEQ ID NO: 954379 - DNA, 22 bp, Homo sapiens
ggcctccactcccccacctgac

SEQ ID NO: 954380 - DNA, 23 bp, Homo sapiens
ggcctccactcccccacctgaca

SEQ ID NO: 954381 - DNA, 14 bp, Homo sapiens
ggcctccaggaggg

SEQ ID NO: 954382 - DNA, 13 bp, Homo sapiens
ggcctccagggcc

SEQ ID NO: 954383 - DNA, 15 bp, Homo sapiens
ggcctccatttctgt

SEQ ID NO: 954384 - DNA, 12 bp, Homo sapiens
ggcctcccaaag

SEQ ID NO: 954385 - DNA, 16 bp, Homo sapiens
ggcctcccacagactc

SEQ ID NO: 954386 - DNA, 10 bp, Homo sapiens
ggcctccccc

SEQ ID NO: 954387 - DNA, 23 bp, Homo sapiens
ggcctcccccaacacctgctgcg

SEQ ID NO: 954388 - DNA, 12 bp, Homo sapiens
ggcctccccgag

SEQ ID NO: 954389 - DNA, 14 bp, Homo sapiens
ggcctcccctgctg

SEQ ID NO: 954390 - DNA, 15 bp, Homo sapiens
ggcctcccctgctga

SEQ ID NO: 954391 - DNA, 17 bp, Homo sapiens
ggcctcccctgggcagg

SEQ ID NO: 954392 - DNA, 21 bp, Homo sapiens
ggcctccctagcacctccccc

SEQ ID NO: 954393 - DNA, 23 bp, Homo sapiens
ggcctccctagcacctcccccta

SEQ ID NO: 954394 - DNA, 12 bp, Homo sapiens
ggcctccctgct

SEQ ID NO: 954395 - DNA, 22 bp, Homo sapiens
ggcctccctgctgtgccatgct

SEQ ID NO: 954396 - DNA, 22 bp, Homo sapiens
ggcctccgatgcctggcctgcc

SEQ ID NO: 954397 - DNA, 16 bp, Homo sapiens
ggcctccggcctcccc

SEQ ID NO: 954398 - DNA, 16 bp, Homo sapiens
ggcctcctaggggaag

SEQ ID NO: 954399 - DNA, 18 bp, Homo sapiens
ggcctcctaggggaaggg

SEQ ID NO: 954400 - DNA, 12 bp, Homo sapiens
ggcctcctcagc

SEQ ID NO: 954401 - DNA, 17 bp, Homo sapiens
ggcctcctcggagagca

SEQ ID NO: 954402 - DNA, 20 bp, Homo sapiens
ggcctcctcggagagcagca

SEQ ID NO: 954403 - DNA, 18 bp, Homo sapiens
ggcctcctctgtccaggg

SEQ ID NO: 954404 - DNA, 19 bp, Homo sapiens
ggcctcctggcccgccctc

SEQ ID NO: 954405 - DNA, 12 bp, Homo sapiens
ggcctcctgggg

SEQ ID NO: 954406 - DNA, 17 bp, Homo sapiens
ggcctcctgggggacct

SEQ ID NO: 954407 - DNA, 22 bp, Homo sapiens
ggcctccttcccatgcctgtct

SEQ ID NO: 954408 - DNA, 21 bp, Homo sapiens
ggcctccttcttccacttctc

SEQ ID NO: 954409 - DNA, 21 bp, Homo sapiens
ggcctcgcacttgcagaggag

SEQ ID NO: 954410 - DNA, 22 bp, Homo sapiens
ggcctcgcacttgcagaggagc

SEQ ID NO: 954411 - DNA, 23 bp, Homo sapiens
ggcctcgcacttgcagaggagcc

SEQ ID NO: 954412 - DNA, 16 bp, Homo sapiens
ggcctcgcctccccac

SEQ ID NO: 954413 - DNA, 18 bp, Homo sapiens
ggcctcgcctgcctttct

SEQ ID NO: 954414 - DNA, 15 bp, Homo sapiens
ggcctcggagcctca

SEQ ID NO: 954415 - DNA, 22 bp, Homo sapiens
ggcctcggcagaactctctgtc

SEQ ID NO: 954416 - DNA, 16 bp, Homo sapiens
ggcctcgggacacctg

SEQ ID NO: 954417 - DNA, 22 bp, Homo sapiens
ggcctcgggacacctgccctgc

SEQ ID NO: 954418 - DNA, 23 bp, Homo sapiens
ggcctcgggacacctgccctgcc

SEQ ID NO: 954419 - DNA, 14 bp, Homo sapiens
ggcctcgtgccatg

SEQ ID NO: 954420 - DNA, 20 bp, Homo sapiens
ggcctcgtgccatgatctgt

SEQ ID NO: 954421 - DNA, 19 bp, Homo sapiens
ggcctctccaaccactgtg

SEQ ID NO: 954422 - DNA, 19 bp, Homo sapiens
ggcctctcctgccctctgc

SEQ ID NO: 954423 - DNA, 23 bp, Homo sapiens
ggcctctctatcctctcttcctc

SEQ ID NO: 954424 - DNA, 17 bp, Homo sapiens
ggcctctctcaggagca

SEQ ID NO: 954425 - DNA, 15 bp, Homo sapiens
ggcctctctcctgcc

SEQ ID NO: 954426 - DNA, 18 bp, Homo sapiens
ggcctctctcctgcctgc

SEQ ID NO: 954427 - DNA, 20 bp, Homo sapiens
ggcctctctcctgcctgccc

SEQ ID NO: 954428 - DNA, 16 bp, Homo sapiens
ggcctctctctgctcc

SEQ ID NO: 954429 - DNA, 15 bp, Homo sapiens
ggcctctctggcctc

SEQ ID NO: 954430 - DNA, 16 bp, Homo sapiens
ggcctctctgggggag

SEQ ID NO: 954431 - DNA, 14 bp, Homo sapiens
ggcctctgctgccc

SEQ ID NO: 954432 - DNA, 15 bp, Homo sapiens
ggcctctggccctcg

SEQ ID NO: 954433 - DNA, 10 bp, Homo sapiens
ggcctctggt

SEQ ID NO: 954434 - DNA, 21 bp, Homo sapiens
ggcctctggttctgacacttt

SEQ ID NO: 954435 - DNA, 14 bp, Homo sapiens
ggcctctgtgatta

SEQ ID NO: 954436 - DNA, 14 bp, Homo sapiens
ggcctctgtgtaca

SEQ ID NO: 954437 - DNA, 14 bp, Homo sapiens
ggcctctgtgtcct

SEQ ID NO: 954438 - DNA, 19 bp, Homo sapiens
ggcctcttccgtgacgtca

SEQ ID NO: 954439 - DNA, 20 bp, Homo sapiens
ggcctcttgagttcctctgc

SEQ ID NO: 954440 - DNA, 23 bp, Homo sapiens
ggcctcttgagttcctctgcagt

SEQ ID NO: 954441 - DNA, 22 bp, Homo sapiens
ggcctcttggacctctgctctg

SEQ ID NO: 954442 - DNA, 13 bp, Homo sapiens
ggcctcttggcag

SEQ ID NO: 954443 - DNA, 19 bp, Homo sapiens
ggcctcttgggtcccccac

SEQ ID NO: 954444 - DNA, 16 bp, Homo sapiens
ggcctcttgtcccttg

SEQ ID NO: 954445 - DNA, 18 bp, Homo sapiens
ggcctcttgtcccttggc

SEQ ID NO: 954446 - DNA, 19 bp, Homo sapiens
ggcctcttgtcccttggca

SEQ ID NO: 954447 - DNA, 19 bp, Homo sapiens
ggcctctttttgcccttta

SEQ ID NO: 954448 - DNA, 15 bp, Homo sapiens
ggcctgaaacccgcc

SEQ ID NO: 954449 - DNA, 17 bp, Homo sapiens
ggcctgaacccgtccat

SEQ ID NO: 954450 - DNA, 15 bp, Homo sapiens
ggcctgaactgagga

SEQ ID NO: 954451 - DNA, 15 bp, Homo sapiens
ggcctgaagccagct

SEQ ID NO: 954452 - DNA, 16 bp, Homo sapiens
ggcctgaagccagctg

SEQ ID NO: 954453 - DNA, 16 bp, Homo sapiens
ggcctgacaccccctc

SEQ ID NO: 954454 - DNA, 13 bp, Homo sapiens
ggcctgactgctc

SEQ ID NO: 954455 - DNA, 15 bp, Homo sapiens
ggcctgactgctcag

SEQ ID NO: 954456 - DNA, 19 bp, Homo sapiens
ggcctgactggttgtcaga

SEQ ID NO: 954457 - DNA, 15 bp, Homo sapiens
ggcctgacttgagcc

SEQ ID NO: 954458 - DNA, 19 bp, Homo sapiens
ggcctgagaatgagtggga

SEQ ID NO: 954459 - DNA, 13 bp, Homo sapiens
ggcctgagagaat

SEQ ID NO: 954460 - DNA, 12 bp, Homo sapiens
ggcctgagctgg

SEQ ID NO: 954461 - DNA, 13 bp, Homo sapiens
ggcctgagctggg

SEQ ID NO: 954462 - DNA, 15 bp, Homo sapiens
ggcctgagctggggc

SEQ ID NO: 954463 - DNA, 18 bp, Homo sapiens
ggcctgaggatgagctgg

SEQ ID NO: 954464 - DNA, 19 bp, Homo sapiens
ggcctgaggatgagctgga

SEQ ID NO: 954465 - DNA, 18 bp, Homo sapiens
ggcctgatcagaccacgg

SEQ ID NO: 954466 - DNA, 16 bp, Homo sapiens
ggcctgatcttgcctg

SEQ ID NO: 954467 - DNA, 20 bp, Homo sapiens
ggcctgatgagactccactc

SEQ ID NO: 954468 - DNA, 21 bp, Homo sapiens
ggcctgatgagactccactca

SEQ ID NO: 954469 - DNA, 14 bp, Homo sapiens
ggcctgatgctccc

SEQ ID NO: 954470 - DNA, 15 bp, Homo sapiens
ggcctgatgctccct

SEQ ID NO: 954471 - DNA, 13 bp, Homo sapiens
ggcctgatgctgc

SEQ ID NO: 954472 - DNA, 23 bp, Homo sapiens
ggcctgcaaaccttcctgggagg

SEQ ID NO: 954473 - DNA, 14 bp, Homo sapiens
ggcctgcagtggtg

SEQ ID NO: 954474 - DNA, 15 bp, Homo sapiens
tgattggattattca

SEQ ID NO: 954475 - DNA, 21 bp, Homo sapiens
tgattggattattcatttaaa

SEQ ID NO: 954476 - DNA, 21 bp, Homo sapiens
tgattggcctgtagagttgct

SEQ ID NO: 954477 - DNA, 22 bp, Homo sapiens
tgattggcttaaagtgaaggaa

SEQ ID NO: 954478 - DNA, 18 bp, Homo sapiens
tgattggtgattcaaagt

SEQ ID NO: 954479 - DNA, 15 bp, Homo sapiens
tgattggttcagttt

SEQ ID NO: 954480 - DNA, 14 bp, Homo sapiens
tgattgtacttgga

SEQ ID NO: 954481 - DNA, 13 bp, Homo sapiens
tgattgtcagcca

SEQ ID NO: 954482 - DNA, 18 bp, Homo sapiens
tgattgtgaattccttaa

SEQ ID NO: 954483 - DNA, 15 bp, Homo sapiens
tgattgtgaggcttc

SEQ ID NO: 954484 - DNA, 15 bp, Homo sapiens
tgcaaacagaacagg

SEQ ID NO: 954485 - DNA, 17 bp, Homo sapiens
tgcaaacagaacagggt

SEQ ID NO: 954486 - DNA, 18 bp, Homo sapiens
tgcaaacagaacagggtc

SEQ ID NO: 954487 - DNA, 19 bp, Homo sapiens
tgcaaacagaacagggtca

SEQ ID NO: 954488 - DNA, 13 bp, Homo sapiens
tgcaaacagtaac

SEQ ID NO: 954489 - DNA, 16 bp, Homo sapiens
tgcaaaccctttgtat

SEQ ID NO: 954490 - DNA, 17 bp, Homo sapiens
tgcaaaccctttgtatt

SEQ ID NO: 954491 - DNA, 18 bp, Homo sapiens
tgcaaaccctttgtatta

SEQ ID NO: 954492 - DNA, 21 bp, Homo sapiens
tgcaaaccctttgtattataa

SEQ ID NO: 954493 - DNA, 18 bp, Homo sapiens
tgcaaaccttcctgggag

SEQ ID NO: 954494 - DNA, 16 bp, Homo sapiens
tgcaaactcactgctc

SEQ ID NO: 954495 - DNA, 19 bp, Homo sapiens
tgcaaactgtggcaactga

SEQ ID NO: 954496 - DNA, 20 bp, Homo sapiens
tgcaaacttttttatatctt

SEQ ID NO: 954497 - DNA, 23 bp, Homo sapiens
tgcaaagaaagaaaaaaaaccat

SEQ ID NO: 954498 - DNA, 15 bp, Homo sapiens
tgcaaagaccacctc

SEQ ID NO: 954499 - DNA, 18 bp, Homo sapiens
tgcaaagactctgagcca

SEQ ID NO: 954500 - DNA, 14 bp, Homo sapiens
tgcaaagcaatgaa

SEQ ID NO: 954501 - DNA, 14 bp, Homo sapiens
tgcaaagcacacct

SEQ ID NO: 954502 - DNA, 16 bp, Homo sapiens
tgcaaagcactctctg

SEQ ID NO: 954503 - DNA, 18 bp, Homo sapiens
tgcaaagcactctctgca

SEQ ID NO: 954504 - DNA, 15 bp, Homo sapiens
tgcaaagcccagctt

SEQ ID NO: 954505 - DNA, 18 bp, Homo sapiens
tgcaaagctttggctgag

SEQ ID NO: 954506 - DNA, 13 bp, Homo sapiens
tgcaaaggaaata

SEQ ID NO: 954507 - DNA, 16 bp, Homo sapiens
tgcaaaggaaatacca

SEQ ID NO: 954508 - DNA, 13 bp, Homo sapiens
tgcaaaggcctgg

SEQ ID NO: 954509 - DNA, 20 bp, Homo sapiens
tgcaaagggctgccttgctg

SEQ ID NO: 954510 - DNA, 20 bp, Homo sapiens
tgcaaagtaaaaaaatatga

SEQ ID NO: 954511 - DNA, 20 bp, Homo sapiens
tgcaaagtatccctactgta

SEQ ID NO: 954512 - DNA, 18 bp, Homo sapiens
tgcaaagtattgtaaatt

SEQ ID NO: 954513 - DNA, 23 bp, Homo sapiens
tgcaaagttccctacttcctgtg

SEQ ID NO: 954514 - DNA, 20 bp, Homo sapiens
tgcaaataaaacccaatact

SEQ ID NO: 954515 - DNA, 21 bp, Homo sapiens
tgcaaataaaacccaatactt

SEQ ID NO: 954516 - DNA, 16 bp, Homo sapiens
tgcaaataaagccttt

SEQ ID NO: 954517 - DNA, 18 bp, Homo sapiens
tgcaaataagtgtatttt

SEQ ID NO: 954518 - DNA, 21 bp, Homo sapiens
tgcaaataagtgtattttgaa

SEQ ID NO: 954519 - DNA, 14 bp, Homo sapiens
tgcaaatagaaaac

SEQ ID NO: 954520 - DNA, 17 bp, Homo sapiens
tgcaaatagaaaacagg

SEQ ID NO: 954521 - DNA, 20 bp, Homo sapiens
tgcaaatagccttcctgacc

SEQ ID NO: 954522 - DNA, 19 bp, Homo sapiens
tgcaaatattagcaaagaa

SEQ ID NO: 954523 - DNA, 21 bp, Homo sapiens
tgcaaatgagttcaggactac

SEQ ID NO: 954524 - DNA, 15 bp, Homo sapiens
tgcaaatgctgtatt

SEQ ID NO: 954525 - DNA, 18 bp, Homo sapiens
tgcaaatggagataaaag

SEQ ID NO: 954526 - DNA, 19 bp, Homo sapiens
tgcaaatggagataaaagc

SEQ ID NO: 954527 - DNA, 20 bp, Homo sapiens
tgcaaatgggagctgagcag

SEQ ID NO: 954528 - DNA, 15 bp, Homo sapiens
tgcaaatgtcttcca

SEQ ID NO: 954529 - DNA, 19 bp, Homo sapiens
tgcaaatgtcttccaggtc

SEQ ID NO: 954530 - DNA, 23 bp, Homo sapiens
tgcaaattaatgtataatttgag

SEQ ID NO: 954531 - DNA, 18 bp, Homo sapiens
tgcaaattatttattact

SEQ ID NO: 954532 - DNA, 24 bp, Homo sapiens
tgcaaattatttattacttgtgca

SEQ ID NO: 954533 - DNA, 16 bp, Homo sapiens
tgcaaattgtatctta

SEQ ID NO: 954534 - DNA, 18 bp, Homo sapiens
tgcaaatttctataaatt

SEQ ID NO: 954535 - DNA, 15 bp, Homo sapiens
tgcaaattttgcatt

SEQ ID NO: 954536 - DNA, 13 bp, Homo sapiens
tgcaacaaaattc

SEQ ID NO: 954537 - DNA, 12 bp, Homo sapiens
tgcaacacacag

SEQ ID NO: 954538 - DNA, 15 bp, Homo sapiens
tgcaacacacagaca

SEQ ID NO: 954539 - DNA, 16 bp, Homo sapiens
tgcaacagacttgaat

SEQ ID NO: 954540 - DNA, 24 bp, Homo sapiens
tgcaacagcactggctctctccag

SEQ ID NO: 954541 - DNA, 24 bp, Homo sapiens
tgcaacagggtatggactatctgt

SEQ ID NO: 954542 - DNA, 15 bp, Homo sapiens
tgcaacatttctgta

SEQ ID NO: 954543 - DNA, 21 bp, Homo sapiens
tgcaaccaactatccaagtgt

SEQ ID NO: 954544 - DNA, 13 bp, Homo sapiens
tgcaaccactgca

SEQ ID NO: 954545 - DNA, 15 bp, Homo sapiens
tgcaaccactgcaac

SEQ ID NO: 954546 - DNA, 15 bp, Homo sapiens
tgcaaccactgcaat

SEQ ID NO: 954547 - DNA, 20 bp, Homo sapiens
tgcaaccaggaacagcaaat

SEQ ID NO: 954548 - DNA, 16 bp, Homo sapiens
tgcaaccaggcagctg

SEQ ID NO: 954549 - DNA, 17 bp, Homo sapiens
tgcaacccttacccctt

SEQ ID NO: 954550 - DNA, 13 bp, Homo sapiens
tgcaacctcacta

SEQ ID NO: 954551 - DNA, 14 bp, Homo sapiens
tgcaacctcgctgg

SEQ ID NO: 954552 - DNA, 19 bp, Homo sapiens
tgcaacctcgctggactct

SEQ ID NO: 954553 - DNA, 22 bp, Homo sapiens
tgcaacctcgctggactctcag

SEQ ID NO: 954554 - DNA, 14 bp, Homo sapiens
tgcaacctctgcct

SEQ ID NO: 954555 - DNA, 16 bp, Homo sapiens
tgcaacctctgcctcc

SEQ ID NO: 954556 - DNA, 18 bp, Homo sapiens
tgcaacctcttggcctga

SEQ ID NO: 954557 - DNA, 13 bp, Homo sapiens
tgcaacctgtggc

SEQ ID NO: 954558 - DNA, 20 bp, Homo sapiens
tgcaaccttcacctccaggt

SEQ ID NO: 954559 - DNA, 19 bp, Homo sapiens
tgcaaccttgtttattaaa

SEQ ID NO: 954560 - DNA, 19 bp, Homo sapiens
tgcaacgggattgaagggt

SEQ ID NO: 954561 - DNA, 15 bp, Homo sapiens
tgcaactaaggacaa

SEQ ID NO: 954562 - DNA, 16 bp, Homo sapiens
tgcaactaaggacaaa

SEQ ID NO: 954563 - DNA, 22 bp, Homo sapiens
tgcaactaaggacaaattagca

SEQ ID NO: 954564 - DNA, 17 bp, Homo sapiens
tgcaactagccaaggct

SEQ ID NO: 954565 - DNA, 13 bp, Homo sapiens
tgcaactcactga

SEQ ID NO: 954566 - DNA, 21 bp, Homo sapiens
tgcaactgctcagctctggtc

SEQ ID NO: 954567 - DNA, 16 bp, Homo sapiens
tgcaactggccagcca

SEQ ID NO: 954568 - DNA, 18 bp, Homo sapiens
tgcaacttccgctgaggg

SEQ ID NO: 954569 - DNA, 15 bp, Homo sapiens
tgcaacttctatcct

SEQ ID NO: 954570 - DNA, 16 bp, Homo sapiens
tgcaactttttaaagt

SEQ ID NO: 954571 - DNA, 20 bp, Homo sapiens
tgcaagaaaatgatgtgtac

SEQ ID NO: 954572 - DNA, 18 bp, Homo sapiens
tgcaagaccacggaggga

SEQ ID NO: 954573 - DNA, 22 bp, Homo sapiens
tgcaagaccagtattctaaagt

SEQ ID NO: 954574 - DNA, 22 bp, Homo sapiens
tgcaagaccccaagaggaagtt

SEQ ID NO: 954575 - DNA, 21 bp, Homo sapiens
tgcaagacctagtcccctttc

SEQ ID NO: 954576 - DNA, 19 bp, Homo sapiens
tgcaagagtgattgcagct

SEQ ID NO: 954577 - DNA, 19 bp, Homo sapiens
tgcaagatgcttggttgtg

SEQ ID NO: 954578 - DNA, 22 bp, Homo sapiens
tgcaagatggacacgagccaca

SEQ ID NO: 954579 - DNA, 23 bp, Homo sapiens
tgcaagatggacacgagccacaa

SEQ ID NO: 954580 - DNA, 15 bp, Homo sapiens
tgcaagatgtgaatt

SEQ ID NO: 954581 - DNA, 16 bp, Homo sapiens
tgcaagatgtgaatta

SEQ ID NO: 954582 - DNA, 23 bp, Homo sapiens
tgcaagattttttttttaagtga

SEQ ID NO: 954583 - DNA, 23 bp, Homo sapiens
tgcaagcagctttttattccctg

SEQ ID NO: 954584 - DNA, 23 bp, Homo sapiens
tgcaagccccagggcctgggggc

SEQ ID NO: 954585 - DNA, 20 bp, Homo sapiens
tgcaagcttggtcaaacttt

SEQ ID NO: 954586 - DNA, 21 bp, Homo sapiens
tgcaagcttggtcaaactttt

SEQ ID NO: 954587 - DNA, 19 bp, Homo sapiens
tgcaaggaaggaaagaaag

SEQ ID NO: 954588 - DNA, 15 bp, Homo sapiens
tgcaaggaccaggac

SEQ ID NO: 954589 - DNA, 22 bp, Homo sapiens
tgcaaggatttttccatgtgtg

SEQ ID NO: 954590 - DNA, 11 bp, Homo sapiens
tgcaagggaaa

SEQ ID NO: 954591 - DNA, 18 bp, Homo sapiens
tgcaagggcccagagtga

SEQ ID NO: 954592 - DNA, 18 bp, Homo sapiens
tgcaaggggaaaatctca

SEQ ID NO: 954593 - DNA, 21 bp, Homo sapiens
tgcaaggtattacactctgta

SEQ ID NO: 954594 - DNA, 17 bp, Homo sapiens
tgcaaggtgctggtggg

SEQ ID NO: 954595 - DNA, 23 bp, Homo sapiens
tgcaaggtggcctttgtgctgcg

SEQ ID NO: 954596 - DNA, 17 bp, Homo sapiens
tgcaagtatactaggga

SEQ ID NO: 954597 - DNA, 20 bp, Homo sapiens
tgcaagtatactagggagcc

SEQ ID NO: 954598 - DNA, 18 bp, Homo sapiens
tgcaagtatgtgagtgtg

SEQ ID NO: 954599 - DNA, 21 bp, Homo sapiens
tgcaagtatgttttagcatgt

SEQ ID NO: 954600 - DNA, 22 bp, Homo sapiens
tgcaagtatgttttagcatgtg

SEQ ID NO: 954601 - DNA, 13 bp, Homo sapiens
tgcaagtctgtgg

SEQ ID NO: 954602 - DNA, 21 bp, Homo sapiens
ggccttctgtggggctgggca

SEQ ID NO: 954603 - DNA, 22 bp, Homo sapiens
ggccttctgtggggctgggcac

SEQ ID NO: 954604 - DNA, 16 bp, Homo sapiens
ggccttgcggaagcca

SEQ ID NO: 954605 - DNA, 12 bp, Homo sapiens
ggctccagctgg

SEQ ID NO: 954606 - DNA, 17 bp, Homo sapiens
ggctccaggcctgtact

SEQ ID NO: 954607 - DNA, 21 bp, Homo sapiens
ggctccatgcctctggaggcc

SEQ ID NO: 954608 - DNA, 23 bp, Homo sapiens
ggctccatgctgaaggctcccat

SEQ ID NO: 954609 - DNA, 23 bp, Homo sapiens
ggctcccaatcagcttttgttct

SEQ ID NO: 954610 - DNA, 16 bp, Homo sapiens
tgcaccaaagatgtcc

SEQ ID NO: 954611 - DNA, 20 bp, Homo sapiens
tgcaccaaagatgtcctgac

SEQ ID NO: 954612 - DNA, 19 bp, Homo sapiens
tgcaccaacctcactgccc

SEQ ID NO: 954613 - DNA, 23 bp, Homo sapiens
tgcaccaagaaagcttcttcaga

SEQ ID NO: 954614 - DNA, 14 bp, Homo sapiens
tgcaccacacctgg

SEQ ID NO: 954615 - DNA, 19 bp, Homo sapiens
tgcaccacacctggcatgg

SEQ ID NO: 954616 - DNA, 20 bp, Homo sapiens
tgcaccacacctggcatggt

SEQ ID NO: 954617 - DNA, 14 bp, Homo sapiens
tgcaccaccaagcc

SEQ ID NO: 954618 - DNA, 15 bp, Homo sapiens
tgcaccaccaagcca

SEQ ID NO: 954619 - DNA, 19 bp, Homo sapiens
tgcaccaccaagccaaggg

SEQ ID NO: 954620 - DNA, 14 bp, Homo sapiens
tgcaccactgcact

SEQ ID NO: 954621 - DNA, 12 bp, Homo sapiens
tgcaccagagca

SEQ ID NO: 954622 - DNA, 18 bp, Homo sapiens
tgcaccaggactggctgt

SEQ ID NO: 954623 - DNA, 22 bp, Homo sapiens
tgcaccatccctttttgaagtg

SEQ ID NO: 954624 - DNA, 23 bp, Homo sapiens
tgcaccattgcgctctagcctgg

SEQ ID NO: 954625 - DNA, 17 bp, Homo sapiens
tgcacccacccaggagt

SEQ ID NO: 954626 - DNA, 13 bp, Homo sapiens
tgcacccacctgt

SEQ ID NO: 954627 - DNA, 20 bp, Homo sapiens
tgcacccactcaccagggtc

SEQ ID NO: 954628 - DNA, 17 bp, Homo sapiens
tgcacccagaacagtgg

SEQ ID NO: 954629 - DNA, 18 bp, Homo sapiens
tgcaccccaaagctttcc

SEQ ID NO: 954630 - DNA, 22 bp, Homo sapiens
tgcaccccagcattccagctct

SEQ ID NO: 954631 - DNA, 16 bp, Homo sapiens
tgcaccctccgccttc

SEQ ID NO: 954632 - DNA, 12 bp, Homo sapiens
tgcaccctggaa

SEQ ID NO: 954633 - DNA, 16 bp, Homo sapiens
tgcacccttcttttct

SEQ ID NO: 954634 - DNA, 18 bp, Homo sapiens
tgcaccgccgcagaagca

SEQ ID NO: 954635 - DNA, 22 bp, Homo sapiens
tgcaccgcctgccctcccgcac

SEQ ID NO: 954636 - DNA, 15 bp, Homo sapiens
tgcaccgtcctcagc

SEQ ID NO: 954637 - DNA, 20 bp, Homo sapiens
tgcaccgtctcactgtgtgt

SEQ ID NO: 954638 - DNA, 16 bp, Homo sapiens
tgcacctaaagaaaaa

SEQ ID NO: 954639 - DNA, 20 bp, Homo sapiens
tgcacctatctcagccatag

SEQ ID NO: 954640 - DNA, 13 bp, Homo sapiens
tgcacctcagggc

SEQ ID NO: 954641 - DNA, 15 bp, Homo sapiens
tgcacctcagggcca

SEQ ID NO: 954642 - DNA, 14 bp, Homo sapiens
tgcacctcccccca

SEQ ID NO: 954643 - DNA, 17 bp, Homo sapiens
tgcacctccccccactg

SEQ ID NO: 954644 - DNA, 20 bp, Homo sapiens
tgcacctccccccactgcag

SEQ ID NO: 954645 - DNA, 22 bp, Homo sapiens
tgcacctccctccccagctccg

SEQ ID NO: 954646 - DNA, 18 bp, Homo sapiens
tgcacctctgttcatttc

SEQ ID NO: 954647 - DNA, 19 bp, Homo sapiens
tgcacctctgttcatttca

SEQ ID NO: 954648 - DNA, 16 bp, Homo sapiens
tgcacctgacctgctg

SEQ ID NO: 954649 - DNA, 20 bp, Homo sapiens
tgcacctgacctgctgaatt

SEQ ID NO: 954650 - DNA, 14 bp, Homo sapiens
tgcacctgagaccc

SEQ ID NO: 954651 - DNA, 19 bp, Homo sapiens
tgcacctgagaccctactg

SEQ ID NO: 954652 - DNA, 21 bp, Homo sapiens
tgcacctgagaccctactgaa

SEQ ID NO: 954653 - DNA, 15 bp, Homo sapiens
tgcacctgcagcgcg

SEQ ID NO: 954654 - DNA, 11 bp, Homo sapiens
tgcacctgcat

SEQ ID NO: 954655 - DNA, 15 bp, Homo sapiens
tgcacctgccagcct

SEQ ID NO: 954656 - DNA, 18 bp, Homo sapiens
tgcacctgccagcctggc

SEQ ID NO: 954657 - DNA, 19 bp, Homo sapiens
tgcacctgccagcctggct

SEQ ID NO: 954658 - DNA, 14 bp, Homo sapiens
tgcacctgcccagc

SEQ ID NO: 954659 - DNA, 16 bp, Homo sapiens
tgcacctgcctcagct

SEQ ID NO: 954660 - DNA, 16 bp, Homo sapiens
tgcacctgctgcgtcc

SEQ ID NO: 954661 - DNA, 21 bp, Homo sapiens
tgcacctgctgcgtccccact

SEQ ID NO: 954662 - DNA, 23 bp, Homo sapiens
tgcacctgctgcgtccccactcc

SEQ ID NO: 954663 - DNA, 22 bp, Homo sapiens
tgcacctggaatatataaccag

SEQ ID NO: 954664 - DNA, 18 bp, Homo sapiens
tgcacctgggcagctcct

SEQ ID NO: 954665 - DNA, 16 bp, Homo sapiens
tgcacctgtactcagg

SEQ ID NO: 954666 - DNA, 19 bp, Homo sapiens
tgcaccttatatttctgtg

SEQ ID NO: 954667 - DNA, 22 bp, Homo sapiens
tgcaccttatatttctgtgtac

SEQ ID NO: 954668 - DNA, 14 bp, Homo sapiens
tgcacctttctagt

SEQ ID NO: 954669 - DNA, 19 bp, Homo sapiens
tgcacgacgccctctcccc

SEQ ID NO: 954670 - DNA, 17 bp, Homo sapiens
tgcacgcccatgtgtga

SEQ ID NO: 954671 - DNA, 19 bp, Homo sapiens
tgcacgcccatgtgtgagt

SEQ ID NO: 954672 - DNA, 22 bp, Homo sapiens
tgcacgcccatgtgtgagtgtg

SEQ ID NO: 954673 - DNA, 16 bp, Homo sapiens
tgcacgctcccctcca

SEQ ID NO: 954674 - DNA, 20 bp, Homo sapiens
tgcacgggatgcgtgggagg

SEQ ID NO: 954675 - DNA, 20 bp, Homo sapiens
tgcacgggcatgcacacggc

SEQ ID NO: 954676 - DNA, 21 bp, Homo sapiens
tgcacgggcatgcacacggct

SEQ ID NO: 954677 - DNA, 15 bp, Homo sapiens
tgcacgtcatgggag

SEQ ID NO: 954678 - DNA, 16 bp, Homo sapiens
tgcacgtcttgctatt

SEQ ID NO: 954679 - DNA, 15 bp, Homo sapiens
tgcacgtggcctctt

SEQ ID NO: 954680 - DNA, 15 bp, Homo sapiens
tgcacgtggggccca

SEQ ID NO: 954681 - DNA, 18 bp, Homo sapiens
tgcactaaatcagagaca

SEQ ID NO: 954682 - DNA, 17 bp, Homo sapiens
tgcactaaggggcccgg

SEQ ID NO: 954683 - DNA, 22 bp, Homo sapiens
tgcactaaggggcccggccagc

SEQ ID NO: 954684 - DNA, 23 bp, Homo sapiens
tgcactaaggggcccggccagcc

SEQ ID NO: 954685 - DNA, 22 bp, Homo sapiens
tgcactaatgtgttatgagaaa

SEQ ID NO: 954686 - DNA, 23 bp, Homo sapiens
tgcactactcctctgcagtgcct

SEQ ID NO: 954687 - DNA, 16 bp, Homo sapiens
tgcactactgacatgt

SEQ ID NO: 954688 - DNA, 18 bp, Homo sapiens
tgcactactgacatgtgg

SEQ ID NO: 954689 - DNA, 13 bp, Homo sapiens
tgcactagcctgt

SEQ ID NO: 954690 - DNA, 13 bp, Homo sapiens
tgcactaggaatt

SEQ ID NO: 954691 - DNA, 23 bp, Homo sapiens
tgcactaggaattctttgcattc

SEQ ID NO: 954692 - DNA, 16 bp, Homo sapiens
tgcactatatttgtat

SEQ ID NO: 954693 - DNA, 18 bp, Homo sapiens
tgcactatatttgtatat

SEQ ID NO: 954694 - DNA, 14 bp, Homo sapiens
tgcactcagctctt

SEQ ID NO: 954695 - DNA, 14 bp, Homo sapiens
tgcactcatcatat

SEQ ID NO: 954696 - DNA, 15 bp, Homo sapiens
tgcactcatcatatt

SEQ ID NO: 954697 - DNA, 17 bp, Homo sapiens
tgcactccagcctgggg

SEQ ID NO: 954698 - DNA, 18 bp, Homo sapiens
tgcactccagcctggggg

SEQ ID NO: 954699 - DNA, 15 bp, Homo sapiens
tgcactccagcttgg

SEQ ID NO: 954700 - DNA, 20 bp, Homo sapiens
tgcactccatggccaccccg

SEQ ID NO: 954701 - DNA, 15 bp, Homo sapiens
tgcactcccacctga

SEQ ID NO: 954702 - DNA, 19 bp, Homo sapiens
tgcactcccgcctgggcga

SEQ ID NO: 954703 - DNA, 15 bp, Homo sapiens
tgcactccctggcct

SEQ ID NO: 954704 - DNA, 19 bp, Homo sapiens
tgcactcctcacacagaat

SEQ ID NO: 954705 - DNA, 13 bp, Homo sapiens
tgcactctttaac

SEQ ID NO: 954706 - DNA, 19 bp, Homo sapiens
tgcactgaaaacttagcca

SEQ ID NO: 954707 - DNA, 17 bp, Homo sapiens
tgcactgaaacctgaga

SEQ ID NO: 954708 - DNA, 15 bp, Homo sapiens
tgcactgaatatata

SEQ ID NO: 954709 - DNA, 20 bp, Homo sapiens
tgcactgaatatataaacac

SEQ ID NO: 954710 - DNA, 14 bp, Homo sapiens
tgcactgactgtga

SEQ ID NO: 954711 - DNA, 14 bp, Homo sapiens
tgcactgagaacag

SEQ ID NO: 954712 - DNA, 17 bp, Homo sapiens
tgcactgagagggcaag

SEQ ID NO: 954713 - DNA, 15 bp, Homo sapiens
tgcactgatcaccca

SEQ ID NO: 954714 - DNA, 13 bp, Homo sapiens
tgcactgatgttg

SEQ ID NO: 954715 - DNA, 19 bp, Homo sapiens
tgcactgcccatggacagg

SEQ ID NO: 954716 - DNA, 13 bp, Homo sapiens
tgcactgctgttc

SEQ ID NO: 954717 - DNA, 15 bp, Homo sapiens
tgcactggagccaca

SEQ ID NO: 954718 - DNA, 21 bp, Homo sapiens
tgcactggccttctgatgaaa

SEQ ID NO: 954719 - DNA, 19 bp, Homo sapiens
tgcactgggaaggaaacaa

SEQ ID NO: 954720 - DNA, 11 bp, Homo sapiens
tgcactgggca

SEQ ID NO: 954721 - DNA, 12 bp, Homo sapiens
tgcactgggcag

SEQ ID NO: 954722 - DNA, 13 bp, Homo sapiens
tgcactgggcagg

SEQ ID NO: 954723 - DNA, 20 bp, Homo sapiens
tgcactggggagcccgtctc

SEQ ID NO: 954724 - DNA, 23 bp, Homo sapiens
tgcactgtcactttgctctgggt

SEQ ID NO: 954725 - DNA, 18 bp, Homo sapiens
tgcactgtgaatcctggc

SEQ ID NO: 954726 - DNA, 21 bp, Homo sapiens
tgcactgtgaatcctggcaag

SEQ ID NO: 954727 - DNA, 10 bp, Homo sapiens
tgcagcagag

SEQ ID NO: 954728 - DNA, 14 bp, Homo sapiens
tgcagcagcccagc

SEQ ID NO: 954729 - DNA, 22 bp, Homo sapiens
tgcagcaggaaggaacaaagac

SEQ ID NO: 954730 - DNA, 22 bp, Homo sapiens
tgcagcaggagtggtgcagaca

SEQ ID NO: 954731 - DNA, 18 bp, Homo sapiens
tgcagcagggatgccctg

SEQ ID NO: 954732 - DNA, 15 bp, Homo sapiens
tgcagcagggctggg

SEQ ID NO: 954733 - DNA, 19 bp, Homo sapiens
tgcagcagggctgggcctg

SEQ ID NO: 954734 - DNA, 19 bp, Homo sapiens
tgcagcaggtgctgggctg

SEQ ID NO: 954735 - DNA, 22 bp, Homo sapiens
tgcagcagtgagtctcttcaga

SEQ ID NO: 954736 - DNA, 17 bp, Homo sapiens
tgcagcatgacctgtga

SEQ ID NO: 954737 - DNA, 23 bp, Homo sapiens
tgcagcatgacctgtgaccagca

SEQ ID NO: 954738 - DNA, 19 bp, Homo sapiens
tgcagcatggggtttttat

SEQ ID NO: 954739 - DNA, 16 bp, Homo sapiens
tgcagcatggtccctg

SEQ ID NO: 954740 - DNA, 23 bp, Homo sapiens
ggctcttctcctttcacaacctt

SEQ ID NO: 954741 - DNA, 21 bp, Homo sapiens
ggctcttggcttccagaaggc

SEQ ID NO: 954742 - DNA, 23 bp, Homo sapiens
ggctctttctctctgctgagctg

SEQ ID NO: 954743 - DNA, 22 bp, Homo sapiens
ggctctttggggtcagccaggg

SEQ ID NO: 954744 - DNA, 20 bp, Homo sapiens
ggctgaaatatccacccagc

SEQ ID NO: 954745 - DNA, 14 bp, Homo sapiens
ggctgaaattctcc

SEQ ID NO: 954746 - DNA, 17 bp, Homo sapiens
ggctgaaattctcctgg

SEQ ID NO: 954747 - DNA, 18 bp, Homo sapiens
ggctgaaattctcctgga

SEQ ID NO: 954748 - DNA, 14 bp, Homo sapiens
ggctgaacatgcct

SEQ ID NO: 954749 - DNA, 18 bp, Homo sapiens
ggctgaacatgcctgcca

SEQ ID NO: 954750 - DNA, 19 bp, Homo sapiens
ggctgaacatgcctgccaa

SEQ ID NO: 954751 - DNA, 22 bp, Homo sapiens
ggctgaaccctgtgctggtgtc

SEQ ID NO: 954752 - DNA, 23 bp, Homo sapiens
ggctgaaccctgtgctggtgtcc

SEQ ID NO: 954753 - DNA, 20 bp, Homo sapiens
ggctgaacggggagaaaagg

SEQ ID NO: 954754 - DNA, 11 bp, Homo sapiens
ggctgaagacg

SEQ ID NO: 954755 - DNA, 12 bp, Homo sapiens
ggctgaagctgg

SEQ ID NO: 954756 - DNA, 18 bp, Homo sapiens
ggctgaagctggagcagc

SEQ ID NO: 954757 - DNA, 18 bp, Homo sapiens
ggctgaatcttctggaga

SEQ ID NO: 954758 - DNA, 19 bp, Homo sapiens
ggctgaatgtatgtaaata

SEQ ID NO: 954759 - DNA, 17 bp, Homo sapiens
ggctgacacctaccatg

SEQ ID NO: 954760 - DNA, 20 bp, Homo sapiens
ggctgacacctaccatgctg

SEQ ID NO: 954761 - DNA, 22 bp, Homo sapiens
ggctgacacctaccatgctgct

SEQ ID NO: 954762 - DNA, 23 bp, Homo sapiens
ggctgacacctaccatgctgctt

SEQ ID NO: 954763 - DNA, 17 bp, Homo sapiens
ggctgacagactcactg

SEQ ID NO: 954764 - DNA, 18 bp, Homo sapiens
ggctgacatctgtgtttc

SEQ ID NO: 954765 - DNA, 15 bp, Homo sapiens
ggctgaccacagcac

SEQ ID NO: 954766 - DNA, 16 bp, Homo sapiens
ggctgaccacagcaca

SEQ ID NO: 954767 - DNA, 19 bp, Homo sapiens
ggctgaccccaaagagcct

SEQ ID NO: 954768 - DNA, 20 bp, Homo sapiens
ggctgaccccaaagagcctg

SEQ ID NO: 954769 - DNA, 22 bp, Homo sapiens
ggctgacggtgcagtctgggtg

SEQ ID NO: 954770 - DNA, 15 bp, Homo sapiens
ggctgacgtgtgagg

SEQ ID NO: 954771 - DNA, 19 bp, Homo sapiens
ggctgactagaagggccag

SEQ ID NO: 954772 - DNA, 22 bp, Homo sapiens
ggctgactagaagggccagtcc

SEQ ID NO: 954773 - DNA, 14 bp, Homo sapiens
ggctgactggcagg

SEQ ID NO: 954774 - DNA, 15 bp, Homo sapiens
ggctgactgggccac

SEQ ID NO: 954775 - DNA, 16 bp, Homo sapiens
ggctgagagccccagc

SEQ ID NO: 954776 - DNA, 19 bp, Homo sapiens
ggctgagagccccagctga

SEQ ID NO: 954777 - DNA, 16 bp, Homo sapiens
ggctgagcccctaccc

SEQ ID NO: 954778 - DNA, 15 bp, Homo sapiens
ggctgagcccctggt

SEQ ID NO: 954779 - DNA, 12 bp, Homo sapiens
ggctgagccctg

SEQ ID NO: 954780 - DNA, 16 bp, Homo sapiens
ggctgagccctggcag

SEQ ID NO: 954781 - DNA, 18 bp, Homo sapiens
ggctgagccctgtaccca

SEQ ID NO: 954782 - DNA, 11 bp, Homo sapiens
ggctgagcctg

SEQ ID NO: 954783 - DNA, 15 bp, Homo sapiens
ggctgagcctggctg

SEQ ID NO: 954784 - DNA, 19 bp, Homo sapiens
ggctgagcggatgcatctg

SEQ ID NO: 954785 - DNA, 23 bp, Homo sapiens
ggctgagcgtggaagggggagga

SEQ ID NO: 954786 - DNA, 18 bp, Homo sapiens
ggctgagctagcctccag

SEQ ID NO: 954787 - DNA, 19 bp, Homo sapiens
ggctgagctagcctccagc

SEQ ID NO: 954788 - DNA, 20 bp, Homo sapiens
ggctgagctctctgtgggct

SEQ ID NO: 954789 - DNA, 17 bp, Homo sapiens
ggctgaggagcagccag

SEQ ID NO: 954790 - DNA, 18 bp, Homo sapiens
ggctgaggagcagccagg

SEQ ID NO: 954791 - DNA, 19 bp, Homo sapiens
ggctgaggagcagccagga

SEQ ID NO: 954792 - DNA, 21 bp, Homo sapiens
ggctgaggagcagccaggacc

SEQ ID NO: 954793 - DNA, 13 bp, Homo sapiens
ggctgaggcagaa

SEQ ID NO: 954794 - DNA, 15 bp, Homo sapiens
ggctgaggccagagt

SEQ ID NO: 954795 - DNA, 14 bp, Homo sapiens
ggctgaggctggca

SEQ ID NO: 954796 - DNA, 15 bp, Homo sapiens
ggctgagggcctgct

SEQ ID NO: 954797 - DNA, 21 bp, Homo sapiens
ggctgagggcctgctggaggc

SEQ ID NO: 954798 - DNA, 16 bp, Homo sapiens
ggctgaggggatacca

SEQ ID NO: 954799 - DNA, 12 bp, Homo sapiens
ggctgaggtggg

SEQ ID NO: 954800 - DNA, 15 bp, Homo sapiens
ggctgaggtgggagg

SEQ ID NO: 954801 - DNA, 16 bp, Homo sapiens
ggctgaggtggggaag

SEQ ID NO: 954802 - DNA, 17 bp, Homo sapiens
ggctgaggtggggaagg

SEQ ID NO: 954803 - DNA, 17 bp, Homo sapiens
ggctgaggttcctctgc

SEQ ID NO: 954804 - DNA, 19 bp, Homo sapiens
ggctgaggttcctctgcct

SEQ ID NO: 954805 - DNA, 20 bp, Homo sapiens
ggctgagtactggaataaac

SEQ ID NO: 954806 - DNA, 22 bp, Homo sapiens
ggctgagtactggaataaacag

SEQ ID NO: 954807 - DNA, 15 bp, Homo sapiens
ggctgatggcctggc

SEQ ID NO: 954808 - DNA, 17 bp, Homo sapiens
ggctgatgtggactgtc

SEQ ID NO: 954809 - DNA, 16 bp, Homo sapiens
ggctgatttatttcta

SEQ ID NO: 954810 - DNA, 17 bp, Homo sapiens
ggctgcaaaattaaatc

SEQ ID NO: 954811 - DNA, 13 bp, Homo sapiens
ggctgcacaacag

SEQ ID NO: 954812 - DNA, 16 bp, Homo sapiens
ggctgcacaacagccc

SEQ ID NO: 954813 - DNA, 19 bp, Homo sapiens
ggctgcacaacagccctgc

SEQ ID NO: 954814 - DNA, 13 bp, Homo sapiens
ggctgcacagaag

SEQ ID NO: 954815 - DNA, 19 bp, Homo sapiens
ggctgcacagaagggctct

SEQ ID NO: 954816 - DNA, 21 bp, Homo sapiens
ggctgcactcttgaactgggc

SEQ ID NO: 954817 - DNA, 17 bp, Homo sapiens
ggctgcactggagccac

SEQ ID NO: 954818 - DNA, 18 bp, Homo sapiens
ggctgcactggagccaca

SEQ ID NO: 954819 - DNA, 23 bp, Homo sapiens
ggctgcactggagccacaggcag

SEQ ID NO: 954820 - DNA, 13 bp, Homo sapiens
ggctgcagagccc

SEQ ID NO: 954821 - DNA, 15 bp, Homo sapiens
ggctgcagagcccgg

SEQ ID NO: 954822 - DNA, 19 bp, Homo sapiens
ggctgcagaggccagaggc

SEQ ID NO: 954823 - DNA, 20 bp, Homo sapiens
ggctgcagagtctgccccac

SEQ ID NO: 954824 - DNA, 10 bp, Homo sapiens
ggctgcagca

SEQ ID NO: 954825 - DNA, 13 bp, Homo sapiens
ggctgcagcaggt

SEQ ID NO: 954826 - DNA, 19 bp, Homo sapiens
ggctgcagcaggtgctggg

SEQ ID NO: 954827 - DNA, 20 bp, Homo sapiens
ggctgcagcaggtgctgggc

SEQ ID NO: 954828 - DNA, 22 bp, Homo sapiens
ggctgcagcaggtgctgggctg

SEQ ID NO: 954829 - DNA, 12 bp, Homo sapiens
ggctgcagcatg

SEQ ID NO: 954830 - DNA, 16 bp, Homo sapiens
ggctgcagctggacag

SEQ ID NO: 954831 - DNA, 24 bp, Homo sapiens
ggctgcagctggacagaggggact

SEQ ID NO: 954832 - DNA, 13 bp, Homo sapiens
ggctgcaggtgct

SEQ ID NO: 954833 - DNA, 14 bp, Homo sapiens
ggctgcaggtgctg

SEQ ID NO: 954834 - DNA, 15 bp, Homo sapiens
ggctgcatgctctgg

SEQ ID NO: 954835 - DNA, 15 bp, Homo sapiens
ggctgccaaggccag

SEQ ID NO: 954836 - DNA, 17 bp, Homo sapiens
ggctgccaaggccagag

SEQ ID NO: 954837 - DNA, 21 bp, Homo sapiens
ggctgccatagggtctgcagc

SEQ ID NO: 954838 - DNA, 17 bp, Homo sapiens
ggctgccattggtccac

SEQ ID NO: 954839 - DNA, 20 bp, Homo sapiens
ggctgcccagccccgctcag

SEQ ID NO: 954840 - DNA, 22 bp, Homo sapiens
ggctgcccagccccgctcaggc

SEQ ID NO: 954841 - DNA, 16 bp, Homo sapiens
ggctgcccagctgctc

SEQ ID NO: 954842 - DNA, 23 bp, Homo sapiens
ggctgcccaggagacagaccact

SEQ ID NO: 954843 - DNA, 14 bp, Homo sapiens
ggctgccccaggcc

SEQ ID NO: 954844 - DNA, 19 bp, Homo sapiens
ggctgcccccatccagcca

SEQ ID NO: 954845 - DNA, 22 bp, Homo sapiens
ggctgcccccatccagccacgg

SEQ ID NO: 954846 - DNA, 17 bp, Homo sapiens
ggctgccccggcctcct

SEQ ID NO: 954847 - DNA, 19 bp, Homo sapiens
ggctgcccctcgcacacag

SEQ ID NO: 954848 - DNA, 17 bp, Homo sapiens
tgcagggatattgcctt

SEQ ID NO: 954849 - DNA, 13 bp, Homo sapiens
tgcagggcagtca

SEQ ID NO: 954850 - DNA, 14 bp, Homo sapiens
tgcagggcagtcat

SEQ ID NO: 954851 - DNA, 22 bp, Homo sapiens
tgcaggggattgaagccctcca

SEQ ID NO: 954852 - DNA, 17 bp, Homo sapiens
tgcaggggccactccaa

SEQ ID NO: 954853 - DNA, 14 bp, Homo sapiens
tgcaggggcctgga

SEQ ID NO: 954854 - DNA, 22 bp, Homo sapiens
tgcagggggaggaggacttgga

SEQ ID NO: 954855 - DNA, 22 bp, Homo sapiens
tgcagggggtgtgtctgctcag

SEQ ID NO: 954856 - DNA, 18 bp, Homo sapiens
tgcaggggtcccccctca

SEQ ID NO: 954857 - DNA, 18 bp, Homo sapiens
tgcagggtgacgcctgag

SEQ ID NO: 954858 - DNA, 19 bp, Homo sapiens
tgcagggtgacgcctgaga

SEQ ID NO: 954859 - DNA, 17 bp, Homo sapiens
tgcagggtggtgctggg

SEQ ID NO: 954860 - DNA, 19 bp, Homo sapiens
tgcagggtggtgctgggac

SEQ ID NO: 954861 - DNA, 24 bp, Homo sapiens
tgcaggtacttcctcctgatggcc

SEQ ID NO: 954862 - DNA, 12 bp, Homo sapiens
tgcaggtcagcc

SEQ ID NO: 954863 - DNA, 15 bp, Homo sapiens
tgcaggtgggctggg

SEQ ID NO: 954864 - DNA, 18 bp, Homo sapiens
tgcaggtgggctgggccc

SEQ ID NO: 954865 - DNA, 13 bp, Homo sapiens
tgcaggtggggag

SEQ ID NO: 954866 - DNA, 13 bp, Homo sapiens
ggctggggcaggc

SEQ ID NO: 954867 - DNA, 16 bp, Homo sapiens
ggctggggcaggctct

SEQ ID NO: 954868 - DNA, 20 bp, Homo sapiens
ggctggggcaggctctctcc

SEQ ID NO: 954869 - DNA, 13 bp, Homo sapiens
ggctggggcaggg

SEQ ID NO: 954870 - DNA, 14 bp, Homo sapiens
ggctggggcagggg

SEQ ID NO: 954871 - DNA, 22 bp, Homo sapiens
ggctggggcaggggcctgggcc

SEQ ID NO: 954872 - DNA, 13 bp, Homo sapiens
ggctggggcatgg

SEQ ID NO: 954873 - DNA, 16 bp, Homo sapiens
ggctggggcatggcaa

SEQ ID NO: 954874 - DNA, 15 bp, Homo sapiens
ggctggggccacctt

SEQ ID NO: 954875 - DNA, 14 bp, Homo sapiens
ggctggggctgctc

SEQ ID NO: 954876 - DNA, 15 bp, Homo sapiens
ggctggggctgctcc

SEQ ID NO: 954877 - DNA, 17 bp, Homo sapiens
ggctggggctgctcccc

SEQ ID NO: 954878 - DNA, 16 bp, Homo sapiens
ggctgggggaagaagc

SEQ ID NO: 954879 - DNA, 15 bp, Homo sapiens
ggctgggggagagcc

SEQ ID NO: 954880 - DNA, 14 bp, Homo sapiens
ggctgggggcagga

SEQ ID NO: 954881 - DNA, 17 bp, Homo sapiens
ggctgggggcaggaggg

SEQ ID NO: 954882 - DNA, 20 bp, Homo sapiens
ggctggggtgagcctgactg

SEQ ID NO: 954883 - DNA, 12 bp, Homo sapiens
ggctgggtcagg

SEQ ID NO: 954884 - DNA, 19 bp, Homo sapiens
ggctgggtcagggccagac

SEQ ID NO: 954885 - DNA, 18 bp, Homo sapiens
ggctgggtcggccctgcc

SEQ ID NO: 954886 - DNA, 19 bp, Homo sapiens
ggctgggtcggccctgccc

SEQ ID NO: 954887 - DNA, 18 bp, Homo sapiens
ggctgggtgggcccagaa

SEQ ID NO: 954888 - DNA, 20 bp, Homo sapiens
ggctgggtgtttcagtttga

SEQ ID NO: 954889 - DNA, 20 bp, Homo sapiens
ggctggtagcagcaggctca

SEQ ID NO: 954890 - DNA, 22 bp, Homo sapiens
ggctggtagcagcaggctcagg

SEQ ID NO: 954891 - DNA, 14 bp, Homo sapiens
ggctggtattctct

SEQ ID NO: 954892 - DNA, 15 bp, Homo sapiens
tgcatctgaccccgg

SEQ ID NO: 954893 - DNA, 16 bp, Homo sapiens
tgcatctgaccccggg

SEQ ID NO: 954894 - DNA, 20 bp, Homo sapiens
tgcatctgggtagctgtaag

SEQ ID NO: 954895 - DNA, 12 bp, Homo sapiens
tgcatctggtgt

SEQ ID NO: 954896 - DNA, 13 bp, Homo sapiens
tgcatctggtgta

SEQ ID NO: 954897 - DNA, 20 bp, Homo sapiens
tgcatctggtgtaggaagtt

SEQ ID NO: 954898 - DNA, 11 bp, Homo sapiens
tgcatctgtat

SEQ ID NO: 954899 - DNA, 13 bp, Homo sapiens
tgcatctgtgcat

SEQ ID NO: 954900 - DNA, 14 bp, Homo sapiens
tgcatcttaacatg

SEQ ID NO: 954901 - DNA, 18 bp, Homo sapiens
tgcatcttcttgcatcta

SEQ ID NO: 954902 - DNA, 23 bp, Homo sapiens
tgcatgaagagaagcaattttgg

SEQ ID NO: 954903 - DNA, 17 bp, Homo sapiens
tgcatgacgtttaaggc

SEQ ID NO: 954904 - DNA, 13 bp, Homo sapiens
tgcatgatgccct

SEQ ID NO: 954905 - DNA, 14 bp, Homo sapiens
tgcatgatgtttgc

SEQ ID NO: 954906 - DNA, 14 bp, Homo sapiens
tgcatgcaactaat

SEQ ID NO: 954907 - DNA, 22 bp, Homo sapiens
tgcatgcactgttccccctgtg

SEQ ID NO: 954908 - DNA, 12 bp, Homo sapiens
tgcatgccaggc

SEQ ID NO: 954909 - DNA, 14 bp, Homo sapiens
tgcatgcctggtct

SEQ ID NO: 954910 - DNA, 16 bp, Homo sapiens
tgcatgctctctgcag

SEQ ID NO: 954911 - DNA, 18 bp, Homo sapiens
tgcatgctctctgcagcc

SEQ ID NO: 954912 - DNA, 19 bp, Homo sapiens
tgcatgctctctgcagcca

SEQ ID NO: 954913 - DNA, 12 bp, Homo sapiens
tgcatgctctgg

SEQ ID NO: 954914 - DNA, 15 bp, Homo sapiens
tgcatgctctggaag

SEQ ID NO: 954915 - DNA, 19 bp, Homo sapiens
tgcatgctgataatcattt

SEQ ID NO: 954916 - DNA, 15 bp, Homo sapiens
tgcatgctgtagctg

SEQ ID NO: 954917 - DNA, 17 bp, Homo sapiens
tgcatgcttagagcatg

SEQ ID NO: 954918 - DNA, 17 bp, Homo sapiens
tgcatggaaatcagcca

SEQ ID NO: 954919 - DNA, 15 bp, Homo sapiens
tgcatggacctaaca

SEQ ID NO: 954920 - DNA, 13 bp, Homo sapiens
tgcatggactgtg

SEQ ID NO: 954921 - DNA, 13 bp, Homo sapiens
tgcatggagcctg

SEQ ID NO: 954922 - DNA, 15 bp, Homo sapiens
tgcatggagcctgga

SEQ ID NO: 954923 - DNA, 18 bp, Homo sapiens
tgcatggaggccctcctg

SEQ ID NO: 954924 - DNA, 16 bp, Homo sapiens
tgcatggatttctttg

SEQ ID NO: 954925 - DNA, 19 bp, Homo sapiens
tgcatggctccagaaatgt

SEQ ID NO: 954926 - DNA, 22 bp, Homo sapiens
tgcatggctccagaaatgtcta

SEQ ID NO: 954927 - DNA, 17 bp, Homo sapiens
tgcatgggaggaattca

SEQ ID NO: 954928 - DNA, 13 bp, Homo sapiens
tgcatgggctcgc

SEQ ID NO: 954929 - DNA, 16 bp, Homo sapiens
tgcatggggaggcagc

SEQ ID NO: 954930 - DNA, 16 bp, Homo sapiens
tgcatgggtgaaggga

SEQ ID NO: 954931 - DNA, 20 bp, Homo sapiens
tgcatggtgtttatgcacac

SEQ ID NO: 954932 - DNA, 17 bp, Homo sapiens
tgcatgtactgtatatt

SEQ ID NO: 954933 - DNA, 21 bp, Homo sapiens
tgcatgtacttgaaggatgga

SEQ ID NO: 954934 - DNA, 17 bp, Homo sapiens
tgcatgtagtaacacta

SEQ ID NO: 954935 - DNA, 16 bp, Homo sapiens
tgcatgtctgttcttc

SEQ ID NO: 954936 - DNA, 14 bp, Homo sapiens
tgcatgtcttttaa

SEQ ID NO: 954937 - DNA, 12 bp, Homo sapiens
tgcatgtgaaga

SEQ ID NO: 954938 - DNA, 19 bp, Homo sapiens
tgcatgtgaagcatgcttt

SEQ ID NO: 954939 - DNA, 16 bp, Homo sapiens
tgcatgtgacttctcc

SEQ ID NO: 954940 - DNA, 23 bp, Homo sapiens
tgcatgtgacttctcccctgccc

SEQ ID NO: 954941 - DNA, 14 bp, Homo sapiens
tgcatgtgctgtct

SEQ ID NO: 954942 - DNA, 15 bp, Homo sapiens
tgcatgtggcttctc

SEQ ID NO: 954943 - DNA, 17 bp, Homo sapiens
tgcatgtggcttctctg

SEQ ID NO: 954944 - DNA, 15 bp, Homo sapiens
tgcatgtggcttttt

SEQ ID NO: 954945 - DNA, 12 bp, Homo sapiens
tgcatgtgtgcg

SEQ ID NO: 954946 - DNA, 16 bp, Homo sapiens
tgcatgtgtgtgtctg

SEQ ID NO: 954947 - DNA, 14 bp, Homo sapiens
tgcatgtgtgtgtg

SEQ ID NO: 954948 - DNA, 13 bp, Homo sapiens
tgcatgttatgtt

SEQ ID NO: 954949 - DNA, 16 bp, Homo sapiens
tgcattaaacctgtct

SEQ ID NO: 954950 - DNA, 17 bp, Homo sapiens
tgcattaaattcacaaa

SEQ ID NO: 954951 - DNA, 19 bp, Homo sapiens
tgcattaaattcacaaact

SEQ ID NO: 954952 - DNA, 20 bp, Homo sapiens
tgcattaaattcacaaactt

SEQ ID NO: 954953 - DNA, 21 bp, Homo sapiens
tgcattaaattcacaaacttt

SEQ ID NO: 954954 - DNA, 19 bp, Homo sapiens
tgcattaaccactctacag

SEQ ID NO: 954955 - DNA, 22 bp, Homo sapiens
tgcattaaccactctacagact

SEQ ID NO: 954956 - DNA, 12 bp, Homo sapiens
tgcattaataaa

SEQ ID NO: 954957 - DNA, 15 bp, Homo sapiens
tgcattacagagagg

SEQ ID NO: 954958 - DNA, 16 bp, Homo sapiens
tgcattacagagagga

SEQ ID NO: 954959 - DNA, 18 bp, Homo sapiens
tgcattacagagaggaga

SEQ ID NO: 954960 - DNA, 19 bp, Homo sapiens
tgcattaccgcgttgtaaa

SEQ ID NO: 954961 - DNA, 23 bp, Homo sapiens
tgcattaccgcgttgtaaaatat

SEQ ID NO: 954962 - DNA, 19 bp, Homo sapiens
tgcattagaaatagacagt

SEQ ID NO: 954963 - DNA, 22 bp, Homo sapiens
tgcattagaaatagacagtata

SEQ ID NO: 954964 - DNA, 13 bp, Homo sapiens
tgcattagaaatt

SEQ ID NO: 954965 - DNA, 23 bp, Homo sapiens
tgcattagaaattagctgtgtga

SEQ ID NO: 954966 - DNA, 22 bp, Homo sapiens
tgcattatctagatactgtatc

SEQ ID NO: 954967 - DNA, 14 bp, Homo sapiens
tgcattattaaatt

SEQ ID NO: 954968 - DNA, 11 bp, Homo sapiens
tgcattcattt

SEQ ID NO: 954969 - DNA, 15 bp, Homo sapiens
tgcattcatttttat

SEQ ID NO: 954970 - DNA, 18 bp, Homo sapiens
tgcattcatttttatagc

SEQ ID NO: 954971 - DNA, 18 bp, Homo sapiens
tgcattccagaacaaatt

SEQ ID NO: 954972 - DNA, 20 bp, Homo sapiens
tgcattccagaacaaattgt

SEQ ID NO: 954973 - DNA, 17 bp, Homo sapiens
tgcattccagaatcttg

SEQ ID NO: 954974 - DNA, 21 bp, Homo sapiens
tgcattccagaatcttgactt

SEQ ID NO: 954975 - DNA, 16 bp, Homo sapiens
tgcattccctgaatct

SEQ ID NO: 954976 - DNA, 20 bp, Homo sapiens
tgcattccctgaatctgtgc

SEQ ID NO: 954977 - DNA, 23 bp, Homo sapiens
tgcattccctgaatctgtgcctg

SEQ ID NO: 954978 - DNA, 19 bp, Homo sapiens
tgcattccttacttgcact

SEQ ID NO: 954979 - DNA, 20 bp, Homo sapiens
tgcattccttacttgcactg

SEQ ID NO: 954980 - DNA, 20 bp, Homo sapiens
tgcattcctttgtcttcaaa

SEQ ID NO: 954981 - DNA, 18 bp, Homo sapiens
tgcattctgcacgctgcc

SEQ ID NO: 954982 - DNA, 18 bp, Homo sapiens
tgcattctgtttcctctt

SEQ ID NO: 954983 - DNA, 21 bp, Homo sapiens
tgcattcttttaaaagacaag

SEQ ID NO: 954984 - DNA, 14 bp, Homo sapiens
tgcattgaacacaa

SEQ ID NO: 954985 - DNA, 19 bp, Homo sapiens
tgcattgaacacaaactgt

SEQ ID NO: 954986 - DNA, 22 bp, Homo sapiens
tgcattgaacacaaactgtaaa

SEQ ID NO: 954987 - DNA, 23 bp, Homo sapiens
tgcattgaacacaaactgtaaat

SEQ ID NO: 954988 - DNA, 14 bp, Homo sapiens
tgcattgaatatat

SEQ ID NO: 954989 - DNA, 16 bp, Homo sapiens
ggcttctcagcccctt

SEQ ID NO: 954990 - DNA, 23 bp, Homo sapiens
ggcttctccgccagcctcctctg

SEQ ID NO: 954991 - DNA, 14 bp, Homo sapiens
ggcttctcctcctc

SEQ ID NO: 954992 - DNA, 15 bp, Homo sapiens
ggcttctcctgaccc

SEQ ID NO: 954993 - DNA, 14 bp, Homo sapiens
ggcttctcctgtga

SEQ ID NO: 954994 - DNA, 16 bp, Homo sapiens
ggcttctgaagagcct

SEQ ID NO: 954995 - DNA, 16 bp, Homo sapiens
ggcttctgcaccctcc

SEQ ID NO: 954996 - DNA, 21 bp, Homo sapiens
ggcttctgttctctgctgagg

SEQ ID NO: 954997 - DNA, 14 bp, Homo sapiens
ggcttcttaaaaac

SEQ ID NO: 954998 - DNA, 21 bp, Homo sapiens
ggcttcttaaaaactgtgtat

SEQ ID NO: 954999 - DNA, 16 bp, Homo sapiens
ggcttgaagccaaaga

SEQ ID NO: 955000 - DNA, 20 bp, Homo sapiens
ggcttgaagccaaagaaaaa

SEQ ID NO: 955001 - DNA, 14 bp, Homo sapiens
ggcttgaaggactg

SEQ ID NO: 955002 - DNA, 21 bp, Homo sapiens
ggcttgaaggactgcagacag

SEQ ID NO: 955003 - DNA, 14 bp, Homo sapiens
ggcttgacatgtgc

SEQ ID NO: 955004 - DNA, 20 bp, Homo sapiens
ggcttgagcccccgcgccca

SEQ ID NO: 955005 - DNA, 15 bp, Homo sapiens
ggcttgccacacccc

SEQ ID NO: 955006 - DNA, 14 bp, Homo sapiens
ggcttgccccagga

SEQ ID NO: 955007 - DNA, 17 bp, Homo sapiens
ggcttgccccaggactc

SEQ ID NO: 955008 - DNA, 21 bp, Homo sapiens
ggcttgccccaggactctggc

SEQ ID NO: 955009 - DNA, 22 bp, Homo sapiens
ggcttgccccaggactctggca

SEQ ID NO: 955010 - DNA, 22 bp, Homo sapiens
ggcttgcctgggctgggcagcc

SEQ ID NO: 955011 - DNA, 23 bp, Homo sapiens
ggcttgcctgggctgggcagcct

SEQ ID NO: 955012 - DNA, 15 bp, Homo sapiens
ggcttgctccagggt

SEQ ID NO: 955013 - DNA, 22 bp, Homo sapiens
ggcttgctccagggtcttgggc

SEQ ID NO: 955014 - DNA, 18 bp, Homo sapiens
ggcttgcttgccgagcct

SEQ ID NO: 955015 - DNA, 18 bp, Homo sapiens
ggcttggcatctgtgtgc

SEQ ID NO: 955016 - DNA, 18 bp, Homo sapiens
ggcttggcccgcggcctg

SEQ ID NO: 955017 - DNA, 20 bp, Homo sapiens
ggcttggcccgcggcctgca

SEQ ID NO: 955018 - DNA, 13 bp, Homo sapiens
ggcttggcctgct

SEQ ID NO: 955019 - DNA, 16 bp, Homo sapiens
ggcttggcctggagag

SEQ ID NO: 955020 - DNA, 22 bp, Homo sapiens
tgcatttgtttatgtaatttca

SEQ ID NO: 955021 - DNA, 19 bp, Homo sapiens
tgcattttaaccctatttt

SEQ ID NO: 955022 - DNA, 21 bp, Homo sapiens
tgcattttattgactgggcaa

SEQ ID NO: 955023 - DNA, 16 bp, Homo sapiens
tgcattttcacaaatt

SEQ ID NO: 955024 - DNA, 16 bp, Homo sapiens
tgcattttcctcttgt

SEQ ID NO: 955025 - DNA, 17 bp, Homo sapiens
tgcattttctgatgtat

SEQ ID NO: 955026 - DNA, 13 bp, Homo sapiens
tgcattttgctat

SEQ ID NO: 955027 - DNA, 15 bp, Homo sapiens
tgcattttgctattg

SEQ ID NO: 955028 - DNA, 16 bp, Homo sapiens
tgcattttgctattgt

SEQ ID NO: 955029 - DNA, 18 bp, Homo sapiens
tgcattttgctattgtaa

SEQ ID NO: 955030 - DNA, 14 bp, Homo sapiens
tgcatttttaaact

SEQ ID NO: 955031 - DNA, 15 bp, Homo sapiens
tgcatttttaaactt

SEQ ID NO: 955032 - DNA, 16 bp, Homo sapiens
tgcatttttaaacttg

SEQ ID NO: 955033 - DNA, 17 bp, Homo sapiens
tgcatttttaaacttga

SEQ ID NO: 955034 - DNA, 17 bp, Homo sapiens
tgcatttttgtgaaatg

SEQ ID NO: 955035 - DNA, 19 bp, Homo sapiens
tgccaaaaatacaacacag

SEQ ID NO: 955036 - DNA, 16 bp, Homo sapiens
tgccaaaaccacatgg

SEQ ID NO: 955037 - DNA, 18 bp, Homo sapiens
tgccaaaatgctctagtg

SEQ ID NO: 955038 - DNA, 23 bp, Homo sapiens
tgccaaacaaaaaggttctcagg

SEQ ID NO: 955039 - DNA, 16 bp, Homo sapiens
tgccaaagatgtttga

SEQ ID NO: 955040 - DNA, 21 bp, Homo sapiens
tgccaaagctttactactgtg

SEQ ID NO: 955041 - DNA, 16 bp, Homo sapiens
tgccaaaggatgtgat

SEQ ID NO: 955042 - DNA, 14 bp, Homo sapiens
tgccaaagggaaat

SEQ ID NO: 955043 - DNA, 13 bp, Homo sapiens
tgccaaagtagtc

SEQ ID NO: 955044 - DNA, 18 bp, Homo sapiens
tgccaaagtagtcctggc

SEQ ID NO: 955045 - DNA, 16 bp, Homo sapiens
tgccaaatagccccag

SEQ ID NO: 955046 - DNA, 19 bp, Homo sapiens
tgccaaattctccggtttg

SEQ ID NO: 955047 - DNA, 18 bp, Homo sapiens
tgccaaattgactgtcac

SEQ ID NO: 955048 - DNA, 24 bp, Homo sapiens
tgccaaattgagataatgatactt

SEQ ID NO: 955049 - DNA, 20 bp, Homo sapiens
tgccaaccccacccagctcc

SEQ ID NO: 955050 - DNA, 18 bp, Homo sapiens
tgccaacctgatgcccct

SEQ ID NO: 955051 - DNA, 23 bp, Homo sapiens
tgccaacctgttcttagagtgta

SEQ ID NO: 955052 - DNA, 14 bp, Homo sapiens
tgccaactgaagcc

SEQ ID NO: 955053 - DNA, 19 bp, Homo sapiens
tgccaactgaagccttctt

SEQ ID NO: 955054 - DNA, 23 bp, Homo sapiens
tgccaactgaagccttcttctgc

SEQ ID NO: 955055 - DNA, 23 bp, Homo sapiens
tgccaacttcccacacggcagcc

SEQ ID NO: 955056 - DNA, 23 bp, Homo sapiens
tgccaacttgatgttccacctgc

SEQ ID NO: 955057 - DNA, 21 bp, Homo sapiens
tgccaagaaaagggctgacat

SEQ ID NO: 955058 - DNA, 14 bp, Homo sapiens
tgccaagacaaatc

SEQ ID NO: 955059 - DNA, 16 bp, Homo sapiens
tgccaagacaaatcaa

SEQ ID NO: 955060 - DNA, 19 bp, Homo sapiens
tgccaagacaaatcaacag

SEQ ID NO: 955061 - DNA, 14 bp, Homo sapiens
tgccaagagccgac

SEQ ID NO: 955062 - DNA, 14 bp, Homo sapiens
tgccaagcttcctg

SEQ ID NO: 955063 - DNA, 17 bp, Homo sapiens
tgccaagcttcctgtgc

SEQ ID NO: 955064 - DNA, 20 bp, Homo sapiens
tgccaagcttcctgtgccct

SEQ ID NO: 955065 - DNA, 22 bp, Homo sapiens
tgccaaggcagaggcctgggct

SEQ ID NO: 955066 - DNA, 21 bp, Homo sapiens
tgccaaggccagagtggcctg

SEQ ID NO: 955067 - DNA, 14 bp, Homo sapiens
tgccaaggctctcc

SEQ ID NO: 955068 - DNA, 18 bp, Homo sapiens
tgccaaggctctcccctc

SEQ ID NO: 955069 - DNA, 12 bp, Homo sapiens
tgccaagggccc

SEQ ID NO: 955070 - DNA, 19 bp, Homo sapiens
tgccaagggccccaggggc

SEQ ID NO: 955071 - DNA, 20 bp, Homo sapiens
tgccaagggccccaggggca

SEQ ID NO: 955072 - DNA, 23 bp, Homo sapiens
tgccaagggccccaggggcagca

SEQ ID NO: 955073 - DNA, 21 bp, Homo sapiens
tgccaagggctttgttttgca

SEQ ID NO: 955074 - DNA, 14 bp, Homo sapiens
tgccaagtgcctgc

SEQ ID NO: 955075 - DNA, 16 bp, Homo sapiens
tgccaagttgctgtca

SEQ ID NO: 955076 - DNA, 20 bp, Homo sapiens
tgccaagttgctgtcactgt

SEQ ID NO: 955077 - DNA, 16 bp, Homo sapiens
tgccaataaagtgatc

SEQ ID NO: 955078 - DNA, 17 bp, Homo sapiens
tgccaataaagtgatct

SEQ ID NO: 955079 - DNA, 21 bp, Homo sapiens
tgccaataaagtgatctgtgt

SEQ ID NO: 955080 - DNA, 19 bp, Homo sapiens
tgccaatcggctacccctc

SEQ ID NO: 955081 - DNA, 20 bp, Homo sapiens
tgccaatgaggtctgaaatg

SEQ ID NO: 955082 - DNA, 17 bp, Homo sapiens
tgccaatgctgtacgta

SEQ ID NO: 955083 - DNA, 17 bp, Homo sapiens
tgccaatgtgggctgcc

SEQ ID NO: 955084 - DNA, 15 bp, Homo sapiens
tgccaattagcaatt

SEQ ID NO: 955085 - DNA, 14 bp, Homo sapiens
tgccaatttttgtt

SEQ ID NO: 955086 - DNA, 13 bp, Homo sapiens
tgccacacagagt

SEQ ID NO: 955087 - DNA, 23 bp, Homo sapiens
tgccacacagagtggtctttctg

SEQ ID NO: 955088 - DNA, 18 bp, Homo sapiens
tgccacaccaatcagaga

SEQ ID NO: 955089 - DNA, 20 bp, Homo sapiens
tgccacaccaatcagagagc

SEQ ID NO: 955090 - DNA, 23 bp, Homo sapiens
tgccacaccaatcagagagccta

SEQ ID NO: 955091 - DNA, 23 bp, Homo sapiens
tgccacaccccccacccctagga

SEQ ID NO: 955092 - DNA, 13 bp, Homo sapiens
tgccacaccctcc

SEQ ID NO: 955093 - DNA, 15 bp, Homo sapiens
tgccacacctggcct

SEQ ID NO: 955094 - DNA, 16 bp, Homo sapiens
tgccacacctggcctt

SEQ ID NO: 955095 - DNA, 17 bp, Homo sapiens
tgccacacctggcctta

SEQ ID NO: 955096 - DNA, 17 bp, Homo sapiens
tgccacacgcatgggca

SEQ ID NO: 955097 - DNA, 13 bp, Homo sapiens
tgccacactgatg

SEQ ID NO: 955098 - DNA, 22 bp, Homo sapiens
tgccacactgatggctcaagac

SEQ ID NO: 955099 - DNA, 12 bp, Homo sapiens
tgccacacttca

SEQ ID NO: 955100 - DNA, 13 bp, Homo sapiens
tgccacacttcag

SEQ ID NO: 955101 - DNA, 22 bp, Homo sapiens
tgccacacttcaggctcttctc

SEQ ID NO: 955102 - DNA, 15 bp, Homo sapiens
tgccacagccagagg

SEQ ID NO: 955103 - DNA, 17 bp, Homo sapiens
tgccacagccagaggag

SEQ ID NO: 955104 - DNA, 14 bp, Homo sapiens
tgccacagcctgct

SEQ ID NO: 955105 - DNA, 15 bp, Homo sapiens
tgccacagcctgctg

SEQ ID NO: 955106 - DNA, 18 bp, Homo sapiens
tgccacagcctgctggca

SEQ ID NO: 955107 - DNA, 19 bp, Homo sapiens
tgccacagcctgctggcag

SEQ ID NO: 955108 - DNA, 23 bp, Homo sapiens
tgccacagcctgctggcagggcc

SEQ ID NO: 955109 - DNA, 16 bp, Homo sapiens
tgccacagcttttgca

SEQ ID NO: 955110 - DNA, 21 bp, Homo sapiens
gggaagagggcagtacctggg

SEQ ID NO: 955111 - DNA, 18 bp, Homo sapiens
gggaagagtggaggtgga

SEQ ID NO: 955112 - DNA, 22 bp, Homo sapiens
gggaagataggctctgcacaga

SEQ ID NO: 955113 - DNA, 19 bp, Homo sapiens
gggaagatgaactttgtca

SEQ ID NO: 955114 - DNA, 16 bp, Homo sapiens
gggaagatgtctcaga

SEQ ID NO: 955115 - DNA, 20 bp, Homo sapiens
gggaagatgtctcagagcct

SEQ ID NO: 955116 - DNA, 10 bp, Homo sapiens
gggaagcaaa

SEQ ID NO: 955117 - DNA, 17 bp, Homo sapiens
gggaagcaaagggggga

SEQ ID NO: 955118 - DNA, 18 bp, Homo sapiens
gggaagcaaaggggggag

SEQ ID NO: 955119 - DNA, 12 bp, Homo sapiens
gggaagcaggga

SEQ ID NO: 955120 - DNA, 19 bp, Homo sapiens
gggaagcgtatatacttaa

SEQ ID NO: 955121 - DNA, 17 bp, Homo sapiens
gggaagcgtcgccccag

SEQ ID NO: 955122 - DNA, 14 bp, Homo sapiens
gggaagctcccacc

SEQ ID NO: 955123 - DNA, 19 bp, Homo sapiens
gggaagctcccaccccact

SEQ ID NO: 955124 - DNA, 23 bp, Homo sapiens
gggaagctcccaccccactcagg

SEQ ID NO: 955125 - DNA, 21 bp, Homo sapiens
gggaagctgaggcgggagaat

SEQ ID NO: 955126 - DNA, 13 bp, Homo sapiens
gggaagctggctt

SEQ ID NO: 955127 - DNA, 14 bp, Homo sapiens
gggaagctggggga

SEQ ID NO: 955128 - DNA, 21 bp, Homo sapiens
gggaagctgggggaagggtgg

SEQ ID NO: 955129 - DNA, 18 bp, Homo sapiens
gggaagctgtactcagag

SEQ ID NO: 955130 - DNA, 13 bp, Homo sapiens
gggaaggaaacaa

SEQ ID NO: 955131 - DNA, 15 bp, Homo sapiens
gggaaggacacagca

SEQ ID NO: 955132 - DNA, 19 bp, Homo sapiens
gggaaggacacagcagtat

SEQ ID NO: 955133 - DNA, 13 bp, Homo sapiens
gggaaggagccag

SEQ ID NO: 955134 - DNA, 17 bp, Homo sapiens
gggaaggcagaggctgg

SEQ ID NO: 955135 - DNA, 16 bp, Homo sapiens
gggaaggccctgaggc

SEQ ID NO: 955136 - DNA, 13 bp, Homo sapiens
gggaaggcctgac

SEQ ID NO: 955137 - DNA, 15 bp, Homo sapiens
gggaaggcctgactt

SEQ ID NO: 955138 - DNA, 16 bp, Homo sapiens
gggaaggcgagtctgg

SEQ ID NO: 955139 - DNA, 13 bp, Homo sapiens
gggaagggagagc

SEQ ID NO: 955140 - DNA, 14 bp, Homo sapiens
gggaaggggatgga

SEQ ID NO: 955141 - DNA, 19 bp, Homo sapiens
gggaaggggatggaggcca

SEQ ID NO: 955142 - DNA, 20 bp, Homo sapiens
gggaaggggatggaggccag

SEQ ID NO: 955143 - DNA, 15 bp, Homo sapiens
gggaagggggaaagg

SEQ ID NO: 955144 - DNA, 13 bp, Homo sapiens
gggaaggggtgca

SEQ ID NO: 955145 - DNA, 16 bp, Homo sapiens
gggaagggtttgaatt

SEQ ID NO: 955146 - DNA, 17 bp, Homo sapiens
gggaagtacgtcccagc

SEQ ID NO: 955147 - DNA, 15 bp, Homo sapiens
gggaagtagtccttg

SEQ ID NO: 955148 - DNA, 21 bp, Homo sapiens
tgccactcactaggcccccac

SEQ ID NO: 955149 - DNA, 22 bp, Homo sapiens
tgccactcactaggcccccact

SEQ ID NO: 955150 - DNA, 18 bp, Homo sapiens
tgccactcattcctgtag

SEQ ID NO: 955151 - DNA, 16 bp, Homo sapiens
tgccactccctaccca

SEQ ID NO: 955152 - DNA, 14 bp, Homo sapiens
tgccactccctgag

SEQ ID NO: 955153 - DNA, 15 bp, Homo sapiens
tgccactccctgagc

SEQ ID NO: 955154 - DNA, 15 bp, Homo sapiens
tgccactctctggga

SEQ ID NO: 955155 - DNA, 18 bp, Homo sapiens
tgccactctctgggactc

SEQ ID NO: 955156 - DNA, 19 bp, Homo sapiens
tgccactctctgggactct

SEQ ID NO: 955157 - DNA, 20 bp, Homo sapiens
tgccactgccaggcacctgg

SEQ ID NO: 955158 - DNA, 21 bp, Homo sapiens
tgccactgccaggcacctggc

SEQ ID NO: 955159 - DNA, 23 bp, Homo sapiens
tgccactgccaggcacctggcct

SEQ ID NO: 955160 - DNA, 14 bp, Homo sapiens
tgccactgcccccc

SEQ ID NO: 955161 - DNA, 17 bp, Homo sapiens
tgccactgcccgagctg

SEQ ID NO: 955162 - DNA, 20 bp, Homo sapiens
tgccactgcccgagctggtg

SEQ ID NO: 955163 - DNA, 13 bp, Homo sapiens
tgccactgcctct

SEQ ID NO: 955164 - DNA, 19 bp, Homo sapiens
tgccactgccttcgcttct

SEQ ID NO: 955165 - DNA, 21 bp, Homo sapiens
tgccactgccttcgcttcttg

SEQ ID NO: 955166 - DNA, 22 bp, Homo sapiens
tgccactgcctttcagaagtga

SEQ ID NO: 955167 - DNA, 15 bp, Homo sapiens
tgccactgggcacct

SEQ ID NO: 955168 - DNA, 17 bp, Homo sapiens
tgccactgggcacctgc

SEQ ID NO: 955169 - DNA, 18 bp, Homo sapiens
tgccactgggcacctgcg

SEQ ID NO: 955170 - DNA, 12 bp, Homo sapiens
tgccactgggct

SEQ ID NO: 955171 - DNA, 13 bp, Homo sapiens
tgccactgggctc

SEQ ID NO: 955172 - DNA, 21 bp, Homo sapiens
tgccacttctgcgggctccct

SEQ ID NO: 955173 - DNA, 17 bp, Homo sapiens
tgccacttgacattcct

SEQ ID NO: 955174 - DNA, 18 bp, Homo sapiens
tgccacttgacattcctt

SEQ ID NO: 955175 - DNA, 20 bp, Homo sapiens
tgccactttacccacctaga

SEQ ID NO: 955176 - DNA, 21 bp, Homo sapiens
tgccactttacccacctagaa

SEQ ID NO: 955177 - DNA, 20 bp, Homo sapiens
tgccactttcacgtggcctc

SEQ ID NO: 955178 - DNA, 21 bp, Homo sapiens
tgccactttggcttctcctgt

SEQ ID NO: 955179 - DNA, 23 bp, Homo sapiens
tgccactttggcttctcctgtga

SEQ ID NO: 955180 - DNA, 18 bp, Homo sapiens
tgccagaaaaaaataact

SEQ ID NO: 955181 - DNA, 19 bp, Homo sapiens
tgccagaaacagtgggagc

SEQ ID NO: 955182 - DNA, 10 bp, Homo sapiens
tgccagaaga

SEQ ID NO: 955183 - DNA, 19 bp, Homo sapiens
tgccagaagagaattcagt

SEQ ID NO: 955184 - DNA, 12 bp, Homo sapiens
tgccagacatgt

SEQ ID NO: 955185 - DNA, 13 bp, Homo sapiens
tgccagagaaact

SEQ ID NO: 955186 - DNA, 23 bp, Homo sapiens
tgccagagaaactaacttggtgg

SEQ ID NO: 955187 - DNA, 11 bp, Homo sapiens
tgccagagagg

SEQ ID NO: 955188 - DNA, 16 bp, Homo sapiens
tgccagagcaggagcc

SEQ ID NO: 955189 - DNA, 20 bp, Homo sapiens
tgccagagcaggagcccctg

SEQ ID NO: 955190 - DNA, 14 bp, Homo sapiens
tgccagagggccag

SEQ ID NO: 955191 - DNA, 15 bp, Homo sapiens
tgccagagggccagc

SEQ ID NO: 955192 - DNA, 18 bp, Homo sapiens
tgccagagggccagcagg

SEQ ID NO: 955193 - DNA, 20 bp, Homo sapiens
tgccagagggccagcaggct

SEQ ID NO: 955194 - DNA, 16 bp, Homo sapiens
tgccagaggtgggcag

SEQ ID NO: 955195 - DNA, 17 bp, Homo sapiens
tgccagaggtgggcagg

SEQ ID NO: 955196 - DNA, 20 bp, Homo sapiens
tgccagaggtgggcaggtgg

SEQ ID NO: 955197 - DNA, 21 bp, Homo sapiens
tgccagaggtgggcaggtggt

SEQ ID NO: 955198 - DNA, 21 bp, Homo sapiens
tgccagatataactgtcttgt

SEQ ID NO: 955199 - DNA, 16 bp, Homo sapiens
tgccagattctgcctc

SEQ ID NO: 955200 - DNA, 20 bp, Homo sapiens
tgccagattctgcctctctg

SEQ ID NO: 955201 - DNA, 17 bp, Homo sapiens
tgccagcaaataaatac

SEQ ID NO: 955202 - DNA, 15 bp, Homo sapiens
tgccagcaactgaat

SEQ ID NO: 955203 - DNA, 17 bp, Homo sapiens
tgccagcaactgaataa

SEQ ID NO: 955204 - DNA, 22 bp, Homo sapiens
tgccagcaatgacatctcaggg

SEQ ID NO: 955205 - DNA, 22 bp, Homo sapiens
tgccagcacagagcgtccttcc

SEQ ID NO: 955206 - DNA, 17 bp, Homo sapiens
tgccagcacaggggccc

SEQ ID NO: 955207 - DNA, 21 bp, Homo sapiens
tgccagcacaggggccccaga

SEQ ID NO: 955208 - DNA, 14 bp, Homo sapiens
tgccagcagcctcg

SEQ ID NO: 955209 - DNA, 20 bp, Homo sapiens
tgccagcatacattttctgg

SEQ ID NO: 955210 - DNA, 15 bp, Homo sapiens
tgccagcatatactg

SEQ ID NO: 955211 - DNA, 20 bp, Homo sapiens
tgccagccaatccctggcca

SEQ ID NO: 955212 - DNA, 11 bp, Homo sapiens
tgccagccaca

SEQ ID NO: 955213 - DNA, 16 bp, Homo sapiens
tgccagccgaccctcc

SEQ ID NO: 955214 - DNA, 20 bp, Homo sapiens
tgccagccgaccctcctggc

SEQ ID NO: 955215 - DNA, 14 bp, Homo sapiens
tgccagcctccttg

SEQ ID NO: 955216 - DNA, 15 bp, Homo sapiens
tgccagcctccttgc

SEQ ID NO: 955217 - DNA, 20 bp, Homo sapiens
tgccagcctccttgctgacc

SEQ ID NO: 955218 - DNA, 22 bp, Homo sapiens
tgccagcctccttgctgacccc

SEQ ID NO: 955219 - DNA, 21 bp, Homo sapiens
tgccagcctggcttctggagc

SEQ ID NO: 955220 - DNA, 14 bp, Homo sapiens
tgccagccttcctc

SEQ ID NO: 955221 - DNA, 17 bp, Homo sapiens
tgccagccttgagccct

SEQ ID NO: 955222 - DNA, 23 bp, Homo sapiens
tgccagccttgagccctggctgt

SEQ ID NO: 955223 - DNA, 11 bp, Homo sapiens
tgccagctcca

SEQ ID NO: 955224 - DNA, 12 bp, Homo sapiens
tgccagctccag

SEQ ID NO: 955225 - DNA, 18 bp, Homo sapiens
tgccagctggcctttgta

SEQ ID NO: 955226 - DNA, 16 bp, Homo sapiens
tgccagcttctctctc

SEQ ID NO: 955227 - DNA, 18 bp, Homo sapiens
tgccagcttctctctcca

SEQ ID NO: 955228 - DNA, 20 bp, Homo sapiens
tgccagcttttcctcccttg

SEQ ID NO: 955229 - DNA, 20 bp, Homo sapiens
tgccaggaaacaagggaagg

SEQ ID NO: 955230 - DNA, 13 bp, Homo sapiens
tgccaggacacgc

SEQ ID NO: 955231 - DNA, 11 bp, Homo sapiens
tgccaggacca

SEQ ID NO: 955232 - DNA, 22 bp, Homo sapiens
gggaccctgtccggcccagtgc

SEQ ID NO: 955233 - DNA, 17 bp, Homo sapiens
gggacccttgcctgcct

SEQ ID NO: 955234 - DNA, 23 bp, Homo sapiens
gggacccttgcctgcctcctagg

SEQ ID NO: 955235 - DNA, 13 bp, Homo sapiens
gggaccggtgctg

SEQ ID NO: 955236 - DNA, 13 bp, Homo sapiens
gggaccgtgcccc

SEQ ID NO: 955237 - DNA, 21 bp, Homo sapiens
gggaccgtgccccacctcccc

SEQ ID NO: 955238 - DNA, 22 bp, Homo sapiens
gggaccgtgccccacctcccca

SEQ ID NO: 955239 - DNA, 17 bp, Homo sapiens
gggaccgtgcgagctgc

SEQ ID NO: 955240 - DNA, 13 bp, Homo sapiens
gggacctcagggg

SEQ ID NO: 955241 - DNA, 14 bp, Homo sapiens
gggacctcaggggc

SEQ ID NO: 955242 - DNA, 15 bp, Homo sapiens
gggacctcaggggca

SEQ ID NO: 955243 - DNA, 18 bp, Homo sapiens
gggacctgccaggcaggg

SEQ ID NO: 955244 - DNA, 22 bp, Homo sapiens
gggaccttaagtgatttgcctg

SEQ ID NO: 955245 - DNA, 20 bp, Homo sapiens
gggacgacgctgactgccct

SEQ ID NO: 955246 - DNA, 15 bp, Homo sapiens
gggacgcctgccctg

SEQ ID NO: 955247 - DNA, 17 bp, Homo sapiens
gggacgggatgaggagc

SEQ ID NO: 955248 - DNA, 24 bp, Homo sapiens
gggacgggcaagtgagaggggagg

SEQ ID NO: 955249 - DNA, 14 bp, Homo sapiens
gggacgtggctcag

SEQ ID NO: 955250 - DNA, 14 bp, Homo sapiens
gggacgtttctcat

SEQ ID NO: 955251 - DNA, 17 bp, Homo sapiens
gggactcagccctgagg

SEQ ID NO: 955252 - DNA, 18 bp, Homo sapiens
gggactcagcgtcccctg

SEQ ID NO: 955253 - DNA, 15 bp, Homo sapiens
gggactcagggaccg

SEQ ID NO: 955254 - DNA, 21 bp, Homo sapiens
gggactccatgctccttgaga

SEQ ID NO: 955255 - DNA, 12 bp, Homo sapiens
gggactcctcaa

SEQ ID NO: 955256 - DNA, 21 bp, Homo sapiens
gggactcgcagcacccacagc

SEQ ID NO: 955257 - DNA, 16 bp, Homo sapiens
gggactcggtgagccg

SEQ ID NO: 955258 - DNA, 18 bp, Homo sapiens
gggactctcctcctcccc

SEQ ID NO: 955259 - DNA, 21 bp, Homo sapiens
gggactctcctcctcccctcc

SEQ ID NO: 955260 - DNA, 14 bp, Homo sapiens
gggactctggcaca

SEQ ID NO: 955261 - DNA, 15 bp, Homo sapiens
gggactctggcacag

SEQ ID NO: 955262 - DNA, 19 bp, Homo sapiens
gggactgaaaacctctcct

SEQ ID NO: 955263 - DNA, 14 bp, Homo sapiens
gggactgagccagt

SEQ ID NO: 955264 - DNA, 17 bp, Homo sapiens
gggactgagccagtccc

SEQ ID NO: 955265 - DNA, 17 bp, Homo sapiens
gggactgccaggctgtt

SEQ ID NO: 955266 - DNA, 17 bp, Homo sapiens
gggactgctgctgcctg

SEQ ID NO: 955267 - DNA, 19 bp, Homo sapiens
gggactggaaccagggaga

SEQ ID NO: 955268 - DNA, 20 bp, Homo sapiens
gggactgggagccgcagcag

SEQ ID NO: 955269 - DNA, 19 bp, Homo sapiens
gggactggggaaggggagg

SEQ ID NO: 955270 - DNA, 20 bp, Homo sapiens
gggactggggatgtgggagg

SEQ ID NO: 955271 - DNA, 12 bp, Homo sapiens
gggactgttcct

SEQ ID NO: 955272 - DNA, 17 bp, Homo sapiens
gggacttccgctccctg

SEQ ID NO: 955273 - DNA, 19 bp, Homo sapiens
gggacttccttgctctccc

SEQ ID NO: 955274 - DNA, 21 bp, Homo sapiens
gggacttcttacccaaagcac

SEQ ID NO: 955275 - DNA, 13 bp, Homo sapiens
tgccagtcagcaa

SEQ ID NO: 955276 - DNA, 18 bp, Homo sapiens
tgccagtcgggagagcca

SEQ ID NO: 955277 - DNA, 20 bp, Homo sapiens
tgccagtcgggagagccagg

SEQ ID NO: 955278 - DNA, 14 bp, Homo sapiens
tgccagtgaagact

SEQ ID NO: 955279 - DNA, 15 bp, Homo sapiens
tgccagtgaagactt

SEQ ID NO: 955280 - DNA, 20 bp, Homo sapiens
tgccagtgacagacaggctc

SEQ ID NO: 955281 - DNA, 13 bp, Homo sapiens
tgccagtgccagg

SEQ ID NO: 955282 - DNA, 17 bp, Homo sapiens
tgccagtgccagggtgg

SEQ ID NO: 955283 - DNA, 11 bp, Homo sapiens
tgccagtgcct

SEQ ID NO: 955284 - DNA, 21 bp, Homo sapiens
tgccagtgccttacctcctgc

SEQ ID NO: 955285 - DNA, 13 bp, Homo sapiens
tgccagttcctgt

SEQ ID NO: 955286 - DNA, 14 bp, Homo sapiens
tgccagttgggctc

SEQ ID NO: 955287 - DNA, 15 bp, Homo sapiens
tgccagttgggctcg

SEQ ID NO: 955288 - DNA, 21 bp, Homo sapiens
tgccagttgggctcgcactgc

SEQ ID NO: 955289 - DNA, 21 bp, Homo sapiens
tgccataaaacattaagaaaa

SEQ ID NO: 955290 - DNA, 16 bp, Homo sapiens
tgccatactaatgatg

SEQ ID NO: 955291 - DNA, 15 bp, Homo sapiens
tgccatactttgtct

SEQ ID NO: 955292 - DNA, 13 bp, Homo sapiens
tgccatagagttt

SEQ ID NO: 955293 - DNA, 20 bp, Homo sapiens
tgccatagcataatatgaag

SEQ ID NO: 955294 - DNA, 14 bp, Homo sapiens
tgccatagccccat

SEQ ID NO: 955295 - DNA, 16 bp, Homo sapiens
tgccatattaaatttt

SEQ ID NO: 955296 - DNA, 13 bp, Homo sapiens
tgccatattttca

SEQ ID NO: 955297 - DNA, 13 bp, Homo sapiens
tgccatcagcccc

SEQ ID NO: 955298 - DNA, 16 bp, Homo sapiens
tgccatcagcccctgg

SEQ ID NO: 955299 - DNA, 18 bp, Homo sapiens
tgccatcagcccctggga

SEQ ID NO: 955300 - DNA, 19 bp, Homo sapiens
tgccatcagcccctgggaa

SEQ ID NO: 955301 - DNA, 21 bp, Homo sapiens
tgccatcagcccctgggaaca

SEQ ID NO: 955302 - DNA, 13 bp, Homo sapiens
tgccatcatctcc

SEQ ID NO: 955303 - DNA, 16 bp, Homo sapiens
tgccatcatctcctgc

SEQ ID NO: 955304 - DNA, 23 bp, Homo sapiens
tgccatcatctcctgccttcctc

SEQ ID NO: 955305 - DNA, 16 bp, Homo sapiens
tgccatcatgcctgac

SEQ ID NO: 955306 - DNA, 21 bp, Homo sapiens
tgccatccccctctcacgcca

SEQ ID NO: 955307 - DNA, 22 bp, Homo sapiens
tgccatcctgatggacctgccc

SEQ ID NO: 955308 - DNA, 19 bp, Homo sapiens
tgccatctaatggcttcag

SEQ ID NO: 955309 - DNA, 14 bp, Homo sapiens
tgccatcttcccag

SEQ ID NO: 955310 - DNA, 18 bp, Homo sapiens
tgccatcttctccccgag

SEQ ID NO: 955311 - DNA, 16 bp, Homo sapiens
tgccatgaatttctac

SEQ ID NO: 955312 - DNA, 15 bp, Homo sapiens
tgccatgatagctgg

SEQ ID NO: 955313 - DNA, 17 bp, Homo sapiens
tgccatgatctgtattt

SEQ ID NO: 955314 - DNA, 16 bp, Homo sapiens
tgccatgatgtttaca

SEQ ID NO: 955315 - DNA, 17 bp, Homo sapiens
tgccatgatgtttacaa

SEQ ID NO: 955316 - DNA, 15 bp, Homo sapiens
tgccatgcaggaaga

SEQ ID NO: 955317 - DNA, 20 bp, Homo sapiens
tgccatgcaggaagaggccc

SEQ ID NO: 955318 - DNA, 21 bp, Homo sapiens
tgccatgcaggaagaggccca

SEQ ID NO: 955319 - DNA, 18 bp, Homo sapiens
tgccatgccactgccagg

SEQ ID NO: 955320 - DNA, 14 bp, Homo sapiens
tgccatgctgggcc

SEQ ID NO: 955321 - DNA, 21 bp, Homo sapiens
tgccatggaattccctcctga

SEQ ID NO: 955322 - DNA, 21 bp, Homo sapiens
tgccatggatctgatctgtac

SEQ ID NO: 955323 - DNA, 19 bp, Homo sapiens
tgccatggcaatggcatgc

SEQ ID NO: 955324 - DNA, 16 bp, Homo sapiens
tgccatgggcctgctg

SEQ ID NO: 955325 - DNA, 17 bp, Homo sapiens
tgccatgggcctgctgc

SEQ ID NO: 955326 - DNA, 18 bp, Homo sapiens
tgccatgggtgcagaccc

SEQ ID NO: 955327 - DNA, 19 bp, Homo sapiens
tgccatgggtgcagaccct

SEQ ID NO: 955328 - DNA, 16 bp, Homo sapiens
tgccatggtctttgct

SEQ ID NO: 955329 - DNA, 20 bp, Homo sapiens
tgccatgtaaatccccactg

SEQ ID NO: 955330 - DNA, 14 bp, Homo sapiens
tgccatgtaaggtt

SEQ ID NO: 955331 - DNA, 20 bp, Homo sapiens
tgccatgtaaggttgtgcag

SEQ ID NO: 955332 - DNA, 18 bp, Homo sapiens
tgccatgtacctcccctg

SEQ ID NO: 955333 - DNA, 13 bp, Homo sapiens
tgccatgtcgctt

SEQ ID NO: 955334 - DNA, 23 bp, Homo sapiens
tgccatgtttagattccaggatc

SEQ ID NO: 955335 - DNA, 21 bp, Homo sapiens
tgccatgttttgccaccccct

SEQ ID NO: 955336 - DNA, 18 bp, Homo sapiens
tgccattactactgtaca

SEQ ID NO: 955337 - DNA, 22 bp, Homo sapiens
tgccattattaacccatttttg

SEQ ID NO: 955338 - DNA, 16 bp, Homo sapiens
tgccattcacttcata

SEQ ID NO: 955339 - DNA, 19 bp, Homo sapiens
tgccattccactccactca

SEQ ID NO: 955340 - DNA, 21 bp, Homo sapiens
tgccattccactccactcagg

SEQ ID NO: 955341 - DNA, 16 bp, Homo sapiens
tgccattgccaggaga

SEQ ID NO: 955342 - DNA, 19 bp, Homo sapiens
tgccattgtactccagcct

SEQ ID NO: 955343 - DNA, 13 bp, Homo sapiens
tgccatttccctt

SEQ ID NO: 955344 - DNA, 16 bp, Homo sapiens
tgccatttcttctctc

SEQ ID NO: 955345 - DNA, 18 bp, Homo sapiens
tgccatttcttctctctg

SEQ ID NO: 955346 - DNA, 17 bp, Homo sapiens
tgccatttgcaccctcc

SEQ ID NO: 955347 - DNA, 21 bp, Homo sapiens
tgccatttgcaccctccgcct

SEQ ID NO: 955348 - DNA, 17 bp, Homo sapiens
tgccattttaaatttta

SEQ ID NO: 955349 - DNA, 18 bp, Homo sapiens
tgccattttaaattttat

SEQ ID NO: 955350 - DNA, 20 bp, Homo sapiens
tgccatttttctataaatca

SEQ ID NO: 955351 - DNA, 19 bp, Homo sapiens
tgcccaaaaatatggttga

SEQ ID NO: 955352 - DNA, 19 bp, Homo sapiens
tgcccaaacccttaactga

SEQ ID NO: 955353 - DNA, 14 bp, Homo sapiens
tgcccaaactcccc

SEQ ID NO: 955354 - DNA, 22 bp, Homo sapiens
gggagcctttggggggccaccc

SEQ ID NO: 955355 - DNA, 15 bp, Homo sapiens
gggagctcaaggcca

SEQ ID NO: 955356 - DNA, 19 bp, Homo sapiens
gggagctccactctgcttc

SEQ ID NO: 955357 - DNA, 16 bp, Homo sapiens
gggagctcctggccag

SEQ ID NO: 955358 - DNA, 16 bp, Homo sapiens
gggagctcctgggacc

SEQ ID NO: 955359 - DNA, 14 bp, Homo sapiens
gggagctctgggga

SEQ ID NO: 955360 - DNA, 17 bp, Homo sapiens
gggagctgaaccacaga

SEQ ID NO: 955361 - DNA, 13 bp, Homo sapiens
gggagctgagcag

SEQ ID NO: 955362 - DNA, 19 bp, Homo sapiens
gggagctgctggctgacct

SEQ ID NO: 955363 - DNA, 21 bp, Homo sapiens
gggagctgctggctgacctgg

SEQ ID NO: 955364 - DNA, 10 bp, Homo sapiens
gggagctggt

SEQ ID NO: 955365 - DNA, 17 bp, Homo sapiens
gggagcttcctggctct

SEQ ID NO: 955366 - DNA, 18 bp, Homo sapiens
gggagcttcctggctctg

SEQ ID NO: 955367 - DNA, 17 bp, Homo sapiens
gggagcttgggactcag

SEQ ID NO: 955368 - DNA, 20 bp, Homo sapiens
gggagcttgggactcaggtc

SEQ ID NO: 955369 - DNA, 21 bp, Homo sapiens
gggagcttgggactcaggtct

SEQ ID NO: 955370 - DNA, 21 bp, Homo sapiens
gggagctttttcagaaacagg

SEQ ID NO: 955371 - DNA, 12 bp, Homo sapiens
gggaggaaaaaa

SEQ ID NO: 955372 - DNA, 16 bp, Homo sapiens
gggaggaaaaaagaac

SEQ ID NO: 955373 - DNA, 17 bp, Homo sapiens
gggaggacctggggcac

SEQ ID NO: 955374 - DNA, 14 bp, Homo sapiens
gggaggagaatgag

SEQ ID NO: 955375 - DNA, 16 bp, Homo sapiens
gggaggagagccactg

SEQ ID NO: 955376 - DNA, 13 bp, Homo sapiens
gggaggagcctct

SEQ ID NO: 955377 - DNA, 12 bp, Homo sapiens
gggaggaggaaa

SEQ ID NO: 955378 - DNA, 19 bp, Homo sapiens
gggaggaggaacgggcagc

SEQ ID NO: 955379 - DNA, 21 bp, Homo sapiens
gggaggaggaacgggcagcca

SEQ ID NO: 955380 - DNA, 12 bp, Homo sapiens
gggaggaggact

SEQ ID NO: 955381 - DNA, 17 bp, Homo sapiens
gggaggagggagaggga

SEQ ID NO: 955382 - DNA, 20 bp, Homo sapiens
gggaggagtcaggggctctg

SEQ ID NO: 955383 - DNA, 15 bp, Homo sapiens
gggaggatacagagg

SEQ ID NO: 955384 - DNA, 18 bp, Homo sapiens
gggaggatacagaggaga

SEQ ID NO: 955385 - DNA, 23 bp, Homo sapiens
gggaggatctcttgagcctggga

SEQ ID NO: 955386 - DNA, 21 bp, Homo sapiens
gggaggattgcttgagctcag

SEQ ID NO: 955387 - DNA, 15 bp, Homo sapiens
gggaggcaccagctc

SEQ ID NO: 955388 - DNA, 16 bp, Homo sapiens
gggaggcaccagctct

SEQ ID NO: 955389 - DNA, 23 bp, Homo sapiens
gggaggcaccagctctgtggcct

SEQ ID NO: 955390 - DNA, 20 bp, Homo sapiens
gggaggcaccatgcaaatgt

SEQ ID NO: 955391 - DNA, 12 bp, Homo sapiens
gggaggcagagc

SEQ ID NO: 955392 - DNA, 19 bp, Homo sapiens
gggaggcagatggagccca

SEQ ID NO: 955393 - DNA, 14 bp, Homo sapiens
gggaggcagggctc

SEQ ID NO: 955394 - DNA, 15 bp, Homo sapiens
gggaggcagggctgg

SEQ ID NO: 955395 - DNA, 16 bp, Homo sapiens
gggaggccaaggcagg

SEQ ID NO: 955396 - DNA, 14 bp, Homo sapiens
gggaggccacgtcc

SEQ ID NO: 955397 - DNA, 18 bp, Homo sapiens
gggaggccacgtcccacc

SEQ ID NO: 955398 - DNA, 19 bp, Homo sapiens
gggaggccacgtcccaccc

SEQ ID NO: 955399 - DNA, 20 bp, Homo sapiens
gggaggccaggcgagcctga

SEQ ID NO: 955400 - DNA, 17 bp, Homo sapiens
gggaggcctaggcgggc

SEQ ID NO: 955401 - DNA, 16 bp, Homo sapiens
gggaggcgcagggaca

SEQ ID NO: 955402 - DNA, 17 bp, Homo sapiens
tgcccagaataagttat

SEQ ID NO: 955403 - DNA, 20 bp, Homo sapiens
tgcccagacacagactggca

SEQ ID NO: 955404 - DNA, 22 bp, Homo sapiens
tgcccagacacagactggcaat

SEQ ID NO: 955405 - DNA, 18 bp, Homo sapiens
tgcccagacccctctggc

SEQ ID NO: 955406 - DNA, 19 bp, Homo sapiens
tgcccagacccctctggcc

SEQ ID NO: 955407 - DNA, 17 bp, Homo sapiens
tgcccagactacagggc

SEQ ID NO: 955408 - DNA, 20 bp, Homo sapiens
tgcccagactgatgagcaca

SEQ ID NO: 955409 - DNA, 11 bp, Homo sapiens
tgcccagagat

SEQ ID NO: 955410 - DNA, 20 bp, Homo sapiens
tgcccagagatgcctccacc

SEQ ID NO: 955411 - DNA, 21 bp, Homo sapiens
tgcccagagatgcctccaccg

SEQ ID NO: 955412 - DNA, 22 bp, Homo sapiens
tgcccagagatgcctccaccgc

SEQ ID NO: 955413 - DNA, 21 bp, Homo sapiens
tgcccagaggactcccaaccc

SEQ ID NO: 955414 - DNA, 15 bp, Homo sapiens
tgcccagattcccag

SEQ ID NO: 955415 - DNA, 16 bp, Homo sapiens
tgcccagattcccaga

SEQ ID NO: 955416 - DNA, 13 bp, Homo sapiens
tgcccagcaggcc

SEQ ID NO: 955417 - DNA, 15 bp, Homo sapiens
tgcccagcaggccca

SEQ ID NO: 955418 - DNA, 22 bp, Homo sapiens
tgcccagccactccaagccccc

SEQ ID NO: 955419 - DNA, 19 bp, Homo sapiens
tgcccagccagccacccct

SEQ ID NO: 955420 - DNA, 20 bp, Homo sapiens
tgcccagccagccacccctg

SEQ ID NO: 955421 - DNA, 20 bp, Homo sapiens
tgcccagccccgctcaggcc

SEQ ID NO: 955422 - DNA, 13 bp, Homo sapiens
tgcccagcccctt

SEQ ID NO: 955423 - DNA, 13 bp, Homo sapiens
tgcccagctctct

SEQ ID NO: 955424 - DNA, 15 bp, Homo sapiens
tgcccagctctctga

SEQ ID NO: 955425 - DNA, 18 bp, Homo sapiens
tgcccagctctctgacgc

SEQ ID NO: 955426 - DNA, 20 bp, Homo sapiens
tgcccaggagagccagccct

SEQ ID NO: 955427 - DNA, 16 bp, Homo sapiens
tgcccaggcccttggc

SEQ ID NO: 955428 - DNA, 18 bp, Homo sapiens
tgcccaggcctatctgga

SEQ ID NO: 955429 - DNA, 19 bp, Homo sapiens
tgcccaggcctatctggaa

SEQ ID NO: 955430 - DNA, 17 bp, Homo sapiens
tgcccaggcctgcctgt

SEQ ID NO: 955431 - DNA, 18 bp, Homo sapiens
tgcccaggctggagtgca

SEQ ID NO: 955432 - DNA, 20 bp, Homo sapiens
tgcccaggctggagtgcagt

SEQ ID NO: 955433 - DNA, 20 bp, Homo sapiens
tgcccaggctggagtgtagt

SEQ ID NO: 955434 - DNA, 21 bp, Homo sapiens
tgcccaggctggagtgtagtg

SEQ ID NO: 955435 - DNA, 14 bp, Homo sapiens
tgcccaggctgtgc

SEQ ID NO: 955436 - DNA, 18 bp, Homo sapiens
tgcccagggagtccttgc

SEQ ID NO: 955437 - DNA, 14 bp, Homo sapiens
tgcccagggctcag

SEQ ID NO: 955438 - DNA, 19 bp, Homo sapiens
tgcccagggctcagcctgg

SEQ ID NO: 955439 - DNA, 18 bp, Homo sapiens
tgcccaggggtgccccct

SEQ ID NO: 955440 - DNA, 23 bp, Homo sapiens
tgcccaggggtgccccctcctct

SEQ ID NO: 955441 - DNA, 19 bp, Homo sapiens
tgcccagggtcctgtgcct

SEQ ID NO: 955442 - DNA, 20 bp, Homo sapiens
tgcccagggtcctgtgcctg

SEQ ID NO: 955443 - DNA, 16 bp, Homo sapiens
tgcccagggtggctgc

SEQ ID NO: 955444 - DNA, 19 bp, Homo sapiens
tgcccaggtaccacccttc

SEQ ID NO: 955445 - DNA, 20 bp, Homo sapiens
tgcccaggtaccacccttca

SEQ ID NO: 955446 - DNA, 18 bp, Homo sapiens
tgcccaggtcaccaagca

SEQ ID NO: 955447 - DNA, 16 bp, Homo sapiens
tgcccaggtggcctcc

SEQ ID NO: 955448 - DNA, 18 bp, Homo sapiens
tgcccaggtggcctcctg

SEQ ID NO: 955449 - DNA, 15 bp, Homo sapiens
tgcccagtacattta

SEQ ID NO: 955450 - DNA, 12 bp, Homo sapiens
tgcccagtgttg

SEQ ID NO: 955451 - DNA, 18 bp, Homo sapiens
tgcccagtgttgtttgta

SEQ ID NO: 955452 - DNA, 20 bp, Homo sapiens
tgcccatcacagggttgggc

SEQ ID NO: 955453 - DNA, 23 bp, Homo sapiens
tgcccatcacagggttgggccca

SEQ ID NO: 955454 - DNA, 18 bp, Homo sapiens
tgcccatcatgtggcccc

SEQ ID NO: 955455 - DNA, 21 bp, Homo sapiens
tgcccatcatgtggccccacc

SEQ ID NO: 955456 - DNA, 22 bp, Homo sapiens
tgcccatcatgtggccccaccc

SEQ ID NO: 955457 - DNA, 13 bp, Homo sapiens
tgcccatcctgcc

SEQ ID NO: 955458 - DNA, 14 bp, Homo sapiens
tgcccatcctgcca

SEQ ID NO: 955459 - DNA, 19 bp, Homo sapiens
tgcccatgtgtcccctcac

SEQ ID NO: 955460 - DNA, 18 bp, Homo sapiens
tgcccattcaccaaaatt

SEQ ID NO: 955461 - DNA, 22 bp, Homo sapiens
tgccccaaataacttcagtcct

SEQ ID NO: 955462 - DNA, 15 bp, Homo sapiens
tgccccaactcctgg

SEQ ID NO: 955463 - DNA, 18 bp, Homo sapiens
tgccccaagcagccagcc

SEQ ID NO: 955464 - DNA, 21 bp, Homo sapiens
tgccccaagcagccagccagt

SEQ ID NO: 955465 - DNA, 22 bp, Homo sapiens
tgccccaaggccccagggacag

SEQ ID NO: 955466 - DNA, 21 bp, Homo sapiens
tgccccaatcgggtccagaga

SEQ ID NO: 955467 - DNA, 20 bp, Homo sapiens
tgccccacaaaacttcagtg

SEQ ID NO: 955468 - DNA, 17 bp, Homo sapiens
tgccccacacctcctct

SEQ ID NO: 955469 - DNA, 15 bp, Homo sapiens
tgccccacacggact

SEQ ID NO: 955470 - DNA, 11 bp, Homo sapiens
tgccccacagc

SEQ ID NO: 955471 - DNA, 22 bp, Homo sapiens
tgccccacatgtggccatggcc

SEQ ID NO: 955472 - DNA, 21 bp, Homo sapiens
tgccccacccaccccacagac

SEQ ID NO: 955473 - DNA, 19 bp, Homo sapiens
tgccccaccccatccagcc

SEQ ID NO: 955474 - DNA, 14 bp, Homo sapiens
tgccccacccccct

SEQ ID NO: 955475 - DNA, 13 bp, Homo sapiens
gggatacttagtg

SEQ ID NO: 955476 - DNA, 22 bp, Homo sapiens
gggatactttagaagtagaatt

SEQ ID NO: 955477 - DNA, 23 bp, Homo sapiens
gggatagtgttctgctcctgctt

SEQ ID NO: 955478 - DNA, 16 bp, Homo sapiens
gggatataggagagga

SEQ ID NO: 955479 - DNA, 16 bp, Homo sapiens
gggatatggcaggact

SEQ ID NO: 955480 - DNA, 14 bp, Homo sapiens
gggatatggctgcc

SEQ ID NO: 955481 - DNA, 18 bp, Homo sapiens
gggatcaaacctttctgg

SEQ ID NO: 955482 - DNA, 22 bp, Homo sapiens
gggatcagccccgcctgtcaca

SEQ ID NO: 955483 - DNA, 14 bp, Homo sapiens
gggatcaggagccc

SEQ ID NO: 955484 - DNA, 16 bp, Homo sapiens
gggatccacttcttgg

SEQ ID NO: 955485 - DNA, 23 bp, Homo sapiens
gggatccccgcctggccaggagc

SEQ ID NO: 955486 - DNA, 14 bp, Homo sapiens
gggatcctccacag

SEQ ID NO: 955487 - DNA, 19 bp, Homo sapiens
gggatcctccacagagagg

SEQ ID NO: 955488 - DNA, 14 bp, Homo sapiens
gggatcctgccccc

SEQ ID NO: 955489 - DNA, 15 bp, Homo sapiens
gggatcgtgcatttg

SEQ ID NO: 955490 - DNA, 22 bp, Homo sapiens
gggatctgagctcccacctccc

SEQ ID NO: 955491 - DNA, 12 bp, Homo sapiens
gggatctggggg

SEQ ID NO: 955492 - DNA, 13 bp, Homo sapiens
gggatctgggggg

SEQ ID NO: 955493 - DNA, 21 bp, Homo sapiens
gggatctggggggtggggagg

SEQ ID NO: 955494 - DNA, 23 bp, Homo sapiens
gggatctggtcctacccatcccc

SEQ ID NO: 955495 - DNA, 16 bp, Homo sapiens
gggatcttcccacagg

SEQ ID NO: 955496 - DNA, 20 bp, Homo sapiens
gggatgactaaaatatttat

SEQ ID NO: 955497 - DNA, 16 bp, Homo sapiens
gggatgccctggaggt

SEQ ID NO: 955498 - DNA, 14 bp, Homo sapiens
gggatgcctgtctt

SEQ ID NO: 955499 - DNA, 19 bp, Homo sapiens
gggatgcgtgggaggcaga

SEQ ID NO: 955500 - DNA, 17 bp, Homo sapiens
gggatgctgacccagga

SEQ ID NO: 955501 - DNA, 13 bp, Homo sapiens
gggatgctggtgg

SEQ ID NO: 955502 - DNA, 19 bp, Homo sapiens
gggatgctggtggctggtg

SEQ ID NO: 955503 - DNA, 12 bp, Homo sapiens
gggatgcttcat

SEQ ID NO: 955504 - DNA, 17 bp, Homo sapiens
gggatggacaggaaagg

SEQ ID NO: 955505 - DNA, 15 bp, Homo sapiens
gggatggagaaagaa

SEQ ID NO: 955506 - DNA, 16 bp, Homo sapiens
gggatggagaaagaag

SEQ ID NO: 955507 - DNA, 22 bp, Homo sapiens
gggatggagaaagggcagagga

SEQ ID NO: 955508 - DNA, 14 bp, Homo sapiens
gggatggaggagaa

SEQ ID NO: 955509 - DNA, 18 bp, Homo sapiens
gggatggaggagaagaat

SEQ ID NO: 955510 - DNA, 14 bp, Homo sapiens
gggatggaggccag

SEQ ID NO: 955511 - DNA, 18 bp, Homo sapiens
gggatggaggccagagtc

SEQ ID NO: 955512 - DNA, 20 bp, Homo sapiens
gggatgggccccgccttcct

SEQ ID NO: 955513 - DNA, 14 bp, Homo sapiens
gggatgggcctggc

SEQ ID NO: 955514 - DNA, 12 bp, Homo sapiens
gggatggggagg

SEQ ID NO: 955515 - DNA, 14 bp, Homo sapiens
gggatggtccagga

SEQ ID NO: 955516 - DNA, 15 bp, Homo sapiens
gggatggtcctgggg

SEQ ID NO: 955517 - DNA, 16 bp, Homo sapiens
gggatggtcctggggc

SEQ ID NO: 955518 - DNA, 16 bp, Homo sapiens
gggatggtggcacagg

SEQ ID NO: 955519 - DNA, 18 bp, Homo sapiens
gggatggtggcacaggca

SEQ ID NO: 955520 - DNA, 12 bp, Homo sapiens
gggatgtcctct

SEQ ID NO: 955521 - DNA, 14 bp, Homo sapiens
gggatgtgggaggg

SEQ ID NO: 955522 - DNA, 14 bp, Homo sapiens
gggattcaggctgc

SEQ ID NO: 955523 - DNA, 15 bp, Homo sapiens
gggattcaggctgct

SEQ ID NO: 955524 - DNA, 14 bp, Homo sapiens
gggattcctgaccc

SEQ ID NO: 955525 - DNA, 19 bp, Homo sapiens
gggattcctgacccaggcc

SEQ ID NO: 955526 - DNA, 17 bp, Homo sapiens
gggattcctgagctggc

SEQ ID NO: 955527 - DNA, 18 bp, Homo sapiens
gggattcctgagctggcc

SEQ ID NO: 955528 - DNA, 21 bp, Homo sapiens
gggattctactttaagcacta

SEQ ID NO: 955529 - DNA, 15 bp, Homo sapiens
tgcccccaggcagcc

SEQ ID NO: 955530 - DNA, 17 bp, Homo sapiens
tgcccccaggcagccac

SEQ ID NO: 955531 - DNA, 13 bp, Homo sapiens
tgcccccatcacc

SEQ ID NO: 955532 - DNA, 12 bp, Homo sapiens
tgcccccatcca

SEQ ID NO: 955533 - DNA, 15 bp, Homo sapiens
tgcccccatccagcc

SEQ ID NO: 955534 - DNA, 16 bp, Homo sapiens
tgcccccatccagcca

SEQ ID NO: 955535 - DNA, 20 bp, Homo sapiens
tgcccccatccagccacgga

SEQ ID NO: 955536 - DNA, 20 bp, Homo sapiens
tgcccccatctccccaggcc

SEQ ID NO: 955537 - DNA, 15 bp, Homo sapiens
tgccccccaccccag

SEQ ID NO: 955538 - DNA, 17 bp, Homo sapiens
tgccccccaccccagcc

SEQ ID NO: 955539 - DNA, 20 bp, Homo sapiens
tgccccccaccccagcctaa

SEQ ID NO: 955540 - DNA, 17 bp, Homo sapiens
tgccccccacccctgga

SEQ ID NO: 955541 - DNA, 15 bp, Homo sapiens
tgccccccagggcta

SEQ ID NO: 955542 - DNA, 17 bp, Homo sapiens
tgccccccgaggctgct

SEQ ID NO: 955543 - DNA, 22 bp, Homo sapiens
tgcccccctcaaacctcctctt

SEQ ID NO: 955544 - DNA, 13 bp, Homo sapiens
tgcccccctccca

SEQ ID NO: 955545 - DNA, 17 bp, Homo sapiens
tgcccccctcctccagt

SEQ ID NO: 955546 - DNA, 16 bp, Homo sapiens
tgcccccgcctgccac

SEQ ID NO: 955547 - DNA, 20 bp, Homo sapiens
tgcccccgcgggttctagac

SEQ ID NO: 955548 - DNA, 16 bp, Homo sapiens
tgccccctcctctccc

SEQ ID NO: 955549 - DNA, 20 bp, Homo sapiens
tgccccctcctctcccatcc

SEQ ID NO: 955550 - DNA, 21 bp, Homo sapiens
tgccccctcctctcccatccc

SEQ ID NO: 955551 - DNA, 19 bp, Homo sapiens
tgccccctcgggggcctgt

SEQ ID NO: 955552 - DNA, 13 bp, Homo sapiens
tgccccctgccag

SEQ ID NO: 955553 - DNA, 18 bp, Homo sapiens
tgccccctgccagtgaag

SEQ ID NO: 955554 - DNA, 18 bp, Homo sapiens
tgccccctgcttggccag

SEQ ID NO: 955555 - DNA, 12 bp, Homo sapiens
tgccccctgggc

SEQ ID NO: 955556 - DNA, 13 bp, Homo sapiens
tgccccctggtgg

SEQ ID NO: 955557 - DNA, 22 bp, Homo sapiens
tgccccctggtggacagtcctg

SEQ ID NO: 955558 - DNA, 15 bp, Homo sapiens
tgcccccttccccag

SEQ ID NO: 955559 - DNA, 21 bp, Homo sapiens
tgccccctttcagatgtcttc

SEQ ID NO: 955560 - DNA, 22 bp, Homo sapiens
tgccccctttcagatgtcttct

SEQ ID NO: 955561 - DNA, 21 bp, Homo sapiens
tgccccgagcccaggcagcta

SEQ ID NO: 955562 - DNA, 22 bp, Homo sapiens
tgccccgcccccagtccccacc

SEQ ID NO: 955563 - DNA, 19 bp, Homo sapiens
tgccccgccccccagagcc

SEQ ID NO: 955564 - DNA, 22 bp, Homo sapiens
tgccccgccccccagagccagg

SEQ ID NO: 955565 - DNA, 23 bp, Homo sapiens
tgccccgccccccagagccaggg

SEQ ID NO: 955566 - DNA, 15 bp, Homo sapiens
tgccccgcctccccg

SEQ ID NO: 955567 - DNA, 17 bp, Homo sapiens
tgccccgctttgcggac

SEQ ID NO: 955568 - DNA, 16 bp, Homo sapiens
tgccccggacctacct

SEQ ID NO: 955569 - DNA, 18 bp, Homo sapiens
tgccccggaggaagcttg

SEQ ID NO: 955570 - DNA, 21 bp, Homo sapiens
tgccccggccccggccccagc

SEQ ID NO: 955571 - DNA, 15 bp, Homo sapiens
tgccccggcctcctc

SEQ ID NO: 955572 - DNA, 20 bp, Homo sapiens
tgccccgtcaccatctcagg

SEQ ID NO: 955573 - DNA, 21 bp, Homo sapiens
tgccccgtcaccatctcaggc

SEQ ID NO: 955574 - DNA, 23 bp, Homo sapiens
tgccccgtcggactgcccccaga

SEQ ID NO: 955575 - DNA, 16 bp, Homo sapiens
tgccccgtgtgaatgt

SEQ ID NO: 955576 - DNA, 18 bp, Homo sapiens
tgccccgtgtgaatgtag

SEQ ID NO: 955577 - DNA, 19 bp, Homo sapiens
tgccccgttccctgtcaga

SEQ ID NO: 955578 - DNA, 19 bp, Homo sapiens
tgcccctaaagatgggagg

SEQ ID NO: 955579 - DNA, 22 bp, Homo sapiens
tgcccctaagttattacctctc

SEQ ID NO: 955580 - DNA, 17 bp, Homo sapiens
tgcccctaccctggact

SEQ ID NO: 955581 - DNA, 20 bp, Homo sapiens
tgcccctaggatgctgcagc

SEQ ID NO: 955582 - DNA, 22 bp, Homo sapiens
tgcccctcagggggccagctgg

SEQ ID NO: 955583 - DNA, 23 bp, Homo sapiens
tgcccctcagggggccagctggg

SEQ ID NO: 955584 - DNA, 21 bp, Homo sapiens
tgcccctcccccaacccccac

SEQ ID NO: 955585 - DNA, 22 bp, Homo sapiens
tgcccctcccccaacccccacc

SEQ ID NO: 955586 - DNA, 19 bp, Homo sapiens
tgcccctcccccagctgcg

SEQ ID NO: 955587 - DNA, 14 bp, Homo sapiens
tgcccctccctcag

SEQ ID NO: 955588 - DNA, 19 bp, Homo sapiens
tgcccctccctcagggagc

SEQ ID NO: 955589 - DNA, 18 bp, Homo sapiens
tgcccctcctggagcaga

SEQ ID NO: 955590 - DNA, 23 bp, Homo sapiens
tgcccctcctggagcagaaagtg

SEQ ID NO: 955591 - DNA, 20 bp, Homo sapiens
tgcccctcgcacacagggct

SEQ ID NO: 955592 - DNA, 22 bp, Homo sapiens
tgcccctcggggtgtcagaaat

SEQ ID NO: 955593 - DNA, 20 bp, Homo sapiens
tgcccctctccaggcgccgg

SEQ ID NO: 955594 - DNA, 12 bp, Homo sapiens
tgcccctctgtt

SEQ ID NO: 955595 - DNA, 18 bp, Homo sapiens
tgcccctctgttctctcc

SEQ ID NO: 955596 - DNA, 22 bp, Homo sapiens
tgcccctctttctctttcttcc

SEQ ID NO: 955597 - DNA, 12 bp, Homo sapiens
gggcagagccca

SEQ ID NO: 955598 - DNA, 13 bp, Homo sapiens
gggcagagcctgt

SEQ ID NO: 955599 - DNA, 16 bp, Homo sapiens
gggcagagctggctct

SEQ ID NO: 955600 - DNA, 14 bp, Homo sapiens
gggcagaggctgga

SEQ ID NO: 955601 - DNA, 21 bp, Homo sapiens
gggcagaggctggaggcaggg

SEQ ID NO: 955602 - DNA, 23 bp, Homo sapiens
gggcagaggctggaggcagggcc

SEQ ID NO: 955603 - DNA, 12 bp, Homo sapiens
gggcagagggaa

SEQ ID NO: 955604 - DNA, 22 bp, Homo sapiens
gggcagagggaatgttccctgc

SEQ ID NO: 955605 - DNA, 23 bp, Homo sapiens
gggcagagggaatgttccctgca

SEQ ID NO: 955606 - DNA, 14 bp, Homo sapiens
gggcagagggcaga

SEQ ID NO: 955607 - DNA, 22 bp, Homo sapiens
gggcagagggctggaggcccag

SEQ ID NO: 955608 - DNA, 18 bp, Homo sapiens
gggcagaggggcagccgc

SEQ ID NO: 955609 - DNA, 16 bp, Homo sapiens
gggcagatccccactg

SEQ ID NO: 955610 - DNA, 13 bp, Homo sapiens
gggcagcaccctc

SEQ ID NO: 955611 - DNA, 14 bp, Homo sapiens
gggcagcaccctcc

SEQ ID NO: 955612 - DNA, 18 bp, Homo sapiens
gggcagcaccctcccccg

SEQ ID NO: 955613 - DNA, 21 bp, Homo sapiens
gggcagcactgggaagctgga

SEQ ID NO: 955614 - DNA, 10 bp, Homo sapiens
gggcagcagc

SEQ ID NO: 955615 - DNA, 16 bp, Homo sapiens
gggcagcagcagccct

SEQ ID NO: 955616 - DNA, 18 bp, Homo sapiens
gggcagcagcatcccagc

SEQ ID NO: 955617 - DNA, 11 bp, Homo sapiens
gggcagcagcc

SEQ ID NO: 955618 - DNA, 14 bp, Homo sapiens
gggcagcagggcta

SEQ ID NO: 955619 - DNA, 13 bp, Homo sapiens
gggcagcagtggg

SEQ ID NO: 955620 - DNA, 16 bp, Homo sapiens
gggcagcagtggggtg

SEQ ID NO: 955621 - DNA, 17 bp, Homo sapiens
gggcagccaaacccatg

SEQ ID NO: 955622 - DNA, 15 bp, Homo sapiens
gggcagccacccaag

SEQ ID NO: 955623 - DNA, 23 bp, Homo sapiens
gggcagccacccaagcctgctgg

SEQ ID NO: 955624 - DNA, 11 bp, Homo sapiens
gggcagccagc

SEQ ID NO: 955625 - DNA, 12 bp, Homo sapiens
gggcagccagca

SEQ ID NO: 955626 - DNA, 13 bp, Homo sapiens
gggcagccagcag

SEQ ID NO: 955627 - DNA, 16 bp, Homo sapiens
gggcagccaggagtgc

SEQ ID NO: 955628 - DNA, 23 bp, Homo sapiens
gggcagccccgttttggggacgt

SEQ ID NO: 955629 - DNA, 14 bp, Homo sapiens
gggcagccctgagt

SEQ ID NO: 955630 - DNA, 17 bp, Homo sapiens
gggcagccgctaggaga

SEQ ID NO: 955631 - DNA, 22 bp, Homo sapiens
gggcagcctccaccttgctctt

SEQ ID NO: 955632 - DNA, 18 bp, Homo sapiens
gggcagctcctccctgtg

SEQ ID NO: 955633 - DNA, 14 bp, Homo sapiens
gggcagctgcctgg

SEQ ID NO: 955634 - DNA, 15 bp, Homo sapiens
gggcagctgcctggc

SEQ ID NO: 955635 - DNA, 17 bp, Homo sapiens
gggcagctgcctggcca

SEQ ID NO: 955636 - DNA, 13 bp, Homo sapiens
gggcagctgtgat

SEQ ID NO: 955637 - DNA, 19 bp, Homo sapiens
gggcagcttagggccctgg

SEQ ID NO: 955638 - DNA, 20 bp, Homo sapiens
gggcaggaaagccacatctt

SEQ ID NO: 955639 - DNA, 15 bp, Homo sapiens
gggcaggaaggggaa

SEQ ID NO: 955640 - DNA, 16 bp, Homo sapiens
gggcaggagtgccagg

SEQ ID NO: 955641 - DNA, 19 bp, Homo sapiens
gggcaggagtgccaggacc

SEQ ID NO: 955642 - DNA, 23 bp, Homo sapiens
gggcaggagtgccaggaccagcc

SEQ ID NO: 955643 - DNA, 18 bp, Homo sapiens
gggcaggatctcaagcca

SEQ ID NO: 955644 - DNA, 22 bp, Homo sapiens
gggcaggatctcaagccagccc

SEQ ID NO: 955645 - DNA, 17 bp, Homo sapiens
gggcaggcaagcccttc

SEQ ID NO: 955646 - DNA, 11 bp, Homo sapiens
gggcaggccag

SEQ ID NO: 955647 - DNA, 12 bp, Homo sapiens
gggcaggccagc

SEQ ID NO: 955648 - DNA, 12 bp, Homo sapiens
gggcaggcctgg

SEQ ID NO: 955649 - DNA, 21 bp, Homo sapiens
gggcaggcctgggacccagct

SEQ ID NO: 955650 - DNA, 19 bp, Homo sapiens
gggcaggcggtccccatcc

SEQ ID NO: 955651 - DNA, 15 bp, Homo sapiens
gggcaggctgggcca

SEQ ID NO: 955652 - DNA, 23 bp, Homo sapiens
gggcagggatgatggcagagcca

SEQ ID NO: 955653 - DNA, 20 bp, Homo sapiens
gggcagggcatctcctgtgc

SEQ ID NO: 955654 - DNA, 14 bp, Homo sapiens
gggcagggcccacg

SEQ ID NO: 955655 - DNA, 16 bp, Homo sapiens
tgccctagcccagact

SEQ ID NO: 955656 - DNA, 19 bp, Homo sapiens
tgccctagcccagactctg

SEQ ID NO: 955657 - DNA, 21 bp, Homo sapiens
tgccctagcccagactctgag

SEQ ID NO: 955658 - DNA, 12 bp, Homo sapiens
tgccctcacccc

SEQ ID NO: 955659 - DNA, 18 bp, Homo sapiens
tgccctcactccctctgc

SEQ ID NO: 955660 - DNA, 12 bp, Homo sapiens
tgccctcaggga

SEQ ID NO: 955661 - DNA, 23 bp, Homo sapiens
tgccctcatggcccctctgacct

SEQ ID NO: 955662 - DNA, 13 bp, Homo sapiens
tgccctccaaaga

SEQ ID NO: 955663 - DNA, 14 bp, Homo sapiens
tgccctccatcccg

SEQ ID NO: 955664 - DNA, 17 bp, Homo sapiens
tgccctcccaggaccct

SEQ ID NO: 955665 - DNA, 14 bp, Homo sapiens
tgccctcccctcag

SEQ ID NO: 955666 - DNA, 23 bp, Homo sapiens
tgccctccctcagccgtcagcca

SEQ ID NO: 955667 - DNA, 17 bp, Homo sapiens
tgccctccggaggagca

SEQ ID NO: 955668 - DNA, 12 bp, Homo sapiens
tgccctcctctc

SEQ ID NO: 955669 - DNA, 15 bp, Homo sapiens
tgccctcctctccca

SEQ ID NO: 955670 - DNA, 16 bp, Homo sapiens
tgccctcctctcccat

SEQ ID NO: 955671 - DNA, 14 bp, Homo sapiens
tgccctcctgccca

SEQ ID NO: 955672 - DNA, 15 bp, Homo sapiens
tgccctcctggacaa

SEQ ID NO: 955673 - DNA, 16 bp, Homo sapiens
tgccctcgtggccagc

SEQ ID NO: 955674 - DNA, 17 bp, Homo sapiens
tgccctcgtggccagcc

SEQ ID NO: 955675 - DNA, 19 bp, Homo sapiens
tgccctcgtggccagcccg

SEQ ID NO: 955676 - DNA, 20 bp, Homo sapiens
tgccctcgtggccagcccgg

SEQ ID NO: 955677 - DNA, 14 bp, Homo sapiens
tgccctctgctctg

SEQ ID NO: 955678 - DNA, 15 bp, Homo sapiens
tgccctctgctctgc

SEQ ID NO: 955679 - DNA, 18 bp, Homo sapiens
tgccctctgctctgcctg

SEQ ID NO: 955680 - DNA, 21 bp, Homo sapiens
tgccctctgctctgcctggag

SEQ ID NO: 955681 - DNA, 17 bp, Homo sapiens
tgccctctgctgctgcc

SEQ ID NO: 955682 - DNA, 20 bp, Homo sapiens
tgccctctgctgctgcccgg

SEQ ID NO: 955683 - DNA, 18 bp, Homo sapiens
tgccctcttaagatctga

SEQ ID NO: 955684 - DNA, 20 bp, Homo sapiens
tgccctcttctcgtgcctcc

SEQ ID NO: 955685 - DNA, 16 bp, Homo sapiens
tgccctgaaagggccc

SEQ ID NO: 955686 - DNA, 19 bp, Homo sapiens
tgccctgaccatgcatttt

SEQ ID NO: 955687 - DNA, 17 bp, Homo sapiens
tgccctgacctcccagc

SEQ ID NO: 955688 - DNA, 20 bp, Homo sapiens
tgccctgacctcccagccct

SEQ ID NO: 955689 - DNA, 11 bp, Homo sapiens
tgccctgagaa

SEQ ID NO: 955690 - DNA, 12 bp, Homo sapiens
tgccctgagggg

SEQ ID NO: 955691 - DNA, 15 bp, Homo sapiens
tgccctgaggggctg

SEQ ID NO: 955692 - DNA, 19 bp, Homo sapiens
tgccctgaggggctgggga

SEQ ID NO: 955693 - DNA, 23 bp, Homo sapiens
tgccctgagtggatctccaagga

SEQ ID NO: 955694 - DNA, 20 bp, Homo sapiens
tgccctgcaggcacagagga

SEQ ID NO: 955695 - DNA, 17 bp, Homo sapiens
tgccctgcatgctgccc

SEQ ID NO: 955696 - DNA, 12 bp, Homo sapiens
tgccctgccatt

SEQ ID NO: 955697 - DNA, 16 bp, Homo sapiens
tgccctgcccaagtga

SEQ ID NO: 955698 - DNA, 12 bp, Homo sapiens
tgccctgcccag

SEQ ID NO: 955699 - DNA, 13 bp, Homo sapiens
tgccctgccccca

SEQ ID NO: 955700 - DNA, 16 bp, Homo sapiens
tgccctgcccccacga

SEQ ID NO: 955701 - DNA, 15 bp, Homo sapiens
tgccctgcccttcct

SEQ ID NO: 955702 - DNA, 13 bp, Homo sapiens
tgccctgcctcag

SEQ ID NO: 955703 - DNA, 13 bp, Homo sapiens
tgccctgcctccc

SEQ ID NO: 955704 - DNA, 17 bp, Homo sapiens
tgccctgcctgagggcc

SEQ ID NO: 955705 - DNA, 12 bp, Homo sapiens
tgccctgcctgc

SEQ ID NO: 955706 - DNA, 17 bp, Homo sapiens
tgccctgcctgcccact

SEQ ID NO: 955707 - DNA, 11 bp, Homo sapiens
tgccctgcctt

SEQ ID NO: 955708 - DNA, 13 bp, Homo sapiens
tgccctgccttgc

SEQ ID NO: 955709 - DNA, 23 bp, Homo sapiens
tgccctgcgaagtggctctcagg

SEQ ID NO: 955710 - DNA, 23 bp, Homo sapiens
tgccctgctgagtcccaggctga

SEQ ID NO: 955711 - DNA, 20 bp, Homo sapiens
tgccctgctggcctgtctcc

SEQ ID NO: 955712 - DNA, 16 bp, Homo sapiens
tgccctggcagcagca

SEQ ID NO: 955713 - DNA, 18 bp, Homo sapiens
tgccctggcagcagcagg

SEQ ID NO: 955714 - DNA, 23 bp, Homo sapiens
tgccctggcagggtcatcctgtg

SEQ ID NO: 955715 - DNA, 18 bp, Homo sapiens
tgccctggctccttgcag

SEQ ID NO: 955716 - DNA, 16 bp, Homo sapiens
tgccctggctgctgcc

SEQ ID NO: 955717 - DNA, 17 bp, Homo sapiens
tgccctggctgctgccc

SEQ ID NO: 955718 - DNA, 19 bp, Homo sapiens
tgccctgggatgcctcacc

SEQ ID NO: 955719 - DNA, 13 bp, Homo sapiens
tgccctgggccac

SEQ ID NO: 955720 - DNA, 22 bp, Homo sapiens
gggccaaacccacttctggcct

SEQ ID NO: 955721 - DNA, 13 bp, Homo sapiens
gggccaagaaaga

SEQ ID NO: 955722 - DNA, 19 bp, Homo sapiens
gggccaataccctactgtg

SEQ ID NO: 955723 - DNA, 15 bp, Homo sapiens
gggccacacagaaac

SEQ ID NO: 955724 - DNA, 18 bp, Homo sapiens
gggccacacccaggaagg

SEQ ID NO: 955725 - DNA, 19 bp, Homo sapiens
gggccacatgggaggctca

SEQ ID NO: 955726 - DNA, 22 bp, Homo sapiens
gggccaccccgtgcccctgtgc

SEQ ID NO: 955727 - DNA, 20 bp, Homo sapiens
gggccaccgcccagctcatg

SEQ ID NO: 955728 - DNA, 22 bp, Homo sapiens
gggccacctcctaccccttcct

SEQ ID NO: 955729 - DNA, 14 bp, Homo sapiens
gggccacctgcagg

SEQ ID NO: 955730 - DNA, 22 bp, Homo sapiens
gggccacgccccagcccgacaa

SEQ ID NO: 955731 - DNA, 18 bp, Homo sapiens
gggccacgtgccaggccc

SEQ ID NO: 955732 - DNA, 18 bp, Homo sapiens
gggccactctcccctccc

SEQ ID NO: 955733 - DNA, 13 bp, Homo sapiens
gggccactgggga

SEQ ID NO: 955734 - DNA, 22 bp, Homo sapiens
gggccactggggactttattta

SEQ ID NO: 955735 - DNA, 22 bp, Homo sapiens
gggccagaaggagggcagagcc

SEQ ID NO: 955736 - DNA, 16 bp, Homo sapiens
gggccagagagcaggg

SEQ ID NO: 955737 - DNA, 22 bp, Homo sapiens
gggccagaggaactgtccagag

SEQ ID NO: 955738 - DNA, 23 bp, Homo sapiens
gggccagaggaactgtccagaga

SEQ ID NO: 955739 - DNA, 16 bp, Homo sapiens
gggccagaggctggga

SEQ ID NO: 955740 - DNA, 19 bp, Homo sapiens
gggccagaggctgggagtc

SEQ ID NO: 955741 - DNA, 15 bp, Homo sapiens
gggccagcagagggc

SEQ ID NO: 955742 - DNA, 12 bp, Homo sapiens
gggccagcaggc

SEQ ID NO: 955743 - DNA, 18 bp, Homo sapiens
gggccagcatagggggga

SEQ ID NO: 955744 - DNA, 19 bp, Homo sapiens
gggccagcataggggggag

SEQ ID NO: 955745 - DNA, 12 bp, Homo sapiens
gggccagccagg

SEQ ID NO: 955746 - DNA, 14 bp, Homo sapiens
gggccagccaggcg

SEQ ID NO: 955747 - DNA, 22 bp, Homo sapiens
gggccagccaggcgggctcaag

SEQ ID NO: 955748 - DNA, 19 bp, Homo sapiens
gggccagccctgcagccca

SEQ ID NO: 955749 - DNA, 22 bp, Homo sapiens
gggccagcggggctgctcaccc

SEQ ID NO: 955750 - DNA, 14 bp, Homo sapiens
gggccagctgggga

SEQ ID NO: 955751 - DNA, 16 bp, Homo sapiens
gggccagctggggaga

SEQ ID NO: 955752 - DNA, 12 bp, Homo sapiens
gggccaggcaga

SEQ ID NO: 955753 - DNA, 13 bp, Homo sapiens
gggccaggcagaa

SEQ ID NO: 955754 - DNA, 13 bp, Homo sapiens
gggccaggcaggt

SEQ ID NO: 955755 - DNA, 14 bp, Homo sapiens
gggccagggaggca

SEQ ID NO: 955756 - DNA, 23 bp, Homo sapiens
gggccagggaggcagagcgggag

SEQ ID NO: 955757 - DNA, 14 bp, Homo sapiens
gggccagggcaatg

SEQ ID NO: 955758 - DNA, 17 bp, Homo sapiens
gggccagggcaatgcca

SEQ ID NO: 955759 - DNA, 18 bp, Homo sapiens
gggccagggccctgcaga

SEQ ID NO: 955760 - DNA, 19 bp, Homo sapiens
gggccaggggcaggcaggg

SEQ ID NO: 955761 - DNA, 10 bp, Homo sapiens
gggccagggt

SEQ ID NO: 955762 - DNA, 18 bp, Homo sapiens
gggccagggtctgtgtga

SEQ ID NO: 955763 - DNA, 12 bp, Homo sapiens
gggccagggtgg

SEQ ID NO: 955764 - DNA, 12 bp, Homo sapiens
gggccaggtgcg

SEQ ID NO: 955765 - DNA, 21 bp, Homo sapiens
gggccaggtgcggcctggggg

SEQ ID NO: 955766 - DNA, 13 bp, Homo sapiens
gggccagtcctcc

SEQ ID NO: 955767 - DNA, 15 bp, Homo sapiens
gggccagtcctgcct

SEQ ID NO: 955768 - DNA, 18 bp, Homo sapiens
gggccagtcctgcctggc

SEQ ID NO: 955769 - DNA, 20 bp, Homo sapiens
gggccagtcctgcctggcca

SEQ ID NO: 955770 - DNA, 20 bp, Homo sapiens
gggccagtctgggctgccgg

SEQ ID NO: 955771 - DNA, 17 bp, Homo sapiens
gggccagtgagggctgg

SEQ ID NO: 955772 - DNA, 21 bp, Homo sapiens
gggccagtggattcccacagc

SEQ ID NO: 955773 - DNA, 23 bp, Homo sapiens
gggccatctcttaggtgagacag

SEQ ID NO: 955774 - DNA, 12 bp, Homo sapiens
gggccatgcccc

SEQ ID NO: 955775 - DNA, 13 bp, Homo sapiens
gggccatgcctcc

SEQ ID NO: 955776 - DNA, 23 bp, Homo sapiens
gggccatgcctcctcaggagccg

SEQ ID NO: 955777 - DNA, 23 bp, Homo sapiens
gggccatgcgaggggccagcaga

SEQ ID NO: 955778 - DNA, 15 bp, Homo sapiens
gggccatgctgaagg

SEQ ID NO: 955779 - DNA, 14 bp, Homo sapiens
gggccatgctgagg

SEQ ID NO: 955780 - DNA, 17 bp, Homo sapiens
gggccatgctgaggcct

SEQ ID NO: 955781 - DNA, 21 bp, Homo sapiens
gggccatgctgaggcctgggc

SEQ ID NO: 955782 - DNA, 23 bp, Homo sapiens
gggccatgctgaggcctgggccg

SEQ ID NO: 955783 - DNA, 18 bp, Homo sapiens
gggccatggtggagggca

SEQ ID NO: 955784 - DNA, 17 bp, Homo sapiens
gggccatgtcagacaca

SEQ ID NO: 955785 - DNA, 13 bp, Homo sapiens
gggcccaaaggcc

SEQ ID NO: 955786 - DNA, 19 bp, Homo sapiens
gggcccaagacagatgccc

SEQ ID NO: 955787 - DNA, 20 bp, Homo sapiens
gggcccaagtccctgttttc

SEQ ID NO: 955788 - DNA, 12 bp, Homo sapiens
gggcccaagtgg

SEQ ID NO: 955789 - DNA, 23 bp, Homo sapiens
gggcccaagttgcagtgagcagg

SEQ ID NO: 955790 - DNA, 14 bp, Homo sapiens
gggcccacagagcc

SEQ ID NO: 955791 - DNA, 20 bp, Homo sapiens
gggcccacagagcctggctt

SEQ ID NO: 955792 - DNA, 16 bp, Homo sapiens
gggcccacctggccac

SEQ ID NO: 955793 - DNA, 22 bp, Homo sapiens
gggcccacctggccacctgagg

SEQ ID NO: 955794 - DNA, 20 bp, Homo sapiens
gggcccaccttggaccctgg

SEQ ID NO: 955795 - DNA, 19 bp, Homo sapiens
gggcccacgtggttggggc

SEQ ID NO: 955796 - DNA, 13 bp, Homo sapiens
gggcccacttggg

SEQ ID NO: 955797 - DNA, 22 bp, Homo sapiens
gggcccagaactgcccccactg

SEQ ID NO: 955798 - DNA, 12 bp, Homo sapiens
gggcccagagcc

SEQ ID NO: 955799 - DNA, 12 bp, Homo sapiens
gggcccagagtg

SEQ ID NO: 955800 - DNA, 12 bp, Homo sapiens
gggcccagccca

SEQ ID NO: 955801 - DNA, 16 bp, Homo sapiens
gggcccagcccagagc

SEQ ID NO: 955802 - DNA, 17 bp, Homo sapiens
gggcccagcccagagcc

SEQ ID NO: 955803 - DNA, 17 bp, Homo sapiens
gggcccagcctcctctg

SEQ ID NO: 955804 - DNA, 12 bp, Homo sapiens
gggcccagctgg

SEQ ID NO: 955805 - DNA, 15 bp, Homo sapiens
gggcccagctgggct

SEQ ID NO: 955806 - DNA, 12 bp, Homo sapiens
gggcccagctgt

SEQ ID NO: 955807 - DNA, 14 bp, Homo sapiens
gggcccaggaccag

SEQ ID NO: 955808 - DNA, 18 bp, Homo sapiens
gggcccaggaccagctgg

SEQ ID NO: 955809 - DNA, 24 bp, Homo sapiens
gggcccaggaccagctggggcgtg

SEQ ID NO: 955810 - DNA, 15 bp, Homo sapiens
gggcccaggccatgt

SEQ ID NO: 955811 - DNA, 13 bp, Homo sapiens
gggcccaggcctg

SEQ ID NO: 955812 - DNA, 15 bp, Homo sapiens
gggcccaggcctgga

SEQ ID NO: 955813 - DNA, 18 bp, Homo sapiens
gggcccaggcctggagcg

SEQ ID NO: 955814 - DNA, 11 bp, Homo sapiens
gggcccaggga

SEQ ID NO: 955815 - DNA, 13 bp, Homo sapiens
gggcccatctctt

SEQ ID NO: 955816 - DNA, 21 bp, Homo sapiens
gggcccatgaagaaagcccct

SEQ ID NO: 955817 - DNA, 22 bp, Homo sapiens
gggccccaaacgggctgccctg

SEQ ID NO: 955818 - DNA, 18 bp, Homo sapiens
gggccccagaaggcaggg

SEQ ID NO: 955819 - DNA, 21 bp, Homo sapiens
gggccccagaccccagggcag

SEQ ID NO: 955820 - DNA, 13 bp, Homo sapiens
gggccccagatct

SEQ ID NO: 955821 - DNA, 14 bp, Homo sapiens
gggccccagatctg

SEQ ID NO: 955822 - DNA, 20 bp, Homo sapiens
gggccccagcgtctgcaggg

SEQ ID NO: 955823 - DNA, 22 bp, Homo sapiens
gggccccaggcccgcgggcaca

SEQ ID NO: 955824 - DNA, 13 bp, Homo sapiens
gggccccaggggc

SEQ ID NO: 955825 - DNA, 15 bp, Homo sapiens
gggccccaggggcag

SEQ ID NO: 955826 - DNA, 17 bp, Homo sapiens
gggccccaggggcagca

SEQ ID NO: 955827 - DNA, 21 bp, Homo sapiens
gggccccaggggcagcaaggc

SEQ ID NO: 955828 - DNA, 23 bp, Homo sapiens
gggccccatcttgatctttgagc

SEQ ID NO: 955829 - DNA, 18 bp, Homo sapiens
gggccccatgctctgccc

SEQ ID NO: 955830 - DNA, 17 bp, Homo sapiens
gggcccccagcctggcc

SEQ ID NO: 955831 - DNA, 23 bp, Homo sapiens
gggcccccagcgagagtccctgc

SEQ ID NO: 955832 - DNA, 21 bp, Homo sapiens
gggcccccctgaaccgcaccc

SEQ ID NO: 955833 - DNA, 15 bp, Homo sapiens
gggcccccgccccgc

SEQ ID NO: 955834 - DNA, 16 bp, Homo sapiens
gggccccgccagggct

SEQ ID NO: 955835 - DNA, 21 bp, Homo sapiens
gggccccggggctggcaagca

SEQ ID NO: 955836 - DNA, 17 bp, Homo sapiens
gggcccctcaccctgcc

SEQ ID NO: 955837 - DNA, 19 bp, Homo sapiens
gggcccctcaccctgcctt

SEQ ID NO: 955838 - DNA, 14 bp, Homo sapiens
gggcccctccacgc

SEQ ID NO: 955839 - DNA, 17 bp, Homo sapiens
gggcccctccacgcctc

SEQ ID NO: 955840 - DNA, 14 bp, Homo sapiens
gggcccctcccctc

SEQ ID NO: 955841 - DNA, 17 bp, Homo sapiens
gggcccctcccctcaga

SEQ ID NO: 955842 - DNA, 15 bp, Homo sapiens
tgcctcatgccacac

SEQ ID NO: 955843 - DNA, 14 bp, Homo sapiens
tgcctccaccacca

SEQ ID NO: 955844 - DNA, 18 bp, Homo sapiens
tgcctccacccgtcctcc

SEQ ID NO: 955845 - DNA, 17 bp, Homo sapiens
tgcctccaggaaccaca

SEQ ID NO: 955846 - DNA, 19 bp, Homo sapiens
tgcctccaggaaccacacc

SEQ ID NO: 955847 - DNA, 19 bp, Homo sapiens
tgcctcccaaggtcctctc

SEQ ID NO: 955848 - DNA, 13 bp, Homo sapiens
tgcctcccacact

SEQ ID NO: 955849 - DNA, 18 bp, Homo sapiens
tgcctcccacacttgctg

SEQ ID NO: 955850 - DNA, 13 bp, Homo sapiens
tgcctcccatgcc

SEQ ID NO: 955851 - DNA, 16 bp, Homo sapiens
tgcctcccatgcctgg

SEQ ID NO: 955852 - DNA, 20 bp, Homo sapiens
tgcctcccatgcctggtccc

SEQ ID NO: 955853 - DNA, 19 bp, Homo sapiens
tgcctccccaaccctgccc

SEQ ID NO: 955854 - DNA, 20 bp, Homo sapiens
tgcctccccaaccctgcccc

SEQ ID NO: 955855 - DNA, 22 bp, Homo sapiens
tgcctccccatttcccatctgc

SEQ ID NO: 955856 - DNA, 23 bp, Homo sapiens
tgcctccccatttcccatctgca

SEQ ID NO: 955857 - DNA, 15 bp, Homo sapiens
tgcctcccccgaatg

SEQ ID NO: 955858 - DNA, 21 bp, Homo sapiens
tgcctcccccgcctccagtca

SEQ ID NO: 955859 - DNA, 21 bp, Homo sapiens
tgcctccctcaccctgagccc

SEQ ID NO: 955860 - DNA, 14 bp, Homo sapiens
tgcctccctctcca

SEQ ID NO: 955861 - DNA, 18 bp, Homo sapiens
tgcctccctgggccacct

SEQ ID NO: 955862 - DNA, 20 bp, Homo sapiens
tgcctccctgggccacctcc

SEQ ID NO: 955863 - DNA, 21 bp, Homo sapiens
tgcctccctgggccacctcct

SEQ ID NO: 955864 - DNA, 22 bp, Homo sapiens
tgcctccctgggccacctccta

SEQ ID NO: 955865 - DNA, 23 bp, Homo sapiens
tgcctcccttcccagtgggctgt

SEQ ID NO: 955866 - DNA, 19 bp, Homo sapiens
tgcctcccttgtggcagca

SEQ ID NO: 955867 - DNA, 16 bp, Homo sapiens
tgcctcctaggctgga

SEQ ID NO: 955868 - DNA, 21 bp, Homo sapiens
tgcctcctaggctggaagcca

SEQ ID NO: 955869 - DNA, 12 bp, Homo sapiens
tgcctcctcacc

SEQ ID NO: 955870 - DNA, 12 bp, Homo sapiens
tgcctcctcagg

SEQ ID NO: 955871 - DNA, 13 bp, Homo sapiens
tgcctcctcagga

SEQ ID NO: 955872 - DNA, 11 bp, Homo sapiens
tgcctcctcat

SEQ ID NO: 955873 - DNA, 15 bp, Homo sapiens
tgcctcctcccatcc

SEQ ID NO: 955874 - DNA, 16 bp, Homo sapiens
tgcctcctctcctcct

SEQ ID NO: 955875 - DNA, 12 bp, Homo sapiens
tgcctcctgcag

SEQ ID NO: 955876 - DNA, 17 bp, Homo sapiens
tgcctcctgccacccct

SEQ ID NO: 955877 - DNA, 20 bp, Homo sapiens
tgcctcctgccaccccttcc

SEQ ID NO: 955878 - DNA, 11 bp, Homo sapiens
tgcctcctgga

SEQ ID NO: 955879 - DNA, 19 bp, Homo sapiens
tgcctcctggtctcttcac

SEQ ID NO: 955880 - DNA, 22 bp, Homo sapiens
tgcctcctggtttcctttctca

SEQ ID NO: 955881 - DNA, 10 bp, Homo sapiens
tgcctcctgt

SEQ ID NO: 955882 - DNA, 13 bp, Homo sapiens
tgcctcctgtgta

SEQ ID NO: 955883 - DNA, 21 bp, Homo sapiens
tgcctcctgttttctccctct

SEQ ID NO: 955884 - DNA, 17 bp, Homo sapiens
tgcctccttccacctcc

SEQ ID NO: 955885 - DNA, 23 bp, Homo sapiens
tgcctcgacacgtgggctcccct

SEQ ID NO: 955886 - DNA, 17 bp, Homo sapiens
tgcctcgaggcaccggc

SEQ ID NO: 955887 - DNA, 23 bp, Homo sapiens
tgcctcgaggcaccggcgctgca

SEQ ID NO: 955888 - DNA, 15 bp, Homo sapiens
tgcctcgagggccgc

SEQ ID NO: 955889 - DNA, 19 bp, Homo sapiens
tgcctcgcatcctatgctt

SEQ ID NO: 955890 - DNA, 22 bp, Homo sapiens
tgcctcgctcaccgctggccct

SEQ ID NO: 955891 - DNA, 17 bp, Homo sapiens
tgcctcggactccatgg

SEQ ID NO: 955892 - DNA, 20 bp, Homo sapiens
tgcctcggcctcccaaagtg

SEQ ID NO: 955893 - DNA, 16 bp, Homo sapiens
tgcctcggctcacaaa

SEQ ID NO: 955894 - DNA, 16 bp, Homo sapiens
tgcctctatgccctgc

SEQ ID NO: 955895 - DNA, 22 bp, Homo sapiens
tgcctctatgccctgcagagca

SEQ ID NO: 955896 - DNA, 22 bp, Homo sapiens
tgcctctcaactgccctaagtc

SEQ ID NO: 955897 - DNA, 21 bp, Homo sapiens
tgcctctcccaggctgtcccc

SEQ ID NO: 955898 - DNA, 13 bp, Homo sapiens
tgcctctccctct

SEQ ID NO: 955899 - DNA, 15 bp, Homo sapiens
tgcctctccctctgg

SEQ ID NO: 955900 - DNA, 15 bp, Homo sapiens
tgcctctccctgggt

SEQ ID NO: 955901 - DNA, 13 bp, Homo sapiens
tgcctctcttgcc

SEQ ID NO: 955902 - DNA, 13 bp, Homo sapiens
tgcctctctttga

SEQ ID NO: 955903 - DNA, 19 bp, Homo sapiens
tgcctctgacagcagcctg

SEQ ID NO: 955904 - DNA, 20 bp, Homo sapiens
tgcctctgacagcagcctgt

SEQ ID NO: 955905 - DNA, 20 bp, Homo sapiens
tgcctctgacagtccacagg

SEQ ID NO: 955906 - DNA, 22 bp, Homo sapiens
tgcctctgacagtccacagggg

SEQ ID NO: 955907 - DNA, 16 bp, Homo sapiens
tgcctctgaccccagc

SEQ ID NO: 955908 - DNA, 17 bp, Homo sapiens
tgcctctgaccccagca

SEQ ID NO: 955909 - DNA, 23 bp, Homo sapiens
tgcctctgagttttgatgctgta

SEQ ID NO: 955910 - DNA, 21 bp, Homo sapiens
tgcctctgccaaaggatgtga

SEQ ID NO: 955911 - DNA, 22 bp, Homo sapiens
tgcctctgccaaaggatgtgat

SEQ ID NO: 955912 - DNA, 22 bp, Homo sapiens
gggcctagatccacacacagag

SEQ ID NO: 955913 - DNA, 23 bp, Homo sapiens
gggcctagcgatctctcctggcc

SEQ ID NO: 955914 - DNA, 19 bp, Homo sapiens
gggcctcaaaggcccgctc

SEQ ID NO: 955915 - DNA, 20 bp, Homo sapiens
gggcctcaaaggcccgctct

SEQ ID NO: 955916 - DNA, 20 bp, Homo sapiens
gggcctcaccgagtgggggc

SEQ ID NO: 955917 - DNA, 16 bp, Homo sapiens
gggcctcacctgcccc

SEQ ID NO: 955918 - DNA, 22 bp, Homo sapiens
gggcctcagaccccctcagcct

SEQ ID NO: 955919 - DNA, 16 bp, Homo sapiens
gggcctcagggtcctg

SEQ ID NO: 955920 - DNA, 21 bp, Homo sapiens
gggcctcagtgtgcccatctg

SEQ ID NO: 955921 - DNA, 19 bp, Homo sapiens
gggcctccagaagctgctc

SEQ ID NO: 955922 - DNA, 18 bp, Homo sapiens
gggcctccatgccccagc

SEQ ID NO: 955923 - DNA, 23 bp, Homo sapiens
gggcctccatgccccagctctgg

SEQ ID NO: 955924 - DNA, 16 bp, Homo sapiens
gggcctcccctgggca

SEQ ID NO: 955925 - DNA, 18 bp, Homo sapiens
gggcctcccggggcccag

SEQ ID NO: 955926 - DNA, 19 bp, Homo sapiens
gggcctccctccgagtgag

SEQ ID NO: 955927 - DNA, 19 bp, Homo sapiens
gggcctccctggcactgaa

SEQ ID NO: 955928 - DNA, 18 bp, Homo sapiens
gggcctcctgggggacct

SEQ ID NO: 955929 - DNA, 18 bp, Homo sapiens
gggcctccttcccatgcc

SEQ ID NO: 955930 - DNA, 15 bp, Homo sapiens
gggcctcggagcctc

SEQ ID NO: 955931 - DNA, 14 bp, Homo sapiens
gggcctcgggacct

SEQ ID NO: 955932 - DNA, 19 bp, Homo sapiens
gggcctctctcctgcctgc

SEQ ID NO: 955933 - DNA, 16 bp, Homo sapiens
gggcctctctggggga

SEQ ID NO: 955934 - DNA, 19 bp, Homo sapiens
gggcctctttttgcccttt

SEQ ID NO: 955935 - DNA, 15 bp, Homo sapiens
gggcctgacaccccc

SEQ ID NO: 955936 - DNA, 17 bp, Homo sapiens
gggcctgactgctcaga

SEQ ID NO: 955937 - DNA, 15 bp, Homo sapiens
gggcctgacttgagc

SEQ ID NO: 955938 - DNA, 20 bp, Homo sapiens
gggcctgacttgagccactc

SEQ ID NO: 955939 - DNA, 22 bp, Homo sapiens
gggcctgacttgagccactcct

SEQ ID NO: 955940 - DNA, 15 bp, Homo sapiens
gggcctgcatggaga

SEQ ID NO: 955941 - DNA, 20 bp, Homo sapiens
gggcctgcatgggggcaccg

SEQ ID NO: 955942 - DNA, 11 bp, Homo sapiens
gggcctgcccc

SEQ ID NO: 955943 - DNA, 13 bp, Homo sapiens
gggcctgcctggc

SEQ ID NO: 955944 - DNA, 16 bp, Homo sapiens
gggcctgcgcccagag

SEQ ID NO: 955945 - DNA, 18 bp, Homo sapiens
gggcctgcgcccagagct

SEQ ID NO: 955946 - DNA, 12 bp, Homo sapiens
gggcctgctgcg

SEQ ID NO: 955947 - DNA, 13 bp, Homo sapiens
gggcctgctggag

SEQ ID NO: 955948 - DNA, 21 bp, Homo sapiens
gggcctgctggaggcctcagg

SEQ ID NO: 955949 - DNA, 14 bp, Homo sapiens
gggcctgctggagt

SEQ ID NO: 955950 - DNA, 15 bp, Homo sapiens
gggcctgctggagtt

SEQ ID NO: 955951 - DNA, 20 bp, Homo sapiens
gggcctggacaaggtctctt

SEQ ID NO: 955952 - DNA, 21 bp, Homo sapiens
gggcctggacctatgcaggga

SEQ ID NO: 955953 - DNA, 23 bp, Homo sapiens
gggcctggacctatgcagggagg

SEQ ID NO: 955954 - DNA, 16 bp, Homo sapiens
gggcctggacctgcct

SEQ ID NO: 955955 - DNA, 21 bp, Homo sapiens
gggcctggagatcctcctgca

SEQ ID NO: 955956 - DNA, 21 bp, Homo sapiens
gggcctggccagtcctggtcc

SEQ ID NO: 955957 - DNA, 23 bp, Homo sapiens
gggcctggccagtcctggtcctg

SEQ ID NO: 955958 - DNA, 18 bp, Homo sapiens
gggcctggcccaaagcag

SEQ ID NO: 955959 - DNA, 17 bp, Homo sapiens
gggcctggcctgagctg

SEQ ID NO: 955960 - DNA, 20 bp, Homo sapiens
gggcctggcttgctccaggg

SEQ ID NO: 955961 - DNA, 21 bp, Homo sapiens
gggcctggcttgctccagggt

SEQ ID NO: 955962 - DNA, 23 bp, Homo sapiens
gggcctggcttgctccagggtct

SEQ ID NO: 955963 - DNA, 20 bp, Homo sapiens
tgcctgcactccctggcctt

SEQ ID NO: 955964 - DNA, 18 bp, Homo sapiens
tgcctgcactgggaagga

SEQ ID NO: 955965 - DNA, 19 bp, Homo sapiens
tgcctgcactgggaaggaa

SEQ ID NO: 955966 - DNA, 19 bp, Homo sapiens
tgcctgcagaggtctgtgc

SEQ ID NO: 955967 - DNA, 17 bp, Homo sapiens
tgcctgcagcacatgcg

SEQ ID NO: 955968 - DNA, 15 bp, Homo sapiens
tgcctgcaggggagc

SEQ ID NO: 955969 - DNA, 23 bp, Homo sapiens
tgcctgcaggtcagttgtaataa

SEQ ID NO: 955970 - DNA, 12 bp, Homo sapiens
tgcctgcagttt

SEQ ID NO: 955971 - DNA, 22 bp, Homo sapiens
tgcctgcagtttcttgtgtaga

SEQ ID NO: 955972 - DNA, 14 bp, Homo sapiens
tgcctgccaaagta

SEQ ID NO: 955973 - DNA, 17 bp, Homo sapiens
tgcctgccaaagtagtc

SEQ ID NO: 955974 - DNA, 21 bp, Homo sapiens
tgcctgccaaagtagtcctgg

SEQ ID NO: 955975 - DNA, 13 bp, Homo sapiens
tgcctgccactct

SEQ ID NO: 955976 - DNA, 14 bp, Homo sapiens
tgcctgccactctc

SEQ ID NO: 955977 - DNA, 19 bp, Homo sapiens
tgcctgccactctctggga

SEQ ID NO: 955978 - DNA, 21 bp, Homo sapiens
tgcctgccactctctgggact

SEQ ID NO: 955979 - DNA, 21 bp, Homo sapiens
tgcctgccatgtacctcccct

SEQ ID NO: 955980 - DNA, 23 bp, Homo sapiens
tgcctgccatgtacctcccctgc

SEQ ID NO: 955981 - DNA, 15 bp, Homo sapiens
tgcctgccccaccca

SEQ ID NO: 955982 - DNA, 18 bp, Homo sapiens
tgcctgcccccctcatct

SEQ ID NO: 955983 - DNA, 16 bp, Homo sapiens
tgcctgccctctgtct

SEQ ID NO: 955984 - DNA, 23 bp, Homo sapiens
tgcctgccctgcctcagccaggc

SEQ ID NO: 955985 - DNA, 13 bp, Homo sapiens
tgcctgccctgga

SEQ ID NO: 955986 - DNA, 13 bp, Homo sapiens
tgcctgcctccac

SEQ ID NO: 955987 - DNA, 20 bp, Homo sapiens
tgcctgcctcctaggctgga

SEQ ID NO: 955988 - DNA, 15 bp, Homo sapiens
tgcctgcctcctccc

SEQ ID NO: 955989 - DNA, 17 bp, Homo sapiens
tgcctgcctcctccctc

SEQ ID NO: 955990 - DNA, 14 bp, Homo sapiens
tgcctgcctgtctg

SEQ ID NO: 955991 - DNA, 18 bp, Homo sapiens
tgcctgcgcctgctgcct

SEQ ID NO: 955992 - DNA, 20 bp, Homo sapiens
tgcctgcgcctgctgcctgc

SEQ ID NO: 955993 - DNA, 13 bp, Homo sapiens
tgcctgcgtcttc

SEQ ID NO: 955994 - DNA, 13 bp, Homo sapiens
tgcctgctagagc

SEQ ID NO: 955995 - DNA, 18 bp, Homo sapiens
tgcctgctagagcaaccc

SEQ ID NO: 955996 - DNA, 13 bp, Homo sapiens
tgcctgctcagca

SEQ ID NO: 955997 - DNA, 15 bp, Homo sapiens
tgcctgctgagatga

SEQ ID NO: 955998 - DNA, 20 bp, Homo sapiens
tgcctgctgttggtcctctc

SEQ ID NO: 955999 - DNA, 14 bp, Homo sapiens
tgcctgctttgaat

SEQ ID NO: 956000 - DNA, 19 bp, Homo sapiens
tgcctggagacaaggtgct

SEQ ID NO: 956001 - DNA, 22 bp, Homo sapiens
tgcctggagacaaggtgctaac

SEQ ID NO: 956002 - DNA, 18 bp, Homo sapiens
tgcctggagacgtggaac

SEQ ID NO: 956003 - DNA, 22 bp, Homo sapiens
tgcctggagggtaactgggggg

SEQ ID NO: 956004 - DNA, 21 bp, Homo sapiens
tgcctggcacagaccaggcct

SEQ ID NO: 956005 - DNA, 15 bp, Homo sapiens
tgcctggcaggctgt

SEQ ID NO: 956006 - DNA, 18 bp, Homo sapiens
tgcctggccactgctccc

SEQ ID NO: 956007 - DNA, 13 bp, Homo sapiens
tgcctggccagat

SEQ ID NO: 956008 - DNA, 12 bp, Homo sapiens
tgcctggccagg

SEQ ID NO: 956009 - DNA, 20 bp, Homo sapiens
tgcctggccaggcagatctg

SEQ ID NO: 956010 - DNA, 15 bp, Homo sapiens
tgcctggccatgctg

SEQ ID NO: 956011 - DNA, 20 bp, Homo sapiens
tgcctggccatgctgtccct

SEQ ID NO: 956012 - DNA, 13 bp, Homo sapiens
tgcctggccccag

SEQ ID NO: 956013 - DNA, 21 bp, Homo sapiens
tgcctggccccagcctgggcc

SEQ ID NO: 956014 - DNA, 22 bp, Homo sapiens
tgcctggccttgtcctcagcca

SEQ ID NO: 956015 - DNA, 19 bp, Homo sapiens
tgcctggctgtggaggcct

SEQ ID NO: 956016 - DNA, 21 bp, Homo sapiens
tgcctggctgtggaggcctga

SEQ ID NO: 956017 - DNA, 14 bp, Homo sapiens
tgcctgggaagccc

SEQ ID NO: 956018 - DNA, 19 bp, Homo sapiens
tgcctgggaagcccaccca

SEQ ID NO: 956019 - DNA, 16 bp, Homo sapiens
tgcctgggaatgtatt

SEQ ID NO: 956020 - DNA, 21 bp, Homo sapiens
tgcctgggccatgcgaggggc

SEQ ID NO: 956021 - DNA, 18 bp, Homo sapiens
tgcctgggcccctcccct

SEQ ID NO: 956022 - DNA, 14 bp, Homo sapiens
tgcctgggcccgga

SEQ ID NO: 956023 - DNA, 17 bp, Homo sapiens
tgcctgggccctgggct

SEQ ID NO: 956024 - DNA, 19 bp, Homo sapiens
tgcctgggccctgggctga

SEQ ID NO: 956025 - DNA, 12 bp, Homo sapiens
tgcctgggcctg

SEQ ID NO: 956026 - DNA, 22 bp, Homo sapiens
tgcctgggcctgtgcagcagcc

SEQ ID NO: 956027 - DNA, 23 bp, Homo sapiens
tgcctgggcctgtgcagcagccc

SEQ ID NO: 956028 - DNA, 17 bp, Homo sapiens
tgcctgggccttggctg

SEQ ID NO: 956029 - DNA, 20 bp, Homo sapiens
tgcctgggccttggctgggc

SEQ ID NO: 956030 - DNA, 18 bp, Homo sapiens
tgcctgggctgggcagcc

SEQ ID NO: 956031 - DNA, 21 bp, Homo sapiens
tgcctgggctgggcagccttg

SEQ ID NO: 956032 - DNA, 21 bp, Homo sapiens
tgcctggggcctccagaagct

SEQ ID NO: 956033 - DNA, 19 bp, Homo sapiens
tgcctgggggagagaggca

SEQ ID NO: 956034 - DNA, 21 bp, Homo sapiens
tgcctgggggagttttcctct

SEQ ID NO: 956035 - DNA, 17 bp, Homo sapiens
tgcctggggtctgagca

SEQ ID NO: 956036 - DNA, 19 bp, Homo sapiens
tgcctgggtggccatccta

SEQ ID NO: 956037 - DNA, 20 bp, Homo sapiens
gggctcagagctttgtcact

SEQ ID NO: 956038 - DNA, 21 bp, Homo sapiens
gggctcagagtgaccctcagc

SEQ ID NO: 956039 - DNA, 10 bp, Homo sapiens
gggctcagca

SEQ ID NO: 956040 - DNA, 13 bp, Homo sapiens
gggctcagcaatg

SEQ ID NO: 956041 - DNA, 19 bp, Homo sapiens
gggctcagccacagcctga

SEQ ID NO: 956042 - DNA, 20 bp, Homo sapiens
gggctcagcctggtgggcct

SEQ ID NO: 956043 - DNA, 13 bp, Homo sapiens
gggctcagggctg

SEQ ID NO: 956044 - DNA, 16 bp, Homo sapiens
gggctccacgggcagg

SEQ ID NO: 956045 - DNA, 21 bp, Homo sapiens
gggctccagcatccagcctgt

SEQ ID NO: 956046 - DNA, 22 bp, Homo sapiens
gggctccagcatccagcctgtg

SEQ ID NO: 956047 - DNA, 23 bp, Homo sapiens
gggctccagcatccagcctgtgt

SEQ ID NO: 956048 - DNA, 13 bp, Homo sapiens
gggctccagccat

SEQ ID NO: 956049 - DNA, 18 bp, Homo sapiens
gggctccatgcctctgga

SEQ ID NO: 956050 - DNA, 21 bp, Homo sapiens
gggctccatgctgaaggctcc

SEQ ID NO: 956051 - DNA, 11 bp, Homo sapiens
gggctcccagg

SEQ ID NO: 956052 - DNA, 23 bp, Homo sapiens
gggctcccaggggtctccctggc

SEQ ID NO: 956053 - DNA, 12 bp, Homo sapiens
gggctcccctct

SEQ ID NO: 956054 - DNA, 13 bp, Homo sapiens
gggctcccgcccg

SEQ ID NO: 956055 - DNA, 15 bp, Homo sapiens
gggctccctcctctg

SEQ ID NO: 956056 - DNA, 18 bp, Homo sapiens
gggctccctcctctggca

SEQ ID NO: 956057 - DNA, 13 bp, Homo sapiens
gggctccctctct

SEQ ID NO: 956058 - DNA, 19 bp, Homo sapiens
gggctccctctctggtttc

SEQ ID NO: 956059 - DNA, 18 bp, Homo sapiens
gggctccctgactgggag

SEQ ID NO: 956060 - DNA, 22 bp, Homo sapiens
gggctccgaaattccaaggccc

SEQ ID NO: 956061 - DNA, 23 bp, Homo sapiens
gggctccggaggggacccagctc

SEQ ID NO: 956062 - DNA, 22 bp, Homo sapiens
gggctcctgcacttacttgctt

SEQ ID NO: 956063 - DNA, 11 bp, Homo sapiens
gggctcctgga

SEQ ID NO: 956064 - DNA, 18 bp, Homo sapiens
gggctcctggctgccagg

SEQ ID NO: 956065 - DNA, 19 bp, Homo sapiens
gggctcctggctgccaggc

SEQ ID NO: 956066 - DNA, 14 bp, Homo sapiens
gggctcctggggca

SEQ ID NO: 956067 - DNA, 16 bp, Homo sapiens
gggctcctggggcaga

SEQ ID NO: 956068 - DNA, 15 bp, Homo sapiens
gggctcctgggttgg

SEQ ID NO: 956069 - DNA, 23 bp, Homo sapiens
gggctccttcccctgcacctggc

SEQ ID NO: 956070 - DNA, 18 bp, Homo sapiens
gggctcctttctccagcc

SEQ ID NO: 956071 - DNA, 22 bp, Homo sapiens
gggctcctttctccagccagca

SEQ ID NO: 956072 - DNA, 17 bp, Homo sapiens
gggctcgcactgcccac

SEQ ID NO: 956073 - DNA, 14 bp, Homo sapiens
gggctcgccatgcc

SEQ ID NO: 956074 - DNA, 13 bp, Homo sapiens
gggctcggggagg

SEQ ID NO: 956075 - DNA, 17 bp, Homo sapiens
gggctcggggaggcaga

SEQ ID NO: 956076 - DNA, 18 bp, Homo sapiens
gggctcgggtctgggcag

SEQ ID NO: 956077 - DNA, 17 bp, Homo sapiens
gggctctcaaagtataa

SEQ ID NO: 956078 - DNA, 13 bp, Homo sapiens
gggctctcagctc

SEQ ID NO: 956079 - DNA, 16 bp, Homo sapiens
gggctctccaaagggg

SEQ ID NO: 956080 - DNA, 14 bp, Homo sapiens
gggctctccacctc

SEQ ID NO: 956081 - DNA, 18 bp, Homo sapiens
gggctctccacctcagcc

SEQ ID NO: 956082 - DNA, 12 bp, Homo sapiens
gggctctgccca

SEQ ID NO: 956083 - DNA, 19 bp, Homo sapiens
gggctctgccccagctctg

SEQ ID NO: 956084 - DNA, 20 bp, Homo sapiens
gggctctgccccagctctgg

SEQ ID NO: 956085 - DNA, 21 bp, Homo sapiens
gggctttccttttatttttta

SEQ ID NO: 956086 - DNA, 15 bp, Homo sapiens
gggctttcggggagg

SEQ ID NO: 956087 - DNA, 16 bp, Homo sapiens
gggctttcggggaggg

SEQ ID NO: 956088 - DNA, 18 bp, Homo sapiens
gggctttcggggagggcg

SEQ ID NO: 956089 - DNA, 14 bp, Homo sapiens
gggctttctcctgg

SEQ ID NO: 956090 - DNA, 21 bp, Homo sapiens
gggctttctcttccccttcct

SEQ ID NO: 956091 - DNA, 23 bp, Homo sapiens
gggctttctcttccccttcctgt

SEQ ID NO: 956092 - DNA, 14 bp, Homo sapiens
gggctttgcaggct

SEQ ID NO: 956093 - DNA, 20 bp, Homo sapiens
gggctttgcaggctctgggc

SEQ ID NO: 956094 - DNA, 20 bp, Homo sapiens
gggctttgggcccaagaact

SEQ ID NO: 956095 - DNA, 17 bp, Homo sapiens
gggctttggttccttct

SEQ ID NO: 956096 - DNA, 21 bp, Homo sapiens
gggctttggttccttctctgg

SEQ ID NO: 956097 - DNA, 13 bp, Homo sapiens
ggggaaaaaaaag

SEQ ID NO: 956098 - DNA, 14 bp, Homo sapiens
ggggaaaaaaaaga

SEQ ID NO: 956099 - DNA, 16 bp, Homo sapiens
ggggaaaaaaaagaaa

SEQ ID NO: 956100 - DNA, 16 bp, Homo sapiens
ggggaaaatcagcctg

SEQ ID NO: 956101 - DNA, 21 bp, Homo sapiens
ggggaaaatcagcctgctcca

SEQ ID NO: 956102 - DNA, 13 bp, Homo sapiens
ggggaaagaggga

SEQ ID NO: 956103 - DNA, 22 bp, Homo sapiens
ggggaacaaggagttctcttcc

SEQ ID NO: 956104 - DNA, 22 bp, Homo sapiens
ggggaacctgccatgccaggaa

SEQ ID NO: 956105 - DNA, 23 bp, Homo sapiens
ggggaagattttatgcacagcct

SEQ ID NO: 956106 - DNA, 15 bp, Homo sapiens
ggggaagctgcacat

SEQ ID NO: 956107 - DNA, 15 bp, Homo sapiens
ggggaaggagccagt

SEQ ID NO: 956108 - DNA, 13 bp, Homo sapiens
ggggaaggcagag

SEQ ID NO: 956109 - DNA, 17 bp, Homo sapiens
ggggaaggccaagggga

SEQ ID NO: 956110 - DNA, 13 bp, Homo sapiens
ggggaagggccag

SEQ ID NO: 956111 - DNA, 12 bp, Homo sapiens
ggggaagggggt

SEQ ID NO: 956112 - DNA, 14 bp, Homo sapiens
ggggaagggggtgc

SEQ ID NO: 956113 - DNA, 14 bp, Homo sapiens
ggggaaggggtgca

SEQ ID NO: 956114 - DNA, 13 bp, Homo sapiens
ggggaagggtggg

SEQ ID NO: 956115 - DNA, 14 bp, Homo sapiens
ggggaagggtgggg

SEQ ID NO: 956116 - DNA, 16 bp, Homo sapiens
ggggaatgcacctccc

SEQ ID NO: 956117 - DNA, 14 bp, Homo sapiens
ggggacagaggccc

SEQ ID NO: 956118 - DNA, 15 bp, Homo sapiens
ggggacagcttcctc

SEQ ID NO: 956119 - DNA, 13 bp, Homo sapiens
ggggacaggcccg

SEQ ID NO: 956120 - DNA, 12 bp, Homo sapiens
ggggacaggcct

SEQ ID NO: 956121 - DNA, 17 bp, Homo sapiens
ggggacaggcctcacct

SEQ ID NO: 956122 - DNA, 14 bp, Homo sapiens
ggggacagggggtg

SEQ ID NO: 956123 - DNA, 18 bp, Homo sapiens
ggggacagttggcagaga

SEQ ID NO: 956124 - DNA, 20 bp, Homo sapiens
ggggacagttggcagagaag

SEQ ID NO: 956125 - DNA, 21 bp, Homo sapiens
ggggacccaatgtaggagctg

SEQ ID NO: 956126 - DNA, 15 bp, Homo sapiens
ggggacccacccagc

SEQ ID NO: 956127 - DNA, 19 bp, Homo sapiens
ggggacccacccagcccct

SEQ ID NO: 956128 - DNA, 21 bp, Homo sapiens
ggggacccacccagcccctct

SEQ ID NO: 956129 - DNA, 20 bp, Homo sapiens
ggggacctgtcccccactct

SEQ ID NO: 956130 - DNA, 13 bp, Homo sapiens
ggggactcagccc

SEQ ID NO: 956131 - DNA, 16 bp, Homo sapiens
ggggactcagccctga

SEQ ID NO: 956132 - DNA, 15 bp, Homo sapiens
ggggactctgggcta

SEQ ID NO: 956133 - DNA, 16 bp, Homo sapiens
ggggactctgggctat

SEQ ID NO: 956134 - DNA, 18 bp, Homo sapiens
ggggactgctgctgcctg

SEQ ID NO: 956135 - DNA, 10 bp, Homo sapiens
ggggagaaag

SEQ ID NO: 956136 - DNA, 19 bp, Homo sapiens
ggggagaacttacattgtg

SEQ ID NO: 956137 - DNA, 17 bp, Homo sapiens
ggggagaagagccctgg

SEQ ID NO: 956138 - DNA, 17 bp, Homo sapiens
ggggagaagctgaagcc

SEQ ID NO: 956139 - DNA, 16 bp, Homo sapiens
ggggagacagttgaga

SEQ ID NO: 956140 - DNA, 17 bp, Homo sapiens
ggggagactgggctgag

SEQ ID NO: 956141 - DNA, 17 bp, Homo sapiens
ggggagagacaggcagc

SEQ ID NO: 956142 - DNA, 23 bp, Homo sapiens
ggggagagacaggcagcccagca

SEQ ID NO: 956143 - DNA, 14 bp, Homo sapiens
ggggagagcctgct

SEQ ID NO: 956144 - DNA, 16 bp, Homo sapiens
ggggagagcctgctgg

SEQ ID NO: 956145 - DNA, 16 bp, Homo sapiens
ggggagagggggaggt

SEQ ID NO: 956146 - DNA, 14 bp, Homo sapiens
ggggagcacaggtg

SEQ ID NO: 956147 - DNA, 21 bp, Homo sapiens
ggggagcacaggtgtctgcct

SEQ ID NO: 956148 - DNA, 17 bp, Homo sapiens
ggggagcagagagagcc

SEQ ID NO: 956149 - DNA, 18 bp, Homo sapiens
ggggagcaggaggccaat

SEQ ID NO: 956150 - DNA, 11 bp, Homo sapiens
ggggagccaga

SEQ ID NO: 956151 - DNA, 21 bp, Homo sapiens
ggggagccagaaatgggcagt

SEQ ID NO: 956152 - DNA, 11 bp, Homo sapiens
ggggagccagc

SEQ ID NO: 956153 - DNA, 19 bp, Homo sapiens
ggggagccagctgcttgac

SEQ ID NO: 956154 - DNA, 15 bp, Homo sapiens
ggggagccctcaggc

SEQ ID NO: 956155 - DNA, 19 bp, Homo sapiens
ggggagccctcaggctccc

SEQ ID NO: 956156 - DNA, 10 bp, Homo sapiens
ggggagctcc

SEQ ID NO: 956157 - DNA, 13 bp, Homo sapiens
ggggagctcctgg

SEQ ID NO: 956158 - DNA, 18 bp, Homo sapiens
ggggaggaaactcacctg

SEQ ID NO: 956159 - DNA, 11 bp, Homo sapiens
ggggaggacca

SEQ ID NO: 956160 - DNA, 20 bp, Homo sapiens
ggggaggaggaacgggcagc

SEQ ID NO: 956161 - DNA, 13 bp, Homo sapiens
ggggaggaggaag

SEQ ID NO: 956162 - DNA, 14 bp, Homo sapiens
ggggaggaggaagc

SEQ ID NO: 956163 - DNA, 19 bp, Homo sapiens
ggggaggatcactggagcc

SEQ ID NO: 956164 - DNA, 13 bp, Homo sapiens
ggggaggcagaga

SEQ ID NO: 956165 - DNA, 13 bp, Homo sapiens
ggggaggcagcag

SEQ ID NO: 956166 - DNA, 20 bp, Homo sapiens
tgcctgggtggccatcctac

SEQ ID NO: 956167 - DNA, 21 bp, Homo sapiens
tgcctgggtggggctgctcct

SEQ ID NO: 956168 - DNA, 22 bp, Homo sapiens
tgcctgggtggggctgctcctc

SEQ ID NO: 956169 - DNA, 23 bp, Homo sapiens
tgcctgggtggggctgctcctcc

SEQ ID NO: 956170 - DNA, 24 bp, Homo sapiens
tgcctgggtggggctgctcctcca

SEQ ID NO: 956171 - DNA, 16 bp, Homo sapiens
tgcctggtaaaattaa

SEQ ID NO: 956172 - DNA, 14 bp, Homo sapiens
tgcctggtacagta

SEQ ID NO: 956173 - DNA, 20 bp, Homo sapiens
tgcctggtatatccaaaagc

SEQ ID NO: 956174 - DNA, 14 bp, Homo sapiens
tgcctggtattttc

SEQ ID NO: 956175 - DNA, 19 bp, Homo sapiens
tgcctggtattttcaacca

SEQ ID NO: 956176 - DNA, 19 bp, Homo sapiens
tgcctggtcccagagtggc

SEQ ID NO: 956177 - DNA, 19 bp, Homo sapiens
tgcctggtgcactgtgtct

SEQ ID NO: 956178 - DNA, 20 bp, Homo sapiens
tgcctggtgcttccaaatat

SEQ ID NO: 956179 - DNA, 21 bp, Homo sapiens
tgcctggtgggggaaggggag

SEQ ID NO: 956180 - DNA, 15 bp, Homo sapiens
tgcctggttttattt

SEQ ID NO: 956181 - DNA, 17 bp, Homo sapiens
tgcctggttttatttat

SEQ ID NO: 956182 - DNA, 15 bp, Homo sapiens
tgcctgtaacttgag

SEQ ID NO: 956183 - DNA, 15 bp, Homo sapiens
tgcctgtaattaaac

SEQ ID NO: 956184 - DNA, 22 bp, Homo sapiens
tgcctgtaattaaactagttta

SEQ ID NO: 956185 - DNA, 16 bp, Homo sapiens
tgcctgtacaggaagg

SEQ ID NO: 956186 - DNA, 15 bp, Homo sapiens
tgcctgtagcagtga

SEQ ID NO: 956187 - DNA, 16 bp, Homo sapiens
tgcctgtagttaggaa

SEQ ID NO: 956188 - DNA, 23 bp, Homo sapiens
tgcctgtagttaggaaataaaac

SEQ ID NO: 956189 - DNA, 19 bp, Homo sapiens
tgcctgtcccacccccacc

SEQ ID NO: 956190 - DNA, 23 bp, Homo sapiens
tgcctgtccccaaacaggacagc

SEQ ID NO: 956191 - DNA, 21 bp, Homo sapiens
tgcctgtccttgaaaaacaaa

SEQ ID NO: 956192 - DNA, 22 bp, Homo sapiens
tgcctgtccttgaaaaacaaag

SEQ ID NO: 956193 - DNA, 15 bp, Homo sapiens
tgcctgtctaaagcc

SEQ ID NO: 956194 - DNA, 16 bp, Homo sapiens
tgcctgtctccatgag

SEQ ID NO: 956195 - DNA, 16 bp, Homo sapiens
tgcctgtctgccccag

SEQ ID NO: 956196 - DNA, 18 bp, Homo sapiens
tgcctgtctgtctctcca

SEQ ID NO: 956197 - DNA, 22 bp, Homo sapiens
tgcctgtcttgagtagacttgg

SEQ ID NO: 956198 - DNA, 16 bp, Homo sapiens
tgcctgtgaggcaggg

SEQ ID NO: 956199 - DNA, 19 bp, Homo sapiens
tgcctgtgatttcctaatt

SEQ ID NO: 956200 - DNA, 19 bp, Homo sapiens
tgcctgtgctacaattcat

SEQ ID NO: 956201 - DNA, 21 bp, Homo sapiens
tgcctgtggccttgcccgcca

SEQ ID NO: 956202 - DNA, 22 bp, Homo sapiens
tgcctgtggcgccgtctccagg

SEQ ID NO: 956203 - DNA, 23 bp, Homo sapiens
tgcctgtggcgccgtctccaggg

SEQ ID NO: 956204 - DNA, 21 bp, Homo sapiens
tgcctgtggtgaagtgtggct

SEQ ID NO: 956205 - DNA, 24 bp, Homo sapiens
tgcctgtggtgaagtgtggctggt

SEQ ID NO: 956206 - DNA, 15 bp, Homo sapiens
tgcctgtgtccatgc

SEQ ID NO: 956207 - DNA, 14 bp, Homo sapiens
ggggcagcaaggcc

SEQ ID NO: 956208 - DNA, 18 bp, Homo sapiens
ggggcagcaccctataaa

SEQ ID NO: 956209 - DNA, 19 bp, Homo sapiens
ggggcagcagcagccctgc

SEQ ID NO: 956210 - DNA, 13 bp, Homo sapiens
ggggcaggacctg

SEQ ID NO: 956211 - DNA, 16 bp, Homo sapiens
ggggcaggagggccct

SEQ ID NO: 956212 - DNA, 13 bp, Homo sapiens
ggggcaggcaggg

SEQ ID NO: 956213 - DNA, 19 bp, Homo sapiens
ggggcaggccagggcagtt

SEQ ID NO: 956214 - DNA, 18 bp, Homo sapiens
ggggcaggggcctgggcc

SEQ ID NO: 956215 - DNA, 23 bp, Homo sapiens
ggggcagtcttgcaacagtgcca

SEQ ID NO: 956216 - DNA, 15 bp, Homo sapiens
ggggcagtgtgagga

SEQ ID NO: 956217 - DNA, 17 bp, Homo sapiens
ggggcagttagagcagc

SEQ ID NO: 956218 - DNA, 20 bp, Homo sapiens
ggggcagttagagcagcctc

SEQ ID NO: 956219 - DNA, 17 bp, Homo sapiens
ggggcatcagccagcta

SEQ ID NO: 956220 - DNA, 14 bp, Homo sapiens
ggggcatctgcccc

SEQ ID NO: 956221 - DNA, 16 bp, Homo sapiens
ggggcatgctggggca

SEQ ID NO: 956222 - DNA, 20 bp, Homo sapiens
ggggcatgtgtgcctgtggc

SEQ ID NO: 956223 - DNA, 17 bp, Homo sapiens
ggggcatttagggagca

SEQ ID NO: 956224 - DNA, 18 bp, Homo sapiens
ggggccaccaaagctgcc

SEQ ID NO: 956225 - DNA, 21 bp, Homo sapiens
ggggccacgtgtgctgtggcc

SEQ ID NO: 956226 - DNA, 17 bp, Homo sapiens
ggggccagagagcaggg

SEQ ID NO: 956227 - DNA, 13 bp, Homo sapiens
ggggccagaggct

SEQ ID NO: 956228 - DNA, 13 bp, Homo sapiens
ggggccagcagag

SEQ ID NO: 956229 - DNA, 17 bp, Homo sapiens
ggggccagcagagggcg

SEQ ID NO: 956230 - DNA, 14 bp, Homo sapiens
ggggccagggctgg

SEQ ID NO: 956231 - DNA, 15 bp, Homo sapiens
ggggccagggctgga

SEQ ID NO: 956232 - DNA, 18 bp, Homo sapiens
ggggccagggctggatgg

SEQ ID NO: 956233 - DNA, 22 bp, Homo sapiens
ggggccatgagctccagacccc

SEQ ID NO: 956234 - DNA, 17 bp, Homo sapiens
ggggccatgcctcctca

SEQ ID NO: 956235 - DNA, 23 bp, Homo sapiens
ggggccatgcctcctcaggagcc

SEQ ID NO: 956236 - DNA, 13 bp, Homo sapiens
ggggccatgggca

SEQ ID NO: 956237 - DNA, 19 bp, Homo sapiens
ggggccatggtggagggca

SEQ ID NO: 956238 - DNA, 21 bp, Homo sapiens
ggggccatttgcaataacagc

SEQ ID NO: 956239 - DNA, 13 bp, Homo sapiens
ggggcccaagtgg

SEQ ID NO: 956240 - DNA, 22 bp, Homo sapiens
ggggcccaagttgcagtgagca

SEQ ID NO: 956241 - DNA, 21 bp, Homo sapiens
ggggccccagatctgcctggg

SEQ ID NO: 956242 - DNA, 23 bp, Homo sapiens
ggggccccagatctgcctgggcc

SEQ ID NO: 956243 - DNA, 22 bp, Homo sapiens
ggggccccgccagggctgggga

SEQ ID NO: 956244 - DNA, 21 bp, Homo sapiens
ggggcccctttttactcccct

SEQ ID NO: 956245 - DNA, 19 bp, Homo sapiens
ggggcccgacaggtgggcc

SEQ ID NO: 956246 - DNA, 13 bp, Homo sapiens
ggggcccggccag

SEQ ID NO: 956247 - DNA, 20 bp, Homo sapiens
ggggccctctatgctggctt

SEQ ID NO: 956248 - DNA, 19 bp, Homo sapiens
ggggccctcttgccagcct

SEQ ID NO: 956249 - DNA, 14 bp, Homo sapiens
ggggccctgcccca

SEQ ID NO: 956250 - DNA, 16 bp, Homo sapiens
ggggccctgccccacc

SEQ ID NO: 956251 - DNA, 19 bp, Homo sapiens
ggggccctgccccacccca

SEQ ID NO: 956252 - DNA, 11 bp, Homo sapiens
ggggccctggg

SEQ ID NO: 956253 - DNA, 18 bp, Homo sapiens
ggggccctgggcctcagt

SEQ ID NO: 956254 - DNA, 14 bp, Homo sapiens
ggggcccttggagc

SEQ ID NO: 956255 - DNA, 19 bp, Homo sapiens
ggggcccttggggcctggc

SEQ ID NO: 956256 - DNA, 20 bp, Homo sapiens
ggggcccttggggcctggct

SEQ ID NO: 956257 - DNA, 14 bp, Homo sapiens
ggggccgcctgccc

SEQ ID NO: 956258 - DNA, 16 bp, Homo sapiens
ggggccgcctgccctg

SEQ ID NO: 956259 - DNA, 23 bp, Homo sapiens
ggggccgggcaggtcctgcccat

SEQ ID NO: 956260 - DNA, 14 bp, Homo sapiens
ggggccggggaggg

SEQ ID NO: 956261 - DNA, 20 bp, Homo sapiens
ggggcctaggcctcagccag

SEQ ID NO: 956262 - DNA, 13 bp, Homo sapiens
ggggcctcagacg

SEQ ID NO: 956263 - DNA, 14 bp, Homo sapiens
ggggcctcagacga

SEQ ID NO: 956264 - DNA, 19 bp, Homo sapiens
ggggcctcccggggcccag

SEQ ID NO: 956265 - DNA, 11 bp, Homo sapiens
ggggcctgcaa

SEQ ID NO: 956266 - DNA, 15 bp, Homo sapiens
ggggcctggacctgc

SEQ ID NO: 956267 - DNA, 16 bp, Homo sapiens
ggggcctggacctgcc

SEQ ID NO: 956268 - DNA, 12 bp, Homo sapiens
ggggcctgggcc

SEQ ID NO: 956269 - DNA, 13 bp, Homo sapiens
ggggcctgggccg

SEQ ID NO: 956270 - DNA, 12 bp, Homo sapiens
ggggcctgtgga

SEQ ID NO: 956271 - DNA, 23 bp, Homo sapiens
ggggccttagggcactgggctgt

SEQ ID NO: 956272 - DNA, 19 bp, Homo sapiens
ggggccttgcggaagccat

SEQ ID NO: 956273 - DNA, 21 bp, Homo sapiens
ggggccttgcggaagccatag

SEQ ID NO: 956274 - DNA, 16 bp, Homo sapiens
ggggcgccttttcagc

SEQ ID NO: 956275 - DNA, 22 bp, Homo sapiens
ggggcgctcaggacccaggccc

SEQ ID NO: 956276 - DNA, 13 bp, Homo sapiens
ggggcgctgtcct

SEQ ID NO: 956277 - DNA, 12 bp, Homo sapiens
ggggcggaggag

SEQ ID NO: 956278 - DNA, 13 bp, Homo sapiens
ggggcggaggagg

SEQ ID NO: 956279 - DNA, 14 bp, Homo sapiens
ggggcggaggagga

SEQ ID NO: 956280 - DNA, 17 bp, Homo sapiens
ggggcgggctcagagct

SEQ ID NO: 956281 - DNA, 20 bp, Homo sapiens
ggggcggggttagagccaag

SEQ ID NO: 956282 - DNA, 18 bp, Homo sapiens
ggggcgtctgttccccct

SEQ ID NO: 956283 - DNA, 20 bp, Homo sapiens
ggggcgtgagacccagtgca

SEQ ID NO: 956284 - DNA, 15 bp, Homo sapiens
ggggcgtggggaggg

SEQ ID NO: 956285 - DNA, 21 bp, Homo sapiens
ggggctaagcggtggaggaag

SEQ ID NO: 956286 - DNA, 24 bp, Homo sapiens
ggggctaaggtttccagtcagatg

SEQ ID NO: 956287 - DNA, 13 bp, Homo sapiens
ggggctagctgga

SEQ ID NO: 956288 - DNA, 13 bp, Homo sapiens
ggggctcccgccc

SEQ ID NO: 956289 - DNA, 16 bp, Homo sapiens
ggggctccctacattc

SEQ ID NO: 956290 - DNA, 12 bp, Homo sapiens
ggggctccctct

SEQ ID NO: 956291 - DNA, 15 bp, Homo sapiens
ggggctccggagggg

SEQ ID NO: 956292 - DNA, 15 bp, Homo sapiens
tgcctttcccccctc

SEQ ID NO: 956293 - DNA, 16 bp, Homo sapiens
tgcctttcgaggcctg

SEQ ID NO: 956294 - DNA, 15 bp, Homo sapiens
tgcctttctgcagtt

SEQ ID NO: 956295 - DNA, 14 bp, Homo sapiens
tgcctttcttctgc

SEQ ID NO: 956296 - DNA, 12 bp, Homo sapiens
tgcctttgaatg

SEQ ID NO: 956297 - DNA, 16 bp, Homo sapiens
tgcctttgcaaatcag

SEQ ID NO: 956298 - DNA, 22 bp, Homo sapiens
tgcctttgctgtttagcttcct

SEQ ID NO: 956299 - DNA, 12 bp, Homo sapiens
tgcctttgtaac

SEQ ID NO: 956300 - DNA, 15 bp, Homo sapiens
tgcctttgtaagtta

SEQ ID NO: 956301 - DNA, 17 bp, Homo sapiens
tgcctttgtccccacac

SEQ ID NO: 956302 - DNA, 18 bp, Homo sapiens
tgcctttgtccccacaca

SEQ ID NO: 956303 - DNA, 19 bp, Homo sapiens
tgcctttgtggtgggcgct

SEQ ID NO: 956304 - DNA, 13 bp, Homo sapiens
tgccttttaagtt

SEQ ID NO: 956305 - DNA, 16 bp, Homo sapiens
tgccttttaattttta

SEQ ID NO: 956306 - DNA, 13 bp, Homo sapiens
tgccttttctgtg

SEQ ID NO: 956307 - DNA, 18 bp, Homo sapiens
tgccttttgcacccctcc

SEQ ID NO: 956308 - DNA, 21 bp, Homo sapiens
tgccttttgcacccctcccat

SEQ ID NO: 956309 - DNA, 22 bp, Homo sapiens
tgccttttgcacccctcccatt

SEQ ID NO: 956310 - DNA, 15 bp, Homo sapiens
tgccttttgcagaag

SEQ ID NO: 956311 - DNA, 16 bp, Homo sapiens
tgccttttgcagaaga

SEQ ID NO: 956312 - DNA, 22 bp, Homo sapiens
tgccttttgcagaagagggtgt

SEQ ID NO: 956313 - DNA, 15 bp, Homo sapiens
tgccttttggtttca

SEQ ID NO: 956314 - DNA, 22 bp, Homo sapiens
tgccttttgtaggctgttccct

SEQ ID NO: 956315 - DNA, 13 bp, Homo sapiens
tgcctttttaagt

SEQ ID NO: 956316 - DNA, 20 bp, Homo sapiens
tgcctttttaagtaaaaaag

SEQ ID NO: 956317 - DNA, 22 bp, Homo sapiens
tgcctttttatttttgttttta

SEQ ID NO: 956318 - DNA, 13 bp, Homo sapiens
tgcctttttcctt

SEQ ID NO: 956319 - DNA, 20 bp, Homo sapiens
tgcctttttccttatttcaa

SEQ ID NO: 956320 - DNA, 19 bp, Homo sapiens
tgcgaaaaggtttttagga

SEQ ID NO: 956321 - DNA, 23 bp, Homo sapiens
tgcgaaatgttctcatgaactac

SEQ ID NO: 956322 - DNA, 18 bp, Homo sapiens
tgcgaaggggccctggtc

SEQ ID NO: 956323 - DNA, 22 bp, Homo sapiens
tgcgaatccaagctccctgccc

SEQ ID NO: 956324 - DNA, 22 bp, Homo sapiens
tgcgaatggttccattctctct

SEQ ID NO: 956325 - DNA, 15 bp, Homo sapiens
tgcgacagagagagg

SEQ ID NO: 956326 - DNA, 16 bp, Homo sapiens
tgcgacagagagaggg

SEQ ID NO: 956327 - DNA, 18 bp, Homo sapiens
tgcgaccttgcaacctca

SEQ ID NO: 956328 - DNA, 22 bp, Homo sapiens
tgcgacgcgggcttctggagct

SEQ ID NO: 956329 - DNA, 23 bp, Homo sapiens
tgctaaaaatgagcttgattaaa

SEQ ID NO: 956330 - DNA, 14 bp, Homo sapiens
tgctaaaacttcac

SEQ ID NO: 956331 - DNA, 11 bp, Homo sapiens
tgctaaaagaa

SEQ ID NO: 956332 - DNA, 12 bp, Homo sapiens
tgctaaaagaag

SEQ ID NO: 956333 - DNA, 17 bp, Homo sapiens
tgctaaaagaagagagg

SEQ ID NO: 956334 - DNA, 15 bp, Homo sapiens
tgctaaagcactttg

SEQ ID NO: 956335 - DNA, 20 bp, Homo sapiens
tgctaaagccaaccagcctt

SEQ ID NO: 956336 - DNA, 20 bp, Homo sapiens
tgctaaagggagaaatgcca

SEQ ID NO: 956337 - DNA, 12 bp, Homo sapiens
tgctaaatagtt

SEQ ID NO: 956338 - DNA, 21 bp, Homo sapiens
tgctaaattttcagtagggct

SEQ ID NO: 956339 - DNA, 13 bp, Homo sapiens
tgctaacaaagac

SEQ ID NO: 956340 - DNA, 13 bp, Homo sapiens
tgctaacatctaa

SEQ ID NO: 956341 - DNA, 15 bp, Homo sapiens
tgctaacctaaaaga

SEQ ID NO: 956342 - DNA, 11 bp, Homo sapiens
tgctaagaaat

SEQ ID NO: 956343 - DNA, 12 bp, Homo sapiens
tgctaagaaatg

SEQ ID NO: 956344 - DNA, 19 bp, Homo sapiens
tgctaagaagcctataaga

SEQ ID NO: 956345 - DNA, 16 bp, Homo sapiens
tgctaagagaagtaga

SEQ ID NO: 956346 - DNA, 19 bp, Homo sapiens
tgctaagagggcccaaaga

SEQ ID NO: 956347 - DNA, 15 bp, Homo sapiens
tgctaaggctgctgg

SEQ ID NO: 956348 - DNA, 19 bp, Homo sapiens
tgctaaggctgctggcttc

SEQ ID NO: 956349 - DNA, 20 bp, Homo sapiens
tgctaaggctgctggcttca

SEQ ID NO: 956350 - DNA, 22 bp, Homo sapiens
tgctaaggctgctggcttcagg

SEQ ID NO: 956351 - DNA, 22 bp, Homo sapiens
tgctaagtaatttagaagatat

SEQ ID NO: 956352 - DNA, 16 bp, Homo sapiens
tgctaagtatttccca

SEQ ID NO: 956353 - DNA, 18 bp, Homo sapiens
tgctaagtatttcccagc

SEQ ID NO: 956354 - DNA, 15 bp, Homo sapiens
tgctaagtctttccc

SEQ ID NO: 956355 - DNA, 22 bp, Homo sapiens
tgctaatatactttttttgtta

SEQ ID NO: 956356 - DNA, 17 bp, Homo sapiens
tgctaatcaaagccagg

SEQ ID NO: 956357 - DNA, 22 bp, Homo sapiens
tgctaatcttcttatgcaattt

SEQ ID NO: 956358 - DNA, 15 bp, Homo sapiens
tgctaatgcaaatta

SEQ ID NO: 956359 - DNA, 15 bp, Homo sapiens
tgctaatgctatgca

SEQ ID NO: 956360 - DNA, 13 bp, Homo sapiens
tgctaatgttgat

SEQ ID NO: 956361 - DNA, 13 bp, Homo sapiens
tgctaattaaata

SEQ ID NO: 956362 - DNA, 18 bp, Homo sapiens
tgctaattaaataataca

SEQ ID NO: 956363 - DNA, 17 bp, Homo sapiens
tgctaatttaaagagac

SEQ ID NO: 956364 - DNA, 19 bp, Homo sapiens
tgctacaaatttatgcatt

SEQ ID NO: 956365 - DNA, 23 bp, Homo sapiens
tgctacaaatttatgcatttcat

SEQ ID NO: 956366 - DNA, 13 bp, Homo sapiens
tgctacaacttca

SEQ ID NO: 956367 - DNA, 16 bp, Homo sapiens
tgctacatcagactct

SEQ ID NO: 956368 - DNA, 21 bp, Homo sapiens
tgctacattataatgtacaga

SEQ ID NO: 956369 - DNA, 15 bp, Homo sapiens
tgctaccagtattta

SEQ ID NO: 956370 - DNA, 15 bp, Homo sapiens
tgctaccgccctggg

SEQ ID NO: 956371 - DNA, 21 bp, Homo sapiens
tgctaccgccctgggctggac

SEQ ID NO: 956372 - DNA, 22 bp, Homo sapiens
tgctaccgccctgggctggact

SEQ ID NO: 956373 - DNA, 14 bp, Homo sapiens
tgctacctcactgg

SEQ ID NO: 956374 - DNA, 15 bp, Homo sapiens
tgctacctcactggg

SEQ ID NO: 956375 - DNA, 22 bp, Homo sapiens
tgctacctcactggggtcctgg

SEQ ID NO: 956376 - DNA, 15 bp, Homo sapiens
tgctacctcccttgc

SEQ ID NO: 956377 - DNA, 23 bp, Homo sapiens
tgctacctgggtccttttcagaa

SEQ ID NO: 956378 - DNA, 14 bp, Homo sapiens
tgctacgtgcctcc

SEQ ID NO: 956379 - DNA, 15 bp, Homo sapiens
tgctacgtgcctccc

SEQ ID NO: 956380 - DNA, 16 bp, Homo sapiens
tgctactcctgtgctc

SEQ ID NO: 956381 - DNA, 12 bp, Homo sapiens
tgctactgatgc

SEQ ID NO: 956382 - DNA, 15 bp, Homo sapiens
tgctactgcactcca

SEQ ID NO: 956383 - DNA, 20 bp, Homo sapiens
tgctactgcactccagcctg

SEQ ID NO: 956384 - DNA, 18 bp, Homo sapiens
tgctactggacttgaatg

SEQ ID NO: 956385 - DNA, 20 bp, Homo sapiens
tgctacttaaatttgaatct

SEQ ID NO: 956386 - DNA, 22 bp, Homo sapiens
tgctacttatcatttttgtata

SEQ ID NO: 956387 - DNA, 19 bp, Homo sapiens
tgctacttcactgtcatct

SEQ ID NO: 956388 - DNA, 23 bp, Homo sapiens
tgctacttcactgtcatcttcaa

SEQ ID NO: 956389 - DNA, 21 bp, Homo sapiens
tgctagaaaatttagcccttt

SEQ ID NO: 956390 - DNA, 15 bp, Homo sapiens
tgctagaaattttca

SEQ ID NO: 956391 - DNA, 15 bp, Homo sapiens
tgctagaagctgtaa

SEQ ID NO: 956392 - DNA, 16 bp, Homo sapiens
tgctagacagaaacca

SEQ ID NO: 956393 - DNA, 17 bp, Homo sapiens
tgctagagcaacccctg

SEQ ID NO: 956394 - DNA, 15 bp, Homo sapiens
tgctagagcagacag

SEQ ID NO: 956395 - DNA, 20 bp, Homo sapiens
tgctagagcagacaggcctg

SEQ ID NO: 956396 - DNA, 20 bp, Homo sapiens
tgctagattttaatttattt

SEQ ID NO: 956397 - DNA, 22 bp, Homo sapiens
tgctagattttaatttatttgt

SEQ ID NO: 956398 - DNA, 20 bp, Homo sapiens
tgctagcacttggagccaag

SEQ ID NO: 956399 - DNA, 16 bp, Homo sapiens
tgctagctagccagcc

SEQ ID NO: 956400 - DNA, 13 bp, Homo sapiens
tgctagctgtaga

SEQ ID NO: 956401 - DNA, 14 bp, Homo sapiens
tgctaggccagagc

SEQ ID NO: 956402 - DNA, 17 bp, Homo sapiens
tgctagggaaacttccc

SEQ ID NO: 956403 - DNA, 20 bp, Homo sapiens
tgctagggttaggaggtcct

SEQ ID NO: 956404 - DNA, 20 bp, Homo sapiens
tgctaggtgggccagcccct

SEQ ID NO: 956405 - DNA, 16 bp, Homo sapiens
tgctagtgctgtaata

SEQ ID NO: 956406 - DNA, 23 bp, Homo sapiens
tgctagtgctgtaatattgtaaa

SEQ ID NO: 956407 - DNA, 15 bp, Homo sapiens
tgctagttctgctgc

SEQ ID NO: 956408 - DNA, 16 bp, Homo sapiens
tgctagttctgctgcc

SEQ ID NO: 956409 - DNA, 17 bp, Homo sapiens
tgctagttctgctgccc

SEQ ID NO: 956410 - DNA, 18 bp, Homo sapiens
tgctagttctgctgccct

SEQ ID NO: 956411 - DNA, 14 bp, Homo sapiens
tgctatacacacac

SEQ ID NO: 956412 - DNA, 18 bp, Homo sapiens
tgctatagagcctacctg

SEQ ID NO: 956413 - DNA, 14 bp, Homo sapiens
tgctatagcctggg

SEQ ID NO: 956414 - DNA, 13 bp, Homo sapiens
tgctatagtattt

SEQ ID NO: 956415 - DNA, 15 bp, Homo sapiens
tgctatagtatttga

SEQ ID NO: 956416 - DNA, 21 bp, Homo sapiens
tgctatatataaaacggtgct

SEQ ID NO: 956417 - DNA, 21 bp, Homo sapiens
tgctatatccagttcctgctc

SEQ ID NO: 956418 - DNA, 17 bp, Homo sapiens
tgctatcacatgtgaaa

SEQ ID NO: 956419 - DNA, 15 bp, Homo sapiens
tgctatccatttctc

SEQ ID NO: 956420 - DNA, 20 bp, Homo sapiens
tgctatccccatctccctgc

SEQ ID NO: 956421 - DNA, 22 bp, Homo sapiens
tgctatcgcaccactgtgtatt

SEQ ID NO: 956422 - DNA, 18 bp, Homo sapiens
tgctatcgccctcctttc

SEQ ID NO: 956423 - DNA, 17 bp, Homo sapiens
ggggttcagcccctcct

SEQ ID NO: 956424 - DNA, 14 bp, Homo sapiens
ggggttcaggcccg

SEQ ID NO: 956425 - DNA, 21 bp, Homo sapiens
ggggttcagggaactgcttgc

SEQ ID NO: 956426 - DNA, 21 bp, Homo sapiens
ggggttccccacacagggcac

SEQ ID NO: 956427 - DNA, 18 bp, Homo sapiens
ggggttcctcaaattttt

SEQ ID NO: 956428 - DNA, 20 bp, Homo sapiens
ggggttcggttgcagggctg

SEQ ID NO: 956429 - DNA, 21 bp, Homo sapiens
ggggttgcgtctgaggcctgc

SEQ ID NO: 956430 - DNA, 19 bp, Homo sapiens
ggggttggcttccctggca

SEQ ID NO: 956431 - DNA, 17 bp, Homo sapiens
ggggttggggtgacagt

SEQ ID NO: 956432 - DNA, 18 bp, Homo sapiens
ggggttgtggcaaaagcc

SEQ ID NO: 956433 - DNA, 17 bp, Homo sapiens
ggggttttcaatgtgaa

SEQ ID NO: 956434 - DNA, 18 bp, Homo sapiens
ggggttttttgggaagac

SEQ ID NO: 956435 - DNA, 15 bp, Homo sapiens
gggtaaaaagtggct

SEQ ID NO: 956436 - DNA, 19 bp, Homo sapiens
gggtaacctggccactgtc

SEQ ID NO: 956437 - DNA, 19 bp, Homo sapiens
gggtaagccagagcctggg

SEQ ID NO: 956438 - DNA, 13 bp, Homo sapiens
gggtaaggtgcct

SEQ ID NO: 956439 - DNA, 17 bp, Homo sapiens
gggtaatccctgctttt

SEQ ID NO: 956440 - DNA, 19 bp, Homo sapiens
gggtacatttctctgagca

SEQ ID NO: 956441 - DNA, 20 bp, Homo sapiens
gggtagaatgattaatcaaa

SEQ ID NO: 956442 - DNA, 21 bp, Homo sapiens
gggtagccccgccccagccct

SEQ ID NO: 956443 - DNA, 12 bp, Homo sapiens
gggtagcctgga

SEQ ID NO: 956444 - DNA, 23 bp, Homo sapiens
gggtagctagcgtgtgccaggca

SEQ ID NO: 956445 - DNA, 13 bp, Homo sapiens
gggtaggagagga

SEQ ID NO: 956446 - DNA, 22 bp, Homo sapiens
gggtaggctgtctgtgccatgg

SEQ ID NO: 956447 - DNA, 13 bp, Homo sapiens
gggtagggcagac

SEQ ID NO: 956448 - DNA, 17 bp, Homo sapiens
gggtagggggtagtgag

SEQ ID NO: 956449 - DNA, 22 bp, Homo sapiens
gggtagggtaaatcagtaagag

SEQ ID NO: 956450 - DNA, 23 bp, Homo sapiens
gggtataaaactttcctcgcctg

SEQ ID NO: 956451 - DNA, 15 bp, Homo sapiens
tgctcaaaaaatgag

SEQ ID NO: 956452 - DNA, 15 bp, Homo sapiens
tgctcaaaaatctgt

SEQ ID NO: 956453 - DNA, 23 bp, Homo sapiens
tgctcaaaacacttccagtctgg

SEQ ID NO: 956454 - DNA, 22 bp, Homo sapiens
tgctcaaaacctcttaaatcat

SEQ ID NO: 956455 - DNA, 13 bp, Homo sapiens
tgctcaaagaaat

SEQ ID NO: 956456 - DNA, 21 bp, Homo sapiens
tgctcaaatctattcagacaa

SEQ ID NO: 956457 - DNA, 13 bp, Homo sapiens
tgctcaacccccc

SEQ ID NO: 956458 - DNA, 16 bp, Homo sapiens
tgctcaacccccctcc

SEQ ID NO: 956459 - DNA, 18 bp, Homo sapiens
tgctcaacccccctccca

SEQ ID NO: 956460 - DNA, 20 bp, Homo sapiens
tgctcaacccccctcccaga

SEQ ID NO: 956461 - DNA, 22 bp, Homo sapiens
tgctcaacccccctcccagaca

SEQ ID NO: 956462 - DNA, 20 bp, Homo sapiens
tgctcaactctacccctgct

SEQ ID NO: 956463 - DNA, 22 bp, Homo sapiens
tgctcaagaagacatggagact

SEQ ID NO: 956464 - DNA, 19 bp, Homo sapiens
tgctcaaggaccaagagca

SEQ ID NO: 956465 - DNA, 13 bp, Homo sapiens
tgctcacagctgt

SEQ ID NO: 956466 - DNA, 18 bp, Homo sapiens
tgctcacagggatgctgg

SEQ ID NO: 956467 - DNA, 16 bp, Homo sapiens
tgctcaccagccctgc

SEQ ID NO: 956468 - DNA, 17 bp, Homo sapiens
tgctcaccagccctgca

SEQ ID NO: 956469 - DNA, 20 bp, Homo sapiens
tgctcaccagccctgcagcc

SEQ ID NO: 956470 - DNA, 12 bp, Homo sapiens
tgctcacctcta

SEQ ID NO: 956471 - DNA, 17 bp, Homo sapiens
tgctcacgtcaaatgca

SEQ ID NO: 956472 - DNA, 16 bp, Homo sapiens
tgctcacgttaccttg

SEQ ID NO: 956473 - DNA, 22 bp, Homo sapiens
tgctcacgttaccttgacacat

SEQ ID NO: 956474 - DNA, 19 bp, Homo sapiens
tgctcactcactcactcca

SEQ ID NO: 956475 - DNA, 21 bp, Homo sapiens
tgctcactcccaagggacagc

SEQ ID NO: 956476 - DNA, 22 bp, Homo sapiens
tgctcactcccaagggacagca

SEQ ID NO: 956477 - DNA, 14 bp, Homo sapiens
tgctcactttatta

SEQ ID NO: 956478 - DNA, 13 bp, Homo sapiens
tgctcagacagaa

SEQ ID NO: 956479 - DNA, 17 bp, Homo sapiens
tgctcagagctttaaaa

SEQ ID NO: 956480 - DNA, 13 bp, Homo sapiens
tgctcagcagcca

SEQ ID NO: 956481 - DNA, 14 bp, Homo sapiens
tgctcagcagccag

SEQ ID NO: 956482 - DNA, 15 bp, Homo sapiens
tgctcagcagccagt

SEQ ID NO: 956483 - DNA, 13 bp, Homo sapiens
tgctcagcatgat

SEQ ID NO: 956484 - DNA, 21 bp, Homo sapiens
tgctcagctctggtccaggcc

SEQ ID NO: 956485 - DNA, 20 bp, Homo sapiens
tgctcagctgtcaaggctca

SEQ ID NO: 956486 - DNA, 12 bp, Homo sapiens
tgctcagcttct

SEQ ID NO: 956487 - DNA, 15 bp, Homo sapiens
tgctcagcttctcct

SEQ ID NO: 956488 - DNA, 20 bp, Homo sapiens
tgctcagcttctcctgtgtg

SEQ ID NO: 956489 - DNA, 21 bp, Homo sapiens
tgctcagcttctcctgtgtga

SEQ ID NO: 956490 - DNA, 17 bp, Homo sapiens
tgctcaggcctccctag

SEQ ID NO: 956491 - DNA, 18 bp, Homo sapiens
tgctcaggcctccctagc

SEQ ID NO: 956492 - DNA, 12 bp, Homo sapiens
tgctcaggctgc

SEQ ID NO: 956493 - DNA, 21 bp, Homo sapiens
tgctcaggctgcagctggaca

SEQ ID NO: 956494 - DNA, 23 bp, Homo sapiens
tgctcaggctgcagctggacaga

SEQ ID NO: 956495 - DNA, 16 bp, Homo sapiens
tgctcagggtcaattt

SEQ ID NO: 956496 - DNA, 20 bp, Homo sapiens
tgctcagggtcaatttcttt

SEQ ID NO: 956497 - DNA, 14 bp, Homo sapiens
tgctcagtaatata

SEQ ID NO: 956498 - DNA, 15 bp, Homo sapiens
tgctcagtgcctcct

SEQ ID NO: 956499 - DNA, 17 bp, Homo sapiens
tgctcagtgcctcctgg

SEQ ID NO: 956500 - DNA, 17 bp, Homo sapiens
tgctcagtgccttttgg

SEQ ID NO: 956501 - DNA, 13 bp, Homo sapiens
tgctcagtgcttg

SEQ ID NO: 956502 - DNA, 19 bp, Homo sapiens
tgctcagtgcttgggctcc

SEQ ID NO: 956503 - DNA, 22 bp, Homo sapiens
tgctcagtgcttgggctccacg

SEQ ID NO: 956504 - DNA, 23 bp, Homo sapiens
tgctcagtgcttgggctccacgg

SEQ ID NO: 956505 - DNA, 13 bp, Homo sapiens
tgctcagtgtcca

SEQ ID NO: 956506 - DNA, 22 bp, Homo sapiens
tgctcataaagatgttaaatgg

SEQ ID NO: 956507 - DNA, 19 bp, Homo sapiens
tgctcatacacagttaaat

SEQ ID NO: 956508 - DNA, 21 bp, Homo sapiens
tgctcatgtccctgtccccag

SEQ ID NO: 956509 - DNA, 16 bp, Homo sapiens
tgctcattacagttct

SEQ ID NO: 956510 - DNA, 17 bp, Homo sapiens
tgctcattatgccactt

SEQ ID NO: 956511 - DNA, 20 bp, Homo sapiens
tgctcattcttgaggagcat

SEQ ID NO: 956512 - DNA, 18 bp, Homo sapiens
tgctcatttaagtttcaa

SEQ ID NO: 956513 - DNA, 19 bp, Homo sapiens
tgctccaaagtagaactct

SEQ ID NO: 956514 - DNA, 14 bp, Homo sapiens
tgctccaaatataa

SEQ ID NO: 956515 - DNA, 22 bp, Homo sapiens
tgctccaagggaccctttgcct

SEQ ID NO: 956516 - DNA, 14 bp, Homo sapiens
tgctccaccacatc

SEQ ID NO: 956517 - DNA, 16 bp, Homo sapiens
tgctccaccagcagca

SEQ ID NO: 956518 - DNA, 17 bp, Homo sapiens
tgctccacccttggcct

SEQ ID NO: 956519 - DNA, 18 bp, Homo sapiens
tgctccacgaagccttaa

SEQ ID NO: 956520 - DNA, 22 bp, Homo sapiens
tgctccagaagatgccagcttc

SEQ ID NO: 956521 - DNA, 21 bp, Homo sapiens
tgctccagaatttggaaatcc

SEQ ID NO: 956522 - DNA, 23 bp, Homo sapiens
tgctccagataactctctttcct

SEQ ID NO: 956523 - DNA, 15 bp, Homo sapiens
tgctccagattctga

SEQ ID NO: 956524 - DNA, 18 bp, Homo sapiens
tgctccagcaactgccct

SEQ ID NO: 956525 - DNA, 20 bp, Homo sapiens
tgctccagctgtcgtctgac

SEQ ID NO: 956526 - DNA, 16 bp, Homo sapiens
tgctccagctgttcag

SEQ ID NO: 956527 - DNA, 20 bp, Homo sapiens
tgctccagctgttcagctgg

SEQ ID NO: 956528 - DNA, 12 bp, Homo sapiens
tgctccagggtc

SEQ ID NO: 956529 - DNA, 14 bp, Homo sapiens
tgctccagggtctt

SEQ ID NO: 956530 - DNA, 16 bp, Homo sapiens
tgctccagggtcttgg

SEQ ID NO: 956531 - DNA, 18 bp, Homo sapiens
tgctccagggtcttgggc

SEQ ID NO: 956532 - DNA, 16 bp, Homo sapiens
tgctccagtgggcagg

SEQ ID NO: 956533 - DNA, 20 bp, Homo sapiens
tgctccatgactggctgtct

SEQ ID NO: 956534 - DNA, 22 bp, Homo sapiens
tgctccatttataaccccagcc

SEQ ID NO: 956535 - DNA, 23 bp, Homo sapiens
tgctccatttataaccccagcct

SEQ ID NO: 956536 - DNA, 17 bp, Homo sapiens
tgctcccaaaacatttt

SEQ ID NO: 956537 - DNA, 18 bp, Homo sapiens
tgctcccacacttgtgcc

SEQ ID NO: 956538 - DNA, 21 bp, Homo sapiens
tgctcccacacttgtgccagc

SEQ ID NO: 956539 - DNA, 22 bp, Homo sapiens
tgctcccaccccagaaatcact

SEQ ID NO: 956540 - DNA, 23 bp, Homo sapiens
tgctcccaccccagaaatcactg

SEQ ID NO: 956541 - DNA, 14 bp, Homo sapiens
tgctcccagcagcc

SEQ ID NO: 956542 - DNA, 20 bp, Homo sapiens
tgctcccagcagccctaagg

SEQ ID NO: 956543 - DNA, 21 bp, Homo sapiens
tgctcccagcagccctaagga

SEQ ID NO: 956544 - DNA, 17 bp, Homo sapiens
tgctcccagcctgctga

SEQ ID NO: 956545 - DNA, 20 bp, Homo sapiens
tgctcccagctgtgctgtgg

SEQ ID NO: 956546 - DNA, 17 bp, Homo sapiens
tgctcccatcattcctt

SEQ ID NO: 956547 - DNA, 16 bp, Homo sapiens
tgctcccatctcctga

SEQ ID NO: 956548 - DNA, 17 bp, Homo sapiens
tgctcccattcctccct

SEQ ID NO: 956549 - DNA, 19 bp, Homo sapiens
gggtgagaatcctgcctct

SEQ ID NO: 956550 - DNA, 15 bp, Homo sapiens
gggtgagagcaccca

SEQ ID NO: 956551 - DNA, 16 bp, Homo sapiens
gggtgagagcacccac

SEQ ID NO: 956552 - DNA, 14 bp, Homo sapiens
gggtgagaggcagg

SEQ ID NO: 956553 - DNA, 15 bp, Homo sapiens
gggtgagaggcagga

SEQ ID NO: 956554 - DNA, 17 bp, Homo sapiens
gggtgagaggcaggaat

SEQ ID NO: 956555 - DNA, 18 bp, Homo sapiens
gggtgagaggcaggaatg

SEQ ID NO: 956556 - DNA, 14 bp, Homo sapiens
gggtgagcctgact

SEQ ID NO: 956557 - DNA, 18 bp, Homo sapiens
gggtgaggaccactcctg

SEQ ID NO: 956558 - DNA, 16 bp, Homo sapiens
gggtgaggaggacaag

SEQ ID NO: 956559 - DNA, 14 bp, Homo sapiens
gggtgaggataaca

SEQ ID NO: 956560 - DNA, 13 bp, Homo sapiens
gggtgaggtaggc

SEQ ID NO: 956561 - DNA, 21 bp, Homo sapiens
gggtgagtcccctactccctc

SEQ ID NO: 956562 - DNA, 18 bp, Homo sapiens
gggtgatgcttttgctgc

SEQ ID NO: 956563 - DNA, 18 bp, Homo sapiens
gggtgatggccagcccct

SEQ ID NO: 956564 - DNA, 22 bp, Homo sapiens
gggtgatttcagagagggcaga

SEQ ID NO: 956565 - DNA, 16 bp, Homo sapiens
gggtgcaaagactctg

SEQ ID NO: 956566 - DNA, 19 bp, Homo sapiens
gggtgcaaagactctgagc

SEQ ID NO: 956567 - DNA, 21 bp, Homo sapiens
gggtgcaaagactctgagcca

SEQ ID NO: 956568 - DNA, 14 bp, Homo sapiens
gggtgcagaggctg

SEQ ID NO: 956569 - DNA, 15 bp, Homo sapiens
gggtgcagaggctgt

SEQ ID NO: 956570 - DNA, 13 bp, Homo sapiens
gggtgcagctggg

SEQ ID NO: 956571 - DNA, 15 bp, Homo sapiens
gggtgcagctgggtg

SEQ ID NO: 956572 - DNA, 16 bp, Homo sapiens
gggttttcaatgtgaa

SEQ ID NO: 956573 - DNA, 15 bp, Homo sapiens
gggttttcttttctt

SEQ ID NO: 956574 - DNA, 21 bp, Homo sapiens
gggttttgcaataacttctat

SEQ ID NO: 956575 - DNA, 23 bp, Homo sapiens
gggtttttattatttttacctaa

SEQ ID NO: 956576 - DNA, 16 bp, Homo sapiens
ggtaaaaaatttataa

SEQ ID NO: 956577 - DNA, 15 bp, Homo sapiens
ggtaaaaacccagcg

SEQ ID NO: 956578 - DNA, 18 bp, Homo sapiens
ggtaaaaagtggctgcgg

SEQ ID NO: 956579 - DNA, 13 bp, Homo sapiens
ggtaaaatacttc

SEQ ID NO: 956580 - DNA, 17 bp, Homo sapiens
ggtaaaatcacttcaga

SEQ ID NO: 956581 - DNA, 19 bp, Homo sapiens
ggtaaagccatgttaaatg

SEQ ID NO: 956582 - DNA, 13 bp, Homo sapiens
ggtaaagggacag

SEQ ID NO: 956583 - DNA, 13 bp, Homo sapiens
ggtaaatattttc

SEQ ID NO: 956584 - DNA, 15 bp, Homo sapiens
ggtaaatcagtaaga

SEQ ID NO: 956585 - DNA, 20 bp, Homo sapiens
ggtaaatggttaaattttac

SEQ ID NO: 956586 - DNA, 11 bp, Homo sapiens
ggtaaatgtta

SEQ ID NO: 956587 - DNA, 15 bp, Homo sapiens
ggtaaattaagacat

SEQ ID NO: 956588 - DNA, 12 bp, Homo sapiens
ggtaaatttttg

SEQ ID NO: 956589 - DNA, 20 bp, Homo sapiens
ggtaaatttttgaaaaatat

SEQ ID NO: 956590 - DNA, 12 bp, Homo sapiens
ggtaacagtggc

SEQ ID NO: 956591 - DNA, 21 bp, Homo sapiens
ggtaacctggccactgtccct

SEQ ID NO: 956592 - DNA, 13 bp, Homo sapiens
ggtaactaactgc

SEQ ID NO: 956593 - DNA, 20 bp, Homo sapiens
ggtaactaggatatgtatat

SEQ ID NO: 956594 - DNA, 16 bp, Homo sapiens
ggtaactgtcctgtcc

SEQ ID NO: 956595 - DNA, 22 bp, Homo sapiens
ggtaactttgcaggcggccctc

SEQ ID NO: 956596 - DNA, 23 bp, Homo sapiens
ggtaagaagccgggaacagacaa

SEQ ID NO: 956597 - DNA, 23 bp, Homo sapiens
ggtaagaagttttaaaaagccag

SEQ ID NO: 956598 - DNA, 19 bp, Homo sapiens
ggtaagaatagtagatgtg

SEQ ID NO: 956599 - DNA, 16 bp, Homo sapiens
ggtaagatgactctga

SEQ ID NO: 956600 - DNA, 15 bp, Homo sapiens
ggtaagattgttatt

SEQ ID NO: 956601 - DNA, 14 bp, Homo sapiens
ggtaagtaaacaga

SEQ ID NO: 956602 - DNA, 16 bp, Homo sapiens
ggtaagtgttctcatg

SEQ ID NO: 956603 - DNA, 18 bp, Homo sapiens
ggtaagtgttctcatgaa

SEQ ID NO: 956604 - DNA, 19 bp, Homo sapiens
ggtaagttgttaagagtgg

SEQ ID NO: 956605 - DNA, 14 bp, Homo sapiens
ggtaataacaaacg

SEQ ID NO: 956606 - DNA, 13 bp, Homo sapiens
ggtaatatacctg

SEQ ID NO: 956607 - DNA, 20 bp, Homo sapiens
ggtaatccaggcacagctga

SEQ ID NO: 956608 - DNA, 15 bp, Homo sapiens
ggtaatgtcactgtt

SEQ ID NO: 956609 - DNA, 22 bp, Homo sapiens
ggtaattgttgctaatcttctt

SEQ ID NO: 956610 - DNA, 15 bp, Homo sapiens
ggtacaaaaataaat

SEQ ID NO: 956611 - DNA, 19 bp, Homo sapiens
ggtacaaaaataaatttat

SEQ ID NO: 956612 - DNA, 13 bp, Homo sapiens
ggtacagcagggt

SEQ ID NO: 956613 - DNA, 21 bp, Homo sapiens
ggtacagcagggtcttgctgt

SEQ ID NO: 956614 - DNA, 16 bp, Homo sapiens
ggtacagcgggctgtg

SEQ ID NO: 956615 - DNA, 15 bp, Homo sapiens
ggtacaggagaggca

SEQ ID NO: 956616 - DNA, 21 bp, Homo sapiens
ggtacaggcagttaggtgctg

SEQ ID NO: 956617 - DNA, 17 bp, Homo sapiens
ggtacagtatgggggtt

SEQ ID NO: 956618 - DNA, 16 bp, Homo sapiens
ggtacatttatcactg

SEQ ID NO: 956619 - DNA, 18 bp, Homo sapiens
ggtacatttctctgagca

SEQ ID NO: 956620 - DNA, 16 bp, Homo sapiens
ggtaccaaacaaggaa

SEQ ID NO: 956621 - DNA, 22 bp, Homo sapiens
ggtaccacccttcagaccccag

SEQ ID NO: 956622 - DNA, 16 bp, Homo sapiens
ggtacccaattcaatt

SEQ ID NO: 956623 - DNA, 18 bp, Homo sapiens
ggtaccgtctacatttca

SEQ ID NO: 956624 - DNA, 16 bp, Homo sapiens
ggtacctcaagcccca

SEQ ID NO: 956625 - DNA, 20 bp, Homo sapiens
ggtacctcatgaggaccagg

SEQ ID NO: 956626 - DNA, 21 bp, Homo sapiens
ggtactaaacccgcaccccag

SEQ ID NO: 956627 - DNA, 12 bp, Homo sapiens
ggtactctccta

SEQ ID NO: 956628 - DNA, 16 bp, Homo sapiens
ggtactctcctagaga

SEQ ID NO: 956629 - DNA, 19 bp, Homo sapiens
ggtactggggtgggatctt

SEQ ID NO: 956630 - DNA, 21 bp, Homo sapiens
ggtacttagagtttctgtttg

SEQ ID NO: 956631 - DNA, 21 bp, Homo sapiens
ggtacttcctcctgatggcca

SEQ ID NO: 956632 - DNA, 16 bp, Homo sapiens
ggtacttggagggctc

SEQ ID NO: 956633 - DNA, 21 bp, Homo sapiens
ggtacttttatgatgtatatt

SEQ ID NO: 956634 - DNA, 13 bp, Homo sapiens
ggtagaaaaacat

SEQ ID NO: 956635 - DNA, 19 bp, Homo sapiens
ggtagaaaactccagggtc

SEQ ID NO: 956636 - DNA, 23 bp, Homo sapiens
ggtagaaatatctgaaaatgtat

SEQ ID NO: 956637 - DNA, 11 bp, Homo sapiens
ggtagaaatgc

SEQ ID NO: 956638 - DNA, 15 bp, Homo sapiens
ggtagaaggaaagca

SEQ ID NO: 956639 - DNA, 16 bp, Homo sapiens
ggtagaatgattaatc

SEQ ID NO: 956640 - DNA, 19 bp, Homo sapiens
ggtagaatgtaaagcttgt

SEQ ID NO: 956641 - DNA, 19 bp, Homo sapiens
ggtagagattcattatttt

SEQ ID NO: 956642 - DNA, 17 bp, Homo sapiens
ggtagagcaaaggagac

SEQ ID NO: 956643 - DNA, 15 bp, Homo sapiens
ggtagagtcattcat

SEQ ID NO: 956644 - DNA, 23 bp, Homo sapiens
ggtagagtttgaaggaggtgagg

SEQ ID NO: 956645 - DNA, 23 bp, Homo sapiens
ggtagatgatttctagcaggcag

SEQ ID NO: 956646 - DNA, 16 bp, Homo sapiens
ggtagcagcaggctca

SEQ ID NO: 956647 - DNA, 12 bp, Homo sapiens
ggtagcagctgg

SEQ ID NO: 956648 - DNA, 21 bp, Homo sapiens
ggtagccagcacacagggcag

SEQ ID NO: 956649 - DNA, 14 bp, Homo sapiens
ggtagcctgctgtg

SEQ ID NO: 956650 - DNA, 14 bp, Homo sapiens
ggtagcgagctgct

SEQ ID NO: 956651 - DNA, 21 bp, Homo sapiens
ggtagctgtaaggcatgaagg

SEQ ID NO: 956652 - DNA, 14 bp, Homo sapiens
ggtagcttttccct

SEQ ID NO: 956653 - DNA, 19 bp, Homo sapiens
ggtaggagagcactgcctc

SEQ ID NO: 956654 - DNA, 15 bp, Homo sapiens
ggtaggagaggagaa

SEQ ID NO: 956655 - DNA, 19 bp, Homo sapiens
ggtaggagaggagaaaaaa

SEQ ID NO: 956656 - DNA, 20 bp, Homo sapiens
ggtaggagcccttctctttg

SEQ ID NO: 956657 - DNA, 19 bp, Homo sapiens
ggtaggaggtttggatggg

SEQ ID NO: 956658 - DNA, 18 bp, Homo sapiens
ggtaggagttttgttcca

SEQ ID NO: 956659 - DNA, 16 bp, Homo sapiens
ggtaggcccttgtcct

SEQ ID NO: 956660 - DNA, 21 bp, Homo sapiens
ggtaggcccttgtcctgccag

SEQ ID NO: 956661 - DNA, 22 bp, Homo sapiens
ggtaggcccttgtcctgccagc

SEQ ID NO: 956662 - DNA, 17 bp, Homo sapiens
ggtaggggagggcaggc

SEQ ID NO: 956663 - DNA, 15 bp, Homo sapiens
ggtaggtgtggtggc

SEQ ID NO: 956664 - DNA, 18 bp, Homo sapiens
ggtaggtgtggtggcgtt

SEQ ID NO: 956665 - DNA, 15 bp, Homo sapiens
ggtaggttgggacac

SEQ ID NO: 956666 - DNA, 19 bp, Homo sapiens
ggtaggttgggacaccagg

SEQ ID NO: 956667 - DNA, 22 bp, Homo sapiens
ggtagtactcctgcaaaatttt

SEQ ID NO: 956668 - DNA, 14 bp, Homo sapiens
ggtagtactgggaa

SEQ ID NO: 956669 - DNA, 16 bp, Homo sapiens
ggtagtgcagggcaca

SEQ ID NO: 956670 - DNA, 16 bp, Homo sapiens
ggtagttagtagcatg

SEQ ID NO: 956671 - DNA, 19 bp, Homo sapiens
ggtagttagtagcatgttg

SEQ ID NO: 956672 - DNA, 19 bp, Homo sapiens
ggtagttgggtagaaaaat

SEQ ID NO: 956673 - DNA, 20 bp, Homo sapiens
ggtagttttttcatcttcag

SEQ ID NO: 956674 - DNA, 20 bp, Homo sapiens
ggtataagttgctgtaaaat

SEQ ID NO: 956675 - DNA, 14 bp, Homo sapiens
ggtataatgtttaa

SEQ ID NO: 956676 - DNA, 16 bp, Homo sapiens
ggtatatccaaaagct

SEQ ID NO: 956677 - DNA, 19 bp, Homo sapiens
ggtatcattcaactctcca

SEQ ID NO: 956678 - DNA, 13 bp, Homo sapiens
ggtatcctccctg

SEQ ID NO: 956679 - DNA, 14 bp, Homo sapiens
ggtatcctccctgc

SEQ ID NO: 956680 - DNA, 18 bp, Homo sapiens
tgctctgaatctgtacat

SEQ ID NO: 956681 - DNA, 21 bp, Homo sapiens
tgctctgaatctgtacatgtt

SEQ ID NO: 956682 - DNA, 21 bp, Homo sapiens
tgctctgaccatgaggtgggg

SEQ ID NO: 956683 - DNA, 18 bp, Homo sapiens
tgctctgacgtagaaaga

SEQ ID NO: 956684 - DNA, 18 bp, Homo sapiens
tgctctgaggcttccaga

SEQ ID NO: 956685 - DNA, 21 bp, Homo sapiens
tgctctgaggtcaataaagca

SEQ ID NO: 956686 - DNA, 22 bp, Homo sapiens
tgctctgaggtcaataaagcag

SEQ ID NO: 956687 - DNA, 13 bp, Homo sapiens
tgctctgatccct

SEQ ID NO: 956688 - DNA, 21 bp, Homo sapiens
tgctctgcaggctggggaggt

SEQ ID NO: 956689 - DNA, 17 bp, Homo sapiens
tgctctgccccaagccc

SEQ ID NO: 956690 - DNA, 18 bp, Homo sapiens
tgctctgccccaagcccc

SEQ ID NO: 956691 - DNA, 19 bp, Homo sapiens
tgctctgccccaccttgcc

SEQ ID NO: 956692 - DNA, 12 bp, Homo sapiens
tgctctgcccct

SEQ ID NO: 956693 - DNA, 12 bp, Homo sapiens
tgctctgccctt

SEQ ID NO: 956694 - DNA, 14 bp, Homo sapiens
tgctctgcctggag

SEQ ID NO: 956695 - DNA, 15 bp, Homo sapiens
tgctctgcctggagt

SEQ ID NO: 956696 - DNA, 22 bp, Homo sapiens
tgctctgcgtgtcacctgtgct

SEQ ID NO: 956697 - DNA, 18 bp, Homo sapiens
tgctctgctggtcttcaa

SEQ ID NO: 956698 - DNA, 14 bp, Homo sapiens
tgctctggagcagc

SEQ ID NO: 956699 - DNA, 21 bp, Homo sapiens
tgctctggagcagccaaggcc

SEQ ID NO: 956700 - DNA, 18 bp, Homo sapiens
tgctctggaggaagttct

SEQ ID NO: 956701 - DNA, 19 bp, Homo sapiens
tgctctggaggaagttctc

SEQ ID NO: 956702 - DNA, 21 bp, Homo sapiens
tgctctggaggaagttctcca

SEQ ID NO: 956703 - DNA, 15 bp, Homo sapiens
tgctctggaggctgc

SEQ ID NO: 956704 - DNA, 13 bp, Homo sapiens
tgctctggcggct

SEQ ID NO: 956705 - DNA, 21 bp, Homo sapiens
tgctctggcggcttcctgtcc

SEQ ID NO: 956706 - DNA, 24 bp, Homo sapiens
tgctctggcggcttcctgtccact

SEQ ID NO: 956707 - DNA, 20 bp, Homo sapiens
tgctctggcttgccccagga

SEQ ID NO: 956708 - DNA, 19 bp, Homo sapiens
tgctctggggatttctggg

SEQ ID NO: 956709 - DNA, 15 bp, Homo sapiens
tgctctggtctgacc

SEQ ID NO: 956710 - DNA, 21 bp, Homo sapiens
tgctctggtctgaccgatgtg

SEQ ID NO: 956711 - DNA, 19 bp, Homo sapiens
tgctctggttgtttctgtt

SEQ ID NO: 956712 - DNA, 23 bp, Homo sapiens
tgctctggttgtttctgttccaa

SEQ ID NO: 956713 - DNA, 21 bp, Homo sapiens
tgctctgtcccccaggctgga

SEQ ID NO: 956714 - DNA, 16 bp, Homo sapiens
tgctctgtctcccagg

SEQ ID NO: 956715 - DNA, 20 bp, Homo sapiens
tgctctgtgttcccagaggc

SEQ ID NO: 956716 - DNA, 22 bp, Homo sapiens
tgctctgtgttcccagaggcag

SEQ ID NO: 956717 - DNA, 20 bp, Homo sapiens
tgctcttaagaaactatgaa

SEQ ID NO: 956718 - DNA, 21 bp, Homo sapiens
tgctcttactacactgaggag

SEQ ID NO: 956719 - DNA, 15 bp, Homo sapiens
tgctcttagtcccaa

SEQ ID NO: 956720 - DNA, 21 bp, Homo sapiens
tgctcttagtgcccgcctagg

SEQ ID NO: 956721 - DNA, 22 bp, Homo sapiens
tgctcttctccacgtctttcct

SEQ ID NO: 956722 - DNA, 16 bp, Homo sapiens
tgctcttctttctgag

SEQ ID NO: 956723 - DNA, 19 bp, Homo sapiens
tgctcttgcagttgctctg

SEQ ID NO: 956724 - DNA, 12 bp, Homo sapiens
tgctcttggaaa

SEQ ID NO: 956725 - DNA, 18 bp, Homo sapiens
tgctcttggaaagctgat

SEQ ID NO: 956726 - DNA, 16 bp, Homo sapiens
tgctcttggctgaccc

SEQ ID NO: 956727 - DNA, 17 bp, Homo sapiens
tgctcttggctgacccc

SEQ ID NO: 956728 - DNA, 14 bp, Homo sapiens
tgctcttgtcccac

SEQ ID NO: 956729 - DNA, 16 bp, Homo sapiens
tgctcttgtcccacgt

SEQ ID NO: 956730 - DNA, 17 bp, Homo sapiens
tgctcttgttctgttcc

SEQ ID NO: 956731 - DNA, 18 bp, Homo sapiens
tgctcttgtttcactcca

SEQ ID NO: 956732 - DNA, 15 bp, Homo sapiens
tgctcttgtttttat

SEQ ID NO: 956733 - DNA, 18 bp, Homo sapiens
tgctcttgtttttattaa

SEQ ID NO: 956734 - DNA, 21 bp, Homo sapiens
tgctctttctctgccagtgac

SEQ ID NO: 956735 - DNA, 16 bp, Homo sapiens
tgctcttttaagcagt

SEQ ID NO: 956736 - DNA, 22 bp, Homo sapiens
tgctcttttggtggggagcact

SEQ ID NO: 956737 - DNA, 17 bp, Homo sapiens
tgctcttttgtgatgaa

SEQ ID NO: 956738 - DNA, 16 bp, Homo sapiens
tgctgaaaaatatagc

SEQ ID NO: 956739 - DNA, 14 bp, Homo sapiens
tgctgaaaatggta

SEQ ID NO: 956740 - DNA, 18 bp, Homo sapiens
tgctgaaagtcctgcttt

SEQ ID NO: 956741 - DNA, 17 bp, Homo sapiens
tgctgaaattttatatg

SEQ ID NO: 956742 - DNA, 17 bp, Homo sapiens
tgctgaacacagtgtct

SEQ ID NO: 956743 - DNA, 14 bp, Homo sapiens
tgctgaacagtgga

SEQ ID NO: 956744 - DNA, 18 bp, Homo sapiens
tgctgaacattgttctga

SEQ ID NO: 956745 - DNA, 17 bp, Homo sapiens
tgctgaactccttgtta

SEQ ID NO: 956746 - DNA, 20 bp, Homo sapiens
tgctgaactcttaggcacat

SEQ ID NO: 956747 - DNA, 17 bp, Homo sapiens
tgctgaaggtccaggct

SEQ ID NO: 956748 - DNA, 23 bp, Homo sapiens
tgctgaatacagaggcaactgca

SEQ ID NO: 956749 - DNA, 18 bp, Homo sapiens
tgctgaatatacagcagg

SEQ ID NO: 956750 - DNA, 18 bp, Homo sapiens
tgctgaatcccatcaggc

SEQ ID NO: 956751 - DNA, 17 bp, Homo sapiens
tgctgaatgcagggaat

SEQ ID NO: 956752 - DNA, 15 bp, Homo sapiens
tgctgaatgccccct

SEQ ID NO: 956753 - DNA, 22 bp, Homo sapiens
tgctgaattgagaataagaatt

SEQ ID NO: 956754 - DNA, 16 bp, Homo sapiens
tgctgacaacttagct

SEQ ID NO: 956755 - DNA, 14 bp, Homo sapiens
tgctgacagacact

SEQ ID NO: 956756 - DNA, 22 bp, Homo sapiens
tgctgacagacactaactttgt

SEQ ID NO: 956757 - DNA, 18 bp, Homo sapiens
tgctgacagctgctccta

SEQ ID NO: 956758 - DNA, 14 bp, Homo sapiens
tgctgaccccaggt

SEQ ID NO: 956759 - DNA, 16 bp, Homo sapiens
tgctgaccccaggtca

SEQ ID NO: 956760 - DNA, 18 bp, Homo sapiens
tgctgaccccaggtcagc

SEQ ID NO: 956761 - DNA, 21 bp, Homo sapiens
tgctgaccccaggtcagccct

SEQ ID NO: 956762 - DNA, 21 bp, Homo sapiens
tgctgactactactctgccaa

SEQ ID NO: 956763 - DNA, 23 bp, Homo sapiens
tgctgactctctgagctggggag

SEQ ID NO: 956764 - DNA, 14 bp, Homo sapiens
tgctgactgtactc

SEQ ID NO: 956765 - DNA, 16 bp, Homo sapiens
tgctgactgtactcct

SEQ ID NO: 956766 - DNA, 15 bp, Homo sapiens
tgctgagaaaacatg

SEQ ID NO: 956767 - DNA, 17 bp, Homo sapiens
tgctgagagacccaagg

SEQ ID NO: 956768 - DNA, 18 bp, Homo sapiens
tgctgagagacccaagga

SEQ ID NO: 956769 - DNA, 22 bp, Homo sapiens
tgctgagagggctcgaggggtg

SEQ ID NO: 956770 - DNA, 19 bp, Homo sapiens
tgctgagattgcagatgtg

SEQ ID NO: 956771 - DNA, 17 bp, Homo sapiens
tgctgagcaccctctcc

SEQ ID NO: 956772 - DNA, 19 bp, Homo sapiens
tgctgagcaccctctccgg

SEQ ID NO: 956773 - DNA, 21 bp, Homo sapiens
tgctgagcctcacagcagtga

SEQ ID NO: 956774 - DNA, 14 bp, Homo sapiens
tgctgagcctctgc

SEQ ID NO: 956775 - DNA, 14 bp, Homo sapiens
tgctgagctggccc

SEQ ID NO: 956776 - DNA, 12 bp, Homo sapiens
tgctgagctggg

SEQ ID NO: 956777 - DNA, 15 bp, Homo sapiens
tgctgagctgggccc

SEQ ID NO: 956778 - DNA, 18 bp, Homo sapiens
tgctgagctgggcccagc

SEQ ID NO: 956779 - DNA, 21 bp, Homo sapiens
tgctgagcttagccttgtgcc

SEQ ID NO: 956780 - DNA, 21 bp, Homo sapiens
tgctgaggaggggcctgggca

SEQ ID NO: 956781 - DNA, 20 bp, Homo sapiens
tgctgaggatataagctttt

SEQ ID NO: 956782 - DNA, 16 bp, Homo sapiens
tgctgaggcccagtgc

SEQ ID NO: 956783 - DNA, 18 bp, Homo sapiens
tgctgaggcccagtgcat

SEQ ID NO: 956784 - DNA, 14 bp, Homo sapiens
tgctgaggcctggg

SEQ ID NO: 956785 - DNA, 14 bp, Homo sapiens
tgctgaggccttct

SEQ ID NO: 956786 - DNA, 16 bp, Homo sapiens
tgctgaggggcactct

SEQ ID NO: 956787 - DNA, 17 bp, Homo sapiens
tgctgaggggcactctc

SEQ ID NO: 956788 - DNA, 17 bp, Homo sapiens
tgctgaggttttgaata

SEQ ID NO: 956789 - DNA, 19 bp, Homo sapiens
tgctgagtaaggaacacga

SEQ ID NO: 956790 - DNA, 21 bp, Homo sapiens
tgctgagtatgttaagctctt

SEQ ID NO: 956791 - DNA, 17 bp, Homo sapiens
tgctgagtcatctgtta

SEQ ID NO: 956792 - DNA, 19 bp, Homo sapiens
tgctgagtcatctgttagg

SEQ ID NO: 956793 - DNA, 15 bp, Homo sapiens
tgctgagtcccaggc

SEQ ID NO: 956794 - DNA, 14 bp, Homo sapiens
tgctgagtgctggg

SEQ ID NO: 956795 - DNA, 23 bp, Homo sapiens
tgctgagtgtacagagtggaata

SEQ ID NO: 956796 - DNA, 16 bp, Homo sapiens
tgctgataatcatttt

SEQ ID NO: 956797 - DNA, 14 bp, Homo sapiens
tgctgataattgtg

SEQ ID NO: 956798 - DNA, 18 bp, Homo sapiens
tgctgatattttctctag

SEQ ID NO: 956799 - DNA, 19 bp, Homo sapiens
tgctgatccggctgctcct

SEQ ID NO: 956800 - DNA, 19 bp, Homo sapiens
tgctgatcgtagaaaattt

SEQ ID NO: 956801 - DNA, 22 bp, Homo sapiens
tgctgatcgtagaaaatttgct

SEQ ID NO: 956802 - DNA, 19 bp, Homo sapiens
tgctgatgctcctccgggt

SEQ ID NO: 956803 - DNA, 16 bp, Homo sapiens
tgctgatggagccttc

SEQ ID NO: 956804 - DNA, 18 bp, Homo sapiens
ggtatcctgcccagtgtt

SEQ ID NO: 956805 - DNA, 22 bp, Homo sapiens
ggtatcgaaatttgttgtttgt

SEQ ID NO: 956806 - DNA, 19 bp, Homo sapiens
ggtatctcagaaagtgcct

SEQ ID NO: 956807 - DNA, 16 bp, Homo sapiens
ggtatctccaggattg

SEQ ID NO: 956808 - DNA, 14 bp, Homo sapiens
ggtatgctggccag

SEQ ID NO: 956809 - DNA, 13 bp, Homo sapiens
ggtatgtgccagg

SEQ ID NO: 956810 - DNA, 12 bp, Homo sapiens
ggtatgtttaat

SEQ ID NO: 956811 - DNA, 16 bp, Homo sapiens
ggtattaataaaaaga

SEQ ID NO: 956812 - DNA, 22 bp, Homo sapiens
ggtattaatatatagtccagac

SEQ ID NO: 956813 - DNA, 15 bp, Homo sapiens
ggtatttaagactga

SEQ ID NO: 956814 - DNA, 14 bp, Homo sapiens
ggtatttctccagt

SEQ ID NO: 956815 - DNA, 20 bp, Homo sapiens
ggtcccatggctgaagctgg

SEQ ID NO: 956816 - DNA, 17 bp, Homo sapiens
ggtcccatttctcactg

SEQ ID NO: 956817 - DNA, 16 bp, Homo sapiens
ggtccccacagactgc

SEQ ID NO: 956818 - DNA, 21 bp, Homo sapiens
ggtccccacagactgccccag

SEQ ID NO: 956819 - DNA, 22 bp, Homo sapiens
ggtccccacagactgccccagc

SEQ ID NO: 956820 - DNA, 12 bp, Homo sapiens
ggtccccactgc

SEQ ID NO: 956821 - DNA, 21 bp, Homo sapiens
ggtccccactgctgagctggc

SEQ ID NO: 956822 - DNA, 22 bp, Homo sapiens
ggtccccactgctgagctggcc

SEQ ID NO: 956823 - DNA, 16 bp, Homo sapiens
ggtccccatcatccca

SEQ ID NO: 956824 - DNA, 23 bp, Homo sapiens
ggtccccatccccaccagctcgt

SEQ ID NO: 956825 - DNA, 21 bp, Homo sapiens
ggtccccccaccgctcagtgt

SEQ ID NO: 956826 - DNA, 23 bp, Homo sapiens
ggtccccccaccgctcagtgtca

SEQ ID NO: 956827 - DNA, 21 bp, Homo sapiens
ggtcccccgactgcctgtctc

SEQ ID NO: 956828 - DNA, 13 bp, Homo sapiens
ggtccccctcagc

SEQ ID NO: 956829 - DNA, 20 bp, Homo sapiens
ggtccccctcagcaagccct

SEQ ID NO: 956830 - DNA, 17 bp, Homo sapiens
ggtccccgagtgcctag

SEQ ID NO: 956831 - DNA, 11 bp, Homo sapiens
ggtcccctccc

SEQ ID NO: 956832 - DNA, 23 bp, Homo sapiens
ggtcccctccccagctcccttgg

SEQ ID NO: 956833 - DNA, 12 bp, Homo sapiens
ggtcccctctgt

SEQ ID NO: 956834 - DNA, 15 bp, Homo sapiens
ggtcccctgcctgga

SEQ ID NO: 956835 - DNA, 18 bp, Homo sapiens
ggtcccctgcctggaact

SEQ ID NO: 956836 - DNA, 24 bp, Homo sapiens
ggtcccggttcagacccctgcctg

SEQ ID NO: 956837 - DNA, 13 bp, Homo sapiens
ggtccctctcaga

SEQ ID NO: 956838 - DNA, 22 bp, Homo sapiens
ggtccctctcagatacccagtg

SEQ ID NO: 956839 - DNA, 19 bp, Homo sapiens
ggtccctcttctctcctca

SEQ ID NO: 956840 - DNA, 20 bp, Homo sapiens
ggtccctcttctctcctcag

SEQ ID NO: 956841 - DNA, 11 bp, Homo sapiens
ggtccctgctc

SEQ ID NO: 956842 - DNA, 13 bp, Homo sapiens
ggtccctgctccc

SEQ ID NO: 956843 - DNA, 19 bp, Homo sapiens
ggtcccttccatgccctgg

SEQ ID NO: 956844 - DNA, 20 bp, Homo sapiens
ggtcccttgagacctcagcc

SEQ ID NO: 956845 - DNA, 15 bp, Homo sapiens
ggtccgcaccagctg

SEQ ID NO: 956846 - DNA, 20 bp, Homo sapiens
ggtccgcaccagctgctctg

SEQ ID NO: 956847 - DNA, 21 bp, Homo sapiens
ggtccgcaccagctgctctgc

SEQ ID NO: 956848 - DNA, 20 bp, Homo sapiens
ggtccgccttaatctggaag

SEQ ID NO: 956849 - DNA, 15 bp, Homo sapiens
ggtccggcgccccgc

SEQ ID NO: 956850 - DNA, 17 bp, Homo sapiens
ggtccggtgtccttttc

SEQ ID NO: 956851 - DNA, 20 bp, Homo sapiens
ggtccgtgcccaggcccttg

SEQ ID NO: 956852 - DNA, 23 bp, Homo sapiens
ggtcctaaaacttggatggactt

SEQ ID NO: 956853 - DNA, 19 bp, Homo sapiens
ggtcctagcccagtgcttc

SEQ ID NO: 956854 - DNA, 16 bp, Homo sapiens
ggtcctagcccttccc

SEQ ID NO: 956855 - DNA, 16 bp, Homo sapiens
ggtcctcagctgctcc

SEQ ID NO: 956856 - DNA, 14 bp, Homo sapiens
ggtcctcaggtcag

SEQ ID NO: 956857 - DNA, 15 bp, Homo sapiens
ggtcctcaggtcagc

SEQ ID NO: 956858 - DNA, 23 bp, Homo sapiens
ggtcctccgtagggtctttcttg

SEQ ID NO: 956859 - DNA, 21 bp, Homo sapiens
ggtcctcctaagtcccttcct

SEQ ID NO: 956860 - DNA, 12 bp, Homo sapiens
ggtcctcctcgc

SEQ ID NO: 956861 - DNA, 12 bp, Homo sapiens
ggtcctctcagt

SEQ ID NO: 956862 - DNA, 22 bp, Homo sapiens
ggtcctctctctgtggggctga

SEQ ID NO: 956863 - DNA, 21 bp, Homo sapiens
ggtcctctgatacccagagca

SEQ ID NO: 956864 - DNA, 22 bp, Homo sapiens
ggtcctcttctgggcctgacca

SEQ ID NO: 956865 - DNA, 22 bp, Homo sapiens
ggtcctcttttcctggcagctg

SEQ ID NO: 956866 - DNA, 18 bp, Homo sapiens
ggtcctgaagaattaaga

SEQ ID NO: 956867 - DNA, 16 bp, Homo sapiens
ggtcctgcagggggag

SEQ ID NO: 956868 - DNA, 17 bp, Homo sapiens
ggtcctgccctccggag

SEQ ID NO: 956869 - DNA, 16 bp, Homo sapiens
ggtcctggacacctcc

SEQ ID NO: 956870 - DNA, 18 bp, Homo sapiens
ggtcctggacacctccca

SEQ ID NO: 956871 - DNA, 23 bp, Homo sapiens
ggtcctggacacctcccagggga

SEQ ID NO: 956872 - DNA, 17 bp, Homo sapiens
ggtcctggagcagacca

SEQ ID NO: 956873 - DNA, 13 bp, Homo sapiens
ggtcctggccatc

SEQ ID NO: 956874 - DNA, 16 bp, Homo sapiens
ggtcctggccatccca

SEQ ID NO: 956875 - DNA, 13 bp, Homo sapiens
ggtcctggcctcc

SEQ ID NO: 956876 - DNA, 12 bp, Homo sapiens
ggtcctggctcc

SEQ ID NO: 956877 - DNA, 16 bp, Homo sapiens
ggtcctgggcaggtgg

SEQ ID NO: 956878 - DNA, 21 bp, Homo sapiens
ggtcctgtcgccaccacttcc

SEQ ID NO: 956879 - DNA, 15 bp, Homo sapiens
ggtcctgtggatggg

SEQ ID NO: 956880 - DNA, 21 bp, Homo sapiens
ggtccttcaagttagctcagg

SEQ ID NO: 956881 - DNA, 16 bp, Homo sapiens
ggtccttgatgccaga

SEQ ID NO: 956882 - DNA, 19 bp, Homo sapiens
ggtccttgatgccagaggg

SEQ ID NO: 956883 - DNA, 20 bp, Homo sapiens
ggtccttgatgccagagggc

SEQ ID NO: 956884 - DNA, 22 bp, Homo sapiens
ggtccttgatgccagagggcca

SEQ ID NO: 956885 - DNA, 20 bp, Homo sapiens
ggtccttgcctgaactccag

SEQ ID NO: 956886 - DNA, 20 bp, Homo sapiens
ggtccttggtgtgaccctct

SEQ ID NO: 956887 - DNA, 16 bp, Homo sapiens
ggtcgaggagtaacaa

SEQ ID NO: 956888 - DNA, 13 bp, Homo sapiens
ggtcgaggcagga

SEQ ID NO: 956889 - DNA, 14 bp, Homo sapiens
ggtcgcccaggaga

SEQ ID NO: 956890 - DNA, 14 bp, Homo sapiens
ggtcgctcctgccc

SEQ ID NO: 956891 - DNA, 18 bp, Homo sapiens
ggtcgcttgggaatttta

SEQ ID NO: 956892 - DNA, 14 bp, Homo sapiens
ggtcggaaaacatg

SEQ ID NO: 956893 - DNA, 16 bp, Homo sapiens
ggtcggacggggcagg

SEQ ID NO: 956894 - DNA, 15 bp, Homo sapiens
ggtcgggcagccagc

SEQ ID NO: 956895 - DNA, 17 bp, Homo sapiens
ggtctaaagtgtttagc

SEQ ID NO: 956896 - DNA, 20 bp, Homo sapiens
ggtctaactgtggaatataa

SEQ ID NO: 956897 - DNA, 21 bp, Homo sapiens
ggtctaaggagcgctagtgcc

SEQ ID NO: 956898 - DNA, 18 bp, Homo sapiens
ggtctacctcatctctga

SEQ ID NO: 956899 - DNA, 14 bp, Homo sapiens
ggtctagggagaga

SEQ ID NO: 956900 - DNA, 13 bp, Homo sapiens
ggtctatggggag

SEQ ID NO: 956901 - DNA, 14 bp, Homo sapiens
ggtctattgtcgct

SEQ ID NO: 956902 - DNA, 23 bp, Homo sapiens
ggtctattgtcgctatgtgactt

SEQ ID NO: 956903 - DNA, 17 bp, Homo sapiens
ggtctcaaactcctgac

SEQ ID NO: 956904 - DNA, 23 bp, Homo sapiens
ggtctcaaactcctgggctcagg

SEQ ID NO: 956905 - DNA, 18 bp, Homo sapiens
ggtctcacagtgttgccc

SEQ ID NO: 956906 - DNA, 20 bp, Homo sapiens
ggtctcacagtgttgcccag

SEQ ID NO: 956907 - DNA, 13 bp, Homo sapiens
ggtctcactctgt

SEQ ID NO: 956908 - DNA, 19 bp, Homo sapiens
ggtctcactctgtcgctca

SEQ ID NO: 956909 - DNA, 23 bp, Homo sapiens
ggtctcagcttgtatatagagat

SEQ ID NO: 956910 - DNA, 21 bp, Homo sapiens
ggtctcaggatatccttatca

SEQ ID NO: 956911 - DNA, 22 bp, Homo sapiens
ggtctcaggatatccttatcag

SEQ ID NO: 956912 - DNA, 15 bp, Homo sapiens
ggtctcaggttcttt

SEQ ID NO: 956913 - DNA, 18 bp, Homo sapiens
ggtctcatgctccttaat

SEQ ID NO: 956914 - DNA, 12 bp, Homo sapiens
ggtctccaaggg

SEQ ID NO: 956915 - DNA, 16 bp, Homo sapiens
ggtctccaagggaggg

SEQ ID NO: 956916 - DNA, 21 bp, Homo sapiens
ggtctcccaaagtgctgggat

SEQ ID NO: 956917 - DNA, 23 bp, Homo sapiens
ggtctcccaaagtgctgggatta

SEQ ID NO: 956918 - DNA, 13 bp, Homo sapiens
ggtctcccctcct

SEQ ID NO: 956919 - DNA, 17 bp, Homo sapiens
ggtctcccctcctgcac

SEQ ID NO: 956920 - DNA, 21 bp, Homo sapiens
ggtctcccctcctgcacacag

SEQ ID NO: 956921 - DNA, 21 bp, Homo sapiens
ggtctccctgtgttacccagg

SEQ ID NO: 956922 - DNA, 18 bp, Homo sapiens
ggtctcctcagggtgggg

SEQ ID NO: 956923 - DNA, 23 bp, Homo sapiens
ggtctcctggaccttgacagagc

SEQ ID NO: 956924 - DNA, 15 bp, Homo sapiens
ggtctcgcagcctga

SEQ ID NO: 956925 - DNA, 17 bp, Homo sapiens
ggtctcgcagcctgaag

SEQ ID NO: 956926 - DNA, 19 bp, Homo sapiens
ggtctcgctttgttgccca

SEQ ID NO: 956927 - DNA, 21 bp, Homo sapiens
ggtctcgctttgttgcccagg

SEQ ID NO: 956928 - DNA, 14 bp, Homo sapiens
ggtctctctcccta

SEQ ID NO: 956929 - DNA, 19 bp, Homo sapiens
ggtctctctctctctacaa

SEQ ID NO: 956930 - DNA, 13 bp, Homo sapiens
ggtctctgctggg

SEQ ID NO: 956931 - DNA, 12 bp, Homo sapiens
ggtctctgggga

SEQ ID NO: 956932 - DNA, 19 bp, Homo sapiens
ggtctctgtacgggccagt

SEQ ID NO: 956933 - DNA, 22 bp, Homo sapiens
tgctggcccctcacctgggcac

SEQ ID NO: 956934 - DNA, 18 bp, Homo sapiens
tgctggcctctctgacat

SEQ ID NO: 956935 - DNA, 15 bp, Homo sapiens
tgctggcctggatct

SEQ ID NO: 956936 - DNA, 13 bp, Homo sapiens
ggtctgaaatgga

SEQ ID NO: 956937 - DNA, 12 bp, Homo sapiens
ggtctgaatgtt

SEQ ID NO: 956938 - DNA, 14 bp, Homo sapiens
ggtctgaatgttct

SEQ ID NO: 956939 - DNA, 15 bp, Homo sapiens
ggtctgacagtcctt

SEQ ID NO: 956940 - DNA, 17 bp, Homo sapiens
ggtctgagcaccccctc

SEQ ID NO: 956941 - DNA, 15 bp, Homo sapiens
ggtctgcagaccatc

SEQ ID NO: 956942 - DNA, 16 bp, Homo sapiens
ggtctgcagcctgctg

SEQ ID NO: 956943 - DNA, 21 bp, Homo sapiens
ggtctgcagcctgctggggct

SEQ ID NO: 956944 - DNA, 19 bp, Homo sapiens
ggtctggactgacagcatg

SEQ ID NO: 956945 - DNA, 22 bp, Homo sapiens
ggtctggagaagcagtgagccg

SEQ ID NO: 956946 - DNA, 22 bp, Homo sapiens
ggtctggatgggaggagagcca

SEQ ID NO: 956947 - DNA, 14 bp, Homo sapiens
ggtctggcagagcc

SEQ ID NO: 956948 - DNA, 20 bp, Homo sapiens
ggtctggcagagcctctgag

SEQ ID NO: 956949 - DNA, 15 bp, Homo sapiens
ggtctggcagcctcc

SEQ ID NO: 956950 - DNA, 15 bp, Homo sapiens
ggtctggctgagctg

SEQ ID NO: 956951 - DNA, 14 bp, Homo sapiens
ggtctgggcaagta

SEQ ID NO: 956952 - DNA, 16 bp, Homo sapiens
ggtctgggcagtgcca

SEQ ID NO: 956953 - DNA, 22 bp, Homo sapiens
ggtctgggcagtgccacagcct

SEQ ID NO: 956954 - DNA, 14 bp, Homo sapiens
ggtctgggctgggc

SEQ ID NO: 956955 - DNA, 17 bp, Homo sapiens
ggtctgtaactgcccag

SEQ ID NO: 956956 - DNA, 18 bp, Homo sapiens
ggtctgtaactgcccagc

SEQ ID NO: 956957 - DNA, 21 bp, Homo sapiens
ggtctgtaactgcccagcccc

SEQ ID NO: 956958 - DNA, 14 bp, Homo sapiens
ggtctgtagggatt

SEQ ID NO: 956959 - DNA, 17 bp, Homo sapiens
ggtctgtgctgtgcctg

SEQ ID NO: 956960 - DNA, 19 bp, Homo sapiens
ggtctgtgctgtgcctgct

SEQ ID NO: 956961 - DNA, 13 bp, Homo sapiens
ggtctgtgtctct

SEQ ID NO: 956962 - DNA, 18 bp, Homo sapiens
ggtctgtgtgctgtttga

SEQ ID NO: 956963 - DNA, 17 bp, Homo sapiens
ggtctgttctttccaaa

SEQ ID NO: 956964 - DNA, 20 bp, Homo sapiens
ggtctgttggcaggctggcc

SEQ ID NO: 956965 - DNA, 15 bp, Homo sapiens
ggtctgtttaaagtg

SEQ ID NO: 956966 - DNA, 20 bp, Homo sapiens
ggtctgtttgtctgaacaaa

SEQ ID NO: 956967 - DNA, 15 bp, Homo sapiens
ggtctgttttggtcc

SEQ ID NO: 956968 - DNA, 19 bp, Homo sapiens
ggtcttacctctctgggac

SEQ ID NO: 956969 - DNA, 17 bp, Homo sapiens
ggtcttaggatgtctgt

SEQ ID NO: 956970 - DNA, 17 bp, Homo sapiens
ggtcttagttctggttg

SEQ ID NO: 956971 - DNA, 19 bp, Homo sapiens
ggtcttatctgttcagtgt

SEQ ID NO: 956972 - DNA, 16 bp, Homo sapiens
ggtcttcagcctccct

SEQ ID NO: 956973 - DNA, 17 bp, Homo sapiens
ggtcttcagcctccctc

SEQ ID NO: 956974 - DNA, 10 bp, Homo sapiens
ggtcttcctt

SEQ ID NO: 956975 - DNA, 16 bp, Homo sapiens
ggtcttgcagtggctt

SEQ ID NO: 956976 - DNA, 19 bp, Homo sapiens
ggtcttgccccatcactgc

SEQ ID NO: 956977 - DNA, 14 bp, Homo sapiens
ggtcttgctctgtc

SEQ ID NO: 956978 - DNA, 20 bp, Homo sapiens
ggtcttgctctgtcccccag

SEQ ID NO: 956979 - DNA, 23 bp, Homo sapiens
ggtcttggagctgagcctctcac

SEQ ID NO: 956980 - DNA, 13 bp, Homo sapiens
ggtcttgggaaat

SEQ ID NO: 956981 - DNA, 21 bp, Homo sapiens
ggtcttgggggtcagggggga

SEQ ID NO: 956982 - DNA, 18 bp, Homo sapiens
ggtctttcctaaggctgc

SEQ ID NO: 956983 - DNA, 14 bp, Homo sapiens
ggtctttctcctca

SEQ ID NO: 956984 - DNA, 17 bp, Homo sapiens
ggtctttgcacatgtga

SEQ ID NO: 956985 - DNA, 21 bp, Homo sapiens
ggtctttttctcttctgttct

SEQ ID NO: 956986 - DNA, 14 bp, Homo sapiens
ggtgaaaatgtttt

SEQ ID NO: 956987 - DNA, 23 bp, Homo sapiens
ggtgaaatttattagttaatata

SEQ ID NO: 956988 - DNA, 19 bp, Homo sapiens
ggtgaacaaagcagccacg

SEQ ID NO: 956989 - DNA, 21 bp, Homo sapiens
ggtgaactgagctgggcagga

SEQ ID NO: 956990 - DNA, 14 bp, Homo sapiens
ggtgaaggaatata

SEQ ID NO: 956991 - DNA, 16 bp, Homo sapiens
ggtgaaggatccagga

SEQ ID NO: 956992 - DNA, 19 bp, Homo sapiens
ggtgaaggatccaggaata

SEQ ID NO: 956993 - DNA, 18 bp, Homo sapiens
ggtgaagggagagccagc

SEQ ID NO: 956994 - DNA, 16 bp, Homo sapiens
ggtgaagtgtggctgg

SEQ ID NO: 956995 - DNA, 18 bp, Homo sapiens
ggtgaatacttattttca

SEQ ID NO: 956996 - DNA, 21 bp, Homo sapiens
ggtgacaaagatggctcagag

SEQ ID NO: 956997 - DNA, 13 bp, Homo sapiens
ggtgacaagagcc

SEQ ID NO: 956998 - DNA, 15 bp, Homo sapiens
ggtgacacctccccc

SEQ ID NO: 956999 - DNA, 16 bp, Homo sapiens
ggtgacacctccccct

SEQ ID NO: 957000 - DNA, 13 bp, Homo sapiens
ggtgacagagcga

SEQ ID NO: 957001 - DNA, 18 bp, Homo sapiens
ggtgacagtcatcatcag

SEQ ID NO: 957002 - DNA, 15 bp, Homo sapiens
ggtgacagtcctcca

SEQ ID NO: 957003 - DNA, 17 bp, Homo sapiens
ggtgacagtcctccatc

SEQ ID NO: 957004 - DNA, 17 bp, Homo sapiens
ggtgacatcggaaaaat

SEQ ID NO: 957005 - DNA, 18 bp, Homo sapiens
ggtgacatcggaaaaata

SEQ ID NO: 957006 - DNA, 18 bp, Homo sapiens
ggtgacatggggaaggca

SEQ ID NO: 957007 - DNA, 23 bp, Homo sapiens
ggtgacatggggaaggcagaggc

SEQ ID NO: 957008 - DNA, 17 bp, Homo sapiens
ggtgaccagcctgtcac

SEQ ID NO: 957009 - DNA, 18 bp, Homo sapiens
ggtgacccacagctctgg

SEQ ID NO: 957010 - DNA, 17 bp, Homo sapiens
ggtgaccgactacccca

SEQ ID NO: 957011 - DNA, 24 bp, Homo sapiens
ggtgacctcctgtcactcactgag

SEQ ID NO: 957012 - DNA, 20 bp, Homo sapiens
ggtgacgatgggtgttgctg

SEQ ID NO: 957013 - DNA, 14 bp, Homo sapiens
ggtgacgcccacct

SEQ ID NO: 957014 - DNA, 16 bp, Homo sapiens
ggtgacgcccaccttc

SEQ ID NO: 957015 - DNA, 13 bp, Homo sapiens
ggtgacgcctgag

SEQ ID NO: 957016 - DNA, 14 bp, Homo sapiens
ggtgacgcctgaga

SEQ ID NO: 957017 - DNA, 17 bp, Homo sapiens
ggtgacgcctgagacag

SEQ ID NO: 957018 - DNA, 20 bp, Homo sapiens
ggtgacgcctgagacagcac

SEQ ID NO: 957019 - DNA, 18 bp, Homo sapiens
ggtgacgcctgccctccc

SEQ ID NO: 957020 - DNA, 12 bp, Homo sapiens
ggtgacggccct

SEQ ID NO: 957021 - DNA, 23 bp, Homo sapiens
ggtgactgcgatcttcagagcag

SEQ ID NO: 957022 - DNA, 11 bp, Homo sapiens
ggtgactggaa

SEQ ID NO: 957023 - DNA, 13 bp, Homo sapiens
ggtgactgtccca

SEQ ID NO: 957024 - DNA, 16 bp, Homo sapiens
ggtgactgtcccaccg

SEQ ID NO: 957025 - DNA, 16 bp, Homo sapiens
ggtgactgtgctgtgc

SEQ ID NO: 957026 - DNA, 18 bp, Homo sapiens
ggtgacttctagcagaga

SEQ ID NO: 957027 - DNA, 15 bp, Homo sapiens
ggtgactttggggac

SEQ ID NO: 957028 - DNA, 17 bp, Homo sapiens
ggtgactttggggacag

SEQ ID NO: 957029 - DNA, 13 bp, Homo sapiens
ggtgagaaattta

SEQ ID NO: 957030 - DNA, 14 bp, Homo sapiens
ggtgagacagttgc

SEQ ID NO: 957031 - DNA, 18 bp, Homo sapiens
ggtgagacagttgcccga

SEQ ID NO: 957032 - DNA, 20 bp, Homo sapiens
ggtgagaccccgcactgcag

SEQ ID NO: 957033 - DNA, 21 bp, Homo sapiens
ggtgagagaccacacatttta

SEQ ID NO: 957034 - DNA, 14 bp, Homo sapiens
ggtgagagagacag

SEQ ID NO: 957035 - DNA, 12 bp, Homo sapiens
ggtgagagctgc

SEQ ID NO: 957036 - DNA, 14 bp, Homo sapiens
ggtgagaggcagga

SEQ ID NO: 957037 - DNA, 21 bp, Homo sapiens
ggtgagaggcgagtcaccctc

SEQ ID NO: 957038 - DNA, 17 bp, Homo sapiens
ggtgagagtcaaagctg

SEQ ID NO: 957039 - DNA, 19 bp, Homo sapiens
ggtgagcagaagtggagct

SEQ ID NO: 957040 - DNA, 17 bp, Homo sapiens
ggtgagcatggcagctg

SEQ ID NO: 957041 - DNA, 20 bp, Homo sapiens
ggtgagcctgactgccagga

SEQ ID NO: 957042 - DNA, 11 bp, Homo sapiens
ggtgagcctgg

SEQ ID NO: 957043 - DNA, 15 bp, Homo sapiens
ggtgagcctgggcag

SEQ ID NO: 957044 - DNA, 20 bp, Homo sapiens
ggtgagcggatcacaaggtc

SEQ ID NO: 957045 - DNA, 11 bp, Homo sapiens
ggtgagctggg

SEQ ID NO: 957046 - DNA, 15 bp, Homo sapiens
ggtgaggaccactcc

SEQ ID NO: 957047 - DNA, 21 bp, Homo sapiens
ggtgaggcccaagagccctgt

SEQ ID NO: 957048 - DNA, 14 bp, Homo sapiens
ggtgaggcccagcc

SEQ ID NO: 957049 - DNA, 19 bp, Homo sapiens
ggtgaggcgttctcctgct

SEQ ID NO: 957050 - DNA, 16 bp, Homo sapiens
ggtgagggacagagcc

SEQ ID NO: 957051 - DNA, 22 bp, Homo sapiens
ggtgaggtccaccggcccctgg

SEQ ID NO: 957052 - DNA, 12 bp, Homo sapiens
ggtgaggtggcc

SEQ ID NO: 957053 - DNA, 14 bp, Homo sapiens
ggtgaggtggccca

SEQ ID NO: 957054 - DNA, 21 bp, Homo sapiens
ggtgagtcccctactccctct

SEQ ID NO: 957055 - DNA, 17 bp, Homo sapiens
ggtgagtcttggcggca

SEQ ID NO: 957056 - DNA, 19 bp, Homo sapiens
ggtgagtgtgagggcagca

SEQ ID NO: 957057 - DNA, 21 bp, Homo sapiens
ggtgagtttgagctgccttcc

SEQ ID NO: 957058 - DNA, 17 bp, Homo sapiens
ggtgataaaaataaagc

SEQ ID NO: 957059 - DNA, 19 bp, Homo sapiens
tgcttcagagtttgtgtgt

SEQ ID NO: 957060 - DNA, 20 bp, Homo sapiens
tgcttcagatattattgctt

SEQ ID NO: 957061 - DNA, 15 bp, Homo sapiens
tgcttcagccctggc

SEQ ID NO: 957062 - DNA, 15 bp, Homo sapiens
tgcttcagcctgagg

SEQ ID NO: 957063 - DNA, 22 bp, Homo sapiens
tgcttcagcctgaggctgagac

SEQ ID NO: 957064 - DNA, 22 bp, Homo sapiens
ggtgatgcttttgctgctgctt

SEQ ID NO: 957065 - DNA, 19 bp, Homo sapiens
ggtgatggccagcccctgg

SEQ ID NO: 957066 - DNA, 19 bp, Homo sapiens
ggtgatggggctgagcagg

SEQ ID NO: 957067 - DNA, 18 bp, Homo sapiens
ggtgattggaccaggcca

SEQ ID NO: 957068 - DNA, 14 bp, Homo sapiens
ggtgattggctcct

SEQ ID NO: 957069 - DNA, 18 bp, Homo sapiens
ggtgcaaaaaaaaactta

SEQ ID NO: 957070 - DNA, 15 bp, Homo sapiens
ggtgcaaattcattt

SEQ ID NO: 957071 - DNA, 22 bp, Homo sapiens
ggtgcaaggagtgtaaaatgta

SEQ ID NO: 957072 - DNA, 16 bp, Homo sapiens
ggtgcactttgtaaat

SEQ ID NO: 957073 - DNA, 19 bp, Homo sapiens
ggtgcagccttcccctccc

SEQ ID NO: 957074 - DNA, 15 bp, Homo sapiens
ggtgcagctgggctt

SEQ ID NO: 957075 - DNA, 21 bp, Homo sapiens
ggtgcagggagacatctgcac

SEQ ID NO: 957076 - DNA, 16 bp, Homo sapiens
ggtgcagtgtgaaaag

SEQ ID NO: 957077 - DNA, 18 bp, Homo sapiens
ggtgcagttgacagcagg

SEQ ID NO: 957078 - DNA, 20 bp, Homo sapiens
ggtgcatcctcctcagcccc

SEQ ID NO: 957079 - DNA, 16 bp, Homo sapiens
ggtgcatctgcaggca

SEQ ID NO: 957080 - DNA, 18 bp, Homo sapiens
ggtgcatgccgggaccat

SEQ ID NO: 957081 - DNA, 19 bp, Homo sapiens
ggtgcattacagagaggag

SEQ ID NO: 957082 - DNA, 19 bp, Homo sapiens
ggtgcatttgagagaagcc

SEQ ID NO: 957083 - DNA, 23 bp, Homo sapiens
ggtgccaaacaaaaaggttctca

SEQ ID NO: 957084 - DNA, 19 bp, Homo sapiens
ggtgccaaatagccccaga

SEQ ID NO: 957085 - DNA, 22 bp, Homo sapiens
ggtgccaaatagccccagactg

SEQ ID NO: 957086 - DNA, 18 bp, Homo sapiens
ggtgccactccctgagct

SEQ ID NO: 957087 - DNA, 22 bp, Homo sapiens
ggtgccacttcttaaaggcctg

SEQ ID NO: 957088 - DNA, 19 bp, Homo sapiens
ggtgccactttacccacct

SEQ ID NO: 957089 - DNA, 17 bp, Homo sapiens
ggtgccagaaggaaggt

SEQ ID NO: 957090 - DNA, 17 bp, Homo sapiens
ggtgccagcaactgaat

SEQ ID NO: 957091 - DNA, 20 bp, Homo sapiens
ggtgccagccttcctctgca

SEQ ID NO: 957092 - DNA, 18 bp, Homo sapiens
ggtgcccaagccagaggc

SEQ ID NO: 957093 - DNA, 21 bp, Homo sapiens
ggtgcccacaccggggacagg

SEQ ID NO: 957094 - DNA, 14 bp, Homo sapiens
ggtgcccacagcag

SEQ ID NO: 957095 - DNA, 23 bp, Homo sapiens
ggtgcccagaataagttattgca

SEQ ID NO: 957096 - DNA, 23 bp, Homo sapiens
ggtgccccacagctacctgagac

SEQ ID NO: 957097 - DNA, 22 bp, Homo sapiens
ggtgccccccttgccagacatg

SEQ ID NO: 957098 - DNA, 20 bp, Homo sapiens
ggtgccccctcctctcccat

SEQ ID NO: 957099 - DNA, 23 bp, Homo sapiens
ggtgccccctcctctcccatccc

SEQ ID NO: 957100 - DNA, 22 bp, Homo sapiens
ggtgccctctgctcaggcctcc

SEQ ID NO: 957101 - DNA, 19 bp, Homo sapiens
ggtgccctggatgcccagg

SEQ ID NO: 957102 - DNA, 20 bp, Homo sapiens
ggtgccctggatgcccagga

SEQ ID NO: 957103 - DNA, 18 bp, Homo sapiens
ggtgccggggaggggcag

SEQ ID NO: 957104 - DNA, 15 bp, Homo sapiens
ggtgcctcaggacct

SEQ ID NO: 957105 - DNA, 17 bp, Homo sapiens
ggtgcctcagttttcct

SEQ ID NO: 957106 - DNA, 15 bp, Homo sapiens
ggtgcctctgtgcac

SEQ ID NO: 957107 - DNA, 23 bp, Homo sapiens
ggtgcctctgtgcacagtggctt

SEQ ID NO: 957108 - DNA, 15 bp, Homo sapiens
ggtgcctgagaggca

SEQ ID NO: 957109 - DNA, 18 bp, Homo sapiens
ggtgcctgagaggcaggc

SEQ ID NO: 957110 - DNA, 22 bp, Homo sapiens
ggtgcctggccatgtcacctgg

SEQ ID NO: 957111 - DNA, 16 bp, Homo sapiens
ggtgcctgggtggcca

SEQ ID NO: 957112 - DNA, 18 bp, Homo sapiens
ggtgcctgtgaggcaggg

SEQ ID NO: 957113 - DNA, 18 bp, Homo sapiens
ggtgcctttcaaatttag

SEQ ID NO: 957114 - DNA, 22 bp, Homo sapiens
ggtgcgcgccaccgtgcctggc

SEQ ID NO: 957115 - DNA, 15 bp, Homo sapiens
ggtgcgtggctgtgg

SEQ ID NO: 957116 - DNA, 20 bp, Homo sapiens
ggtgcgtggctgtggcacag

SEQ ID NO: 957117 - DNA, 21 bp, Homo sapiens
ggtgcgtggctgtggcacaga

SEQ ID NO: 957118 - DNA, 20 bp, Homo sapiens
ggtgcgtgttcagcagaacc

SEQ ID NO: 957119 - DNA, 13 bp, Homo sapiens
ggtgcgtttttac

SEQ ID NO: 957120 - DNA, 18 bp, Homo sapiens
ggtgctaaaaatgaaaat

SEQ ID NO: 957121 - DNA, 17 bp, Homo sapiens
ggtgctaaagccaacca

SEQ ID NO: 957122 - DNA, 21 bp, Homo sapiens
ggtgctaaatggtcgcccagg

SEQ ID NO: 957123 - DNA, 23 bp, Homo sapiens
ggtgctaaatggtcgcccaggag

SEQ ID NO: 957124 - DNA, 17 bp, Homo sapiens
ggtgctataggctggag

SEQ ID NO: 957125 - DNA, 23 bp, Homo sapiens
ggtgctatatccagttcctgctc

SEQ ID NO: 957126 - DNA, 22 bp, Homo sapiens
ggtgctcaagggttctttcctc

SEQ ID NO: 957127 - DNA, 18 bp, Homo sapiens
ggtgctcacgactcttcc

SEQ ID NO: 957128 - DNA, 13 bp, Homo sapiens
ggtgctcactccc

SEQ ID NO: 957129 - DNA, 19 bp, Homo sapiens
ggtgctcgggaagggaggg

SEQ ID NO: 957130 - DNA, 16 bp, Homo sapiens
ggtgctctgaggtcaa

SEQ ID NO: 957131 - DNA, 12 bp, Homo sapiens
ggtgctctggtc

SEQ ID NO: 957132 - DNA, 22 bp, Homo sapiens
ggtgctctgtgttcccagaggc

SEQ ID NO: 957133 - DNA, 12 bp, Homo sapiens
ggtgctgagctt

SEQ ID NO: 957134 - DNA, 16 bp, Homo sapiens
ggtgctgagcttagcc

SEQ ID NO: 957135 - DNA, 18 bp, Homo sapiens
ggtgctgagtgtacagag

SEQ ID NO: 957136 - DNA, 16 bp, Homo sapiens
ggtgctgatgggaagg

SEQ ID NO: 957137 - DNA, 19 bp, Homo sapiens
ggtgctgatgggaaggagg

SEQ ID NO: 957138 - DNA, 20 bp, Homo sapiens
ggtgctgatgggaaggaggg

SEQ ID NO: 957139 - DNA, 12 bp, Homo sapiens
ggtgctgccctg

SEQ ID NO: 957140 - DNA, 13 bp, Homo sapiens
ggtgctgccctgt

SEQ ID NO: 957141 - DNA, 16 bp, Homo sapiens
ggtgctgccctgtgta

SEQ ID NO: 957142 - DNA, 17 bp, Homo sapiens
ggtgctgcctctacctg

SEQ ID NO: 957143 - DNA, 24 bp, Homo sapiens
ggtgctgggactgagccagtccca

SEQ ID NO: 957144 - DNA, 14 bp, Homo sapiens
ggtgctggggccag

SEQ ID NO: 957145 - DNA, 19 bp, Homo sapiens
ggtgctggggccagggcag

SEQ ID NO: 957146 - DNA, 20 bp, Homo sapiens
ggtgctggtagctgagggga

SEQ ID NO: 957147 - DNA, 13 bp, Homo sapiens
ggtgctggtcccg

SEQ ID NO: 957148 - DNA, 20 bp, Homo sapiens
ggtgctggtgggtctgagct

SEQ ID NO: 957149 - DNA, 17 bp, Homo sapiens
ggtgctgtgagggaggg

SEQ ID NO: 957150 - DNA, 16 bp, Homo sapiens
ggtgctgtggccaggg

SEQ ID NO: 957151 - DNA, 19 bp, Homo sapiens
ggtgcttattctcaaagca

SEQ ID NO: 957152 - DNA, 19 bp, Homo sapiens
ggtgcttccaacaaggaca

SEQ ID NO: 957153 - DNA, 17 bp, Homo sapiens
ggtgcttcctcctcagg

SEQ ID NO: 957154 - DNA, 22 bp, Homo sapiens
ggtgcttcctcctcaggcccag

SEQ ID NO: 957155 - DNA, 15 bp, Homo sapiens
ggtgcttctggaaac

SEQ ID NO: 957156 - DNA, 18 bp, Homo sapiens
ggtggaaataatttgaat

SEQ ID NO: 957157 - DNA, 19 bp, Homo sapiens
ggtggaaattttatatgta

SEQ ID NO: 957158 - DNA, 20 bp, Homo sapiens
ggtggaagccctccttccac

SEQ ID NO: 957159 - DNA, 15 bp, Homo sapiens
ggtggaaggcagaca

SEQ ID NO: 957160 - DNA, 20 bp, Homo sapiens
ggtggaagggtagagaggcg

SEQ ID NO: 957161 - DNA, 20 bp, Homo sapiens
ggtggacttcagtgtgtgta

SEQ ID NO: 957162 - DNA, 21 bp, Homo sapiens
ggtggagaaagcactgacctg

SEQ ID NO: 957163 - DNA, 14 bp, Homo sapiens
ggtggagccagggc

SEQ ID NO: 957164 - DNA, 22 bp, Homo sapiens
ggtggaggaaggctctgtcact

SEQ ID NO: 957165 - DNA, 22 bp, Homo sapiens
ggtggaggaaggtgctgagctt

SEQ ID NO: 957166 - DNA, 20 bp, Homo sapiens
ggtggaggagctgagggagg

SEQ ID NO: 957167 - DNA, 21 bp, Homo sapiens
ggtggaggagctgagggaggg

SEQ ID NO: 957168 - DNA, 12 bp, Homo sapiens
ggtggaggcaag

SEQ ID NO: 957169 - DNA, 21 bp, Homo sapiens
ggtggaggctgcggtgagccg

SEQ ID NO: 957170 - DNA, 15 bp, Homo sapiens
ggtggaggcttcctg

SEQ ID NO: 957171 - DNA, 18 bp, Homo sapiens
ggtggagggcacttcagg

SEQ ID NO: 957172 - DNA, 17 bp, Homo sapiens
ggtggaggttgtgcatg

SEQ ID NO: 957173 - DNA, 18 bp, Homo sapiens
ggtggataactagccaga

SEQ ID NO: 957174 - DNA, 16 bp, Homo sapiens
ggtggatcacctgagg

SEQ ID NO: 957175 - DNA, 16 bp, Homo sapiens
ggtggatgacagggca

SEQ ID NO: 957176 - DNA, 18 bp, Homo sapiens
ggtggatgttatgaacag

SEQ ID NO: 957177 - DNA, 21 bp, Homo sapiens
ggtggatgttatgaacagctg

SEQ ID NO: 957178 - DNA, 22 bp, Homo sapiens
ggtggattctccctgggcctca

SEQ ID NO: 957179 - DNA, 11 bp, Homo sapiens
tgctttcacat

SEQ ID NO: 957180 - DNA, 19 bp, Homo sapiens
tgctttcatcttggtcaca

SEQ ID NO: 957181 - DNA, 16 bp, Homo sapiens
tgctttcccatatctt

SEQ ID NO: 957182 - DNA, 21 bp, Homo sapiens
tgctttcccatatcttgcctt

SEQ ID NO: 957183 - DNA, 14 bp, Homo sapiens
tgctttcccctgtg

SEQ ID NO: 957184 - DNA, 17 bp, Homo sapiens
tgctttccgtggcactg

SEQ ID NO: 957185 - DNA, 17 bp, Homo sapiens
tgctttcctgcatctct

SEQ ID NO: 957186 - DNA, 15 bp, Homo sapiens
tgctttctcctttaa

SEQ ID NO: 957187 - DNA, 13 bp, Homo sapiens
tgctttctgaaat

SEQ ID NO: 957188 - DNA, 20 bp, Homo sapiens
tgctttctgaagctttacca

SEQ ID NO: 957189 - DNA, 12 bp, Homo sapiens
tgctttctgctc

SEQ ID NO: 957190 - DNA, 20 bp, Homo sapiens
tgctttctgctcagcttctc

SEQ ID NO: 957191 - DNA, 14 bp, Homo sapiens
tgctttctgtggct

SEQ ID NO: 957192 - DNA, 15 bp, Homo sapiens
tgctttctgttccaa

SEQ ID NO: 957193 - DNA, 23 bp, Homo sapiens
ggtgtccgccatccagggtctgg

SEQ ID NO: 957194 - DNA, 13 bp, Homo sapiens
ggtgtcctgacca

SEQ ID NO: 957195 - DNA, 18 bp, Homo sapiens
ggtgtcctgaccaccctc

SEQ ID NO: 957196 - DNA, 15 bp, Homo sapiens
ggtgtcctgcctgtc

SEQ ID NO: 957197 - DNA, 13 bp, Homo sapiens
ggtgtctccctcg

SEQ ID NO: 957198 - DNA, 15 bp, Homo sapiens
ggtgtctccctcggg

SEQ ID NO: 957199 - DNA, 14 bp, Homo sapiens
ggtgtctctgggcc

SEQ ID NO: 957200 - DNA, 16 bp, Homo sapiens
ggtgtctctgggcctg

SEQ ID NO: 957201 - DNA, 18 bp, Homo sapiens
ggtgtctctgggcctgtg

SEQ ID NO: 957202 - DNA, 15 bp, Homo sapiens
ggtgtctgcctagat

SEQ ID NO: 957203 - DNA, 17 bp, Homo sapiens
ggtgtctggtttctgtc

SEQ ID NO: 957204 - DNA, 20 bp, Homo sapiens
ggtgtcttgggcagagctgg

SEQ ID NO: 957205 - DNA, 10 bp, Homo sapiens
ggtgtctttt

SEQ ID NO: 957206 - DNA, 13 bp, Homo sapiens
ggtgtgaactttt

SEQ ID NO: 957207 - DNA, 14 bp, Homo sapiens
ggtgtgaccatgtt

SEQ ID NO: 957208 - DNA, 19 bp, Homo sapiens
ggtgtgactcgggagctgc

SEQ ID NO: 957209 - DNA, 14 bp, Homo sapiens
ggtgtgagccactg

SEQ ID NO: 957210 - DNA, 15 bp, Homo sapiens
ggtgtgagccactgc

SEQ ID NO: 957211 - DNA, 16 bp, Homo sapiens
ggtgtgcaccagggtt

SEQ ID NO: 957212 - DNA, 24 bp, Homo sapiens
ggtgtgcacgtggcatgtggcctg

SEQ ID NO: 957213 - DNA, 14 bp, Homo sapiens
ggtgtgcctgcagc

SEQ ID NO: 957214 - DNA, 21 bp, Homo sapiens
ggtgtgcggcctttggcttca

SEQ ID NO: 957215 - DNA, 20 bp, Homo sapiens
ggtgtgcgtgcgtgtgcgtg

SEQ ID NO: 957216 - DNA, 15 bp, Homo sapiens
ggtgtgctctgggct

SEQ ID NO: 957217 - DNA, 14 bp, Homo sapiens
ggtgtgctgccaac

SEQ ID NO: 957218 - DNA, 12 bp, Homo sapiens
ggtgtgctggga

SEQ ID NO: 957219 - DNA, 12 bp, Homo sapiens
ggtgtggccagc

SEQ ID NO: 957220 - DNA, 20 bp, Homo sapiens
ggtgtggccatcactcagcc

SEQ ID NO: 957221 - DNA, 21 bp, Homo sapiens
ggtgtggccatcactcagccc

SEQ ID NO: 957222 - DNA, 12 bp, Homo sapiens
ggtgtggcctca

SEQ ID NO: 957223 - DNA, 14 bp, Homo sapiens
ggtgtggcctcagc

SEQ ID NO: 957224 - DNA, 19 bp, Homo sapiens
ggtgtggcctcagccctca

SEQ ID NO: 957225 - DNA, 12 bp, Homo sapiens
ggtgtggctcct

SEQ ID NO: 957226 - DNA, 15 bp, Homo sapiens
ggtgtggctgtgaag

SEQ ID NO: 957227 - DNA, 11 bp, Homo sapiens
ggtgtggggga

SEQ ID NO: 957228 - DNA, 14 bp, Homo sapiens
ggtgtggggggctg

SEQ ID NO: 957229 - DNA, 15 bp, Homo sapiens
ggtgtggggtggggt

SEQ ID NO: 957230 - DNA, 19 bp, Homo sapiens
ggtgtgggtaaagggacag

SEQ ID NO: 957231 - DNA, 15 bp, Homo sapiens
ggtgtgggtgtcctg

SEQ ID NO: 957232 - DNA, 22 bp, Homo sapiens
ggtgtgggtgtcctgcctgtct

SEQ ID NO: 957233 - DNA, 14 bp, Homo sapiens
ggtgtgtgtagcca

SEQ ID NO: 957234 - DNA, 18 bp, Homo sapiens
ggtgtgtgttcaccttca

SEQ ID NO: 957235 - DNA, 14 bp, Homo sapiens
ggtgttaatttttg

SEQ ID NO: 957236 - DNA, 19 bp, Homo sapiens
ggtgttactagaaggcgtc

SEQ ID NO: 957237 - DNA, 22 bp, Homo sapiens
ggtgttaggcatgtcccaccca

SEQ ID NO: 957238 - DNA, 15 bp, Homo sapiens
ggtgttcagaggcag

SEQ ID NO: 957239 - DNA, 12 bp, Homo sapiens
ggtgttcctgga

SEQ ID NO: 957240 - DNA, 15 bp, Homo sapiens
ggtgttcctggaagc

SEQ ID NO: 957241 - DNA, 22 bp, Homo sapiens
ggtgttcctggaagcaggtgct

SEQ ID NO: 957242 - DNA, 19 bp, Homo sapiens
ggtgttctttcctgccctg

SEQ ID NO: 957243 - DNA, 22 bp, Homo sapiens
ggtgttgaccactccagagaag

SEQ ID NO: 957244 - DNA, 13 bp, Homo sapiens
ggtgttgctgttt

SEQ ID NO: 957245 - DNA, 21 bp, Homo sapiens
ggtgttgtcagcaggcaggct

SEQ ID NO: 957246 - DNA, 23 bp, Homo sapiens
ggtgtttattacaagtggctccc

SEQ ID NO: 957247 - DNA, 14 bp, Homo sapiens
ggtgtttcaacaga

SEQ ID NO: 957248 - DNA, 15 bp, Homo sapiens
ggtgtttcccttcct

SEQ ID NO: 957249 - DNA, 20 bp, Homo sapiens
ggtgtttcccttcctcggtg

SEQ ID NO: 957250 - DNA, 14 bp, Homo sapiens
ggtgttttgtcaga

SEQ ID NO: 957251 - DNA, 13 bp, Homo sapiens
ggttaaaaaggcc

SEQ ID NO: 957252 - DNA, 16 bp, Homo sapiens
ggttaaaacaaaaaca

SEQ ID NO: 957253 - DNA, 22 bp, Homo sapiens
ggttaaaactgtacatttaaaa

SEQ ID NO: 957254 - DNA, 18 bp, Homo sapiens
ggttaaaagggaacacaa

SEQ ID NO: 957255 - DNA, 13 bp, Homo sapiens
ggttaaagctaaa

SEQ ID NO: 957256 - DNA, 22 bp, Homo sapiens
ggttaacccttcatcttcctgt

SEQ ID NO: 957257 - DNA, 14 bp, Homo sapiens
ggttaaggcctgaa

SEQ ID NO: 957258 - DNA, 22 bp, Homo sapiens
ggttaagtttctcttcacccct

SEQ ID NO: 957259 - DNA, 18 bp, Homo sapiens
ggttaataaaactgcaca

SEQ ID NO: 957260 - DNA, 15 bp, Homo sapiens
ggttaataccagctt

SEQ ID NO: 957261 - DNA, 12 bp, Homo sapiens
ggttaatggcta

SEQ ID NO: 957262 - DNA, 17 bp, Homo sapiens
ggttaatggctagtact

SEQ ID NO: 957263 - DNA, 17 bp, Homo sapiens
ggttaatttttcctgca

SEQ ID NO: 957264 - DNA, 16 bp, Homo sapiens
ggttacagagacctat

SEQ ID NO: 957265 - DNA, 22 bp, Homo sapiens
ggttaccactcttttgctgtgc

SEQ ID NO: 957266 - DNA, 14 bp, Homo sapiens
ggttacgaagacaa

SEQ ID NO: 957267 - DNA, 18 bp, Homo sapiens
ggttactaccctcaccct

SEQ ID NO: 957268 - DNA, 17 bp, Homo sapiens
ggttactcagcagcaga

SEQ ID NO: 957269 - DNA, 13 bp, Homo sapiens
ggttactgagtga

SEQ ID NO: 957270 - DNA, 15 bp, Homo sapiens
ggttagaaaggcagc

SEQ ID NO: 957271 - DNA, 18 bp, Homo sapiens
ggttagaaaggcagccct

SEQ ID NO: 957272 - DNA, 20 bp, Homo sapiens
ggttaggagttcgagaccag

SEQ ID NO: 957273 - DNA, 16 bp, Homo sapiens
ggttaggatttaacag

SEQ ID NO: 957274 - DNA, 21 bp, Homo sapiens
ggttaggtggccgctcctccc

SEQ ID NO: 957275 - DNA, 22 bp, Homo sapiens
ggttaggtggccgctcctccct

SEQ ID NO: 957276 - DNA, 23 bp, Homo sapiens
ggttaggtggccgctcctccctg

SEQ ID NO: 957277 - DNA, 13 bp, Homo sapiens
ggttatacaataa

SEQ ID NO: 957278 - DNA, 23 bp, Homo sapiens
ggttatagacagtcgttcccagt

SEQ ID NO: 957279 - DNA, 23 bp, Homo sapiens
ggttatcctttcattaggcaaag

SEQ ID NO: 957280 - DNA, 18 bp, Homo sapiens
ggttatctgcctggcctg

SEQ ID NO: 957281 - DNA, 20 bp, Homo sapiens
ggttatgttcccagcagtgg

SEQ ID NO: 957282 - DNA, 19 bp, Homo sapiens
ggttattagcaaggctggg

SEQ ID NO: 957283 - DNA, 16 bp, Homo sapiens
ggttattcattattcc

SEQ ID NO: 957284 - DNA, 18 bp, Homo sapiens
ggttatttttattaaatg

SEQ ID NO: 957285 - DNA, 23 bp, Homo sapiens
ggttcaacaaagaaacaaagatg

SEQ ID NO: 957286 - DNA, 19 bp, Homo sapiens
ggttcaagcaatcctccta

SEQ ID NO: 957287 - DNA, 14 bp, Homo sapiens
ggttcaccttgccg

SEQ ID NO: 957288 - DNA, 16 bp, Homo sapiens
ggttcagacccctgcc

SEQ ID NO: 957289 - DNA, 16 bp, Homo sapiens
ggttcagagactcagg

SEQ ID NO: 957290 - DNA, 17 bp, Homo sapiens
ggttcagcccctcctct

SEQ ID NO: 957291 - DNA, 18 bp, Homo sapiens
ggttcagcccctcctctg

SEQ ID NO: 957292 - DNA, 19 bp, Homo sapiens
ggttcagcccctcctctgc

SEQ ID NO: 957293 - DNA, 21 bp, Homo sapiens
ggttcagcccctcctctgcca

SEQ ID NO: 957294 - DNA, 12 bp, Homo sapiens
ggttcaggacca

SEQ ID NO: 957295 - DNA, 13 bp, Homo sapiens
ggttcaggcccgg

SEQ ID NO: 957296 - DNA, 17 bp, Homo sapiens
ggttcagggaactgctt

SEQ ID NO: 957297 - DNA, 12 bp, Homo sapiens
ggttcagtttct

SEQ ID NO: 957298 - DNA, 14 bp, Homo sapiens
ggttcagtttcttc

SEQ ID NO: 957299 - DNA, 15 bp, Homo sapiens
ggttcataggggcag

SEQ ID NO: 957300 - DNA, 16 bp, Homo sapiens
ggttcataggggcagg

SEQ ID NO: 957301 - DNA, 17 bp, Homo sapiens
ggttcataggggcaggt

SEQ ID NO: 957302 - DNA, 15 bp, Homo sapiens
ggtttcatttcttat

SEQ ID NO: 957303 - DNA, 19 bp, Homo sapiens
ggtttccccagggaaggaa

SEQ ID NO: 957304 - DNA, 13 bp, Homo sapiens
ggtttcccctgca

SEQ ID NO: 957305 - DNA, 15 bp, Homo sapiens
ggtttccctgcccct

SEQ ID NO: 957306 - DNA, 16 bp, Homo sapiens
ggtttccctgcccctg

SEQ ID NO: 957307 - DNA, 13 bp, Homo sapiens
ggtttcctgctcc

SEQ ID NO: 957308 - DNA, 18 bp, Homo sapiens
ggtttccttttggaacat

SEQ ID NO: 957309 - DNA, 23 bp, Homo sapiens
ggtttcgactggtccagctctga

SEQ ID NO: 957310 - DNA, 14 bp, Homo sapiens
ggtttcggaaaaaa

SEQ ID NO: 957311 - DNA, 19 bp, Homo sapiens
ggtttctacttcccctggg

SEQ ID NO: 957312 - DNA, 13 bp, Homo sapiens
ggtttctctccct

SEQ ID NO: 957313 - DNA, 22 bp, Homo sapiens
ggtttcttggggtcccagggaa

SEQ ID NO: 957314 - DNA, 18 bp, Homo sapiens
ggtttctttttttttcct

SEQ ID NO: 957315 - DNA, 17 bp, Homo sapiens
ggtttgatcatttctgc

SEQ ID NO: 957316 - DNA, 23 bp, Homo sapiens
ggtttgcatttaaacatgtttaa

SEQ ID NO: 957317 - DNA, 13 bp, Homo sapiens
ggtttgccagtga

SEQ ID NO: 957318 - DNA, 17 bp, Homo sapiens
ggtttgcccagtcctgg

SEQ ID NO: 957319 - DNA, 21 bp, Homo sapiens
ggtttgcccagtcctgggttg

SEQ ID NO: 957320 - DNA, 16 bp, Homo sapiens
ggtttgcctgagggcg

SEQ ID NO: 957321 - DNA, 23 bp, Homo sapiens
ggtttgcgggggtctgagtctat

SEQ ID NO: 957322 - DNA, 12 bp, Homo sapiens
ggtttggacccc

SEQ ID NO: 957323 - DNA, 20 bp, Homo sapiens
ggtttggaccccagctggga

SEQ ID NO: 957324 - DNA, 15 bp, Homo sapiens
tggaaagtgaatttg

SEQ ID NO: 957325 - DNA, 17 bp, Homo sapiens
tggaaagtgaatttgaa

SEQ ID NO: 957326 - DNA, 21 bp, Homo sapiens
tggaaagtgaatttgaatgaa

SEQ ID NO: 957327 - DNA, 23 bp, Homo sapiens
tggaaagtgaatttgaatgaaaa

SEQ ID NO: 957328 - DNA, 16 bp, Homo sapiens
tggaaataaactgtgc

SEQ ID NO: 957329 - DNA, 17 bp, Homo sapiens
tggaaataaactgtgca

SEQ ID NO: 957330 - DNA, 15 bp, Homo sapiens
tggaaataatttgaa

SEQ ID NO: 957331 - DNA, 19 bp, Homo sapiens
tggaaatagaaagaagcca

SEQ ID NO: 957332 - DNA, 18 bp, Homo sapiens
tggaaatcagccaagttt

SEQ ID NO: 957333 - DNA, 19 bp, Homo sapiens
tggaaatcctagtttcctc

SEQ ID NO: 957334 - DNA, 22 bp, Homo sapiens
tggaaatcctagtttcctctcc

SEQ ID NO: 957335 - DNA, 17 bp, Homo sapiens
tggaaatgtagcactta

SEQ ID NO: 957336 - DNA, 20 bp, Homo sapiens
tggaaattaagaagaaacta

SEQ ID NO: 957337 - DNA, 19 bp, Homo sapiens
tggaaattaggttgaaaca

SEQ ID NO: 957338 - DNA, 20 bp, Homo sapiens
tggaaattaggttgaaacat

SEQ ID NO: 957339 - DNA, 21 bp, Homo sapiens
tggaaattccaggaaccaaaa

SEQ ID NO: 957340 - DNA, 16 bp, Homo sapiens
tggaaattgacgaggg

SEQ ID NO: 957341 - DNA, 16 bp, Homo sapiens
tggaaattggaagagc

SEQ ID NO: 957342 - DNA, 21 bp, Homo sapiens
tggaaatttaaagcaggttct

SEQ ID NO: 957343 - DNA, 22 bp, Homo sapiens
tggaaatttaaagcaggttctt

SEQ ID NO: 957344 - DNA, 21 bp, Homo sapiens
tggaacaaatcgtttctcaga

SEQ ID NO: 957345 - DNA, 15 bp, Homo sapiens
tggaacaacttgtag

SEQ ID NO: 957346 - DNA, 23 bp, Homo sapiens
tggaacacaaatgaaaatgaata

SEQ ID NO: 957347 - DNA, 21 bp, Homo sapiens
tggaacagatatttagctctg

SEQ ID NO: 957348 - DNA, 19 bp, Homo sapiens
tggaacagcgggagacctg

SEQ ID NO: 957349 - DNA, 21 bp, Homo sapiens
tggaacagtcacccttctggg

SEQ ID NO: 957350 - DNA, 20 bp, Homo sapiens
tggaacataaaaaggacatc

SEQ ID NO: 957351 - DNA, 16 bp, Homo sapiens
tggaacatactgttca

SEQ ID NO: 957352 - DNA, 17 bp, Homo sapiens
tggaacatttctttctt

SEQ ID NO: 957353 - DNA, 22 bp, Homo sapiens
tggaacatttgatatttttcca

SEQ ID NO: 957354 - DNA, 17 bp, Homo sapiens
tggaaccacattgaaga

SEQ ID NO: 957355 - DNA, 13 bp, Homo sapiens
tggaaccagactc

SEQ ID NO: 957356 - DNA, 15 bp, Homo sapiens
tggaaccagagccac

SEQ ID NO: 957357 - DNA, 18 bp, Homo sapiens
tggaaccagggaggagag

SEQ ID NO: 957358 - DNA, 18 bp, Homo sapiens
tggaacccaggaggtgga

SEQ ID NO: 957359 - DNA, 14 bp, Homo sapiens
tggaaccccccagg

SEQ ID NO: 957360 - DNA, 13 bp, Homo sapiens
tggaacctctgtc

SEQ ID NO: 957361 - DNA, 16 bp, Homo sapiens
tggaacctctgtctca

SEQ ID NO: 957362 - DNA, 20 bp, Homo sapiens
tggaacctctgtctcatcct

SEQ ID NO: 957363 - DNA, 16 bp, Homo sapiens
tggaacctgcaaaaaa

SEQ ID NO: 957364 - DNA, 14 bp, Homo sapiens
tggaacctgtctcc

SEQ ID NO: 957365 - DNA, 14 bp, Homo sapiens
tggaaccttgctgt

SEQ ID NO: 957366 - DNA, 20 bp, Homo sapiens
tggaacggtgaaggtgacag

SEQ ID NO: 957367 - DNA, 17 bp, Homo sapiens
tggaactaataaataca

SEQ ID NO: 957368 - DNA, 23 bp, Homo sapiens
tggaactacattagtacacagca

SEQ ID NO: 957369 - DNA, 13 bp, Homo sapiens
tggaactctgctt

SEQ ID NO: 957370 - DNA, 22 bp, Homo sapiens
tggaactgaccccctcccctga

SEQ ID NO: 957371 - DNA, 16 bp, Homo sapiens
tggaactgtgtattta

SEQ ID NO: 957372 - DNA, 16 bp, Homo sapiens
tggaacttacattgtt

SEQ ID NO: 957373 - DNA, 16 bp, Homo sapiens
tggaacttagccattt

SEQ ID NO: 957374 - DNA, 13 bp, Homo sapiens
tggaacttgaact

SEQ ID NO: 957375 - DNA, 18 bp, Homo sapiens
tggaagaacatcaagata

SEQ ID NO: 957376 - DNA, 21 bp, Homo sapiens
tggaagaacatcaagatacct

SEQ ID NO: 957377 - DNA, 13 bp, Homo sapiens
tggaagaagggag

SEQ ID NO: 957378 - DNA, 14 bp, Homo sapiens
tggaagacacttca

SEQ ID NO: 957379 - DNA, 17 bp, Homo sapiens
tggaagacacttcagat

SEQ ID NO: 957380 - DNA, 12 bp, Homo sapiens
tggaagagaggc

SEQ ID NO: 957381 - DNA, 18 bp, Homo sapiens
tggaagagaggcacctgc

SEQ ID NO: 957382 - DNA, 12 bp, Homo sapiens
tggaagagcagc

SEQ ID NO: 957383 - DNA, 18 bp, Homo sapiens
tggaagagcagcctgatg

SEQ ID NO: 957384 - DNA, 24 bp, Homo sapiens
tggaagagcccgccgtctgcaggg

SEQ ID NO: 957385 - DNA, 23 bp, Homo sapiens
tggaagaggaacagcactgggga

SEQ ID NO: 957386 - DNA, 19 bp, Homo sapiens
tggaagatagttttctcct

SEQ ID NO: 957387 - DNA, 21 bp, Homo sapiens
tggaagattctatttaattga

SEQ ID NO: 957388 - DNA, 23 bp, Homo sapiens
tggaagattctatttaattgaaa

SEQ ID NO: 957389 - DNA, 22 bp, Homo sapiens
tggaagatttaccttttctgtt

SEQ ID NO: 957390 - DNA, 14 bp, Homo sapiens
tggaagattttaaa

SEQ ID NO: 957391 - DNA, 16 bp, Homo sapiens
tggaagattttaaatt

SEQ ID NO: 957392 - DNA, 14 bp, Homo sapiens
tggaagcaaagaca

SEQ ID NO: 957393 - DNA, 14 bp, Homo sapiens
tggaagcaaagtat

SEQ ID NO: 957394 - DNA, 21 bp, Homo sapiens
tggaagcacagcctcggggat

SEQ ID NO: 957395 - DNA, 19 bp, Homo sapiens
tggaagcatgtaggagaat

SEQ ID NO: 957396 - DNA, 18 bp, Homo sapiens
tggaagccaggtacagga

SEQ ID NO: 957397 - DNA, 16 bp, Homo sapiens
tggaagccatcctgcc

SEQ ID NO: 957398 - DNA, 19 bp, Homo sapiens
tggaagcccaactggggtt

SEQ ID NO: 957399 - DNA, 20 bp, Homo sapiens
tggaagcccctgggcccagt

SEQ ID NO: 957400 - DNA, 13 bp, Homo sapiens
tggaagccctcct

SEQ ID NO: 957401 - DNA, 19 bp, Homo sapiens
tggaagccctccttccacg

SEQ ID NO: 957402 - DNA, 17 bp, Homo sapiens
tggaagcctgaactgag

SEQ ID NO: 957403 - DNA, 14 bp, Homo sapiens
tggaagcctgagca

SEQ ID NO: 957404 - DNA, 16 bp, Homo sapiens
tggaagctaatttgca

SEQ ID NO: 957405 - DNA, 18 bp, Homo sapiens
tggaagctgccctgccca

SEQ ID NO: 957406 - DNA, 19 bp, Homo sapiens
tggaagctgttcagggcat

SEQ ID NO: 957407 - DNA, 17 bp, Homo sapiens
tggaagctgtttggaaa

SEQ ID NO: 957408 - DNA, 18 bp, Homo sapiens
tggaagctgtttggaaaa

SEQ ID NO: 957409 - DNA, 12 bp, Homo sapiens
tggaaggagcag

SEQ ID NO: 957410 - DNA, 21 bp, Homo sapiens
tggaaggatctgctgaggccc

SEQ ID NO: 957411 - DNA, 16 bp, Homo sapiens
tggaaggcagagaaat

SEQ ID NO: 957412 - DNA, 16 bp, Homo sapiens
tggaaggcagggcaga

SEQ ID NO: 957413 - DNA, 17 bp, Homo sapiens
tggaaggccttccactg

SEQ ID NO: 957414 - DNA, 13 bp, Homo sapiens
tggaaggctggct

SEQ ID NO: 957415 - DNA, 14 bp, Homo sapiens
tggaaggctttgcc

SEQ ID NO: 957416 - DNA, 19 bp, Homo sapiens
tggaagggcgttctaggta

SEQ ID NO: 957417 - DNA, 12 bp, Homo sapiens
tggaaggggcag

SEQ ID NO: 957418 - DNA, 14 bp, Homo sapiens
tggaaggggcagca

SEQ ID NO: 957419 - DNA, 15 bp, Homo sapiens
tggaaggggcagcag

SEQ ID NO: 957420 - DNA, 14 bp, Homo sapiens
tggaaggggcagcc

SEQ ID NO: 957421 - DNA, 15 bp, Homo sapiens
tggaaggggcagccc

SEQ ID NO: 957422 - DNA, 23 bp, Homo sapiens
tggaaggggccacgtggatgggc

SEQ ID NO: 957423 - DNA, 21 bp, Homo sapiens
tggaagggggaggagtcaggg

SEQ ID NO: 957424 - DNA, 18 bp, Homo sapiens
tggacagatttcagtaat

SEQ ID NO: 957425 - DNA, 18 bp, Homo sapiens
tggacagcaaaaccattg

SEQ ID NO: 957426 - DNA, 21 bp, Homo sapiens
tggacagcaaaaccattgctt

SEQ ID NO: 957427 - DNA, 22 bp, Homo sapiens
tggacagcaaaaccattgcttc

SEQ ID NO: 957428 - DNA, 19 bp, Homo sapiens
tggacagcagaagcctcca

SEQ ID NO: 957429 - DNA, 14 bp, Homo sapiens
tggacagccagtga

SEQ ID NO: 957430 - DNA, 12 bp, Homo sapiens
tggacagccccc

SEQ ID NO: 957431 - DNA, 14 bp, Homo sapiens
tggacagctgcttg

SEQ ID NO: 957432 - DNA, 12 bp, Homo sapiens
tggacaggcagc

SEQ ID NO: 957433 - DNA, 15 bp, Homo sapiens
tggacaggcagcctc

SEQ ID NO: 957434 - DNA, 14 bp, Homo sapiens
tggacaggctctgc

SEQ ID NO: 957435 - DNA, 14 bp, Homo sapiens
tggacagggccagg

SEQ ID NO: 957436 - DNA, 14 bp, Homo sapiens
tggacagtcctggg

SEQ ID NO: 957437 - DNA, 17 bp, Homo sapiens
tggacagtctccctgat

SEQ ID NO: 957438 - DNA, 23 bp, Homo sapiens
tggacagtctccctgatggaccc

SEQ ID NO: 957439 - DNA, 15 bp, Homo sapiens
tggacagtctggcca

SEQ ID NO: 957440 - DNA, 13 bp, Homo sapiens
tggacagtggcct

SEQ ID NO: 957441 - DNA, 14 bp, Homo sapiens
tggacagtggcctc

SEQ ID NO: 957442 - DNA, 23 bp, Homo sapiens
tggacagtttaccagttgccttt

SEQ ID NO: 957443 - DNA, 19 bp, Homo sapiens
tggacatactgctggagtc

SEQ ID NO: 957444 - DNA, 17 bp, Homo sapiens
tggacatcaccagtcct

SEQ ID NO: 957445 - DNA, 20 bp, Homo sapiens
tggacatcctcctcccaccc

SEQ ID NO: 957446 - DNA, 14 bp, Homo sapiens
tggacatctctctg

SEQ ID NO: 957447 - DNA, 18 bp, Homo sapiens
tggacatctctctggctt

SEQ ID NO: 957448 - DNA, 20 bp, Homo sapiens
tggacatctctctggcttct

SEQ ID NO: 957449 - DNA, 19 bp, Homo sapiens
tggacatgagatggagagg

SEQ ID NO: 957450 - DNA, 16 bp, Homo sapiens
tggacatggaaagaaa

SEQ ID NO: 957451 - DNA, 21 bp, Homo sapiens
tggacatggcccattggagca

SEQ ID NO: 957452 - DNA, 19 bp, Homo sapiens
tggacatggtcacagtcct

SEQ ID NO: 957453 - DNA, 19 bp, Homo sapiens
tggacatgtgtcccagcca

SEQ ID NO: 957454 - DNA, 16 bp, Homo sapiens
gtaaatatataaatat

SEQ ID NO: 957455 - DNA, 15 bp, Homo sapiens
gtaaatatcccagag

SEQ ID NO: 957456 - DNA, 19 bp, Homo sapiens
gtaaatatcccagagaaca

SEQ ID NO: 957457 - DNA, 15 bp, Homo sapiens
gtaaatatccctccc

SEQ ID NO: 957458 - DNA, 16 bp, Homo sapiens
gtaaatatgtgaagaa

SEQ ID NO: 957459 - DNA, 19 bp, Homo sapiens
gtaaatatgtttgtgcctt

SEQ ID NO: 957460 - DNA, 14 bp, Homo sapiens
gtaaatattctaca

SEQ ID NO: 957461 - DNA, 22 bp, Homo sapiens
gtaaatattctacacatgtaaa

SEQ ID NO: 957462 - DNA, 11 bp, Homo sapiens
gtaaatattta

SEQ ID NO: 957463 - DNA, 18 bp, Homo sapiens
gtaaatatttactctttg

SEQ ID NO: 957464 - DNA, 20 bp, Homo sapiens
gtaaatatttactctttgca

SEQ ID NO: 957465 - DNA, 14 bp, Homo sapiens
gtaaatattttaaa

SEQ ID NO: 957466 - DNA, 19 bp, Homo sapiens
gtaaatattttgatacaaa

SEQ ID NO: 957467 - DNA, 20 bp, Homo sapiens
gtaaatattttgatacaaat

SEQ ID NO: 957468 - DNA, 21 bp, Homo sapiens
gtaaatcacgctttttgaaaa

SEQ ID NO: 957469 - DNA, 16 bp, Homo sapiens
gtaaatcagaaagtaa

SEQ ID NO: 957470 - DNA, 17 bp, Homo sapiens
gtaaatcagtaagaggt

SEQ ID NO: 957471 - DNA, 22 bp, Homo sapiens
gtaaatcctagacttgaaagtt

SEQ ID NO: 957472 - DNA, 20 bp, Homo sapiens
gtaaatcctgccatttaaaa

SEQ ID NO: 957473 - DNA, 15 bp, Homo sapiens
gtaaatctgaagaaa

SEQ ID NO: 957474 - DNA, 12 bp, Homo sapiens
gtaaatctgcca

SEQ ID NO: 957475 - DNA, 13 bp, Homo sapiens
gtaaatctgccac

SEQ ID NO: 957476 - DNA, 15 bp, Homo sapiens
gtaaatctgccacaa

SEQ ID NO: 957477 - DNA, 17 bp, Homo sapiens
gtaaatctttttgcttc

SEQ ID NO: 957478 - DNA, 13 bp, Homo sapiens
gtaaatgagaaga

SEQ ID NO: 957479 - DNA, 15 bp, Homo sapiens
gtaaatgctgtgttg

SEQ ID NO: 957480 - DNA, 18 bp, Homo sapiens
gtaaatgggggtgcattt

SEQ ID NO: 957481 - DNA, 16 bp, Homo sapiens
gtaaatggtgtacata

SEQ ID NO: 957482 - DNA, 16 bp, Homo sapiens
gtaaatgtggattttg

SEQ ID NO: 957483 - DNA, 22 bp, Homo sapiens
gtaaatgtggattttgtagatg

SEQ ID NO: 957484 - DNA, 24 bp, Homo sapiens
gtaaatgtgtttcttgctgccatg

SEQ ID NO: 957485 - DNA, 13 bp, Homo sapiens
gtaaatgttatta

SEQ ID NO: 957486 - DNA, 17 bp, Homo sapiens
gtaaattaaacattttt

SEQ ID NO: 957487 - DNA, 17 bp, Homo sapiens
gtaaattaacttttata

SEQ ID NO: 957488 - DNA, 15 bp, Homo sapiens
gtaaattatatttgt

SEQ ID NO: 957489 - DNA, 19 bp, Homo sapiens
gtaaattatatttgtgcta

SEQ ID NO: 957490 - DNA, 14 bp, Homo sapiens
gtaaattattgtaa

SEQ ID NO: 957491 - DNA, 16 bp, Homo sapiens
gtaaattattgtaaac

SEQ ID NO: 957492 - DNA, 16 bp, Homo sapiens
gtaaattgcacagagc

SEQ ID NO: 957493 - DNA, 16 bp, Homo sapiens
gtaaattgcagaattc

SEQ ID NO: 957494 - DNA, 16 bp, Homo sapiens
gtaaattgcctgattt

SEQ ID NO: 957495 - DNA, 14 bp, Homo sapiens
gtaaattggaaaca

SEQ ID NO: 957496 - DNA, 19 bp, Homo sapiens
gtaaattggcatggaaatt

SEQ ID NO: 957497 - DNA, 22 bp, Homo sapiens
gtaaattggcatggaaatttaa

SEQ ID NO: 957498 - DNA, 22 bp, Homo sapiens
gtaaatttagtgtttttttatt

SEQ ID NO: 957499 - DNA, 17 bp, Homo sapiens
gtaaatttttgaaaaat

SEQ ID NO: 957500 - DNA, 14 bp, Homo sapiens
gtaacaagaaaaca

SEQ ID NO: 957501 - DNA, 15 bp, Homo sapiens
gtaacaagaaaacat

SEQ ID NO: 957502 - DNA, 14 bp, Homo sapiens
gtaacaagccagat

SEQ ID NO: 957503 - DNA, 21 bp, Homo sapiens
gtaacaattgtgtagcctttt

SEQ ID NO: 957504 - DNA, 17 bp, Homo sapiens
gtaacactaatatattt

SEQ ID NO: 957505 - DNA, 17 bp, Homo sapiens
gtaacactttacaatgt

SEQ ID NO: 957506 - DNA, 19 bp, Homo sapiens
gtaacaggaaaattttaaa

SEQ ID NO: 957507 - DNA, 14 bp, Homo sapiens
gtaacaggtctcct

SEQ ID NO: 957508 - DNA, 21 bp, Homo sapiens
gtaacaggtctcctcttaaaa

SEQ ID NO: 957509 - DNA, 17 bp, Homo sapiens
gtaacagttcatgtttg

SEQ ID NO: 957510 - DNA, 20 bp, Homo sapiens
gtaacagttcatgtttgctt

SEQ ID NO: 957511 - DNA, 16 bp, Homo sapiens
gtaacatcagccattt

SEQ ID NO: 957512 - DNA, 12 bp, Homo sapiens
gtaacatgttta

SEQ ID NO: 957513 - DNA, 15 bp, Homo sapiens
gtaacattgtaaagt

SEQ ID NO: 957514 - DNA, 21 bp, Homo sapiens
gtaacattgtaaagtatgtga

SEQ ID NO: 957515 - DNA, 21 bp, Homo sapiens
gtaaccaagagttaagatatc

SEQ ID NO: 957516 - DNA, 23 bp, Homo sapiens
gtaaccattttcctttggactgt

SEQ ID NO: 957517 - DNA, 19 bp, Homo sapiens
gtaaccgagccagcagctg

SEQ ID NO: 957518 - DNA, 21 bp, Homo sapiens
gtaaccgagccagcagctgaa

SEQ ID NO: 957519 - DNA, 17 bp, Homo sapiens
gtaacctcaaactctgg

SEQ ID NO: 957520 - DNA, 18 bp, Homo sapiens
gtaacctcagctctggga

SEQ ID NO: 957521 - DNA, 19 bp, Homo sapiens
gtaacctcagtatttatgt

SEQ ID NO: 957522 - DNA, 23 bp, Homo sapiens
gtaacctggccactgtccctgtc

SEQ ID NO: 957523 - DNA, 23 bp, Homo sapiens
gtaacgaacccctagaaaggaga

SEQ ID NO: 957524 - DNA, 14 bp, Homo sapiens
gtaacgtgcactgt

SEQ ID NO: 957525 - DNA, 15 bp, Homo sapiens
gtaactaaaataatt

SEQ ID NO: 957526 - DNA, 20 bp, Homo sapiens
gtaactaaaataattttgta

SEQ ID NO: 957527 - DNA, 21 bp, Homo sapiens
gtaactaattttgttgaaaat

SEQ ID NO: 957528 - DNA, 16 bp, Homo sapiens
gtaactacaatgatgg

SEQ ID NO: 957529 - DNA, 12 bp, Homo sapiens
gtaactacttta

SEQ ID NO: 957530 - DNA, 18 bp, Homo sapiens
gtaactactttttatact

SEQ ID NO: 957531 - DNA, 17 bp, Homo sapiens
gtaactattaacctttt

SEQ ID NO: 957532 - DNA, 18 bp, Homo sapiens
gtaactcagacattccaa

SEQ ID NO: 957533 - DNA, 19 bp, Homo sapiens
gtaactccagatagagaaa

SEQ ID NO: 957534 - DNA, 18 bp, Homo sapiens
gtaactcttacctaaact

SEQ ID NO: 957535 - DNA, 20 bp, Homo sapiens
gtaactgctcagagctttaa

SEQ ID NO: 957536 - DNA, 15 bp, Homo sapiens
gtaactgctgagcca

SEQ ID NO: 957537 - DNA, 23 bp, Homo sapiens
gtaactggttaaaaaacaaatgt

SEQ ID NO: 957538 - DNA, 20 bp, Homo sapiens
gtaactgtccgtagtatcag

SEQ ID NO: 957539 - DNA, 21 bp, Homo sapiens
gtaactgtcctgtcctgctca

SEQ ID NO: 957540 - DNA, 13 bp, Homo sapiens
gtaactgttcttg

SEQ ID NO: 957541 - DNA, 16 bp, Homo sapiens
gtaactgttttttaag

SEQ ID NO: 957542 - DNA, 19 bp, Homo sapiens
gtaacttatattgaagaca

SEQ ID NO: 957543 - DNA, 22 bp, Homo sapiens
gtaacttatattgaagacaatt

SEQ ID NO: 957544 - DNA, 18 bp, Homo sapiens
gtaacttcttatggaatt

SEQ ID NO: 957545 - DNA, 20 bp, Homo sapiens
gtaacttgcttaaatttctt

SEQ ID NO: 957546 - DNA, 22 bp, Homo sapiens
gtaattaaactgttaacttatt

SEQ ID NO: 957547 - DNA, 21 bp, Homo sapiens
gtaattaagtactatgtatca

SEQ ID NO: 957548 - DNA, 18 bp, Homo sapiens
gtaattacatatttgact

SEQ ID NO: 957549 - DNA, 16 bp, Homo sapiens
gtaattacctggagaa

SEQ ID NO: 957550 - DNA, 22 bp, Homo sapiens
gtaattatcgggaacagtgttt

SEQ ID NO: 957551 - DNA, 14 bp, Homo sapiens
gtaattcaggactc

SEQ ID NO: 957552 - DNA, 22 bp, Homo sapiens
gtaattcattgagcagttagct

SEQ ID NO: 957553 - DNA, 16 bp, Homo sapiens
gtaattccaaaatcca

SEQ ID NO: 957554 - DNA, 14 bp, Homo sapiens
gtaattctaaatga

SEQ ID NO: 957555 - DNA, 18 bp, Homo sapiens
gtaattctaaatgaatgt

SEQ ID NO: 957556 - DNA, 22 bp, Homo sapiens
gtaattctccctaaggaatctg

SEQ ID NO: 957557 - DNA, 16 bp, Homo sapiens
gtaattgaataaagtt

SEQ ID NO: 957558 - DNA, 16 bp, Homo sapiens
gtaattgcttacattt

SEQ ID NO: 957559 - DNA, 23 bp, Homo sapiens
gtaattggaatcttcacctcaga

SEQ ID NO: 957560 - DNA, 16 bp, Homo sapiens
gtaattgtaattccaa

SEQ ID NO: 957561 - DNA, 17 bp, Homo sapiens
gtaattgtgtaaaaaat

SEQ ID NO: 957562 - DNA, 15 bp, Homo sapiens
gtaattgtgtggatt

SEQ ID NO: 957563 - DNA, 21 bp, Homo sapiens
gtaattgttgctaatcttctt

SEQ ID NO: 957564 - DNA, 14 bp, Homo sapiens
gtaattgtttttta

SEQ ID NO: 957565 - DNA, 19 bp, Homo sapiens
gtaattgttttttaaagca

SEQ ID NO: 957566 - DNA, 22 bp, Homo sapiens
gtaatttaaaacttttgtttaa

SEQ ID NO: 957567 - DNA, 19 bp, Homo sapiens
gtaatttaaacaggcccag

SEQ ID NO: 957568 - DNA, 21 bp, Homo sapiens
gtaatttaaacaggcccagca

SEQ ID NO: 957569 - DNA, 13 bp, Homo sapiens
gtaatttaatggg

SEQ ID NO: 957570 - DNA, 11 bp, Homo sapiens
gtaatttattt

SEQ ID NO: 957571 - DNA, 15 bp, Homo sapiens
gtaatttcgccttaa

SEQ ID NO: 957572 - DNA, 12 bp, Homo sapiens
gtaatttgaaga

SEQ ID NO: 957573 - DNA, 14 bp, Homo sapiens
gtaatttgaagatt

SEQ ID NO: 957574 - DNA, 12 bp, Homo sapiens
gtaatttgaatt

SEQ ID NO: 957575 - DNA, 16 bp, Homo sapiens
gtaatttgaggacaac

SEQ ID NO: 957576 - DNA, 20 bp, Homo sapiens
gtaatttgatggtatttctt

SEQ ID NO: 957577 - DNA, 15 bp, Homo sapiens
gtaatttgcattact

SEQ ID NO: 957578 - DNA, 22 bp, Homo sapiens
gtaatttgtgatacaatgctgt

SEQ ID NO: 957579 - DNA, 23 bp, Homo sapiens
gtaattttcggatgggagagttt

SEQ ID NO: 957580 - DNA, 17 bp, Homo sapiens
gtaattttggattttgc

SEQ ID NO: 957581 - DNA, 15 bp, Homo sapiens
gtaattttgtcacat

SEQ ID NO: 957582 - DNA, 14 bp, Homo sapiens
gtaattttgtgtaa

SEQ ID NO: 957583 - DNA, 21 bp, Homo sapiens
gtaattttgttctagttttca

SEQ ID NO: 957584 - DNA, 18 bp, Homo sapiens
tggacttgtatagtgaga

SEQ ID NO: 957585 - DNA, 16 bp, Homo sapiens
tggactttaaaaaaac

SEQ ID NO: 957586 - DNA, 18 bp, Homo sapiens
tggactttccaccccctc

SEQ ID NO: 957587 - DNA, 21 bp, Homo sapiens
tggactttctctaataataaa

SEQ ID NO: 957588 - DNA, 22 bp, Homo sapiens
tggactttctctaataataaat

SEQ ID NO: 957589 - DNA, 23 bp, Homo sapiens
tggactttctctaataataaata

SEQ ID NO: 957590 - DNA, 18 bp, Homo sapiens
tggagaaaaaggtgccat

SEQ ID NO: 957591 - DNA, 14 bp, Homo sapiens
tggagaaaccctgt

SEQ ID NO: 957592 - DNA, 16 bp, Homo sapiens
tggagaaaccctgtct

SEQ ID NO: 957593 - DNA, 19 bp, Homo sapiens
tggagaaagcactgacctg

SEQ ID NO: 957594 - DNA, 21 bp, Homo sapiens
tggagaaataaaaatacctct

SEQ ID NO: 957595 - DNA, 23 bp, Homo sapiens
tggagaaataaaaatacctcttt

SEQ ID NO: 957596 - DNA, 23 bp, Homo sapiens
tggagaacgccagtctcccaggc

SEQ ID NO: 957597 - DNA, 15 bp, Homo sapiens
tggagaactctggct

SEQ ID NO: 957598 - DNA, 19 bp, Homo sapiens
tggagaagaatggctttca

SEQ ID NO: 957599 - DNA, 13 bp, Homo sapiens
tggagaagattta

SEQ ID NO: 957600 - DNA, 13 bp, Homo sapiens
tggagaagcagtg

SEQ ID NO: 957601 - DNA, 16 bp, Homo sapiens
tggagaagctcaccca

SEQ ID NO: 957602 - DNA, 15 bp, Homo sapiens
tggagaagctgcagg

SEQ ID NO: 957603 - DNA, 20 bp, Homo sapiens
tggagaagggttctgccctg

SEQ ID NO: 957604 - DNA, 21 bp, Homo sapiens
tggagaagggttctgccctgc

SEQ ID NO: 957605 - DNA, 22 bp, Homo sapiens
tggagaagggttctgccctgcc

SEQ ID NO: 957606 - DNA, 17 bp, Homo sapiens
tggagaatactttgctt

SEQ ID NO: 957607 - DNA, 20 bp, Homo sapiens
tggagacaaggtgctaacat

SEQ ID NO: 957608 - DNA, 19 bp, Homo sapiens
tggagaccctgcaaacaga

SEQ ID NO: 957609 - DNA, 19 bp, Homo sapiens
tggagaccgcttcacccct

SEQ ID NO: 957610 - DNA, 20 bp, Homo sapiens
tggagacgtggaacctctgt

SEQ ID NO: 957611 - DNA, 24 bp, Homo sapiens
tggagacgtggaacctctgtctca

SEQ ID NO: 957612 - DNA, 17 bp, Homo sapiens
tggagacgtggtgggac

SEQ ID NO: 957613 - DNA, 12 bp, Homo sapiens
tggagactgctt

SEQ ID NO: 957614 - DNA, 17 bp, Homo sapiens
tggagactgcttcccat

SEQ ID NO: 957615 - DNA, 19 bp, Homo sapiens
tggagactggtcctgtgtg

SEQ ID NO: 957616 - DNA, 17 bp, Homo sapiens
tggagactgtctcaaga

SEQ ID NO: 957617 - DNA, 15 bp, Homo sapiens
tggagacttcctctg

SEQ ID NO: 957618 - DNA, 21 bp, Homo sapiens
tggagagaaggcctccctagc

SEQ ID NO: 957619 - DNA, 17 bp, Homo sapiens
tggagagaatgtgtgtg

SEQ ID NO: 957620 - DNA, 20 bp, Homo sapiens
tggagagagaggctgcctca

SEQ ID NO: 957621 - DNA, 14 bp, Homo sapiens
tggagagcaaaggc

SEQ ID NO: 957622 - DNA, 13 bp, Homo sapiens
tggagagcagcag

SEQ ID NO: 957623 - DNA, 15 bp, Homo sapiens
tggagagcagcaggt

SEQ ID NO: 957624 - DNA, 12 bp, Homo sapiens
tggagagcagct

SEQ ID NO: 957625 - DNA, 13 bp, Homo sapiens
tggagagcagctg

SEQ ID NO: 957626 - DNA, 16 bp, Homo sapiens
tggagagcagctggct

SEQ ID NO: 957627 - DNA, 20 bp, Homo sapiens
tggagagcagctggctctcc

SEQ ID NO: 957628 - DNA, 13 bp, Homo sapiens
tggagagccctgg

SEQ ID NO: 957629 - DNA, 19 bp, Homo sapiens
tggagagctggtgcccgga

SEQ ID NO: 957630 - DNA, 18 bp, Homo sapiens
tggagaggccctctggag

SEQ ID NO: 957631 - DNA, 12 bp, Homo sapiens
tggagaggcctg

SEQ ID NO: 957632 - DNA, 15 bp, Homo sapiens
tggagaggcctgggg

SEQ ID NO: 957633 - DNA, 23 bp, Homo sapiens
tggagaggcctggggtgggacag

SEQ ID NO: 957634 - DNA, 13 bp, Homo sapiens
tggagaggcggcc

SEQ ID NO: 957635 - DNA, 20 bp, Homo sapiens
tggagagggagactcctggg

SEQ ID NO: 957636 - DNA, 19 bp, Homo sapiens
tggagagggagatgtgtga

SEQ ID NO: 957637 - DNA, 14 bp, Homo sapiens
tggagagtggggag

SEQ ID NO: 957638 - DNA, 17 bp, Homo sapiens
tggagagtggggagagg

SEQ ID NO: 957639 - DNA, 14 bp, Homo sapiens
tggagataaaagca

SEQ ID NO: 957640 - DNA, 14 bp, Homo sapiens
tggagatagctggg

SEQ ID NO: 957641 - DNA, 20 bp, Homo sapiens
tggagatagtgccaggtggc

SEQ ID NO: 957642 - DNA, 19 bp, Homo sapiens
tggagatatttatgggggg

SEQ ID NO: 957643 - DNA, 14 bp, Homo sapiens
tggagatcctcctg

SEQ ID NO: 957644 - DNA, 18 bp, Homo sapiens
tggagatcctcctgcaga

SEQ ID NO: 957645 - DNA, 21 bp, Homo sapiens
tggagatcctcctgcagacca

SEQ ID NO: 957646 - DNA, 14 bp, Homo sapiens
tggagatgaggcca

SEQ ID NO: 957647 - DNA, 15 bp, Homo sapiens
tggagatgaggccag

SEQ ID NO: 957648 - DNA, 19 bp, Homo sapiens
tggagatgaggccagacca

SEQ ID NO: 957649 - DNA, 22 bp, Homo sapiens
tggagatgaggccagaccatgg

SEQ ID NO: 957650 - DNA, 20 bp, Homo sapiens
tggagatgcagctactggaa

SEQ ID NO: 957651 - DNA, 18 bp, Homo sapiens
tggagatggactcaggat

SEQ ID NO: 957652 - DNA, 16 bp, Homo sapiens
tggagatgggatgctt

SEQ ID NO: 957653 - DNA, 18 bp, Homo sapiens
tggagatgggatgcttgc

SEQ ID NO: 957654 - DNA, 16 bp, Homo sapiens
tggagcaaaaggcagc

SEQ ID NO: 957655 - DNA, 18 bp, Homo sapiens
tggagcaaaaggcagctc

SEQ ID NO: 957656 - DNA, 20 bp, Homo sapiens
tggagcaaaaggcagctcac

SEQ ID NO: 957657 - DNA, 14 bp, Homo sapiens
tggagcaaaccatt

SEQ ID NO: 957658 - DNA, 22 bp, Homo sapiens
tggagcaagaaggaaggaggca

SEQ ID NO: 957659 - DNA, 16 bp, Homo sapiens
tggagcacaaaattca

SEQ ID NO: 957660 - DNA, 20 bp, Homo sapiens
tggagcacatgttactgctt

SEQ ID NO: 957661 - DNA, 21 bp, Homo sapiens
tggagcacatgttactgcttc

SEQ ID NO: 957662 - DNA, 23 bp, Homo sapiens
tggagcacatgttactgcttcat

SEQ ID NO: 957663 - DNA, 13 bp, Homo sapiens
tggagcacctggg

SEQ ID NO: 957664 - DNA, 21 bp, Homo sapiens
tggagcacctgggccccactg

SEQ ID NO: 957665 - DNA, 14 bp, Homo sapiens
tggagcactggact

SEQ ID NO: 957666 - DNA, 20 bp, Homo sapiens
tggagcacttgttttaaaat

SEQ ID NO: 957667 - DNA, 21 bp, Homo sapiens
gtacataggcttctattacct

SEQ ID NO: 957668 - DNA, 18 bp, Homo sapiens
gtacatagttatttattt

SEQ ID NO: 957669 - DNA, 20 bp, Homo sapiens
gtacatagttatttttctct

SEQ ID NO: 957670 - DNA, 17 bp, Homo sapiens
gtacatatttgtggaat

SEQ ID NO: 957671 - DNA, 15 bp, Homo sapiens
gtacatcatgttatt

SEQ ID NO: 957672 - DNA, 18 bp, Homo sapiens
gtacatctgcaatatgaa

SEQ ID NO: 957673 - DNA, 15 bp, Homo sapiens
gtacatgaaaacaca

SEQ ID NO: 957674 - DNA, 17 bp, Homo sapiens
gtacatgaaaacacatt

SEQ ID NO: 957675 - DNA, 19 bp, Homo sapiens
gtacatggaataacatgta

SEQ ID NO: 957676 - DNA, 18 bp, Homo sapiens
gtacattcaatgtttatg

SEQ ID NO: 957677 - DNA, 20 bp, Homo sapiens
gtacattcttccatcatcac

SEQ ID NO: 957678 - DNA, 12 bp, Homo sapiens
gtacattgctta

SEQ ID NO: 957679 - DNA, 18 bp, Homo sapiens
gtacattgcttaaaatat

SEQ ID NO: 957680 - DNA, 18 bp, Homo sapiens
gtacattgtgagctctgg

SEQ ID NO: 957681 - DNA, 14 bp, Homo sapiens
gtacatttaaaatt

SEQ ID NO: 957682 - DNA, 18 bp, Homo sapiens
gtacatttatttattact

SEQ ID NO: 957683 - DNA, 20 bp, Homo sapiens
gtacatttatttattactgt

SEQ ID NO: 957684 - DNA, 21 bp, Homo sapiens
gtacatttatttattactgtc

SEQ ID NO: 957685 - DNA, 22 bp, Homo sapiens
gtacatttgggagtttttatga

SEQ ID NO: 957686 - DNA, 15 bp, Homo sapiens
gtacatttttggggg

SEQ ID NO: 957687 - DNA, 20 bp, Homo sapiens
gtacatttttggggggagag

SEQ ID NO: 957688 - DNA, 16 bp, Homo sapiens
gtacattttttttcaa

SEQ ID NO: 957689 - DNA, 12 bp, Homo sapiens
gtaccaaaacat

SEQ ID NO: 957690 - DNA, 19 bp, Homo sapiens
gtaccaaatccacaagcca

SEQ ID NO: 957691 - DNA, 14 bp, Homo sapiens
gtaccaatcatttt

SEQ ID NO: 957692 - DNA, 14 bp, Homo sapiens
gtaccaatgctgtt

SEQ ID NO: 957693 - DNA, 21 bp, Homo sapiens
gtaccaatgctgttgtaaaca

SEQ ID NO: 957694 - DNA, 14 bp, Homo sapiens
gtaccacacagtaa

SEQ ID NO: 957695 - DNA, 14 bp, Homo sapiens
gtaccactcaggcc

SEQ ID NO: 957696 - DNA, 16 bp, Homo sapiens
gtaccacttttgcaaa

SEQ ID NO: 957697 - DNA, 16 bp, Homo sapiens
gtaccagcaatatgta

SEQ ID NO: 957698 - DNA, 20 bp, Homo sapiens
gtaccagttaatttttccaa

SEQ ID NO: 957699 - DNA, 22 bp, Homo sapiens
gtaccagttaatttttccaact

SEQ ID NO: 957700 - DNA, 20 bp, Homo sapiens
gtaccatagtaccatttata

SEQ ID NO: 957701 - DNA, 20 bp, Homo sapiens
gtaccatgaaacaaagctgc

SEQ ID NO: 957702 - DNA, 17 bp, Homo sapiens
gtaccattccttcaaat

SEQ ID NO: 957703 - DNA, 22 bp, Homo sapiens
gtaccattccttcaaataaaga

SEQ ID NO: 957704 - DNA, 19 bp, Homo sapiens
gtaccatttatacaaatta

SEQ ID NO: 957705 - DNA, 14 bp, Homo sapiens
gtaccatttgcatg

SEQ ID NO: 957706 - DNA, 14 bp, Homo sapiens
gtacccaccccagc

SEQ ID NO: 957707 - DNA, 15 bp, Homo sapiens
gtacccaccccagca

SEQ ID NO: 957708 - DNA, 18 bp, Homo sapiens
gtacccagccatctgccc

SEQ ID NO: 957709 - DNA, 17 bp, Homo sapiens
gtacccagccatgtgtt

SEQ ID NO: 957710 - DNA, 14 bp, Homo sapiens
gtaccccaccctca

SEQ ID NO: 957711 - DNA, 16 bp, Homo sapiens
tggagcgcacctgccc

SEQ ID NO: 957712 - DNA, 16 bp, Homo sapiens
tggagcggagatgagg

SEQ ID NO: 957713 - DNA, 12 bp, Homo sapiens
tggagctcagcc

SEQ ID NO: 957714 - DNA, 13 bp, Homo sapiens
tggagctcagccc

SEQ ID NO: 957715 - DNA, 20 bp, Homo sapiens
tggagctcatgtcagccgtg

SEQ ID NO: 957716 - DNA, 13 bp, Homo sapiens
tggagctcgcccc

SEQ ID NO: 957717 - DNA, 19 bp, Homo sapiens
tggagctcgcccctcccct

SEQ ID NO: 957718 - DNA, 22 bp, Homo sapiens
tggagctcgcccctcccctcag

SEQ ID NO: 957719 - DNA, 23 bp, Homo sapiens
tggagctctgtgggtctctggaa

SEQ ID NO: 957720 - DNA, 20 bp, Homo sapiens
tggagctgagaagaggagga

SEQ ID NO: 957721 - DNA, 17 bp, Homo sapiens
tggagctgagcctctca

SEQ ID NO: 957722 - DNA, 16 bp, Homo sapiens
tggagctgggagacaa

SEQ ID NO: 957723 - DNA, 22 bp, Homo sapiens
tggagctggtctgccaggggct

SEQ ID NO: 957724 - DNA, 19 bp, Homo sapiens
tggagcttaagccactgcc

SEQ ID NO: 957725 - DNA, 20 bp, Homo sapiens
tggagcttaagccactgcct

SEQ ID NO: 957726 - DNA, 22 bp, Homo sapiens
tggagcttaagccactgcctct

SEQ ID NO: 957727 - DNA, 21 bp, Homo sapiens
tggagcttcatggcagaaggc

SEQ ID NO: 957728 - DNA, 21 bp, Homo sapiens
tggagcttttttctttaagat

SEQ ID NO: 957729 - DNA, 11 bp, Homo sapiens
tggaggaaaaa

SEQ ID NO: 957730 - DNA, 16 bp, Homo sapiens
tggaggaaaaaggtca

SEQ ID NO: 957731 - DNA, 17 bp, Homo sapiens
tggaggaagagccacct

SEQ ID NO: 957732 - DNA, 19 bp, Homo sapiens
tggaggaagagccacctgc

SEQ ID NO: 957733 - DNA, 20 bp, Homo sapiens
tggaggaagagccacctgca

SEQ ID NO: 957734 - DNA, 18 bp, Homo sapiens
tggaggaagagggacaga

SEQ ID NO: 957735 - DNA, 19 bp, Homo sapiens
tggaggaagatagcgcata

SEQ ID NO: 957736 - DNA, 20 bp, Homo sapiens
tggaggaaggtgctgagctt

SEQ ID NO: 957737 - DNA, 18 bp, Homo sapiens
tggaggaagtggggtctg

SEQ ID NO: 957738 - DNA, 21 bp, Homo sapiens
tggaggaatacattttattct

SEQ ID NO: 957739 - DNA, 16 bp, Homo sapiens
tggaggaatgctcccc

SEQ ID NO: 957740 - DNA, 17 bp, Homo sapiens
tggaggaatgctccccc

SEQ ID NO: 957741 - DNA, 21 bp, Homo sapiens
tggaggacagtggcacaatca

SEQ ID NO: 957742 - DNA, 18 bp, Homo sapiens
tggaggaccccgagggct

SEQ ID NO: 957743 - DNA, 16 bp, Homo sapiens
tggaggaccgttctct

SEQ ID NO: 957744 - DNA, 17 bp, Homo sapiens
tggaggaccgttctctg

SEQ ID NO: 957745 - DNA, 21 bp, Homo sapiens
tggaggaccgttctctgtccc

SEQ ID NO: 957746 - DNA, 13 bp, Homo sapiens
tggaggagaggag

SEQ ID NO: 957747 - DNA, 19 bp, Homo sapiens
tggaggagctgagggaggg

SEQ ID NO: 957748 - DNA, 22 bp, Homo sapiens
tggaggagcttgggggatgact

SEQ ID NO: 957749 - DNA, 14 bp, Homo sapiens
tggaggaggaaggc

SEQ ID NO: 957750 - DNA, 15 bp, Homo sapiens
tggaggaggaaggca

SEQ ID NO: 957751 - DNA, 16 bp, Homo sapiens
tggaggaggaggagga

SEQ ID NO: 957752 - DNA, 15 bp, Homo sapiens
tggaggaggatgcca

SEQ ID NO: 957753 - DNA, 17 bp, Homo sapiens
tggaggatcagtttttt

SEQ ID NO: 957754 - DNA, 15 bp, Homo sapiens
tggaggatggagaga

SEQ ID NO: 957755 - DNA, 20 bp, Homo sapiens
tggaggattctttccccaga

SEQ ID NO: 957756 - DNA, 22 bp, Homo sapiens
tggaggattctttccccagagg

SEQ ID NO: 957757 - DNA, 20 bp, Homo sapiens
tggaggcaagagggagggga

SEQ ID NO: 957758 - DNA, 14 bp, Homo sapiens
tggaggcaatccta

SEQ ID NO: 957759 - DNA, 14 bp, Homo sapiens
tggaggcaatgtgg

SEQ ID NO: 957760 - DNA, 14 bp, Homo sapiens
tggaggcactttag

SEQ ID NO: 957761 - DNA, 15 bp, Homo sapiens
tggaggcagagacct

SEQ ID NO: 957762 - DNA, 16 bp, Homo sapiens
tggaggcagagacctc

SEQ ID NO: 957763 - DNA, 21 bp, Homo sapiens
tggaggcagatgtggggctga

SEQ ID NO: 957764 - DNA, 17 bp, Homo sapiens
tggaggcagccagggct

SEQ ID NO: 957765 - DNA, 14 bp, Homo sapiens
tggaggcagggcct

SEQ ID NO: 957766 - DNA, 22 bp, Homo sapiens
tggaggcagggccttgcccaga

SEQ ID NO: 957767 - DNA, 23 bp, Homo sapiens
tggaggcaggggctgctgccttg

SEQ ID NO: 957768 - DNA, 10 bp, Homo sapiens
tggaggccag

SEQ ID NO: 957769 - DNA, 16 bp, Homo sapiens
tggaggccagagtctc

SEQ ID NO: 957770 - DNA, 16 bp, Homo sapiens
tggaggcccctggagc

SEQ ID NO: 957771 - DNA, 17 bp, Homo sapiens
tggaggcccctggagcc

SEQ ID NO: 957772 - DNA, 17 bp, Homo sapiens
tggaggcctcaggtgct

SEQ ID NO: 957773 - DNA, 17 bp, Homo sapiens
tggaggcctctggccct

SEQ ID NO: 957774 - DNA, 20 bp, Homo sapiens
tggaggcctgatgctgcccc

SEQ ID NO: 957775 - DNA, 17 bp, Homo sapiens
tggaggccttccagctg

SEQ ID NO: 957776 - DNA, 21 bp, Homo sapiens
tggaggccttccagctgctgt

SEQ ID NO: 957777 - DNA, 21 bp, Homo sapiens
tggaggctcagcccaccctcc

SEQ ID NO: 957778 - DNA, 19 bp, Homo sapiens
tggaggctgacgtgtgagg

SEQ ID NO: 957779 - DNA, 13 bp, Homo sapiens
tggaggcttcctg

SEQ ID NO: 957780 - DNA, 16 bp, Homo sapiens
tggaggcttcctgcgt

SEQ ID NO: 957781 - DNA, 17 bp, Homo sapiens
tggaggcttcctgcgtc

SEQ ID NO: 957782 - DNA, 22 bp, Homo sapiens
tggaggcttcctgcgtcctcct

SEQ ID NO: 957783 - DNA, 13 bp, Homo sapiens
tggagggaaccac

SEQ ID NO: 957784 - DNA, 22 bp, Homo sapiens
tggagggacaagtggactcagg

SEQ ID NO: 957785 - DNA, 11 bp, Homo sapiens
tggagggagag

SEQ ID NO: 957786 - DNA, 17 bp, Homo sapiens
tggagggagggaagggt

SEQ ID NO: 957787 - DNA, 17 bp, Homo sapiens
tggagggagggcagctg

SEQ ID NO: 957788 - DNA, 22 bp, Homo sapiens
tggagggagggcagctggcccc

SEQ ID NO: 957789 - DNA, 20 bp, Homo sapiens
tggatatgttgttaaacacg

SEQ ID NO: 957790 - DNA, 14 bp, Homo sapiens
tggatattgttacg

SEQ ID NO: 957791 - DNA, 13 bp, Homo sapiens
tggatattttcaa

SEQ ID NO: 957792 - DNA, 18 bp, Homo sapiens
tggatattttcaaattgt

SEQ ID NO: 957793 - DNA, 23 bp, Homo sapiens
tggatattttcaaattgtatcta

SEQ ID NO: 957794 - DNA, 15 bp, Homo sapiens
tggatatttttgtac

SEQ ID NO: 957795 - DNA, 18 bp, Homo sapiens
tggatatttttgtacttg

SEQ ID NO: 957796 - DNA, 16 bp, Homo sapiens
tggatcaaaaggagaa

SEQ ID NO: 957797 - DNA, 18 bp, Homo sapiens
tggatcaagcttgtgtac

SEQ ID NO: 957798 - DNA, 22 bp, Homo sapiens
tggatcacacctcagtgggaag

SEQ ID NO: 957799 - DNA, 16 bp, Homo sapiens
tggatcacagctgctt

SEQ ID NO: 957800 - DNA, 20 bp, Homo sapiens
tggatcacgacgctgcagag

SEQ ID NO: 957801 - DNA, 16 bp, Homo sapiens
tggatcagtcctttga

SEQ ID NO: 957802 - DNA, 19 bp, Homo sapiens
tggatcagtcctttgatca

SEQ ID NO: 957803 - DNA, 14 bp, Homo sapiens
tggatccctgccct

SEQ ID NO: 957804 - DNA, 19 bp, Homo sapiens
tggatccctgcccttctca

SEQ ID NO: 957805 - DNA, 20 bp, Homo sapiens
tggatccctgcccttctcaa

SEQ ID NO: 957806 - DNA, 14 bp, Homo sapiens
tggatcctgggctg

SEQ ID NO: 957807 - DNA, 19 bp, Homo sapiens
tggatcctgggctgggtgg

SEQ ID NO: 957808 - DNA, 18 bp, Homo sapiens
tggatcgagtgtagctgt

SEQ ID NO: 957809 - DNA, 19 bp, Homo sapiens
tggatcgagtgtagctgtg

SEQ ID NO: 957810 - DNA, 18 bp, Homo sapiens
tggatctatttcatgttt

SEQ ID NO: 957811 - DNA, 20 bp, Homo sapiens
tggatctatttcatgttttt

SEQ ID NO: 957812 - DNA, 18 bp, Homo sapiens
tggatctccaaggaccag

SEQ ID NO: 957813 - DNA, 21 bp, Homo sapiens
tggatctccaaggaccaggtt

SEQ ID NO: 957814 - DNA, 15 bp, Homo sapiens
tggatctcctccctt

SEQ ID NO: 957815 - DNA, 16 bp, Homo sapiens
tggatctgaccctccc

SEQ ID NO: 957816 - DNA, 19 bp, Homo sapiens
tggatctgatctgtaccat

SEQ ID NO: 957817 - DNA, 20 bp, Homo sapiens
tggatctgggaccctttcct

SEQ ID NO: 957818 - DNA, 23 bp, Homo sapiens
tggatctgggaccctttccttcc

SEQ ID NO: 957819 - DNA, 20 bp, Homo sapiens
tggatctgtccaaggaaact

SEQ ID NO: 957820 - DNA, 15 bp, Homo sapiens
tggatcttcagaact

SEQ ID NO: 957821 - DNA, 22 bp, Homo sapiens
tggatcttcagaactgcccttg

SEQ ID NO: 957822 - DNA, 23 bp, Homo sapiens
tggatcttcagaactgcccttgc

SEQ ID NO: 957823 - DNA, 23 bp, Homo sapiens
tggatctttctccctttctcctc

SEQ ID NO: 957824 - DNA, 19 bp, Homo sapiens
tggatcttttactttaaag

SEQ ID NO: 957825 - DNA, 14 bp, Homo sapiens
tggatgaaattttc

SEQ ID NO: 957826 - DNA, 15 bp, Homo sapiens
tggatgacagggcag

SEQ ID NO: 957827 - DNA, 19 bp, Homo sapiens
tggatgacagggcagagca

SEQ ID NO: 957828 - DNA, 13 bp, Homo sapiens
tggatgaccagaa

SEQ ID NO: 957829 - DNA, 17 bp, Homo sapiens
tggatgaggcacttctg

SEQ ID NO: 957830 - DNA, 22 bp, Homo sapiens
tggatgaggcacttctgtcaat

SEQ ID NO: 957831 - DNA, 15 bp, Homo sapiens
tggatgagtcagaca

SEQ ID NO: 957832 - DNA, 15 bp, Homo sapiens
tggatgatatacaca

SEQ ID NO: 957833 - DNA, 17 bp, Homo sapiens
tggatgatgtttcgtga

SEQ ID NO: 957834 - DNA, 22 bp, Homo sapiens
tggatgccgatttctgtaaact

SEQ ID NO: 957835 - DNA, 19 bp, Homo sapiens
tggatgcgagcttggcctt

SEQ ID NO: 957836 - DNA, 17 bp, Homo sapiens
tggatgcgcagtgcctt

SEQ ID NO: 957837 - DNA, 16 bp, Homo sapiens
tggatgctccagggca

SEQ ID NO: 957838 - DNA, 18 bp, Homo sapiens
tggatgctccagggcagc

SEQ ID NO: 957839 - DNA, 13 bp, Homo sapiens
tggatgctgagct

SEQ ID NO: 957840 - DNA, 21 bp, Homo sapiens
gtagaaaggaagccttgctca

SEQ ID NO: 957841 - DNA, 15 bp, Homo sapiens
gtagaacactaattc

SEQ ID NO: 957842 - DNA, 17 bp, Homo sapiens
gtagaacactaattcat

SEQ ID NO: 957843 - DNA, 16 bp, Homo sapiens
gtagaactcactctgg

SEQ ID NO: 957844 - DNA, 17 bp, Homo sapiens
gtagaactcactctggg

SEQ ID NO: 957845 - DNA, 18 bp, Homo sapiens
gtagaactcactctgggc

SEQ ID NO: 957846 - DNA, 22 bp, Homo sapiens
gtagaactcttaaatacttttt

SEQ ID NO: 957847 - DNA, 22 bp, Homo sapiens
gtagaagctcttggacaacagc

SEQ ID NO: 957848 - DNA, 19 bp, Homo sapiens
gtagaaggttgacacagtt

SEQ ID NO: 957849 - DNA, 13 bp, Homo sapiens
gtagaagtagttt

SEQ ID NO: 957850 - DNA, 19 bp, Homo sapiens
gtagaagtgagtttgtaaa

SEQ ID NO: 957851 - DNA, 21 bp, Homo sapiens
gtagaagtgagtttgtaaata

SEQ ID NO: 957852 - DNA, 19 bp, Homo sapiens
gtagaagttctagtgtttt

SEQ ID NO: 957853 - DNA, 22 bp, Homo sapiens
gtagaagttctagtgttttcaa

SEQ ID NO: 957854 - DNA, 19 bp, Homo sapiens
gtagaataacctttcagaa

SEQ ID NO: 957855 - DNA, 18 bp, Homo sapiens
gtagaatacgcagaacta

SEQ ID NO: 957856 - DNA, 18 bp, Homo sapiens
gtagaattaccattaatt

SEQ ID NO: 957857 - DNA, 22 bp, Homo sapiens
gtagaattaccattaattacat

SEQ ID NO: 957858 - DNA, 13 bp, Homo sapiens
gtagaattccttc

SEQ ID NO: 957859 - DNA, 23 bp, Homo sapiens
gtagaattccttcgaaaggcctt

SEQ ID NO: 957860 - DNA, 14 bp, Homo sapiens
gtagaattgtatat

SEQ ID NO: 957861 - DNA, 22 bp, Homo sapiens
gtagaatttcaatgtccagtga

SEQ ID NO: 957862 - DNA, 14 bp, Homo sapiens
gtagaccaaaataa

SEQ ID NO: 957863 - DNA, 15 bp, Homo sapiens
gtagaccaaaataaa

SEQ ID NO: 957864 - DNA, 16 bp, Homo sapiens
gtagacctagggagga

SEQ ID NO: 957865 - DNA, 15 bp, Homo sapiens
gtagaccttgagggt

SEQ ID NO: 957866 - DNA, 16 bp, Homo sapiens
gtagaccttgagggtg

SEQ ID NO: 957867 - DNA, 21 bp, Homo sapiens
gtagaccttgagggtgggcca

SEQ ID NO: 957868 - DNA, 22 bp, Homo sapiens
gtagaccttgagggtgggccag

SEQ ID NO: 957869 - DNA, 19 bp, Homo sapiens
gtagaccttgttacttctg

SEQ ID NO: 957870 - DNA, 17 bp, Homo sapiens
gtagactaggtttattt

SEQ ID NO: 957871 - DNA, 23 bp, Homo sapiens
gtagacttggacccaaaaaatca

SEQ ID NO: 957872 - DNA, 22 bp, Homo sapiens
gtagagaatgtcactgtagttt

SEQ ID NO: 957873 - DNA, 15 bp, Homo sapiens
gtagagacccccagg

SEQ ID NO: 957874 - DNA, 22 bp, Homo sapiens
gtagagacggggtttcaccatg

SEQ ID NO: 957875 - DNA, 14 bp, Homo sapiens
gtagagagccgggc

SEQ ID NO: 957876 - DNA, 17 bp, Homo sapiens
gtagagaggggactggg

SEQ ID NO: 957877 - DNA, 18 bp, Homo sapiens
gtagagatttttatgtgt

SEQ ID NO: 957878 - DNA, 17 bp, Homo sapiens
gtagagcaaaggagaca

SEQ ID NO: 957879 - DNA, 15 bp, Homo sapiens
gtagagccaggtgct

SEQ ID NO: 957880 - DNA, 21 bp, Homo sapiens
gtagagtagggtagaaggaaa

SEQ ID NO: 957881 - DNA, 23 bp, Homo sapiens
gtagagtcatctccatcagctgt

SEQ ID NO: 957882 - DNA, 14 bp, Homo sapiens
gtagagtcattcat

SEQ ID NO: 957883 - DNA, 15 bp, Homo sapiens
gtagagtgggagctg

SEQ ID NO: 957884 - DNA, 15 bp, Homo sapiens
gtagagtgtgcctga

SEQ ID NO: 957885 - DNA, 15 bp, Homo sapiens
gtagagttgctgaga

SEQ ID NO: 957886 - DNA, 16 bp, Homo sapiens
gtagatacttcctgcc

SEQ ID NO: 957887 - DNA, 23 bp, Homo sapiens
gtagatagttaaaagactgcagc

SEQ ID NO: 957888 - DNA, 16 bp, Homo sapiens
gtagatattgttttct

SEQ ID NO: 957889 - DNA, 19 bp, Homo sapiens
gtagatattttttctgaat

SEQ ID NO: 957890 - DNA, 13 bp, Homo sapiens
gtagatccagatc

SEQ ID NO: 957891 - DNA, 16 bp, Homo sapiens
gtagatgaacctgcag

SEQ ID NO: 957892 - DNA, 14 bp, Homo sapiens
gtagatgaacttga

SEQ ID NO: 957893 - DNA, 20 bp, Homo sapiens
gtagatgatttctagcaggc

SEQ ID NO: 957894 - DNA, 19 bp, Homo sapiens
gtagatgcatgacttgtgt

SEQ ID NO: 957895 - DNA, 17 bp, Homo sapiens
gtagatggagtttcact

SEQ ID NO: 957896 - DNA, 22 bp, Homo sapiens
gtagatggagtttcacttttgt

SEQ ID NO: 957897 - DNA, 21 bp, Homo sapiens
gtagatgggagggaggctcag

SEQ ID NO: 957898 - DNA, 21 bp, Homo sapiens
gtagatgtgcatttttgtgaa

SEQ ID NO: 957899 - DNA, 18 bp, Homo sapiens
gtagattcaggtaataca

SEQ ID NO: 957900 - DNA, 13 bp, Homo sapiens
gtagattctgtgg

SEQ ID NO: 957901 - DNA, 16 bp, Homo sapiens
gtagattctgtggaac

SEQ ID NO: 957902 - DNA, 15 bp, Homo sapiens
gtagattgattgtat

SEQ ID NO: 957903 - DNA, 16 bp, Homo sapiens
gtagattgcttctgta

SEQ ID NO: 957904 - DNA, 12 bp, Homo sapiens
gtagatttattt

SEQ ID NO: 957905 - DNA, 18 bp, Homo sapiens
gtagatttccttttttct

SEQ ID NO: 957906 - DNA, 14 bp, Homo sapiens
gtagattttccaaa

SEQ ID NO: 957907 - DNA, 18 bp, Homo sapiens
gtagatttttaacaaaaa

SEQ ID NO: 957908 - DNA, 20 bp, Homo sapiens
gtagcaagatgcaaatgcat

SEQ ID NO: 957909 - DNA, 15 bp, Homo sapiens
gtagcaatggccaga

SEQ ID NO: 957910 - DNA, 22 bp, Homo sapiens
gtaggttccccagagagcaggc

SEQ ID NO: 957911 - DNA, 21 bp, Homo sapiens
gtaggttccgtatctccctgg

SEQ ID NO: 957912 - DNA, 14 bp, Homo sapiens
gtagtaaaagtggt

SEQ ID NO: 957913 - DNA, 23 bp, Homo sapiens
gtagtaaaagtggtctctgctgg

SEQ ID NO: 957914 - DNA, 14 bp, Homo sapiens
gtagtaacactaat

SEQ ID NO: 957915 - DNA, 21 bp, Homo sapiens
gtagtagccctttctgtgtgc

SEQ ID NO: 957916 - DNA, 22 bp, Homo sapiens
gtagtagtctcattacttttga

SEQ ID NO: 957917 - DNA, 13 bp, Homo sapiens
gtagtatttttta

SEQ ID NO: 957918 - DNA, 15 bp, Homo sapiens
gtagtattttttgta

SEQ ID NO: 957919 - DNA, 23 bp, Homo sapiens
gtagtcccctgttgattatcttc

SEQ ID NO: 957920 - DNA, 17 bp, Homo sapiens
gtagtcctggcagctgg

SEQ ID NO: 957921 - DNA, 14 bp, Homo sapiens
gtagtccttggcat

SEQ ID NO: 957922 - DNA, 18 bp, Homo sapiens
gtagtctcattacttttg

SEQ ID NO: 957923 - DNA, 12 bp, Homo sapiens
gtagtctcctgg

SEQ ID NO: 957924 - DNA, 13 bp, Homo sapiens
gtagtctcctggg

SEQ ID NO: 957925 - DNA, 14 bp, Homo sapiens
gtagtctgagtaat

SEQ ID NO: 957926 - DNA, 14 bp, Homo sapiens
gtagtgagatagca

SEQ ID NO: 957927 - DNA, 16 bp, Homo sapiens
gtagtgattaaatata

SEQ ID NO: 957928 - DNA, 15 bp, Homo sapiens
gtagtgcaaaatggt

SEQ ID NO: 957929 - DNA, 15 bp, Homo sapiens
gtagtgtagctgtgt

SEQ ID NO: 957930 - DNA, 19 bp, Homo sapiens
gtagtgtctggatcagtaa

SEQ ID NO: 957931 - DNA, 12 bp, Homo sapiens
gtagtgtggcct

SEQ ID NO: 957932 - DNA, 14 bp, Homo sapiens
gtagtgtggcctgt

SEQ ID NO: 957933 - DNA, 16 bp, Homo sapiens
gtagtgtggcctgtgc

SEQ ID NO: 957934 - DNA, 20 bp, Homo sapiens
gtagttacattaatgcccag

SEQ ID NO: 957935 - DNA, 16 bp, Homo sapiens
gtagttaggaaataaa

SEQ ID NO: 957936 - DNA, 20 bp, Homo sapiens
gtagttaggaaataaaacct

SEQ ID NO: 957937 - DNA, 22 bp, Homo sapiens
gtagttaggaaataaaaccttt

SEQ ID NO: 957938 - DNA, 20 bp, Homo sapiens
gtagttccctgaaaacccag

SEQ ID NO: 957939 - DNA, 15 bp, Homo sapiens
gtagttcctgctaca

SEQ ID NO: 957940 - DNA, 22 bp, Homo sapiens
gtagttgacaattctgcatgta

SEQ ID NO: 957941 - DNA, 15 bp, Homo sapiens
gtagttggtttgtat

SEQ ID NO: 957942 - DNA, 16 bp, Homo sapiens
gtagttttcaaaacac

SEQ ID NO: 957943 - DNA, 20 bp, Homo sapiens
gtagttttccctgcactgtg

SEQ ID NO: 957944 - DNA, 18 bp, Homo sapiens
gtagtttttaattaaaaa

SEQ ID NO: 957945 - DNA, 22 bp, Homo sapiens
gtagtttttacagctgtgttat

SEQ ID NO: 957946 - DNA, 13 bp, Homo sapiens
gtagttttttcat

SEQ ID NO: 957947 - DNA, 12 bp, Homo sapiens
gtataaaaacaa

SEQ ID NO: 957948 - DNA, 15 bp, Homo sapiens
gtataaaaaggaaat

SEQ ID NO: 957949 - DNA, 17 bp, Homo sapiens
gtataaaaaggaaatta

SEQ ID NO: 957950 - DNA, 15 bp, Homo sapiens
gtataaaactttcct

SEQ ID NO: 957951 - DNA, 19 bp, Homo sapiens
gtataaaatccatagattt

SEQ ID NO: 957952 - DNA, 19 bp, Homo sapiens
gtataaaatggtgttttca

SEQ ID NO: 957953 - DNA, 14 bp, Homo sapiens
gtataaacaaagtt

SEQ ID NO: 957954 - DNA, 20 bp, Homo sapiens
gtataaacatgaccctgggc

SEQ ID NO: 957955 - DNA, 13 bp, Homo sapiens
gtataaactatca

SEQ ID NO: 957956 - DNA, 12 bp, Homo sapiens
gtataaagaaca

SEQ ID NO: 957957 - DNA, 13 bp, Homo sapiens
gtataaagattgt

SEQ ID NO: 957958 - DNA, 18 bp, Homo sapiens
gtataaagcaactgttat

SEQ ID NO: 957959 - DNA, 19 bp, Homo sapiens
gtataaataagagcatgat

SEQ ID NO: 957960 - DNA, 17 bp, Homo sapiens
gtataaatatcagtatt

SEQ ID NO: 957961 - DNA, 12 bp, Homo sapiens
gtataaatggtt

SEQ ID NO: 957962 - DNA, 14 bp, Homo sapiens
gtataaatgtacat

SEQ ID NO: 957963 - DNA, 22 bp, Homo sapiens
gtataaattgtctttaaaaact

SEQ ID NO: 957964 - DNA, 20 bp, Homo sapiens
gtataacacaatatgaatac

SEQ ID NO: 957965 - DNA, 19 bp, Homo sapiens
gtataagtggaggcacttt

SEQ ID NO: 957966 - DNA, 13 bp, Homo sapiens
gtataatactttg

SEQ ID NO: 957967 - DNA, 13 bp, Homo sapiens
gtataatagagat

SEQ ID NO: 957968 - DNA, 13 bp, Homo sapiens
gtataatattgaa

SEQ ID NO: 957969 - DNA, 15 bp, Homo sapiens
gtataatatttctta

SEQ ID NO: 957970 - DNA, 16 bp, Homo sapiens
gtataatatttcttaa

SEQ ID NO: 957971 - DNA, 14 bp, Homo sapiens
tggcacctgtttcc

SEQ ID NO: 957972 - DNA, 23 bp, Homo sapiens
tggcacgcacctgtagtcccagc

SEQ ID NO: 957973 - DNA, 19 bp, Homo sapiens
tggcacggagagaaggccc

SEQ ID NO: 957974 - DNA, 16 bp, Homo sapiens
tggcacgggccctccc

SEQ ID NO: 957975 - DNA, 16 bp, Homo sapiens
tggcacgtattgctgt

SEQ ID NO: 957976 - DNA, 17 bp, Homo sapiens
tggcacgtattgctgtg

SEQ ID NO: 957977 - DNA, 18 bp, Homo sapiens
tggcactaaaccacttct

SEQ ID NO: 957978 - DNA, 20 bp, Homo sapiens
tggcactaaaccacttctct

SEQ ID NO: 957979 - DNA, 22 bp, Homo sapiens
tggcactaaaccacttctctgc

SEQ ID NO: 957980 - DNA, 23 bp, Homo sapiens
tggcactcaactctgagcccata

SEQ ID NO: 957981 - DNA, 18 bp, Homo sapiens
tggcactcacagacctgg

SEQ ID NO: 957982 - DNA, 12 bp, Homo sapiens
tggcactgaagt

SEQ ID NO: 957983 - DNA, 19 bp, Homo sapiens
tggcactgactgggcatag

SEQ ID NO: 957984 - DNA, 22 bp, Homo sapiens
tggcactgagatatttattgtt

SEQ ID NO: 957985 - DNA, 13 bp, Homo sapiens
tggcactgagccc

SEQ ID NO: 957986 - DNA, 17 bp, Homo sapiens
tggcactgggaggcagg

SEQ ID NO: 957987 - DNA, 22 bp, Homo sapiens
tggcactggtaggttgggacac

SEQ ID NO: 957988 - DNA, 13 bp, Homo sapiens
tggcacttaagtg

SEQ ID NO: 957989 - DNA, 16 bp, Homo sapiens
tggcacttaagtgcac

SEQ ID NO: 957990 - DNA, 20 bp, Homo sapiens
tggcacttaagtgcactttt

SEQ ID NO: 957991 - DNA, 15 bp, Homo sapiens
tggcacttgtattta

SEQ ID NO: 957992 - DNA, 16 bp, Homo sapiens
tggcactttgaagggg

SEQ ID NO: 957993 - DNA, 20 bp, Homo sapiens
tggcactttgttttcaagat

SEQ ID NO: 957994 - DNA, 12 bp, Homo sapiens
tggcagaaaaga

SEQ ID NO: 957995 - DNA, 22 bp, Homo sapiens
tggcagaaaagaggagaccctg

SEQ ID NO: 957996 - DNA, 18 bp, Homo sapiens
tggcagaaacaggaggct

SEQ ID NO: 957997 - DNA, 21 bp, Homo sapiens
tggcagaaacaggaggctccg

SEQ ID NO: 957998 - DNA, 21 bp, Homo sapiens
tggcagaactgagctcctctg

SEQ ID NO: 957999 - DNA, 19 bp, Homo sapiens
tggcagaagtgtcaccctg

SEQ ID NO: 958000 - DNA, 17 bp, Homo sapiens
tggcagactagagtctg

SEQ ID NO: 958001 - DNA, 19 bp, Homo sapiens
tggcagactcaaggggctg

SEQ ID NO: 958002 - DNA, 17 bp, Homo sapiens
tggcagagaaggcctct

SEQ ID NO: 958003 - DNA, 18 bp, Homo sapiens
tggcagagaaggcctctt

SEQ ID NO: 958004 - DNA, 23 bp, Homo sapiens
tggcagagaaggcctcttgtgct

SEQ ID NO: 958005 - DNA, 14 bp, Homo sapiens
tggcagagcacagc

SEQ ID NO: 958006 - DNA, 18 bp, Homo sapiens
tggcagagcacagcccac

SEQ ID NO: 958007 - DNA, 11 bp, Homo sapiens
tggcagagcca

SEQ ID NO: 958008 - DNA, 20 bp, Homo sapiens
tggcagagcttttgcatttc

SEQ ID NO: 958009 - DNA, 15 bp, Homo sapiens
tggcagaggtgcaag

SEQ ID NO: 958010 - DNA, 19 bp, Homo sapiens
tggcagagttacagttctg

SEQ ID NO: 958011 - DNA, 16 bp, Homo sapiens
tggcagagttgtaaat

SEQ ID NO: 958012 - DNA, 21 bp, Homo sapiens
tggcagataatcagcctctta

SEQ ID NO: 958013 - DNA, 20 bp, Homo sapiens
tggcagatgtcttccctggg

SEQ ID NO: 958014 - DNA, 22 bp, Homo sapiens
tggcagatgtcttccctgggct

SEQ ID NO: 958015 - DNA, 15 bp, Homo sapiens
tggcagattttacaa

SEQ ID NO: 958016 - DNA, 20 bp, Homo sapiens
tggcagattttacaaaagat

SEQ ID NO: 958017 - DNA, 15 bp, Homo sapiens
tggcagcacagccca

SEQ ID NO: 958018 - DNA, 16 bp, Homo sapiens
tggcagcacagcccag

SEQ ID NO: 958019 - DNA, 18 bp, Homo sapiens
tggcagcacagcccaggg

SEQ ID NO: 958020 - DNA, 22 bp, Homo sapiens
tggcagcacagcccagggcctg

SEQ ID NO: 958021 - DNA, 22 bp, Homo sapiens
tggcagcacgcaggcggggcag

SEQ ID NO: 958022 - DNA, 18 bp, Homo sapiens
tggcagcattcccaccaa

SEQ ID NO: 958023 - DNA, 14 bp, Homo sapiens
tggcagccaaggaa

SEQ ID NO: 958024 - DNA, 15 bp, Homo sapiens
tggcagccaaggaat

SEQ ID NO: 958025 - DNA, 16 bp, Homo sapiens
tggcagccacacgcag

SEQ ID NO: 958026 - DNA, 22 bp, Homo sapiens
tggcagccacacgcaggcggcc

SEQ ID NO: 958027 - DNA, 13 bp, Homo sapiens
tggcagccatgcc

SEQ ID NO: 958028 - DNA, 14 bp, Homo sapiens
tggcagccatgcct

SEQ ID NO: 958029 - DNA, 18 bp, Homo sapiens
tggcagccatgcctcatg

SEQ ID NO: 958030 - DNA, 11 bp, Homo sapiens
tggcagcccag

SEQ ID NO: 958031 - DNA, 14 bp, Homo sapiens
tggcagcccggctg

SEQ ID NO: 958032 - DNA, 14 bp, Homo sapiens
tggccaccaggctg

SEQ ID NO: 958033 - DNA, 15 bp, Homo sapiens
tggccaccaggctgg

SEQ ID NO: 958034 - DNA, 18 bp, Homo sapiens
tggccaccaggctggcgc

SEQ ID NO: 958035 - DNA, 22 bp, Homo sapiens
tggccaccaggctggcgcagcc

SEQ ID NO: 958036 - DNA, 14 bp, Homo sapiens
tggccacccctccc

SEQ ID NO: 958037 - DNA, 22 bp, Homo sapiens
tggccacccgttctgctggcct

SEQ ID NO: 958038 - DNA, 14 bp, Homo sapiens
tggccaccctggcc

SEQ ID NO: 958039 - DNA, 20 bp, Homo sapiens
tggccacccttggcctgtcc

SEQ ID NO: 958040 - DNA, 15 bp, Homo sapiens
tggccacctctctcc

SEQ ID NO: 958041 - DNA, 20 bp, Homo sapiens
tggccacctctctcctttgc

SEQ ID NO: 958042 - DNA, 17 bp, Homo sapiens
tggccacctgaggtggg

SEQ ID NO: 958043 - DNA, 20 bp, Homo sapiens
tggccacctgaggtgggccc

SEQ ID NO: 958044 - DNA, 18 bp, Homo sapiens
tggccaccttgcttgagg

SEQ ID NO: 958045 - DNA, 13 bp, Homo sapiens
tggccacgaggtt

SEQ ID NO: 958046 - DNA, 14 bp, Homo sapiens
tggccacgggggca

SEQ ID NO: 958047 - DNA, 18 bp, Homo sapiens
tggccacgggggcagtgt

SEQ ID NO: 958048 - DNA, 19 bp, Homo sapiens
tggccacgggggcagtgtg

SEQ ID NO: 958049 - DNA, 21 bp, Homo sapiens
tggccacgttcagggaggggc

SEQ ID NO: 958050 - DNA, 18 bp, Homo sapiens
tggccactaaagcttcag

SEQ ID NO: 958051 - DNA, 12 bp, Homo sapiens
tggccactaagc

SEQ ID NO: 958052 - DNA, 20 bp, Homo sapiens
tggccactgggtctcactcc

SEQ ID NO: 958053 - DNA, 15 bp, Homo sapiens
tggccactgtcaagg

SEQ ID NO: 958054 - DNA, 17 bp, Homo sapiens
tggccactgtccctgtc

SEQ ID NO: 958055 - DNA, 19 bp, Homo sapiens
tggccactgtccctgtcct

SEQ ID NO: 958056 - DNA, 20 bp, Homo sapiens
tggccacttcattccagcag

SEQ ID NO: 958057 - DNA, 22 bp, Homo sapiens
tggccacttcattccagcagct

SEQ ID NO: 958058 - DNA, 21 bp, Homo sapiens
tggccacttgggtcttccctg

SEQ ID NO: 958059 - DNA, 20 bp, Homo sapiens
tggccagaagggggccatga

SEQ ID NO: 958060 - DNA, 13 bp, Homo sapiens
tggccagagagcc

SEQ ID NO: 958061 - DNA, 18 bp, Homo sapiens
tggccagagagggcccag

SEQ ID NO: 958062 - DNA, 20 bp, Homo sapiens
tggccagagagggcccagct

SEQ ID NO: 958063 - DNA, 21 bp, Homo sapiens
tggccagagctggaaggcagg

SEQ ID NO: 958064 - DNA, 17 bp, Homo sapiens
tggccagagtcttggac

SEQ ID NO: 958065 - DNA, 22 bp, Homo sapiens
tggccagatgcggggacaggct

SEQ ID NO: 958066 - DNA, 18 bp, Homo sapiens
tggccagattgtggggtg

SEQ ID NO: 958067 - DNA, 19 bp, Homo sapiens
tggccagcaaggcaggttg

SEQ ID NO: 958068 - DNA, 19 bp, Homo sapiens
tggccagcacaccaagtgg

SEQ ID NO: 958069 - DNA, 21 bp, Homo sapiens
tggccagcacaccaagtggct

SEQ ID NO: 958070 - DNA, 22 bp, Homo sapiens
tggccagcacaccaagtggctg

SEQ ID NO: 958071 - DNA, 23 bp, Homo sapiens
tggccagcacaccaagtggctgg

SEQ ID NO: 958072 - DNA, 20 bp, Homo sapiens
tggccagcaccctctcctgg

SEQ ID NO: 958073 - DNA, 21 bp, Homo sapiens
tggccagcaccctctcctggg

SEQ ID NO: 958074 - DNA, 16 bp, Homo sapiens
tggccagccagtgcca

SEQ ID NO: 958075 - DNA, 17 bp, Homo sapiens
tggccagcccctggggc

SEQ ID NO: 958076 - DNA, 21 bp, Homo sapiens
tggccagcccctggggcccag

SEQ ID NO: 958077 - DNA, 15 bp, Homo sapiens
tggccagcgccaggg

SEQ ID NO: 958078 - DNA, 23 bp, Homo sapiens
tggccaggagctcttcaggcctc

SEQ ID NO: 958079 - DNA, 11 bp, Homo sapiens
tggccaggagg

SEQ ID NO: 958080 - DNA, 22 bp, Homo sapiens
tggccaggaggttggtgactga

SEQ ID NO: 958081 - DNA, 12 bp, Homo sapiens
tggccaggatgg

SEQ ID NO: 958082 - DNA, 20 bp, Homo sapiens
tggccaggcaccccctggag

SEQ ID NO: 958083 - DNA, 21 bp, Homo sapiens
tggccaggcaccccctggaga

SEQ ID NO: 958084 - DNA, 12 bp, Homo sapiens
tggccaggcaga

SEQ ID NO: 958085 - DNA, 16 bp, Homo sapiens
tggccaggcagatctg

SEQ ID NO: 958086 - DNA, 19 bp, Homo sapiens
tggccaggcagatctgtgc

SEQ ID NO: 958087 - DNA, 20 bp, Homo sapiens
tggccaggcagatctgtgcc

SEQ ID NO: 958088 - DNA, 23 bp, Homo sapiens
tggccaggccttacatctggctg

SEQ ID NO: 958089 - DNA, 13 bp, Homo sapiens
tggccaggctggt

SEQ ID NO: 958090 - DNA, 13 bp, Homo sapiens
tggccaggctgtt

SEQ ID NO: 958091 - DNA, 15 bp, Homo sapiens
tggccaggctgttct

SEQ ID NO: 958092 - DNA, 20 bp, Homo sapiens
tggccaggctgttctcgaac

SEQ ID NO: 958093 - DNA, 11 bp, Homo sapiens
tggccagggag

SEQ ID NO: 958094 - DNA, 12 bp, Homo sapiens
tggccagggagg

SEQ ID NO: 958095 - DNA, 13 bp, Homo sapiens
tggccagggaggc

SEQ ID NO: 958096 - DNA, 16 bp, Homo sapiens
tggccagggaggcgca

SEQ ID NO: 958097 - DNA, 22 bp, Homo sapiens
tggccagggccacgctccagct

SEQ ID NO: 958098 - DNA, 12 bp, Homo sapiens
tggccagggctt

SEQ ID NO: 958099 - DNA, 11 bp, Homo sapiens
tggccaggtgg

SEQ ID NO: 958100 - DNA, 17 bp, Homo sapiens
gtatctagtgcagctga

SEQ ID NO: 958101 - DNA, 20 bp, Homo sapiens
gtatctatatatgtgtatgt

SEQ ID NO: 958102 - DNA, 22 bp, Homo sapiens
gtatctatgcaaagcactctct

SEQ ID NO: 958103 - DNA, 14 bp, Homo sapiens
gtatctatttgtac

SEQ ID NO: 958104 - DNA, 17 bp, Homo sapiens
gtatctatttgtacaat

SEQ ID NO: 958105 - DNA, 19 bp, Homo sapiens
gtatctatttgtacaattt

SEQ ID NO: 958106 - DNA, 14 bp, Homo sapiens
gtatctcagaaagt

SEQ ID NO: 958107 - DNA, 21 bp, Homo sapiens
gtatctcagaaagtgcctgac

SEQ ID NO: 958108 - DNA, 21 bp, Homo sapiens
gtatctcaggaagtccagcca

SEQ ID NO: 958109 - DNA, 16 bp, Homo sapiens
gtatctcatactgtct

SEQ ID NO: 958110 - DNA, 13 bp, Homo sapiens
gtatctccaggat

SEQ ID NO: 958111 - DNA, 20 bp, Homo sapiens
gtatctctgaagcatgtttc

SEQ ID NO: 958112 - DNA, 15 bp, Homo sapiens
gtatctctggcacca

SEQ ID NO: 958113 - DNA, 20 bp, Homo sapiens
gtatctgagttgccaagaca

SEQ ID NO: 958114 - DNA, 22 bp, Homo sapiens
gtatctgagttgccaagacaaa

SEQ ID NO: 958115 - DNA, 19 bp, Homo sapiens
gtatctgcaggcagacacg

SEQ ID NO: 958116 - DNA, 18 bp, Homo sapiens
gtatctgtaacccttgaa

SEQ ID NO: 958117 - DNA, 16 bp, Homo sapiens
gtatctgtatctctct

SEQ ID NO: 958118 - DNA, 13 bp, Homo sapiens
gtatctgtctttc

SEQ ID NO: 958119 - DNA, 20 bp, Homo sapiens
gtatctgtctttccactctg

SEQ ID NO: 958120 - DNA, 14 bp, Homo sapiens
gtatcttagagttt

SEQ ID NO: 958121 - DNA, 17 bp, Homo sapiens
gtatcttattataaaat

SEQ ID NO: 958122 - DNA, 14 bp, Homo sapiens
gtatcttctatttt

SEQ ID NO: 958123 - DNA, 18 bp, Homo sapiens
gtatcttggggcaagact

SEQ ID NO: 958124 - DNA, 23 bp, Homo sapiens
gtatcttgggtgtattctctgta

SEQ ID NO: 958125 - DNA, 23 bp, Homo sapiens
gtatcttgtttttccactactgc

SEQ ID NO: 958126 - DNA, 14 bp, Homo sapiens
gtatctttaacaat

SEQ ID NO: 958127 - DNA, 16 bp, Homo sapiens
gtatctttatgctgta

SEQ ID NO: 958128 - DNA, 21 bp, Homo sapiens
gtatgaaaatccttttaacca

SEQ ID NO: 958129 - DNA, 23 bp, Homo sapiens
gtatgaaagatggctgtgcctct

SEQ ID NO: 958130 - DNA, 19 bp, Homo sapiens
gtatgaataatgaaaataa

SEQ ID NO: 958131 - DNA, 20 bp, Homo sapiens
gtatgaatctatgccaaaga

SEQ ID NO: 958132 - DNA, 14 bp, Homo sapiens
gtatgaattattca

SEQ ID NO: 958133 - DNA, 18 bp, Homo sapiens
gtatgactaaagagagaa

SEQ ID NO: 958134 - DNA, 13 bp, Homo sapiens
gtatgaggcattt

SEQ ID NO: 958135 - DNA, 17 bp, Homo sapiens
gtatgaggcatttgttt

SEQ ID NO: 958136 - DNA, 12 bp, Homo sapiens
gtatgaggtcct

SEQ ID NO: 958137 - DNA, 20 bp, Homo sapiens
gtatgaggtcctcaggtcag

SEQ ID NO: 958138 - DNA, 21 bp, Homo sapiens
gtatgagtcaatgtgcagtgt

SEQ ID NO: 958139 - DNA, 15 bp, Homo sapiens
gtatgatgaaaataa

SEQ ID NO: 958140 - DNA, 20 bp, Homo sapiens
gtatgatgaaaataattttc

SEQ ID NO: 958141 - DNA, 18 bp, Homo sapiens
gtatgatttgttttgaat

SEQ ID NO: 958142 - DNA, 21 bp, Homo sapiens
gtatgatttgttttgaatttt

SEQ ID NO: 958143 - DNA, 22 bp, Homo sapiens
gtatgatttgttttgaattttg

SEQ ID NO: 958144 - DNA, 23 bp, Homo sapiens
gtatgcagggagcactgttcaca

SEQ ID NO: 958145 - DNA, 19 bp, Homo sapiens
gtatgcagtgtagatttta

SEQ ID NO: 958146 - DNA, 17 bp, Homo sapiens
gtatgcagttgataaga

SEQ ID NO: 958147 - DNA, 17 bp, Homo sapiens
gtatgcatcagataaca

SEQ ID NO: 958148 - DNA, 16 bp, Homo sapiens
gtatgcatgtgaagaa

SEQ ID NO: 958149 - DNA, 17 bp, Homo sapiens
gtatgcattattaaatt

SEQ ID NO: 958150 - DNA, 14 bp, Homo sapiens
gtatgccttaagca

SEQ ID NO: 958151 - DNA, 16 bp, Homo sapiens
gtatgctgaatttcta

SEQ ID NO: 958152 - DNA, 12 bp, Homo sapiens
gtatgctgcttt

SEQ ID NO: 958153 - DNA, 16 bp, Homo sapiens
gtattgttagatgttt

SEQ ID NO: 958154 - DNA, 11 bp, Homo sapiens
gtattgttccc

SEQ ID NO: 958155 - DNA, 18 bp, Homo sapiens
gtattgttcccagtgaca

SEQ ID NO: 958156 - DNA, 9 bp, Homo sapiens
gtatttaac

SEQ ID NO: 958157 - DNA, 20 bp, Homo sapiens
gtatttaacaaaaagtgctt

SEQ ID NO: 958158 - DNA, 20 bp, Homo sapiens
gtatttaacagaaattgtat

SEQ ID NO: 958159 - DNA, 22 bp, Homo sapiens
gtatttaactacatctgcctcg

SEQ ID NO: 958160 - DNA, 19 bp, Homo sapiens
gtatttaagactgataatt

SEQ ID NO: 958161 - DNA, 13 bp, Homo sapiens
gtatttaatcgca

SEQ ID NO: 958162 - DNA, 15 bp, Homo sapiens
gtatttaccaaaaat

SEQ ID NO: 958163 - DNA, 19 bp, Homo sapiens
gtatttagactgtggccat

SEQ ID NO: 958164 - DNA, 16 bp, Homo sapiens
gtatttagccattacc

SEQ ID NO: 958165 - DNA, 20 bp, Homo sapiens
gtatttataaaaatataaat

SEQ ID NO: 958166 - DNA, 13 bp, Homo sapiens
gtatttatatatt

SEQ ID NO: 958167 - DNA, 16 bp, Homo sapiens
gtatttatatatttat

SEQ ID NO: 958168 - DNA, 17 bp, Homo sapiens
gtatttatatatttata

SEQ ID NO: 958169 - DNA, 15 bp, Homo sapiens
gtatttatatttgga

SEQ ID NO: 958170 - DNA, 16 bp, Homo sapiens
gtatttatatttggaa

SEQ ID NO: 958171 - DNA, 19 bp, Homo sapiens
gtatttatatttggaaaga

SEQ ID NO: 958172 - DNA, 21 bp, Homo sapiens
gtatttatatttggaaagaga

SEQ ID NO: 958173 - DNA, 23 bp, Homo sapiens
gtatttatatttggaaagagacc

SEQ ID NO: 958174 - DNA, 18 bp, Homo sapiens
gtatttatgtaatttgta

SEQ ID NO: 958175 - DNA, 19 bp, Homo sapiens
gtatttatgtaatttgtac

SEQ ID NO: 958176 - DNA, 20 bp, Homo sapiens
gtatttatgtaatttgtaca

SEQ ID NO: 958177 - DNA, 22 bp, Homo sapiens
gtatttattttcctccccagca

SEQ ID NO: 958178 - DNA, 22 bp, Homo sapiens
gtatttcagggacctcaggggc

SEQ ID NO: 958179 - DNA, 16 bp, Homo sapiens
gtatttcatgtggctg

SEQ ID NO: 958180 - DNA, 16 bp, Homo sapiens
gtatttccagtgcaat

SEQ ID NO: 958181 - DNA, 12 bp, Homo sapiens
gtatttcccagc

SEQ ID NO: 958182 - DNA, 12 bp, Homo sapiens
gtatttcccctg

SEQ ID NO: 958183 - DNA, 11 bp, Homo sapiens
gtatttccctt

SEQ ID NO: 958184 - DNA, 20 bp, Homo sapiens
gtatttccttccactgtagc

SEQ ID NO: 958185 - DNA, 17 bp, Homo sapiens
gtatttcgaaactgcca

SEQ ID NO: 958186 - DNA, 10 bp, Homo sapiens
gtatttctaa

SEQ ID NO: 958187 - DNA, 11 bp, Homo sapiens
gtatttctcag

SEQ ID NO: 958188 - DNA, 14 bp, Homo sapiens
gtatttctcaggaa

SEQ ID NO: 958189 - DNA, 13 bp, Homo sapiens
gtatttctccaga

SEQ ID NO: 958190 - DNA, 19 bp, Homo sapiens
gtatttctttgtagaataa

SEQ ID NO: 958191 - DNA, 21 bp, Homo sapiens
gtatttctttgtagaataaat

SEQ ID NO: 958192 - DNA, 19 bp, Homo sapiens
gtatttgaaaattttactt

SEQ ID NO: 958193 - DNA, 18 bp, Homo sapiens
gtatttgattcaaaatat

SEQ ID NO: 958194 - DNA, 14 bp, Homo sapiens
gtatttgatttcct

SEQ ID NO: 958195 - DNA, 11 bp, Homo sapiens
gtatttgctaa

SEQ ID NO: 958196 - DNA, 12 bp, Homo sapiens
gtatttgctaat

SEQ ID NO: 958197 - DNA, 19 bp, Homo sapiens
gtatttgctgccagacact

SEQ ID NO: 958198 - DNA, 15 bp, Homo sapiens
gtatttgctgtattg

SEQ ID NO: 958199 - DNA, 12 bp, Homo sapiens
gtatttgctgtt

SEQ ID NO: 958200 - DNA, 13 bp, Homo sapiens
gtatttgctgttg

SEQ ID NO: 958201 - DNA, 12 bp, Homo sapiens
gtatttgctttt

SEQ ID NO: 958202 - DNA, 21 bp, Homo sapiens
gtatttggaaataaagtcaga

SEQ ID NO: 958203 - DNA, 21 bp, Homo sapiens
gtatttggtccaaaaaaagga

SEQ ID NO: 958204 - DNA, 21 bp, Homo sapiens
gtatttgtattaataaagcat

SEQ ID NO: 958205 - DNA, 22 bp, Homo sapiens
gtatttgtattaataaagcatt

SEQ ID NO: 958206 - DNA, 15 bp, Homo sapiens
gtatttgtgactttt

SEQ ID NO: 958207 - DNA, 16 bp, Homo sapiens
gtatttgttatttatt

SEQ ID NO: 958208 - DNA, 23 bp, Homo sapiens
gtattttaaaatagcgttcttgt

SEQ ID NO: 958209 - DNA, 21 bp, Homo sapiens
gtattttaagagaaaactgca

SEQ ID NO: 958210 - DNA, 17 bp, Homo sapiens
gtattttcaatagccac

SEQ ID NO: 958211 - DNA, 12 bp, Homo sapiens
gtattttcagtc

SEQ ID NO: 958212 - DNA, 11 bp, Homo sapiens
gtattttcata

SEQ ID NO: 958213 - DNA, 18 bp, Homo sapiens
gtattttcgggattcttt

SEQ ID NO: 958214 - DNA, 14 bp, Homo sapiens
gtattttggagaaa

SEQ ID NO: 958215 - DNA, 17 bp, Homo sapiens
gtattttggagaaatta

SEQ ID NO: 958216 - DNA, 23 bp, Homo sapiens
gtattttgtgtgaccaactgtgt

SEQ ID NO: 958217 - DNA, 18 bp, Homo sapiens
gtattttgttaaagctgg

SEQ ID NO: 958218 - DNA, 18 bp, Homo sapiens
gtatttttaatgggggta

SEQ ID NO: 958219 - DNA, 21 bp, Homo sapiens
gtatttttcaggtaggccctt

SEQ ID NO: 958220 - DNA, 16 bp, Homo sapiens
gtatttttcttgctgt

SEQ ID NO: 958221 - DNA, 19 bp, Homo sapiens
gtatttttgatgtatatat

SEQ ID NO: 958222 - DNA, 20 bp, Homo sapiens
gtattttttaaaacactaaa

SEQ ID NO: 958223 - DNA, 23 bp, Homo sapiens
gtattttttatttacattttata

SEQ ID NO: 958224 - DNA, 21 bp, Homo sapiens
gtattttttcaagttgtaaat

SEQ ID NO: 958225 - DNA, 13 bp, Homo sapiens
gtattttttcctt

SEQ ID NO: 958226 - DNA, 23 bp, Homo sapiens
gtatttttttatcttgggactgg

SEQ ID NO: 958227 - DNA, 23 bp, Homo sapiens
gtattttttttttaaataaaagc

SEQ ID NO: 958228 - DNA, 17 bp, Homo sapiens
gtcaaaaaagaatctgt

SEQ ID NO: 958229 - DNA, 12 bp, Homo sapiens
gtcaaaacactg

SEQ ID NO: 958230 - DNA, 13 bp, Homo sapiens
gtcaaaacagatt

SEQ ID NO: 958231 - DNA, 15 bp, Homo sapiens
tggccaggtggccac

SEQ ID NO: 958232 - DNA, 16 bp, Homo sapiens
tggccagtccaggctg

SEQ ID NO: 958233 - DNA, 15 bp, Homo sapiens
tggccagtcctggtc

SEQ ID NO: 958234 - DNA, 20 bp, Homo sapiens
tggccagtcctggtcctggc

SEQ ID NO: 958235 - DNA, 21 bp, Homo sapiens
tggccagtcctggtcctggct

SEQ ID NO: 958236 - DNA, 22 bp, Homo sapiens
tggccagtcctggtcctggctg

SEQ ID NO: 958237 - DNA, 17 bp, Homo sapiens
tggccagtctgggtctg

SEQ ID NO: 958238 - DNA, 20 bp, Homo sapiens
tggccagtctggtctcgaac

SEQ ID NO: 958239 - DNA, 22 bp, Homo sapiens
tggccagtgagaagctgaggcc

SEQ ID NO: 958240 - DNA, 23 bp, Homo sapiens
tggccagtgagaagctgaggcct

SEQ ID NO: 958241 - DNA, 16 bp, Homo sapiens
tggccagtgctgcttc

SEQ ID NO: 958242 - DNA, 18 bp, Homo sapiens
tggccagtgctgcttctt

SEQ ID NO: 958243 - DNA, 16 bp, Homo sapiens
tggccagtgtgatccc

SEQ ID NO: 958244 - DNA, 19 bp, Homo sapiens
tggccagtgtttaaaactt

SEQ ID NO: 958245 - DNA, 17 bp, Homo sapiens
tggccatagaggcccag

SEQ ID NO: 958246 - DNA, 23 bp, Homo sapiens
tggccatagaggcccaggcacca

SEQ ID NO: 958247 - DNA, 18 bp, Homo sapiens
tggccatatatgctgtat

SEQ ID NO: 958248 - DNA, 20 bp, Homo sapiens
tggccatatatgctgtattt

SEQ ID NO: 958249 - DNA, 23 bp, Homo sapiens
tggccatatatgctgtatttctt

SEQ ID NO: 958250 - DNA, 16 bp, Homo sapiens
tggccatcagggtggg

SEQ ID NO: 958251 - DNA, 13 bp, Homo sapiens
tggccatcccaca

SEQ ID NO: 958252 - DNA, 21 bp, Homo sapiens
tggccatgaatctctgcctct

SEQ ID NO: 958253 - DNA, 15 bp, Homo sapiens
tggccatgcaggagg

SEQ ID NO: 958254 - DNA, 16 bp, Homo sapiens
tggccatgcaggaggt

SEQ ID NO: 958255 - DNA, 18 bp, Homo sapiens
tggccatgcaggaggtgg

SEQ ID NO: 958256 - DNA, 15 bp, Homo sapiens
tggccatgcctcagc

SEQ ID NO: 958257 - DNA, 18 bp, Homo sapiens
tggccatgcctcagccct

SEQ ID NO: 958258 - DNA, 20 bp, Homo sapiens
tggccatgcctcagccctga

SEQ ID NO: 958259 - DNA, 12 bp, Homo sapiens
tggccatgctgt

SEQ ID NO: 958260 - DNA, 24 bp, Homo sapiens
tggccatgctgtccctgcactgtg

SEQ ID NO: 958261 - DNA, 23 bp, Homo sapiens
tggccatggacgaatatgaatgt

SEQ ID NO: 958262 - DNA, 14 bp, Homo sapiens
tggccatggcctct

SEQ ID NO: 958263 - DNA, 17 bp, Homo sapiens
tggccatgttatgctgg

SEQ ID NO: 958264 - DNA, 19 bp, Homo sapiens
tggcccaaaacgtcttatt

SEQ ID NO: 958265 - DNA, 14 bp, Homo sapiens
tggcccaagactgg

SEQ ID NO: 958266 - DNA, 18 bp, Homo sapiens
tggcccaagactgggctg

SEQ ID NO: 958267 - DNA, 16 bp, Homo sapiens
tggcccaagggatggc

SEQ ID NO: 958268 - DNA, 19 bp, Homo sapiens
tggcccaatgcctataaaa

SEQ ID NO: 958269 - DNA, 12 bp, Homo sapiens
tggcccaccccc

SEQ ID NO: 958270 - DNA, 16 bp, Homo sapiens
tggcccaccgtggcac

SEQ ID NO: 958271 - DNA, 14 bp, Homo sapiens
tggcccactgcatc

SEQ ID NO: 958272 - DNA, 17 bp, Homo sapiens
tggcccagaaacaacag

SEQ ID NO: 958273 - DNA, 13 bp, Homo sapiens
tggcccagaaagc

SEQ ID NO: 958274 - DNA, 21 bp, Homo sapiens
tggcccagaaagcctctctct

SEQ ID NO: 958275 - DNA, 19 bp, Homo sapiens
gtcaagtgaaaaaggagga

SEQ ID NO: 958276 - DNA, 16 bp, Homo sapiens
gtcaagttcccaactg

SEQ ID NO: 958277 - DNA, 14 bp, Homo sapiens
gtcaagttgagatt

SEQ ID NO: 958278 - DNA, 15 bp, Homo sapiens
gtcaagttgagattt

SEQ ID NO: 958279 - DNA, 16 bp, Homo sapiens
gtcaataaaagagctg

SEQ ID NO: 958280 - DNA, 20 bp, Homo sapiens
gtcaataaaagagctgtctg

SEQ ID NO: 958281 - DNA, 13 bp, Homo sapiens
gtcaataaacagc

SEQ ID NO: 958282 - DNA, 18 bp, Homo sapiens
gtcaataaacttagagga

SEQ ID NO: 958283 - DNA, 21 bp, Homo sapiens
gtcaataaacttagaggaaaa

SEQ ID NO: 958284 - DNA, 22 bp, Homo sapiens
gtcaataaacttagaggaaaat

SEQ ID NO: 958285 - DNA, 16 bp, Homo sapiens
gtcaataaagcagagc

SEQ ID NO: 958286 - DNA, 19 bp, Homo sapiens
gtcaataaagcagagccaa

SEQ ID NO: 958287 - DNA, 23 bp, Homo sapiens
gtcaataaagcagagccaaggcc

SEQ ID NO: 958288 - DNA, 14 bp, Homo sapiens
gtcaataaatgaca

SEQ ID NO: 958289 - DNA, 13 bp, Homo sapiens
gtcaatatttaaa

SEQ ID NO: 958290 - DNA, 15 bp, Homo sapiens
gtcaatcctgtgggt

SEQ ID NO: 958291 - DNA, 19 bp, Homo sapiens
gtcaatcctgtgggtgaag

SEQ ID NO: 958292 - DNA, 14 bp, Homo sapiens
gtcaatgtgtgcac

SEQ ID NO: 958293 - DNA, 20 bp, Homo sapiens
gtcaattaccagaaagataa

SEQ ID NO: 958294 - DNA, 23 bp, Homo sapiens
gtcaattctgatgttactgagat

SEQ ID NO: 958295 - DNA, 22 bp, Homo sapiens
gtcaatttccctgactcctcta

SEQ ID NO: 958296 - DNA, 14 bp, Homo sapiens
gtcacaaactgatc

SEQ ID NO: 958297 - DNA, 14 bp, Homo sapiens
gtcacaacagagtg

SEQ ID NO: 958298 - DNA, 14 bp, Homo sapiens
gtcacaaccaagaa

SEQ ID NO: 958299 - DNA, 15 bp, Homo sapiens
gtcacaacctctctg

SEQ ID NO: 958300 - DNA, 15 bp, Homo sapiens
gtcacaataaagttt

SEQ ID NO: 958301 - DNA, 16 bp, Homo sapiens
gtcacaataaagttta

SEQ ID NO: 958302 - DNA, 13 bp, Homo sapiens
gtcacaataaatg

SEQ ID NO: 958303 - DNA, 19 bp, Homo sapiens
gtcacaataaatggccagt

SEQ ID NO: 958304 - DNA, 21 bp, Homo sapiens
gtcacaataaatggccagtgc

SEQ ID NO: 958305 - DNA, 23 bp, Homo sapiens
gtcacaataaatggccagtgctg

SEQ ID NO: 958306 - DNA, 13 bp, Homo sapiens
gtcacacactgat

SEQ ID NO: 958307 - DNA, 13 bp, Homo sapiens
gtcacacactgga

SEQ ID NO: 958308 - DNA, 15 bp, Homo sapiens
gtcacacactggacc

SEQ ID NO: 958309 - DNA, 20 bp, Homo sapiens
gtcacacagtgttggaggtt

SEQ ID NO: 958310 - DNA, 22 bp, Homo sapiens
gtcacactctacacggactgag

SEQ ID NO: 958311 - DNA, 13 bp, Homo sapiens
gtcacactggtgc

SEQ ID NO: 958312 - DNA, 14 bp, Homo sapiens
gtcacactggtgct

SEQ ID NO: 958313 - DNA, 11 bp, Homo sapiens
gtcacagctgc

SEQ ID NO: 958314 - DNA, 16 bp, Homo sapiens
gtcacagctgcagctg

SEQ ID NO: 958315 - DNA, 16 bp, Homo sapiens
gtcacaggctgggtca

SEQ ID NO: 958316 - DNA, 12 bp, Homo sapiens
gtcacagggcca

SEQ ID NO: 958317 - DNA, 13 bp, Homo sapiens
gtcacagggccaa

SEQ ID NO: 958318 - DNA, 14 bp, Homo sapiens
gtcacaggtgtggg

SEQ ID NO: 958319 - DNA, 21 bp, Homo sapiens
gtcacagtccaaccagaaaca

SEQ ID NO: 958320 - DNA, 22 bp, Homo sapiens
gtcacagttcttggtgactgtc

SEQ ID NO: 958321 - DNA, 14 bp, Homo sapiens
gtcacatagtcgtg

SEQ ID NO: 958322 - DNA, 15 bp, Homo sapiens
gtcacatcacaggac

SEQ ID NO: 958323 - DNA, 13 bp, Homo sapiens
gtcacattctgct

SEQ ID NO: 958324 - DNA, 20 bp, Homo sapiens
gtcacattgatgtaaggact

SEQ ID NO: 958325 - DNA, 17 bp, Homo sapiens
gtcaccaagcagtggcc

SEQ ID NO: 958326 - DNA, 14 bp, Homo sapiens
gtcaccaaggaaac

SEQ ID NO: 958327 - DNA, 20 bp, Homo sapiens
gtcaccaccacccctaccac

SEQ ID NO: 958328 - DNA, 12 bp, Homo sapiens
gtcaccacccag

SEQ ID NO: 958329 - DNA, 19 bp, Homo sapiens
gtcaccacccagcccttcc

SEQ ID NO: 958330 - DNA, 20 bp, Homo sapiens
gtcaccacccagcccttcct

SEQ ID NO: 958331 - DNA, 17 bp, Homo sapiens
gtcaccaccctgctcat

SEQ ID NO: 958332 - DNA, 15 bp, Homo sapiens
gtcaccaccttccca

SEQ ID NO: 958333 - DNA, 19 bp, Homo sapiens
gtcaccacgactggccagg

SEQ ID NO: 958334 - DNA, 14 bp, Homo sapiens
gtcaccagcaacat

SEQ ID NO: 958335 - DNA, 19 bp, Homo sapiens
gtcaccagctatctgtcat

SEQ ID NO: 958336 - DNA, 14 bp, Homo sapiens
gtcaccagctgctg

SEQ ID NO: 958337 - DNA, 17 bp, Homo sapiens
gtcaccagctgctgtgc

SEQ ID NO: 958338 - DNA, 18 bp, Homo sapiens
gtcaccaggaatgttaaa

SEQ ID NO: 958339 - DNA, 23 bp, Homo sapiens
gtcaccaggaatgttaaagtcag

SEQ ID NO: 958340 - DNA, 13 bp, Homo sapiens
gtcaccaggactt

SEQ ID NO: 958341 - DNA, 23 bp, Homo sapiens
gtcaccaggacttggggtcagga

SEQ ID NO: 958342 - DNA, 18 bp, Homo sapiens
gtcaccatcctcagaggc

SEQ ID NO: 958343 - DNA, 14 bp, Homo sapiens
gtcacccagagcac

SEQ ID NO: 958344 - DNA, 21 bp, Homo sapiens
gtcacccaggctctggagcca

SEQ ID NO: 958345 - DNA, 20 bp, Homo sapiens
gtcacccaggctggactgca

SEQ ID NO: 958346 - DNA, 20 bp, Homo sapiens
gtcacccaggctggagtgcg

SEQ ID NO: 958347 - DNA, 13 bp, Homo sapiens
gtcacccccactt

SEQ ID NO: 958348 - DNA, 15 bp, Homo sapiens
gtcacccctccctcc

SEQ ID NO: 958349 - DNA, 19 bp, Homo sapiens
gtcaccctccaccgagcca

SEQ ID NO: 958350 - DNA, 16 bp, Homo sapiens
gtcaccctccacctct

SEQ ID NO: 958351 - DNA, 20 bp, Homo sapiens
gtcaccctcctcacagacct

SEQ ID NO: 958352 - DNA, 22 bp, Homo sapiens
gtcaccctcctcacagacctct

SEQ ID NO: 958353 - DNA, 13 bp, Homo sapiens
gtcaccctgtgac

SEQ ID NO: 958354 - DNA, 19 bp, Homo sapiens
gtcaccctgtgggtgtctc

SEQ ID NO: 958355 - DNA, 16 bp, Homo sapiens
gtcacccttctgggca

SEQ ID NO: 958356 - DNA, 15 bp, Homo sapiens
gtcaccgacagcggc

SEQ ID NO: 958357 - DNA, 16 bp, Homo sapiens
gtcaccgacagcggcc

SEQ ID NO: 958358 - DNA, 22 bp, Homo sapiens
gtcaccgggatgaacctatcct

SEQ ID NO: 958359 - DNA, 18 bp, Homo sapiens
tggccctggggtgtgtct

SEQ ID NO: 958360 - DNA, 14 bp, Homo sapiens
tggccctgtcccag

SEQ ID NO: 958361 - DNA, 18 bp, Homo sapiens
tggccctgtcccaggccg

SEQ ID NO: 958362 - DNA, 12 bp, Homo sapiens
tggccctgtgca

SEQ ID NO: 958363 - DNA, 19 bp, Homo sapiens
tggcccttcagtctgctcc

SEQ ID NO: 958364 - DNA, 23 bp, Homo sapiens
tggcccttcagtctgctccacca

SEQ ID NO: 958365 - DNA, 14 bp, Homo sapiens
tggcccttccagtg

SEQ ID NO: 958366 - DNA, 19 bp, Homo sapiens
tggcccttcccactggagg

SEQ ID NO: 958367 - DNA, 15 bp, Homo sapiens
tggcccttggaataa

SEQ ID NO: 958368 - DNA, 16 bp, Homo sapiens
tggcccttggaataaa

SEQ ID NO: 958369 - DNA, 15 bp, Homo sapiens
tggcccttgtttaca

SEQ ID NO: 958370 - DNA, 13 bp, Homo sapiens
tggccctttcctt

SEQ ID NO: 958371 - DNA, 13 bp, Homo sapiens
tggccgagctcct

SEQ ID NO: 958372 - DNA, 16 bp, Homo sapiens
tggccgagctcctggg

SEQ ID NO: 958373 - DNA, 16 bp, Homo sapiens
tggccgaggactttga

SEQ ID NO: 958374 - DNA, 15 bp, Homo sapiens
tggccgagtccaagc

SEQ ID NO: 958375 - DNA, 17 bp, Homo sapiens
tggccgagtccaagctg

SEQ ID NO: 958376 - DNA, 16 bp, Homo sapiens
tggccgccacccccat

SEQ ID NO: 958377 - DNA, 17 bp, Homo sapiens
tggccgccacccccatc

SEQ ID NO: 958378 - DNA, 13 bp, Homo sapiens
tggccgccacctg

SEQ ID NO: 958379 - DNA, 20 bp, Homo sapiens
tggccgccatctgcgcaggg

SEQ ID NO: 958380 - DNA, 17 bp, Homo sapiens
tggccgccccctgcccc

SEQ ID NO: 958381 - DNA, 15 bp, Homo sapiens
tggccgcccctgagg

SEQ ID NO: 958382 - DNA, 16 bp, Homo sapiens
tggccgcccctgaggc

SEQ ID NO: 958383 - DNA, 16 bp, Homo sapiens
tggccgcgctccgggc

SEQ ID NO: 958384 - DNA, 17 bp, Homo sapiens
tggccgcggagcctgca

SEQ ID NO: 958385 - DNA, 14 bp, Homo sapiens
tggccgctcctccc

SEQ ID NO: 958386 - DNA, 17 bp, Homo sapiens
tggccgctcctccctgc

SEQ ID NO: 958387 - DNA, 19 bp, Homo sapiens
tggccgctgagcgcccccg

SEQ ID NO: 958388 - DNA, 17 bp, Homo sapiens
tggccgctgagtggcag

SEQ ID NO: 958389 - DNA, 16 bp, Homo sapiens
tggccgcttctagagc

SEQ ID NO: 958390 - DNA, 20 bp, Homo sapiens
tggccggcttgctgctccgg

SEQ ID NO: 958391 - DNA, 13 bp, Homo sapiens
tggccgggcaggg

SEQ ID NO: 958392 - DNA, 15 bp, Homo sapiens
tggccgtctcctccc

SEQ ID NO: 958393 - DNA, 17 bp, Homo sapiens
tggccgtctcctccctc

SEQ ID NO: 958394 - DNA, 14 bp, Homo sapiens
tggccgttatctgg

SEQ ID NO: 958395 - DNA, 16 bp, Homo sapiens
tggcctaaaaatgcaa

SEQ ID NO: 958396 - DNA, 15 bp, Homo sapiens
tggcctaaatttctt

SEQ ID NO: 958397 - DNA, 17 bp, Homo sapiens
tggcctaaatttcttct

SEQ ID NO: 958398 - DNA, 21 bp, Homo sapiens
tggcgcaggtgggctggactt

SEQ ID NO: 958399 - DNA, 17 bp, Homo sapiens
tggcgccaccagctctg

SEQ ID NO: 958400 - DNA, 19 bp, Homo sapiens
tggcgctatattgtggctg

SEQ ID NO: 958401 - DNA, 14 bp, Homo sapiens
tggcgctcagaccc

SEQ ID NO: 958402 - DNA, 15 bp, Homo sapiens
tggcgctcagacccc

SEQ ID NO: 958403 - DNA, 14 bp, Homo sapiens
tggcgctctcagct

SEQ ID NO: 958404 - DNA, 13 bp, Homo sapiens
tggcgcttagaga

SEQ ID NO: 958405 - DNA, 20 bp, Homo sapiens
tggcgcttagagaggacaat

SEQ ID NO: 958406 - DNA, 20 bp, Homo sapiens
tggcgcttggatctggggtg

SEQ ID NO: 958407 - DNA, 18 bp, Homo sapiens
tggcggcaaaagcccatt

SEQ ID NO: 958408 - DNA, 14 bp, Homo sapiens
tggcggcagacaca

SEQ ID NO: 958409 - DNA, 23 bp, Homo sapiens
tggcggcagcagccatcatagga

SEQ ID NO: 958410 - DNA, 21 bp, Homo sapiens
tggcggccccaactcgggctc

SEQ ID NO: 958411 - DNA, 14 bp, Homo sapiens
tggcggcctgtggg

SEQ ID NO: 958412 - DNA, 15 bp, Homo sapiens
tggcggctactcagc

SEQ ID NO: 958413 - DNA, 22 bp, Homo sapiens
tggcggctgcacaacagccctg

SEQ ID NO: 958414 - DNA, 13 bp, Homo sapiens
tggcggcttcctg

SEQ ID NO: 958415 - DNA, 20 bp, Homo sapiens
tggcgggggcacgtgtgggc

SEQ ID NO: 958416 - DNA, 13 bp, Homo sapiens
tggcggggtgggg

SEQ ID NO: 958417 - DNA, 15 bp, Homo sapiens
tggcggtggccacag

SEQ ID NO: 958418 - DNA, 21 bp, Homo sapiens
tggcgtaagatgatggatttg

SEQ ID NO: 958419 - DNA, 18 bp, Homo sapiens
tggcgtaatgggcctgcc

SEQ ID NO: 958420 - DNA, 20 bp, Homo sapiens
tggcgtaatgggcctgccca

SEQ ID NO: 958421 - DNA, 22 bp, Homo sapiens
tggcgtagcagagttaaatctc

SEQ ID NO: 958422 - DNA, 22 bp, Homo sapiens
tggcgtcggccagaggggctgc

SEQ ID NO: 958423 - DNA, 15 bp, Homo sapiens
tggcgtctgtcttca

SEQ ID NO: 958424 - DNA, 20 bp, Homo sapiens
tggcgtctgtcttcaagggc

SEQ ID NO: 958425 - DNA, 16 bp, Homo sapiens
tggcgtgagctgcccg

SEQ ID NO: 958426 - DNA, 15 bp, Homo sapiens
tggcgtgccctggag

SEQ ID NO: 958427 - DNA, 12 bp, Homo sapiens
tggcgtggcctc

SEQ ID NO: 958428 - DNA, 14 bp, Homo sapiens
tggcgttatggcag

SEQ ID NO: 958429 - DNA, 16 bp, Homo sapiens
tggcgttatggcagcc

SEQ ID NO: 958430 - DNA, 21 bp, Homo sapiens
tggcgtttttctcgtccccct

SEQ ID NO: 958431 - DNA, 21 bp, Homo sapiens
tggctaactatatttgctttt

SEQ ID NO: 958432 - DNA, 11 bp, Homo sapiens
tggctaataaa

SEQ ID NO: 958433 - DNA, 18 bp, Homo sapiens
tggctaataaactgtatt

SEQ ID NO: 958434 - DNA, 22 bp, Homo sapiens
tggctaataaactgtattaaat

SEQ ID NO: 958435 - DNA, 15 bp, Homo sapiens
tggctacatcccagc

SEQ ID NO: 958436 - DNA, 18 bp, Homo sapiens
tggctacatcccagcctg

SEQ ID NO: 958437 - DNA, 23 bp, Homo sapiens
tggctacgcctcttctgtccctg

SEQ ID NO: 958438 - DNA, 21 bp, Homo sapiens
tggctagaggccagccccacc

SEQ ID NO: 958439 - DNA, 23 bp, Homo sapiens
tggctagaggccagccccaccca

SEQ ID NO: 958440 - DNA, 23 bp, Homo sapiens
tggctagcattcctcaggaagga

SEQ ID NO: 958441 - DNA, 22 bp, Homo sapiens
tggctagtcctttctgtgaagc

SEQ ID NO: 958442 - DNA, 17 bp, Homo sapiens
tggctatagatgtcttt

SEQ ID NO: 958443 - DNA, 13 bp, Homo sapiens
tggctatcctgat

SEQ ID NO: 958444 - DNA, 23 bp, Homo sapiens
tggctatgaaaatgagccctggc

SEQ ID NO: 958445 - DNA, 15 bp, Homo sapiens
tggctatgcatttga

SEQ ID NO: 958446 - DNA, 17 bp, Homo sapiens
tggctatgcatttgaaa

SEQ ID NO: 958447 - DNA, 19 bp, Homo sapiens
tggctatgcatttgaaaat

SEQ ID NO: 958448 - DNA, 12 bp, Homo sapiens
tggctattttat

SEQ ID NO: 958449 - DNA, 14 bp, Homo sapiens
tggctcaagtagaa

SEQ ID NO: 958450 - DNA, 22 bp, Homo sapiens
tggctcacgccccgctgtgtcc

SEQ ID NO: 958451 - DNA, 17 bp, Homo sapiens
tggctcactggctggga

SEQ ID NO: 958452 - DNA, 20 bp, Homo sapiens
tggctcactggctgggagtc

SEQ ID NO: 958453 - DNA, 21 bp, Homo sapiens
tggctcaggcaagcccctcag

SEQ ID NO: 958454 - DNA, 12 bp, Homo sapiens
tggctcaggcag

SEQ ID NO: 958455 - DNA, 12 bp, Homo sapiens
tggctcagggga

SEQ ID NO: 958456 - DNA, 20 bp, Homo sapiens
tggctcagggtcaaagacag

SEQ ID NO: 958457 - DNA, 23 bp, Homo sapiens
tggctcagtgccacctatgcctg

SEQ ID NO: 958458 - DNA, 17 bp, Homo sapiens
tggctccaccttgatgg

SEQ ID NO: 958459 - DNA, 21 bp, Homo sapiens
tggctccagatgcagggcagt

SEQ ID NO: 958460 - DNA, 23 bp, Homo sapiens
tggctccagatgcagggcagtca

SEQ ID NO: 958461 - DNA, 17 bp, Homo sapiens
tggctccagctggccgg

SEQ ID NO: 958462 - DNA, 23 bp, Homo sapiens
tggctccagtctgctgccctcca

SEQ ID NO: 958463 - DNA, 17 bp, Homo sapiens
tggctcccacaggccct

SEQ ID NO: 958464 - DNA, 20 bp, Homo sapiens
tggctcccacaggcccttcc

SEQ ID NO: 958465 - DNA, 16 bp, Homo sapiens
tggctcccagggtgga

SEQ ID NO: 958466 - DNA, 23 bp, Homo sapiens
tggctcccatgaccatactgagg

SEQ ID NO: 958467 - DNA, 14 bp, Homo sapiens
tggctccccacctg

SEQ ID NO: 958468 - DNA, 16 bp, Homo sapiens
tggctccccacctgga

SEQ ID NO: 958469 - DNA, 23 bp, Homo sapiens
tggctccccacctggacacacac

SEQ ID NO: 958470 - DNA, 19 bp, Homo sapiens
tggctccccacgagtcacc

SEQ ID NO: 958471 - DNA, 22 bp, Homo sapiens
tggctccccctccccaggctgg

SEQ ID NO: 958472 - DNA, 13 bp, Homo sapiens
tggctccccgagg

SEQ ID NO: 958473 - DNA, 16 bp, Homo sapiens
tggctccccgagggct

SEQ ID NO: 958474 - DNA, 19 bp, Homo sapiens
tggctccccgagggctcag

SEQ ID NO: 958475 - DNA, 20 bp, Homo sapiens
tggctccccgagggctcaga

SEQ ID NO: 958476 - DNA, 19 bp, Homo sapiens
tggctcctccgtctgaccc

SEQ ID NO: 958477 - DNA, 13 bp, Homo sapiens
tggctcctctcag

SEQ ID NO: 958478 - DNA, 14 bp, Homo sapiens
tggctcctgagggg

SEQ ID NO: 958479 - DNA, 19 bp, Homo sapiens
tggctccttcccatcgctg

SEQ ID NO: 958480 - DNA, 20 bp, Homo sapiens
tggctccttgcagcagggct

SEQ ID NO: 958481 - DNA, 18 bp, Homo sapiens
tggctcgaatctctgtgc

SEQ ID NO: 958482 - DNA, 20 bp, Homo sapiens
tggctcgaatctctgtgcct

SEQ ID NO: 958483 - DNA, 20 bp, Homo sapiens
tggctcgcagggtgcaggag

SEQ ID NO: 958484 - DNA, 23 bp, Homo sapiens
tggctcgctccctgtagctctgc

SEQ ID NO: 958485 - DNA, 16 bp, Homo sapiens
tggctcggacccaccc

SEQ ID NO: 958486 - DNA, 18 bp, Homo sapiens
tggctcggacccacccca

SEQ ID NO: 958487 - DNA, 16 bp, Homo sapiens
gtcaccggtcagtgcc

SEQ ID NO: 958488 - DNA, 18 bp, Homo sapiens
gtcaccggtcagtgcctt

SEQ ID NO: 958489 - DNA, 19 bp, Homo sapiens
gtcaccggtcagtgccttt

SEQ ID NO: 958490 - DNA, 20 bp, Homo sapiens
gtcaccgtggaccttcctgc

SEQ ID NO: 958491 - DNA, 16 bp, Homo sapiens
gtcacctacatatgct

SEQ ID NO: 958492 - DNA, 14 bp, Homo sapiens
gtcacctcctccac

SEQ ID NO: 958493 - DNA, 17 bp, Homo sapiens
gtcacctcctccactca

SEQ ID NO: 958494 - DNA, 18 bp, Homo sapiens
gtcacctgcaagccccag

SEQ ID NO: 958495 - DNA, 20 bp, Homo sapiens
gtcacctgctcacagggatg

SEQ ID NO: 958496 - DNA, 21 bp, Homo sapiens
gtcacctgctcacagggatgc

SEQ ID NO: 958497 - DNA, 13 bp, Homo sapiens
gtcacctgctcca

SEQ ID NO: 958498 - DNA, 18 bp, Homo sapiens
gtcacctggcacattcat

SEQ ID NO: 958499 - DNA, 12 bp, Homo sapiens
gtcacctgggag

SEQ ID NO: 958500 - DNA, 13 bp, Homo sapiens
gtcaccttccctt

SEQ ID NO: 958501 - DNA, 16 bp, Homo sapiens
gtcaccttctgggcaa

SEQ ID NO: 958502 - DNA, 16 bp, Homo sapiens
gtcaccttgcactcct

SEQ ID NO: 958503 - DNA, 18 bp, Homo sapiens
gtcacctttctgggcttt

SEQ ID NO: 958504 - DNA, 22 bp, Homo sapiens
gtcacctttctgggctttctcc

SEQ ID NO: 958505 - DNA, 21 bp, Homo sapiens
gtcacgaattccatcttgtaa

SEQ ID NO: 958506 - DNA, 15 bp, Homo sapiens
gtcacgctccctgac

SEQ ID NO: 958507 - DNA, 23 bp, Homo sapiens
gtcacgctccctgacttctcccc

SEQ ID NO: 958508 - DNA, 17 bp, Homo sapiens
gtcacgcttgcctggtc

SEQ ID NO: 958509 - DNA, 16 bp, Homo sapiens
gtcacgtgaaatattt

SEQ ID NO: 958510 - DNA, 19 bp, Homo sapiens
gtcactaaccaacaaggtt

SEQ ID NO: 958511 - DNA, 22 bp, Homo sapiens
gtcactattttcactagggctg

SEQ ID NO: 958512 - DNA, 23 bp, Homo sapiens
gtcactattttcactagggctga

SEQ ID NO: 958513 - DNA, 14 bp, Homo sapiens
gtcactcattgctg

SEQ ID NO: 958514 - DNA, 20 bp, Homo sapiens
gtcactcattgctgagcctc

SEQ ID NO: 958515 - DNA, 21 bp, Homo sapiens
gtcactcattgctgagcctct

SEQ ID NO: 958516 - DNA, 24 bp, Homo sapiens
gtcactcattgctgagcctctgct

SEQ ID NO: 958517 - DNA, 15 bp, Homo sapiens
gtcactccaccatcc

SEQ ID NO: 958518 - DNA, 15 bp, Homo sapiens
gtcactctgccctct

SEQ ID NO: 958519 - DNA, 19 bp, Homo sapiens
tggctgaattaaaatggtt

SEQ ID NO: 958520 - DNA, 15 bp, Homo sapiens
tggctgacccagtcc

SEQ ID NO: 958521 - DNA, 17 bp, Homo sapiens
tggctgacccagtccct

SEQ ID NO: 958522 - DNA, 22 bp, Homo sapiens
tggctgaccccaaagagcctgg

SEQ ID NO: 958523 - DNA, 14 bp, Homo sapiens
tggctgacccctct

SEQ ID NO: 958524 - DNA, 14 bp, Homo sapiens
tggctgactggggc

SEQ ID NO: 958525 - DNA, 20 bp, Homo sapiens
tggctgagacctgggatttg

SEQ ID NO: 958526 - DNA, 21 bp, Homo sapiens
tggctgagacctgggatttga

SEQ ID NO: 958527 - DNA, 19 bp, Homo sapiens
tggctgagatatgaacata

SEQ ID NO: 958528 - DNA, 16 bp, Homo sapiens
tggctgagcctggctg

SEQ ID NO: 958529 - DNA, 19 bp, Homo sapiens
tggctgagcctggctggca

SEQ ID NO: 958530 - DNA, 16 bp, Homo sapiens
tggctgagtactggaa

SEQ ID NO: 958531 - DNA, 20 bp, Homo sapiens
tggctgagtactggaataaa

SEQ ID NO: 958532 - DNA, 21 bp, Homo sapiens
tggctgagtggaatgcaggga

SEQ ID NO: 958533 - DNA, 19 bp, Homo sapiens
tggctgataattttaaatt

SEQ ID NO: 958534 - DNA, 21 bp, Homo sapiens
tggctgatgatccagaacagt

SEQ ID NO: 958535 - DNA, 21 bp, Homo sapiens
tggctgatgatgtcttctggt

SEQ ID NO: 958536 - DNA, 19 bp, Homo sapiens
tggctgcacctttttgcat

SEQ ID NO: 958537 - DNA, 13 bp, Homo sapiens
tggctgcactctt

SEQ ID NO: 958538 - DNA, 12 bp, Homo sapiens
tggctgccacac

SEQ ID NO: 958539 - DNA, 16 bp, Homo sapiens
tggctgccacacccag

SEQ ID NO: 958540 - DNA, 22 bp, Homo sapiens
tggctgccacacccaggggaag

SEQ ID NO: 958541 - DNA, 17 bp, Homo sapiens
tggctgccagcccactg

SEQ ID NO: 958542 - DNA, 11 bp, Homo sapiens
tggctgccagg

SEQ ID NO: 958543 - DNA, 21 bp, Homo sapiens
tggctgcccagacccctctgg

SEQ ID NO: 958544 - DNA, 13 bp, Homo sapiens
tggctgcccagga

SEQ ID NO: 958545 - DNA, 14 bp, Homo sapiens
tggctgcccaggag

SEQ ID NO: 958546 - DNA, 18 bp, Homo sapiens
tggctgccccacctgccg

SEQ ID NO: 958547 - DNA, 13 bp, Homo sapiens
tggctgccccggc

SEQ ID NO: 958548 - DNA, 17 bp, Homo sapiens
tggctgcgcccccagct

SEQ ID NO: 958549 - DNA, 18 bp, Homo sapiens
tggctgcgctaaccccca

SEQ ID NO: 958550 - DNA, 13 bp, Homo sapiens
tggctgctagcac

SEQ ID NO: 958551 - DNA, 15 bp, Homo sapiens
tggctgctagcactt

SEQ ID NO: 958552 - DNA, 14 bp, Homo sapiens
tggctgctaggcca

SEQ ID NO: 958553 - DNA, 15 bp, Homo sapiens
tggctgctcactgtc

SEQ ID NO: 958554 - DNA, 15 bp, Homo sapiens
tggctgctgccccca

SEQ ID NO: 958555 - DNA, 14 bp, Homo sapiens
tggctgctgcttct

SEQ ID NO: 958556 - DNA, 15 bp, Homo sapiens
tggctgcttgcagcc

SEQ ID NO: 958557 - DNA, 16 bp, Homo sapiens
tggctgcttgcagcca

SEQ ID NO: 958558 - DNA, 19 bp, Homo sapiens
tggctgcttgcagccagga

SEQ ID NO: 958559 - DNA, 18 bp, Homo sapiens
tggctggaaactgctccc

SEQ ID NO: 958560 - DNA, 23 bp, Homo sapiens
tggctggaaagcagagcctcctg

SEQ ID NO: 958561 - DNA, 11 bp, Homo sapiens
tggctggaatt

SEQ ID NO: 958562 - DNA, 16 bp, Homo sapiens
tggctggaattaaaac

SEQ ID NO: 958563 - DNA, 22 bp, Homo sapiens
tggctggaggaagtggggtctg

SEQ ID NO: 958564 - DNA, 19 bp, Homo sapiens
tggctggatgaaattttct

SEQ ID NO: 958565 - DNA, 22 bp, Homo sapiens
tggctggatgaaattttctaga

SEQ ID NO: 958566 - DNA, 23 bp, Homo sapiens
tggctggcagctgagagccctgc

SEQ ID NO: 958567 - DNA, 15 bp, Homo sapiens
tggctggcctcaccc

SEQ ID NO: 958568 - DNA, 14 bp, Homo sapiens
tggctggctgcagt

SEQ ID NO: 958569 - DNA, 12 bp, Homo sapiens
tggctgggcatg

SEQ ID NO: 958570 - DNA, 11 bp, Homo sapiens
tggctgggccc

SEQ ID NO: 958571 - DNA, 15 bp, Homo sapiens
tggctgggcccagaa

SEQ ID NO: 958572 - DNA, 17 bp, Homo sapiens
tggctgggcccctgggg

SEQ ID NO: 958573 - DNA, 14 bp, Homo sapiens
tggctgggcctctg

SEQ ID NO: 958574 - DNA, 15 bp, Homo sapiens
tggctggggcagagg

SEQ ID NO: 958575 - DNA, 11 bp, Homo sapiens
tggctgggtgg

SEQ ID NO: 958576 - DNA, 22 bp, Homo sapiens
tggctgggtgggcccagaactg

SEQ ID NO: 958577 - DNA, 23 bp, Homo sapiens
tggctgggtggtattctggtagg

SEQ ID NO: 958578 - DNA, 16 bp, Homo sapiens
tggctggtccagggct

SEQ ID NO: 958579 - DNA, 22 bp, Homo sapiens
tggctggtctggagtcccaccc

SEQ ID NO: 958580 - DNA, 23 bp, Homo sapiens
tggctggtctggagtcccacccg

SEQ ID NO: 958581 - DNA, 17 bp, Homo sapiens
tggctggtgagaccccg

SEQ ID NO: 958582 - DNA, 19 bp, Homo sapiens
tggctggtgagaccccgca

SEQ ID NO: 958583 - DNA, 13 bp, Homo sapiens
tggctggtgccca

SEQ ID NO: 958584 - DNA, 14 bp, Homo sapiens
tggctggtgggccc

SEQ ID NO: 958585 - DNA, 13 bp, Homo sapiens
tggctggtgtccc

SEQ ID NO: 958586 - DNA, 14 bp, Homo sapiens
tggctggtgtcccc

SEQ ID NO: 958587 - DNA, 19 bp, Homo sapiens
tggctggtgtccccttccc

SEQ ID NO: 958588 - DNA, 21 bp, Homo sapiens
tggctggtgtccccttcccct

SEQ ID NO: 958589 - DNA, 20 bp, Homo sapiens
tggctgtacctgttcctccc

SEQ ID NO: 958590 - DNA, 21 bp, Homo sapiens
tggctgtagatggtgacctgg

SEQ ID NO: 958591 - DNA, 17 bp, Homo sapiens
tggctgtatcttgtttt

SEQ ID NO: 958592 - DNA, 19 bp, Homo sapiens
tggctgtccaaccagactt

SEQ ID NO: 958593 - DNA, 14 bp, Homo sapiens
tggctgtccctgtg

SEQ ID NO: 958594 - DNA, 14 bp, Homo sapiens
tggctgtccttccc

SEQ ID NO: 958595 - DNA, 20 bp, Homo sapiens
tggctgtccttccccttccc

SEQ ID NO: 958596 - DNA, 16 bp, Homo sapiens
tggctgtctagaatgt

SEQ ID NO: 958597 - DNA, 13 bp, Homo sapiens
tggctgtctgcac

SEQ ID NO: 958598 - DNA, 14 bp, Homo sapiens
tggctgtgaactga

SEQ ID NO: 958599 - DNA, 21 bp, Homo sapiens
tggctgtgacaaccctggcct

SEQ ID NO: 958600 - DNA, 23 bp, Homo sapiens
tggctgtgacaaccctggcctca

SEQ ID NO: 958601 - DNA, 14 bp, Homo sapiens
tggctgtgacctct

SEQ ID NO: 958602 - DNA, 15 bp, Homo sapiens
tggctgtgaggcccc

SEQ ID NO: 958603 - DNA, 14 bp, Homo sapiens
tggctgtgcccagc

SEQ ID NO: 958604 - DNA, 16 bp, Homo sapiens
tggctgtgcccagcag

SEQ ID NO: 958605 - DNA, 19 bp, Homo sapiens
tggctgtgcccagcaggcc

SEQ ID NO: 958606 - DNA, 13 bp, Homo sapiens
tggctgtgcccct

SEQ ID NO: 958607 - DNA, 19 bp, Homo sapiens
tggctgtgcccctgatgca

SEQ ID NO: 958608 - DNA, 22 bp, Homo sapiens
tggctgtgcctctgcctgtctc

SEQ ID NO: 958609 - DNA, 14 bp, Homo sapiens
tggctgtgcctgct

SEQ ID NO: 958610 - DNA, 15 bp, Homo sapiens
tggctgtgcctgctt

SEQ ID NO: 958611 - DNA, 13 bp, Homo sapiens
tggctgtggcaca

SEQ ID NO: 958612 - DNA, 20 bp, Homo sapiens
tggctgtggcatttccaaac

SEQ ID NO: 958613 - DNA, 16 bp, Homo sapiens
tggctgtggtcagcag

SEQ ID NO: 958614 - DNA, 21 bp, Homo sapiens
tggctgtggttcctaagcctg

SEQ ID NO: 958615 - DNA, 15 bp, Homo sapiens
gtcagctgggagcca

SEQ ID NO: 958616 - DNA, 18 bp, Homo sapiens
gtcagctgttactttctt

SEQ ID NO: 958617 - DNA, 13 bp, Homo sapiens
gtcagctttcaga

SEQ ID NO: 958618 - DNA, 16 bp, Homo sapiens
gtcagctttgccttcc

SEQ ID NO: 958619 - DNA, 19 bp, Homo sapiens
gtcagcttttgttgtttat

SEQ ID NO: 958620 - DNA, 17 bp, Homo sapiens
gtcaggaacagaaggat

SEQ ID NO: 958621 - DNA, 16 bp, Homo sapiens
gtcaggagtgtagttg

SEQ ID NO: 958622 - DNA, 19 bp, Homo sapiens
gtcaggagttcgagaccaa

SEQ ID NO: 958623 - DNA, 19 bp, Homo sapiens
gtcaggagttttactgcct

SEQ ID NO: 958624 - DNA, 20 bp, Homo sapiens
gtcaggagttttactgcctg

SEQ ID NO: 958625 - DNA, 21 bp, Homo sapiens
gtcaggagttttactgcctgt

SEQ ID NO: 958626 - DNA, 15 bp, Homo sapiens
gtcaggcaattgatt

SEQ ID NO: 958627 - DNA, 17 bp, Homo sapiens
gtcaggcactggctgaa

SEQ ID NO: 958628 - DNA, 14 bp, Homo sapiens
gtcaggcagccagt

SEQ ID NO: 958629 - DNA, 16 bp, Homo sapiens
gtcaggccagcctgtc

SEQ ID NO: 958630 - DNA, 17 bp, Homo sapiens
gtcaggccagcctgtcc

SEQ ID NO: 958631 - DNA, 23 bp, Homo sapiens
gtcaggcccgtcggagctgcctg

SEQ ID NO: 958632 - DNA, 16 bp, Homo sapiens
gtcaggccctctgcct

SEQ ID NO: 958633 - DNA, 18 bp, Homo sapiens
gtcaggccctctgcctgc

SEQ ID NO: 958634 - DNA, 21 bp, Homo sapiens
gtcaggccctgactcctctgg

SEQ ID NO: 958635 - DNA, 22 bp, Homo sapiens
gtcaggccctgactcctctggc

SEQ ID NO: 958636 - DNA, 15 bp, Homo sapiens
gtcaggcctgggcag

SEQ ID NO: 958637 - DNA, 17 bp, Homo sapiens
gtcaggcctgggcagga

SEQ ID NO: 958638 - DNA, 20 bp, Homo sapiens
gtcaggcctgggcaggaccc

SEQ ID NO: 958639 - DNA, 22 bp, Homo sapiens
gtcaggcctgggcaggaccctg

SEQ ID NO: 958640 - DNA, 13 bp, Homo sapiens
gtcaggcctgtgt

SEQ ID NO: 958641 - DNA, 16 bp, Homo sapiens
gtcaggctacaaggta

SEQ ID NO: 958642 - DNA, 13 bp, Homo sapiens
gtcaggctggtct

SEQ ID NO: 958643 - DNA, 21 bp, Homo sapiens
gtcagggagaggtcaccagct

SEQ ID NO: 958644 - DNA, 12 bp, Homo sapiens
gtcagggagggc

SEQ ID NO: 958645 - DNA, 18 bp, Homo sapiens
gtcagggcacagctgccc

SEQ ID NO: 958646 - DNA, 15 bp, Homo sapiens
gtcagggcagtggcc

SEQ ID NO: 958647 - DNA, 13 bp, Homo sapiens
gtcagggccagac

SEQ ID NO: 958648 - DNA, 20 bp, Homo sapiens
gtcagggcccaagtccctgt

SEQ ID NO: 958649 - DNA, 11 bp, Homo sapiens
gtcagggctca

SEQ ID NO: 958650 - DNA, 15 bp, Homo sapiens
gtcaggggagaagct

SEQ ID NO: 958651 - DNA, 17 bp, Homo sapiens
gtcaggggagaagctga

SEQ ID NO: 958652 - DNA, 13 bp, Homo sapiens
gtcaggggctctg

SEQ ID NO: 958653 - DNA, 18 bp, Homo sapiens
gtcaggggctctgtgtta

SEQ ID NO: 958654 - DNA, 18 bp, Homo sapiens
gtcagggggagtctttgc

SEQ ID NO: 958655 - DNA, 14 bp, Homo sapiens
gtcaggggggagaa

SEQ ID NO: 958656 - DNA, 17 bp, Homo sapiens
gtcaggggtcaggtgtc

SEQ ID NO: 958657 - DNA, 17 bp, Homo sapiens
gtcagggttggtgtgct

SEQ ID NO: 958658 - DNA, 18 bp, Homo sapiens
gtcagggttggtgtgctg

SEQ ID NO: 958659 - DNA, 16 bp, Homo sapiens
gtcaggtcccagcgag

SEQ ID NO: 958660 - DNA, 23 bp, Homo sapiens
gtcaggtcccagcgagccacagg

SEQ ID NO: 958661 - DNA, 15 bp, Homo sapiens
gtcaggtgtcaggcc

SEQ ID NO: 958662 - DNA, 16 bp, Homo sapiens
gtcaggttcttgcctt

SEQ ID NO: 958663 - DNA, 13 bp, Homo sapiens
gtcagtaatttat

SEQ ID NO: 958664 - DNA, 21 bp, Homo sapiens
gtcagtaggtccaagggccat

SEQ ID NO: 958665 - DNA, 15 bp, Homo sapiens
gtcagtctttgctca

SEQ ID NO: 958666 - DNA, 18 bp, Homo sapiens
gtcagtctttgctcagtg

SEQ ID NO: 958667 - DNA, 23 bp, Homo sapiens
gtcagtgaggcccagggagaggc

SEQ ID NO: 958668 - DNA, 23 bp, Homo sapiens
gtcagtgctctcagctggcagtg

SEQ ID NO: 958669 - DNA, 14 bp, Homo sapiens
gtcagtgctgcctg

SEQ ID NO: 958670 - DNA, 15 bp, Homo sapiens
gtcagtgctgcctgt

SEQ ID NO: 958671 - DNA, 16 bp, Homo sapiens
gtcagtgctgcctgtc

SEQ ID NO: 958672 - DNA, 22 bp, Homo sapiens
gtcagtgctgcctgtccccatg

SEQ ID NO: 958673 - DNA, 21 bp, Homo sapiens
gtcagtggtttctacttcccc

SEQ ID NO: 958674 - DNA, 22 bp, Homo sapiens
gtcagtggtttctacttcccct

SEQ ID NO: 958675 - DNA, 21 bp, Homo sapiens
gtcagtgtacacgtctggacc

SEQ ID NO: 958676 - DNA, 20 bp, Homo sapiens
gtcagtgtagacctgagctg

SEQ ID NO: 958677 - DNA, 17 bp, Homo sapiens
gtcagtgtttcttttaa

SEQ ID NO: 958678 - DNA, 23 bp, Homo sapiens
gtcagtgtttcttttaagtatac

SEQ ID NO: 958679 - DNA, 11 bp, Homo sapiens
gtcagttgaac

SEQ ID NO: 958680 - DNA, 16 bp, Homo sapiens
gtcagtttcactccct

SEQ ID NO: 958681 - DNA, 13 bp, Homo sapiens
gtcagtttcccct

SEQ ID NO: 958682 - DNA, 15 bp, Homo sapiens
gtcagtttcccctct

SEQ ID NO: 958683 - DNA, 14 bp, Homo sapiens
gtcagtttggaatg

SEQ ID NO: 958684 - DNA, 15 bp, Homo sapiens
gtcagttttgttcac

SEQ ID NO: 958685 - DNA, 18 bp, Homo sapiens
gtcataaaatagaataat

SEQ ID NO: 958686 - DNA, 13 bp, Homo sapiens
gtcataaaatgca

SEQ ID NO: 958687 - DNA, 19 bp, Homo sapiens
gtcataaaatgcatactgt

SEQ ID NO: 958688 - DNA, 12 bp, Homo sapiens
gtcataacattt

SEQ ID NO: 958689 - DNA, 17 bp, Homo sapiens
gtcataacatttaaaga

SEQ ID NO: 958690 - DNA, 18 bp, Homo sapiens
gtcataactaaataaagc

SEQ ID NO: 958691 - DNA, 19 bp, Homo sapiens
gtcataccgtgacagcccg

SEQ ID NO: 958692 - DNA, 20 bp, Homo sapiens
gtcatacctggaatgtgtca

SEQ ID NO: 958693 - DNA, 13 bp, Homo sapiens
gtcatagaaatta

SEQ ID NO: 958694 - DNA, 22 bp, Homo sapiens
gtcatagaaattacacccaaag

SEQ ID NO: 958695 - DNA, 17 bp, Homo sapiens
gtcatagccaaagccag

SEQ ID NO: 958696 - DNA, 19 bp, Homo sapiens
gtcatagggattgtccctg

SEQ ID NO: 958697 - DNA, 21 bp, Homo sapiens
gtcatagggattgtccctgtg

SEQ ID NO: 958698 - DNA, 21 bp, Homo sapiens
gtcatataagattcatattta

SEQ ID NO: 958699 - DNA, 17 bp, Homo sapiens
gtcatatactgccatgt

SEQ ID NO: 958700 - DNA, 16 bp, Homo sapiens
gtcatatgttaagcag

SEQ ID NO: 958701 - DNA, 22 bp, Homo sapiens
gtcatatttcgctatagatttt

SEQ ID NO: 958702 - DNA, 18 bp, Homo sapiens
gtcatcaaacatttgcca

SEQ ID NO: 958703 - DNA, 13 bp, Homo sapiens
gtcatcaaagcag

SEQ ID NO: 958704 - DNA, 19 bp, Homo sapiens
gtcatcaaagcagaagtct

SEQ ID NO: 958705 - DNA, 14 bp, Homo sapiens
gtcatcactccctg

SEQ ID NO: 958706 - DNA, 16 bp, Homo sapiens
gtcatcacttttcagt

SEQ ID NO: 958707 - DNA, 16 bp, Homo sapiens
gtcatcagatatgctt

SEQ ID NO: 958708 - DNA, 16 bp, Homo sapiens
gtcatcatcagggcct

SEQ ID NO: 958709 - DNA, 17 bp, Homo sapiens
gtcatcatcagggcctg

SEQ ID NO: 958710 - DNA, 18 bp, Homo sapiens
gtcatcatcagggcctgg

SEQ ID NO: 958711 - DNA, 20 bp, Homo sapiens
gtcatcatcagggcctgggg

SEQ ID NO: 958712 - DNA, 20 bp, Homo sapiens
gtcatccatgccctcccagg

SEQ ID NO: 958713 - DNA, 21 bp, Homo sapiens
gtcatccatgccctcccagga

SEQ ID NO: 958714 - DNA, 17 bp, Homo sapiens
gtcatcccctctcagga

SEQ ID NO: 958715 - DNA, 19 bp, Homo sapiens
gtcatcccctctcaggaga

SEQ ID NO: 958716 - DNA, 22 bp, Homo sapiens
gtcatcctcaaagaaagtgtat

SEQ ID NO: 958717 - DNA, 22 bp, Homo sapiens
gtcatcctcctggtgcccacag

SEQ ID NO: 958718 - DNA, 18 bp, Homo sapiens
gtcatcggaggctgggcc

SEQ ID NO: 958719 - DNA, 22 bp, Homo sapiens
gtcatcggaggctgggcccctg

SEQ ID NO: 958720 - DNA, 16 bp, Homo sapiens
gtcatcgttccccacc

SEQ ID NO: 958721 - DNA, 19 bp, Homo sapiens
gtcatctccatcagctgta

SEQ ID NO: 958722 - DNA, 16 bp, Homo sapiens
gtcatctcccctcctg

SEQ ID NO: 958723 - DNA, 14 bp, Homo sapiens
gtcatctctctggg

SEQ ID NO: 958724 - DNA, 17 bp, Homo sapiens
gtcatctgattggacag

SEQ ID NO: 958725 - DNA, 16 bp, Homo sapiens
gtcatctggtagattt

SEQ ID NO: 958726 - DNA, 21 bp, Homo sapiens
gtcatctgtaagagcttgctc

SEQ ID NO: 958727 - DNA, 18 bp, Homo sapiens
gtcatcttgctaccagta

SEQ ID NO: 958728 - DNA, 16 bp, Homo sapiens
gtcatctttttctaga

SEQ ID NO: 958729 - DNA, 18 bp, Homo sapiens
gtcatgaacatgttcctg

SEQ ID NO: 958730 - DNA, 18 bp, Homo sapiens
gtcatgatctccctgccg

SEQ ID NO: 958731 - DNA, 19 bp, Homo sapiens
gtcatgatgaatcagtcct

SEQ ID NO: 958732 - DNA, 14 bp, Homo sapiens
gtcatgcactgagg

SEQ ID NO: 958733 - DNA, 16 bp, Homo sapiens
gtcatgcactgaggtc

SEQ ID NO: 958734 - DNA, 17 bp, Homo sapiens
gtcatgcagttcctggc

SEQ ID NO: 958735 - DNA, 19 bp, Homo sapiens
gtcatgcagttcctggccc

SEQ ID NO: 958736 - DNA, 15 bp, Homo sapiens
gtcatgcccccctca

SEQ ID NO: 958737 - DNA, 19 bp, Homo sapiens
gtcatgcctcactttcttc

SEQ ID NO: 958738 - DNA, 20 bp, Homo sapiens
gtcatgcctcactttcttct

SEQ ID NO: 958739 - DNA, 19 bp, Homo sapiens
gtcatggaatcttgctgca

SEQ ID NO: 958740 - DNA, 14 bp, Homo sapiens
gtcatggacagata

SEQ ID NO: 958741 - DNA, 20 bp, Homo sapiens
gtcatggcttaatgtttatt

SEQ ID NO: 958742 - DNA, 21 bp, Homo sapiens
gtcatgggaacgcagcctcca

SEQ ID NO: 958743 - DNA, 23 bp, Homo sapiens
gtcatgggaacgcagcctccagt

SEQ ID NO: 958744 - DNA, 14 bp, Homo sapiens
gtcatgtaccatca

SEQ ID NO: 958745 - DNA, 15 bp, Homo sapiens
gtcatgtaccatcaa

SEQ ID NO: 958746 - DNA, 18 bp, Homo sapiens
gtcatgtacttcctgtgt

SEQ ID NO: 958747 - DNA, 14 bp, Homo sapiens
gtcatgtattttat

SEQ ID NO: 958748 - DNA, 16 bp, Homo sapiens
gtcatgtattttatga

SEQ ID NO: 958749 - DNA, 15 bp, Homo sapiens
gtcatgtgacaggta

SEQ ID NO: 958750 - DNA, 16 bp, Homo sapiens
gtcatgtgcatctggt

SEQ ID NO: 958751 - DNA, 17 bp, Homo sapiens
gtcatgtgcatctggtg

SEQ ID NO: 958752 - DNA, 19 bp, Homo sapiens
gtcatgtgcatctggtgta

SEQ ID NO: 958753 - DNA, 12 bp, Homo sapiens
gtcatgtgtgca

SEQ ID NO: 958754 - DNA, 15 bp, Homo sapiens
gtcatgtgtgcatgt

SEQ ID NO: 958755 - DNA, 23 bp, Homo sapiens
gtcattatgatttcattatcaca

SEQ ID NO: 958756 - DNA, 15 bp, Homo sapiens
gtcattatttattgt

SEQ ID NO: 958757 - DNA, 17 bp, Homo sapiens
gtcattatttttgttag

SEQ ID NO: 958758 - DNA, 23 bp, Homo sapiens
gtcattatttttgttagcaaaga

SEQ ID NO: 958759 - DNA, 12 bp, Homo sapiens
gtcattccagag

SEQ ID NO: 958760 - DNA, 21 bp, Homo sapiens
gtcattcgctactatgattta

SEQ ID NO: 958761 - DNA, 21 bp, Homo sapiens
gtcattctaggatgtggagct

SEQ ID NO: 958762 - DNA, 22 bp, Homo sapiens
gtcattcttacaattgcactgc

SEQ ID NO: 958763 - DNA, 18 bp, Homo sapiens
tggcttccagaaggcagc

SEQ ID NO: 958764 - DNA, 15 bp, Homo sapiens
tggcttccaggtatc

SEQ ID NO: 958765 - DNA, 16 bp, Homo sapiens
tggcttccatgatggt

SEQ ID NO: 958766 - DNA, 16 bp, Homo sapiens
tggcttcccgctcagc

SEQ ID NO: 958767 - DNA, 17 bp, Homo sapiens
tggcttcccgctcagcc

SEQ ID NO: 958768 - DNA, 20 bp, Homo sapiens
tggcttcccgctcagccctc

SEQ ID NO: 958769 - DNA, 20 bp, Homo sapiens
tggcttccctctttcatctc

SEQ ID NO: 958770 - DNA, 23 bp, Homo sapiens
tggcttcctccgtccacccaggc

SEQ ID NO: 958771 - DNA, 21 bp, Homo sapiens
tggcttcctcctccctcctgc

SEQ ID NO: 958772 - DNA, 14 bp, Homo sapiens
tggcttcctttctt

SEQ ID NO: 958773 - DNA, 14 bp, Homo sapiens
tggcttcggagggc

SEQ ID NO: 958774 - DNA, 15 bp, Homo sapiens
tggcttcggagggcc

SEQ ID NO: 958775 - DNA, 23 bp, Homo sapiens
tggcttcggagggccgcagggcc

SEQ ID NO: 958776 - DNA, 18 bp, Homo sapiens
tggcttctagtttgcaac

SEQ ID NO: 958777 - DNA, 13 bp, Homo sapiens
tggcttctcagcc

SEQ ID NO: 958778 - DNA, 16 bp, Homo sapiens
tggcttctcagcccct

SEQ ID NO: 958779 - DNA, 17 bp, Homo sapiens
tggcttctcagcccctt

SEQ ID NO: 958780 - DNA, 14 bp, Homo sapiens
tggcttctggagcc

SEQ ID NO: 958781 - DNA, 22 bp, Homo sapiens
tggcttctgtgatgagctgatc

SEQ ID NO: 958782 - DNA, 17 bp, Homo sapiens
tggcttcttaaaaactg

SEQ ID NO: 958783 - DNA, 23 bp, Homo sapiens
tggcttcttaaaaactgtgtatc

SEQ ID NO: 958784 - DNA, 16 bp, Homo sapiens
tggcttcttttcgttt

SEQ ID NO: 958785 - DNA, 20 bp, Homo sapiens
tggcttgaagccaagtcagc

SEQ ID NO: 958786 - DNA, 12 bp, Homo sapiens
tggcttgacatg

SEQ ID NO: 958787 - DNA, 15 bp, Homo sapiens
tggcttgacatgtgc

SEQ ID NO: 958788 - DNA, 21 bp, Homo sapiens
tggcttgagctagagataaaa

SEQ ID NO: 958789 - DNA, 15 bp, Homo sapiens
tggcttgccccagga

SEQ ID NO: 958790 - DNA, 21 bp, Homo sapiens
tggcttgccccaggactctgg

SEQ ID NO: 958791 - DNA, 22 bp, Homo sapiens
tggcttgccccaggactctggc

SEQ ID NO: 958792 - DNA, 13 bp, Homo sapiens
tggcttgctccag

SEQ ID NO: 958793 - DNA, 15 bp, Homo sapiens
tggcttgctccaggg

SEQ ID NO: 958794 - DNA, 17 bp, Homo sapiens
tggcttgctccagggtc

SEQ ID NO: 958795 - DNA, 13 bp, Homo sapiens
tggcttgctgttt

SEQ ID NO: 958796 - DNA, 22 bp, Homo sapiens
tggcttggggtcaagaaacagc

SEQ ID NO: 958797 - DNA, 17 bp, Homo sapiens
tggcttgtaactccacc

SEQ ID NO: 958798 - DNA, 22 bp, Homo sapiens
tggcttgttcatcatccagatg

SEQ ID NO: 958799 - DNA, 20 bp, Homo sapiens
tggcttgttctctggaacct

SEQ ID NO: 958800 - DNA, 17 bp, Homo sapiens
tggcttgtttgatttca

SEQ ID NO: 958801 - DNA, 20 bp, Homo sapiens
tggcttgtttgatttcaaca

SEQ ID NO: 958802 - DNA, 23 bp, Homo sapiens
tggctttattactcccctaagtc

SEQ ID NO: 958803 - DNA, 20 bp, Homo sapiens
tggctttcaaggctggggca

SEQ ID NO: 958804 - DNA, 14 bp, Homo sapiens
tggctttcagagcc

SEQ ID NO: 958805 - DNA, 22 bp, Homo sapiens
tggctttcagagccagcctggc

SEQ ID NO: 958806 - DNA, 17 bp, Homo sapiens
tggctttcatcctgtgt

SEQ ID NO: 958807 - DNA, 18 bp, Homo sapiens
tggctttcatcctgtgtc

SEQ ID NO: 958808 - DNA, 17 bp, Homo sapiens
tggctttcattattagt

SEQ ID NO: 958809 - DNA, 22 bp, Homo sapiens
tggctttccaggcaccctcagg

SEQ ID NO: 958810 - DNA, 19 bp, Homo sapiens
tggctttcccaggagatgg

SEQ ID NO: 958811 - DNA, 14 bp, Homo sapiens
tggctttcccttcc

SEQ ID NO: 958812 - DNA, 20 bp, Homo sapiens
tggctttctcccactgagtt

SEQ ID NO: 958813 - DNA, 19 bp, Homo sapiens
tggctttgaaacctcaggg

SEQ ID NO: 958814 - DNA, 16 bp, Homo sapiens
tggctttggtccccag

SEQ ID NO: 958815 - DNA, 20 bp, Homo sapiens
tggcttttattaatgcactt

SEQ ID NO: 958816 - DNA, 14 bp, Homo sapiens
tggcttttcactgc

SEQ ID NO: 958817 - DNA, 16 bp, Homo sapiens
tggcttttcactgctg

SEQ ID NO: 958818 - DNA, 15 bp, Homo sapiens
tggcttttgtgcatt

SEQ ID NO: 958819 - DNA, 21 bp, Homo sapiens
tggcttttgtgcattatctag

SEQ ID NO: 958820 - DNA, 17 bp, Homo sapiens
tggctttttgttcagaa

SEQ ID NO: 958821 - DNA, 22 bp, Homo sapiens
tggcttttttaaaaaagcaaca

SEQ ID NO: 958822 - DNA, 14 bp, Homo sapiens
tgggaaaaaaacaa

SEQ ID NO: 958823 - DNA, 17 bp, Homo sapiens
tgggaaaaaaactgaag

SEQ ID NO: 958824 - DNA, 20 bp, Homo sapiens
tgggaaaaaagttttgatga

SEQ ID NO: 958825 - DNA, 11 bp, Homo sapiens
tgggaaacacc

SEQ ID NO: 958826 - DNA, 15 bp, Homo sapiens
tgggaaacagaggct

SEQ ID NO: 958827 - DNA, 23 bp, Homo sapiens
tgggaaagacatccataaagaag

SEQ ID NO: 958828 - DNA, 19 bp, Homo sapiens
tgggaaagatggataaact

SEQ ID NO: 958829 - DNA, 23 bp, Homo sapiens
tgggaaagcgcggacgtgctggg

SEQ ID NO: 958830 - DNA, 20 bp, Homo sapiens
tgggaaagcggcgccacaga

SEQ ID NO: 958831 - DNA, 16 bp, Homo sapiens
tgggaaaggagtagaa

SEQ ID NO: 958832 - DNA, 13 bp, Homo sapiens
tgggaaatgcaga

SEQ ID NO: 958833 - DNA, 15 bp, Homo sapiens
tgggaaatggcttga

SEQ ID NO: 958834 - DNA, 22 bp, Homo sapiens
tgggaaatggtatgagctgagg

SEQ ID NO: 958835 - DNA, 21 bp, Homo sapiens
tgggaaattaaatccaataaa

SEQ ID NO: 958836 - DNA, 22 bp, Homo sapiens
tgggaaattaaatccaataaaa

SEQ ID NO: 958837 - DNA, 17 bp, Homo sapiens
tgggaaattgaagtgtc

SEQ ID NO: 958838 - DNA, 20 bp, Homo sapiens
tgggaaattgaagtgtcttc

SEQ ID NO: 958839 - DNA, 21 bp, Homo sapiens
tgggaacaaattagaggagac

SEQ ID NO: 958840 - DNA, 15 bp, Homo sapiens
tgggaacaggcccca

SEQ ID NO: 958841 - DNA, 16 bp, Homo sapiens
tgggaacaggccccac

SEQ ID NO: 958842 - DNA, 13 bp, Homo sapiens
tgggaaccactcc

SEQ ID NO: 958843 - DNA, 23 bp, Homo sapiens
tgggaaccagcatctcagcgcca

SEQ ID NO: 958844 - DNA, 22 bp, Homo sapiens
tgggaaccccttcatcctctga

SEQ ID NO: 958845 - DNA, 19 bp, Homo sapiens
tgggaacgtgtgtccaggc

SEQ ID NO: 958846 - DNA, 21 bp, Homo sapiens
tgggaacgtgtgtccaggctc

SEQ ID NO: 958847 - DNA, 23 bp, Homo sapiens
tgggaactgtgcaaagggctgcc

SEQ ID NO: 958848 - DNA, 21 bp, Homo sapiens
tgggaagaccaaaggaaggaa

SEQ ID NO: 958849 - DNA, 22 bp, Homo sapiens
tgggaagaccaaaggaaggaac

SEQ ID NO: 958850 - DNA, 13 bp, Homo sapiens
tgggaagactcag

SEQ ID NO: 958851 - DNA, 22 bp, Homo sapiens
tgggaagactcaggagtctgcc

SEQ ID NO: 958852 - DNA, 14 bp, Homo sapiens
tgggaagagaagaa

SEQ ID NO: 958853 - DNA, 23 bp, Homo sapiens
tgggaagagaagagggcccagcc

SEQ ID NO: 958854 - DNA, 21 bp, Homo sapiens
tgggaagatgtctcagagcct

SEQ ID NO: 958855 - DNA, 12 bp, Homo sapiens
tgggaagcagga

SEQ ID NO: 958856 - DNA, 11 bp, Homo sapiens
tgggaagccat

SEQ ID NO: 958857 - DNA, 19 bp, Homo sapiens
tgggaagcccatcctgacc

SEQ ID NO: 958858 - DNA, 22 bp, Homo sapiens
tgggaagcccatcctgaccagc

SEQ ID NO: 958859 - DNA, 17 bp, Homo sapiens
tgggaagctggagtgct

SEQ ID NO: 958860 - DNA, 12 bp, Homo sapiens
tgggaagctggg

SEQ ID NO: 958861 - DNA, 15 bp, Homo sapiens
tgggaagctgtactc

SEQ ID NO: 958862 - DNA, 23 bp, Homo sapiens
tgggaagctgtactcagagcaga

SEQ ID NO: 958863 - DNA, 17 bp, Homo sapiens
tgggaaggaaatatatt

SEQ ID NO: 958864 - DNA, 13 bp, Homo sapiens
tgggaaggacaca

SEQ ID NO: 958865 - DNA, 22 bp, Homo sapiens
gtccagctgggaagcccttttt

SEQ ID NO: 958866 - DNA, 13 bp, Homo sapiens
gtccagctgggac

SEQ ID NO: 958867 - DNA, 17 bp, Homo sapiens
gtccagctggggccaga

SEQ ID NO: 958868 - DNA, 22 bp, Homo sapiens
gtccagctggggccagaggctg

SEQ ID NO: 958869 - DNA, 16 bp, Homo sapiens
gtccagcttgctcttc

SEQ ID NO: 958870 - DNA, 12 bp, Homo sapiens
gtccaggaacaa

SEQ ID NO: 958871 - DNA, 17 bp, Homo sapiens
gtccaggaactgcctgg

SEQ ID NO: 958872 - DNA, 17 bp, Homo sapiens
gtccaggaaggcagctg

SEQ ID NO: 958873 - DNA, 17 bp, Homo sapiens
gtccaggagagcctggg

SEQ ID NO: 958874 - DNA, 19 bp, Homo sapiens
gtccaggagagcctggggg

SEQ ID NO: 958875 - DNA, 17 bp, Homo sapiens
gtccaggagctcaggaa

SEQ ID NO: 958876 - DNA, 23 bp, Homo sapiens
gtccaggagctcaggaagaagag

SEQ ID NO: 958877 - DNA, 21 bp, Homo sapiens
gtccaggatgctaacatctaa

SEQ ID NO: 958878 - DNA, 14 bp, Homo sapiens
gtccaggcacagga

SEQ ID NO: 958879 - DNA, 21 bp, Homo sapiens
gtccaggcagctccctcctgc

SEQ ID NO: 958880 - DNA, 11 bp, Homo sapiens
gtccaggccac

SEQ ID NO: 958881 - DNA, 21 bp, Homo sapiens
gtccaggccactgtggccaga

SEQ ID NO: 958882 - DNA, 22 bp, Homo sapiens
gtccaggccactgtggccagag

SEQ ID NO: 958883 - DNA, 23 bp, Homo sapiens
gtccaggccactgtggccagagc

SEQ ID NO: 958884 - DNA, 14 bp, Homo sapiens
tctcccagcccacc

SEQ ID NO: 958885 - DNA, 11 bp, Homo sapiens
tctcccaggaa

SEQ ID NO: 958886 - DNA, 12 bp, Homo sapiens
tctcccaggccc

SEQ ID NO: 958887 - DNA, 16 bp, Homo sapiens
tctcccaggcctgcct

SEQ ID NO: 958888 - DNA, 13 bp, Homo sapiens
tctcccagggagt

SEQ ID NO: 958889 - DNA, 12 bp, Homo sapiens
tctcccagggat

SEQ ID NO: 958890 - DNA, 14 bp, Homo sapiens
tctcccagtctctg

SEQ ID NO: 958891 - DNA, 22 bp, Homo sapiens
tctcccagtgaactcctgccag

SEQ ID NO: 958892 - DNA, 17 bp, Homo sapiens
tctcccatccccctgcc

SEQ ID NO: 958893 - DNA, 18 bp, Homo sapiens
tctcccatccccctgccc

SEQ ID NO: 958894 - DNA, 16 bp, Homo sapiens
tctcccatcctgatcc

SEQ ID NO: 958895 - DNA, 12 bp, Homo sapiens
tctcccatttcc

SEQ ID NO: 958896 - DNA, 14 bp, Homo sapiens
tctcccatttcctg

SEQ ID NO: 958897 - DNA, 13 bp, Homo sapiens
gctctgtggcctg

SEQ ID NO: 958898 - DNA, 16 bp, Homo sapiens
gctctgtggcctgtgt

SEQ ID NO: 958899 - DNA, 22 bp, Homo sapiens
gctctgtgttaggatgcggctt

SEQ ID NO: 958900 - DNA, 18 bp, Homo sapiens
gctctgtgttcccagagg

SEQ ID NO: 958901 - DNA, 19 bp, Homo sapiens
gctctgtgttcccagaggc

SEQ ID NO: 958902 - DNA, 14 bp, Homo sapiens
gctctgttctgcct

SEQ ID NO: 958903 - DNA, 16 bp, Homo sapiens
gctcttaaaaagacac

SEQ ID NO: 958904 - DNA, 16 bp, Homo sapiens
gctcttaaaatatctt

SEQ ID NO: 958905 - DNA, 22 bp, Homo sapiens
gctcttagattgggccatggct

SEQ ID NO: 958906 - DNA, 19 bp, Homo sapiens
gctcttagcagcttccaga

SEQ ID NO: 958907 - DNA, 19 bp, Homo sapiens
gctcttagctttctcaggg

SEQ ID NO: 958908 - DNA, 18 bp, Homo sapiens
gctcttagtctctttggt

SEQ ID NO: 958909 - DNA, 12 bp, Homo sapiens
gctcttcaggcc

SEQ ID NO: 958910 - DNA, 15 bp, Homo sapiens
gctcttcaggcctcc

SEQ ID NO: 958911 - DNA, 18 bp, Homo sapiens
gctcttcaggcctccctc

SEQ ID NO: 958912 - DNA, 17 bp, Homo sapiens
gctcttcatctgcctgc

SEQ ID NO: 958913 - DNA, 20 bp, Homo sapiens
gctcttcatctgcctgcgct

SEQ ID NO: 958914 - DNA, 21 bp, Homo sapiens
gctcttcatctgcctgcgctc

SEQ ID NO: 958915 - DNA, 15 bp, Homo sapiens
gctcttcatttctgg

SEQ ID NO: 958916 - DNA, 22 bp, Homo sapiens
gctcttccaggagccaccttgc

SEQ ID NO: 958917 - DNA, 15 bp, Homo sapiens
gctcttcccctagac

SEQ ID NO: 958918 - DNA, 14 bp, Homo sapiens
gctcttcctggacc

SEQ ID NO: 958919 - DNA, 18 bp, Homo sapiens
gctcttcggtttctgagc

SEQ ID NO: 958920 - DNA, 21 bp, Homo sapiens
gctcttctccacgtctttcct

SEQ ID NO: 958921 - DNA, 17 bp, Homo sapiens
gctcttctcctttcaca

SEQ ID NO: 958922 - DNA, 12 bp, Homo sapiens
gctcttctggag

SEQ ID NO: 958923 - DNA, 21 bp, Homo sapiens
gctcttctggagtttctctaa

SEQ ID NO: 958924 - DNA, 11 bp, Homo sapiens
gctcttctggg

SEQ ID NO: 958925 - DNA, 14 bp, Homo sapiens
gctcttctgggcag

SEQ ID NO: 958926 - DNA, 15 bp, Homo sapiens
gctcttctgggcaga

SEQ ID NO: 958927 - DNA, 17 bp, Homo sapiens
gctcttctgggcagagc

SEQ ID NO: 958928 - DNA, 18 bp, Homo sapiens
gctcttctgggcagagcc

SEQ ID NO: 958929 - DNA, 21 bp, Homo sapiens
gctcttctgggcagagcctgt

SEQ ID NO: 958930 - DNA, 22 bp, Homo sapiens
gctcttctgggcagagcctgtc

SEQ ID NO: 958931 - DNA, 19 bp, Homo sapiens
gctcttctgtgcccagggt

SEQ ID NO: 958932 - DNA, 20 bp, Homo sapiens
gctcttctgtgcccagggtg

SEQ ID NO: 958933 - DNA, 12 bp, Homo sapiens
gctcttctttct

SEQ ID NO: 958934 - DNA, 15 bp, Homo sapiens
gctcttgaaatatgt

SEQ ID NO: 958935 - DNA, 21 bp, Homo sapiens
gctcttgaaatattcagaaat

SEQ ID NO: 958936 - DNA, 15 bp, Homo sapiens
gctcttgaacctgtg

SEQ ID NO: 958937 - DNA, 19 bp, Homo sapiens
gctcttgaggaagcccagg

SEQ ID NO: 958938 - DNA, 17 bp, Homo sapiens
gctcttgatacccccct

SEQ ID NO: 958939 - DNA, 20 bp, Homo sapiens
gctcttgatacccccctctg

SEQ ID NO: 958940 - DNA, 18 bp, Homo sapiens
gctcttgccccactccct

SEQ ID NO: 958941 - DNA, 12 bp, Homo sapiens
gctcttgccctt

SEQ ID NO: 958942 - DNA, 17 bp, Homo sapiens
gctcttgcccttccctg

SEQ ID NO: 958943 - DNA, 12 bp, Homo sapiens
gctcttgctctc

SEQ ID NO: 958944 - DNA, 22 bp, Homo sapiens
gctcttggaaagctgatgatgt

SEQ ID NO: 958945 - DNA, 18 bp, Homo sapiens
gctcttggaagagctctt

SEQ ID NO: 958946 - DNA, 22 bp, Homo sapiens
gctcttggcattttcctcgcct

SEQ ID NO: 958947 - DNA, 17 bp, Homo sapiens
gctcttggctgacccct

SEQ ID NO: 958948 - DNA, 18 bp, Homo sapiens
gctcttggctgacccctc

SEQ ID NO: 958949 - DNA, 23 bp, Homo sapiens
gctcttggcttccagaaggcagc

SEQ ID NO: 958950 - DNA, 24 bp, Homo sapiens
gctcttggggttcataggggcagg

SEQ ID NO: 958951 - DNA, 20 bp, Homo sapiens
gctcttggtccctggtccct

SEQ ID NO: 958952 - DNA, 17 bp, Homo sapiens
gctcttgtttcactcca

SEQ ID NO: 958953 - DNA, 22 bp, Homo sapiens
gctcttgtttttattaatttat

SEQ ID NO: 958954 - DNA, 23 bp, Homo sapiens
gctcttgtttttattaatttata

SEQ ID NO: 958955 - DNA, 23 bp, Homo sapiens
gctctttccaaattaaaacaaat

SEQ ID NO: 958956 - DNA, 18 bp, Homo sapiens
gctctttccttgctcaac

SEQ ID NO: 958957 - DNA, 17 bp, Homo sapiens
gctctttctctgccagt

SEQ ID NO: 958958 - DNA, 19 bp, Homo sapiens
gctctttgacaactaaaat

SEQ ID NO: 958959 - DNA, 13 bp, Homo sapiens
gctctttggtaga

SEQ ID NO: 958960 - DNA, 13 bp, Homo sapiens
gctcttttccact

SEQ ID NO: 958961 - DNA, 19 bp, Homo sapiens
gctcttttctaagtggcgt

SEQ ID NO: 958962 - DNA, 22 bp, Homo sapiens
gctcttttttgtttgtttcttt

SEQ ID NO: 958963 - DNA, 19 bp, Homo sapiens
gctgaaaaatcacatcctg

SEQ ID NO: 958964 - DNA, 20 bp, Homo sapiens
gctgaaaacctaagtccttt

SEQ ID NO: 958965 - DNA, 15 bp, Homo sapiens
gctgaaaagggcact

SEQ ID NO: 958966 - DNA, 20 bp, Homo sapiens
gctgaaacattccgaagagg

SEQ ID NO: 958967 - DNA, 13 bp, Homo sapiens
gctgaaagccaag

SEQ ID NO: 958968 - DNA, 19 bp, Homo sapiens
gctgaaatatccacccagc

SEQ ID NO: 958969 - DNA, 16 bp, Homo sapiens
gctgaaatgctgcatt

SEQ ID NO: 958970 - DNA, 14 bp, Homo sapiens
gctgaaattctcct

SEQ ID NO: 958971 - DNA, 16 bp, Homo sapiens
gctgaaattttagaaa

SEQ ID NO: 958972 - DNA, 17 bp, Homo sapiens
gctgaaattttagaaat

SEQ ID NO: 958973 - DNA, 22 bp, Homo sapiens
gctgaacacagtgtctgttcag

SEQ ID NO: 958974 - DNA, 22 bp, Homo sapiens
gctgaacacatttgcccaattc

SEQ ID NO: 958975 - DNA, 22 bp, Homo sapiens
gctgaacagtggaggaagaggg

SEQ ID NO: 958976 - DNA, 19 bp, Homo sapiens
gctgaacattgttctgaac

SEQ ID NO: 958977 - DNA, 13 bp, Homo sapiens
gctgaaccctgtg

SEQ ID NO: 958978 - DNA, 20 bp, Homo sapiens
gctgaaccctgtgctggtgt

SEQ ID NO: 958979 - DNA, 16 bp, Homo sapiens
gctgaacggggagaaa

SEQ ID NO: 958980 - DNA, 22 bp, Homo sapiens
gctgaactgagaaggcaggcct

SEQ ID NO: 958981 - DNA, 23 bp, Homo sapiens
gctgaactgtgcatcaaccagga

SEQ ID NO: 958982 - DNA, 13 bp, Homo sapiens
gctgaacttggag

SEQ ID NO: 958983 - DNA, 19 bp, Homo sapiens
gctgaagacatgtttcaag

SEQ ID NO: 958984 - DNA, 15 bp, Homo sapiens
gctgaagacattcaa

SEQ ID NO: 958985 - DNA, 14 bp, Homo sapiens
gctgaagagaggga

SEQ ID NO: 958986 - DNA, 16 bp, Homo sapiens
gctgaagagagggaca

SEQ ID NO: 958987 - DNA, 15 bp, Homo sapiens
gctgaagagcaaggt

SEQ ID NO: 958988 - DNA, 20 bp, Homo sapiens
gctgaagatgcccctgctcc

SEQ ID NO: 958989 - DNA, 13 bp, Homo sapiens
gctgaagatggca

SEQ ID NO: 958990 - DNA, 14 bp, Homo sapiens
gctgaagcccccct

SEQ ID NO: 958991 - DNA, 20 bp, Homo sapiens
gctgaagggaccttgaaggg

SEQ ID NO: 958992 - DNA, 10 bp, Homo sapiens
gctgaatcca

SEQ ID NO: 958993 - DNA, 18 bp, Homo sapiens
gctgaatgccccctgctt

SEQ ID NO: 958994 - DNA, 19 bp, Homo sapiens
gctgaatgcctcctgtggg

SEQ ID NO: 958995 - DNA, 17 bp, Homo sapiens
gctgaatggttttcaaa

SEQ ID NO: 958996 - DNA, 20 bp, Homo sapiens
gctgaatgttgggactgcta

SEQ ID NO: 958997 - DNA, 16 bp, Homo sapiens
gctgaattaaaatggt

SEQ ID NO: 958998 - DNA, 17 bp, Homo sapiens
gctgaattgtttataat

SEQ ID NO: 958999 - DNA, 13 bp, Homo sapiens
gctgaatttctaa

SEQ ID NO: 959000 - DNA, 23 bp, Homo sapiens
gctgacaaccaccgctccccagc

SEQ ID NO: 959001 - DNA, 15 bp, Homo sapiens
gctgacacagaggct

SEQ ID NO: 959002 - DNA, 14 bp, Homo sapiens
gctgacacctacca

SEQ ID NO: 959003 - DNA, 21 bp, Homo sapiens
gctgacacctaccatgctgct

SEQ ID NO: 959004 - DNA, 14 bp, Homo sapiens
gctgacagctgctc

SEQ ID NO: 959005 - DNA, 15 bp, Homo sapiens
gctgacagctgctcc

SEQ ID NO: 959006 - DNA, 17 bp, Homo sapiens
gctgacagctgctccta

SEQ ID NO: 959007 - DNA, 18 bp, Homo sapiens
gctgacaggtgatgctct

SEQ ID NO: 959008 - DNA, 13 bp, Homo sapiens
gctgacatctgtg

SEQ ID NO: 959009 - DNA, 16 bp, Homo sapiens
gctgacatctgtgttt

SEQ ID NO: 959010 - DNA, 19 bp, Homo sapiens
gctgacatctgtgtttcaa

SEQ ID NO: 959011 - DNA, 16 bp, Homo sapiens
gctgacattcacctgc

SEQ ID NO: 959012 - DNA, 15 bp, Homo sapiens
gctgaccaattgtgc

SEQ ID NO: 959013 - DNA, 21 bp, Homo sapiens
gctgaccaattgtgctgccat

SEQ ID NO: 959014 - DNA, 17 bp, Homo sapiens
gctgaccatgcgtcagg

SEQ ID NO: 959015 - DNA, 20 bp, Homo sapiens
gctgaccatgcgtcaggggc

SEQ ID NO: 959016 - DNA, 22 bp, Homo sapiens
gctgacccagcatctcccagca

SEQ ID NO: 959017 - DNA, 12 bp, Homo sapiens
tctctacccccc

SEQ ID NO: 959018 - DNA, 15 bp, Homo sapiens
tctctacccctttct

SEQ ID NO: 959019 - DNA, 22 bp, Homo sapiens
gctgagttacttgtctgaggcc

SEQ ID NO: 959020 - DNA, 15 bp, Homo sapiens
gctgagttctgggtt

SEQ ID NO: 959021 - DNA, 15 bp, Homo sapiens
gctgagttgttctaa

SEQ ID NO: 959022 - DNA, 13 bp, Homo sapiens
tctctgcatctga

SEQ ID NO: 959023 - DNA, 13 bp, Homo sapiens
tctctgccaagat

SEQ ID NO: 959024 - DNA, 15 bp, Homo sapiens
tctctgccacccact

SEQ ID NO: 959025 - DNA, 16 bp, Homo sapiens
tctctgccacccactc

SEQ ID NO: 959026 - DNA, 17 bp, Homo sapiens
tctctgccacccactca

SEQ ID NO: 959027 - DNA, 14 bp, Homo sapiens
tctctgccagtgac

SEQ ID NO: 959028 - DNA, 21 bp, Homo sapiens
tctctgccagtgacagacagg

SEQ ID NO: 959029 - DNA, 17 bp, Homo sapiens
tctctgcccgggcccct

SEQ ID NO: 959030 - DNA, 20 bp, Homo sapiens
tctctgcccttgatcagccc

SEQ ID NO: 959031 - DNA, 15 bp, Homo sapiens
tctctgccggctctt

SEQ ID NO: 959032 - DNA, 21 bp, Homo sapiens
tctctgccggctctttccttg

SEQ ID NO: 959033 - DNA, 11 bp, Homo sapiens
tctctgcctct

SEQ ID NO: 959034 - DNA, 12 bp, Homo sapiens
tctctgcctctg

SEQ ID NO: 959035 - DNA, 14 bp, Homo sapiens
tctctgcctctggg

SEQ ID NO: 959036 - DNA, 21 bp, Homo sapiens
tctctgcgtgcagggacaaag

SEQ ID NO: 959037 - DNA, 18 bp, Homo sapiens
tctctgctcatgggtggc

SEQ ID NO: 959038 - DNA, 13 bp, Homo sapiens
tctctgctccacc

SEQ ID NO: 959039 - DNA, 17 bp, Homo sapiens
tctctgctccaccacat

SEQ ID NO: 959040 - DNA, 12 bp, Homo sapiens
tctctgctccag

SEQ ID NO: 959041 - DNA, 11 bp, Homo sapiens
tctctgctcct

SEQ ID NO: 959042 - DNA, 13 bp, Homo sapiens
tctctgctccttc

SEQ ID NO: 959043 - DNA, 22 bp, Homo sapiens
tctctgctccttcactgttccc

SEQ ID NO: 959044 - DNA, 23 bp, Homo sapiens
tctctgctctgcgtgtcacctgt

SEQ ID NO: 959045 - DNA, 13 bp, Homo sapiens
tctctgctgaagg

SEQ ID NO: 959046 - DNA, 14 bp, Homo sapiens
tctctgctgagctg

SEQ ID NO: 959047 - DNA, 15 bp, Homo sapiens
tctctgctgcatctt

SEQ ID NO: 959048 - DNA, 14 bp, Homo sapiens
tctctgctgcctct

SEQ ID NO: 959049 - DNA, 19 bp, Homo sapiens
tctctgctgcctctgtgga

SEQ ID NO: 959050 - DNA, 17 bp, Homo sapiens
tctctgcttacccttca

SEQ ID NO: 959051 - DNA, 19 bp, Homo sapiens
tctctgcttacccttcacc

SEQ ID NO: 959052 - DNA, 22 bp, Homo sapiens
tctctgcttactaatgtgcccc

SEQ ID NO: 959053 - DNA, 13 bp, Homo sapiens
tctctgcttccat

SEQ ID NO: 959054 - DNA, 14 bp, Homo sapiens
tctctgcttccatg

SEQ ID NO: 959055 - DNA, 17 bp, Homo sapiens
tctctgctttccttttc

SEQ ID NO: 959056 - DNA, 14 bp, Homo sapiens
tctctggaaagagg

SEQ ID NO: 959057 - DNA, 20 bp, Homo sapiens
tctctggaagcccctgggcc

SEQ ID NO: 959058 - DNA, 12 bp, Homo sapiens
tctctggagcca

SEQ ID NO: 959059 - DNA, 18 bp, Homo sapiens
tctctggagccagagaga

SEQ ID NO: 959060 - DNA, 22 bp, Homo sapiens
tctctggagtgatggtgtcctt

SEQ ID NO: 959061 - DNA, 23 bp, Homo sapiens
tctctggagtgatggtgtccttc

SEQ ID NO: 959062 - DNA, 13 bp, Homo sapiens
tctctggcccaga

SEQ ID NO: 959063 - DNA, 17 bp, Homo sapiens
tctctggcgacagtttt

SEQ ID NO: 959064 - DNA, 22 bp, Homo sapiens
tctctggcgacagttttccttc

SEQ ID NO: 959065 - DNA, 15 bp, Homo sapiens
tctctggctggtctt

SEQ ID NO: 959066 - DNA, 13 bp, Homo sapiens
tctctggcttctg

SEQ ID NO: 959067 - DNA, 15 bp, Homo sapiens
tctctgggacctagg

SEQ ID NO: 959068 - DNA, 16 bp, Homo sapiens
tctctgggactctcct

SEQ ID NO: 959069 - DNA, 13 bp, Homo sapiens
tctctgggagaaa

SEQ ID NO: 959070 - DNA, 16 bp, Homo sapiens
tctctgggagaaaatc

SEQ ID NO: 959071 - DNA, 17 bp, Homo sapiens
tctctgggagaaaatca

SEQ ID NO: 959072 - DNA, 19 bp, Homo sapiens
tctctgggagaaaatcatc

SEQ ID NO: 959073 - DNA, 11 bp, Homo sapiens
tctctgggcct

SEQ ID NO: 959074 - DNA, 13 bp, Homo sapiens
tctctgggcctgt

SEQ ID NO: 959075 - DNA, 15 bp, Homo sapiens
tctctgggcctgtgt

SEQ ID NO: 959076 - DNA, 20 bp, Homo sapiens
tctctgggcctgtgtgtggg

SEQ ID NO: 959077 - DNA, 15 bp, Homo sapiens
tctctggggaccctc

SEQ ID NO: 959078 - DNA, 19 bp, Homo sapiens
tctctggggaccctccaga

SEQ ID NO: 959079 - DNA, 21 bp, Homo sapiens
tctctggggaccctccagagg

SEQ ID NO: 959080 - DNA, 19 bp, Homo sapiens
tctctgggggaggcagggc

SEQ ID NO: 959081 - DNA, 22 bp, Homo sapiens
tctctgggggaggcagggctgg

SEQ ID NO: 959082 - DNA, 23 bp, Homo sapiens
tctctgggggaggcagggctgga

SEQ ID NO: 959083 - DNA, 16 bp, Homo sapiens
tctctgggtcagaacc

SEQ ID NO: 959084 - DNA, 18 bp, Homo sapiens
tctctgggtcagaaccag

SEQ ID NO: 959085 - DNA, 23 bp, Homo sapiens
tctctggttttcttgccaccctc

SEQ ID NO: 959086 - DNA, 12 bp, Homo sapiens
tctctgtaaagc

SEQ ID NO: 959087 - DNA, 14 bp, Homo sapiens
tctctgtaaagcta

SEQ ID NO: 959088 - DNA, 18 bp, Homo sapiens
tctctgtaggatcgtaaa

SEQ ID NO: 959089 - DNA, 19 bp, Homo sapiens
tctctgtcacccttgtcct

SEQ ID NO: 959090 - DNA, 15 bp, Homo sapiens
tctctgtcccttgct

SEQ ID NO: 959091 - DNA, 15 bp, Homo sapiens
tctctgtcctacttc

SEQ ID NO: 959092 - DNA, 17 bp, Homo sapiens
tctctgtcgtggacacg

SEQ ID NO: 959093 - DNA, 12 bp, Homo sapiens
tctctgtctcat

SEQ ID NO: 959094 - DNA, 21 bp, Homo sapiens
tctctgtctcatccatcatca

SEQ ID NO: 959095 - DNA, 23 bp, Homo sapiens
tctctgtctgtctctccccctct

SEQ ID NO: 959096 - DNA, 14 bp, Homo sapiens
tctctgtcttctct

SEQ ID NO: 959097 - DNA, 20 bp, Homo sapiens
tctctgtgaatacaattaaa

SEQ ID NO: 959098 - DNA, 22 bp, Homo sapiens
tctctgtgctttgactcacctg

SEQ ID NO: 959099 - DNA, 24 bp, Homo sapiens
tctctgtggaaaagccatctcagg

SEQ ID NO: 959100 - DNA, 20 bp, Homo sapiens
tctctgtgtttgttcctaca

SEQ ID NO: 959101 - DNA, 12 bp, Homo sapiens
tctctgttaaca

SEQ ID NO: 959102 - DNA, 21 bp, Homo sapiens
tctctgttcagatgtgcattt

SEQ ID NO: 959103 - DNA, 14 bp, Homo sapiens
tctctgttcccttc

SEQ ID NO: 959104 - DNA, 17 bp, Homo sapiens
tctctgttggtccactg

SEQ ID NO: 959105 - DNA, 23 bp, Homo sapiens
tctctgttggtccactgtgttta

SEQ ID NO: 959106 - DNA, 22 bp, Homo sapiens
tctcttaaatgcaagtgcctag

SEQ ID NO: 959107 - DNA, 13 bp, Homo sapiens
tctcttaaatttt

SEQ ID NO: 959108 - DNA, 17 bp, Homo sapiens
tctcttaatattgagaa

SEQ ID NO: 959109 - DNA, 18 bp, Homo sapiens
tctcttaatcactactgt

SEQ ID NO: 959110 - DNA, 18 bp, Homo sapiens
tctcttaatttaatcttt

SEQ ID NO: 959111 - DNA, 22 bp, Homo sapiens
tctcttacattttcgtcctgta

SEQ ID NO: 959112 - DNA, 21 bp, Homo sapiens
tctcttaccgcgagactgaga

SEQ ID NO: 959113 - DNA, 14 bp, Homo sapiens
tctcttacctgtta

SEQ ID NO: 959114 - DNA, 15 bp, Homo sapiens
tctcttagaaatact

SEQ ID NO: 959115 - DNA, 13 bp, Homo sapiens
tctcttagaagcc

SEQ ID NO: 959116 - DNA, 14 bp, Homo sapiens
tctcttagaagcca

SEQ ID NO: 959117 - DNA, 16 bp, Homo sapiens
tctcttagctactgta

SEQ ID NO: 959118 - DNA, 16 bp, Homo sapiens
tctcttaggtctaatg

SEQ ID NO: 959119 - DNA, 21 bp, Homo sapiens
tctcttaggtgagacagttgc

SEQ ID NO: 959120 - DNA, 20 bp, Homo sapiens
tctcttcaagcatcctcaga

SEQ ID NO: 959121 - DNA, 17 bp, Homo sapiens
tctcttcactaccctga

SEQ ID NO: 959122 - DNA, 24 bp, Homo sapiens
tctcttcaggaggccctggtgtca

SEQ ID NO: 959123 - DNA, 13 bp, Homo sapiens
tctcttcaggttc

SEQ ID NO: 959124 - DNA, 9 bp, Homo sapiens
tctcttcat

SEQ ID NO: 959125 - DNA, 14 bp, Homo sapiens
tctcttcatacttt

SEQ ID NO: 959126 - DNA, 12 bp, Homo sapiens
tctcttcccagg

SEQ ID NO: 959127 - DNA, 15 bp, Homo sapiens
tctcttcccaggcct

SEQ ID NO: 959128 - DNA, 18 bp, Homo sapiens
tctcttcccaggcctttg

SEQ ID NO: 959129 - DNA, 12 bp, Homo sapiens
tctcttccctat

SEQ ID NO: 959130 - DNA, 17 bp, Homo sapiens
tctcttccctgcgcctg

SEQ ID NO: 959131 - DNA, 14 bp, Homo sapiens
tctcttccgggagc

SEQ ID NO: 959132 - DNA, 13 bp, Homo sapiens
tctcttcctctgt

SEQ ID NO: 959133 - DNA, 12 bp, Homo sapiens
tctcttccttga

SEQ ID NO: 959134 - DNA, 20 bp, Homo sapiens
tctcttcctttgctctgagg

SEQ ID NO: 959135 - DNA, 19 bp, Homo sapiens
tctcttcgtcctgatccct

SEQ ID NO: 959136 - DNA, 14 bp, Homo sapiens
tctcttctcagagt

SEQ ID NO: 959137 - DNA, 19 bp, Homo sapiens
tctcttctcagagtggtgg

SEQ ID NO: 959138 - DNA, 11 bp, Homo sapiens
tctcttctcca

SEQ ID NO: 959139 - DNA, 16 bp, Homo sapiens
tctcttctcccagaat

SEQ ID NO: 959140 - DNA, 22 bp, Homo sapiens
tctcttctgagctatttcatct

SEQ ID NO: 959141 - DNA, 19 bp, Homo sapiens
tctcttctgggttccttcc

SEQ ID NO: 959142 - DNA, 16 bp, Homo sapiens
gctgccaaggccagag

SEQ ID NO: 959143 - DNA, 17 bp, Homo sapiens
gctgccacacttcaggc

SEQ ID NO: 959144 - DNA, 15 bp, Homo sapiens
gctgccaccacgtct

SEQ ID NO: 959145 - DNA, 16 bp, Homo sapiens
gctgccaccacgtctg

SEQ ID NO: 959146 - DNA, 21 bp, Homo sapiens
gctgccaccacgtctgccagg

SEQ ID NO: 959147 - DNA, 22 bp, Homo sapiens
gctgccaccacgtctgccaggc

SEQ ID NO: 959148 - DNA, 23 bp, Homo sapiens
gctgccaccacgtctgccaggcc

SEQ ID NO: 959149 - DNA, 14 bp, Homo sapiens
gctgccaccagccc

SEQ ID NO: 959150 - DNA, 19 bp, Homo sapiens
gctgccacccacctccctg

SEQ ID NO: 959151 - DNA, 14 bp, Homo sapiens
tctcttgagagggt

SEQ ID NO: 959152 - DNA, 15 bp, Homo sapiens
tctcttgagcatcaa

SEQ ID NO: 959153 - DNA, 16 bp, Homo sapiens
tctcttgagcatcaat

SEQ ID NO: 959154 - DNA, 23 bp, Homo sapiens
tctcttgagcatcaatcttgtta

SEQ ID NO: 959155 - DNA, 15 bp, Homo sapiens
tctcttgagcctggg

SEQ ID NO: 959156 - DNA, 15 bp, Homo sapiens
tctcttgagctggcc

SEQ ID NO: 959157 - DNA, 15 bp, Homo sapiens
tctcttgagtttgtc

SEQ ID NO: 959158 - DNA, 22 bp, Homo sapiens
tctcttgcaccaaattatcttg

SEQ ID NO: 959159 - DNA, 12 bp, Homo sapiens
tctcttgcaccc

SEQ ID NO: 959160 - DNA, 13 bp, Homo sapiens
tctcttgcacccg

SEQ ID NO: 959161 - DNA, 13 bp, Homo sapiens
tctcttgccagca

SEQ ID NO: 959162 - DNA, 21 bp, Homo sapiens
tctcttgccatttgtagcttt

SEQ ID NO: 959163 - DNA, 15 bp, Homo sapiens
tctcttgcccttcct

SEQ ID NO: 959164 - DNA, 22 bp, Homo sapiens
tctcttgcctaagtattccttt

SEQ ID NO: 959165 - DNA, 16 bp, Homo sapiens
tctcttgggaactgaa

SEQ ID NO: 959166 - DNA, 20 bp, Homo sapiens
tctcttgggagtcttgggtg

SEQ ID NO: 959167 - DNA, 14 bp, Homo sapiens
tctcttgggcaggc

SEQ ID NO: 959168 - DNA, 16 bp, Homo sapiens
tctcttgggcaggcag

SEQ ID NO: 959169 - DNA, 22 bp, Homo sapiens
tctcttggtgaaataataaaat

SEQ ID NO: 959170 - DNA, 17 bp, Homo sapiens
tctcttgtaccatagaa

SEQ ID NO: 959171 - DNA, 19 bp, Homo sapiens
tctcttgtgacgtgcactg

SEQ ID NO: 959172 - DNA, 20 bp, Homo sapiens
tctcttgtgacgtgcactgt

SEQ ID NO: 959173 - DNA, 16 bp, Homo sapiens
tctcttgtgcatttgg

SEQ ID NO: 959174 - DNA, 14 bp, Homo sapiens
tctcttgtttgtct

SEQ ID NO: 959175 - DNA, 22 bp, Homo sapiens
tctctttaaaaaagactgaaca

SEQ ID NO: 959176 - DNA, 14 bp, Homo sapiens
tctctttaaaagct

SEQ ID NO: 959177 - DNA, 16 bp, Homo sapiens
tctctttaaccctccc

SEQ ID NO: 959178 - DNA, 16 bp, Homo sapiens
tctctttaatcttcag

SEQ ID NO: 959179 - DNA, 15 bp, Homo sapiens
tctctttacattttg

SEQ ID NO: 959180 - DNA, 21 bp, Homo sapiens
tctctttaccttctaaaagcc

SEQ ID NO: 959181 - DNA, 17 bp, Homo sapiens
tctctttagtataattg

SEQ ID NO: 959182 - DNA, 13 bp, Homo sapiens
tctctttccccca

SEQ ID NO: 959183 - DNA, 11 bp, Homo sapiens
tctctttcctt

SEQ ID NO: 959184 - DNA, 22 bp, Homo sapiens
tctctttccttgagctgttgtg

SEQ ID NO: 959185 - DNA, 17 bp, Homo sapiens
tctctttctctcttccc

SEQ ID NO: 959186 - DNA, 12 bp, Homo sapiens
tctctttctctg

SEQ ID NO: 959187 - DNA, 14 bp, Homo sapiens
tctctttctctggt

SEQ ID NO: 959188 - DNA, 13 bp, Homo sapiens
tctctttcttcct

SEQ ID NO: 959189 - DNA, 20 bp, Homo sapiens
tctctttcttcctttacttt

SEQ ID NO: 959190 - DNA, 19 bp, Homo sapiens
tctctttgattatttgcat

SEQ ID NO: 959191 - DNA, 14 bp, Homo sapiens
tctctttggaaata

SEQ ID NO: 959192 - DNA, 21 bp, Homo sapiens
tctctttgtctgccttcccaa

SEQ ID NO: 959193 - DNA, 17 bp, Homo sapiens
tctctttgttctaaaga

SEQ ID NO: 959194 - DNA, 21 bp, Homo sapiens
tctcttttcccctttcctgtc

SEQ ID NO: 959195 - DNA, 18 bp, Homo sapiens
tctcttttcctctctgtc

SEQ ID NO: 959196 - DNA, 12 bp, Homo sapiens
tctcttttctct

SEQ ID NO: 959197 - DNA, 20 bp, Homo sapiens
tctcttttgaatccatgctt

SEQ ID NO: 959198 - DNA, 15 bp, Homo sapiens
tctcttttgctttct

SEQ ID NO: 959199 - DNA, 23 bp, Homo sapiens
tctctttttatttaaatgtgaat

SEQ ID NO: 959200 - DNA, 17 bp, Homo sapiens
tctctttttggaggtgc

SEQ ID NO: 959201 - DNA, 22 bp, Homo sapiens
tctcttttttattctgttttct

SEQ ID NO: 959202 - DNA, 16 bp, Homo sapiens
tctgaaaaacattcca

SEQ ID NO: 959203 - DNA, 12 bp, Homo sapiens
tctgaaaacaag

SEQ ID NO: 959204 - DNA, 22 bp, Homo sapiens
tctgaaaacacttgatgatgtg

SEQ ID NO: 959205 - DNA, 19 bp, Homo sapiens
tctgaaaacccaaggccag

SEQ ID NO: 959206 - DNA, 20 bp, Homo sapiens
tctgaaaacctaccagccag

SEQ ID NO: 959207 - DNA, 14 bp, Homo sapiens
tctgaaaatataac

SEQ ID NO: 959208 - DNA, 18 bp, Homo sapiens
tctgaaaatctccttcca

SEQ ID NO: 959209 - DNA, 17 bp, Homo sapiens
tctgaaacacacgagca

SEQ ID NO: 959210 - DNA, 17 bp, Homo sapiens
tctgaaacatggcctgt

SEQ ID NO: 959211 - DNA, 15 bp, Homo sapiens
tctgaaaccagtgtt

SEQ ID NO: 959212 - DNA, 23 bp, Homo sapiens
tctgaaacccacagatgtctctg

SEQ ID NO: 959213 - DNA, 21 bp, Homo sapiens
tctgaaagacagaatgtcacc

SEQ ID NO: 959214 - DNA, 13 bp, Homo sapiens
tctgaaaggaaat

SEQ ID NO: 959215 - DNA, 22 bp, Homo sapiens
tctgaaaggaaatacacttctt

SEQ ID NO: 959216 - DNA, 12 bp, Homo sapiens
tctgaaatctga

SEQ ID NO: 959217 - DNA, 15 bp, Homo sapiens
tctgaaatctgaaga

SEQ ID NO: 959218 - DNA, 17 bp, Homo sapiens
tctgaaatttttcttct

SEQ ID NO: 959219 - DNA, 20 bp, Homo sapiens
tctgaaatttttcttcttga

SEQ ID NO: 959220 - DNA, 14 bp, Homo sapiens
tctgaacaaacact

SEQ ID NO: 959221 - DNA, 15 bp, Homo sapiens
tctgaacaaacactg

SEQ ID NO: 959222 - DNA, 16 bp, Homo sapiens
tctgaacaaacactga

SEQ ID NO: 959223 - DNA, 16 bp, Homo sapiens
tctgaacaaagtgcta

SEQ ID NO: 959224 - DNA, 22 bp, Homo sapiens
tctgaacacagtttagtgcttt

SEQ ID NO: 959225 - DNA, 14 bp, Homo sapiens
tctgaactcaaact

SEQ ID NO: 959226 - DNA, 17 bp, Homo sapiens
tctgaactcaaactgag

SEQ ID NO: 959227 - DNA, 21 bp, Homo sapiens
tctgaactccatacagcctct

SEQ ID NO: 959228 - DNA, 14 bp, Homo sapiens
tctgaactccattt

SEQ ID NO: 959229 - DNA, 19 bp, Homo sapiens
tctgaactgcaacactgga

SEQ ID NO: 959230 - DNA, 17 bp, Homo sapiens
tctgaacttttgtggag

SEQ ID NO: 959231 - DNA, 22 bp, Homo sapiens
tctgaagacctcgagcagatga

SEQ ID NO: 959232 - DNA, 18 bp, Homo sapiens
tctgaagagcctgaagct

SEQ ID NO: 959233 - DNA, 20 bp, Homo sapiens
tctgaagatatatttcactt

SEQ ID NO: 959234 - DNA, 14 bp, Homo sapiens
tctgaagatggaag

SEQ ID NO: 959235 - DNA, 16 bp, Homo sapiens
tctgaagcaagagtga

SEQ ID NO: 959236 - DNA, 14 bp, Homo sapiens
tctgaagcatgttt

SEQ ID NO: 959237 - DNA, 17 bp, Homo sapiens
tctgaagcgactctcct

SEQ ID NO: 959238 - DNA, 19 bp, Homo sapiens
tctgaagcgactctcctgt

SEQ ID NO: 959239 - DNA, 18 bp, Homo sapiens
tctgaagcttgactccca

SEQ ID NO: 959240 - DNA, 22 bp, Homo sapiens
tctgaagcttgactcccaagtt

SEQ ID NO: 959241 - DNA, 15 bp, Homo sapiens
tctgaaggaagagaa

SEQ ID NO: 959242 - DNA, 20 bp, Homo sapiens
tctgaaggaatagccagaga

SEQ ID NO: 959243 - DNA, 19 bp, Homo sapiens
tctgaaggacacttcctgc

SEQ ID NO: 959244 - DNA, 21 bp, Homo sapiens
tctgaaggagccccattcctg

SEQ ID NO: 959245 - DNA, 19 bp, Homo sapiens
tctgaaggggcaaattctt

SEQ ID NO: 959246 - DNA, 21 bp, Homo sapiens
tctgaagtacaaacatgaaaa

SEQ ID NO: 959247 - DNA, 13 bp, Homo sapiens
tctgaagtactta

SEQ ID NO: 959248 - DNA, 21 bp, Homo sapiens
tctgaagtatggtattacaaa

SEQ ID NO: 959249 - DNA, 20 bp, Homo sapiens
tctgaagtcacatcacagga

SEQ ID NO: 959250 - DNA, 15 bp, Homo sapiens
tctgaagttggacag

SEQ ID NO: 959251 - DNA, 10 bp, Homo sapiens
tctgaataaa

SEQ ID NO: 959252 - DNA, 11 bp, Homo sapiens
tctgaataaaa

SEQ ID NO: 959253 - DNA, 19 bp, Homo sapiens
tctgaataaagtaattgta

SEQ ID NO: 959254 - DNA, 17 bp, Homo sapiens
tctgaataaagtgtaac

SEQ ID NO: 959255 - DNA, 13 bp, Homo sapiens
tctgaataacttg

SEQ ID NO: 959256 - DNA, 15 bp, Homo sapiens
tctgaataacttgaa

SEQ ID NO: 959257 - DNA, 15 bp, Homo sapiens
tctgaataatttctt

SEQ ID NO: 959258 - DNA, 16 bp, Homo sapiens
tctgaataatttctta

SEQ ID NO: 959259 - DNA, 15 bp, Homo sapiens
tctgaatacacagta

SEQ ID NO: 959260 - DNA, 16 bp, Homo sapiens
tctgaatattaaagct

SEQ ID NO: 959261 - DNA, 15 bp, Homo sapiens
tctgaatattttgta

SEQ ID NO: 959262 - DNA, 17 bp, Homo sapiens
tctgaatcagaaaagct

SEQ ID NO: 959263 - DNA, 19 bp, Homo sapiens
tctgaatctcaagatgggg

SEQ ID NO: 959264 - DNA, 14 bp, Homo sapiens
gctgcctgtcccca

SEQ ID NO: 959265 - DNA, 16 bp, Homo sapiens
gctgcctgtccccatg

SEQ ID NO: 959266 - DNA, 19 bp, Homo sapiens
gctgcctgtgccatgccca

SEQ ID NO: 959267 - DNA, 16 bp, Homo sapiens
gctgccttccctagct

SEQ ID NO: 959268 - DNA, 22 bp, Homo sapiens
gctgcctttatcttgaagtcag

SEQ ID NO: 959269 - DNA, 23 bp, Homo sapiens
gctgcctttatcttgaagtcagc

SEQ ID NO: 959270 - DNA, 23 bp, Homo sapiens
gctgcctttgtccccacacagcc

SEQ ID NO: 959271 - DNA, 15 bp, Homo sapiens
gctgcgatactggca

SEQ ID NO: 959272 - DNA, 19 bp, Homo sapiens
gctgcgcccttaccttccc

SEQ ID NO: 959273 - DNA, 13 bp, Homo sapiens
gctgcgccggaca

SEQ ID NO: 959274 - DNA, 19 bp, Homo sapiens
gctgcgcctgcaggcagag

SEQ ID NO: 959275 - DNA, 17 bp, Homo sapiens
gctgcgcggactcgccc

SEQ ID NO: 959276 - DNA, 15 bp, Homo sapiens
gctgcgctagcagcc

SEQ ID NO: 959277 - DNA, 16 bp, Homo sapiens
gctgcgctagcagccc

SEQ ID NO: 959278 - DNA, 20 bp, Homo sapiens
gctgcgctagcagcccttgt

SEQ ID NO: 959279 - DNA, 20 bp, Homo sapiens
tctgacaaaatggggcagaa

SEQ ID NO: 959280 - DNA, 22 bp, Homo sapiens
tctgacaaaatggggcagaaga

SEQ ID NO: 959281 - DNA, 14 bp, Homo sapiens
tctgacacaaaaaa

SEQ ID NO: 959282 - DNA, 18 bp, Homo sapiens
tctgacactttctgctgg

SEQ ID NO: 959283 - DNA, 18 bp, Homo sapiens
tctgacagcagcctgtga

SEQ ID NO: 959284 - DNA, 19 bp, Homo sapiens
tctgacagcagcctgtgag

SEQ ID NO: 959285 - DNA, 23 bp, Homo sapiens
tctgacagcagcctgtgagggag

SEQ ID NO: 959286 - DNA, 23 bp, Homo sapiens
tctgacagcaggccactagtgac

SEQ ID NO: 959287 - DNA, 22 bp, Homo sapiens
tctgacaggcgcaactcctcca

SEQ ID NO: 959288 - DNA, 18 bp, Homo sapiens
tctgacagtccacagggg

SEQ ID NO: 959289 - DNA, 18 bp, Homo sapiens
tctgacatcccttcctgg

SEQ ID NO: 959290 - DNA, 20 bp, Homo sapiens
tctgacatcccttcctggaa

SEQ ID NO: 959291 - DNA, 12 bp, Homo sapiens
tctgacatgtaa

SEQ ID NO: 959292 - DNA, 18 bp, Homo sapiens
tctgacatgtaagaaaat

SEQ ID NO: 959293 - DNA, 22 bp, Homo sapiens
tctgacatgtaagaaaatgtta

SEQ ID NO: 959294 - DNA, 20 bp, Homo sapiens
tctgacatgtttgtgctctg

SEQ ID NO: 959295 - DNA, 22 bp, Homo sapiens
tctgacatgtttgtgctctgtt

SEQ ID NO: 959296 - DNA, 17 bp, Homo sapiens
tctgacattctgattcg

SEQ ID NO: 959297 - DNA, 22 bp, Homo sapiens
tctgaccacacttcctgtccag

SEQ ID NO: 959298 - DNA, 17 bp, Homo sapiens
tctgaccagcagcgcct

SEQ ID NO: 959299 - DNA, 18 bp, Homo sapiens
tctgaccagcagcgcctt

SEQ ID NO: 959300 - DNA, 17 bp, Homo sapiens
tctgacccaaagcaaaa

SEQ ID NO: 959301 - DNA, 21 bp, Homo sapiens
tctgacccagggcctaggacg

SEQ ID NO: 959302 - DNA, 21 bp, Homo sapiens
tctgacccagtgagattacag

SEQ ID NO: 959303 - DNA, 21 bp, Homo sapiens
tctgaccccagtggaaaacaa

SEQ ID NO: 959304 - DNA, 18 bp, Homo sapiens
tctgaccccggggggctg

SEQ ID NO: 959305 - DNA, 21 bp, Homo sapiens
tctgacccggttgcagtcact

SEQ ID NO: 959306 - DNA, 22 bp, Homo sapiens
tctgacccggttgcagtcactg

SEQ ID NO: 959307 - DNA, 14 bp, Homo sapiens
tctgaccctcccag

SEQ ID NO: 959308 - DNA, 14 bp, Homo sapiens
tctgaccctccttc

SEQ ID NO: 959309 - DNA, 23 bp, Homo sapiens
tctgacccttacagcctctgact

SEQ ID NO: 959310 - DNA, 15 bp, Homo sapiens
tctgaccgattcctt

SEQ ID NO: 959311 - DNA, 17 bp, Homo sapiens
tctgaccgattccttta

SEQ ID NO: 959312 - DNA, 17 bp, Homo sapiens
tctgaccgttttcactt

SEQ ID NO: 959313 - DNA, 12 bp, Homo sapiens
tctgacctgcag

SEQ ID NO: 959314 - DNA, 17 bp, Homo sapiens
tctgacctgcaggccaa

SEQ ID NO: 959315 - DNA, 18 bp, Homo sapiens
tctgacgcaccactgcca

SEQ ID NO: 959316 - DNA, 19 bp, Homo sapiens
tctgacgcaccactgccaa

SEQ ID NO: 959317 - DNA, 13 bp, Homo sapiens
tctgacgcttgtg

SEQ ID NO: 959318 - DNA, 18 bp, Homo sapiens
tctgacgcttgtgacagt

SEQ ID NO: 959319 - DNA, 22 bp, Homo sapiens
tctgacgcttgtgacagtgcct

SEQ ID NO: 959320 - DNA, 23 bp, Homo sapiens
tctgacgtgccttttgcacccct

SEQ ID NO: 959321 - DNA, 14 bp, Homo sapiens
tctgactactttgc

SEQ ID NO: 959322 - DNA, 14 bp, Homo sapiens
tctgactaggctga

SEQ ID NO: 959323 - DNA, 17 bp, Homo sapiens
tctgactaggctgatca

SEQ ID NO: 959324 - DNA, 20 bp, Homo sapiens
tctgactagtagatttctat

SEQ ID NO: 959325 - DNA, 16 bp, Homo sapiens
tctgactcacaagaag

SEQ ID NO: 959326 - DNA, 13 bp, Homo sapiens
tctgactcagggc

SEQ ID NO: 959327 - DNA, 14 bp, Homo sapiens
tctgactcagggct

SEQ ID NO: 959328 - DNA, 20 bp, Homo sapiens
tctgactcagggctcctggg

SEQ ID NO: 959329 - DNA, 22 bp, Homo sapiens
tctgactcatccccacagctgg

SEQ ID NO: 959330 - DNA, 12 bp, Homo sapiens
tctgactccaga

SEQ ID NO: 959331 - DNA, 19 bp, Homo sapiens
tctgactccagagtctgag

SEQ ID NO: 959332 - DNA, 18 bp, Homo sapiens
tctgactcggtttctcca

SEQ ID NO: 959333 - DNA, 19 bp, Homo sapiens
tctgactcggtttctccaa

SEQ ID NO: 959334 - DNA, 20 bp, Homo sapiens
tctgactcggtttctccaaa

SEQ ID NO: 959335 - DNA, 14 bp, Homo sapiens
tctgactctgggtt

SEQ ID NO: 959336 - DNA, 21 bp, Homo sapiens
tctgactgtccaggagctaat

SEQ ID NO: 959337 - DNA, 16 bp, Homo sapiens
tctgactgtccctgcc

SEQ ID NO: 959338 - DNA, 14 bp, Homo sapiens
tctgacttcctctg

SEQ ID NO: 959339 - DNA, 15 bp, Homo sapiens
tctgacttctagctg

SEQ ID NO: 959340 - DNA, 12 bp, Homo sapiens
tctgacttctgc

SEQ ID NO: 959341 - DNA, 14 bp, Homo sapiens
tctgacttctgcct

SEQ ID NO: 959342 - DNA, 14 bp, Homo sapiens
tctgactttacttg

SEQ ID NO: 959343 - DNA, 18 bp, Homo sapiens
tctgactttacttgtggt

SEQ ID NO: 959344 - DNA, 22 bp, Homo sapiens
tctgagaaaatgcgagactctg

SEQ ID NO: 959345 - DNA, 20 bp, Homo sapiens
tctgagaaacctgttgaaga

SEQ ID NO: 959346 - DNA, 17 bp, Homo sapiens
tctgagaagaggtcctt

SEQ ID NO: 959347 - DNA, 16 bp, Homo sapiens
tctgagaagctctgaa

SEQ ID NO: 959348 - DNA, 18 bp, Homo sapiens
tctgagaatcacggtggt

SEQ ID NO: 959349 - DNA, 19 bp, Homo sapiens
tctgagaatctttattgag

SEQ ID NO: 959350 - DNA, 18 bp, Homo sapiens
tctgagaattccaaggag

SEQ ID NO: 959351 - DNA, 14 bp, Homo sapiens
tctgagaggctctc

SEQ ID NO: 959352 - DNA, 15 bp, Homo sapiens
tctgagaggctctcc

SEQ ID NO: 959353 - DNA, 20 bp, Homo sapiens
tctgagaggctctccgtgca

SEQ ID NO: 959354 - DNA, 15 bp, Homo sapiens
tctgagcaagagctg

SEQ ID NO: 959355 - DNA, 15 bp, Homo sapiens
tctgagcaccccctc

SEQ ID NO: 959356 - DNA, 19 bp, Homo sapiens
tctgagcaccgaatattga

SEQ ID NO: 959357 - DNA, 12 bp, Homo sapiens
tctgagcagggg

SEQ ID NO: 959358 - DNA, 15 bp, Homo sapiens
tctgagcaggggcag

SEQ ID NO: 959359 - DNA, 16 bp, Homo sapiens
tctgagcaggggcagg

SEQ ID NO: 959360 - DNA, 17 bp, Homo sapiens
tctgagcaggggcaggc

SEQ ID NO: 959361 - DNA, 18 bp, Homo sapiens
tctgagcaggggcaggcg

SEQ ID NO: 959362 - DNA, 21 bp, Homo sapiens
tctgagcaggggcaggcgcag

SEQ ID NO: 959363 - DNA, 15 bp, Homo sapiens
tctgagcccgggctg

SEQ ID NO: 959364 - DNA, 17 bp, Homo sapiens
tctgagcccgggctgcc

SEQ ID NO: 959365 - DNA, 21 bp, Homo sapiens
tctgagcccgggctgcctggg

SEQ ID NO: 959366 - DNA, 11 bp, Homo sapiens
tctgagccctg

SEQ ID NO: 959367 - DNA, 20 bp, Homo sapiens
tctgagccctggtgtgtttc

SEQ ID NO: 959368 - DNA, 18 bp, Homo sapiens
tctgagccttgagagaaa

SEQ ID NO: 959369 - DNA, 16 bp, Homo sapiens
tctgagcgggaggcag

SEQ ID NO: 959370 - DNA, 18 bp, Homo sapiens
tctgagctccacctctgg

SEQ ID NO: 959371 - DNA, 14 bp, Homo sapiens
tctgagctgctcac

SEQ ID NO: 959372 - DNA, 17 bp, Homo sapiens
tctgagctggggaggtg

SEQ ID NO: 959373 - DNA, 20 bp, Homo sapiens
tctgagcttttcatggaagt

SEQ ID NO: 959374 - DNA, 17 bp, Homo sapiens
tctgaggacaagagaaa

SEQ ID NO: 959375 - DNA, 19 bp, Homo sapiens
tctgaggacagaggccggg

SEQ ID NO: 959376 - DNA, 17 bp, Homo sapiens
tctgaggactcctgagg

SEQ ID NO: 959377 - DNA, 16 bp, Homo sapiens
tctgaggagctgttac

SEQ ID NO: 959378 - DNA, 15 bp, Homo sapiens
tctgaggcaaccccc

SEQ ID NO: 959379 - DNA, 14 bp, Homo sapiens
tctgaggcctcatc

SEQ ID NO: 959380 - DNA, 20 bp, Homo sapiens
tctgaggcctgccccctggg

SEQ ID NO: 959381 - DNA, 21 bp, Homo sapiens
tctgaggcctgccccctgggc

SEQ ID NO: 959382 - DNA, 16 bp, Homo sapiens
tctgagggaaatgttt

SEQ ID NO: 959383 - DNA, 18 bp, Homo sapiens
tctgagggaaatgttttg

SEQ ID NO: 959384 - DNA, 18 bp, Homo sapiens
tctgagggaggaggccac

SEQ ID NO: 959385 - DNA, 16 bp, Homo sapiens
tctgcagacttcccag

SEQ ID NO: 959386 - DNA, 19 bp, Homo sapiens
tctgcagagtcactcacac

SEQ ID NO: 959387 - DNA, 16 bp, Homo sapiens
tctgcagatggaaagt

SEQ ID NO: 959388 - DNA, 18 bp, Homo sapiens
tctgcagccagcccagcc

SEQ ID NO: 959389 - DNA, 19 bp, Homo sapiens
tctgcagccagcccagccc

SEQ ID NO: 959390 - DNA, 21 bp, Homo sapiens
tctgcagccattcttcaggtc

SEQ ID NO: 959391 - DNA, 14 bp, Homo sapiens
tctgcagcccagcc

SEQ ID NO: 959392 - DNA, 21 bp, Homo sapiens
tctgcagccggaggaggagat

SEQ ID NO: 959393 - DNA, 16 bp, Homo sapiens
tctgcagcctcggcct

SEQ ID NO: 959394 - DNA, 13 bp, Homo sapiens
tctgcagcctgct

SEQ ID NO: 959395 - DNA, 15 bp, Homo sapiens
tctgcagcctgctgg

SEQ ID NO: 959396 - DNA, 16 bp, Homo sapiens
tctgcagcctgctggg

SEQ ID NO: 959397 - DNA, 14 bp, Homo sapiens
tctgcaggcagaca

SEQ ID NO: 959398 - DNA, 14 bp, Homo sapiens
tctgcaggctgggg

SEQ ID NO: 959399 - DNA, 13 bp, Homo sapiens
tctgcagggagca

SEQ ID NO: 959400 - DNA, 16 bp, Homo sapiens
tctgcaggggcctgga

SEQ ID NO: 959401 - DNA, 20 bp, Homo sapiens
tctgcagggtgacgcctgag

SEQ ID NO: 959402 - DNA, 21 bp, Homo sapiens
tctgcagggtgacgcctgaga

SEQ ID NO: 959403 - DNA, 21 bp, Homo sapiens
tctgcaggttcttcttcctga

SEQ ID NO: 959404 - DNA, 22 bp, Homo sapiens
tctgcaggttgaagccatgtct

SEQ ID NO: 959405 - DNA, 23 bp, Homo sapiens
tctgcagtaaaacacatttggga

SEQ ID NO: 959406 - DNA, 21 bp, Homo sapiens
tctgcagtaggggacccagag

SEQ ID NO: 959407 - DNA, 18 bp, Homo sapiens
tctgcagtagtctctgtg

SEQ ID NO: 959408 - DNA, 19 bp, Homo sapiens
gctggagacttcctctggt

SEQ ID NO: 959409 - DNA, 18 bp, Homo sapiens
gctggagataacagcctc

SEQ ID NO: 959410 - DNA, 19 bp, Homo sapiens
gctggagataacagcctct

SEQ ID NO: 959411 - DNA, 18 bp, Homo sapiens
gctggagatgaggccaga

SEQ ID NO: 959412 - DNA, 21 bp, Homo sapiens
gctggagatgaggccagacca

SEQ ID NO: 959413 - DNA, 21 bp, Homo sapiens
gctggagatgcaaggtgctgg

SEQ ID NO: 959414 - DNA, 13 bp, Homo sapiens
gctggagcccaca

SEQ ID NO: 959415 - DNA, 19 bp, Homo sapiens
gctggagcccacagcgagc

SEQ ID NO: 959416 - DNA, 13 bp, Homo sapiens
gctggagccccca

SEQ ID NO: 959417 - DNA, 16 bp, Homo sapiens
gctggagcccccagca

SEQ ID NO: 959418 - DNA, 22 bp, Homo sapiens
gctggagctcttggaagagctc

SEQ ID NO: 959419 - DNA, 12 bp, Homo sapiens
gctggagctggc

SEQ ID NO: 959420 - DNA, 19 bp, Homo sapiens
gctggaggagcagcagctt

SEQ ID NO: 959421 - DNA, 20 bp, Homo sapiens
gctggaggaggggaagctgg

SEQ ID NO: 959422 - DNA, 17 bp, Homo sapiens
gctggaggatgtgggca

SEQ ID NO: 959423 - DNA, 20 bp, Homo sapiens
gctggaggatgtgggcagct

SEQ ID NO: 959424 - DNA, 20 bp, Homo sapiens
gctggaggcccaggctggga

SEQ ID NO: 959425 - DNA, 17 bp, Homo sapiens
gctggagggagaaccca

SEQ ID NO: 959426 - DNA, 12 bp, Homo sapiens
gctggagggagg

SEQ ID NO: 959427 - DNA, 13 bp, Homo sapiens
gctggagggaggc

SEQ ID NO: 959428 - DNA, 12 bp, Homo sapiens
gctggaggggct

SEQ ID NO: 959429 - DNA, 22 bp, Homo sapiens
gctggaggggctgtcctccttc

SEQ ID NO: 959430 - DNA, 23 bp, Homo sapiens
gctggaggggctgtcctccttcc

SEQ ID NO: 959431 - DNA, 15 bp, Homo sapiens
gctggagtctcctga

SEQ ID NO: 959432 - DNA, 16 bp, Homo sapiens
gctggagtctcctgag

SEQ ID NO: 959433 - DNA, 20 bp, Homo sapiens
gctggagtgagggcctcaga

SEQ ID NO: 959434 - DNA, 16 bp, Homo sapiens
gctggagtgcagtggc

SEQ ID NO: 959435 - DNA, 20 bp, Homo sapiens
gctggagtgcagtggtgtga

SEQ ID NO: 959436 - DNA, 15 bp, Homo sapiens
gctggagtgctgctt

SEQ ID NO: 959437 - DNA, 20 bp, Homo sapiens
gctggagtgtagtggcgcga

SEQ ID NO: 959438 - DNA, 21 bp, Homo sapiens
gctggagtgtgagggtcctgc

SEQ ID NO: 959439 - DNA, 18 bp, Homo sapiens
gctggagttcagcagtga

SEQ ID NO: 959440 - DNA, 21 bp, Homo sapiens
gctggagttccggcctgggca

SEQ ID NO: 959441 - DNA, 16 bp, Homo sapiens
gctggagtttcatgta

SEQ ID NO: 959442 - DNA, 20 bp, Homo sapiens
gctggatagacttgggatgg

SEQ ID NO: 959443 - DNA, 17 bp, Homo sapiens
gctggatataatgtatt

SEQ ID NO: 959444 - DNA, 13 bp, Homo sapiens
gctggatggacag

SEQ ID NO: 959445 - DNA, 15 bp, Homo sapiens
gctggatggacagac

SEQ ID NO: 959446 - DNA, 16 bp, Homo sapiens
gctggatggacagaca

SEQ ID NO: 959447 - DNA, 12 bp, Homo sapiens
gctggatggcac

SEQ ID NO: 959448 - DNA, 20 bp, Homo sapiens
gctggcaaaggtggctctcc

SEQ ID NO: 959449 - DNA, 12 bp, Homo sapiens
gctggcaccatg

SEQ ID NO: 959450 - DNA, 16 bp, Homo sapiens
gctggcacccaccgtg

SEQ ID NO: 959451 - DNA, 20 bp, Homo sapiens
gctggcacccaccgtggagg

SEQ ID NO: 959452 - DNA, 23 bp, Homo sapiens
gctggcacccaccgtggaggagg

SEQ ID NO: 959453 - DNA, 15 bp, Homo sapiens
gctggcagctgagag

SEQ ID NO: 959454 - DNA, 21 bp, Homo sapiens
gctggcaggacacatcccggc

SEQ ID NO: 959455 - DNA, 15 bp, Homo sapiens
gctggcagggccagg

SEQ ID NO: 959456 - DNA, 17 bp, Homo sapiens
gctggcagggccagggc

SEQ ID NO: 959457 - DNA, 20 bp, Homo sapiens
gctggcatcaggtctgggca

SEQ ID NO: 959458 - DNA, 15 bp, Homo sapiens
gctggcatgttttct

SEQ ID NO: 959459 - DNA, 16 bp, Homo sapiens
gctggccaaggtgtcc

SEQ ID NO: 959460 - DNA, 12 bp, Homo sapiens
gctggccagcac

SEQ ID NO: 959461 - DNA, 13 bp, Homo sapiens
gctggccagcacc

SEQ ID NO: 959462 - DNA, 15 bp, Homo sapiens
gctggccagcaccct

SEQ ID NO: 959463 - DNA, 19 bp, Homo sapiens
gctggccagcaccctctcc

SEQ ID NO: 959464 - DNA, 14 bp, Homo sapiens
gctggccagtccag

SEQ ID NO: 959465 - DNA, 15 bp, Homo sapiens
gctggccagtccagg

SEQ ID NO: 959466 - DNA, 16 bp, Homo sapiens
gctggccagtccaggc

SEQ ID NO: 959467 - DNA, 21 bp, Homo sapiens
gctggcccagccaactgcccc

SEQ ID NO: 959468 - DNA, 17 bp, Homo sapiens
gctggcccagccggcct

SEQ ID NO: 959469 - DNA, 13 bp, Homo sapiens
gctggcccccagc

SEQ ID NO: 959470 - DNA, 19 bp, Homo sapiens
gctggcccccagccctggg

SEQ ID NO: 959471 - DNA, 13 bp, Homo sapiens
gctggccccgccg

SEQ ID NO: 959472 - DNA, 23 bp, Homo sapiens
gctggccccgccgcctggtactc

SEQ ID NO: 959473 - DNA, 24 bp, Homo sapiens
gctggccccgccgcctggtactca

SEQ ID NO: 959474 - DNA, 11 bp, Homo sapiens
gctggcccctc

SEQ ID NO: 959475 - DNA, 12 bp, Homo sapiens
gctggcccctca

SEQ ID NO: 959476 - DNA, 19 bp, Homo sapiens
gctggcccgtgacagactc

SEQ ID NO: 959477 - DNA, 19 bp, Homo sapiens
gctggccctacttccagga

SEQ ID NO: 959478 - DNA, 23 bp, Homo sapiens
gctggccctacttccaggatgga

SEQ ID NO: 959479 - DNA, 15 bp, Homo sapiens
gctggccctgtgcag

SEQ ID NO: 959480 - DNA, 17 bp, Homo sapiens
gctggccctgtgcagac

SEQ ID NO: 959481 - DNA, 22 bp, Homo sapiens
gctggccctgtgcagaccttac

SEQ ID NO: 959482 - DNA, 18 bp, Homo sapiens
gctggcccttagagaccc

SEQ ID NO: 959483 - DNA, 19 bp, Homo sapiens
gctggccgagggtcctggc

SEQ ID NO: 959484 - DNA, 24 bp, Homo sapiens
gctggccgagggtcctggctcctg

SEQ ID NO: 959485 - DNA, 17 bp, Homo sapiens
gctggcctcccccaaca

SEQ ID NO: 959486 - DNA, 19 bp, Homo sapiens
gctggcctcccccaacacc

SEQ ID NO: 959487 - DNA, 23 bp, Homo sapiens
gctggcctcccccaacacctgct

SEQ ID NO: 959488 - DNA, 15 bp, Homo sapiens
gctggcctctctagc

SEQ ID NO: 959489 - DNA, 23 bp, Homo sapiens
gctggcctctctgacatatgcta

SEQ ID NO: 959490 - DNA, 18 bp, Homo sapiens
gctggcctctggctctca

SEQ ID NO: 959491 - DNA, 21 bp, Homo sapiens
gctggcctgactggttgtcag

SEQ ID NO: 959492 - DNA, 15 bp, Homo sapiens
gctggcctggaccat

SEQ ID NO: 959493 - DNA, 14 bp, Homo sapiens
gctggcctggaggc

SEQ ID NO: 959494 - DNA, 15 bp, Homo sapiens
gctggcctggaggct

SEQ ID NO: 959495 - DNA, 13 bp, Homo sapiens
gctggcctggcag

SEQ ID NO: 959496 - DNA, 17 bp, Homo sapiens
gctggcctggcagttga

SEQ ID NO: 959497 - DNA, 23 bp, Homo sapiens
gctggccttcctgccctacagag

SEQ ID NO: 959498 - DNA, 23 bp, Homo sapiens
gctggcgacactcagggcagctg

SEQ ID NO: 959499 - DNA, 17 bp, Homo sapiens
gctggcgcagccaaggc

SEQ ID NO: 959500 - DNA, 20 bp, Homo sapiens
gctggcgcatattaagcact

SEQ ID NO: 959501 - DNA, 19 bp, Homo sapiens
gctggcgcttggatctggg

SEQ ID NO: 959502 - DNA, 15 bp, Homo sapiens
gctggctacgcctct

SEQ ID NO: 959503 - DNA, 15 bp, Homo sapiens
gctggctagtccttt

SEQ ID NO: 959504 - DNA, 21 bp, Homo sapiens
gctggctccagatgcagggca

SEQ ID NO: 959505 - DNA, 18 bp, Homo sapiens
gctggctccccctcccca

SEQ ID NO: 959506 - DNA, 22 bp, Homo sapiens
gctggggcagaggggcagccgc

SEQ ID NO: 959507 - DNA, 24 bp, Homo sapiens
gctggggcagaggggcagccgcta

SEQ ID NO: 959508 - DNA, 18 bp, Homo sapiens
gctggggcatgtgtgcct

SEQ ID NO: 959509 - DNA, 18 bp, Homo sapiens
gctggggccagaggctgg

SEQ ID NO: 959510 - DNA, 14 bp, Homo sapiens
gctggggccagggc

SEQ ID NO: 959511 - DNA, 19 bp, Homo sapiens
gctggggccagggcagatg

SEQ ID NO: 959512 - DNA, 20 bp, Homo sapiens
gctggggccccatcttgatc

SEQ ID NO: 959513 - DNA, 16 bp, Homo sapiens
gctggggcctcagacg

SEQ ID NO: 959514 - DNA, 20 bp, Homo sapiens
gctggggccttttgacggcc

SEQ ID NO: 959515 - DNA, 17 bp, Homo sapiens
gctggggcgtggggagg

SEQ ID NO: 959516 - DNA, 21 bp, Homo sapiens
gctggggctgccagcctgagc

SEQ ID NO: 959517 - DNA, 15 bp, Homo sapiens
gctggggctgctccc

SEQ ID NO: 959518 - DNA, 18 bp, Homo sapiens
gctggggcttatgggtgg

SEQ ID NO: 959519 - DNA, 19 bp, Homo sapiens
gctggggcttatgggtggc

SEQ ID NO: 959520 - DNA, 23 bp, Homo sapiens
gctgggggaagaagctctctcct

SEQ ID NO: 959521 - DNA, 16 bp, Homo sapiens
gctgggggcacagctg

SEQ ID NO: 959522 - DNA, 17 bp, Homo sapiens
gctgggggcacagctgt

SEQ ID NO: 959523 - DNA, 21 bp, Homo sapiens
gctgggggcacagctgtctgc

SEQ ID NO: 959524 - DNA, 22 bp, Homo sapiens
gctgggggccagggctggatgg

SEQ ID NO: 959525 - DNA, 23 bp, Homo sapiens
gctgggggccatgagctccagac

SEQ ID NO: 959526 - DNA, 20 bp, Homo sapiens
gctgggggctgccgagccac

SEQ ID NO: 959527 - DNA, 19 bp, Homo sapiens
gctggggtacacagtgaga

SEQ ID NO: 959528 - DNA, 16 bp, Homo sapiens
gctggggtccagggct

SEQ ID NO: 959529 - DNA, 17 bp, Homo sapiens
gctggggtccagggctg

SEQ ID NO: 959530 - DNA, 20 bp, Homo sapiens
gctggggtctgggcagtgcc

SEQ ID NO: 959531 - DNA, 22 bp, Homo sapiens
gctggggtctgggcagtgccac

SEQ ID NO: 959532 - DNA, 18 bp, Homo sapiens
gctggggtgagcctgact

SEQ ID NO: 959533 - DNA, 19 bp, Homo sapiens
gctggggtgagcctgactg

SEQ ID NO: 959534 - DNA, 21 bp, Homo sapiens
gctgggtaaactgtggatgat

SEQ ID NO: 959535 - DNA, 13 bp, Homo sapiens
gctgggtcaggca

SEQ ID NO: 959536 - DNA, 15 bp, Homo sapiens
tctgcgccaggcaga

SEQ ID NO: 959537 - DNA, 18 bp, Homo sapiens
tctgcgccaggcagagct

SEQ ID NO: 959538 - DNA, 21 bp, Homo sapiens
tctgcgccaggcagagctgag

SEQ ID NO: 959539 - DNA, 19 bp, Homo sapiens
tctgcggatctcagctttg

SEQ ID NO: 959540 - DNA, 18 bp, Homo sapiens
tctgcgggaggctggggc

SEQ ID NO: 959541 - DNA, 20 bp, Homo sapiens
tctgcgggaggctggggccc

SEQ ID NO: 959542 - DNA, 15 bp, Homo sapiens
tctgcgggctccctc

SEQ ID NO: 959543 - DNA, 19 bp, Homo sapiens
tctgcgggctccctcctct

SEQ ID NO: 959544 - DNA, 22 bp, Homo sapiens
tctgcgggctccctcctctggc

SEQ ID NO: 959545 - DNA, 22 bp, Homo sapiens
tctgcggtgaagttgaggctta

SEQ ID NO: 959546 - DNA, 17 bp, Homo sapiens
tctgcgtcatgcttgtg

SEQ ID NO: 959547 - DNA, 15 bp, Homo sapiens
tctgcgtccaccagg

SEQ ID NO: 959548 - DNA, 19 bp, Homo sapiens
tctgcgtctctgctttaaa

SEQ ID NO: 959549 - DNA, 23 bp, Homo sapiens
tctgctaagtaatttagaagata

SEQ ID NO: 959550 - DNA, 14 bp, Homo sapiens
tctgctaatgtaaa

SEQ ID NO: 959551 - DNA, 14 bp, Homo sapiens
tctgctacctcact

SEQ ID NO: 959552 - DNA, 16 bp, Homo sapiens
tctgctactttgctgc

SEQ ID NO: 959553 - DNA, 14 bp, Homo sapiens
tctgctagaaagtt

SEQ ID NO: 959554 - DNA, 17 bp, Homo sapiens
tctgctagagcagacag

SEQ ID NO: 959555 - DNA, 21 bp, Homo sapiens
tctgctaggcgctggggagac

SEQ ID NO: 959556 - DNA, 14 bp, Homo sapiens
tctgctatatataa

SEQ ID NO: 959557 - DNA, 15 bp, Homo sapiens
tctgctatgcatttt

SEQ ID NO: 959558 - DNA, 14 bp, Homo sapiens
tctgctcaggcctc

SEQ ID NO: 959559 - DNA, 15 bp, Homo sapiens
tctgctcatcattct

SEQ ID NO: 959560 - DNA, 18 bp, Homo sapiens
tctgctcattttgacaaa

SEQ ID NO: 959561 - DNA, 22 bp, Homo sapiens
tctgctcattttgacaaagtgc

SEQ ID NO: 959562 - DNA, 12 bp, Homo sapiens
tctgctccaccc

SEQ ID NO: 959563 - DNA, 15 bp, Homo sapiens
tctgctccacccttg

SEQ ID NO: 959564 - DNA, 12 bp, Homo sapiens
tctgctccagca

SEQ ID NO: 959565 - DNA, 20 bp, Homo sapiens
tctgctccagcaactgccct

SEQ ID NO: 959566 - DNA, 13 bp, Homo sapiens
tctgctccagccc

SEQ ID NO: 959567 - DNA, 15 bp, Homo sapiens
tctgctccagcccct

SEQ ID NO: 959568 - DNA, 20 bp, Homo sapiens
tctgctccatagacatcagt

SEQ ID NO: 959569 - DNA, 18 bp, Homo sapiens
tctgctcccaccccagaa

SEQ ID NO: 959570 - DNA, 16 bp, Homo sapiens
tctgctccggggtggt

SEQ ID NO: 959571 - DNA, 23 bp, Homo sapiens
tctgctcctacatccagctcctc

SEQ ID NO: 959572 - DNA, 13 bp, Homo sapiens
tctgctcctctcc

SEQ ID NO: 959573 - DNA, 16 bp, Homo sapiens
tctgctcctctccagg

SEQ ID NO: 959574 - DNA, 18 bp, Homo sapiens
tctgctcctctccaggca

SEQ ID NO: 959575 - DNA, 20 bp, Homo sapiens
tctgctcctctccaggcacc

SEQ ID NO: 959576 - DNA, 12 bp, Homo sapiens
tctgctcctgct

SEQ ID NO: 959577 - DNA, 17 bp, Homo sapiens
tctgctcgccctccttt

SEQ ID NO: 959578 - DNA, 18 bp, Homo sapiens
tctgctcggccgtcttca

SEQ ID NO: 959579 - DNA, 20 bp, Homo sapiens
tctgctcggcttcttggacc

SEQ ID NO: 959580 - DNA, 12 bp, Homo sapiens
tctgctctagcc

SEQ ID NO: 959581 - DNA, 18 bp, Homo sapiens
tctgctctattatataaa

SEQ ID NO: 959582 - DNA, 19 bp, Homo sapiens
tctgctctgaggcttccag

SEQ ID NO: 959583 - DNA, 12 bp, Homo sapiens
tctgctctgcca

SEQ ID NO: 959584 - DNA, 21 bp, Homo sapiens
tctgctctgccatcttcagga

SEQ ID NO: 959585 - DNA, 14 bp, Homo sapiens
tctgctctgccctt

SEQ ID NO: 959586 - DNA, 15 bp, Homo sapiens
tctgctctgcctgga

SEQ ID NO: 959587 - DNA, 18 bp, Homo sapiens
tctgctctgcctggagtg

SEQ ID NO: 959588 - DNA, 14 bp, Homo sapiens
tctgctctgctgct

SEQ ID NO: 959589 - DNA, 18 bp, Homo sapiens
tctgctcttccaaagctc

SEQ ID NO: 959590 - DNA, 17 bp, Homo sapiens
tctgctctttctctgcc

SEQ ID NO: 959591 - DNA, 18 bp, Homo sapiens
tctgctctttctctgcca

SEQ ID NO: 959592 - DNA, 15 bp, Homo sapiens
tctgctgaaggacag

SEQ ID NO: 959593 - DNA, 20 bp, Homo sapiens
tctgctgacctgctgacctg

SEQ ID NO: 959594 - DNA, 17 bp, Homo sapiens
tctgctgactgtttcat

SEQ ID NO: 959595 - DNA, 14 bp, Homo sapiens
tctgctgagctggg

SEQ ID NO: 959596 - DNA, 17 bp, Homo sapiens
tctgctgagctgggccc

SEQ ID NO: 959597 - DNA, 22 bp, Homo sapiens
tctgctgagctgggcccagccc

SEQ ID NO: 959598 - DNA, 20 bp, Homo sapiens
tctgctgaggcccagtgcat

SEQ ID NO: 959599 - DNA, 16 bp, Homo sapiens
tctgctgagtgctggg

SEQ ID NO: 959600 - DNA, 14 bp, Homo sapiens
tctgctgccccctt

SEQ ID NO: 959601 - DNA, 14 bp, Homo sapiens
tctgctgccctcca

SEQ ID NO: 959602 - DNA, 11 bp, Homo sapiens
tctgctgcctc

SEQ ID NO: 959603 - DNA, 19 bp, Homo sapiens
tctgctgcctctgtggaag

SEQ ID NO: 959604 - DNA, 22 bp, Homo sapiens
tctgctgcctctgtggaagaga

SEQ ID NO: 959605 - DNA, 20 bp, Homo sapiens
tctgctgctctgaccttcca

SEQ ID NO: 959606 - DNA, 14 bp, Homo sapiens
tctgctgctgcccg

SEQ ID NO: 959607 - DNA, 18 bp, Homo sapiens
tctgctgctgtccctccc

SEQ ID NO: 959608 - DNA, 21 bp, Homo sapiens
tctgctggaaggggcagcagg

SEQ ID NO: 959609 - DNA, 23 bp, Homo sapiens
tctgctggagtttcatgtacaag

SEQ ID NO: 959610 - DNA, 23 bp, Homo sapiens
tctgctggcatcaagaggtggga

SEQ ID NO: 959611 - DNA, 12 bp, Homo sapiens
tctgctggccca

SEQ ID NO: 959612 - DNA, 14 bp, Homo sapiens
tctgctggcccagc

SEQ ID NO: 959613 - DNA, 14 bp, Homo sapiens
tctgctggcctgga

SEQ ID NO: 959614 - DNA, 15 bp, Homo sapiens
tctgctggtcttcaa

SEQ ID NO: 959615 - DNA, 17 bp, Homo sapiens
tctgctggttttaacaa

SEQ ID NO: 959616 - DNA, 13 bp, Homo sapiens
tctgctgtagaaa

SEQ ID NO: 959617 - DNA, 18 bp, Homo sapiens
tctgctgtggtctataaa

SEQ ID NO: 959618 - DNA, 22 bp, Homo sapiens
tctgctgtggtctataaaataa

SEQ ID NO: 959619 - DNA, 19 bp, Homo sapiens
tctgctgtgtggaaaaaaa

SEQ ID NO: 959620 - DNA, 12 bp, Homo sapiens
tctgctgttgcc

SEQ ID NO: 959621 - DNA, 13 bp, Homo sapiens
tctgctgttgcca

SEQ ID NO: 959622 - DNA, 17 bp, Homo sapiens
tctgctgttgccatagc

SEQ ID NO: 959623 - DNA, 18 bp, Homo sapiens
tctgctgttgccatagcc

SEQ ID NO: 959624 - DNA, 21 bp, Homo sapiens
tctgctgttgccatagcccca

SEQ ID NO: 959625 - DNA, 17 bp, Homo sapiens
tctgcttacaattccct

SEQ ID NO: 959626 - DNA, 20 bp, Homo sapiens
tctgcttacaattccctgct

SEQ ID NO: 959627 - DNA, 17 bp, Homo sapiens
tctgcttacccttcacc

SEQ ID NO: 959628 - DNA, 19 bp, Homo sapiens
tctggctgtctagaatgtg

SEQ ID NO: 959629 - DNA, 21 bp, Homo sapiens
tctggctgtctagaatgtgga

SEQ ID NO: 959630 - DNA, 15 bp, Homo sapiens
tctggctgtgtggcc

SEQ ID NO: 959631 - DNA, 18 bp, Homo sapiens
tctggctgtgttgccctg

SEQ ID NO: 959632 - DNA, 19 bp, Homo sapiens
tctggcttagacaccacct

SEQ ID NO: 959633 - DNA, 20 bp, Homo sapiens
tctggcttccctaaactgca

SEQ ID NO: 959634 - DNA, 18 bp, Homo sapiens
tctggcttgccccaggac

SEQ ID NO: 959635 - DNA, 19 bp, Homo sapiens
tctggcttgccccaggact

SEQ ID NO: 959636 - DNA, 22 bp, Homo sapiens
tctggcttgggcagggtctgtt

SEQ ID NO: 959637 - DNA, 15 bp, Homo sapiens
tctggctttcccagg

SEQ ID NO: 959638 - DNA, 16 bp, Homo sapiens
tctggctttcccagga

SEQ ID NO: 959639 - DNA, 13 bp, Homo sapiens
tctggctttgctc

SEQ ID NO: 959640 - DNA, 16 bp, Homo sapiens
tctggctttgctctat

SEQ ID NO: 959641 - DNA, 18 bp, Homo sapiens
tctgggaaataagagaga

SEQ ID NO: 959642 - DNA, 22 bp, Homo sapiens
tctgggaaatggcttgaagcca

SEQ ID NO: 959643 - DNA, 20 bp, Homo sapiens
tctgggaaattgaagtgtct

SEQ ID NO: 959644 - DNA, 13 bp, Homo sapiens
tctgggaagggag

SEQ ID NO: 959645 - DNA, 15 bp, Homo sapiens
tctgggaccctttcc

SEQ ID NO: 959646 - DNA, 22 bp, Homo sapiens
tctgggacctgccaggcagggg

SEQ ID NO: 959647 - DNA, 21 bp, Homo sapiens
tctgggactctcctcctcccc

SEQ ID NO: 959648 - DNA, 22 bp, Homo sapiens
tctgggactctcctcctcccct

SEQ ID NO: 959649 - DNA, 17 bp, Homo sapiens
tctgggacttccttgct

SEQ ID NO: 959650 - DNA, 13 bp, Homo sapiens
tctgggagaaaat

SEQ ID NO: 959651 - DNA, 17 bp, Homo sapiens
tctgggagagccagctt

SEQ ID NO: 959652 - DNA, 16 bp, Homo sapiens
tctgggagagcctggc

SEQ ID NO: 959653 - DNA, 16 bp, Homo sapiens
tctgggagaggatttt

SEQ ID NO: 959654 - DNA, 20 bp, Homo sapiens
tctgggagctgcgccggaca

SEQ ID NO: 959655 - DNA, 12 bp, Homo sapiens
tctgggagggaa

SEQ ID NO: 959656 - DNA, 16 bp, Homo sapiens
tctgggagtccccttt

SEQ ID NO: 959657 - DNA, 15 bp, Homo sapiens
tctgggatatttaac

SEQ ID NO: 959658 - DNA, 14 bp, Homo sapiens
tctgggatcatgat

SEQ ID NO: 959659 - DNA, 15 bp, Homo sapiens
tctgggatgtagaac

SEQ ID NO: 959660 - DNA, 15 bp, Homo sapiens
tctgggattattctt

SEQ ID NO: 959661 - DNA, 14 bp, Homo sapiens
tctgggcaagggct

SEQ ID NO: 959662 - DNA, 16 bp, Homo sapiens
tctgggcaagggctcc

SEQ ID NO: 959663 - DNA, 18 bp, Homo sapiens
tctgggcaccacaaaata

SEQ ID NO: 959664 - DNA, 21 bp, Homo sapiens
tctgggcaccacctctgtggg

SEQ ID NO: 959665 - DNA, 22 bp, Homo sapiens
tctgggcagaagtgagcccccc

SEQ ID NO: 959666 - DNA, 19 bp, Homo sapiens
gctgtccttagactccttc

SEQ ID NO: 959667 - DNA, 17 bp, Homo sapiens
gctgtccttccccttcc

SEQ ID NO: 959668 - DNA, 15 bp, Homo sapiens
gctgtcgccccaggc

SEQ ID NO: 959669 - DNA, 17 bp, Homo sapiens
gctgtcgccccaggccc

SEQ ID NO: 959670 - DNA, 18 bp, Homo sapiens
gctgtcgccccaggccct

SEQ ID NO: 959671 - DNA, 20 bp, Homo sapiens
gctgtcgccccaggccctcc

SEQ ID NO: 959672 - DNA, 23 bp, Homo sapiens
gctgtcgggaccacatctgtcct

SEQ ID NO: 959673 - DNA, 19 bp, Homo sapiens
gctgtcgtctgactctggg

SEQ ID NO: 959674 - DNA, 17 bp, Homo sapiens
gctgtctacagtagctg

SEQ ID NO: 959675 - DNA, 13 bp, Homo sapiens
gctgtctccagac

SEQ ID NO: 959676 - DNA, 12 bp, Homo sapiens
gctgtctggggc

SEQ ID NO: 959677 - DNA, 16 bp, Homo sapiens
gctgtctgtcaccagc

SEQ ID NO: 959678 - DNA, 21 bp, Homo sapiens
gctgtctgtcaccagctatct

SEQ ID NO: 959679 - DNA, 14 bp, Homo sapiens
gctgtctgtgaata

SEQ ID NO: 959680 - DNA, 15 bp, Homo sapiens
gctgtctgtgccatg

SEQ ID NO: 959681 - DNA, 14 bp, Homo sapiens
gctgtcttgcccca

SEQ ID NO: 959682 - DNA, 13 bp, Homo sapiens
gctgtctttctct

SEQ ID NO: 959683 - DNA, 17 bp, Homo sapiens
gctgtctttgcagggca

SEQ ID NO: 959684 - DNA, 20 bp, Homo sapiens
gctgtcttttgttctctgaa

SEQ ID NO: 959685 - DNA, 20 bp, Homo sapiens
gctgtgaaccctggggcctg

SEQ ID NO: 959686 - DNA, 22 bp, Homo sapiens
gctgtgaaccctggggcctgac

SEQ ID NO: 959687 - DNA, 17 bp, Homo sapiens
gctgtgactctgggcag

SEQ ID NO: 959688 - DNA, 19 bp, Homo sapiens
gctgtgactctgggcaggg

SEQ ID NO: 959689 - DNA, 16 bp, Homo sapiens
gctgtgagccatgcct

SEQ ID NO: 959690 - DNA, 16 bp, Homo sapiens
gctgtgaggcccctgg

SEQ ID NO: 959691 - DNA, 22 bp, Homo sapiens
gctgtgaggcccctggacaagc

SEQ ID NO: 959692 - DNA, 12 bp, Homo sapiens
gctgtgaggctg

SEQ ID NO: 959693 - DNA, 14 bp, Homo sapiens
gctgtgaggctgtc

SEQ ID NO: 959694 - DNA, 23 bp, Homo sapiens
gctgtgagggaggggaaaagcat

SEQ ID NO: 959695 - DNA, 20 bp, Homo sapiens
gctgtgagtgcgtgtgtgtg

SEQ ID NO: 959696 - DNA, 18 bp, Homo sapiens
gctgtgagtgtaagtgtg

SEQ ID NO: 959697 - DNA, 19 bp, Homo sapiens
gctgtgagttctccctgta

SEQ ID NO: 959698 - DNA, 18 bp, Homo sapiens
gctgtgatgccgtcctgc

SEQ ID NO: 959699 - DNA, 16 bp, Homo sapiens
gctgtgatgctgtgtg

SEQ ID NO: 959700 - DNA, 19 bp, Homo sapiens
gctgtgccaacctgttctt

SEQ ID NO: 959701 - DNA, 19 bp, Homo sapiens
gctgtgccacaggcttagg

SEQ ID NO: 959702 - DNA, 15 bp, Homo sapiens
gctgtgccatgctgg

SEQ ID NO: 959703 - DNA, 15 bp, Homo sapiens
gctgtgcccagcagg

SEQ ID NO: 959704 - DNA, 19 bp, Homo sapiens
gctgtgcccagcaggccca

SEQ ID NO: 959705 - DNA, 16 bp, Homo sapiens
gctgtgccccctctgg

SEQ ID NO: 959706 - DNA, 17 bp, Homo sapiens
gctgtgcccctccccca

SEQ ID NO: 959707 - DNA, 16 bp, Homo sapiens
gctgtgcccggcccca

SEQ ID NO: 959708 - DNA, 15 bp, Homo sapiens
gctgtgcctctgcct

SEQ ID NO: 959709 - DNA, 12 bp, Homo sapiens
gctgtgcctgcg

SEQ ID NO: 959710 - DNA, 13 bp, Homo sapiens
gctgtgcctgcta

SEQ ID NO: 959711 - DNA, 16 bp, Homo sapiens
gctgtgcctgctagag

SEQ ID NO: 959712 - DNA, 15 bp, Homo sapiens
gctgtgcctgctcag

SEQ ID NO: 959713 - DNA, 17 bp, Homo sapiens
gctgtgcgcccagggct

SEQ ID NO: 959714 - DNA, 21 bp, Homo sapiens
gctgtgcgctgacaaccaccg

SEQ ID NO: 959715 - DNA, 16 bp, Homo sapiens
gctgtgctatgaattt

SEQ ID NO: 959716 - DNA, 13 bp, Homo sapiens
gctgtgctgccct

SEQ ID NO: 959717 - DNA, 13 bp, Homo sapiens
gctgtgctgctca

SEQ ID NO: 959718 - DNA, 14 bp, Homo sapiens
gctgtgctgctcaa

SEQ ID NO: 959719 - DNA, 20 bp, Homo sapiens
gctgtgcttgaaggccctgc

SEQ ID NO: 959720 - DNA, 22 bp, Homo sapiens
gctgtggagcaaaaggcagctc

SEQ ID NO: 959721 - DNA, 23 bp, Homo sapiens
gctgtggaggattgctatctgga

SEQ ID NO: 959722 - DNA, 13 bp, Homo sapiens
gctgtggaggcct

SEQ ID NO: 959723 - DNA, 14 bp, Homo sapiens
gctgtggaggcctg

SEQ ID NO: 959724 - DNA, 22 bp, Homo sapiens
gctgtggaggcctgatgctgcc

SEQ ID NO: 959725 - DNA, 13 bp, Homo sapiens
gctgtggcacaga

SEQ ID NO: 959726 - DNA, 15 bp, Homo sapiens
gctgtggcacagact

SEQ ID NO: 959727 - DNA, 22 bp, Homo sapiens
gctgtggcagccgtcccaggcc

SEQ ID NO: 959728 - DNA, 21 bp, Homo sapiens
gctgtggcatgggtgaagagg

SEQ ID NO: 959729 - DNA, 15 bp, Homo sapiens
gctgtggcatttcca

SEQ ID NO: 959730 - DNA, 14 bp, Homo sapiens
gctgtggccaggcc

SEQ ID NO: 959731 - DNA, 18 bp, Homo sapiens
gctgtggccaggcctgca

SEQ ID NO: 959732 - DNA, 19 bp, Homo sapiens
gctgtggccaggcctgcag

SEQ ID NO: 959733 - DNA, 13 bp, Homo sapiens
gctgtggccaggg

SEQ ID NO: 959734 - DNA, 16 bp, Homo sapiens
gctgtggccagggtga

SEQ ID NO: 959735 - DNA, 15 bp, Homo sapiens
gctgtggccccctgt

SEQ ID NO: 959736 - DNA, 17 bp, Homo sapiens
gctgtggccccctgtcc

SEQ ID NO: 959737 - DNA, 14 bp, Homo sapiens
gctgtggccctgcc

SEQ ID NO: 959738 - DNA, 13 bp, Homo sapiens
gctgtggccctgg

SEQ ID NO: 959739 - DNA, 14 bp, Homo sapiens
gctgtggccctgga

SEQ ID NO: 959740 - DNA, 15 bp, Homo sapiens
gctgtggccgtctcc

SEQ ID NO: 959741 - DNA, 22 bp, Homo sapiens
gctgtggccgtctcctccctca

SEQ ID NO: 959742 - DNA, 14 bp, Homo sapiens
gctgtggcctgggc

SEQ ID NO: 959743 - DNA, 15 bp, Homo sapiens
gctgtggctggtgag

SEQ ID NO: 959744 - DNA, 18 bp, Homo sapiens
gctgtgggcaagcctaag

SEQ ID NO: 959745 - DNA, 12 bp, Homo sapiens
gctgtgggcctc

SEQ ID NO: 959746 - DNA, 14 bp, Homo sapiens
gctgtggggtctgg

SEQ ID NO: 959747 - DNA, 17 bp, Homo sapiens
gctgtggggtctggctg

SEQ ID NO: 959748 - DNA, 16 bp, Homo sapiens
gctgtggggtggagca

SEQ ID NO: 959749 - DNA, 18 bp, Homo sapiens
gctgtggggtgggctgga

SEQ ID NO: 959750 - DNA, 12 bp, Homo sapiens
gctgtggtccta

SEQ ID NO: 959751 - DNA, 21 bp, Homo sapiens
gcttagccttgtgccctgccc

SEQ ID NO: 959752 - DNA, 18 bp, Homo sapiens
gcttagcgctctggacag

SEQ ID NO: 959753 - DNA, 14 bp, Homo sapiens
gcttaggcctctct

SEQ ID NO: 959754 - DNA, 16 bp, Homo sapiens
gcttagggccctggag

SEQ ID NO: 959755 - DNA, 16 bp, Homo sapiens
gcttaggtgccaggct

SEQ ID NO: 959756 - DNA, 17 bp, Homo sapiens
gcttaggtgccaggctg

SEQ ID NO: 959757 - DNA, 13 bp, Homo sapiens
gcttagttcttga

SEQ ID NO: 959758 - DNA, 19 bp, Homo sapiens
gcttagttcttgaattgtt

SEQ ID NO: 959759 - DNA, 20 bp, Homo sapiens
gcttagttcttgaattgtta

SEQ ID NO: 959760 - DNA, 20 bp, Homo sapiens
gcttagttggctttgcccac

SEQ ID NO: 959761 - DNA, 16 bp, Homo sapiens
gcttagtttgtgtgtt

SEQ ID NO: 959762 - DNA, 14 bp, Homo sapiens
gcttataatgtgtg

SEQ ID NO: 959763 - DNA, 20 bp, Homo sapiens
gcttatacacttacacttta

SEQ ID NO: 959764 - DNA, 17 bp, Homo sapiens
gcttatacgaaataatt

SEQ ID NO: 959765 - DNA, 19 bp, Homo sapiens
gcttatacgaaataattgt

SEQ ID NO: 959766 - DNA, 16 bp, Homo sapiens
gcttatagaataaaag

SEQ ID NO: 959767 - DNA, 21 bp, Homo sapiens
gcttatattttcagcaaagaa

SEQ ID NO: 959768 - DNA, 18 bp, Homo sapiens
gcttatcaactaatgatt

SEQ ID NO: 959769 - DNA, 17 bp, Homo sapiens
gcttatcaataaacctg

SEQ ID NO: 959770 - DNA, 13 bp, Homo sapiens
gcttatctcaggg

SEQ ID NO: 959771 - DNA, 19 bp, Homo sapiens
gcttatctcaggggtgtgc

SEQ ID NO: 959772 - DNA, 17 bp, Homo sapiens
gcttatgggtggctttc

SEQ ID NO: 959773 - DNA, 13 bp, Homo sapiens
gcttatgtcatca

SEQ ID NO: 959774 - DNA, 18 bp, Homo sapiens
gcttattctcaaagcagg

SEQ ID NO: 959775 - DNA, 15 bp, Homo sapiens
gcttattggccactg

SEQ ID NO: 959776 - DNA, 13 bp, Homo sapiens
gcttattgttcca

SEQ ID NO: 959777 - DNA, 14 bp, Homo sapiens
gcttatttaataaa

SEQ ID NO: 959778 - DNA, 16 bp, Homo sapiens
gcttatttaataaaga

SEQ ID NO: 959779 - DNA, 19 bp, Homo sapiens
gcttatttctatgacaaat

SEQ ID NO: 959780 - DNA, 14 bp, Homo sapiens
gcttattttattat

SEQ ID NO: 959781 - DNA, 15 bp, Homo sapiens
gcttatttttataat

SEQ ID NO: 959782 - DNA, 22 bp, Homo sapiens
gcttatttttttaagaaaaaag

SEQ ID NO: 959783 - DNA, 16 bp, Homo sapiens
gcttcaaaatagagaa

SEQ ID NO: 959784 - DNA, 18 bp, Homo sapiens
gcttcaaaccctcaagag

SEQ ID NO: 959785 - DNA, 19 bp, Homo sapiens
gcttcaaattatagaaaca

SEQ ID NO: 959786 - DNA, 19 bp, Homo sapiens
gcttcaaattcaaggcctt

SEQ ID NO: 959787 - DNA, 21 bp, Homo sapiens
gcttcaacaactttgtgcttt

SEQ ID NO: 959788 - DNA, 14 bp, Homo sapiens
gcttcaagctctct

SEQ ID NO: 959789 - DNA, 15 bp, Homo sapiens
gcttcaagctctctg

SEQ ID NO: 959790 - DNA, 17 bp, Homo sapiens
gcttcaagctctctgtt

SEQ ID NO: 959791 - DNA, 19 bp, Homo sapiens
gcttcaaggatatactgca

SEQ ID NO: 959792 - DNA, 21 bp, Homo sapiens
gcttcaaggatatactgcagc

SEQ ID NO: 959793 - DNA, 21 bp, Homo sapiens
gcttcaagtgttgctcttgga

SEQ ID NO: 959794 - DNA, 13 bp, Homo sapiens
gcttcaatataag

SEQ ID NO: 959795 - DNA, 16 bp, Homo sapiens
gcttcaatataagaag

SEQ ID NO: 959796 - DNA, 15 bp, Homo sapiens
gcttcaattaataaa

SEQ ID NO: 959797 - DNA, 23 bp, Homo sapiens
tctgtagctcctcaactcaccta

SEQ ID NO: 959798 - DNA, 17 bp, Homo sapiens
tctgtagctttctggaa

SEQ ID NO: 959799 - DNA, 19 bp, Homo sapiens
tctgtaggcacagagctgc

SEQ ID NO: 959800 - DNA, 16 bp, Homo sapiens
tctgtagggctggacc

SEQ ID NO: 959801 - DNA, 20 bp, Homo sapiens
tctgtagggtaattagtaac

SEQ ID NO: 959802 - DNA, 16 bp, Homo sapiens
tctgtaggtgtctctg

SEQ ID NO: 959803 - DNA, 19 bp, Homo sapiens
tctgtaggtgtctctgggc

SEQ ID NO: 959804 - DNA, 22 bp, Homo sapiens
tctgtagtatacagacaggaag

SEQ ID NO: 959805 - DNA, 14 bp, Homo sapiens
tctgtagtgagata

SEQ ID NO: 959806 - DNA, 17 bp, Homo sapiens
tctgtagtgagatagca

SEQ ID NO: 959807 - DNA, 12 bp, Homo sapiens
tctgtataaata

SEQ ID NO: 959808 - DNA, 19 bp, Homo sapiens
tctgtataaataagagcat

SEQ ID NO: 959809 - DNA, 16 bp, Homo sapiens
tctgtataagtaagaa

SEQ ID NO: 959810 - DNA, 17 bp, Homo sapiens
tctgtataagtaagaaa

SEQ ID NO: 959811 - DNA, 18 bp, Homo sapiens
tctgtataagtaagaaaa

SEQ ID NO: 959812 - DNA, 19 bp, Homo sapiens
tctgtataatactttgtat

SEQ ID NO: 959813 - DNA, 15 bp, Homo sapiens
tctgtatacaaccct

SEQ ID NO: 959814 - DNA, 15 bp, Homo sapiens
tctgtatactcctgt

SEQ ID NO: 959815 - DNA, 14 bp, Homo sapiens
tctgtatactgtaa

SEQ ID NO: 959816 - DNA, 17 bp, Homo sapiens
tctgtatactgtaaaag

SEQ ID NO: 959817 - DNA, 14 bp, Homo sapiens
tctgtatagaaatc

SEQ ID NO: 959818 - DNA, 13 bp, Homo sapiens
tctgtatatacat

SEQ ID NO: 959819 - DNA, 15 bp, Homo sapiens
tctgtatatactttt

SEQ ID NO: 959820 - DNA, 16 bp, Homo sapiens
tctgtatatgattctc

SEQ ID NO: 959821 - DNA, 19 bp, Homo sapiens
tctgtatatgattctctgt

SEQ ID NO: 959822 - DNA, 21 bp, Homo sapiens
tctgtatatgattctctgtgg

SEQ ID NO: 959823 - DNA, 21 bp, Homo sapiens
tctgtatatgttgtaataaaa

SEQ ID NO: 959824 - DNA, 15 bp, Homo sapiens
tctgtatatttgtca

SEQ ID NO: 959825 - DNA, 15 bp, Homo sapiens
tctgtatattttggg

SEQ ID NO: 959826 - DNA, 20 bp, Homo sapiens
tctgtatcaggacccagagg

SEQ ID NO: 959827 - DNA, 16 bp, Homo sapiens
tctgtatctagaaaga

SEQ ID NO: 959828 - DNA, 13 bp, Homo sapiens
tctgtatctatgc

SEQ ID NO: 959829 - DNA, 13 bp, Homo sapiens
tctgtatctctct

SEQ ID NO: 959830 - DNA, 16 bp, Homo sapiens
tctgtatgaatgtgat

SEQ ID NO: 959831 - DNA, 12 bp, Homo sapiens
tctgtatgcatc

SEQ ID NO: 959832 - DNA, 13 bp, Homo sapiens
tctgtatgcatca

SEQ ID NO: 959833 - DNA, 18 bp, Homo sapiens
tctgtattgaaaatggct

SEQ ID NO: 959834 - DNA, 23 bp, Homo sapiens
tctgtatttatgtgtgaggagct

SEQ ID NO: 959835 - DNA, 16 bp, Homo sapiens
tctgtatttcactctt

SEQ ID NO: 959836 - DNA, 13 bp, Homo sapiens
tctgtatttctag

SEQ ID NO: 959837 - DNA, 19 bp, Homo sapiens
tctgtcaaaacactgtgga

SEQ ID NO: 959838 - DNA, 13 bp, Homo sapiens
tctgtcaagctta

SEQ ID NO: 959839 - DNA, 13 bp, Homo sapiens
tctgtcaattttt

SEQ ID NO: 959840 - DNA, 18 bp, Homo sapiens
tctgtcacaggctgggtc

SEQ ID NO: 959841 - DNA, 22 bp, Homo sapiens
tctgtcacagtaaaaataaaat

SEQ ID NO: 959842 - DNA, 21 bp, Homo sapiens
tctgtcacatccaactggaaa

SEQ ID NO: 959843 - DNA, 14 bp, Homo sapiens
tctgtcacgtgaaa

SEQ ID NO: 959844 - DNA, 20 bp, Homo sapiens
tctgtcagatgagaacaaag

SEQ ID NO: 959845 - DNA, 21 bp, Homo sapiens
tctgtcagatgagaacaaagc

SEQ ID NO: 959846 - DNA, 19 bp, Homo sapiens
tctgtcagggccttggccc

SEQ ID NO: 959847 - DNA, 15 bp, Homo sapiens
tctgtcagtaaaact

SEQ ID NO: 959848 - DNA, 12 bp, Homo sapiens
tctgtcagttct

SEQ ID NO: 959849 - DNA, 15 bp, Homo sapiens
tctgtcatcactccc

SEQ ID NO: 959850 - DNA, 18 bp, Homo sapiens
tctgtcatcactccctgg

SEQ ID NO: 959851 - DNA, 17 bp, Homo sapiens
tctgtcatctctctggg

SEQ ID NO: 959852 - DNA, 21 bp, Homo sapiens
tctgtcatctctctggggccc

SEQ ID NO: 959853 - DNA, 23 bp, Homo sapiens
tctgtcatctctctggggccctg

SEQ ID NO: 959854 - DNA, 15 bp, Homo sapiens
tctgtccaaaggagg

SEQ ID NO: 959855 - DNA, 12 bp, Homo sapiens
tctgtccaagga

SEQ ID NO: 959856 - DNA, 19 bp, Homo sapiens
tctgtccacatccccagag

SEQ ID NO: 959857 - DNA, 22 bp, Homo sapiens
tctgtccacatccccagagccc

SEQ ID NO: 959858 - DNA, 21 bp, Homo sapiens
tctgtccagctcccgctgtgg

SEQ ID NO: 959859 - DNA, 12 bp, Homo sapiens
tctgtccaggcc

SEQ ID NO: 959860 - DNA, 16 bp, Homo sapiens
tctgtccaggccactg

SEQ ID NO: 959861 - DNA, 17 bp, Homo sapiens
tctgtccaggccactgt

SEQ ID NO: 959862 - DNA, 20 bp, Homo sapiens
tctgtccaggcccttaggga

SEQ ID NO: 959863 - DNA, 19 bp, Homo sapiens
tctgtccagggccctgagc

SEQ ID NO: 959864 - DNA, 14 bp, Homo sapiens
tctgtccccacgag

SEQ ID NO: 959865 - DNA, 15 bp, Homo sapiens
tctgtccccacgagg

SEQ ID NO: 959866 - DNA, 12 bp, Homo sapiens
tctgtccccagc

SEQ ID NO: 959867 - DNA, 13 bp, Homo sapiens
tctgtccccagcc

SEQ ID NO: 959868 - DNA, 20 bp, Homo sapiens
tctgtccccagccctgtcct

SEQ ID NO: 959869 - DNA, 14 bp, Homo sapiens
tctgtccccaggcc

SEQ ID NO: 959870 - DNA, 19 bp, Homo sapiens
tctgtccccaggcctggct

SEQ ID NO: 959871 - DNA, 16 bp, Homo sapiens
tctgtccccaggtcct

SEQ ID NO: 959872 - DNA, 13 bp, Homo sapiens
tctgtcccccagg

SEQ ID NO: 959873 - DNA, 15 bp, Homo sapiens
tctgtcccccaggct

SEQ ID NO: 959874 - DNA, 20 bp, Homo sapiens
gcttgaaggccctgctgagt

SEQ ID NO: 959875 - DNA, 17 bp, Homo sapiens
gcttgacatacctacca

SEQ ID NO: 959876 - DNA, 22 bp, Homo sapiens
gcttgaccgtactctcacatgt

SEQ ID NO: 959877 - DNA, 13 bp, Homo sapiens
gcttgactctcac

SEQ ID NO: 959878 - DNA, 22 bp, Homo sapiens
gcttgagaaggttactgagtga

SEQ ID NO: 959879 - DNA, 16 bp, Homo sapiens
gcttgagcccaggagt

SEQ ID NO: 959880 - DNA, 18 bp, Homo sapiens
gcttgagccgggcccctg

SEQ ID NO: 959881 - DNA, 21 bp, Homo sapiens
gcttgagccgggcccctgggc

SEQ ID NO: 959882 - DNA, 13 bp, Homo sapiens
gcttgagggaggg

SEQ ID NO: 959883 - DNA, 15 bp, Homo sapiens
gcttgaggtgaattt

SEQ ID NO: 959884 - DNA, 18 bp, Homo sapiens
gcttgaggtgaatttcat

SEQ ID NO: 959885 - DNA, 22 bp, Homo sapiens
gcttgagtgagaagagcttgca

SEQ ID NO: 959886 - DNA, 19 bp, Homo sapiens
gcttgagtttggggaatgc

SEQ ID NO: 959887 - DNA, 18 bp, Homo sapiens
gcttgataatatataaac

SEQ ID NO: 959888 - DNA, 20 bp, Homo sapiens
gcttgatccagaagagccca

SEQ ID NO: 959889 - DNA, 15 bp, Homo sapiens
gcttgatctgtgatt

SEQ ID NO: 959890 - DNA, 13 bp, Homo sapiens
gcttgatgaagca

SEQ ID NO: 959891 - DNA, 18 bp, Homo sapiens
gcttgattttaatacatt

SEQ ID NO: 959892 - DNA, 14 bp, Homo sapiens
gcttgatttttgcc

SEQ ID NO: 959893 - DNA, 16 bp, Homo sapiens
gcttgcaatgtagtca

SEQ ID NO: 959894 - DNA, 22 bp, Homo sapiens
gcttgcactttgtaacatgttt

SEQ ID NO: 959895 - DNA, 13 bp, Homo sapiens
gcttgcagccagg

SEQ ID NO: 959896 - DNA, 19 bp, Homo sapiens
gcttgcagtgagccgagat

SEQ ID NO: 959897 - DNA, 15 bp, Homo sapiens
gcttgcataataagc

SEQ ID NO: 959898 - DNA, 15 bp, Homo sapiens
gcttgccccaggact

SEQ ID NO: 959899 - DNA, 18 bp, Homo sapiens
gcttgccccaggactctg

SEQ ID NO: 959900 - DNA, 20 bp, Homo sapiens
gcttgccgagcctaatgaaa

SEQ ID NO: 959901 - DNA, 15 bp, Homo sapiens
gcttgcctaatggct

SEQ ID NO: 959902 - DNA, 21 bp, Homo sapiens
gcttgcctagggcctggtcca

SEQ ID NO: 959903 - DNA, 14 bp, Homo sapiens
gcttgcctgaagct

SEQ ID NO: 959904 - DNA, 22 bp, Homo sapiens
gcttgcctgggctgggcagcct

SEQ ID NO: 959905 - DNA, 22 bp, Homo sapiens
gcttgcgccgagaccgcagagg

SEQ ID NO: 959906 - DNA, 22 bp, Homo sapiens
gcttgctccagattctgatgca

SEQ ID NO: 959907 - DNA, 14 bp, Homo sapiens
gcttgctccagggt

SEQ ID NO: 959908 - DNA, 18 bp, Homo sapiens
gcttgctgggtacctggt

SEQ ID NO: 959909 - DNA, 17 bp, Homo sapiens
gcttggacttcctgggg

SEQ ID NO: 959910 - DNA, 14 bp, Homo sapiens
gcttggagcagagg

SEQ ID NO: 959911 - DNA, 13 bp, Homo sapiens
gcttggcagctga

SEQ ID NO: 959912 - DNA, 15 bp, Homo sapiens
gcttggcccagcgcc

SEQ ID NO: 959913 - DNA, 19 bp, Homo sapiens
gcttggcccgcggcctgca

SEQ ID NO: 959914 - DNA, 13 bp, Homo sapiens
gcttggcctgctg

SEQ ID NO: 959915 - DNA, 15 bp, Homo sapiens
gcttggcctgctgtg

SEQ ID NO: 959916 - DNA, 16 bp, Homo sapiens
gcttggcctgctgtga

SEQ ID NO: 959917 - DNA, 23 bp, Homo sapiens
gcttggccttatgaccagtgaga

SEQ ID NO: 959918 - DNA, 11 bp, Homo sapiens
gcttggccttg

SEQ ID NO: 959919 - DNA, 18 bp, Homo sapiens
gcttggccttgggccggt

SEQ ID NO: 959920 - DNA, 12 bp, Homo sapiens
gcttggccttgt

SEQ ID NO: 959921 - DNA, 14 bp, Homo sapiens
gcttggctgtagga

SEQ ID NO: 959922 - DNA, 15 bp, Homo sapiens
gcttgggaattttat

SEQ ID NO: 959923 - DNA, 20 bp, Homo sapiens
gcttgggacgtgtacagcac

SEQ ID NO: 959924 - DNA, 11 bp, Homo sapiens
gcttgggactc

SEQ ID NO: 959925 - DNA, 19 bp, Homo sapiens
gcttgggactcaggtctgt

SEQ ID NO: 959926 - DNA, 14 bp, Homo sapiens
gcttgggatttgct

SEQ ID NO: 959927 - DNA, 15 bp, Homo sapiens
gcttgggcagtgccc

SEQ ID NO: 959928 - DNA, 15 bp, Homo sapiens
gcttgggcccagctg

SEQ ID NO: 959929 - DNA, 17 bp, Homo sapiens
gcttgggcccagctggg

SEQ ID NO: 959930 - DNA, 19 bp, Homo sapiens
gcttgggcccagctgggct

SEQ ID NO: 959931 - DNA, 22 bp, Homo sapiens
tctgtttcctgaaatataaact

SEQ ID NO: 959932 - DNA, 19 bp, Homo sapiens
tctgtttcttctcttggtg

SEQ ID NO: 959933 - DNA, 14 bp, Homo sapiens
tctgtttgattctt

SEQ ID NO: 959934 - DNA, 18 bp, Homo sapiens
tctgtttgccacacccag

SEQ ID NO: 959935 - DNA, 16 bp, Homo sapiens
tctgtttgcgtacttg

SEQ ID NO: 959936 - DNA, 19 bp, Homo sapiens
tctgtttggactgcagaag

SEQ ID NO: 959937 - DNA, 13 bp, Homo sapiens
tctgtttggcact

SEQ ID NO: 959938 - DNA, 13 bp, Homo sapiens
tctgtttgtaaat

SEQ ID NO: 959939 - DNA, 14 bp, Homo sapiens
tctgtttgtaaatt

SEQ ID NO: 959940 - DNA, 19 bp, Homo sapiens
tctgtttgtatatttgcaa

SEQ ID NO: 959941 - DNA, 19 bp, Homo sapiens
tctgtttgtctgaacaaag

SEQ ID NO: 959942 - DNA, 12 bp, Homo sapiens
tctgtttgttaa

SEQ ID NO: 959943 - DNA, 13 bp, Homo sapiens
tctgtttgttatt

SEQ ID NO: 959944 - DNA, 13 bp, Homo sapiens
tctgtttgtttaa

SEQ ID NO: 959945 - DNA, 22 bp, Homo sapiens
tctgtttgtttaagctgagcca

SEQ ID NO: 959946 - DNA, 14 bp, Homo sapiens
tctgttttccccca

SEQ ID NO: 959947 - DNA, 15 bp, Homo sapiens
tctgttttgtgagaa

SEQ ID NO: 959948 - DNA, 16 bp, Homo sapiens
tctgttttgtgagaac

SEQ ID NO: 959949 - DNA, 20 bp, Homo sapiens
tctgttttgtggtttggaat

SEQ ID NO: 959950 - DNA, 23 bp, Homo sapiens
tctgttttgtttggcaaggaaag

SEQ ID NO: 959951 - DNA, 19 bp, Homo sapiens
tctgtttttaatgctattt

SEQ ID NO: 959952 - DNA, 18 bp, Homo sapiens
tctgtttttctaactggg

SEQ ID NO: 959953 - DNA, 14 bp, Homo sapiens
tctgtttttctcat

SEQ ID NO: 959954 - DNA, 14 bp, Homo sapiens
tctgtttttctttt

SEQ ID NO: 959955 - DNA, 12 bp, Homo sapiens
tctgtttttgta

SEQ ID NO: 959956 - DNA, 13 bp, Homo sapiens
tctgtttttgtat

SEQ ID NO: 959957 - DNA, 18 bp, Homo sapiens
tcttaaaaaataaaaact

SEQ ID NO: 959958 - DNA, 22 bp, Homo sapiens
tcttaaaaacaacgaaagaagg

SEQ ID NO: 959959 - DNA, 20 bp, Homo sapiens
tcttaaaaactgtgtatcat

SEQ ID NO: 959960 - DNA, 21 bp, Homo sapiens
tcttaaaaactgtgtatcatt

SEQ ID NO: 959961 - DNA, 12 bp, Homo sapiens
tcttaaaaattt

SEQ ID NO: 959962 - DNA, 17 bp, Homo sapiens
tcttaaaaatttataca

SEQ ID NO: 959963 - DNA, 15 bp, Homo sapiens
tcttaaaacaaagcc

SEQ ID NO: 959964 - DNA, 20 bp, Homo sapiens
tcttaaaaccagagaatctt

SEQ ID NO: 959965 - DNA, 18 bp, Homo sapiens
tcttaaaagtactttaaa

SEQ ID NO: 959966 - DNA, 21 bp, Homo sapiens
tcttaaaattcaagaaaataa

SEQ ID NO: 959967 - DNA, 13 bp, Homo sapiens
tcttaaacaatgt

SEQ ID NO: 959968 - DNA, 14 bp, Homo sapiens
tcttaaacaatgta

SEQ ID NO: 959969 - DNA, 16 bp, Homo sapiens
tcttaaacaatgtata

SEQ ID NO: 959970 - DNA, 16 bp, Homo sapiens
tcttaaaccttcagtt

SEQ ID NO: 959971 - DNA, 16 bp, Homo sapiens
tcttaaactaatacgt

SEQ ID NO: 959972 - DNA, 17 bp, Homo sapiens
tcttaaactcctggcct

SEQ ID NO: 959973 - DNA, 17 bp, Homo sapiens
tcttaaagaaacagctt

SEQ ID NO: 959974 - DNA, 14 bp, Homo sapiens
tcttaaagcatttc

SEQ ID NO: 959975 - DNA, 23 bp, Homo sapiens
tcttaaagctgcctgtagttagg

SEQ ID NO: 959976 - DNA, 21 bp, Homo sapiens
tcttaaagtgccagtatttta

SEQ ID NO: 959977 - DNA, 17 bp, Homo sapiens
tcttaaataaaaataat

SEQ ID NO: 959978 - DNA, 15 bp, Homo sapiens
tcttaaataaaacta

SEQ ID NO: 959979 - DNA, 16 bp, Homo sapiens
tcttaaataaaactat

SEQ ID NO: 959980 - DNA, 19 bp, Homo sapiens
tcttaaataagaaactttt

SEQ ID NO: 959981 - DNA, 22 bp, Homo sapiens
tcttaaataatgcttcagatat

SEQ ID NO: 959982 - DNA, 19 bp, Homo sapiens
tcttaaatactttttcagt

SEQ ID NO: 959983 - DNA, 13 bp, Homo sapiens
tcttaaatcattt

SEQ ID NO: 959984 - DNA, 18 bp, Homo sapiens
tcttaaatcatttggtta

SEQ ID NO: 959985 - DNA, 14 bp, Homo sapiens
tcttaaatgctcat

SEQ ID NO: 959986 - DNA, 15 bp, Homo sapiens
tcttaaatgctcata

SEQ ID NO: 959987 - DNA, 19 bp, Homo sapiens
tcttaaatgctcataaaga

SEQ ID NO: 959988 - DNA, 19 bp, Homo sapiens
tcttaaatgctcattttct

SEQ ID NO: 959989 - DNA, 12 bp, Homo sapiens
tcttaaattatt

SEQ ID NO: 959990 - DNA, 18 bp, Homo sapiens
tcttaaattttgttttct

SEQ ID NO: 959991 - DNA, 22 bp, Homo sapiens
tcttaacaaatcagatcagatg

SEQ ID NO: 959992 - DNA, 19 bp, Homo sapiens
tcttaacaatttctgtcct

SEQ ID NO: 959993 - DNA, 12 bp, Homo sapiens
tcttaaccatct

SEQ ID NO: 959994 - DNA, 23 bp, Homo sapiens
tcttaacccctaagactgccttc

SEQ ID NO: 959995 - DNA, 15 bp, Homo sapiens
tcttaactgtatttc

SEQ ID NO: 959996 - DNA, 16 bp, Homo sapiens
tcttaactgtatttca

SEQ ID NO: 959997 - DNA, 19 bp, Homo sapiens
tcttcacctaagtctctgt

SEQ ID NO: 959998 - DNA, 17 bp, Homo sapiens
tcttcacctcagagtgg

SEQ ID NO: 959999 - DNA, 16 bp, Homo sapiens
tcttcacctctatcca

SEQ ID NO: 960000 - DNA, 18 bp, Homo sapiens
tcttcacctgttatgtat

SEQ ID NO: 960001 - DNA, 21 bp, Homo sapiens
tcttcacctttgtaagacatt

SEQ ID NO: 960002 - DNA, 16 bp, Homo sapiens
tcttcactcaaatttt

SEQ ID NO: 960003 - DNA, 18 bp, Homo sapiens
tcttcactctctgaagat

SEQ ID NO: 960004 - DNA, 15 bp, Homo sapiens
tcttcactcttcact

SEQ ID NO: 960005 - DNA, 20 bp, Homo sapiens
tcttcactgcaattttgtgt

SEQ ID NO: 960006 - DNA, 19 bp, Homo sapiens
tcttcactgtggccacagc

SEQ ID NO: 960007 - DNA, 17 bp, Homo sapiens
tcttcacttaatccatt

SEQ ID NO: 960008 - DNA, 17 bp, Homo sapiens
tcttcacttacaagaaa

SEQ ID NO: 960009 - DNA, 17 bp, Homo sapiens
tcttcagaacacacaga

SEQ ID NO: 960010 - DNA, 20 bp, Homo sapiens
tcttcagaacacacagactt

SEQ ID NO: 960011 - DNA, 16 bp, Homo sapiens
tcttcagaactgccct

SEQ ID NO: 960012 - DNA, 17 bp, Homo sapiens
tcttcagaactgccctt

SEQ ID NO: 960013 - DNA, 22 bp, Homo sapiens
tcttcagaactgcccttgctgc

SEQ ID NO: 960014 - DNA, 14 bp, Homo sapiens
tcttcagaggccct

SEQ ID NO: 960015 - DNA, 15 bp, Homo sapiens
tcttcagatctctaa

SEQ ID NO: 960016 - DNA, 12 bp, Homo sapiens
tcttcagcccag

SEQ ID NO: 960017 - DNA, 17 bp, Homo sapiens
tcttcagcccaggcttt

SEQ ID NO: 960018 - DNA, 13 bp, Homo sapiens
tcttcagcctccc

SEQ ID NO: 960019 - DNA, 15 bp, Homo sapiens
tcttcagcctccctc

SEQ ID NO: 960020 - DNA, 16 bp, Homo sapiens
tcttcagcctccctca

SEQ ID NO: 960021 - DNA, 17 bp, Homo sapiens
tcttcagcctccctcag

SEQ ID NO: 960022 - DNA, 21 bp, Homo sapiens
tcttcaggaggccctggtgtc

SEQ ID NO: 960023 - DNA, 13 bp, Homo sapiens
tcttcaggcctcc

SEQ ID NO: 960024 - DNA, 15 bp, Homo sapiens
tcttcaggcctccct

SEQ ID NO: 960025 - DNA, 16 bp, Homo sapiens
tcttcagtaagccgtg

SEQ ID NO: 960026 - DNA, 19 bp, Homo sapiens
tcttcagtgcaaattgtat

SEQ ID NO: 960027 - DNA, 19 bp, Homo sapiens
tcttcagtggaacacaaat

SEQ ID NO: 960028 - DNA, 23 bp, Homo sapiens
tcttcagtggaacacaaatgaaa

SEQ ID NO: 960029 - DNA, 16 bp, Homo sapiens
tcttcagtgtctctgt

SEQ ID NO: 960030 - DNA, 18 bp, Homo sapiens
tcttcagtgtctctgttt

SEQ ID NO: 960031 - DNA, 12 bp, Homo sapiens
tcttcagtttta

SEQ ID NO: 960032 - DNA, 19 bp, Homo sapiens
tcttcatatttttgatcat

SEQ ID NO: 960033 - DNA, 18 bp, Homo sapiens
tcttcatcacttcttcca

SEQ ID NO: 960034 - DNA, 19 bp, Homo sapiens
tcttcatcacttcttccac

SEQ ID NO: 960035 - DNA, 20 bp, Homo sapiens
tcttcatgagtagtgggcta

SEQ ID NO: 960036 - DNA, 17 bp, Homo sapiens
tcttcatgcaatgacat

SEQ ID NO: 960037 - DNA, 21 bp, Homo sapiens
tcttcatggcatcttcaatat

SEQ ID NO: 960038 - DNA, 23 bp, Homo sapiens
tcttcatgtaaattgactgtact

SEQ ID NO: 960039 - DNA, 19 bp, Homo sapiens
tcttcatgtgatgtcatga

SEQ ID NO: 960040 - DNA, 16 bp, Homo sapiens
tcttcatttcattgta

SEQ ID NO: 960041 - DNA, 17 bp, Homo sapiens
tcttcatttcattgtat

SEQ ID NO: 960042 - DNA, 21 bp, Homo sapiens
tcttcatttcattgtatgatg

SEQ ID NO: 960043 - DNA, 22 bp, Homo sapiens
tcttcatttcattgtatgatgt

SEQ ID NO: 960044 - DNA, 19 bp, Homo sapiens
tcttcattttttttaattg

SEQ ID NO: 960045 - DNA, 14 bp, Homo sapiens
tcttccaaagcaca

SEQ ID NO: 960046 - DNA, 20 bp, Homo sapiens
tcttccaaagtaaaattgct

SEQ ID NO: 960047 - DNA, 21 bp, Homo sapiens
tcttccaaatgcagttcattg

SEQ ID NO: 960048 - DNA, 24 bp, Homo sapiens
tcttccaagcaaaggtgaagagac

SEQ ID NO: 960049 - DNA, 18 bp, Homo sapiens
tcttccacaaagaaaatt

SEQ ID NO: 960050 - DNA, 14 bp, Homo sapiens
tcttccacctgtgc

SEQ ID NO: 960051 - DNA, 19 bp, Homo sapiens
tcttccacctgtgccctca

SEQ ID NO: 960052 - DNA, 12 bp, Homo sapiens
tcttccagccac

SEQ ID NO: 960053 - DNA, 13 bp, Homo sapiens
tcttccagcttct

SEQ ID NO: 960054 - DNA, 18 bp, Homo sapiens
tcttccaggagccacctt

SEQ ID NO: 960055 - DNA, 13 bp, Homo sapiens
tcttccaggatgg

SEQ ID NO: 960056 - DNA, 14 bp, Homo sapiens
tcttccagggggaa

SEQ ID NO: 960057 - DNA, 21 bp, Homo sapiens
tcttccaggtccaaacccttc

SEQ ID NO: 960058 - DNA, 21 bp, Homo sapiens
tcttccagtgaacattcccag

SEQ ID NO: 960059 - DNA, 19 bp, Homo sapiens
tcttccatcatcactgtaa

SEQ ID NO: 960060 - DNA, 22 bp, Homo sapiens
tcttccatctgcatcttaacat

SEQ ID NO: 960061 - DNA, 19 bp, Homo sapiens
gctttgccagctgctgctg

SEQ ID NO: 960062 - DNA, 19 bp, Homo sapiens
gctttgccatgggcctgct

SEQ ID NO: 960063 - DNA, 15 bp, Homo sapiens
gctttgcccacccct

SEQ ID NO: 960064 - DNA, 17 bp, Homo sapiens
gctttgcccacccctca

SEQ ID NO: 960065 - DNA, 22 bp, Homo sapiens
gctttgccttccacgctgtctc

SEQ ID NO: 960066 - DNA, 24 bp, Homo sapiens
gctttgccttccacgctgtctcca

SEQ ID NO: 960067 - DNA, 23 bp, Homo sapiens
gctttgctacaaatttatgcatt

SEQ ID NO: 960068 - DNA, 17 bp, Homo sapiens
gctttgctccgctccca

SEQ ID NO: 960069 - DNA, 21 bp, Homo sapiens
gctttgctcttgtcccacgtg

SEQ ID NO: 960070 - DNA, 14 bp, Homo sapiens
gctttgctgcacag

SEQ ID NO: 960071 - DNA, 16 bp, Homo sapiens
gctttgctgcacagca

SEQ ID NO: 960072 - DNA, 12 bp, Homo sapiens
gctttgctgcta

SEQ ID NO: 960073 - DNA, 15 bp, Homo sapiens
gctttgctgctacag

SEQ ID NO: 960074 - DNA, 16 bp, Homo sapiens
gctttgctgctacagg

SEQ ID NO: 960075 - DNA, 14 bp, Homo sapiens
gctttgctgctacc

SEQ ID NO: 960076 - DNA, 21 bp, Homo sapiens
gctttgcttatggtaataaaa

SEQ ID NO: 960077 - DNA, 18 bp, Homo sapiens
gctttgctttctgctcag

SEQ ID NO: 960078 - DNA, 16 bp, Homo sapiens
gctttggcagtgccat

SEQ ID NO: 960079 - DNA, 18 bp, Homo sapiens
gctttggcctgtgagcca

SEQ ID NO: 960080 - DNA, 15 bp, Homo sapiens
gctttggcctttcct

SEQ ID NO: 960081 - DNA, 18 bp, Homo sapiens
gctttggcctttccttgt

SEQ ID NO: 960082 - DNA, 16 bp, Homo sapiens
gctttggctgagacct

SEQ ID NO: 960083 - DNA, 12 bp, Homo sapiens
gctttgggccca

SEQ ID NO: 960084 - DNA, 13 bp, Homo sapiens
gctttgggcccaa

SEQ ID NO: 960085 - DNA, 14 bp, Homo sapiens
gctttgggcccaag

SEQ ID NO: 960086 - DNA, 18 bp, Homo sapiens
gctttgggctgccctggt

SEQ ID NO: 960087 - DNA, 19 bp, Homo sapiens
gctttgggtgcctttgcca

SEQ ID NO: 960088 - DNA, 22 bp, Homo sapiens
gctttgggtggctcactactga

SEQ ID NO: 960089 - DNA, 19 bp, Homo sapiens
gctttggttccttctctgg

SEQ ID NO: 960090 - DNA, 20 bp, Homo sapiens
gctttggttccttctctggg

SEQ ID NO: 960091 - DNA, 15 bp, Homo sapiens
gctttgtaggtgtct

SEQ ID NO: 960092 - DNA, 19 bp, Homo sapiens
gctttgtcacttgccacat

SEQ ID NO: 960093 - DNA, 20 bp, Homo sapiens
gctttgtcacttgccacatg

SEQ ID NO: 960094 - DNA, 12 bp, Homo sapiens
gctttgtccagg

SEQ ID NO: 960095 - DNA, 22 bp, Homo sapiens
gctttgtgcttgtcattccaga

SEQ ID NO: 960096 - DNA, 16 bp, Homo sapiens
gctttgtgtgattgaa

SEQ ID NO: 960097 - DNA, 16 bp, Homo sapiens
gctttgtttggatgcc

SEQ ID NO: 960098 - DNA, 14 bp, Homo sapiens
gctttgttttaata

SEQ ID NO: 960099 - DNA, 16 bp, Homo sapiens
gctttgttttccctgg

SEQ ID NO: 960100 - DNA, 14 bp, Homo sapiens
gctttgttttgcac

SEQ ID NO: 960101 - DNA, 16 bp, Homo sapiens
gcttttaaaaaatatt

SEQ ID NO: 960102 - DNA, 23 bp, Homo sapiens
gcttttaaaaaatattttaagaa

SEQ ID NO: 960103 - DNA, 12 bp, Homo sapiens
gcttttaagaaa

SEQ ID NO: 960104 - DNA, 16 bp, Homo sapiens
gcttttaattctcatt

SEQ ID NO: 960105 - DNA, 22 bp, Homo sapiens
gcttttaattctcatttgttct

SEQ ID NO: 960106 - DNA, 18 bp, Homo sapiens
gcttttatatatgaagtt

SEQ ID NO: 960107 - DNA, 22 bp, Homo sapiens
gcttttatatggcccagccttg

SEQ ID NO: 960108 - DNA, 22 bp, Homo sapiens
gcttttatctcagatgttaaaa

SEQ ID NO: 960109 - DNA, 14 bp, Homo sapiens
gcttttatgaggaa

SEQ ID NO: 960110 - DNA, 18 bp, Homo sapiens
gcttttattaatgcactt

SEQ ID NO: 960111 - DNA, 19 bp, Homo sapiens
gcttttattaatgcacttt

SEQ ID NO: 960112 - DNA, 17 bp, Homo sapiens
gcttttattcctttgaa

SEQ ID NO: 960113 - DNA, 21 bp, Homo sapiens
gcttttattgcaccattttca

SEQ ID NO: 960114 - DNA, 22 bp, Homo sapiens
gcttttattgcaccattttcaa

SEQ ID NO: 960115 - DNA, 12 bp, Homo sapiens
gcttttattgga

SEQ ID NO: 960116 - DNA, 21 bp, Homo sapiens
gcttttattttttcttttgta

SEQ ID NO: 960117 - DNA, 14 bp, Homo sapiens
gcttttcatgtaga

SEQ ID NO: 960118 - DNA, 22 bp, Homo sapiens
gcttttcatgtagaactcagca

SEQ ID NO: 960119 - DNA, 23 bp, Homo sapiens
ggaaagacaactgttttaataaa

SEQ ID NO: 960120 - DNA, 15 bp, Homo sapiens
ggaaagacaggaaga

SEQ ID NO: 960121 - DNA, 19 bp, Homo sapiens
ggaaagacaggaagaccaa

SEQ ID NO: 960122 - DNA, 22 bp, Homo sapiens
ggaaagacctacattccctctc

SEQ ID NO: 960123 - DNA, 18 bp, Homo sapiens
ggaaagagagtttgtaag

SEQ ID NO: 960124 - DNA, 14 bp, Homo sapiens
ggaaagatggataa

SEQ ID NO: 960125 - DNA, 15 bp, Homo sapiens
ggaaagatggataaa

SEQ ID NO: 960126 - DNA, 22 bp, Homo sapiens
ggaaagatggataaactgagcc

SEQ ID NO: 960127 - DNA, 17 bp, Homo sapiens
ggaaagatgttaagcat

SEQ ID NO: 960128 - DNA, 14 bp, Homo sapiens
ggaaagcagaactg

SEQ ID NO: 960129 - DNA, 18 bp, Homo sapiens
ggaaagcagcattctgga

SEQ ID NO: 960130 - DNA, 18 bp, Homo sapiens
ggaaagccacctctccct

SEQ ID NO: 960131 - DNA, 23 bp, Homo sapiens
ggaaagccacctctccctcaaca

SEQ ID NO: 960132 - DNA, 12 bp, Homo sapiens
ggaaagccctcc

SEQ ID NO: 960133 - DNA, 23 bp, Homo sapiens
ggaaagcgcctccaaccctagca

SEQ ID NO: 960134 - DNA, 13 bp, Homo sapiens
ggaaaggaaacat

SEQ ID NO: 960135 - DNA, 12 bp, Homo sapiens
ggaaaggaccca

SEQ ID NO: 960136 - DNA, 19 bp, Homo sapiens
ggaaaggattttaccaaag

SEQ ID NO: 960137 - DNA, 20 bp, Homo sapiens
ggaaaggctctgaaagccag

SEQ ID NO: 960138 - DNA, 11 bp, Homo sapiens
ggaaagggaag

SEQ ID NO: 960139 - DNA, 17 bp, Homo sapiens
ggaaagggcctggccag

SEQ ID NO: 960140 - DNA, 20 bp, Homo sapiens
ggaaagggctggctccccct

SEQ ID NO: 960141 - DNA, 12 bp, Homo sapiens
ggaaaggggaga

SEQ ID NO: 960142 - DNA, 14 bp, Homo sapiens
ggaaaggggagagc

SEQ ID NO: 960143 - DNA, 19 bp, Homo sapiens
ggaaaggggagagcctgct

SEQ ID NO: 960144 - DNA, 14 bp, Homo sapiens
ggaaaggggggagc

SEQ ID NO: 960145 - DNA, 22 bp, Homo sapiens
ggaaagggggtcccagtgggag

SEQ ID NO: 960146 - DNA, 20 bp, Homo sapiens
ggaaagggtgctgcttccct

SEQ ID NO: 960147 - DNA, 18 bp, Homo sapiens
ggaaaggtgtaggctggg

SEQ ID NO: 960148 - DNA, 20 bp, Homo sapiens
ggaaaggtgtgagactggga

SEQ ID NO: 960149 - DNA, 20 bp, Homo sapiens
ggaaagtcctgaactcctgg

SEQ ID NO: 960150 - DNA, 14 bp, Homo sapiens
ggaaagtgaatttg

SEQ ID NO: 960151 - DNA, 19 bp, Homo sapiens
ggaaagtgctgtcttaaac

SEQ ID NO: 960152 - DNA, 21 bp, Homo sapiens
ggaaagtttacccatgaagat

SEQ ID NO: 960153 - DNA, 15 bp, Homo sapiens
ggaaataaaaatgtt

SEQ ID NO: 960154 - DNA, 15 bp, Homo sapiens
ggaaataaaaccttt

SEQ ID NO: 960155 - DNA, 22 bp, Homo sapiens
ggaaataaacattacggtacag

SEQ ID NO: 960156 - DNA, 22 bp, Homo sapiens
ggaaataaaggtaaaatcactt

SEQ ID NO: 960157 - DNA, 17 bp, Homo sapiens
ggaaataacagagagaa

SEQ ID NO: 960158 - DNA, 17 bp, Homo sapiens
ggaaataagaaaaatca

SEQ ID NO: 960159 - DNA, 20 bp, Homo sapiens
ggaaataataaagatgctct

SEQ ID NO: 960160 - DNA, 19 bp, Homo sapiens
ggaaatacagttctgctct

SEQ ID NO: 960161 - DNA, 20 bp, Homo sapiens
ggaaatactttgcataaatt

SEQ ID NO: 960162 - DNA, 23 bp, Homo sapiens
ggaaatatatacaaaaagaaaat

SEQ ID NO: 960163 - DNA, 22 bp, Homo sapiens
ggaaatatcagttactcagccc

SEQ ID NO: 960164 - DNA, 15 bp, Homo sapiens
ggaaatatttatttt

SEQ ID NO: 960165 - DNA, 19 bp, Homo sapiens
ggaaatcaaccctctcctg

SEQ ID NO: 960166 - DNA, 18 bp, Homo sapiens
ggaaatcagccaagtttt

SEQ ID NO: 960167 - DNA, 21 bp, Homo sapiens
ggaaatcaggtagaccatatt

SEQ ID NO: 960168 - DNA, 23 bp, Homo sapiens
ggaaatcgggttcagaacacttt

SEQ ID NO: 960169 - DNA, 15 bp, Homo sapiens
ggaaatctgttttgt

SEQ ID NO: 960170 - DNA, 13 bp, Homo sapiens
ggaaatcttaaac

SEQ ID NO: 960171 - DNA, 14 bp, Homo sapiens
ggaaatgaaattgt

SEQ ID NO: 960172 - DNA, 15 bp, Homo sapiens
ggaaatgagatgaca

SEQ ID NO: 960173 - DNA, 17 bp, Homo sapiens
ggaaatgagtggccagc

SEQ ID NO: 960174 - DNA, 15 bp, Homo sapiens
ggaaatgcagaaatc

SEQ ID NO: 960175 - DNA, 15 bp, Homo sapiens
ggaaatgctgggctg

SEQ ID NO: 960176 - DNA, 19 bp, Homo sapiens
ggaaatggtatgagctgag

SEQ ID NO: 960177 - DNA, 12 bp, Homo sapiens
ggaaatgtactt

SEQ ID NO: 960178 - DNA, 15 bp, Homo sapiens
ggaaatgtacttttg

SEQ ID NO: 960179 - DNA, 20 bp, Homo sapiens
ggaaatgtattttgacactg

SEQ ID NO: 960180 - DNA, 17 bp, Homo sapiens
ggaaatgtcaacaagta

SEQ ID NO: 960181 - DNA, 14 bp, Homo sapiens
ggaaatgtgagaaa

SEQ ID NO: 960182 - DNA, 19 bp, Homo sapiens
ggaaattaagaagaaacta

SEQ ID NO: 960183 - DNA, 20 bp, Homo sapiens
ggaaattaggttgaaacata

SEQ ID NO: 960184 - DNA, 16 bp, Homo sapiens
ggaaattctgctcaga

SEQ ID NO: 960185 - DNA, 20 bp, Homo sapiens
ggaaattgaagtgtcttctg

SEQ ID NO: 960186 - DNA, 23 bp, Homo sapiens
ggaaattgagattagagggaggt

SEQ ID NO: 960187 - DNA, 17 bp, Homo sapiens
ggaaattgtttatgtgt

SEQ ID NO: 960188 - DNA, 21 bp, Homo sapiens
ggaaattttatatgtaaatgt

SEQ ID NO: 960189 - DNA, 23 bp, Homo sapiens
ggaaattttatatgtaaatgtgt

SEQ ID NO: 960190 - DNA, 15 bp, Homo sapiens
tcttctgttcccaag

SEQ ID NO: 960191 - DNA, 22 bp, Homo sapiens
tcttctgttcccaaggaagctc

SEQ ID NO: 960192 - DNA, 22 bp, Homo sapiens
tcttcttaatatgttcttttaa

SEQ ID NO: 960193 - DNA, 15 bp, Homo sapiens
tcttcttacacttct

SEQ ID NO: 960194 - DNA, 15 bp, Homo sapiens
tcttcttacatgcat

SEQ ID NO: 960195 - DNA, 22 bp, Homo sapiens
tcttcttatacagataaaacat

SEQ ID NO: 960196 - DNA, 13 bp, Homo sapiens
tcttcttccctcc

SEQ ID NO: 960197 - DNA, 19 bp, Homo sapiens
tcttcttcctgaagctgag

SEQ ID NO: 960198 - DNA, 13 bp, Homo sapiens
tcttcttcctggt

SEQ ID NO: 960199 - DNA, 12 bp, Homo sapiens
tcttcttctaag

SEQ ID NO: 960200 - DNA, 15 bp, Homo sapiens
tcttcttcttttcta

SEQ ID NO: 960201 - DNA, 17 bp, Homo sapiens
tcttcttgaaattttaa

SEQ ID NO: 960202 - DNA, 21 bp, Homo sapiens
tcttcttgggagtatgttgtc

SEQ ID NO: 960203 - DNA, 19 bp, Homo sapiens
tcttctttagatgccaaac

SEQ ID NO: 960204 - DNA, 17 bp, Homo sapiens
tcttctttattattcct

SEQ ID NO: 960205 - DNA, 20 bp, Homo sapiens
tcttctttattattcctagt

SEQ ID NO: 960206 - DNA, 17 bp, Homo sapiens
tcttctttattgcacta

SEQ ID NO: 960207 - DNA, 15 bp, Homo sapiens
tcttctttccctgga

SEQ ID NO: 960208 - DNA, 16 bp, Homo sapiens
tcttctttccctggac

SEQ ID NO: 960209 - DNA, 18 bp, Homo sapiens
tcttctttccctggacag

SEQ ID NO: 960210 - DNA, 13 bp, Homo sapiens
tcttctttctgag

SEQ ID NO: 960211 - DNA, 14 bp, Homo sapiens
tcttctttctgaga

SEQ ID NO: 960212 - DNA, 15 bp, Homo sapiens
tcttctttctggttg

SEQ ID NO: 960213 - DNA, 15 bp, Homo sapiens
tcttcttttcctgca

SEQ ID NO: 960214 - DNA, 19 bp, Homo sapiens
tcttctttttgcttcaaaa

SEQ ID NO: 960215 - DNA, 21 bp, Homo sapiens
tcttgaaaactgtgcaacttt

SEQ ID NO: 960216 - DNA, 23 bp, Homo sapiens
tcttgaaaactgtgcaacttttt

SEQ ID NO: 960217 - DNA, 15 bp, Homo sapiens
tcttgaaacagcctg

SEQ ID NO: 960218 - DNA, 20 bp, Homo sapiens
tcttgaaacctgttaaaaca

SEQ ID NO: 960219 - DNA, 20 bp, Homo sapiens
tcttgaaatataggaactta

SEQ ID NO: 960220 - DNA, 21 bp, Homo sapiens
tcttgaaatataggaacttaa

SEQ ID NO: 960221 - DNA, 16 bp, Homo sapiens
tcttgaaatattcaga

SEQ ID NO: 960222 - DNA, 13 bp, Homo sapiens
tcttgaaatgaaa

SEQ ID NO: 960223 - DNA, 13 bp, Homo sapiens
tcttgaaatgtag

SEQ ID NO: 960224 - DNA, 19 bp, Homo sapiens
tcttgaacattgtggacaa

SEQ ID NO: 960225 - DNA, 19 bp, Homo sapiens
tcttgaagaataaattcta

SEQ ID NO: 960226 - DNA, 21 bp, Homo sapiens
tcttgaagcatttcaaagccc

SEQ ID NO: 960227 - DNA, 20 bp, Homo sapiens
tcttgaagctgggctgtctc

SEQ ID NO: 960228 - DNA, 20 bp, Homo sapiens
tcttgaatactctgccctct

SEQ ID NO: 960229 - DNA, 16 bp, Homo sapiens
tcttgaatgtcttttg

SEQ ID NO: 960230 - DNA, 12 bp, Homo sapiens
tcttgaatgtgg

SEQ ID NO: 960231 - DNA, 19 bp, Homo sapiens
tcttgaatgtggtctcagg

SEQ ID NO: 960232 - DNA, 15 bp, Homo sapiens
tcttgaccctgcacc

SEQ ID NO: 960233 - DNA, 18 bp, Homo sapiens
tcttgaccctgcaccctc

SEQ ID NO: 960234 - DNA, 19 bp, Homo sapiens
tcttgactaggtattgtct

SEQ ID NO: 960235 - DNA, 13 bp, Homo sapiens
tcttgactctaaa

SEQ ID NO: 960236 - DNA, 15 bp, Homo sapiens
tcttgacttagacct

SEQ ID NO: 960237 - DNA, 24 bp, Homo sapiens
tcttgacttagacctatactgaaa

SEQ ID NO: 960238 - DNA, 16 bp, Homo sapiens
tcttgactttctgatt

SEQ ID NO: 960239 - DNA, 14 bp, Homo sapiens
tcttgagcatcaat

SEQ ID NO: 960240 - DNA, 14 bp, Homo sapiens
ggaacgactggact

SEQ ID NO: 960241 - DNA, 22 bp, Homo sapiens
ggaacgagcactggccagagag

SEQ ID NO: 960242 - DNA, 14 bp, Homo sapiens
ggaacgatgtgtct

SEQ ID NO: 960243 - DNA, 21 bp, Homo sapiens
ggaacgccgggactgagagac

SEQ ID NO: 960244 - DNA, 19 bp, Homo sapiens
ggaacggccctgcaggagc

SEQ ID NO: 960245 - DNA, 21 bp, Homo sapiens
ggaacggccctgcaggagcag

SEQ ID NO: 960246 - DNA, 20 bp, Homo sapiens
ggaacggctgatgtggactg

SEQ ID NO: 960247 - DNA, 20 bp, Homo sapiens
ggaacggtaaatttctgtgg

SEQ ID NO: 960248 - DNA, 22 bp, Homo sapiens
ggaacgtgtgtccaggctctgg

SEQ ID NO: 960249 - DNA, 13 bp, Homo sapiens
ggaactactgtac

SEQ ID NO: 960250 - DNA, 16 bp, Homo sapiens
ggaactactgtacttt

SEQ ID NO: 960251 - DNA, 22 bp, Homo sapiens
ggaactagagggatacactgaa

SEQ ID NO: 960252 - DNA, 19 bp, Homo sapiens
ggaactatacccgggacca

SEQ ID NO: 960253 - DNA, 17 bp, Homo sapiens
ggaactcatctggttga

SEQ ID NO: 960254 - DNA, 13 bp, Homo sapiens
ggaactccactct

SEQ ID NO: 960255 - DNA, 12 bp, Homo sapiens
ggaactccagga

SEQ ID NO: 960256 - DNA, 18 bp, Homo sapiens
ggaactccaggacgagga

SEQ ID NO: 960257 - DNA, 22 bp, Homo sapiens
ggaactcccagcaacacaagct

SEQ ID NO: 960258 - DNA, 13 bp, Homo sapiens
ggaactgggctgg

SEQ ID NO: 960259 - DNA, 14 bp, Homo sapiens
ggaactgtccagag

SEQ ID NO: 960260 - DNA, 15 bp, Homo sapiens
ggaactgtccagaga

SEQ ID NO: 960261 - DNA, 16 bp, Homo sapiens
ggaactgtccagagag

SEQ ID NO: 960262 - DNA, 18 bp, Homo sapiens
ggaactgtccagagagca

SEQ ID NO: 960263 - DNA, 16 bp, Homo sapiens
ggaacttgaactgatt

SEQ ID NO: 960264 - DNA, 21 bp, Homo sapiens
ggaacttgagcgtgaatctgt

SEQ ID NO: 960265 - DNA, 22 bp, Homo sapiens
ggaacttgcgagtccaaggcca

SEQ ID NO: 960266 - DNA, 11 bp, Homo sapiens
ggaacttgtct

SEQ ID NO: 960267 - DNA, 12 bp, Homo sapiens
ggaagaaacaaa

SEQ ID NO: 960268 - DNA, 15 bp, Homo sapiens
ggaagaaactgctga

SEQ ID NO: 960269 - DNA, 18 bp, Homo sapiens
ggaagaaagagcttgagg

SEQ ID NO: 960270 - DNA, 23 bp, Homo sapiens
ggaagaaattcctgtagcatctt

SEQ ID NO: 960271 - DNA, 16 bp, Homo sapiens
ggaagaacatagaact

SEQ ID NO: 960272 - DNA, 22 bp, Homo sapiens
ggaagaagaaatctttctccct

SEQ ID NO: 960273 - DNA, 21 bp, Homo sapiens
ggaagaagacaaatgacagat

SEQ ID NO: 960274 - DNA, 15 bp, Homo sapiens
ggaagaagagatgca

SEQ ID NO: 960275 - DNA, 13 bp, Homo sapiens
ggaagaagagcaa

SEQ ID NO: 960276 - DNA, 14 bp, Homo sapiens
ggaagaaggcagtg

SEQ ID NO: 960277 - DNA, 15 bp, Homo sapiens
ggaagaagggagaag

SEQ ID NO: 960278 - DNA, 16 bp, Homo sapiens
ggaagaagggagaaga

SEQ ID NO: 960279 - DNA, 18 bp, Homo sapiens
ggaagaagggagaagaaa

SEQ ID NO: 960280 - DNA, 16 bp, Homo sapiens
ggaagaattggggatt

SEQ ID NO: 960281 - DNA, 22 bp, Homo sapiens
ggaagacaatgtgaaaagaaaa

SEQ ID NO: 960282 - DNA, 19 bp, Homo sapiens
ggaagacaggtctagactt

SEQ ID NO: 960283 - DNA, 23 bp, Homo sapiens
ggaagacagttctacagaaaaac

SEQ ID NO: 960284 - DNA, 23 bp, Homo sapiens
ggaagacataaaactttaaaagg

SEQ ID NO: 960285 - DNA, 19 bp, Homo sapiens
ggaagaccaaaggaaggaa

SEQ ID NO: 960286 - DNA, 23 bp, Homo sapiens
ggaagaccagaattcccttgaat

SEQ ID NO: 960287 - DNA, 23 bp, Homo sapiens
ggaagaccccacccaagcttggc

SEQ ID NO: 960288 - DNA, 18 bp, Homo sapiens
ggaagactcaggagtctg

SEQ ID NO: 960289 - DNA, 20 bp, Homo sapiens
ggaagactcaggagtctgcc

SEQ ID NO: 960290 - DNA, 22 bp, Homo sapiens
ggaagactcaggagtctgccac

SEQ ID NO: 960291 - DNA, 19 bp, Homo sapiens
ggaagacttgaagcacaga

SEQ ID NO: 960292 - DNA, 13 bp, Homo sapiens
ggaagagaaaaaa

SEQ ID NO: 960293 - DNA, 15 bp, Homo sapiens
ggaagagaaattttt

SEQ ID NO: 960294 - DNA, 15 bp, Homo sapiens
ggaagagcagcctga

SEQ ID NO: 960295 - DNA, 16 bp, Homo sapiens
ggaagagcaggactcc

SEQ ID NO: 960296 - DNA, 23 bp, Homo sapiens
ggaagagcaggactccaggccca

SEQ ID NO: 960297 - DNA, 14 bp, Homo sapiens
ggaagagcaggcac

SEQ ID NO: 960298 - DNA, 12 bp, Homo sapiens
ggaagagccacc

SEQ ID NO: 960299 - DNA, 15 bp, Homo sapiens
ggaagagccacctgc

SEQ ID NO: 960300 - DNA, 15 bp, Homo sapiens
ggaagagcccagtct

SEQ ID NO: 960301 - DNA, 20 bp, Homo sapiens
ggaagagcccagtctgttga

SEQ ID NO: 960302 - DNA, 17 bp, Homo sapiens
ggaagagcccgcagggc

SEQ ID NO: 960303 - DNA, 22 bp, Homo sapiens
ggaagagctcccctccacagct

SEQ ID NO: 960304 - DNA, 15 bp, Homo sapiens
ggaagagggacagat

SEQ ID NO: 960305 - DNA, 16 bp, Homo sapiens
ggaagagggagaccaa

SEQ ID NO: 960306 - DNA, 21 bp, Homo sapiens
ggaagagggcagtacctggga

SEQ ID NO: 960307 - DNA, 22 bp, Homo sapiens
ggaagaggggtgcagaggctgt

SEQ ID NO: 960308 - DNA, 13 bp, Homo sapiens
ggaagagtttttg

SEQ ID NO: 960309 - DNA, 22 bp, Homo sapiens
ggaagagtttttgtgatggggg

SEQ ID NO: 960310 - DNA, 18 bp, Homo sapiens
ggaagataggctctgcac

SEQ ID NO: 960311 - DNA, 18 bp, Homo sapiens
ggaagatcccccagaaaa

SEQ ID NO: 960312 - DNA, 20 bp, Homo sapiens
ggaagatcccctctcctgcc

SEQ ID NO: 960313 - DNA, 22 bp, Homo sapiens
ggaagatcctgcgggtggggct

SEQ ID NO: 960314 - DNA, 23 bp, Homo sapiens
ggaagatgaactttgtcattatg

SEQ ID NO: 960315 - DNA, 19 bp, Homo sapiens
ggaagatgtctcagagcct

SEQ ID NO: 960316 - DNA, 23 bp, Homo sapiens
ggaagattctatttaattgaaac

SEQ ID NO: 960317 - DNA, 16 bp, Homo sapiens
tcttggaaagaaacaa

SEQ ID NO: 960318 - DNA, 15 bp, Homo sapiens
tcttggaaatcaggt

SEQ ID NO: 960319 - DNA, 19 bp, Homo sapiens
tcttggaagctgtttggaa

SEQ ID NO: 960320 - DNA, 17 bp, Homo sapiens
tcttggacaacagctct

SEQ ID NO: 960321 - DNA, 14 bp, Homo sapiens
tcttggacctctgc

SEQ ID NO: 960322 - DNA, 16 bp, Homo sapiens
tcttggacctctgctc

SEQ ID NO: 960323 - DNA, 14 bp, Homo sapiens
tcttggaccttggc

SEQ ID NO: 960324 - DNA, 12 bp, Homo sapiens
tcttggagaagt

SEQ ID NO: 960325 - DNA, 16 bp, Homo sapiens
tcttggagaagtctca

SEQ ID NO: 960326 - DNA, 17 bp, Homo sapiens
tcttggagaccctgcaa

SEQ ID NO: 960327 - DNA, 23 bp, Homo sapiens
tcttggagcctctttttccttct

SEQ ID NO: 960328 - DNA, 16 bp, Homo sapiens
tcttggagctgagcct

SEQ ID NO: 960329 - DNA, 15 bp, Homo sapiens
tcttggagtttttca

SEQ ID NO: 960330 - DNA, 19 bp, Homo sapiens
tcttggataccagctcagg

SEQ ID NO: 960331 - DNA, 18 bp, Homo sapiens
tcttggcaagatgtttct

SEQ ID NO: 960332 - DNA, 14 bp, Homo sapiens
tcttggctgacccc

SEQ ID NO: 960333 - DNA, 15 bp, Homo sapiens
tcttggctgacccct

SEQ ID NO: 960334 - DNA, 17 bp, Homo sapiens
tcttggctgacccctct

SEQ ID NO: 960335 - DNA, 19 bp, Homo sapiens
tcttggctgacccctctgg

SEQ ID NO: 960336 - DNA, 19 bp, Homo sapiens
tcttggctgcctgtgggct

SEQ ID NO: 960337 - DNA, 15 bp, Homo sapiens
tcttggcttaatcat

SEQ ID NO: 960338 - DNA, 20 bp, Homo sapiens
tcttggcttaatcattttca

SEQ ID NO: 960339 - DNA, 21 bp, Homo sapiens
tcttggcttaatcattttcat

SEQ ID NO: 960340 - DNA, 18 bp, Homo sapiens
tcttggcttctgggacct

SEQ ID NO: 960341 - DNA, 19 bp, Homo sapiens
tcttggcttctgggacctg

SEQ ID NO: 960342 - DNA, 21 bp, Homo sapiens
tcttggcttcttaaaaactgt

SEQ ID NO: 960343 - DNA, 17 bp, Homo sapiens
tcttggcttggtgagga

SEQ ID NO: 960344 - DNA, 15 bp, Homo sapiens
tcttgggaaacaccc

SEQ ID NO: 960345 - DNA, 14 bp, Homo sapiens
tcttgggaaatatg

SEQ ID NO: 960346 - DNA, 13 bp, Homo sapiens
tcttgggaactga

SEQ ID NO: 960347 - DNA, 16 bp, Homo sapiens
tcttgggactgggttt

SEQ ID NO: 960348 - DNA, 22 bp, Homo sapiens
tcttgggactgggtttggaccc

SEQ ID NO: 960349 - DNA, 16 bp, Homo sapiens
tcttgggagtatgttg

SEQ ID NO: 960350 - DNA, 21 bp, Homo sapiens
tcttgggcagagctggctctg

SEQ ID NO: 960351 - DNA, 11 bp, Homo sapiens
tcttgggccct

SEQ ID NO: 960352 - DNA, 15 bp, Homo sapiens
tcttgggctactggc

SEQ ID NO: 960353 - DNA, 17 bp, Homo sapiens
tcttgggctgagtgcag

SEQ ID NO: 960354 - DNA, 21 bp, Homo sapiens
tcttgggctgagtgcagccaa

SEQ ID NO: 960355 - DNA, 17 bp, Homo sapiens
tcttggggacatctctt

SEQ ID NO: 960356 - DNA, 22 bp, Homo sapiens
tcttggggactcgggggctggt

SEQ ID NO: 960357 - DNA, 16 bp, Homo sapiens
tcttggggcaagactg

SEQ ID NO: 960358 - DNA, 20 bp, Homo sapiens
tcttggggcaagactgcaaa

SEQ ID NO: 960359 - DNA, 16 bp, Homo sapiens
tcttggggctcgcccc

SEQ ID NO: 960360 - DNA, 20 bp, Homo sapiens
tcttggggctcgccccaccc

SEQ ID NO: 960361 - DNA, 12 bp, Homo sapiens
ggacagacagca

SEQ ID NO: 960362 - DNA, 11 bp, Homo sapiens
ggacagagctg

SEQ ID NO: 960363 - DNA, 14 bp, Homo sapiens
ggacagagctgagg

SEQ ID NO: 960364 - DNA, 15 bp, Homo sapiens
ggacagagctgagga

SEQ ID NO: 960365 - DNA, 16 bp, Homo sapiens
ggacagaggccaagga

SEQ ID NO: 960366 - DNA, 20 bp, Homo sapiens
ggacagaggccaaggactga

SEQ ID NO: 960367 - DNA, 12 bp, Homo sapiens
ggacagaggccc

SEQ ID NO: 960368 - DNA, 17 bp, Homo sapiens
ggacagaggccctgcca

SEQ ID NO: 960369 - DNA, 18 bp, Homo sapiens
ggacagaggccctgccac

SEQ ID NO: 960370 - DNA, 12 bp, Homo sapiens
ggacagagggga

SEQ ID NO: 960371 - DNA, 13 bp, Homo sapiens
ggacagaggggac

SEQ ID NO: 960372 - DNA, 18 bp, Homo sapiens
ggacagatggacgcaggc

SEQ ID NO: 960373 - DNA, 16 bp, Homo sapiens
ggacagatggcccaag

SEQ ID NO: 960374 - DNA, 16 bp, Homo sapiens
ggacagattcgcagca

SEQ ID NO: 960375 - DNA, 20 bp, Homo sapiens
ggacagcaaaaccattgctt

SEQ ID NO: 960376 - DNA, 15 bp, Homo sapiens
ggacagcagaagcct

SEQ ID NO: 960377 - DNA, 18 bp, Homo sapiens
ggacagcagaagcctcca

SEQ ID NO: 960378 - DNA, 17 bp, Homo sapiens
ggacagcagattccaca

SEQ ID NO: 960379 - DNA, 16 bp, Homo sapiens
ggacagcatcccttcc

SEQ ID NO: 960380 - DNA, 14 bp, Homo sapiens
ggacagcccactga

SEQ ID NO: 960381 - DNA, 11 bp, Homo sapiens
ggacagccccc

SEQ ID NO: 960382 - DNA, 23 bp, Homo sapiens
ggacagcctgtggcggtgcctgg

SEQ ID NO: 960383 - DNA, 19 bp, Homo sapiens
ggacagcggcagtgggcct

SEQ ID NO: 960384 - DNA, 12 bp, Homo sapiens
ggacagctctgg

SEQ ID NO: 960385 - DNA, 13 bp, Homo sapiens
ggacagctgcttg

SEQ ID NO: 960386 - DNA, 11 bp, Homo sapiens
ggacagctgtc

SEQ ID NO: 960387 - DNA, 13 bp, Homo sapiens
ggacagctgtcct

SEQ ID NO: 960388 - DNA, 12 bp, Homo sapiens
ggacagctgtgt

SEQ ID NO: 960389 - DNA, 15 bp, Homo sapiens
ggacagcttcctcac

SEQ ID NO: 960390 - DNA, 20 bp, Homo sapiens
ggacagctttgctccgctcc

SEQ ID NO: 960391 - DNA, 23 bp, Homo sapiens
ggacaggaagctggcagaacgga

SEQ ID NO: 960392 - DNA, 14 bp, Homo sapiens
ggacaggaccccag

SEQ ID NO: 960393 - DNA, 16 bp, Homo sapiens
ggacaggaccccagct

SEQ ID NO: 960394 - DNA, 20 bp, Homo sapiens
ggacaggaccccagctctgc

SEQ ID NO: 960395 - DNA, 15 bp, Homo sapiens
ggacaggatccaggc

SEQ ID NO: 960396 - DNA, 14 bp, Homo sapiens
ggacaggcaggcca

SEQ ID NO: 960397 - DNA, 19 bp, Homo sapiens
ggacaggcccgcttgctgg

SEQ ID NO: 960398 - DNA, 16 bp, Homo sapiens
ggacaggcctcacctc

SEQ ID NO: 960399 - DNA, 13 bp, Homo sapiens
ggacaggctctgc

SEQ ID NO: 960400 - DNA, 18 bp, Homo sapiens
ggacaggctgaagagagg

SEQ ID NO: 960401 - DNA, 19 bp, Homo sapiens
ggacaggctgaagagaggg

SEQ ID NO: 960402 - DNA, 21 bp, Homo sapiens
ggacaggctggaatgagggag

SEQ ID NO: 960403 - DNA, 23 bp, Homo sapiens
ggacaggctggaatgagggaggc

SEQ ID NO: 960404 - DNA, 16 bp, Homo sapiens
ggacagggagggccgg

SEQ ID NO: 960405 - DNA, 16 bp, Homo sapiens
ggacagggagggggac

SEQ ID NO: 960406 - DNA, 17 bp, Homo sapiens
ggacagggccagggttg

SEQ ID NO: 960407 - DNA, 17 bp, Homo sapiens
ggacaggtgggcctggc

SEQ ID NO: 960408 - DNA, 18 bp, Homo sapiens
ggacaggtgggcctggcg

SEQ ID NO: 960409 - DNA, 15 bp, Homo sapiens
ggacaggtggggcct

SEQ ID NO: 960410 - DNA, 18 bp, Homo sapiens
ggacaggtggggcctcag

SEQ ID NO: 960411 - DNA, 19 bp, Homo sapiens
ggacaggtggggcctcagc

SEQ ID NO: 960412 - DNA, 14 bp, Homo sapiens
ggacagtcctggga

SEQ ID NO: 960413 - DNA, 16 bp, Homo sapiens
ggacagtcctgggaga

SEQ ID NO: 960414 - DNA, 19 bp, Homo sapiens
ggacagtcctgggagaacc

SEQ ID NO: 960415 - DNA, 19 bp, Homo sapiens
ggacagtctccctgatgga

SEQ ID NO: 960416 - DNA, 16 bp, Homo sapiens
ggacagtgcttcagcc

SEQ ID NO: 960417 - DNA, 17 bp, Homo sapiens
ggacagtgcttcagcct

SEQ ID NO: 960418 - DNA, 20 bp, Homo sapiens
ggacagtgcttcagcctgag

SEQ ID NO: 960419 - DNA, 21 bp, Homo sapiens
ggacagtgcttcagcctgagg

SEQ ID NO: 960420 - DNA, 14 bp, Homo sapiens
ggacagttggcaga

SEQ ID NO: 960421 - DNA, 16 bp, Homo sapiens
ggacagttggcagaga

SEQ ID NO: 960422 - DNA, 18 bp, Homo sapiens
ggacagttggcagagaag

SEQ ID NO: 960423 - DNA, 16 bp, Homo sapiens
ggacataaagagagcc

SEQ ID NO: 960424 - DNA, 23 bp, Homo sapiens
ggacataatggggtcctggccat

SEQ ID NO: 960425 - DNA, 15 bp, Homo sapiens
ggacatactgctgga

SEQ ID NO: 960426 - DNA, 19 bp, Homo sapiens
ggacatatattttttaaaa

SEQ ID NO: 960427 - DNA, 14 bp, Homo sapiens
ggacatcagcaaac

SEQ ID NO: 960428 - DNA, 13 bp, Homo sapiens
ggacatcctcctc

SEQ ID NO: 960429 - DNA, 14 bp, Homo sapiens
ggacatctctctgg

SEQ ID NO: 960430 - DNA, 20 bp, Homo sapiens
ggacatctctctggcttctg

SEQ ID NO: 960431 - DNA, 21 bp, Homo sapiens
ggacatctctctggcttctga

SEQ ID NO: 960432 - DNA, 15 bp, Homo sapiens
ggacatctctttgaa

SEQ ID NO: 960433 - DNA, 21 bp, Homo sapiens
ggacatgatttagggaagcag

SEQ ID NO: 960434 - DNA, 15 bp, Homo sapiens
ggacatgccctgtgt

SEQ ID NO: 960435 - DNA, 23 bp, Homo sapiens
ggacatgcgtgtgtcagggatga

SEQ ID NO: 960436 - DNA, 16 bp, Homo sapiens
ggacatgctcacctct

SEQ ID NO: 960437 - DNA, 14 bp, Homo sapiens
ggacatggcacagg

SEQ ID NO: 960438 - DNA, 18 bp, Homo sapiens
ggacatggggcaagccag

SEQ ID NO: 960439 - DNA, 20 bp, Homo sapiens
ggacatggggcaagccaggg

SEQ ID NO: 960440 - DNA, 17 bp, Homo sapiens
ggacatggtcacagtcc

SEQ ID NO: 960441 - DNA, 17 bp, Homo sapiens
ggacattgctctctggg

SEQ ID NO: 960442 - DNA, 18 bp, Homo sapiens
ggacattgctctctgggc

SEQ ID NO: 960443 - DNA, 18 bp, Homo sapiens
ggacattgtatgcaggga

SEQ ID NO: 960444 - DNA, 18 bp, Homo sapiens
ggacattttctggattct

SEQ ID NO: 960445 - DNA, 19 bp, Homo sapiens
ggaccaaaaaacctcactg

SEQ ID NO: 960446 - DNA, 18 bp, Homo sapiens
ggaccaaccctgtttcct

SEQ ID NO: 960447 - DNA, 20 bp, Homo sapiens
ggaccaacctgctctgtccc

SEQ ID NO: 960448 - DNA, 20 bp, Homo sapiens
ggaccaaggcaaggcaggtg

SEQ ID NO: 960449 - DNA, 13 bp, Homo sapiens
ggaccacacctcc

SEQ ID NO: 960450 - DNA, 21 bp, Homo sapiens
ggaccacagtgggtggcacct

SEQ ID NO: 960451 - DNA, 13 bp, Homo sapiens
ggaccacatttta

SEQ ID NO: 960452 - DNA, 17 bp, Homo sapiens
ggaccaccagccccagc

SEQ ID NO: 960453 - DNA, 18 bp, Homo sapiens
ggaccaccctgagccggc

SEQ ID NO: 960454 - DNA, 18 bp, Homo sapiens
ggaccacgccgccctcca

SEQ ID NO: 960455 - DNA, 20 bp, Homo sapiens
ggaccacgccgccctccatc

SEQ ID NO: 960456 - DNA, 21 bp, Homo sapiens
ggaccacgccgccctccatcc

SEQ ID NO: 960457 - DNA, 19 bp, Homo sapiens
ggaccagaagccaaagact

SEQ ID NO: 960458 - DNA, 23 bp, Homo sapiens
ggaccagccagcagcagcccaag

SEQ ID NO: 960459 - DNA, 22 bp, Homo sapiens
ggaccagcccattggccgagct

SEQ ID NO: 960460 - DNA, 11 bp, Homo sapiens
ggaccaggact

SEQ ID NO: 960461 - DNA, 15 bp, Homo sapiens
ggaccaggcctggag

SEQ ID NO: 960462 - DNA, 17 bp, Homo sapiens
ggaccaggcctggaggg

SEQ ID NO: 960463 - DNA, 15 bp, Homo sapiens
ggaccaggctgtagg

SEQ ID NO: 960464 - DNA, 16 bp, Homo sapiens
ggaccagggatggggg

SEQ ID NO: 960465 - DNA, 14 bp, Homo sapiens
ggaccagggccctg

SEQ ID NO: 960466 - DNA, 15 bp, Homo sapiens
ggaccaggggagagg

SEQ ID NO: 960467 - DNA, 17 bp, Homo sapiens
ggaccagggtggagctg

SEQ ID NO: 960468 - DNA, 19 bp, Homo sapiens
ggaccagtgggatgggctc

SEQ ID NO: 960469 - DNA, 16 bp, Homo sapiens
ggaccatcgcctctgt

SEQ ID NO: 960470 - DNA, 13 bp, Homo sapiens
ggaccatctctgt

SEQ ID NO: 960471 - DNA, 17 bp, Homo sapiens
ggaccatctctgtagga

SEQ ID NO: 960472 - DNA, 14 bp, Homo sapiens
ggaccatctgctgc

SEQ ID NO: 960473 - DNA, 16 bp, Homo sapiens
ggaccatctgctgcag

SEQ ID NO: 960474 - DNA, 23 bp, Homo sapiens
ggaccatgccagattctgcctct

SEQ ID NO: 960475 - DNA, 14 bp, Homo sapiens
ggaccattcctgtc

SEQ ID NO: 960476 - DNA, 17 bp, Homo sapiens
ggaccattcctgtccct

SEQ ID NO: 960477 - DNA, 18 bp, Homo sapiens
ggaccattgacctcagct

SEQ ID NO: 960478 - DNA, 18 bp, Homo sapiens
ggacccaaagcaggatga

SEQ ID NO: 960479 - DNA, 23 bp, Homo sapiens
ggacccaagaaaccaaagtctgc

SEQ ID NO: 960480 - DNA, 19 bp, Homo sapiens
ggacccaatgtaggagctg

SEQ ID NO: 960481 - DNA, 12 bp, Homo sapiens
ggacccaccaaa

SEQ ID NO: 960482 - DNA, 18 bp, Homo sapiens
ggacccaccaaactgcac

SEQ ID NO: 960483 - DNA, 20 bp, Homo sapiens
ggacccaccaaactgcacac

SEQ ID NO: 960484 - DNA, 15 bp, Homo sapiens
tctttaatgctgtct

SEQ ID NO: 960485 - DNA, 18 bp, Homo sapiens
tctttaatgctgtctttg

SEQ ID NO: 960486 - DNA, 16 bp, Homo sapiens
tctttaatgcttttat

SEQ ID NO: 960487 - DNA, 20 bp, Homo sapiens
tctttaatgttgtccaggaa

SEQ ID NO: 960488 - DNA, 20 bp, Homo sapiens
tctttaatttatatcaggtg

SEQ ID NO: 960489 - DNA, 16 bp, Homo sapiens
tctttaattttaactg

SEQ ID NO: 960490 - DNA, 23 bp, Homo sapiens
tctttacaaaacaaactcattca

SEQ ID NO: 960491 - DNA, 20 bp, Homo sapiens
tctttacatggtggtgatgt

SEQ ID NO: 960492 - DNA, 20 bp, Homo sapiens
tctttaccaaaaaccatgtt

SEQ ID NO: 960493 - DNA, 16 bp, Homo sapiens
tctttacctgagacca

SEQ ID NO: 960494 - DNA, 16 bp, Homo sapiens
tctttaccttctaaaa

SEQ ID NO: 960495 - DNA, 18 bp, Homo sapiens
tctttacctttattgata

SEQ ID NO: 960496 - DNA, 14 bp, Homo sapiens
tctttacgtactgt

SEQ ID NO: 960497 - DNA, 15 bp, Homo sapiens
tctttacgtactgta

SEQ ID NO: 960498 - DNA, 14 bp, Homo sapiens
tctttactaacact

SEQ ID NO: 960499 - DNA, 18 bp, Homo sapiens
tctttactaacactggct

SEQ ID NO: 960500 - DNA, 15 bp, Homo sapiens
tctttactattaaaa

SEQ ID NO: 960501 - DNA, 18 bp, Homo sapiens
tctttactattaaaatat

SEQ ID NO: 960502 - DNA, 21 bp, Homo sapiens
tctttactcccttcctggcct

SEQ ID NO: 960503 - DNA, 12 bp, Homo sapiens
tctttactctgg

SEQ ID NO: 960504 - DNA, 18 bp, Homo sapiens
tctttacttaacatatct

SEQ ID NO: 960505 - DNA, 20 bp, Homo sapiens
tctttacttccatctgtttg

SEQ ID NO: 960506 - DNA, 12 bp, Homo sapiens
tctttagagatt

SEQ ID NO: 960507 - DNA, 18 bp, Homo sapiens
tctttagatgccaaacca

SEQ ID NO: 960508 - DNA, 14 bp, Homo sapiens
tctttaggacataa

SEQ ID NO: 960509 - DNA, 18 bp, Homo sapiens
tctttaggacataaagag

SEQ ID NO: 960510 - DNA, 20 bp, Homo sapiens
tctttaggccaggcttgcct

SEQ ID NO: 960511 - DNA, 15 bp, Homo sapiens
tctttagtgccggct

SEQ ID NO: 960512 - DNA, 15 bp, Homo sapiens
tctttagtttttgtg

SEQ ID NO: 960513 - DNA, 16 bp, Homo sapiens
tctttatactgtaatt

SEQ ID NO: 960514 - DNA, 22 bp, Homo sapiens
tctttatagaaggaatttgtac

SEQ ID NO: 960515 - DNA, 20 bp, Homo sapiens
tctttatcgccctgagaaga

SEQ ID NO: 960516 - DNA, 20 bp, Homo sapiens
tctttatgctgtattttaac

SEQ ID NO: 960517 - DNA, 22 bp, Homo sapiens
tctttatggaaaaattgacaaa

SEQ ID NO: 960518 - DNA, 12 bp, Homo sapiens
tctttattaaaa

SEQ ID NO: 960519 - DNA, 20 bp, Homo sapiens
tctttattcttattactatt

SEQ ID NO: 960520 - DNA, 21 bp, Homo sapiens
tctttattgcactaggaattc

SEQ ID NO: 960521 - DNA, 22 bp, Homo sapiens
tctttattgcactaggaattct

SEQ ID NO: 960522 - DNA, 14 bp, Homo sapiens
tctttattgtctgt

SEQ ID NO: 960523 - DNA, 20 bp, Homo sapiens
tctttcaaaaccttttgaaa

SEQ ID NO: 960524 - DNA, 20 bp, Homo sapiens
tctttcaaaggtagccatca

SEQ ID NO: 960525 - DNA, 19 bp, Homo sapiens
tctttcaaattgagagaat

SEQ ID NO: 960526 - DNA, 22 bp, Homo sapiens
tctttcaaattgagagaatgga

SEQ ID NO: 960527 - DNA, 18 bp, Homo sapiens
tctttcaacttgcatcca

SEQ ID NO: 960528 - DNA, 21 bp, Homo sapiens
tctttcaagaactatatataa

SEQ ID NO: 960529 - DNA, 21 bp, Homo sapiens
tctttcaagcagtcgtgcctg

SEQ ID NO: 960530 - DNA, 19 bp, Homo sapiens
tctttcaataaatgtatca

SEQ ID NO: 960531 - DNA, 20 bp, Homo sapiens
tctttcacagctcctcccac

SEQ ID NO: 960532 - DNA, 10 bp, Homo sapiens
tctttcacat

SEQ ID NO: 960533 - DNA, 14 bp, Homo sapiens
tctttcacctttct

SEQ ID NO: 960534 - DNA, 22 bp, Homo sapiens
tctttcagatgatttgaaagca

SEQ ID NO: 960535 - DNA, 14 bp, Homo sapiens
tctttcagatgttt

SEQ ID NO: 960536 - DNA, 18 bp, Homo sapiens
tctttcagatgtttattt

SEQ ID NO: 960537 - DNA, 23 bp, Homo sapiens
tctttcagctcatttaatcccag

SEQ ID NO: 960538 - DNA, 16 bp, Homo sapiens
tctttcagctgtgtct

SEQ ID NO: 960539 - DNA, 22 bp, Homo sapiens
tctttcaggaatacttggacct

SEQ ID NO: 960540 - DNA, 16 bp, Homo sapiens
tctttcagtacttttt

SEQ ID NO: 960541 - DNA, 16 bp, Homo sapiens
tctttcattgctaaga

SEQ ID NO: 960542 - DNA, 17 bp, Homo sapiens
tctttccaaagtacact

SEQ ID NO: 960543 - DNA, 22 bp, Homo sapiens
tctttccaaattaaaacaaata

SEQ ID NO: 960544 - DNA, 20 bp, Homo sapiens
tctttccaaattatttctta

SEQ ID NO: 960545 - DNA, 19 bp, Homo sapiens
tctttccacggagccactc

SEQ ID NO: 960546 - DNA, 22 bp, Homo sapiens
tctttccacggagccactcctc

SEQ ID NO: 960547 - DNA, 14 bp, Homo sapiens
tctttccactctgg

SEQ ID NO: 960548 - DNA, 17 bp, Homo sapiens
tctttccactctggatt

SEQ ID NO: 960549 - DNA, 14 bp, Homo sapiens
tctttccactttgt

SEQ ID NO: 960550 - DNA, 15 bp, Homo sapiens
tctttccagtcaaca

SEQ ID NO: 960551 - DNA, 21 bp, Homo sapiens
tctttccagtggatcataaga

SEQ ID NO: 960552 - DNA, 13 bp, Homo sapiens
tctttccatttgc

SEQ ID NO: 960553 - DNA, 14 bp, Homo sapiens
tctttccatttgca

SEQ ID NO: 960554 - DNA, 18 bp, Homo sapiens
tctttcccatggggaggg

SEQ ID NO: 960555 - DNA, 19 bp, Homo sapiens
tctttcccctcagagctct

SEQ ID NO: 960556 - DNA, 12 bp, Homo sapiens
tctttcccctcc

SEQ ID NO: 960557 - DNA, 16 bp, Homo sapiens
tctttcccctcctttg

SEQ ID NO: 960558 - DNA, 18 bp, Homo sapiens
tctttcccctcctttgtc

SEQ ID NO: 960559 - DNA, 20 bp, Homo sapiens
tctttcccctcctttgtctt

SEQ ID NO: 960560 - DNA, 17 bp, Homo sapiens
tctttccctggacaggc

SEQ ID NO: 960561 - DNA, 16 bp, Homo sapiens
tctttcctcaatatag

SEQ ID NO: 960562 - DNA, 14 bp, Homo sapiens
tctttcctgccctg

SEQ ID NO: 960563 - DNA, 18 bp, Homo sapiens
tctttcctgttgttgtta

SEQ ID NO: 960564 - DNA, 10 bp, Homo sapiens
tctttctaat

SEQ ID NO: 960565 - DNA, 19 bp, Homo sapiens
tctttctaatgtagctatt

SEQ ID NO: 960566 - DNA, 18 bp, Homo sapiens
tctttctaatgtgtgaat

SEQ ID NO: 960567 - DNA, 19 bp, Homo sapiens
tctttctaatgtgtgaatc

SEQ ID NO: 960568 - DNA, 13 bp, Homo sapiens
tctttctagagca

SEQ ID NO: 960569 - DNA, 14 bp, Homo sapiens
tctttctcataaaa

SEQ ID NO: 960570 - DNA, 13 bp, Homo sapiens
tctttctccctca

SEQ ID NO: 960571 - DNA, 13 bp, Homo sapiens
tctttctcctcag

SEQ ID NO: 960572 - DNA, 16 bp, Homo sapiens
tctttctcctggtgac

SEQ ID NO: 960573 - DNA, 20 bp, Homo sapiens
tctttctccttcattaatga

SEQ ID NO: 960574 - DNA, 24 bp, Homo sapiens
tctttctccttgaatatctttcga

SEQ ID NO: 960575 - DNA, 12 bp, Homo sapiens
tctttctctccc

SEQ ID NO: 960576 - DNA, 12 bp, Homo sapiens
tctttctctcct

SEQ ID NO: 960577 - DNA, 13 bp, Homo sapiens
tctttctctgagg

SEQ ID NO: 960578 - DNA, 15 bp, Homo sapiens
tctttctctgccagt

SEQ ID NO: 960579 - DNA, 17 bp, Homo sapiens
tctttctctgccagtga

SEQ ID NO: 960580 - DNA, 16 bp, Homo sapiens
tctttctcttccctga

SEQ ID NO: 960581 - DNA, 12 bp, Homo sapiens
tctttctctttc

SEQ ID NO: 960582 - DNA, 22 bp, Homo sapiens
ggactggtgggggttctggcag

SEQ ID NO: 960583 - DNA, 23 bp, Homo sapiens
ggactggtgggggttctggcagg

SEQ ID NO: 960584 - DNA, 13 bp, Homo sapiens
ggactgtaaacat

SEQ ID NO: 960585 - DNA, 18 bp, Homo sapiens
ggactgtagggagggcgg

SEQ ID NO: 960586 - DNA, 20 bp, Homo sapiens
ggactgtagggagggcggca

SEQ ID NO: 960587 - DNA, 21 bp, Homo sapiens
ggactgtcacggggttccctc

SEQ ID NO: 960588 - DNA, 24 bp, Homo sapiens
ggactgtcctcccacagacctgca

SEQ ID NO: 960589 - DNA, 20 bp, Homo sapiens
ggactgtctttcagatacat

SEQ ID NO: 960590 - DNA, 21 bp, Homo sapiens
ggactgttcacggcagaccag

SEQ ID NO: 960591 - DNA, 17 bp, Homo sapiens
ggactgttccaggccct

SEQ ID NO: 960592 - DNA, 18 bp, Homo sapiens
ggactgttccaggccctc

SEQ ID NO: 960593 - DNA, 23 bp, Homo sapiens
ggactgttttttcctgagcttgg

SEQ ID NO: 960594 - DNA, 15 bp, Homo sapiens
ggacttaacggctcc

SEQ ID NO: 960595 - DNA, 23 bp, Homo sapiens
ggacttaagcatctggctctaat

SEQ ID NO: 960596 - DNA, 19 bp, Homo sapiens
ggacttacaaaatgccaag

SEQ ID NO: 960597 - DNA, 14 bp, Homo sapiens
ggacttcctggggc

SEQ ID NO: 960598 - DNA, 17 bp, Homo sapiens
ggacttctacctgccct

SEQ ID NO: 960599 - DNA, 14 bp, Homo sapiens
ggacttctgcagct

SEQ ID NO: 960600 - DNA, 23 bp, Homo sapiens
ggacttgaaagcatccatgtgtg

SEQ ID NO: 960601 - DNA, 12 bp, Homo sapiens
ggacttgaagtt

SEQ ID NO: 960602 - DNA, 19 bp, Homo sapiens
ggacttgctaaagcacttt

SEQ ID NO: 960603 - DNA, 13 bp, Homo sapiens
ggacttggagggt

SEQ ID NO: 960604 - DNA, 17 bp, Homo sapiens
ggacttggagggtctgg

SEQ ID NO: 960605 - DNA, 17 bp, Homo sapiens
ggacttggctgtccttc

SEQ ID NO: 960606 - DNA, 16 bp, Homo sapiens
ggagagcagcaggtgc

SEQ ID NO: 960607 - DNA, 17 bp, Homo sapiens
ggagagcagctggctct

SEQ ID NO: 960608 - DNA, 23 bp, Homo sapiens
ggagagcaggctggcagctctcc

SEQ ID NO: 960609 - DNA, 22 bp, Homo sapiens
ggagagccaccaagagggacgc

SEQ ID NO: 960610 - DNA, 15 bp, Homo sapiens
ggagagccagccctc

SEQ ID NO: 960611 - DNA, 17 bp, Homo sapiens
ggagagccagctctctc

SEQ ID NO: 960612 - DNA, 11 bp, Homo sapiens
ggagagcctgc

SEQ ID NO: 960613 - DNA, 14 bp, Homo sapiens
ggagagcctgctgg

SEQ ID NO: 960614 - DNA, 16 bp, Homo sapiens
ggagagcctgctggca

SEQ ID NO: 960615 - DNA, 14 bp, Homo sapiens
ggagagcctggggg

SEQ ID NO: 960616 - DNA, 19 bp, Homo sapiens
ggagagcgcctcttcctct

SEQ ID NO: 960617 - DNA, 14 bp, Homo sapiens
ggagagcggaggag

SEQ ID NO: 960618 - DNA, 15 bp, Homo sapiens
ggagagctagcagca

SEQ ID NO: 960619 - DNA, 21 bp, Homo sapiens
ggagagctagcagcagggagg

SEQ ID NO: 960620 - DNA, 14 bp, Homo sapiens
ggagagctgagcca

SEQ ID NO: 960621 - DNA, 16 bp, Homo sapiens
ggagagctggtgactt

SEQ ID NO: 960622 - DNA, 18 bp, Homo sapiens
ggagagctggtgcccgga

SEQ ID NO: 960623 - DNA, 20 bp, Homo sapiens
ggagagcttgtcattgagcc

SEQ ID NO: 960624 - DNA, 17 bp, Homo sapiens
ggagaggacagagcagg

SEQ ID NO: 960625 - DNA, 14 bp, Homo sapiens
ggagaggactctgc

SEQ ID NO: 960626 - DNA, 14 bp, Homo sapiens
ggagaggactgggc

SEQ ID NO: 960627 - DNA, 11 bp, Homo sapiens
ggagaggagaa

SEQ ID NO: 960628 - DNA, 14 bp, Homo sapiens
ggagaggcagcatg

SEQ ID NO: 960629 - DNA, 12 bp, Homo sapiens
ggagaggcctgg

SEQ ID NO: 960630 - DNA, 17 bp, Homo sapiens
ggagaggcggcctcgtg

SEQ ID NO: 960631 - DNA, 22 bp, Homo sapiens
ggagagggacagcccactgaga

SEQ ID NO: 960632 - DNA, 17 bp, Homo sapiens
ggagagggaggtcactg

SEQ ID NO: 960633 - DNA, 23 bp, Homo sapiens
ggagagggatacaagagaggaga

SEQ ID NO: 960634 - DNA, 18 bp, Homo sapiens
ggagagggatttccctgc

SEQ ID NO: 960635 - DNA, 20 bp, Homo sapiens
ggagagggctagccctgagc

SEQ ID NO: 960636 - DNA, 18 bp, Homo sapiens
ggagaggggaagggccag

SEQ ID NO: 960637 - DNA, 14 bp, Homo sapiens
ggagaggggcagaa

SEQ ID NO: 960638 - DNA, 14 bp, Homo sapiens
ggagagggggaggt

SEQ ID NO: 960639 - DNA, 17 bp, Homo sapiens
ggagaggggtgcaccca

SEQ ID NO: 960640 - DNA, 18 bp, Homo sapiens
ggagagggtctggagaag

SEQ ID NO: 960641 - DNA, 22 bp, Homo sapiens
ggagaggtgattctcagggctg

SEQ ID NO: 960642 - DNA, 14 bp, Homo sapiens
ggagaggtgccagc

SEQ ID NO: 960643 - DNA, 20 bp, Homo sapiens
ggagagtacagtgagccaag

SEQ ID NO: 960644 - DNA, 14 bp, Homo sapiens
ggagagtccagtga

SEQ ID NO: 960645 - DNA, 21 bp, Homo sapiens
ggagagtcccctgaaggtctg

SEQ ID NO: 960646 - DNA, 14 bp, Homo sapiens
ggagagtggtgagt

SEQ ID NO: 960647 - DNA, 17 bp, Homo sapiens
ggagagtgtgtgggcag

SEQ ID NO: 960648 - DNA, 23 bp, Homo sapiens
ggagataaaagcaattctgactg

SEQ ID NO: 960649 - DNA, 22 bp, Homo sapiens
ggagataacagcctcttgcccg

SEQ ID NO: 960650 - DNA, 13 bp, Homo sapiens
ggagatagctggg

SEQ ID NO: 960651 - DNA, 14 bp, Homo sapiens
ggagatagctgggg

SEQ ID NO: 960652 - DNA, 16 bp, Homo sapiens
ggagatgaccagggat

SEQ ID NO: 960653 - DNA, 15 bp, Homo sapiens
ggagatgctccttgg

SEQ ID NO: 960654 - DNA, 20 bp, Homo sapiens
ggagatgcttctctccttgc

SEQ ID NO: 960655 - DNA, 18 bp, Homo sapiens
ggagatggacccctccct

SEQ ID NO: 960656 - DNA, 19 bp, Homo sapiens
ggagatggacccctccctt

SEQ ID NO: 960657 - DNA, 15 bp, Homo sapiens
ggagatggactcagg

SEQ ID NO: 960658 - DNA, 12 bp, Homo sapiens
ggagatggaggg

SEQ ID NO: 960659 - DNA, 15 bp, Homo sapiens
ggagatggagggctt

SEQ ID NO: 960660 - DNA, 13 bp, Homo sapiens
ggagatggcagca

SEQ ID NO: 960661 - DNA, 17 bp, Homo sapiens
ggagatggcagcagtga

SEQ ID NO: 960662 - DNA, 19 bp, Homo sapiens
ggagatggcagcagtgaag

SEQ ID NO: 960663 - DNA, 18 bp, Homo sapiens
ggagatggcaggagagct

SEQ ID NO: 960664 - DNA, 15 bp, Homo sapiens
ggagatgggtcctgg

SEQ ID NO: 960665 - DNA, 16 bp, Homo sapiens
ggagatgtagcaaaac

SEQ ID NO: 960666 - DNA, 22 bp, Homo sapiens
ggagatgttgaggggaggaggc

SEQ ID NO: 960667 - DNA, 22 bp, Homo sapiens
ggagattctcataacttgagac

SEQ ID NO: 960668 - DNA, 16 bp, Homo sapiens
ggagattggccagtga

SEQ ID NO: 960669 - DNA, 18 bp, Homo sapiens
ggagattggccagtgaga

SEQ ID NO: 960670 - DNA, 20 bp, Homo sapiens
ggagatttacaactggggga

SEQ ID NO: 960671 - DNA, 12 bp, Homo sapiens
ggagatttctta

SEQ ID NO: 960672 - DNA, 17 bp, Homo sapiens
ggagatttggaattgaa

SEQ ID NO: 960673 - DNA, 16 bp, Homo sapiens
ggagattttaggtgtt

SEQ ID NO: 960674 - DNA, 16 bp, Homo sapiens
ggagcaaaaggcagct

SEQ ID NO: 960675 - DNA, 13 bp, Homo sapiens
ggagcaaagaagg

SEQ ID NO: 960676 - DNA, 17 bp, Homo sapiens
ggagcaaagaaggagct

SEQ ID NO: 960677 - DNA, 18 bp, Homo sapiens
ggagcaaagaaggagctg

SEQ ID NO: 960678 - DNA, 19 bp, Homo sapiens
ggagcaaagaaggagctga

SEQ ID NO: 960679 - DNA, 15 bp, Homo sapiens
ggagcaaatgtttct

SEQ ID NO: 960680 - DNA, 18 bp, Homo sapiens
ggagcaaatgtttctgca

SEQ ID NO: 960681 - DNA, 17 bp, Homo sapiens
ggagcaagaagaaaatg

SEQ ID NO: 960682 - DNA, 16 bp, Homo sapiens
ggagcaagcttacaca

SEQ ID NO: 960683 - DNA, 18 bp, Homo sapiens
ggagcacagccctgggag

SEQ ID NO: 960684 - DNA, 15 bp, Homo sapiens
ggagcacaggtccca

SEQ ID NO: 960685 - DNA, 20 bp, Homo sapiens
ggagcacaggtgtctgccta

SEQ ID NO: 960686 - DNA, 16 bp, Homo sapiens
ggagcacatgttactg

SEQ ID NO: 960687 - DNA, 14 bp, Homo sapiens
ggagcacccagagc

SEQ ID NO: 960688 - DNA, 21 bp, Homo sapiens
ggagcaccgtgatggagagga

SEQ ID NO: 960689 - DNA, 13 bp, Homo sapiens
ggagcacctgaac

SEQ ID NO: 960690 - DNA, 15 bp, Homo sapiens
ggagcacctgaaccc

SEQ ID NO: 960691 - DNA, 15 bp, Homo sapiens
ggagcacctggaccc

SEQ ID NO: 960692 - DNA, 18 bp, Homo sapiens
ggagcacctggaccccct

SEQ ID NO: 960693 - DNA, 20 bp, Homo sapiens
ggagcacctggaccccctgc

SEQ ID NO: 960694 - DNA, 13 bp, Homo sapiens
ggagcactggagt

SEQ ID NO: 960695 - DNA, 18 bp, Homo sapiens
ggagcactggagtgcagg

SEQ ID NO: 960696 - DNA, 21 bp, Homo sapiens
ggagcagagagagccagacag

SEQ ID NO: 960697 - DNA, 15 bp, Homo sapiens
ggagcagagaggtgg

SEQ ID NO: 960698 - DNA, 16 bp, Homo sapiens
ggagcagagaggtggc

SEQ ID NO: 960699 - DNA, 16 bp, Homo sapiens
ggagcagatggacagc

SEQ ID NO: 960700 - DNA, 12 bp, Homo sapiens
ggagcagcagcc

SEQ ID NO: 960701 - DNA, 14 bp, Homo sapiens
ggagcagcagccag

SEQ ID NO: 960702 - DNA, 16 bp, Homo sapiens
ggagcagcagccagca

SEQ ID NO: 960703 - DNA, 14 bp, Homo sapiens
ggagcagcaggaag

SEQ ID NO: 960704 - DNA, 15 bp, Homo sapiens
ggagcagcaggaagg

SEQ ID NO: 960705 - DNA, 12 bp, Homo sapiens
ggagcagccaga

SEQ ID NO: 960706 - DNA, 13 bp, Homo sapiens
ggagcagccagga

SEQ ID NO: 960707 - DNA, 16 bp, Homo sapiens
ggagcagccaggaccc

SEQ ID NO: 960708 - DNA, 16 bp, Homo sapiens
ggagcagcttcttggg

SEQ ID NO: 960709 - DNA, 18 bp, Homo sapiens
ggagcagcttcttgggct

SEQ ID NO: 960710 - DNA, 20 bp, Homo sapiens
ggagcagcttcttgggctga

SEQ ID NO: 960711 - DNA, 21 bp, Homo sapiens
ggagcagcttcttgggctgag

SEQ ID NO: 960712 - DNA, 19 bp, Homo sapiens
ggagcaggaggccaataaa

SEQ ID NO: 960713 - DNA, 21 bp, Homo sapiens
ggagcaggcggtgggcaccca

SEQ ID NO: 960714 - DNA, 20 bp, Homo sapiens
tcttttgagttaggttaata

SEQ ID NO: 960715 - DNA, 17 bp, Homo sapiens
tcttttgccgttattaa

SEQ ID NO: 960716 - DNA, 23 bp, Homo sapiens
tcttttgccttttgcaaccagga

SEQ ID NO: 960717 - DNA, 13 bp, Homo sapiens
tcttttgctgtgc

SEQ ID NO: 960718 - DNA, 19 bp, Homo sapiens
tcttttgcttttgcccatt

SEQ ID NO: 960719 - DNA, 13 bp, Homo sapiens
tcttttggcttcc

SEQ ID NO: 960720 - DNA, 12 bp, Homo sapiens
tcttttggttat

SEQ ID NO: 960721 - DNA, 18 bp, Homo sapiens
tcttttggttattctaag

SEQ ID NO: 960722 - DNA, 13 bp, Homo sapiens
tcttttgtaattg

SEQ ID NO: 960723 - DNA, 21 bp, Homo sapiens
tcttttgtcctgcatcatctt

SEQ ID NO: 960724 - DNA, 14 bp, Homo sapiens
tcttttgtgatgaa

SEQ ID NO: 960725 - DNA, 14 bp, Homo sapiens
tcttttgtgtcctg

SEQ ID NO: 960726 - DNA, 12 bp, Homo sapiens
tcttttgtgttc

SEQ ID NO: 960727 - DNA, 15 bp, Homo sapiens
tcttttgttaaataa

SEQ ID NO: 960728 - DNA, 16 bp, Homo sapiens
tcttttgttgtccttg

SEQ ID NO: 960729 - DNA, 19 bp, Homo sapiens
tgaaaatgagcatcagaga

SEQ ID NO: 960730 - DNA, 13 bp, Homo sapiens
tgaaaatgctctt

SEQ ID NO: 960731 - DNA, 20 bp, Homo sapiens
tgaaaatggaagtggcaata

SEQ ID NO: 960732 - DNA, 16 bp, Homo sapiens
tgaaaatgggctcaac

SEQ ID NO: 960733 - DNA, 14 bp, Homo sapiens
tgaaaatggtttca

SEQ ID NO: 960734 - DNA, 12 bp, Homo sapiens
tgaaaatgtact

SEQ ID NO: 960735 - DNA, 13 bp, Homo sapiens
tgaaaatgtactg

SEQ ID NO: 960736 - DNA, 21 bp, Homo sapiens
tgaaaatgtcagaaaccagtt

SEQ ID NO: 960737 - DNA, 13 bp, Homo sapiens
tgaaaatgtcttg

SEQ ID NO: 960738 - DNA, 14 bp, Homo sapiens
tgaaaatgtcttgt

SEQ ID NO: 960739 - DNA, 16 bp, Homo sapiens
tgaaaatgtcttgtgt

SEQ ID NO: 960740 - DNA, 19 bp, Homo sapiens
tgaaaatgtgctatactgc

SEQ ID NO: 960741 - DNA, 17 bp, Homo sapiens
tgaaaatgtgtttgctg

SEQ ID NO: 960742 - DNA, 13 bp, Homo sapiens
tgaaaatgttttt

SEQ ID NO: 960743 - DNA, 14 bp, Homo sapiens
tgaaaattacatgt

SEQ ID NO: 960744 - DNA, 23 bp, Homo sapiens
tgaaaattacatgttttttcatt

SEQ ID NO: 960745 - DNA, 20 bp, Homo sapiens
tgaaaattaggatttcatga

SEQ ID NO: 960746 - DNA, 13 bp, Homo sapiens
tgaaaattatgca

SEQ ID NO: 960747 - DNA, 17 bp, Homo sapiens
tgaaaattatgcaaaag

SEQ ID NO: 960748 - DNA, 18 bp, Homo sapiens
tgaaaattattttaaaca

SEQ ID NO: 960749 - DNA, 19 bp, Homo sapiens
tgaaaattattttaaacaa

SEQ ID NO: 960750 - DNA, 14 bp, Homo sapiens
tgaaaattcagtgg

SEQ ID NO: 960751 - DNA, 18 bp, Homo sapiens
tgaaaattccagaaagga

SEQ ID NO: 960752 - DNA, 15 bp, Homo sapiens
tgaaaattctggaag

SEQ ID NO: 960753 - DNA, 13 bp, Homo sapiens
tgaaaatttaaca

SEQ ID NO: 960754 - DNA, 13 bp, Homo sapiens
tgaaaattttact

SEQ ID NO: 960755 - DNA, 12 bp, Homo sapiens
tgaaaattttga

SEQ ID NO: 960756 - DNA, 21 bp, Homo sapiens
tgaaaattttgatgttttaag

SEQ ID NO: 960757 - DNA, 23 bp, Homo sapiens
tgaaacaaagagttcaagaaata

SEQ ID NO: 960758 - DNA, 17 bp, Homo sapiens
tgaaacaaagtactctt

SEQ ID NO: 960759 - DNA, 20 bp, Homo sapiens
tgaaacaaagtactctttaa

SEQ ID NO: 960760 - DNA, 21 bp, Homo sapiens
tgaaacaagataactgagaat

SEQ ID NO: 960761 - DNA, 18 bp, Homo sapiens
tgaaacacaccaggctgt

SEQ ID NO: 960762 - DNA, 22 bp, Homo sapiens
tgaaacacaccaggctgtgggc

SEQ ID NO: 960763 - DNA, 15 bp, Homo sapiens
tgaaacacacgagca

SEQ ID NO: 960764 - DNA, 17 bp, Homo sapiens
tgaaacacacgagcaaa

SEQ ID NO: 960765 - DNA, 18 bp, Homo sapiens
tgaaacaccttctctgga

SEQ ID NO: 960766 - DNA, 17 bp, Homo sapiens
tgaaacacgaaacttgt

SEQ ID NO: 960767 - DNA, 11 bp, Homo sapiens
tgaaacactgg

SEQ ID NO: 960768 - DNA, 16 bp, Homo sapiens
tgaaacagaaacaaaa

SEQ ID NO: 960769 - DNA, 11 bp, Homo sapiens
tgaaacagaga

SEQ ID NO: 960770 - DNA, 18 bp, Homo sapiens
tgaaacagagaaagaaaa

SEQ ID NO: 960771 - DNA, 17 bp, Homo sapiens
tgaaacagatgataaat

SEQ ID NO: 960772 - DNA, 14 bp, Homo sapiens
tgaaacagatttca

SEQ ID NO: 960773 - DNA, 13 bp, Homo sapiens
tgaaacagttcca

SEQ ID NO: 960774 - DNA, 13 bp, Homo sapiens
tgaaacatatcat

SEQ ID NO: 960775 - DNA, 14 bp, Homo sapiens
tgaaacatcttctc

SEQ ID NO: 960776 - DNA, 11 bp, Homo sapiens
tgaaacattca

SEQ ID NO: 960777 - DNA, 18 bp, Homo sapiens
tgaaacattccgaagagg

SEQ ID NO: 960778 - DNA, 14 bp, Homo sapiens
tgaaacattttgtc

SEQ ID NO: 960779 - DNA, 20 bp, Homo sapiens
tgaaaccagtgttagggaag

SEQ ID NO: 960780 - DNA, 16 bp, Homo sapiens
tgaaaccatcacagct

SEQ ID NO: 960781 - DNA, 15 bp, Homo sapiens
tgaaaccatgactgt

SEQ ID NO: 960782 - DNA, 16 bp, Homo sapiens
tgaaaccctccaaatc

SEQ ID NO: 960783 - DNA, 18 bp, Homo sapiens
tgaaacctagtactgccc

SEQ ID NO: 960784 - DNA, 21 bp, Homo sapiens
tgaaacctcagggctgtccca

SEQ ID NO: 960785 - DNA, 13 bp, Homo sapiens
tgaaacctgagat

SEQ ID NO: 960786 - DNA, 17 bp, Homo sapiens
tgaaaccttattttttc

SEQ ID NO: 960787 - DNA, 19 bp, Homo sapiens
tgaaacgactcaaaatgac

SEQ ID NO: 960788 - DNA, 17 bp, Homo sapiens
tgaaacggaagctcata

SEQ ID NO: 960789 - DNA, 19 bp, Homo sapiens
tgaaacggaggcagatgga

SEQ ID NO: 960790 - DNA, 21 bp, Homo sapiens
tgaaactatggctttaaacta

SEQ ID NO: 960791 - DNA, 18 bp, Homo sapiens
tgaaactcatagacactg

SEQ ID NO: 960792 - DNA, 20 bp, Homo sapiens
tgaaactcctgattttgtag

SEQ ID NO: 960793 - DNA, 22 bp, Homo sapiens
tgaaactctttcattcttctca

SEQ ID NO: 960794 - DNA, 18 bp, Homo sapiens
tgaaactggcactgaatt

SEQ ID NO: 960795 - DNA, 23 bp, Homo sapiens
tgaaactgtggggcttacagaaa

SEQ ID NO: 960796 - DNA, 18 bp, Homo sapiens
tgaaacttgtgctatagt

SEQ ID NO: 960797 - DNA, 19 bp, Homo sapiens
tgaaacttttttcattttg

SEQ ID NO: 960798 - DNA, 13 bp, Homo sapiens
tgaaagaaaataa

SEQ ID NO: 960799 - DNA, 14 bp, Homo sapiens
tgaaagaaacagtt

SEQ ID NO: 960800 - DNA, 20 bp, Homo sapiens
tgaaagaaacagttaacttt

SEQ ID NO: 960801 - DNA, 19 bp, Homo sapiens
tgaaagaaagctgagaaga

SEQ ID NO: 960802 - DNA, 20 bp, Homo sapiens
tgaaagaagaaaacagtaca

SEQ ID NO: 960803 - DNA, 13 bp, Homo sapiens
tgaaagaagaaca

SEQ ID NO: 960804 - DNA, 19 bp, Homo sapiens
tgaaagaagaacagctgtt

SEQ ID NO: 960805 - DNA, 20 bp, Homo sapiens
tgaaagaatagaacacagtt

SEQ ID NO: 960806 - DNA, 16 bp, Homo sapiens
tgaaagaattattttt

SEQ ID NO: 960807 - DNA, 15 bp, Homo sapiens
tgaaagacagaatgt

SEQ ID NO: 960808 - DNA, 16 bp, Homo sapiens
tgaaagaccagatcct

SEQ ID NO: 960809 - DNA, 15 bp, Homo sapiens
tgaaagactgaagaa

SEQ ID NO: 960810 - DNA, 22 bp, Homo sapiens
tgaaagactgtacaaagtagaa

SEQ ID NO: 960811 - DNA, 21 bp, Homo sapiens
tgaaagagagtaccatgctgg

SEQ ID NO: 960812 - DNA, 22 bp, Homo sapiens
tgaaagaggacgtgttacccac

SEQ ID NO: 960813 - DNA, 19 bp, Homo sapiens
tgaaagaggctgaggcctg

SEQ ID NO: 960814 - DNA, 19 bp, Homo sapiens
tgaaagagttaagaatgtc

SEQ ID NO: 960815 - DNA, 21 bp, Homo sapiens
tgaaagatctctgtcacatcc

SEQ ID NO: 960816 - DNA, 16 bp, Homo sapiens
tgaaagatgatcattt

SEQ ID NO: 960817 - DNA, 21 bp, Homo sapiens
tgaaagattcaggtatgttgc

SEQ ID NO: 960818 - DNA, 21 bp, Homo sapiens
tgaaagcagcagctaggactg

SEQ ID NO: 960819 - DNA, 22 bp, Homo sapiens
tgaaagcagcagctaggactga

SEQ ID NO: 960820 - DNA, 14 bp, Homo sapiens
tgaaagcataacat

SEQ ID NO: 960821 - DNA, 16 bp, Homo sapiens
tgaaagccaaaacctg

SEQ ID NO: 960822 - DNA, 21 bp, Homo sapiens
tgaaagccaacaactctgcct

SEQ ID NO: 960823 - DNA, 23 bp, Homo sapiens
tgaaagccagctgccgaccagag

SEQ ID NO: 960824 - DNA, 16 bp, Homo sapiens
tgaaagccatggagat

SEQ ID NO: 960825 - DNA, 12 bp, Homo sapiens
tgaaagcctgtc

SEQ ID NO: 960826 - DNA, 14 bp, Homo sapiens
tgaaagcctgtctc

SEQ ID NO: 960827 - DNA, 22 bp, Homo sapiens
tgaaagccttagggaagctggc

SEQ ID NO: 960828 - DNA, 15 bp, Homo sapiens
tgaaagctactcata

SEQ ID NO: 960829 - DNA, 15 bp, Homo sapiens
tgaaaggaacactgg

SEQ ID NO: 960830 - DNA, 16 bp, Homo sapiens
tgaaaggaacattttt

SEQ ID NO: 960831 - DNA, 18 bp, Homo sapiens
tgaaaggatgtggaagag

SEQ ID NO: 960832 - DNA, 17 bp, Homo sapiens
tgaaaggcattctctga

SEQ ID NO: 960833 - DNA, 17 bp, Homo sapiens
tgaaaggctatcctgct

SEQ ID NO: 960834 - DNA, 13 bp, Homo sapiens
tgaaagggcactt

SEQ ID NO: 960835 - DNA, 15 bp, Homo sapiens
tgaaagggctatggc

SEQ ID NO: 960836 - DNA, 16 bp, Homo sapiens
tgaaagggctatggca

SEQ ID NO: 960837 - DNA, 14 bp, Homo sapiens
tgaaaggtactata

SEQ ID NO: 960838 - DNA, 14 bp, Homo sapiens
tgaaaggtgtgcta

SEQ ID NO: 960839 - DNA, 21 bp, Homo sapiens
tgaaagtatattttcctccca

SEQ ID NO: 960840 - DNA, 15 bp, Homo sapiens
tgaaagtcagatgcc

SEQ ID NO: 960841 - DNA, 15 bp, Homo sapiens
tgaaagtctgtcctt

SEQ ID NO: 960842 - DNA, 15 bp, Homo sapiens
tgaaagtgaaataat

SEQ ID NO: 960843 - DNA, 18 bp, Homo sapiens
tgaaagtgactttaaaag

SEQ ID NO: 960844 - DNA, 22 bp, Homo sapiens
tgaaagtgttttactctttttc

SEQ ID NO: 960845 - DNA, 13 bp, Homo sapiens
tgaaagtgttttt

SEQ ID NO: 960846 - DNA, 20 bp, Homo sapiens
tgaaagttaactcttcaaat

SEQ ID NO: 960847 - DNA, 14 bp, Homo sapiens
tgaaagttgctttt

SEQ ID NO: 960848 - DNA, 17 bp, Homo sapiens
tgaaagttgcttttatt

SEQ ID NO: 960849 - DNA, 18 bp, Homo sapiens
tgaaagttgcttttattg

SEQ ID NO: 960850 - DNA, 19 bp, Homo sapiens
tgaaagttgcttttattgc

SEQ ID NO: 960851 - DNA, 20 bp, Homo sapiens
tgaaagtttaacaaatgact

SEQ ID NO: 960852 - DNA, 15 bp, Homo sapiens
gcccctcacccacca

SEQ ID NO: 960853 - DNA, 22 bp, Homo sapiens
gcccctcacccaccatggacca

SEQ ID NO: 960854 - DNA, 12 bp, Homo sapiens
gcccctcaccct

SEQ ID NO: 960855 - DNA, 13 bp, Homo sapiens
gcccctcaccctc

SEQ ID NO: 960856 - DNA, 14 bp, Homo sapiens
gcccctcaccctct

SEQ ID NO: 960857 - DNA, 16 bp, Homo sapiens
gcccctcaccctctgt

SEQ ID NO: 960858 - DNA, 21 bp, Homo sapiens
gcccctcaccctctgtcccca

SEQ ID NO: 960859 - DNA, 12 bp, Homo sapiens
gcccctcagagc

SEQ ID NO: 960860 - DNA, 22 bp, Homo sapiens
gcccctcagagccctgccctgc

SEQ ID NO: 960861 - DNA, 23 bp, Homo sapiens
gcccctcagagccctgccctgca

SEQ ID NO: 960862 - DNA, 13 bp, Homo sapiens
gcccctcagccct

SEQ ID NO: 960863 - DNA, 15 bp, Homo sapiens
gcccctcagcccttg

SEQ ID NO: 960864 - DNA, 17 bp, Homo sapiens
gcccctcagcccttgcc

SEQ ID NO: 960865 - DNA, 17 bp, Homo sapiens
gcccctcagggggccag

SEQ ID NO: 960866 - DNA, 20 bp, Homo sapiens
gcccctcagggggccagctg

SEQ ID NO: 960867 - DNA, 17 bp, Homo sapiens
gcccctccaaacctcca

SEQ ID NO: 960868 - DNA, 21 bp, Homo sapiens
gcccctccaaacctccagcct

SEQ ID NO: 960869 - DNA, 17 bp, Homo sapiens
gcccctccagaccctgc

SEQ ID NO: 960870 - DNA, 20 bp, Homo sapiens
gcccctccagaccctgcctg

SEQ ID NO: 960871 - DNA, 15 bp, Homo sapiens
gcccctccagtgttg

SEQ ID NO: 960872 - DNA, 21 bp, Homo sapiens
gcccctcccacacacacccac

SEQ ID NO: 960873 - DNA, 13 bp, Homo sapiens
gcccctcccacca

SEQ ID NO: 960874 - DNA, 16 bp, Homo sapiens
gcccctcccaccacag

SEQ ID NO: 960875 - DNA, 12 bp, Homo sapiens
gcccctccccag

SEQ ID NO: 960876 - DNA, 13 bp, Homo sapiens
gcccctccccagc

SEQ ID NO: 960877 - DNA, 14 bp, Homo sapiens
gcccctccccagcc

SEQ ID NO: 960878 - DNA, 22 bp, Homo sapiens
gcccctcccccaacccccaccc

SEQ ID NO: 960879 - DNA, 14 bp, Homo sapiens
gcccctcccccagc

SEQ ID NO: 960880 - DNA, 16 bp, Homo sapiens
gcccctccccctgcca

SEQ ID NO: 960881 - DNA, 15 bp, Homo sapiens
gcccctccccgtccc

SEQ ID NO: 960882 - DNA, 21 bp, Homo sapiens
gcccctccccgtccctgtccc

SEQ ID NO: 960883 - DNA, 24 bp, Homo sapiens
gcccctccccgtccctgtccccca

SEQ ID NO: 960884 - DNA, 14 bp, Homo sapiens
gcccctcccctcag

SEQ ID NO: 960885 - DNA, 16 bp, Homo sapiens
gcccctcccctcagag

SEQ ID NO: 960886 - DNA, 21 bp, Homo sapiens
gcccctcccctcagagcccat

SEQ ID NO: 960887 - DNA, 22 bp, Homo sapiens
gcccctcccctcagagcccatg

SEQ ID NO: 960888 - DNA, 23 bp, Homo sapiens
gcccctcccctcagagcccatgg

SEQ ID NO: 960889 - DNA, 19 bp, Homo sapiens
gcccctcccctcagcctgc

SEQ ID NO: 960890 - DNA, 16 bp, Homo sapiens
gcccctccctctgccc

SEQ ID NO: 960891 - DNA, 18 bp, Homo sapiens
gcccctcctccagcccct

SEQ ID NO: 960892 - DNA, 16 bp, Homo sapiens
gccctcactaacaaag

SEQ ID NO: 960893 - DNA, 15 bp, Homo sapiens
gccctcactaagccc

SEQ ID NO: 960894 - DNA, 15 bp, Homo sapiens
gccctcactgagcct

SEQ ID NO: 960895 - DNA, 12 bp, Homo sapiens
gccctcagaaca

SEQ ID NO: 960896 - DNA, 16 bp, Homo sapiens
gccctcagatgtccct

SEQ ID NO: 960897 - DNA, 17 bp, Homo sapiens
gccctcagatgtccctt

SEQ ID NO: 960898 - DNA, 17 bp, Homo sapiens
gccctcaggctccccag

SEQ ID NO: 960899 - DNA, 18 bp, Homo sapiens
gccctcaggctccccaga

SEQ ID NO: 960900 - DNA, 21 bp, Homo sapiens
gccctcagtcagttcccggag

SEQ ID NO: 960901 - DNA, 16 bp, Homo sapiens
gccctcagttccttca

SEQ ID NO: 960902 - DNA, 12 bp, Homo sapiens
gccctcatcccg

SEQ ID NO: 960903 - DNA, 19 bp, Homo sapiens
gccctcattactgggcctt

SEQ ID NO: 960904 - DNA, 14 bp, Homo sapiens
gccctccaaaagca

SEQ ID NO: 960905 - DNA, 14 bp, Homo sapiens
gccctccacagccg

SEQ ID NO: 960906 - DNA, 15 bp, Homo sapiens
gccctccactccagc

SEQ ID NO: 960907 - DNA, 21 bp, Homo sapiens
gccctccagtgggctgatgct

SEQ ID NO: 960908 - DNA, 16 bp, Homo sapiens
gccctccatcccgaca

SEQ ID NO: 960909 - DNA, 17 bp, Homo sapiens
gccctccatccgtgctg

SEQ ID NO: 960910 - DNA, 21 bp, Homo sapiens
gccctccatggtcctgtctgt

SEQ ID NO: 960911 - DNA, 23 bp, Homo sapiens
gccctccatggtcctgtctgtcc

SEQ ID NO: 960912 - DNA, 14 bp, Homo sapiens
gccctcccaccacc

SEQ ID NO: 960913 - DNA, 23 bp, Homo sapiens
gccctcccactttgctgttcctt

SEQ ID NO: 960914 - DNA, 15 bp, Homo sapiens
gccctcccagcccat

SEQ ID NO: 960915 - DNA, 20 bp, Homo sapiens
gccctcccagcccattgctg

SEQ ID NO: 960916 - DNA, 13 bp, Homo sapiens
gccctccccagag

SEQ ID NO: 960917 - DNA, 19 bp, Homo sapiens
gccctccccagagcactgg

SEQ ID NO: 960918 - DNA, 14 bp, Homo sapiens
gccctcccccagct

SEQ ID NO: 960919 - DNA, 17 bp, Homo sapiens
gccctcccccagctcct

SEQ ID NO: 960920 - DNA, 19 bp, Homo sapiens
gccctcccccagctccttg

SEQ ID NO: 960921 - DNA, 22 bp, Homo sapiens
gccctccccccagctccctgca

SEQ ID NO: 960922 - DNA, 23 bp, Homo sapiens
gccctccccccagctccctgcac

SEQ ID NO: 960923 - DNA, 12 bp, Homo sapiens
gccctccccctc

SEQ ID NO: 960924 - DNA, 16 bp, Homo sapiens
gccctccccctcaacc

SEQ ID NO: 960925 - DNA, 17 bp, Homo sapiens
gccctccccctcaacct

SEQ ID NO: 960926 - DNA, 15 bp, Homo sapiens
gccctcccccttccc

SEQ ID NO: 960927 - DNA, 20 bp, Homo sapiens
gccctcccccttccccttct

SEQ ID NO: 960928 - DNA, 15 bp, Homo sapiens
gccctcccctctctg

SEQ ID NO: 960929 - DNA, 19 bp, Homo sapiens
gccctcccctctctgcacc

SEQ ID NO: 960930 - DNA, 14 bp, Homo sapiens
gccctccctcccag

SEQ ID NO: 960931 - DNA, 22 bp, Homo sapiens
gccctccctccctagcccttcc

SEQ ID NO: 960932 - DNA, 23 bp, Homo sapiens
gccctccctccgcctcccatccc

SEQ ID NO: 960933 - DNA, 22 bp, Homo sapiens
gccctccctctactcttcctgt

SEQ ID NO: 960934 - DNA, 22 bp, Homo sapiens
gccctccctgactccctgtggg

SEQ ID NO: 960935 - DNA, 23 bp, Homo sapiens
gccctccctgactccctgtgggg

SEQ ID NO: 960936 - DNA, 14 bp, Homo sapiens
gccctccctgtcct

SEQ ID NO: 960937 - DNA, 19 bp, Homo sapiens
gccctcccttctccctgga

SEQ ID NO: 960938 - DNA, 22 bp, Homo sapiens
gccctccgaccacttccagggg

SEQ ID NO: 960939 - DNA, 12 bp, Homo sapiens
gccctccggagg

SEQ ID NO: 960940 - DNA, 15 bp, Homo sapiens
gccctccggaggagc

SEQ ID NO: 960941 - DNA, 22 bp, Homo sapiens
gccctccggaggagcagcctcg

SEQ ID NO: 960942 - DNA, 13 bp, Homo sapiens
gccctcctcaccc

SEQ ID NO: 960943 - DNA, 22 bp, Homo sapiens
gccctcctcagcgagaggcagc

SEQ ID NO: 960944 - DNA, 12 bp, Homo sapiens
gccctcctccac

SEQ ID NO: 960945 - DNA, 20 bp, Homo sapiens
gccctcctctcccattgtcc

SEQ ID NO: 960946 - DNA, 18 bp, Homo sapiens
gccctcctgtgctggggg

SEQ ID NO: 960947 - DNA, 15 bp, Homo sapiens
gccctcctttccctt

SEQ ID NO: 960948 - DNA, 18 bp, Homo sapiens
gccctcctttctgtgccc

SEQ ID NO: 960949 - DNA, 16 bp, Homo sapiens
gccctcgaaccaaggc

SEQ ID NO: 960950 - DNA, 19 bp, Homo sapiens
gccctcgaaccaaggcagc

SEQ ID NO: 960951 - DNA, 22 bp, Homo sapiens
gccctcgaaccaaggcagcctc

SEQ ID NO: 960952 - DNA, 17 bp, Homo sapiens
gccctcgctgccagctc

SEQ ID NO: 960953 - DNA, 16 bp, Homo sapiens
gccctcgctgcttctg

SEQ ID NO: 960954 - DNA, 16 bp, Homo sapiens
gccctcggagctggct

SEQ ID NO: 960955 - DNA, 18 bp, Homo sapiens
gccctcggagctggctgt

SEQ ID NO: 960956 - DNA, 20 bp, Homo sapiens
gccctcggtggctgcacaga

SEQ ID NO: 960957 - DNA, 21 bp, Homo sapiens
gccctcgtgcctgggggagag

SEQ ID NO: 960958 - DNA, 18 bp, Homo sapiens
gccctcgtggccagcccg

SEQ ID NO: 960959 - DNA, 20 bp, Homo sapiens
gccctcgtggccagcccggc

SEQ ID NO: 960960 - DNA, 15 bp, Homo sapiens
gccctctagggcagg

SEQ ID NO: 960961 - DNA, 16 bp, Homo sapiens
gccctctatgctggct

SEQ ID NO: 960962 - DNA, 11 bp, Homo sapiens
gccctctcccc

SEQ ID NO: 960963 - DNA, 20 bp, Homo sapiens
gccctctccccacccctacc

SEQ ID NO: 960964 - DNA, 17 bp, Homo sapiens
gccctctctctgcggca

SEQ ID NO: 960965 - DNA, 15 bp, Homo sapiens
gccctctctctgggc

SEQ ID NO: 960966 - DNA, 14 bp, Homo sapiens
gccctctctgctcc

SEQ ID NO: 960967 - DNA, 15 bp, Homo sapiens
gccctctctgctcct

SEQ ID NO: 960968 - DNA, 16 bp, Homo sapiens
gccctctctgctcctt

SEQ ID NO: 960969 - DNA, 21 bp, Homo sapiens
gccctctctgctccttcactg

SEQ ID NO: 960970 - DNA, 16 bp, Homo sapiens
gccctctctgctctgc

SEQ ID NO: 960971 - DNA, 12 bp, Homo sapiens
gccctctgaaat

SEQ ID NO: 960972 - DNA, 16 bp, Homo sapiens
gccctctgaaattaaa

SEQ ID NO: 960973 - DNA, 17 bp, Homo sapiens
gccctctgaacttgcct

SEQ ID NO: 960974 - DNA, 16 bp, Homo sapiens
gccctctgagccgcca

SEQ ID NO: 960975 - DNA, 16 bp, Homo sapiens
gccctctgcctcctca

SEQ ID NO: 960976 - DNA, 13 bp, Homo sapiens
gccctctgcctgc

SEQ ID NO: 960977 - DNA, 20 bp, Homo sapiens
gccctctgcctgcactccct

SEQ ID NO: 960978 - DNA, 22 bp, Homo sapiens
gccctctgcctgcactccctgg

SEQ ID NO: 960979 - DNA, 23 bp, Homo sapiens
gccctctgcctgcactccctggc

SEQ ID NO: 960980 - DNA, 22 bp, Homo sapiens
gccctctgctcaggcctcccta

SEQ ID NO: 960981 - DNA, 22 bp, Homo sapiens
gccctctgctctgcctggagtg

SEQ ID NO: 960982 - DNA, 23 bp, Homo sapiens
gccctctgctctgcctggagtgt

SEQ ID NO: 960983 - DNA, 14 bp, Homo sapiens
gccctctgctgagc

SEQ ID NO: 960984 - DNA, 13 bp, Homo sapiens
gccctctgctgct

SEQ ID NO: 960985 - DNA, 14 bp, Homo sapiens
gccctctgctgctg

SEQ ID NO: 960986 - DNA, 15 bp, Homo sapiens
gccctctgctgctgc

SEQ ID NO: 960987 - DNA, 16 bp, Homo sapiens
gccctctgctgctgcc

SEQ ID NO: 960988 - DNA, 16 bp, Homo sapiens
gccctctggagtggcc

SEQ ID NO: 960989 - DNA, 13 bp, Homo sapiens
gccctctgggtcc

SEQ ID NO: 960990 - DNA, 13 bp, Homo sapiens
gccctctgtggcc

SEQ ID NO: 960991 - DNA, 19 bp, Homo sapiens
gccctcttatctcatcctt

SEQ ID NO: 960992 - DNA, 11 bp, Homo sapiens
gccctcttgcc

SEQ ID NO: 960993 - DNA, 14 bp, Homo sapiens
gccctcttgccagc

SEQ ID NO: 960994 - DNA, 16 bp, Homo sapiens
gccctcttgccagcct

SEQ ID NO: 960995 - DNA, 19 bp, Homo sapiens
gccctcttgccagcctcct

SEQ ID NO: 960996 - DNA, 19 bp, Homo sapiens
gccctcttgcgggcctgga

SEQ ID NO: 960997 - DNA, 20 bp, Homo sapiens
gccctcttgcgggcctggac

SEQ ID NO: 960998 - DNA, 15 bp, Homo sapiens
gccctgaaagggccc

SEQ ID NO: 960999 - DNA, 19 bp, Homo sapiens
gccctgaaagggcccttcc

SEQ ID NO: 961000 - DNA, 23 bp, Homo sapiens
gccctgaaccacgaggctgcccc

SEQ ID NO: 961001 - DNA, 20 bp, Homo sapiens
gccctgaagcctccgtggaa

SEQ ID NO: 961002 - DNA, 23 bp, Homo sapiens
gccctgaatttcttcttttcctg

SEQ ID NO: 961003 - DNA, 16 bp, Homo sapiens
gccctgacatgctaac

SEQ ID NO: 961004 - DNA, 17 bp, Homo sapiens
gccctgacctcccagcc

SEQ ID NO: 961005 - DNA, 16 bp, Homo sapiens
gccctgaccttggctg

SEQ ID NO: 961006 - DNA, 22 bp, Homo sapiens
gccctgaccttggctgactggg

SEQ ID NO: 961007 - DNA, 15 bp, Homo sapiens
gccctgactcctctg

SEQ ID NO: 961008 - DNA, 19 bp, Homo sapiens
gccctgactgtcagggagg

SEQ ID NO: 961009 - DNA, 21 bp, Homo sapiens
gccctgagcccggccctcccc

SEQ ID NO: 961010 - DNA, 13 bp, Homo sapiens
gccctgagctcgg

SEQ ID NO: 961011 - DNA, 15 bp, Homo sapiens
gccctgagctcggtg

SEQ ID NO: 961012 - DNA, 22 bp, Homo sapiens
gccctgagctcggtggacccag

SEQ ID NO: 961013 - DNA, 14 bp, Homo sapiens
gccctgagctttct

SEQ ID NO: 961014 - DNA, 22 bp, Homo sapiens
gccctgggccccaccacctagg

SEQ ID NO: 961015 - DNA, 13 bp, Homo sapiens
gccctgggcctca

SEQ ID NO: 961016 - DNA, 11 bp, Homo sapiens
gccctgggctg

SEQ ID NO: 961017 - DNA, 13 bp, Homo sapiens
gccctgggctgga

SEQ ID NO: 961018 - DNA, 16 bp, Homo sapiens
gccctgggctggaatc

SEQ ID NO: 961019 - DNA, 14 bp, Homo sapiens
gccctgggctggac

SEQ ID NO: 961020 - DNA, 18 bp, Homo sapiens
gccctgggctggactgga

SEQ ID NO: 961021 - DNA, 20 bp, Homo sapiens
gccctgggctggactggagg

SEQ ID NO: 961022 - DNA, 21 bp, Homo sapiens
gccctgggctggactggaggt

SEQ ID NO: 961023 - DNA, 20 bp, Homo sapiens
gccctgggctgggtgctggg

SEQ ID NO: 961024 - DNA, 20 bp, Homo sapiens
gccctgggctgtctgtcacc

SEQ ID NO: 961025 - DNA, 21 bp, Homo sapiens
gccctgggctgtctgtcacca

SEQ ID NO: 961026 - DNA, 20 bp, Homo sapiens
gccctgggcttggctcttgg

SEQ ID NO: 961027 - DNA, 17 bp, Homo sapiens
gccctggggaggggtgg

SEQ ID NO: 961028 - DNA, 19 bp, Homo sapiens
gccctggggatcttcccac

SEQ ID NO: 961029 - DNA, 23 bp, Homo sapiens
gccctggggatcttcccacagga

SEQ ID NO: 961030 - DNA, 21 bp, Homo sapiens
gccctgggggattcctgagct

SEQ ID NO: 961031 - DNA, 23 bp, Homo sapiens
gccctgggggattcctgagctgg

SEQ ID NO: 961032 - DNA, 21 bp, Homo sapiens
gccctggggtaccatgtggcc

SEQ ID NO: 961033 - DNA, 21 bp, Homo sapiens
gccctggggtttgaagctgac

SEQ ID NO: 961034 - DNA, 21 bp, Homo sapiens
gccctgggtctaaggggttgg

SEQ ID NO: 961035 - DNA, 16 bp, Homo sapiens
gccctggtgctgccac

SEQ ID NO: 961036 - DNA, 14 bp, Homo sapiens
gccctggtggagaa

SEQ ID NO: 961037 - DNA, 18 bp, Homo sapiens
gccctggtggagaaagca

SEQ ID NO: 961038 - DNA, 14 bp, Homo sapiens
gccctggttcccag

SEQ ID NO: 961039 - DNA, 16 bp, Homo sapiens
gccctgtacagtgaat

SEQ ID NO: 961040 - DNA, 15 bp, Homo sapiens
gccctgtacccaccc

SEQ ID NO: 961041 - DNA, 18 bp, Homo sapiens
gccctgtacccaccccag

SEQ ID NO: 961042 - DNA, 23 bp, Homo sapiens
gccctgtacccaccccagcacag

SEQ ID NO: 961043 - DNA, 23 bp, Homo sapiens
gccctgtccaaaagcgccctcac

SEQ ID NO: 961044 - DNA, 13 bp, Homo sapiens
gccctgtccagcc

SEQ ID NO: 961045 - DNA, 21 bp, Homo sapiens
gccctgtccagcccccagtgc

SEQ ID NO: 961046 - DNA, 12 bp, Homo sapiens
gccctgtcccag

SEQ ID NO: 961047 - DNA, 20 bp, Homo sapiens
gccctgtccctgtccccctc

SEQ ID NO: 961048 - DNA, 17 bp, Homo sapiens
gccctgtcctggtggta

SEQ ID NO: 961049 - DNA, 16 bp, Homo sapiens
gccctgtcgagacact

SEQ ID NO: 961050 - DNA, 21 bp, Homo sapiens
gccctgtcgagacacttgcct

SEQ ID NO: 961051 - DNA, 11 bp, Homo sapiens
gccctgtgccg

SEQ ID NO: 961052 - DNA, 13 bp, Homo sapiens
gccctgtgcctgg

SEQ ID NO: 961053 - DNA, 16 bp, Homo sapiens
gccctgtgcctgggcc

SEQ ID NO: 961054 - DNA, 20 bp, Homo sapiens
gccctgtgcctgggccctgg

SEQ ID NO: 961055 - DNA, 23 bp, Homo sapiens
gccctgtgcctgggccctgggct

SEQ ID NO: 961056 - DNA, 14 bp, Homo sapiens
gccctgtggccgcc

SEQ ID NO: 961057 - DNA, 17 bp, Homo sapiens
gccctgtggtctgggga

SEQ ID NO: 961058 - DNA, 19 bp, Homo sapiens
gccctgtggtctggggaga

SEQ ID NO: 961059 - DNA, 24 bp, Homo sapiens
gccctgtgtctgtcacaggctggg

SEQ ID NO: 961060 - DNA, 19 bp, Homo sapiens
gccctgtgtgtttgacatg

SEQ ID NO: 961061 - DNA, 15 bp, Homo sapiens
gccctgttccctgga

SEQ ID NO: 961062 - DNA, 16 bp, Homo sapiens
gccctgttccctggag

SEQ ID NO: 961063 - DNA, 22 bp, Homo sapiens
gccctgttccctggagtcaggg

SEQ ID NO: 961064 - DNA, 17 bp, Homo sapiens
gccctgttctcctcccc

SEQ ID NO: 961065 - DNA, 19 bp, Homo sapiens
gccctgttggcagctctag

SEQ ID NO: 961066 - DNA, 14 bp, Homo sapiens
gcccttagcacaga

SEQ ID NO: 961067 - DNA, 17 bp, Homo sapiens
gcccttagcacagagag

SEQ ID NO: 961068 - DNA, 15 bp, Homo sapiens
gcccttagtccccca

SEQ ID NO: 961069 - DNA, 17 bp, Homo sapiens
gcccttagtcccccaac

SEQ ID NO: 961070 - DNA, 18 bp, Homo sapiens
gcccttattttcaagaaa

SEQ ID NO: 961071 - DNA, 16 bp, Homo sapiens
gcccttcacagtgttt

SEQ ID NO: 961072 - DNA, 14 bp, Homo sapiens
gcccttcactgcca

SEQ ID NO: 961073 - DNA, 14 bp, Homo sapiens
gcccttcagtctgc

SEQ ID NO: 961074 - DNA, 15 bp, Homo sapiens
gcccttccaaactct

SEQ ID NO: 961075 - DNA, 12 bp, Homo sapiens
gcccttccagcc

SEQ ID NO: 961076 - DNA, 12 bp, Homo sapiens
gcccttccagtg

SEQ ID NO: 961077 - DNA, 12 bp, Homo sapiens
gcccttccatgt

SEQ ID NO: 961078 - DNA, 21 bp, Homo sapiens
gcccttccatgtcgcctctgc

SEQ ID NO: 961079 - DNA, 13 bp, Homo sapiens
gcccttccccctg

SEQ ID NO: 961080 - DNA, 14 bp, Homo sapiens
gcccttcccctccc

SEQ ID NO: 961081 - DNA, 24 bp, Homo sapiens
gcccttcccctcccccactcctct

SEQ ID NO: 961082 - DNA, 22 bp, Homo sapiens
gcccttccctctgggcacgcct

SEQ ID NO: 961083 - DNA, 13 bp, Homo sapiens
gcccttccctgtc

SEQ ID NO: 961084 - DNA, 23 bp, Homo sapiens
gcccttccgcagtgtggccaggc

SEQ ID NO: 961085 - DNA, 22 bp, Homo sapiens
gcccttcctcctgatggagtgt

SEQ ID NO: 961086 - DNA, 14 bp, Homo sapiens
gcccttcctctcca

SEQ ID NO: 961087 - DNA, 22 bp, Homo sapiens
gcccttcctctccactgccttc

SEQ ID NO: 961088 - DNA, 14 bp, Homo sapiens
gcccttccttccat

SEQ ID NO: 961089 - DNA, 18 bp, Homo sapiens
gcccttccttgggcgtct

SEQ ID NO: 961090 - DNA, 16 bp, Homo sapiens
gcccttcggtcacctg

SEQ ID NO: 961091 - DNA, 17 bp, Homo sapiens
gcccttctcaagacttt

SEQ ID NO: 961092 - DNA, 18 bp, Homo sapiens
gcccttctcacgggctct

SEQ ID NO: 961093 - DNA, 20 bp, Homo sapiens
gcccttctcacgggctctat

SEQ ID NO: 961094 - DNA, 14 bp, Homo sapiens
gcccttctcccggc

SEQ ID NO: 961095 - DNA, 16 bp, Homo sapiens
gcccttctcccggccc

SEQ ID NO: 961096 - DNA, 15 bp, Homo sapiens
gcccttctgtccacc

SEQ ID NO: 961097 - DNA, 18 bp, Homo sapiens
gcccttctgtccaccaga

SEQ ID NO: 961098 - DNA, 16 bp, Homo sapiens
gcccttgactgtacag

SEQ ID NO: 961099 - DNA, 18 bp, Homo sapiens
gcccttgaggggccccag

SEQ ID NO: 961100 - DNA, 13 bp, Homo sapiens
gcccttggaataa

SEQ ID NO: 961101 - DNA, 15 bp, Homo sapiens
gcccttggagctgcc

SEQ ID NO: 961102 - DNA, 19 bp, Homo sapiens
gcccttggcaccaccaggg

SEQ ID NO: 961103 - DNA, 20 bp, Homo sapiens
gcccttggcaccaccagggt

SEQ ID NO: 961104 - DNA, 15 bp, Homo sapiens
gcccttggccccaga

SEQ ID NO: 961105 - DNA, 19 bp, Homo sapiens
gcccttggccccagaggac

SEQ ID NO: 961106 - DNA, 14 bp, Homo sapiens
gcccttggcttctg

SEQ ID NO: 961107 - DNA, 16 bp, Homo sapiens
gcccttggcttctgct

SEQ ID NO: 961108 - DNA, 15 bp, Homo sapiens
gcccttggcttctgt

SEQ ID NO: 961109 - DNA, 16 bp, Homo sapiens
gcccttgggacagcca

SEQ ID NO: 961110 - DNA, 17 bp, Homo sapiens
gcccttgggacagccag

SEQ ID NO: 961111 - DNA, 16 bp, Homo sapiens
gcccttggggcctggc

SEQ ID NO: 961112 - DNA, 20 bp, Homo sapiens
gcccttggggcctggcttgc

SEQ ID NO: 961113 - DNA, 18 bp, Homo sapiens
gcccttgtcattgccttc

SEQ ID NO: 961114 - DNA, 16 bp, Homo sapiens
gcccttgtcctgccag

SEQ ID NO: 961115 - DNA, 18 bp, Homo sapiens
gcccttgtcctgccagct

SEQ ID NO: 961116 - DNA, 19 bp, Homo sapiens
gcccttgtcctgccagctg

SEQ ID NO: 961117 - DNA, 20 bp, Homo sapiens
gcccttgtcctgccagctgc

SEQ ID NO: 961118 - DNA, 22 bp, Homo sapiens
gcccttgtcctgccagctgcct

SEQ ID NO: 961119 - DNA, 18 bp, Homo sapiens
gcccttgtcgtgggatgg

SEQ ID NO: 961120 - DNA, 11 bp, Homo sapiens
gccctttaaaa

SEQ ID NO: 961121 - DNA, 22 bp, Homo sapiens
gccccagactgggcccaggcag

SEQ ID NO: 961122 - DNA, 23 bp, Homo sapiens
gccccagactgggcccaggcagg

SEQ ID NO: 961123 - DNA, 13 bp, Homo sapiens
gccccagagcccc

SEQ ID NO: 961124 - DNA, 23 bp, Homo sapiens
gccccagagctgtttatggcctc

SEQ ID NO: 961125 - DNA, 15 bp, Homo sapiens
gccccagagtggccc

SEQ ID NO: 961126 - DNA, 18 bp, Homo sapiens
gccccagatcaccagccc

SEQ ID NO: 961127 - DNA, 15 bp, Homo sapiens
gccccagatctgcct

SEQ ID NO: 961128 - DNA, 18 bp, Homo sapiens
gccccagatctgcctggg

SEQ ID NO: 961129 - DNA, 20 bp, Homo sapiens
gccccagatctgcctgggcc

SEQ ID NO: 961130 - DNA, 17 bp, Homo sapiens
gccccagatgatcccag

SEQ ID NO: 961131 - DNA, 21 bp, Homo sapiens
gccccagatgatcccagtcac

SEQ ID NO: 961132 - DNA, 13 bp, Homo sapiens
gccccagcacagc

SEQ ID NO: 961133 - DNA, 17 bp, Homo sapiens
gccccagcactaaagca

SEQ ID NO: 961134 - DNA, 12 bp, Homo sapiens
gccccagccaga

SEQ ID NO: 961135 - DNA, 13 bp, Homo sapiens
gccccagcccaga

SEQ ID NO: 961136 - DNA, 14 bp, Homo sapiens
gccccagcccagcc

SEQ ID NO: 961137 - DNA, 22 bp, Homo sapiens
gccccagcccagccccactcct

SEQ ID NO: 961138 - DNA, 16 bp, Homo sapiens
gccccagccccttctc

SEQ ID NO: 961139 - DNA, 16 bp, Homo sapiens
gccccagccctcagtc

SEQ ID NO: 961140 - DNA, 10 bp, Homo sapiens
gccccagcct

SEQ ID NO: 961141 - DNA, 16 bp, Homo sapiens
gccccagcgtctgcag

SEQ ID NO: 961142 - DNA, 17 bp, Homo sapiens
gccccagcgtctgcagg

SEQ ID NO: 961143 - DNA, 18 bp, Homo sapiens
gccccagcgtctgcaggg

SEQ ID NO: 961144 - DNA, 13 bp, Homo sapiens
gccccagctctgg

SEQ ID NO: 961145 - DNA, 20 bp, Homo sapiens
gccccagctctggatgaagg

SEQ ID NO: 961146 - DNA, 11 bp, Homo sapiens
gccccagctga

SEQ ID NO: 961147 - DNA, 14 bp, Homo sapiens
gccccagctgccag

SEQ ID NO: 961148 - DNA, 16 bp, Homo sapiens
gccccagctgccaggc

SEQ ID NO: 961149 - DNA, 20 bp, Homo sapiens
gccccaggacctggctgcca

SEQ ID NO: 961150 - DNA, 22 bp, Homo sapiens
gccccaggacctggctgccata

SEQ ID NO: 961151 - DNA, 14 bp, Homo sapiens
gccccaggactctg

SEQ ID NO: 961152 - DNA, 15 bp, Homo sapiens
gccccaggactctgg

SEQ ID NO: 961153 - DNA, 15 bp, Homo sapiens
gccccaggcaggctg

SEQ ID NO: 961154 - DNA, 22 bp, Homo sapiens
gccccaggcagggccaaccctt

SEQ ID NO: 961155 - DNA, 13 bp, Homo sapiens
gccccaggccagg

SEQ ID NO: 961156 - DNA, 14 bp, Homo sapiens
gccccaggccaggt

SEQ ID NO: 961157 - DNA, 11 bp, Homo sapiens
gccccaggccc

SEQ ID NO: 961158 - DNA, 17 bp, Homo sapiens
gccccaggccccagaca

SEQ ID NO: 961159 - DNA, 20 bp, Homo sapiens
gccccaggccctactaccca

SEQ ID NO: 961160 - DNA, 18 bp, Homo sapiens
gccccaggccggagccca

SEQ ID NO: 961161 - DNA, 20 bp, Homo sapiens
gccccaggccggagcccaga

SEQ ID NO: 961162 - DNA, 21 bp, Homo sapiens
gccccaggccggagcccagat

SEQ ID NO: 961163 - DNA, 18 bp, Homo sapiens
gccccaggcctggcctcg

SEQ ID NO: 961164 - DNA, 22 bp, Homo sapiens
gccccaggcttccgcgcccagc

SEQ ID NO: 961165 - DNA, 11 bp, Homo sapiens
gccccagggac

SEQ ID NO: 961166 - DNA, 18 bp, Homo sapiens
gccccagggacagaggcc

SEQ ID NO: 961167 - DNA, 20 bp, Homo sapiens
gccccagggagtccagggtt

SEQ ID NO: 961168 - DNA, 13 bp, Homo sapiens
gccccagggcctg

SEQ ID NO: 961169 - DNA, 15 bp, Homo sapiens
gccccagggcctgcg

SEQ ID NO: 961170 - DNA, 13 bp, Homo sapiens
ctggtcctggcct

SEQ ID NO: 961171 - DNA, 13 bp, Homo sapiens
ctggtcctggctg

SEQ ID NO: 961172 - DNA, 13 bp, Homo sapiens
ctggtcctgtgga

SEQ ID NO: 961173 - DNA, 14 bp, Homo sapiens
ctggtcctgtggat

SEQ ID NO: 961174 - DNA, 19 bp, Homo sapiens
ctggtccttccactgtgca

SEQ ID NO: 961175 - DNA, 15 bp, Homo sapiens
ctggtcctttttggt

SEQ ID NO: 961176 - DNA, 16 bp, Homo sapiens
ctggtcgctcctgccc

SEQ ID NO: 961177 - DNA, 23 bp, Homo sapiens
ctggtcgctcctgcccacggagt

SEQ ID NO: 961178 - DNA, 15 bp, Homo sapiens
ctggtctaatttatt

SEQ ID NO: 961179 - DNA, 18 bp, Homo sapiens
ctggtctcaaactcctgg

SEQ ID NO: 961180 - DNA, 20 bp, Homo sapiens
ctggtctcaaactcctgggc

SEQ ID NO: 961181 - DNA, 22 bp, Homo sapiens
ctggtctcaaacttgtggcctc

SEQ ID NO: 961182 - DNA, 18 bp, Homo sapiens
ctggtctcgaactcctga

SEQ ID NO: 961183 - DNA, 17 bp, Homo sapiens
ctggtctctagagggtt

SEQ ID NO: 961184 - DNA, 23 bp, Homo sapiens
ctggtctgatggaactgtgtatt

SEQ ID NO: 961185 - DNA, 16 bp, Homo sapiens
ctggtctgccaggggc

SEQ ID NO: 961186 - DNA, 17 bp, Homo sapiens
ctggtctgccaggggct

SEQ ID NO: 961187 - DNA, 12 bp, Homo sapiens
ctggtctggagt

SEQ ID NO: 961188 - DNA, 17 bp, Homo sapiens
ctggtctggtaaatatg

SEQ ID NO: 961189 - DNA, 21 bp, Homo sapiens
ctggtctggttgggcagccag

SEQ ID NO: 961190 - DNA, 15 bp, Homo sapiens
ctggtctgtctggat

SEQ ID NO: 961191 - DNA, 17 bp, Homo sapiens
ctggtctgtctggatcc

SEQ ID NO: 961192 - DNA, 21 bp, Homo sapiens
ctggtctgtggagatggactc

SEQ ID NO: 961193 - DNA, 20 bp, Homo sapiens
ctggtcttaaactcctggcc

SEQ ID NO: 961194 - DNA, 14 bp, Homo sapiens
ctggtcttgaactg

SEQ ID NO: 961195 - DNA, 19 bp, Homo sapiens
ctggtcttgaactgggctc

SEQ ID NO: 961196 - DNA, 15 bp, Homo sapiens
ctggtcttgagatgt

SEQ ID NO: 961197 - DNA, 18 bp, Homo sapiens
ctggtcttgtggaattgg

SEQ ID NO: 961198 - DNA, 20 bp, Homo sapiens
ctggtcttgttagaaaacaa

SEQ ID NO: 961199 - DNA, 19 bp, Homo sapiens
ctggtcttgtttccaggag

SEQ ID NO: 961200 - DNA, 22 bp, Homo sapiens
ctggtcttgtttccaggagcat

SEQ ID NO: 961201 - DNA, 15 bp, Homo sapiens
ctggtgaacactgtg

SEQ ID NO: 961202 - DNA, 16 bp, Homo sapiens
ctggtgaacactgtga

SEQ ID NO: 961203 - DNA, 18 bp, Homo sapiens
ctggtgaactgagctggg

SEQ ID NO: 961204 - DNA, 16 bp, Homo sapiens
ctggtgacagccttgg

SEQ ID NO: 961205 - DNA, 17 bp, Homo sapiens
ctggtgacctcctgtca

SEQ ID NO: 961206 - DNA, 20 bp, Homo sapiens
ctggtgactttggggacagg

SEQ ID NO: 961207 - DNA, 13 bp, Homo sapiens
ctggtgagacagt

SEQ ID NO: 961208 - DNA, 19 bp, Homo sapiens
ctggtgagaccccgcactg

SEQ ID NO: 961209 - DNA, 21 bp, Homo sapiens
ctggtgagaccccgcactgca

SEQ ID NO: 961210 - DNA, 15 bp, Homo sapiens
ctggtgaggtggccc

SEQ ID NO: 961211 - DNA, 18 bp, Homo sapiens
ctggtgaggtggcccagg

SEQ ID NO: 961212 - DNA, 20 bp, Homo sapiens
ctggtgaggtggcccaggcc

SEQ ID NO: 961213 - DNA, 19 bp, Homo sapiens
ctggtgatgttgaaatatg

SEQ ID NO: 961214 - DNA, 16 bp, Homo sapiens
ctggtgcaaattcaga

SEQ ID NO: 961215 - DNA, 19 bp, Homo sapiens
ctggtgcactttgtaaatt

SEQ ID NO: 961216 - DNA, 17 bp, Homo sapiens
ctggtgcattacagaga

SEQ ID NO: 961217 - DNA, 19 bp, Homo sapiens
ctggtgcattacagagagg

SEQ ID NO: 961218 - DNA, 16 bp, Homo sapiens
ctggtgcattctgttt

SEQ ID NO: 961219 - DNA, 23 bp, Homo sapiens
ctggtgccaaatagccccagact

SEQ ID NO: 961220 - DNA, 15 bp, Homo sapiens
ctggtgcccatgaag

SEQ ID NO: 961221 - DNA, 13 bp, Homo sapiens
ctggtgccccaca

SEQ ID NO: 961222 - DNA, 18 bp, Homo sapiens
ctggtgccccacagctac

SEQ ID NO: 961223 - DNA, 20 bp, Homo sapiens
ctggtgccccccacccctgg

SEQ ID NO: 961224 - DNA, 21 bp, Homo sapiens
ctggtgccccccacccctgga

SEQ ID NO: 961225 - DNA, 11 bp, Homo sapiens
ctggtgccctg

SEQ ID NO: 961226 - DNA, 15 bp, Homo sapiens
ctggtgccctgagac

SEQ ID NO: 961227 - DNA, 13 bp, Homo sapiens
ctggtgcctcctc

SEQ ID NO: 961228 - DNA, 15 bp, Homo sapiens
ctggtgcctcctcaa

SEQ ID NO: 961229 - DNA, 22 bp, Homo sapiens
ctggtgctataggctggagaag

SEQ ID NO: 961230 - DNA, 17 bp, Homo sapiens
ctggtgctcctgcccag

SEQ ID NO: 961231 - DNA, 22 bp, Homo sapiens
ctggtgctcctgcccagccacc

SEQ ID NO: 961232 - DNA, 14 bp, Homo sapiens
ctggtgctctctgc

SEQ ID NO: 961233 - DNA, 13 bp, Homo sapiens
ctggtgctgagtg

SEQ ID NO: 961234 - DNA, 14 bp, Homo sapiens
ctggtgctgagtga

SEQ ID NO: 961235 - DNA, 14 bp, Homo sapiens
ctggtgctgctgct

SEQ ID NO: 961236 - DNA, 19 bp, Homo sapiens
ctggtgctgtggccagggt

SEQ ID NO: 961237 - DNA, 12 bp, Homo sapiens
ctggtggacagt

SEQ ID NO: 961238 - DNA, 16 bp, Homo sapiens
ctggtggacagtcctg

SEQ ID NO: 961239 - DNA, 18 bp, Homo sapiens
ctggtggacagtcctggg

SEQ ID NO: 961240 - DNA, 20 bp, Homo sapiens
ctggtggagaactctggctt

SEQ ID NO: 961241 - DNA, 19 bp, Homo sapiens
ctggtggaggagctgaggg

SEQ ID NO: 961242 - DNA, 20 bp, Homo sapiens
ctggtggaggagctgaggga

SEQ ID NO: 961243 - DNA, 20 bp, Homo sapiens
ctggtggatctaagaagggc

SEQ ID NO: 961244 - DNA, 14 bp, Homo sapiens
ctggtggcacagga

SEQ ID NO: 961245 - DNA, 19 bp, Homo sapiens
ctggtggcaccagatgcaa

SEQ ID NO: 961246 - DNA, 16 bp, Homo sapiens
ctggtggcaggggctt

SEQ ID NO: 961247 - DNA, 22 bp, Homo sapiens
ctggtggccacttcattccagc

SEQ ID NO: 961248 - DNA, 14 bp, Homo sapiens
ctggtggcccagga

SEQ ID NO: 961249 - DNA, 21 bp, Homo sapiens
ctggtggcccgacagcctggc

SEQ ID NO: 961250 - DNA, 20 bp, Homo sapiens
ctggtggccctgtgcctggg

SEQ ID NO: 961251 - DNA, 18 bp, Homo sapiens
ctggtggccttgggcctt

SEQ ID NO: 961252 - DNA, 17 bp, Homo sapiens
ctggtggctcctcctag

SEQ ID NO: 961253 - DNA, 20 bp, Homo sapiens
ctggtggcttaagtgagcag

SEQ ID NO: 961254 - DNA, 21 bp, Homo sapiens
ctggtggcttaagtgagcaga

SEQ ID NO: 961255 - DNA, 18 bp, Homo sapiens
ctggtgggcagctgagga

SEQ ID NO: 961256 - DNA, 12 bp, Homo sapiens
ctggtgggcctc

SEQ ID NO: 961257 - DNA, 17 bp, Homo sapiens
ctggtgggcctcctctg

SEQ ID NO: 961258 - DNA, 23 bp, Homo sapiens
ctggtgggtctttaataaaacaa

SEQ ID NO: 961259 - DNA, 17 bp, Homo sapiens
ctggtgggtggcccaga

SEQ ID NO: 961260 - DNA, 16 bp, Homo sapiens
ctggtggtcagcccta

SEQ ID NO: 961261 - DNA, 17 bp, Homo sapiens
ctggtggtgcagccttc

SEQ ID NO: 961262 - DNA, 20 bp, Homo sapiens
ctggtggttaaggccagggc

SEQ ID NO: 961263 - DNA, 23 bp, Homo sapiens
tccaggcacccttctttcctctt

SEQ ID NO: 961264 - DNA, 14 bp, Homo sapiens
tccaggcactgaga

SEQ ID NO: 961265 - DNA, 12 bp, Homo sapiens
tccaggcaggcc

SEQ ID NO: 961266 - DNA, 20 bp, Homo sapiens
tccaggcatatgtttcccca

SEQ ID NO: 961267 - DNA, 22 bp, Homo sapiens
tccaggccactgtggccagagc

SEQ ID NO: 961268 - DNA, 15 bp, Homo sapiens
tccaggcccaaggct

SEQ ID NO: 961269 - DNA, 20 bp, Homo sapiens
tccaggcccaaggctcccgg

SEQ ID NO: 961270 - DNA, 20 bp, Homo sapiens
tccaggcccctgaggactgg

SEQ ID NO: 961271 - DNA, 21 bp, Homo sapiens
tccaggcccctgaggactgga

SEQ ID NO: 961272 - DNA, 13 bp, Homo sapiens
tccaggcccttag

SEQ ID NO: 961273 - DNA, 19 bp, Homo sapiens
tccaggcccttagggaagt

SEQ ID NO: 961274 - DNA, 18 bp, Homo sapiens
tccaggcctgcctcccac

SEQ ID NO: 961275 - DNA, 17 bp, Homo sapiens
tccaggctctgggcaca

SEQ ID NO: 961276 - DNA, 18 bp, Homo sapiens
tccaggctggtctgaaac

SEQ ID NO: 961277 - DNA, 19 bp, Homo sapiens
tccaggctggtcttgaatt

SEQ ID NO: 961278 - DNA, 20 bp, Homo sapiens
tccaggctttgtacagagtg

SEQ ID NO: 961279 - DNA, 12 bp, Homo sapiens
tccagggaagct

SEQ ID NO: 961280 - DNA, 14 bp, Homo sapiens
tccagggaagctgg

SEQ ID NO: 961281 - DNA, 23 bp, Homo sapiens
tccagggaagctggccgagggtc

SEQ ID NO: 961282 - DNA, 19 bp, Homo sapiens
tccagggaaggtggccaca

SEQ ID NO: 961283 - DNA, 20 bp, Homo sapiens
tccagggaaggtggccacag

SEQ ID NO: 961284 - DNA, 22 bp, Homo sapiens
tccagggaaggtggccacagca

SEQ ID NO: 961285 - DNA, 22 bp, Homo sapiens
tccagggacccttgcctgcctc

SEQ ID NO: 961286 - DNA, 23 bp, Homo sapiens
tccagggatgattcaagccattc

SEQ ID NO: 961287 - DNA, 15 bp, Homo sapiens
tccagggcagcagcc

SEQ ID NO: 961288 - DNA, 22 bp, Homo sapiens
tccagggcagcctccaccttgc

SEQ ID NO: 961289 - DNA, 22 bp, Homo sapiens
tccagggccacgtgccaggccc

SEQ ID NO: 961290 - DNA, 16 bp, Homo sapiens
tccagggcctgacacc

SEQ ID NO: 961291 - DNA, 23 bp, Homo sapiens
tccagggcgccagggtgctgtcg

SEQ ID NO: 961292 - DNA, 19 bp, Homo sapiens
tccagggctgttggaggac

SEQ ID NO: 961293 - DNA, 19 bp, Homo sapiens
tccaggggagatggggagg

SEQ ID NO: 961294 - DNA, 14 bp, Homo sapiens
tccaggggctcctg

SEQ ID NO: 961295 - DNA, 17 bp, Homo sapiens
tccaggggctcctgggt

SEQ ID NO: 961296 - DNA, 23 bp, Homo sapiens
tccaggggctgcttcctcctgga

SEQ ID NO: 961297 - DNA, 14 bp, Homo sapiens
tccaggggtttaca

SEQ ID NO: 961298 - DNA, 17 bp, Homo sapiens
tccaggggtttacagtg

SEQ ID NO: 961299 - DNA, 15 bp, Homo sapiens
tccagggtcccctgc

SEQ ID NO: 961300 - DNA, 18 bp, Homo sapiens
tccagggtcccctgccac

SEQ ID NO: 961301 - DNA, 19 bp, Homo sapiens
tccagggtcccctgccacc

SEQ ID NO: 961302 - DNA, 16 bp, Homo sapiens
tccagggtccctctgt

SEQ ID NO: 961303 - DNA, 17 bp, Homo sapiens
tccagggtccctctgtg

SEQ ID NO: 961304 - DNA, 16 bp, Homo sapiens
tccagggtcctctagc

SEQ ID NO: 961305 - DNA, 19 bp, Homo sapiens
tccagggtctggcagagcc

SEQ ID NO: 961306 - DNA, 20 bp, Homo sapiens
tccagggtctggcagagcct

SEQ ID NO: 961307 - DNA, 21 bp, Homo sapiens
tccagggtctggcagagcctc

SEQ ID NO: 961308 - DNA, 15 bp, Homo sapiens
tccagggtcttgggc

SEQ ID NO: 961309 - DNA, 22 bp, Homo sapiens
tccagggtcttgggctactggc

SEQ ID NO: 961310 - DNA, 16 bp, Homo sapiens
tccagggtttctctgc

SEQ ID NO: 961311 - DNA, 15 bp, Homo sapiens
tccaggtatctccag

SEQ ID NO: 961312 - DNA, 16 bp, Homo sapiens
tccaggtatctccagg

SEQ ID NO: 961313 - DNA, 12 bp, Homo sapiens
tccaggtcagga

SEQ ID NO: 961314 - DNA, 16 bp, Homo sapiens
tccaggtcaggatgca

SEQ ID NO: 961315 - DNA, 15 bp, Homo sapiens
tccaggtcatgcagt

SEQ ID NO: 961316 - DNA, 20 bp, Homo sapiens
tccaggtcctcagatgggaa

SEQ ID NO: 961317 - DNA, 16 bp, Homo sapiens
tccaggtctcacgggc

SEQ ID NO: 961318 - DNA, 22 bp, Homo sapiens
tccaggtgagtgtgagggcagc

SEQ ID NO: 961319 - DNA, 23 bp, Homo sapiens
tccaggtgagtgtgagggcagca

SEQ ID NO: 961320 - DNA, 20 bp, Homo sapiens
tccaggtgtgcacagaaaac

SEQ ID NO: 961321 - DNA, 16 bp, Homo sapiens
tccaggtgttactgta

SEQ ID NO: 961322 - DNA, 20 bp, Homo sapiens
tccaggttcaacccacagct

SEQ ID NO: 961323 - DNA, 23 bp, Homo sapiens
tccaggttcaacccacagctact

SEQ ID NO: 961324 - DNA, 21 bp, Homo sapiens
tccagtaacttttttgtgtat

SEQ ID NO: 961325 - DNA, 23 bp, Homo sapiens
tccagtaacttttttgtgtatgt

SEQ ID NO: 961326 - DNA, 18 bp, Homo sapiens
tccagtaaggaatgatat

SEQ ID NO: 961327 - DNA, 15 bp, Homo sapiens
tccagtaatctaata

SEQ ID NO: 961328 - DNA, 22 bp, Homo sapiens
tccagtaccttgcttcttactg

SEQ ID NO: 961329 - DNA, 15 bp, Homo sapiens
tccagtagctcctgg

SEQ ID NO: 961330 - DNA, 16 bp, Homo sapiens
tccagtagctcctgga

SEQ ID NO: 961331 - DNA, 16 bp, Homo sapiens
tccagtaggatccagt

SEQ ID NO: 961332 - DNA, 17 bp, Homo sapiens
tccagtattatattatc

SEQ ID NO: 961333 - DNA, 13 bp, Homo sapiens
tccagtattcttg

SEQ ID NO: 961334 - DNA, 14 bp, Homo sapiens
tccagtattgctga

SEQ ID NO: 961335 - DNA, 18 bp, Homo sapiens
tccagtcaaatctgggct

SEQ ID NO: 961336 - DNA, 16 bp, Homo sapiens
tccagtcacactcccc

SEQ ID NO: 961337 - DNA, 14 bp, Homo sapiens
tccagtcatcctgc

SEQ ID NO: 961338 - DNA, 20 bp, Homo sapiens
tccagtcatcctgccctgca

SEQ ID NO: 961339 - DNA, 23 bp, Homo sapiens
tccagtcatggtactaccccagc

SEQ ID NO: 961340 - DNA, 19 bp, Homo sapiens
tccagtcgttatttctgtt

SEQ ID NO: 961341 - DNA, 21 bp, Homo sapiens
tccagtctcatctatgtcata

SEQ ID NO: 961342 - DNA, 15 bp, Homo sapiens
tccagtctgctgccc

SEQ ID NO: 961343 - DNA, 20 bp, Homo sapiens
tccagtgacaaaccatccag

SEQ ID NO: 961344 - DNA, 11 bp, Homo sapiens
tccagtgcagt

SEQ ID NO: 961345 - DNA, 17 bp, Homo sapiens
tccagtgccagcaatga

SEQ ID NO: 961346 - DNA, 17 bp, Homo sapiens
tccagtgccgctcctgc

SEQ ID NO: 961347 - DNA, 18 bp, Homo sapiens
tccagtgctctgcctcag

SEQ ID NO: 961348 - DNA, 21 bp, Homo sapiens
tccagtggaagttcttcaaga

SEQ ID NO: 961349 - DNA, 17 bp, Homo sapiens
tccagtggatcataaga

SEQ ID NO: 961350 - DNA, 14 bp, Homo sapiens
tccagtggcagaca

SEQ ID NO: 961351 - DNA, 23 bp, Homo sapiens
tccagtggctcgctccctgtagc

SEQ ID NO: 961352 - DNA, 19 bp, Homo sapiens
tccagtggctggtttctga

SEQ ID NO: 961353 - DNA, 14 bp, Homo sapiens
tccagtgggcaggg

SEQ ID NO: 961354 - DNA, 15 bp, Homo sapiens
tccagtgggcagggg

SEQ ID NO: 961355 - DNA, 19 bp, Homo sapiens
tccagtggtgaagaaaact

SEQ ID NO: 961356 - DNA, 13 bp, Homo sapiens
tccagtggttctg

SEQ ID NO: 961357 - DNA, 15 bp, Homo sapiens
tccagtggttgctgt

SEQ ID NO: 961358 - DNA, 17 bp, Homo sapiens
tccagtgtcagggtcca

SEQ ID NO: 961359 - DNA, 21 bp, Homo sapiens
tccagtgtccttagaacattt

SEQ ID NO: 961360 - DNA, 17 bp, Homo sapiens
tccagtgttctatgaac

SEQ ID NO: 961361 - DNA, 16 bp, Homo sapiens
tccagtgttggctgtg

SEQ ID NO: 961362 - DNA, 21 bp, Homo sapiens
tccagtgttggctgtgtgaca

SEQ ID NO: 961363 - DNA, 22 bp, Homo sapiens
tccagttaaaaaaaattttaat

SEQ ID NO: 961364 - DNA, 19 bp, Homo sapiens
tccagttcatgagaatcta

SEQ ID NO: 961365 - DNA, 13 bp, Homo sapiens
tccagttcccact

SEQ ID NO: 961366 - DNA, 22 bp, Homo sapiens
tccagttcccatggtgtatgtg

SEQ ID NO: 961367 - DNA, 20 bp, Homo sapiens
tccagttcctgctctctgct

SEQ ID NO: 961368 - DNA, 18 bp, Homo sapiens
tccagttgggactcagga

SEQ ID NO: 961369 - DNA, 14 bp, Homo sapiens
tccagtttcccacc

SEQ ID NO: 961370 - DNA, 18 bp, Homo sapiens
tccagtttctccttgaaa

SEQ ID NO: 961371 - DNA, 16 bp, Homo sapiens
tccagtttgcatttgg

SEQ ID NO: 961372 - DNA, 14 bp, Homo sapiens
tccagtttgttctc

SEQ ID NO: 961373 - DNA, 18 bp, Homo sapiens
tccagtttgttctccggg

SEQ ID NO: 961374 - DNA, 16 bp, Homo sapiens
tccagttttctcctct

SEQ ID NO: 961375 - DNA, 23 bp, Homo sapiens
tccataaacagactgttaattat

SEQ ID NO: 961376 - DNA, 17 bp, Homo sapiens
tccataaatgtgttcct

SEQ ID NO: 961377 - DNA, 16 bp, Homo sapiens
tccataaggaatgtag

SEQ ID NO: 961378 - DNA, 14 bp, Homo sapiens
tccataagtaagaa

SEQ ID NO: 961379 - DNA, 18 bp, Homo sapiens
tccataatgcattcttct

SEQ ID NO: 961380 - DNA, 20 bp, Homo sapiens
tccataatgtataaagaaca

SEQ ID NO: 961381 - DNA, 17 bp, Homo sapiens
tccataattatgacagt

SEQ ID NO: 961382 - DNA, 16 bp, Homo sapiens
tccatacagcctctac

SEQ ID NO: 961383 - DNA, 21 bp, Homo sapiens
tccccttgtttgtcccttcta

SEQ ID NO: 961384 - DNA, 22 bp, Homo sapiens
tcccctttcatcggtgcctggt

SEQ ID NO: 961385 - DNA, 13 bp, Homo sapiens
tcccctttcctcc

SEQ ID NO: 961386 - DNA, 12 bp, Homo sapiens
tcccctttcctg

SEQ ID NO: 961387 - DNA, 17 bp, Homo sapiens
tcccctttcctgtccca

SEQ ID NO: 961388 - DNA, 14 bp, Homo sapiens
tcccctttgtcctg

SEQ ID NO: 961389 - DNA, 16 bp, Homo sapiens
tcccctttgtcctgcg

SEQ ID NO: 961390 - DNA, 21 bp, Homo sapiens
tccccttttttttctgattct

SEQ ID NO: 961391 - DNA, 14 bp, Homo sapiens
tcccgacagcccat

SEQ ID NO: 961392 - DNA, 13 bp, Homo sapiens
tcccgacccagcc

SEQ ID NO: 961393 - DNA, 24 bp, Homo sapiens
tcccgacccagccagctgcagggc

SEQ ID NO: 961394 - DNA, 13 bp, Homo sapiens
tcccgaggtcagc

SEQ ID NO: 961395 - DNA, 18 bp, Homo sapiens
tcccgaggtcagccaggc

SEQ ID NO: 961396 - DNA, 19 bp, Homo sapiens
tcccgatggtctctctccc

SEQ ID NO: 961397 - DNA, 18 bp, Homo sapiens
tcccgcaaggcctctcag

SEQ ID NO: 961398 - DNA, 21 bp, Homo sapiens
tcccgcacatggtgtgggggg

SEQ ID NO: 961399 - DNA, 15 bp, Homo sapiens
tcccgccagtgcaga

SEQ ID NO: 961400 - DNA, 19 bp, Homo sapiens
tcccgccccccacacttcc

SEQ ID NO: 961401 - DNA, 15 bp, Homo sapiens
tcccgcgttcaagac

SEQ ID NO: 961402 - DNA, 13 bp, Homo sapiens
tcccgctcagccc

SEQ ID NO: 961403 - DNA, 14 bp, Homo sapiens
tcccgctcagccct

SEQ ID NO: 961404 - DNA, 9 bp, Homo sapiens
tcccgctcc

SEQ ID NO: 961405 - DNA, 13 bp, Homo sapiens
tcccgctgcacac

SEQ ID NO: 961406 - DNA, 14 bp, Homo sapiens
tcccgctgcacaca

SEQ ID NO: 961407 - DNA, 17 bp, Homo sapiens
tcccgctgcacacagac

SEQ ID NO: 961408 - DNA, 22 bp, Homo sapiens
tcccgctgcacacagacggcct

SEQ ID NO: 961409 - DNA, 14 bp, Homo sapiens
tcccgctgcctcct

SEQ ID NO: 961410 - DNA, 16 bp, Homo sapiens
tcccgctgctgtgctc

SEQ ID NO: 961411 - DNA, 15 bp, Homo sapiens
tcccgcttagcctgc

SEQ ID NO: 961412 - DNA, 21 bp, Homo sapiens
tcccgcttagcctgcctcacc

SEQ ID NO: 961413 - DNA, 22 bp, Homo sapiens
tcccgcttagcctgcctcaccc

SEQ ID NO: 961414 - DNA, 17 bp, Homo sapiens
tcccgcttagcgctctg

SEQ ID NO: 961415 - DNA, 15 bp, Homo sapiens
tcccgcttagttctt

SEQ ID NO: 961416 - DNA, 20 bp, Homo sapiens
tcccggagccatcaccctca

SEQ ID NO: 961417 - DNA, 23 bp, Homo sapiens
tcccggagccatcaccctcaccc

SEQ ID NO: 961418 - DNA, 14 bp, Homo sapiens
tcccggaggaaatc

SEQ ID NO: 961419 - DNA, 23 bp, Homo sapiens
tcccggcatgggaaagccacctc

SEQ ID NO: 961420 - DNA, 20 bp, Homo sapiens
tcccggcctcttccacccat

SEQ ID NO: 961421 - DNA, 15 bp, Homo sapiens
tcccggctgccccca

SEQ ID NO: 961422 - DNA, 15 bp, Homo sapiens
tcccggctgcctgcc

SEQ ID NO: 961423 - DNA, 18 bp, Homo sapiens
tcccggctgcctgccgcc

SEQ ID NO: 961424 - DNA, 23 bp, Homo sapiens
tcccgggccaagacagatggaca

SEQ ID NO: 961425 - DNA, 20 bp, Homo sapiens
tcccgggccacgccccagcc

SEQ ID NO: 961426 - DNA, 15 bp, Homo sapiens
tcccgggccagggct

SEQ ID NO: 961427 - DNA, 21 bp, Homo sapiens
tcccgggccagggctgcccct

SEQ ID NO: 961428 - DNA, 13 bp, Homo sapiens
tcccgggccctcc

SEQ ID NO: 961429 - DNA, 18 bp, Homo sapiens
tcccgggccctcccttgg

SEQ ID NO: 961430 - DNA, 14 bp, Homo sapiens
tcccggggctccac

SEQ ID NO: 961431 - DNA, 16 bp, Homo sapiens
tcccggtaccttccat

SEQ ID NO: 961432 - DNA, 20 bp, Homo sapiens
tcccggtgtatcctggccct

SEQ ID NO: 961433 - DNA, 21 bp, Homo sapiens
tcccggttcagacccctgcct

SEQ ID NO: 961434 - DNA, 16 bp, Homo sapiens
tcccggttcttccagt

SEQ ID NO: 961435 - DNA, 21 bp, Homo sapiens
tcccgtatcacagtgttttta

SEQ ID NO: 961436 - DNA, 18 bp, Homo sapiens
tcccgtcccatatcctgc

SEQ ID NO: 961437 - DNA, 20 bp, Homo sapiens
tcccgtcccatatcctgcct

SEQ ID NO: 961438 - DNA, 22 bp, Homo sapiens
tcccgtgcatcccccctgctca

SEQ ID NO: 961439 - DNA, 22 bp, Homo sapiens
tcccgtgcccctttccttcact

SEQ ID NO: 961440 - DNA, 19 bp, Homo sapiens
tcccgtgtgtatttctaag

SEQ ID NO: 961441 - DNA, 16 bp, Homo sapiens
tccctaaactgcagcc

SEQ ID NO: 961442 - DNA, 13 bp, Homo sapiens
tccctaaactgta

SEQ ID NO: 961443 - DNA, 18 bp, Homo sapiens
tccctaaactttggcctt

SEQ ID NO: 961444 - DNA, 22 bp, Homo sapiens
tccctaagcatgtgtcccagga

SEQ ID NO: 961445 - DNA, 16 bp, Homo sapiens
tccctaagccagcctg

SEQ ID NO: 961446 - DNA, 18 bp, Homo sapiens
tccctaatgtgtttcttt

SEQ ID NO: 961447 - DNA, 20 bp, Homo sapiens
tccctaatttatgtgctata

SEQ ID NO: 961448 - DNA, 13 bp, Homo sapiens
tccctacatgtat

SEQ ID NO: 961449 - DNA, 17 bp, Homo sapiens
gcccagtgccagctcca

SEQ ID NO: 961450 - DNA, 18 bp, Homo sapiens
gcccagtgccagctccag

SEQ ID NO: 961451 - DNA, 15 bp, Homo sapiens
gcccagtgggctgca

SEQ ID NO: 961452 - DNA, 15 bp, Homo sapiens
gcccagtggtgagga

SEQ ID NO: 961453 - DNA, 22 bp, Homo sapiens
gcccagtgtcaagttgtgcttg

SEQ ID NO: 961454 - DNA, 17 bp, Homo sapiens
gcccagtgttgtttgta

SEQ ID NO: 961455 - DNA, 19 bp, Homo sapiens
gcccagtgttgtttgtaaa

SEQ ID NO: 961456 - DNA, 23 bp, Homo sapiens
gcccagtgttgtttgtaaataag

SEQ ID NO: 961457 - DNA, 18 bp, Homo sapiens
gcccagttcatcaccatt

SEQ ID NO: 961458 - DNA, 22 bp, Homo sapiens
gcccataaagtctgagaaatag

SEQ ID NO: 961459 - DNA, 20 bp, Homo sapiens
gcccataatagttagccctc

SEQ ID NO: 961460 - DNA, 21 bp, Homo sapiens
gcccataatagttagccctca

SEQ ID NO: 961461 - DNA, 23 bp, Homo sapiens
gcccatacccgtgacagtggctg

SEQ ID NO: 961462 - DNA, 15 bp, Homo sapiens
gcccataccttctgg

SEQ ID NO: 961463 - DNA, 15 bp, Homo sapiens
gcccatactcagcct

SEQ ID NO: 961464 - DNA, 16 bp, Homo sapiens
gcccatagccttgggg

SEQ ID NO: 961465 - DNA, 17 bp, Homo sapiens
gcccatagccttggggt

SEQ ID NO: 961466 - DNA, 18 bp, Homo sapiens
gcccatagctattttcct

SEQ ID NO: 961467 - DNA, 13 bp, Homo sapiens
gcccatcacaggg

SEQ ID NO: 961468 - DNA, 12 bp, Homo sapiens
gcccatcagcca

SEQ ID NO: 961469 - DNA, 20 bp, Homo sapiens
gcccatcagtgacagactgg

SEQ ID NO: 961470 - DNA, 18 bp, Homo sapiens
gcccatcctgaccagctg

SEQ ID NO: 961471 - DNA, 15 bp, Homo sapiens
gcccatcctgactga

SEQ ID NO: 961472 - DNA, 13 bp, Homo sapiens
gcccatccttccc

SEQ ID NO: 961473 - DNA, 16 bp, Homo sapiens
gcccatctcagcctcc

SEQ ID NO: 961474 - DNA, 21 bp, Homo sapiens
gcccatctcagcctcctgagc

SEQ ID NO: 961475 - DNA, 14 bp, Homo sapiens
gcccatctcaggac

SEQ ID NO: 961476 - DNA, 24 bp, Homo sapiens
gcccatctcaggtgccactccctg

SEQ ID NO: 961477 - DNA, 13 bp, Homo sapiens
gcccatctccctg

SEQ ID NO: 961478 - DNA, 14 bp, Homo sapiens
gcccatctccctgc

SEQ ID NO: 961479 - DNA, 18 bp, Homo sapiens
gcccatgatataacttta

SEQ ID NO: 961480 - DNA, 19 bp, Homo sapiens
gcccatgcccacctgccca

SEQ ID NO: 961481 - DNA, 11 bp, Homo sapiens
gcccatgcccc

SEQ ID NO: 961482 - DNA, 19 bp, Homo sapiens
gcccatggcccccaataaa

SEQ ID NO: 961483 - DNA, 21 bp, Homo sapiens
gcccatgtcgcgctcagcatg

SEQ ID NO: 961484 - DNA, 15 bp, Homo sapiens
gcccatgtcttctgc

SEQ ID NO: 961485 - DNA, 20 bp, Homo sapiens
gcccatgtcttctgctgttc

SEQ ID NO: 961486 - DNA, 19 bp, Homo sapiens
gcccatgtgtcccctcact

SEQ ID NO: 961487 - DNA, 22 bp, Homo sapiens
gcccatgtgtcccctcactctg

SEQ ID NO: 961488 - DNA, 23 bp, Homo sapiens
gcccatgtgtcccctcactctgt

SEQ ID NO: 961489 - DNA, 20 bp, Homo sapiens
gcccatgtgtgagtgtgtgc

SEQ ID NO: 961490 - DNA, 22 bp, Homo sapiens
gcccatgttaagtcctccctga

SEQ ID NO: 961491 - DNA, 23 bp, Homo sapiens
gcccatgttaagtcctccctgac

SEQ ID NO: 961492 - DNA, 13 bp, Homo sapiens
gcccattcccacc

SEQ ID NO: 961493 - DNA, 17 bp, Homo sapiens
gcccattcgtctgtccc

SEQ ID NO: 961494 - DNA, 22 bp, Homo sapiens
gcccattcgtctgtcccagagc

SEQ ID NO: 961495 - DNA, 15 bp, Homo sapiens
gcccattctctctcc

SEQ ID NO: 961496 - DNA, 21 bp, Homo sapiens
gcccattctctctcctgtcca

SEQ ID NO: 961497 - DNA, 17 bp, Homo sapiens
gcccattcttctgggtg

SEQ ID NO: 961498 - DNA, 14 bp, Homo sapiens
gcccattgctgcca

SEQ ID NO: 961499 - DNA, 16 bp, Homo sapiens
gcccattggagcacct

SEQ ID NO: 961500 - DNA, 18 bp, Homo sapiens
gcccattgtcctcctttt

SEQ ID NO: 961501 - DNA, 16 bp, Homo sapiens
gccccaaaaccacagc

SEQ ID NO: 961502 - DNA, 23 bp, Homo sapiens
gccccaaaaccacagccctgtca

SEQ ID NO: 961503 - DNA, 18 bp, Homo sapiens
gccccaaacaaatatgca

SEQ ID NO: 961504 - DNA, 22 bp, Homo sapiens
tatacattttgttatagaatac

SEQ ID NO: 961505 - DNA, 17 bp, Homo sapiens
tataccaaagcacattt

SEQ ID NO: 961506 - DNA, 16 bp, Homo sapiens
tataccaaattaaaaa

SEQ ID NO: 961507 - DNA, 22 bp, Homo sapiens
tataccaatgtgttttctgtag

SEQ ID NO: 961508 - DNA, 16 bp, Homo sapiens
tataccacctgtacat

SEQ ID NO: 961509 - DNA, 19 bp, Homo sapiens
tataccacctgtacataca

SEQ ID NO: 961510 - DNA, 19 bp, Homo sapiens
tataccagagacctgaggc

SEQ ID NO: 961511 - DNA, 17 bp, Homo sapiens
tataccatatgtctgct

SEQ ID NO: 961512 - DNA, 21 bp, Homo sapiens
tataccatgtgtgctaatata

SEQ ID NO: 961513 - DNA, 14 bp, Homo sapiens
tatacccaaaggaa

SEQ ID NO: 961514 - DNA, 15 bp, Homo sapiens
tatacccagtgagga

SEQ ID NO: 961515 - DNA, 23 bp, Homo sapiens
tatacccatgaacttaaaatgaa

SEQ ID NO: 961516 - DNA, 17 bp, Homo sapiens
tataccccctgcaaagc

SEQ ID NO: 961517 - DNA, 19 bp, Homo sapiens
tatacccgtacaacgtgtc

SEQ ID NO: 961518 - DNA, 12 bp, Homo sapiens
tatacctgattt

SEQ ID NO: 961519 - DNA, 19 bp, Homo sapiens
tatacctgccttttaagtt

SEQ ID NO: 961520 - DNA, 14 bp, Homo sapiens
tatacctggctttt

SEQ ID NO: 961521 - DNA, 14 bp, Homo sapiens
tatacctggtttac

SEQ ID NO: 961522 - DNA, 15 bp, Homo sapiens
tatacctggtttact

SEQ ID NO: 961523 - DNA, 22 bp, Homo sapiens
tataccttatttatttttgtgt

SEQ ID NO: 961524 - DNA, 20 bp, Homo sapiens
tatacgcagcgtgctttaaa

SEQ ID NO: 961525 - DNA, 17 bp, Homo sapiens
tatacggaaaaaattgt

SEQ ID NO: 961526 - DNA, 15 bp, Homo sapiens
tatacgtataaatat

SEQ ID NO: 961527 - DNA, 19 bp, Homo sapiens
tatactaagatgttcactg

SEQ ID NO: 961528 - DNA, 15 bp, Homo sapiens
tatactcattagaat

SEQ ID NO: 961529 - DNA, 22 bp, Homo sapiens
tatactcattagaattaccatt

SEQ ID NO: 961530 - DNA, 16 bp, Homo sapiens
tatactccatacataa

SEQ ID NO: 961531 - DNA, 19 bp, Homo sapiens
tatactctgtagtctcagt

SEQ ID NO: 961532 - DNA, 16 bp, Homo sapiens
tatactctttctgtat

SEQ ID NO: 961533 - DNA, 17 bp, Homo sapiens
tatactctttctgtata

SEQ ID NO: 961534 - DNA, 19 bp, Homo sapiens
tatactgaaagatctctgt

SEQ ID NO: 961535 - DNA, 22 bp, Homo sapiens
tatactgaagtcttttctgtca

SEQ ID NO: 961536 - DNA, 23 bp, Homo sapiens
tatactgatcttcattaccaata

SEQ ID NO: 961537 - DNA, 13 bp, Homo sapiens
tatactgcagctt

SEQ ID NO: 961538 - DNA, 12 bp, Homo sapiens
tatactgcatac

SEQ ID NO: 961539 - DNA, 16 bp, Homo sapiens
tatactggagaagtct

SEQ ID NO: 961540 - DNA, 16 bp, Homo sapiens
tatactgggttcttgt

SEQ ID NO: 961541 - DNA, 14 bp, Homo sapiens
tatactgtaaaagt

SEQ ID NO: 961542 - DNA, 14 bp, Homo sapiens
tatactgtaattta

SEQ ID NO: 961543 - DNA, 13 bp, Homo sapiens
tatactgtacaat

SEQ ID NO: 961544 - DNA, 12 bp, Homo sapiens
tatactgtacat

SEQ ID NO: 961545 - DNA, 13 bp, Homo sapiens
tatactgtacatg

SEQ ID NO: 961546 - DNA, 13 bp, Homo sapiens
tatactgtatatg

SEQ ID NO: 961547 - DNA, 16 bp, Homo sapiens
tatactgtatttctaa

SEQ ID NO: 961548 - DNA, 14 bp, Homo sapiens
tatacttaaaatga

SEQ ID NO: 961549 - DNA, 16 bp, Homo sapiens
tatacttaaaatgaca

SEQ ID NO: 961550 - DNA, 18 bp, Homo sapiens
tatacttacactgtattg

SEQ ID NO: 961551 - DNA, 18 bp, Homo sapiens
tatacttgtattccctta

SEQ ID NO: 961552 - DNA, 12 bp, Homo sapiens
tatactttagta

SEQ ID NO: 961553 - DNA, 20 bp, Homo sapiens
tatacttttcccctgttaaa

SEQ ID NO: 961554 - DNA, 19 bp, Homo sapiens
tatacttttttcttattta

SEQ ID NO: 961555 - DNA, 23 bp, Homo sapiens
tatagaaaaataaaaatctcttt

SEQ ID NO: 961556 - DNA, 13 bp, Homo sapiens
tatagaaaatctt

SEQ ID NO: 961557 - DNA, 13 bp, Homo sapiens
tatagaaagctgt

SEQ ID NO: 961558 - DNA, 14 bp, Homo sapiens
tatagaaagctgtt

SEQ ID NO: 961559 - DNA, 22 bp, Homo sapiens
tatagaaatagaacactgcctc

SEQ ID NO: 961560 - DNA, 22 bp, Homo sapiens
tatagaacttcatggatcagat

SEQ ID NO: 961561 - DNA, 22 bp, Homo sapiens
tatagaatacttttttctagtt

SEQ ID NO: 961562 - DNA, 23 bp, Homo sapiens
tatagaataggcactttaaaaca

SEQ ID NO: 961563 - DNA, 15 bp, Homo sapiens
tatagaatatttatt

SEQ ID NO: 961564 - DNA, 16 bp, Homo sapiens
tatagaattgcacata

SEQ ID NO: 961565 - DNA, 16 bp, Homo sapiens
tatagacaaataataa

SEQ ID NO: 961566 - DNA, 22 bp, Homo sapiens
tatagacaacgatgaatttctt

SEQ ID NO: 961567 - DNA, 22 bp, Homo sapiens
tatagaccaaagcaaagaaaat

SEQ ID NO: 961568 - DNA, 19 bp, Homo sapiens
tatagagataaatagaaat

SEQ ID NO: 961569 - DNA, 22 bp, Homo sapiens
tatagagatgtttttaaaagtt

SEQ ID NO: 961570 - DNA, 20 bp, Homo sapiens
tatagatataatgaacaaaa

SEQ ID NO: 961571 - DNA, 23 bp, Homo sapiens
tatagatataatgaacaaaatta

SEQ ID NO: 961572 - DNA, 15 bp, Homo sapiens
tatagatcctgagct

SEQ ID NO: 961573 - DNA, 14 bp, Homo sapiens
tatagatggccaaa

SEQ ID NO: 961574 - DNA, 19 bp, Homo sapiens
tatagatgggcaactggct

SEQ ID NO: 961575 - DNA, 15 bp, Homo sapiens
tatagatgtcttttc

SEQ ID NO: 961576 - DNA, 17 bp, Homo sapiens
tatagattgtccttttg

SEQ ID NO: 961577 - DNA, 16 bp, Homo sapiens
tatagattgtcttaat

SEQ ID NO: 961578 - DNA, 13 bp, Homo sapiens
tatagatttagtt

SEQ ID NO: 961579 - DNA, 16 bp, Homo sapiens
tatagcaacaacaatt

SEQ ID NO: 961580 - DNA, 13 bp, Homo sapiens
tatagcaagatat

SEQ ID NO: 961581 - DNA, 23 bp, Homo sapiens
tatagcaatccatgttagttttt

SEQ ID NO: 961582 - DNA, 19 bp, Homo sapiens
tatagccaaaaatagctaa

SEQ ID NO: 961583 - DNA, 18 bp, Homo sapiens
tatagccaactgctaatg

SEQ ID NO: 961584 - DNA, 13 bp, Homo sapiens
tatagcccaggtc

SEQ ID NO: 961585 - DNA, 16 bp, Homo sapiens
tatagctacaggaagc

SEQ ID NO: 961586 - DNA, 18 bp, Homo sapiens
tatagctgtacaaatata

SEQ ID NO: 961587 - DNA, 22 bp, Homo sapiens
tatagctgtacaaatataagaa

SEQ ID NO: 961588 - DNA, 23 bp, Homo sapiens
tataggaacttaaataatgtgaa

SEQ ID NO: 961589 - DNA, 19 bp, Homo sapiens
tataggaatagaggaagaa

SEQ ID NO: 961590 - DNA, 18 bp, Homo sapiens
tataggagccttaatttt

SEQ ID NO: 961591 - DNA, 21 bp, Homo sapiens
tataggatagacactggacat

SEQ ID NO: 961592 - DNA, 14 bp, Homo sapiens
tataggcagcttct

SEQ ID NO: 961593 - DNA, 19 bp, Homo sapiens
tataggcatacctcctatg

SEQ ID NO: 961594 - DNA, 13 bp, Homo sapiens
tataggctatttt

SEQ ID NO: 961595 - DNA, 14 bp, Homo sapiens
tataggtaacgtga

SEQ ID NO: 961596 - DNA, 22 bp, Homo sapiens
tataggtaacgtgattgattca

SEQ ID NO: 961597 - DNA, 23 bp, Homo sapiens
tataggtagatccagatccagac

SEQ ID NO: 961598 - DNA, 15 bp, Homo sapiens
tataggttgtgcaaa

SEQ ID NO: 961599 - DNA, 20 bp, Homo sapiens
tataggtttttctcatgtat

SEQ ID NO: 961600 - DNA, 22 bp, Homo sapiens
tatagtagatttttaacaaaaa

SEQ ID NO: 961601 - DNA, 23 bp, Homo sapiens
tatagtagatttttaacaaaaaa

SEQ ID NO: 961602 - DNA, 20 bp, Homo sapiens
tatagtaggggttgaagaaa

SEQ ID NO: 961603 - DNA, 21 bp, Homo sapiens
tatagtaggggttgaagaaaa

SEQ ID NO: 961604 - DNA, 15 bp, Homo sapiens
tatagtatctgtata

SEQ ID NO: 961605 - DNA, 19 bp, Homo sapiens
tatagtatttgattcaaaa

SEQ ID NO: 961606 - DNA, 18 bp, Homo sapiens
tatagtcctagctgacgc

SEQ ID NO: 961607 - DNA, 16 bp, Homo sapiens
tatagtctacagttgt

SEQ ID NO: 961608 - DNA, 14 bp, Homo sapiens
tatagtgaaaaatg

SEQ ID NO: 961609 - DNA, 19 bp, Homo sapiens
tatagtgcctaaaattgta

SEQ ID NO: 961610 - DNA, 22 bp, Homo sapiens
tatagtgcctaaaattgtatga

SEQ ID NO: 961611 - DNA, 22 bp, Homo sapiens
tatagtggatgatatacacagt

SEQ ID NO: 961612 - DNA, 14 bp, Homo sapiens
tatagtgtgttgtg

SEQ ID NO: 961613 - DNA, 17 bp, Homo sapiens
tatagtgttcacaaact

SEQ ID NO: 961614 - DNA, 20 bp, Homo sapiens
tatagtgttcacaaactgtg

SEQ ID NO: 961615 - DNA, 21 bp, Homo sapiens
tatagtgttcacaaactgtga

SEQ ID NO: 961616 - DNA, 14 bp, Homo sapiens
tatagtgtttaact

SEQ ID NO: 961617 - DNA, 15 bp, Homo sapiens
tatagtgtttaactg

SEQ ID NO: 961618 - DNA, 16 bp, Homo sapiens
tatagtgtttaactgg

SEQ ID NO: 961619 - DNA, 13 bp, Homo sapiens
tatagttaacaca

SEQ ID NO: 961620 - DNA, 15 bp, Homo sapiens
tatagttaacacact

SEQ ID NO: 961621 - DNA, 16 bp, Homo sapiens
tatagttaacacacta

SEQ ID NO: 961622 - DNA, 20 bp, Homo sapiens
tatagttaatattttgttct

SEQ ID NO: 961623 - DNA, 13 bp, Homo sapiens
tatagttactgtg

SEQ ID NO: 961624 - DNA, 16 bp, Homo sapiens
tatagttactgtgtaa

SEQ ID NO: 961625 - DNA, 11 bp, Homo sapiens
tatagttatat

SEQ ID NO: 961626 - DNA, 13 bp, Homo sapiens
tatagttctgtgt

SEQ ID NO: 961627 - DNA, 19 bp, Homo sapiens
tatagttctgtgtagagaa

SEQ ID NO: 961628 - DNA, 22 bp, Homo sapiens
tatagttgcttgcctgatataa

SEQ ID NO: 961629 - DNA, 20 bp, Homo sapiens
gaatggtaaccgagccagca

SEQ ID NO: 961630 - DNA, 15 bp, Homo sapiens
gaatggtccagggtt

SEQ ID NO: 961631 - DNA, 15 bp, Homo sapiens
gaatggtctttgctc

SEQ ID NO: 961632 - DNA, 19 bp, Homo sapiens
gaatggtctttgctccaga

SEQ ID NO: 961633 - DNA, 20 bp, Homo sapiens
gaatggtgttttgtcagact

SEQ ID NO: 961634 - DNA, 20 bp, Homo sapiens
gaatggttaataaaactgca

SEQ ID NO: 961635 - DNA, 20 bp, Homo sapiens
gaatgtaaagcttgtctgat

SEQ ID NO: 961636 - DNA, 18 bp, Homo sapiens
gaatgtaactccagatag

SEQ ID NO: 961637 - DNA, 13 bp, Homo sapiens
gaatgtaatcaat

SEQ ID NO: 961638 - DNA, 16 bp, Homo sapiens
gaatgtaatcaatgtt

SEQ ID NO: 961639 - DNA, 19 bp, Homo sapiens
gaatgtaatcaatgtttct

SEQ ID NO: 961640 - DNA, 15 bp, Homo sapiens
gaatgtaattggaat

SEQ ID NO: 961641 - DNA, 15 bp, Homo sapiens
gaatgtagctggttt

SEQ ID NO: 961642 - DNA, 19 bp, Homo sapiens
gaatgtagcttccacctca

SEQ ID NO: 961643 - DNA, 21 bp, Homo sapiens
gaatgtatcagccagccttcc

SEQ ID NO: 961644 - DNA, 17 bp, Homo sapiens
gaatgtattattctgca

SEQ ID NO: 961645 - DNA, 21 bp, Homo sapiens
gaatgtattattctgcagcat

SEQ ID NO: 961646 - DNA, 14 bp, Homo sapiens
gaatgtatttgatt

SEQ ID NO: 961647 - DNA, 22 bp, Homo sapiens
gaatgtattttcatagatgtgt

SEQ ID NO: 961648 - DNA, 15 bp, Homo sapiens
gaatgtcacaaattg

SEQ ID NO: 961649 - DNA, 20 bp, Homo sapiens
gaatgtcacatttgaattct

SEQ ID NO: 961650 - DNA, 15 bp, Homo sapiens
gaatgtcacttctgg

SEQ ID NO: 961651 - DNA, 15 bp, Homo sapiens
gaatgtcagggccag

SEQ ID NO: 961652 - DNA, 23 bp, Homo sapiens
gaatgtcagggccaggtgcagac

SEQ ID NO: 961653 - DNA, 15 bp, Homo sapiens
gaatgtccccttagg

SEQ ID NO: 961654 - DNA, 18 bp, Homo sapiens
gaatgtctgaagtacaaa

SEQ ID NO: 961655 - DNA, 21 bp, Homo sapiens
gaatgtctgaagtacaaacat

SEQ ID NO: 961656 - DNA, 18 bp, Homo sapiens
gaatgtctgccttactgg

SEQ ID NO: 961657 - DNA, 16 bp, Homo sapiens
gaatgtcttttgaata

SEQ ID NO: 961658 - DNA, 16 bp, Homo sapiens
gaatgtgaaatttaaa

SEQ ID NO: 961659 - DNA, 13 bp, Homo sapiens
gaatgtgcccctg

SEQ ID NO: 961660 - DNA, 18 bp, Homo sapiens
gaatgtgctggtgaacac

SEQ ID NO: 961661 - DNA, 22 bp, Homo sapiens
gaatgtggcccctgaacaagaa

SEQ ID NO: 961662 - DNA, 14 bp, Homo sapiens
gaatgtggtctcag

SEQ ID NO: 961663 - DNA, 22 bp, Homo sapiens
gaatgtggttagttaactgaat

SEQ ID NO: 961664 - DNA, 18 bp, Homo sapiens
gaatgtgtacaaagtgta

SEQ ID NO: 961665 - DNA, 13 bp, Homo sapiens
gaatgtgtcttta

SEQ ID NO: 961666 - DNA, 15 bp, Homo sapiens
gaatgtgtctttaga

SEQ ID NO: 961667 - DNA, 16 bp, Homo sapiens
gaatgtgttcttttct

SEQ ID NO: 961668 - DNA, 19 bp, Homo sapiens
gaatgttaagaattgacca

SEQ ID NO: 961669 - DNA, 23 bp, Homo sapiens
gaatgttaattttttggtacaaa

SEQ ID NO: 961670 - DNA, 20 bp, Homo sapiens
gaatgttacattgtttgtct

SEQ ID NO: 961671 - DNA, 16 bp, Homo sapiens
gaatgttactgcctta

SEQ ID NO: 961672 - DNA, 22 bp, Homo sapiens
gaatgttatgggatgtaaacaa

SEQ ID NO: 961673 - DNA, 17 bp, Homo sapiens
gaatgttccctgcaccc

SEQ ID NO: 961674 - DNA, 17 bp, Homo sapiens
gaatgttctgacattaa

SEQ ID NO: 961675 - DNA, 18 bp, Homo sapiens
gaatgttggcaaatcact

SEQ ID NO: 961676 - DNA, 15 bp, Homo sapiens
gaatgtttcatttgc

SEQ ID NO: 961677 - DNA, 20 bp, Homo sapiens
gaatgtttgtttcagtgcca

SEQ ID NO: 961678 - DNA, 17 bp, Homo sapiens
gaatgttttatttatca

SEQ ID NO: 961679 - DNA, 14 bp, Homo sapiens
gaattaaaaaagca

SEQ ID NO: 961680 - DNA, 13 bp, Homo sapiens
gaattaaactttt

SEQ ID NO: 961681 - DNA, 20 bp, Homo sapiens
gaattaaacttttaattcat

SEQ ID NO: 961682 - DNA, 22 bp, Homo sapiens
gaattaaagtggaccaataggg

SEQ ID NO: 961683 - DNA, 15 bp, Homo sapiens
gaattaaataatgta

SEQ ID NO: 961684 - DNA, 14 bp, Homo sapiens
gaattaaatagtgt

SEQ ID NO: 961685 - DNA, 13 bp, Homo sapiens
gaattaaatttaa

SEQ ID NO: 961686 - DNA, 21 bp, Homo sapiens
gaattaaccatttaataaaga

SEQ ID NO: 961687 - DNA, 13 bp, Homo sapiens
gaattaagaatat

SEQ ID NO: 961688 - DNA, 15 bp, Homo sapiens
gaattaatagctttt

SEQ ID NO: 961689 - DNA, 18 bp, Homo sapiens
gaattaattaatttggag

SEQ ID NO: 961690 - DNA, 11 bp, Homo sapiens
gaattacagta

SEQ ID NO: 961691 - DNA, 19 bp, Homo sapiens
gaattaccatagagtaatg

SEQ ID NO: 961692 - DNA, 19 bp, Homo sapiens
gaattaccattaattacat

SEQ ID NO: 961693 - DNA, 20 bp, Homo sapiens
gaattaccattaattacata

SEQ ID NO: 961694 - DNA, 14 bp, Homo sapiens
gaattaccatttgt

SEQ ID NO: 961695 - DNA, 20 bp, Homo sapiens
gaattaccctttcattcagc

SEQ ID NO: 961696 - DNA, 10 bp, Homo sapiens
gaattagaaa

SEQ ID NO: 961697 - DNA, 22 bp, Homo sapiens
gaattagagggccttgcttctc

SEQ ID NO: 961698 - DNA, 23 bp, Homo sapiens
gaattagagggccttgcttctct

SEQ ID NO: 961699 - DNA, 18 bp, Homo sapiens
gaattaggctgtaactac

SEQ ID NO: 961700 - DNA, 18 bp, Homo sapiens
gaattagtatgtctgttt

SEQ ID NO: 961701 - DNA, 13 bp, Homo sapiens
gaattataacagt

SEQ ID NO: 961702 - DNA, 12 bp, Homo sapiens
gaattatactcc

SEQ ID NO: 961703 - DNA, 20 bp, Homo sapiens
gaattatcagcaaagaaaaa

SEQ ID NO: 961704 - DNA, 22 bp, Homo sapiens
gaattatctatacatatcttta

SEQ ID NO: 961705 - DNA, 13 bp, Homo sapiens
gaattatgcttcc

SEQ ID NO: 961706 - DNA, 16 bp, Homo sapiens
gaattatgtaatatat

SEQ ID NO: 961707 - DNA, 14 bp, Homo sapiens
gaattatgttttga

SEQ ID NO: 961708 - DNA, 19 bp, Homo sapiens
gaattattacagtgtttat

SEQ ID NO: 961709 - DNA, 16 bp, Homo sapiens
gaattattcaatttat

SEQ ID NO: 961710 - DNA, 15 bp, Homo sapiens
gaattattcagtgaa

SEQ ID NO: 961711 - DNA, 17 bp, Homo sapiens
gaattattgacactgaa

SEQ ID NO: 961712 - DNA, 21 bp, Homo sapiens
gaattcaaactggggcctcca

SEQ ID NO: 961713 - DNA, 22 bp, Homo sapiens
gaattcaaactggggcctccag

SEQ ID NO: 961714 - DNA, 17 bp, Homo sapiens
gaattcaatttggcaaa

SEQ ID NO: 961715 - DNA, 19 bp, Homo sapiens
gaattcacacaactacttt

SEQ ID NO: 961716 - DNA, 17 bp, Homo sapiens
gaattcaccagtgttcc

SEQ ID NO: 961717 - DNA, 19 bp, Homo sapiens
gaattcagcaccctgggtg

SEQ ID NO: 961718 - DNA, 13 bp, Homo sapiens
gaattcagcagtt

SEQ ID NO: 961719 - DNA, 15 bp, Homo sapiens
gaattcatcccctcc

SEQ ID NO: 961720 - DNA, 17 bp, Homo sapiens
gaattcatcccctcccc

SEQ ID NO: 961721 - DNA, 18 bp, Homo sapiens
gaattccaacttgaagga

SEQ ID NO: 961722 - DNA, 12 bp, Homo sapiens
gaattccaagga

SEQ ID NO: 961723 - DNA, 14 bp, Homo sapiens
gaattccatcttgt

SEQ ID NO: 961724 - DNA, 15 bp, Homo sapiens
gaattcccttttaat

SEQ ID NO: 961725 - DNA, 20 bp, Homo sapiens
gaattcctaaaattatggaa

SEQ ID NO: 961726 - DNA, 16 bp, Homo sapiens
gaattcctcttttgct

SEQ ID NO: 961727 - DNA, 23 bp, Homo sapiens
gaattcctgctatgacagctggc

SEQ ID NO: 961728 - DNA, 15 bp, Homo sapiens
gaattccttcgaaag

SEQ ID NO: 961729 - DNA, 22 bp, Homo sapiens
gaattccttcgaaaggccttca

SEQ ID NO: 961730 - DNA, 20 bp, Homo sapiens
gaattcctttacaactaaat

SEQ ID NO: 961731 - DNA, 19 bp, Homo sapiens
gaattcggtgtgctgccaa

SEQ ID NO: 961732 - DNA, 14 bp, Homo sapiens
gaattctagtgctg

SEQ ID NO: 961733 - DNA, 16 bp, Homo sapiens
gaattctagtgctgct

SEQ ID NO: 961734 - DNA, 17 bp, Homo sapiens
gaattctagtgctgctg

SEQ ID NO: 961735 - DNA, 20 bp, Homo sapiens
gaattctcaggtaggaagca

SEQ ID NO: 961736 - DNA, 19 bp, Homo sapiens
gaattctgccttggttctg

SEQ ID NO: 961737 - DNA, 19 bp, Homo sapiens
gaattctgctacctcactg

SEQ ID NO: 961738 - DNA, 21 bp, Homo sapiens
gaattcttcctctccttccca

SEQ ID NO: 961739 - DNA, 12 bp, Homo sapiens
gaattcttctgg

SEQ ID NO: 961740 - DNA, 20 bp, Homo sapiens
gaattcttctgttctctggt

SEQ ID NO: 961741 - DNA, 17 bp, Homo sapiens
gaattcttgatctctaa

SEQ ID NO: 961742 - DNA, 13 bp, Homo sapiens
gaattctttgcat

SEQ ID NO: 961743 - DNA, 15 bp, Homo sapiens
gaattgaacccagga

SEQ ID NO: 961744 - DNA, 22 bp, Homo sapiens
gaattgaatcgctgcgatactg

SEQ ID NO: 961745 - DNA, 16 bp, Homo sapiens
gaattgaatctacaaa

SEQ ID NO: 961746 - DNA, 20 bp, Homo sapiens
gaattgactgcagttgaaca

SEQ ID NO: 961747 - DNA, 15 bp, Homo sapiens
gaattgaggtctgct

SEQ ID NO: 961748 - DNA, 16 bp, Homo sapiens
gaattgatcagaatcc

SEQ ID NO: 961749 - DNA, 12 bp, Homo sapiens
gaattgatttgc

SEQ ID NO: 961750 - DNA, 12 bp, Homo sapiens
gaattgcattga

SEQ ID NO: 961751 - DNA, 15 bp, Homo sapiens
cgccgcctggtactc

SEQ ID NO: 961752 - DNA, 12 bp, Homo sapiens
cgccggcctctg

SEQ ID NO: 961753 - DNA, 20 bp, Homo sapiens
cgccggcctctgctgccccc

SEQ ID NO: 961754 - DNA, 21 bp, Homo sapiens
cgccgggagaagccaccttcc

SEQ ID NO: 961755 - DNA, 19 bp, Homo sapiens
cgccgtctgcaggggcctg

SEQ ID NO: 961756 - DNA, 12 bp, Homo sapiens
cgccgtgaccta

SEQ ID NO: 961757 - DNA, 14 bp, Homo sapiens
cgccgtgctgggca

SEQ ID NO: 961758 - DNA, 16 bp, Homo sapiens
cgccgtgtctcagcct

SEQ ID NO: 961759 - DNA, 16 bp, Homo sapiens
cgcctactcttcaggg

SEQ ID NO: 961760 - DNA, 13 bp, Homo sapiens
cgcctagctgctg

SEQ ID NO: 961761 - DNA, 13 bp, Homo sapiens
cgcctaggcctgt

SEQ ID NO: 961762 - DNA, 15 bp, Homo sapiens
cgcctaggcctgtga

SEQ ID NO: 961763 - DNA, 20 bp, Homo sapiens
cgcctagtggggtctccctc

SEQ ID NO: 961764 - DNA, 21 bp, Homo sapiens
cgcctagtggggtctccctct

SEQ ID NO: 961765 - DNA, 22 bp, Homo sapiens
cgcctcaatgtggttgcaaggc

SEQ ID NO: 961766 - DNA, 11 bp, Homo sapiens
cgcctcaccag

SEQ ID NO: 961767 - DNA, 16 bp, Homo sapiens
cgcctccactctagtt

SEQ ID NO: 961768 - DNA, 12 bp, Homo sapiens
cgcctccatcca

SEQ ID NO: 961769 - DNA, 14 bp, Homo sapiens
cgcctcccacggca

SEQ ID NO: 961770 - DNA, 15 bp, Homo sapiens
cgcctcccacggcac

SEQ ID NO: 961771 - DNA, 16 bp, Homo sapiens
cgcctcccccctcact

SEQ ID NO: 961772 - DNA, 10 bp, Homo sapiens
cgcctccccg

SEQ ID NO: 961773 - DNA, 13 bp, Homo sapiens
cgcctccctccac

SEQ ID NO: 961774 - DNA, 13 bp, Homo sapiens
cgcctcctcccac

SEQ ID NO: 961775 - DNA, 17 bp, Homo sapiens
cgcctcctcccactggg

SEQ ID NO: 961776 - DNA, 21 bp, Homo sapiens
cgcctctcccgtcagggccca

SEQ ID NO: 961777 - DNA, 15 bp, Homo sapiens
cgcctctcctcaatg

SEQ ID NO: 961778 - DNA, 13 bp, Homo sapiens
cgcctctgcattc

SEQ ID NO: 961779 - DNA, 20 bp, Homo sapiens
cgcctctgcccgcagagccc

SEQ ID NO: 961780 - DNA, 16 bp, Homo sapiens
cgcctctggccgccac

SEQ ID NO: 961781 - DNA, 19 bp, Homo sapiens
cgcctctggccgccacccc

SEQ ID NO: 961782 - DNA, 10 bp, Homo sapiens
cgcctcttcc

SEQ ID NO: 961783 - DNA, 20 bp, Homo sapiens
cgcctcttttccctctctag

SEQ ID NO: 961784 - DNA, 20 bp, Homo sapiens
cgcctgacaaccactggtct

SEQ ID NO: 961785 - DNA, 20 bp, Homo sapiens
cgcctgacaccgtgggtcat

SEQ ID NO: 961786 - DNA, 16 bp, Homo sapiens
cgcctgagacagcacc

SEQ ID NO: 961787 - DNA, 21 bp, Homo sapiens
cgcctgagtcagtgctctcag

SEQ ID NO: 961788 - DNA, 19 bp, Homo sapiens
cgcctgcaggctggagact

SEQ ID NO: 961789 - DNA, 11 bp, Homo sapiens
cgcctgccacc

SEQ ID NO: 961790 - DNA, 14 bp, Homo sapiens
cgcctgcccagact

SEQ ID NO: 961791 - DNA, 20 bp, Homo sapiens
cgcctgccctcatggcccct

SEQ ID NO: 961792 - DNA, 12 bp, Homo sapiens
cgcctgccctgc

SEQ ID NO: 961793 - DNA, 13 bp, Homo sapiens
cgcctgccctgcc

SEQ ID NO: 961794 - DNA, 14 bp, Homo sapiens
cgcctgccctgcct

SEQ ID NO: 961795 - DNA, 15 bp, Homo sapiens
cgcctgccctgcctg

SEQ ID NO: 961796 - DNA, 16 bp, Homo sapiens
cgcctgccctgccttg

SEQ ID NO: 961797 - DNA, 18 bp, Homo sapiens
cgcctgccctgccttgcc

SEQ ID NO: 961798 - DNA, 14 bp, Homo sapiens
cgcctgctgcctgc

SEQ ID NO: 961799 - DNA, 19 bp, Homo sapiens
cgcctggagggatgccccc

SEQ ID NO: 961800 - DNA, 11 bp, Homo sapiens
cgcctggcaga

SEQ ID NO: 961801 - DNA, 13 bp, Homo sapiens
cgcctggccagga

SEQ ID NO: 961802 - DNA, 18 bp, Homo sapiens
cgcctggccaggagcagg

SEQ ID NO: 961803 - DNA, 13 bp, Homo sapiens
cgcctggccttgt

SEQ ID NO: 961804 - DNA, 23 bp, Homo sapiens
cgcctggccttgtgtggcttgga

SEQ ID NO: 961805 - DNA, 23 bp, Homo sapiens
cgcctggctgctgcttcttgctt

SEQ ID NO: 961806 - DNA, 16 bp, Homo sapiens
cgcctgtaatcccagc

SEQ ID NO: 961807 - DNA, 20 bp, Homo sapiens
cgcctgtaatcccagcactt

SEQ ID NO: 961808 - DNA, 22 bp, Homo sapiens
cgcctgtcacaataaagtttat

SEQ ID NO: 961809 - DNA, 14 bp, Homo sapiens
cgcctgtgtccatc

SEQ ID NO: 961810 - DNA, 15 bp, Homo sapiens
cgccttccctcctgc

SEQ ID NO: 961811 - DNA, 19 bp, Homo sapiens
cgccttccctcctgctttg

SEQ ID NO: 961812 - DNA, 15 bp, Homo sapiens
cgccttcctcctcca

SEQ ID NO: 961813 - DNA, 22 bp, Homo sapiens
cgccttcctcctccacagtgct

SEQ ID NO: 961814 - DNA, 16 bp, Homo sapiens
cgccttcgtgtgctgc

SEQ ID NO: 961815 - DNA, 20 bp, Homo sapiens
cgccttcgtgtgctgctgct

SEQ ID NO: 961816 - DNA, 20 bp, Homo sapiens
cgccttctcccacatgaggc

SEQ ID NO: 961817 - DNA, 19 bp, Homo sapiens
cgccttctcccctctccca

SEQ ID NO: 961818 - DNA, 14 bp, Homo sapiens
cgcctttcccaact

SEQ ID NO: 961819 - DNA, 11 bp, Homo sapiens
cgcctttgtat

SEQ ID NO: 961820 - DNA, 15 bp, Homo sapiens
cgccttttcagccct

SEQ ID NO: 961821 - DNA, 16 bp, Homo sapiens
cgccttttcagccctt

SEQ ID NO: 961822 - DNA, 14 bp, Homo sapiens
cgcgaactgggttc

SEQ ID NO: 961823 - DNA, 16 bp, Homo sapiens
cgcgacttccacaaac

SEQ ID NO: 961824 - DNA, 14 bp, Homo sapiens
cggctcagcctccc

SEQ ID NO: 961825 - DNA, 17 bp, Homo sapiens
cggctcagcctcccgag

SEQ ID NO: 961826 - DNA, 23 bp, Homo sapiens
cggctccagccccagacaacagc

SEQ ID NO: 961827 - DNA, 20 bp, Homo sapiens
cggctccccatgtgtcctgg

SEQ ID NO: 961828 - DNA, 19 bp, Homo sapiens
cggctcccctctgcttctc

SEQ ID NO: 961829 - DNA, 15 bp, Homo sapiens
cggctccctggagcc

SEQ ID NO: 961830 - DNA, 18 bp, Homo sapiens
cggctccgagggcggcca

SEQ ID NO: 961831 - DNA, 22 bp, Homo sapiens
cggctccgagggcggccaggga

SEQ ID NO: 961832 - DNA, 14 bp, Homo sapiens
cggctcctcagagc

SEQ ID NO: 961833 - DNA, 16 bp, Homo sapiens
cggctcctcagagcgc

SEQ ID NO: 961834 - DNA, 20 bp, Homo sapiens
cggctcctcagagcgccagg

SEQ ID NO: 961835 - DNA, 23 bp, Homo sapiens
cggctcctcagagcgccaggaag

SEQ ID NO: 961836 - DNA, 14 bp, Homo sapiens
cggctcctccccga

SEQ ID NO: 961837 - DNA, 18 bp, Homo sapiens
cggctcctccccgatccc

SEQ ID NO: 961838 - DNA, 11 bp, Homo sapiens
cggctcctcgc

SEQ ID NO: 961839 - DNA, 14 bp, Homo sapiens
cggctcctcgcccc

SEQ ID NO: 961840 - DNA, 19 bp, Homo sapiens
cggctcctcgcccccacca

SEQ ID NO: 961841 - DNA, 12 bp, Homo sapiens
cggctcctgatg

SEQ ID NO: 961842 - DNA, 20 bp, Homo sapiens
cggctcggaggaagccccca

SEQ ID NO: 961843 - DNA, 13 bp, Homo sapiens
cggctctcacctg

SEQ ID NO: 961844 - DNA, 13 bp, Homo sapiens
cggctctgagcag

SEQ ID NO: 961845 - DNA, 20 bp, Homo sapiens
cggctctgagcaggggcagg

SEQ ID NO: 961846 - DNA, 15 bp, Homo sapiens
cggctgaactgagaa

SEQ ID NO: 961847 - DNA, 20 bp, Homo sapiens
cggctgaactgagaaggcag

SEQ ID NO: 961848 - DNA, 23 bp, Homo sapiens
cggctgaccatgctcatctgctg

SEQ ID NO: 961849 - DNA, 19 bp, Homo sapiens
cggctgagagccccagctg

SEQ ID NO: 961850 - DNA, 23 bp, Homo sapiens
cggctgagtcatgatctccctgc

SEQ ID NO: 961851 - DNA, 18 bp, Homo sapiens
cggctgcccccatcacct

SEQ ID NO: 961852 - DNA, 15 bp, Homo sapiens
cggctgcctgacact

SEQ ID NO: 961853 - DNA, 17 bp, Homo sapiens
cggctgcctgcccccca

SEQ ID NO: 961854 - DNA, 20 bp, Homo sapiens
cggctgctcctccagccctt

SEQ ID NO: 961855 - DNA, 21 bp, Homo sapiens
cggctgctcctccagcccttc

SEQ ID NO: 961856 - DNA, 14 bp, Homo sapiens
cggctgctgcttgg

SEQ ID NO: 961857 - DNA, 21 bp, Homo sapiens
cggctgggagcctcgcccctc

SEQ ID NO: 961858 - DNA, 12 bp, Homo sapiens
cggctgggcaca

SEQ ID NO: 961859 - DNA, 20 bp, Homo sapiens
cggctgggcacacgcctccc

SEQ ID NO: 961860 - DNA, 11 bp, Homo sapiens
cggctggggac

SEQ ID NO: 961861 - DNA, 14 bp, Homo sapiens
cggctgggtctgtg

SEQ ID NO: 961862 - DNA, 14 bp, Homo sapiens
cggctggtcactct

SEQ ID NO: 961863 - DNA, 20 bp, Homo sapiens
cggctggtcactctgccctc

SEQ ID NO: 961864 - DNA, 22 bp, Homo sapiens
cggctggttttgtaagatgctg

SEQ ID NO: 961865 - DNA, 18 bp, Homo sapiens
cggctgtgacgcagccgg

SEQ ID NO: 961866 - DNA, 16 bp, Homo sapiens
cggctgtgctcagaga

SEQ ID NO: 961867 - DNA, 13 bp, Homo sapiens
cggctgtggagca

SEQ ID NO: 961868 - DNA, 14 bp, Homo sapiens
cggctgtggagcaa

SEQ ID NO: 961869 - DNA, 17 bp, Homo sapiens
cggctgtttactgcttt

SEQ ID NO: 961870 - DNA, 16 bp, Homo sapiens
cggcttcatgccagct

SEQ ID NO: 961871 - DNA, 14 bp, Homo sapiens
cggcttcctgtcca

SEQ ID NO: 961872 - DNA, 20 bp, Homo sapiens
cggcttcttggaccttggcg

SEQ ID NO: 961873 - DNA, 16 bp, Homo sapiens
cggcttgatcacagct

SEQ ID NO: 961874 - DNA, 15 bp, Homo sapiens
cggcttgtgggctgg

SEQ ID NO: 961875 - DNA, 21 bp, Homo sapiens
cggcttgttcttgcagcattc

SEQ ID NO: 961876 - DNA, 21 bp, Homo sapiens
cggctttcactgctgagtttc

SEQ ID NO: 961877 - DNA, 23 bp, Homo sapiens
cggctttctctgcctctgggcag

SEQ ID NO: 961878 - DNA, 13 bp, Homo sapiens
cgggaaagaagaa

SEQ ID NO: 961879 - DNA, 14 bp, Homo sapiens
cgggaaagaagaaa

SEQ ID NO: 961880 - DNA, 20 bp, Homo sapiens
cgggaaaggatggagtgttt

SEQ ID NO: 961881 - DNA, 17 bp, Homo sapiens
cgggaacatgccccctg

SEQ ID NO: 961882 - DNA, 12 bp, Homo sapiens
cgggaagcggag

SEQ ID NO: 961883 - DNA, 12 bp, Homo sapiens
cgggaaggaggg

SEQ ID NO: 961884 - DNA, 14 bp, Homo sapiens
cgggaagggagggg

SEQ ID NO: 961885 - DNA, 15 bp, Homo sapiens
cgggaagggagggga

SEQ ID NO: 961886 - DNA, 20 bp, Homo sapiens
cgggacaccgtggggaaggg

SEQ ID NO: 961887 - DNA, 14 bp, Homo sapiens
cgggacagagtagc

SEQ ID NO: 961888 - DNA, 23 bp, Homo sapiens
cgggacatggttgggggaatgca

SEQ ID NO: 961889 - DNA, 18 bp, Homo sapiens
cgggaccattgacctcag

SEQ ID NO: 961890 - DNA, 19 bp, Homo sapiens
cgggaccattgacctcagc

SEQ ID NO: 961891 - DNA, 13 bp, Homo sapiens
cgggaccctcagg

SEQ ID NO: 961892 - DNA, 16 bp, Homo sapiens
cgggacctcccaggac

SEQ ID NO: 961893 - DNA, 15 bp, Homo sapiens
cgggactagctgcct

SEQ ID NO: 961894 - DNA, 16 bp, Homo sapiens
cgggagaagccacctt

SEQ ID NO: 961895 - DNA, 16 bp, Homo sapiens
cgggagaaggcatgag

SEQ ID NO: 961896 - DNA, 12 bp, Homo sapiens
cgggagacagca

SEQ ID NO: 961897 - DNA, 22 bp, Homo sapiens
cgggagacagcttctctgcagt

SEQ ID NO: 961898 - DNA, 22 bp, Homo sapiens
cgggagatggacccctcccttg

SEQ ID NO: 961899 - DNA, 18 bp, Homo sapiens
cgggagcacccagagcac

SEQ ID NO: 961900 - DNA, 14 bp, Homo sapiens
cgggagcagtgtct

SEQ ID NO: 961901 - DNA, 17 bp, Homo sapiens
cgggagcctaggaccac

SEQ ID NO: 961902 - DNA, 21 bp, Homo sapiens
cgggagctgggagccaggctc

SEQ ID NO: 961903 - DNA, 20 bp, Homo sapiens
cgggagctggtgacagcctt

SEQ ID NO: 961904 - DNA, 22 bp, Homo sapiens
cgggagctggtgacagccttgg

SEQ ID NO: 961905 - DNA, 21 bp, Homo sapiens
cgggaggaagccggtgtccct

SEQ ID NO: 961906 - DNA, 21 bp, Homo sapiens
cgggaggactccgggaccatt

SEQ ID NO: 961907 - DNA, 13 bp, Homo sapiens
cgggaggaggtgt

SEQ ID NO: 961908 - DNA, 16 bp, Homo sapiens
cgggaggcaccagctc

SEQ ID NO: 961909 - DNA, 18 bp, Homo sapiens
cgggaggcaccagctctg

SEQ ID NO: 961910 - DNA, 19 bp, Homo sapiens
cgggaggcaccagctctgt

SEQ ID NO: 961911 - DNA, 14 bp, Homo sapiens
cgggaggcagagtt

SEQ ID NO: 961912 - DNA, 16 bp, Homo sapiens
cgggaggcagagtttg

SEQ ID NO: 961913 - DNA, 14 bp, Homo sapiens
cgggaggcagtgct

SEQ ID NO: 961914 - DNA, 13 bp, Homo sapiens
cgggaggctgaga

SEQ ID NO: 961915 - DNA, 19 bp, Homo sapiens
cgggaggctgagacaggag

SEQ ID NO: 961916 - DNA, 15 bp, Homo sapiens
cgggaggctggggcc

SEQ ID NO: 961917 - DNA, 16 bp, Homo sapiens
cgggaggtcgaggcag

SEQ ID NO: 961918 - DNA, 20 bp, Homo sapiens
cgggagtcctctagcaggcc

SEQ ID NO: 961919 - DNA, 21 bp, Homo sapiens
gcccctgatctctgacctctg

SEQ ID NO: 961920 - DNA, 15 bp, Homo sapiens
gcccctgcaatgtgg

SEQ ID NO: 961921 - DNA, 20 bp, Homo sapiens
gcccctgcagtttggccctg

SEQ ID NO: 961922 - DNA, 15 bp, Homo sapiens
gcccctgccccgtca

SEQ ID NO: 961923 - DNA, 17 bp, Homo sapiens
gcccctgccctggggag

SEQ ID NO: 961924 - DNA, 20 bp, Homo sapiens
gcccctgcctgacagccttc

SEQ ID NO: 961925 - DNA, 21 bp, Homo sapiens
gcccctgcctgacagccttcc

SEQ ID NO: 961926 - DNA, 22 bp, Homo sapiens
gcccctgcctgacagccttccc

SEQ ID NO: 961927 - DNA, 12 bp, Homo sapiens
gcccctgcctgc

SEQ ID NO: 961928 - DNA, 17 bp, Homo sapiens
gcccctgctgcttggga

SEQ ID NO: 961929 - DNA, 21 bp, Homo sapiens
gcccctggacccctggggtgg

SEQ ID NO: 961930 - DNA, 21 bp, Homo sapiens
gcccctggcagcacagcccag

SEQ ID NO: 961931 - DNA, 22 bp, Homo sapiens
gcccctggcagcacagcccagg

SEQ ID NO: 961932 - DNA, 11 bp, Homo sapiens
gcccctggccc

SEQ ID NO: 961933 - DNA, 22 bp, Homo sapiens
gcccctggcccagcggcccctc

SEQ ID NO: 961934 - DNA, 19 bp, Homo sapiens
gcccctggccccgcctgcc

SEQ ID NO: 961935 - DNA, 20 bp, Homo sapiens
gcccctggccccgcctgcct

SEQ ID NO: 961936 - DNA, 22 bp, Homo sapiens
gcccctggccccgcctgcctgc

SEQ ID NO: 961937 - DNA, 15 bp, Homo sapiens
gcccctggccgcgct

SEQ ID NO: 961938 - DNA, 19 bp, Homo sapiens
gcccctggccgcgctccgg

SEQ ID NO: 961939 - DNA, 20 bp, Homo sapiens
gcccctggccgcgctccggg

SEQ ID NO: 961940 - DNA, 21 bp, Homo sapiens
gcccctggccgcgctccgggc

SEQ ID NO: 961941 - DNA, 16 bp, Homo sapiens
gcccctggctgggacg

SEQ ID NO: 961942 - DNA, 22 bp, Homo sapiens
gcccctgggaacaggccccacg

SEQ ID NO: 961943 - DNA, 11 bp, Homo sapiens
gcccctgggct

SEQ ID NO: 961944 - DNA, 12 bp, Homo sapiens
gcccctgggctt

SEQ ID NO: 961945 - DNA, 19 bp, Homo sapiens
gcccctggggaaatagcct

SEQ ID NO: 961946 - DNA, 21 bp, Homo sapiens
cgggcagggtgtggggccatg

SEQ ID NO: 961947 - DNA, 20 bp, Homo sapiens
cgggcagtcctgtgtgagga

SEQ ID NO: 961948 - DNA, 18 bp, Homo sapiens
cgggcatgcacacggctg

SEQ ID NO: 961949 - DNA, 23 bp, Homo sapiens
cgggcatgggcctctctggggga

SEQ ID NO: 961950 - DNA, 21 bp, Homo sapiens
cgggcatggtggcgcaagcct

SEQ ID NO: 961951 - DNA, 12 bp, Homo sapiens
cgggccacaggg

SEQ ID NO: 961952 - DNA, 13 bp, Homo sapiens
cgggccacagggc

SEQ ID NO: 961953 - DNA, 16 bp, Homo sapiens
cgggccagccaggcgg

SEQ ID NO: 961954 - DNA, 17 bp, Homo sapiens
cgggccagccaggcggg

SEQ ID NO: 961955 - DNA, 13 bp, Homo sapiens
cgggccagggctg

SEQ ID NO: 961956 - DNA, 12 bp, Homo sapiens
cgggccagggtc

SEQ ID NO: 961957 - DNA, 14 bp, Homo sapiens
cgggccagggtggg

SEQ ID NO: 961958 - DNA, 17 bp, Homo sapiens
cgggcccagaccggctt

SEQ ID NO: 961959 - DNA, 19 bp, Homo sapiens
cgggcccagaccggcttct

SEQ ID NO: 961960 - DNA, 22 bp, Homo sapiens
cgggcccatgaagaaagcccct

SEQ ID NO: 961961 - DNA, 23 bp, Homo sapiens
cgggcccatgaagaaagcccctc

SEQ ID NO: 961962 - DNA, 19 bp, Homo sapiens
cgggccccatcctcatccc

SEQ ID NO: 961963 - DNA, 13 bp, Homo sapiens
cgggcccccgccc

SEQ ID NO: 961964 - DNA, 16 bp, Homo sapiens
cgggcccccgccccgc

SEQ ID NO: 961965 - DNA, 23 bp, Homo sapiens
cgggcccctgggcttggcctgct

SEQ ID NO: 961966 - DNA, 18 bp, Homo sapiens
cgggcccgggcccccgcc

SEQ ID NO: 961967 - DNA, 11 bp, Homo sapiens
cgggccctccc

SEQ ID NO: 961968 - DNA, 17 bp, Homo sapiens
cgggccctcccttggaa

SEQ ID NO: 961969 - DNA, 19 bp, Homo sapiens
cgggccgaccctgcggcct

SEQ ID NO: 961970 - DNA, 20 bp, Homo sapiens
cgggccgcaggagggaggcg

SEQ ID NO: 961971 - DNA, 12 bp, Homo sapiens
cgggcctgcaca

SEQ ID NO: 961972 - DNA, 20 bp, Homo sapiens
cgggcgccaggacagcagca

SEQ ID NO: 961973 - DNA, 14 bp, Homo sapiens
cgggcgcggtggct

SEQ ID NO: 961974 - DNA, 17 bp, Homo sapiens
cgggcgctcgctcaggt

SEQ ID NO: 961975 - DNA, 13 bp, Homo sapiens
cgggcgctgctgg

SEQ ID NO: 961976 - DNA, 21 bp, Homo sapiens
cgggcggtcaggggttcgaga

SEQ ID NO: 961977 - DNA, 17 bp, Homo sapiens
cgggcgtgggtctctgg

SEQ ID NO: 961978 - DNA, 19 bp, Homo sapiens
cgggcgtgggtctctgggg

SEQ ID NO: 961979 - DNA, 17 bp, Homo sapiens
cgggcgtggtggcgggc

SEQ ID NO: 961980 - DNA, 12 bp, Homo sapiens
cgggctcagagc

SEQ ID NO: 961981 - DNA, 18 bp, Homo sapiens
cgggctccagccatctca

SEQ ID NO: 961982 - DNA, 18 bp, Homo sapiens
cgggctccatgcctctgg

SEQ ID NO: 961983 - DNA, 19 bp, Homo sapiens
cgggctccatgcctctgga

SEQ ID NO: 961984 - DNA, 17 bp, Homo sapiens
cgggctccctcctctgg

SEQ ID NO: 961985 - DNA, 18 bp, Homo sapiens
cgggctccctcctctggc

SEQ ID NO: 961986 - DNA, 20 bp, Homo sapiens
cgggctccctcctctggcag

SEQ ID NO: 961987 - DNA, 21 bp, Homo sapiens
cgggctccctcctctggcagg

SEQ ID NO: 961988 - DNA, 17 bp, Homo sapiens
cgggctccttcccctgc

SEQ ID NO: 961989 - DNA, 13 bp, Homo sapiens
cgggctcgcccat

SEQ ID NO: 961990 - DNA, 14 bp, Homo sapiens
cgggctcgggtctg

SEQ ID NO: 961991 - DNA, 15 bp, Homo sapiens
cgggctcgggtctgg

SEQ ID NO: 961992 - DNA, 17 bp, Homo sapiens
cgggctctctcacccag

SEQ ID NO: 961993 - DNA, 15 bp, Homo sapiens
cgggctgaggccaga

SEQ ID NO: 961994 - DNA, 15 bp, Homo sapiens
cgggctgagggcctg

SEQ ID NO: 961995 - DNA, 16 bp, Homo sapiens
cgggctgagggcctgc

SEQ ID NO: 961996 - DNA, 23 bp, Homo sapiens
cgggctgcctgcccctgctgctt

SEQ ID NO: 961997 - DNA, 14 bp, Homo sapiens
cgggctgcctgggc

SEQ ID NO: 961998 - DNA, 16 bp, Homo sapiens
cgggctgggagctctg

SEQ ID NO: 961999 - DNA, 19 bp, Homo sapiens
cgggctgggggggctgcct

SEQ ID NO: 962000 - DNA, 19 bp, Homo sapiens
cgggctgggggtagcctgg

SEQ ID NO: 962001 - DNA, 15 bp, Homo sapiens
cgggctgtctgggtg

SEQ ID NO: 962002 - DNA, 16 bp, Homo sapiens
cgggctgtctgggtgt

SEQ ID NO: 962003 - DNA, 14 bp, Homo sapiens
cgggcttctggagc

SEQ ID NO: 962004 - DNA, 16 bp, Homo sapiens
cggggaactcctggaa

SEQ ID NO: 962005 - DNA, 15 bp, Homo sapiens
cggggaagctggctt

SEQ ID NO: 962006 - DNA, 17 bp, Homo sapiens
cggggaccctgccgagg

SEQ ID NO: 962007 - DNA, 14 bp, Homo sapiens
cggggaccctgtga

SEQ ID NO: 962008 - DNA, 23 bp, Homo sapiens
cggggacctggatagttaagggc

SEQ ID NO: 962009 - DNA, 17 bp, Homo sapiens
cggggactgctggctca

SEQ ID NO: 962010 - DNA, 19 bp, Homo sapiens
cggggagaaataagaatta

SEQ ID NO: 962011 - DNA, 23 bp, Homo sapiens
cggggagcggcggaaagcctgta

SEQ ID NO: 962012 - DNA, 13 bp, Homo sapiens
cggggagctgcag

SEQ ID NO: 962013 - DNA, 18 bp, Homo sapiens
cggggagctgcagagcag

SEQ ID NO: 962014 - DNA, 17 bp, Homo sapiens
cggggaggaggaacggg

SEQ ID NO: 962015 - DNA, 21 bp, Homo sapiens
cggggaggaggaacgggcagc

SEQ ID NO: 962016 - DNA, 13 bp, Homo sapiens
cggggaggccaag

SEQ ID NO: 962017 - DNA, 23 bp, Homo sapiens
cggggaggccaagtgcaggctgg

SEQ ID NO: 962018 - DNA, 14 bp, Homo sapiens
cggggaggggcaga

SEQ ID NO: 962019 - DNA, 15 bp, Homo sapiens
cggggagggggcacg

SEQ ID NO: 962020 - DNA, 15 bp, Homo sapiens
cggggagggtgacag

SEQ ID NO: 962021 - DNA, 15 bp, Homo sapiens
cggggatggggaggg

SEQ ID NO: 962022 - DNA, 17 bp, Homo sapiens
cggggcaagagggaagg

SEQ ID NO: 962023 - DNA, 18 bp, Homo sapiens
cggggcaagagggaaggt

SEQ ID NO: 962024 - DNA, 19 bp, Homo sapiens
cggggcagctgccagagaa

SEQ ID NO: 962025 - DNA, 17 bp, Homo sapiens
cggggcagtatgtgatg

SEQ ID NO: 962026 - DNA, 23 bp, Homo sapiens
cggggcagtatgtgatggactgg

SEQ ID NO: 962027 - DNA, 16 bp, Homo sapiens
cggggcatgctggggc

SEQ ID NO: 962028 - DNA, 20 bp, Homo sapiens
cggggcatggacagggccag

SEQ ID NO: 962029 - DNA, 21 bp, Homo sapiens
cggggccacgtgtgctgtggc

SEQ ID NO: 962030 - DNA, 15 bp, Homo sapiens
cggggccagagacat

SEQ ID NO: 962031 - DNA, 12 bp, Homo sapiens
cggggcccagga

SEQ ID NO: 962032 - DNA, 21 bp, Homo sapiens
cggggccggtgaggggagggg

SEQ ID NO: 962033 - DNA, 17 bp, Homo sapiens
cggggcctccaacccat

SEQ ID NO: 962034 - DNA, 15 bp, Homo sapiens
cggggcctcgcgagg

SEQ ID NO: 962035 - DNA, 12 bp, Homo sapiens
cggggcctgctg

SEQ ID NO: 962036 - DNA, 13 bp, Homo sapiens
cggggcctgctgg

SEQ ID NO: 962037 - DNA, 21 bp, Homo sapiens
cggggccttatcgggctccag

SEQ ID NO: 962038 - DNA, 12 bp, Homo sapiens
cggggctggcaa

SEQ ID NO: 962039 - DNA, 14 bp, Homo sapiens
cgggggagagagtt

SEQ ID NO: 962040 - DNA, 14 bp, Homo sapiens
cgggggagcagaga

SEQ ID NO: 962041 - DNA, 16 bp, Homo sapiens
cgggggagcagagaga

SEQ ID NO: 962042 - DNA, 14 bp, Homo sapiens
cgggggaggggccc

SEQ ID NO: 962043 - DNA, 16 bp, Homo sapiens
cgggggcagtgtgagg

SEQ ID NO: 962044 - DNA, 12 bp, Homo sapiens
cgggggcctgtg

SEQ ID NO: 962045 - DNA, 13 bp, Homo sapiens
cgggggcctgtgg

SEQ ID NO: 962046 - DNA, 15 bp, Homo sapiens
cgggggcgcctggag

SEQ ID NO: 962047 - DNA, 15 bp, Homo sapiens
cgggggctcttcccc

SEQ ID NO: 962048 - DNA, 14 bp, Homo sapiens
gcccgggcaggcca

SEQ ID NO: 962049 - DNA, 14 bp, Homo sapiens
gcccgggcccccgc

SEQ ID NO: 962050 - DNA, 15 bp, Homo sapiens
gcccgggcccccgcc

SEQ ID NO: 962051 - DNA, 16 bp, Homo sapiens
gcccgggccccttgct

SEQ ID NO: 962052 - DNA, 16 bp, Homo sapiens
gcccgggctgcctggg

SEQ ID NO: 962053 - DNA, 18 bp, Homo sapiens
gcccgggctgcctgggct

SEQ ID NO: 962054 - DNA, 17 bp, Homo sapiens
gcccggggagctgcaga

SEQ ID NO: 962055 - DNA, 20 bp, Homo sapiens
gcccggggcagcagcagccc

SEQ ID NO: 962056 - DNA, 14 bp, Homo sapiens
gcccggggcagctg

SEQ ID NO: 962057 - DNA, 18 bp, Homo sapiens
gcccggggcagctgccag

SEQ ID NO: 962058 - DNA, 16 bp, Homo sapiens
gcccggggtggccaca

SEQ ID NO: 962059 - DNA, 18 bp, Homo sapiens
gcccggtggtttgccatg

SEQ ID NO: 962060 - DNA, 19 bp, Homo sapiens
gcccggtggtttgccatgt

SEQ ID NO: 962061 - DNA, 18 bp, Homo sapiens
gcccgtcatgttcctcaa

SEQ ID NO: 962062 - DNA, 23 bp, Homo sapiens
gcccgtcctcctctacctctctc

SEQ ID NO: 962063 - DNA, 13 bp, Homo sapiens
gcccgtcctgcct

SEQ ID NO: 962064 - DNA, 14 bp, Homo sapiens
gcccgtcggagctg

SEQ ID NO: 962065 - DNA, 20 bp, Homo sapiens
gcccgtcggagctgcctgca

SEQ ID NO: 962066 - DNA, 21 bp, Homo sapiens
gcccgtcggagctgcctgcag

SEQ ID NO: 962067 - DNA, 23 bp, Homo sapiens
gcccgtcggagctgcctgcagca

SEQ ID NO: 962068 - DNA, 15 bp, Homo sapiens
gcccgtcgtgtgctg

SEQ ID NO: 962069 - DNA, 19 bp, Homo sapiens
ctaaaattaggactgtata

SEQ ID NO: 962070 - DNA, 18 bp, Homo sapiens
ctaaaattccactgcgtt

SEQ ID NO: 962071 - DNA, 18 bp, Homo sapiens
ctaaaattgtatgaaaat

SEQ ID NO: 962072 - DNA, 22 bp, Homo sapiens
ctaaaattgtatgaaaatcctt

SEQ ID NO: 962073 - DNA, 21 bp, Homo sapiens
ctaaaatttcataattctgaa

SEQ ID NO: 962074 - DNA, 20 bp, Homo sapiens
ctaaacacaacaataacttt

SEQ ID NO: 962075 - DNA, 18 bp, Homo sapiens
gctgcgcggactcgcccc

SEQ ID NO: 962076 - DNA, 13 bp, Homo sapiens
gctgcgctagcag

SEQ ID NO: 962077 - DNA, 17 bp, Homo sapiens
gctgcgctagcagccct

SEQ ID NO: 962078 - DNA, 16 bp, Homo sapiens
gctgcgcttgcttttc

SEQ ID NO: 962079 - DNA, 17 bp, Homo sapiens
gctgcgcttgcttttct

SEQ ID NO: 962080 - DNA, 22 bp, Homo sapiens
gctgcggacaccgtggcctggg

SEQ ID NO: 962081 - DNA, 15 bp, Homo sapiens
gctgcgggtctgaag

SEQ ID NO: 962082 - DNA, 15 bp, Homo sapiens
gctgcggtgtttggc

SEQ ID NO: 962083 - DNA, 21 bp, Homo sapiens
gctgcgtcagaccagtactgg

SEQ ID NO: 962084 - DNA, 19 bp, Homo sapiens
gctgcgtccctccgagctt

SEQ ID NO: 962085 - DNA, 19 bp, Homo sapiens
gctgctaccgccctgggct

SEQ ID NO: 962086 - DNA, 17 bp, Homo sapiens
gctgctactacccgagc

SEQ ID NO: 962087 - DNA, 23 bp, Homo sapiens
gctgctacttaattcctttctca

SEQ ID NO: 962088 - DNA, 14 bp, Homo sapiens
gctgctagagaagg

SEQ ID NO: 962089 - DNA, 14 bp, Homo sapiens
gctgctagatttta

SEQ ID NO: 962090 - DNA, 20 bp, Homo sapiens
gctgctagcacttggagcca

SEQ ID NO: 962091 - DNA, 18 bp, Homo sapiens
gctgctaggccagagcca

SEQ ID NO: 962092 - DNA, 22 bp, Homo sapiens
gctgctatccccatctccctgc

SEQ ID NO: 962093 - DNA, 19 bp, Homo sapiens
gctgctatgaaaatgagca

SEQ ID NO: 962094 - DNA, 16 bp, Homo sapiens
gctgctattgctgtct

SEQ ID NO: 962095 - DNA, 18 bp, Homo sapiens
gctgctattgctgtctgg

SEQ ID NO: 962096 - DNA, 23 bp, Homo sapiens
gctgctattgctgtctggtgagg

SEQ ID NO: 962097 - DNA, 19 bp, Homo sapiens
gctgctatttattttccta

SEQ ID NO: 962098 - DNA, 22 bp, Homo sapiens
gctgctattttataaacatttt

SEQ ID NO: 962099 - DNA, 20 bp, Homo sapiens
gctgctcaaggaccaagagc

SEQ ID NO: 962100 - DNA, 17 bp, Homo sapiens
gctgctcacccacctct

SEQ ID NO: 962101 - DNA, 23 bp, Homo sapiens
gctgctcacccacctcttgtgca

SEQ ID NO: 962102 - DNA, 17 bp, Homo sapiens
gctgctcatgggaagaa

SEQ ID NO: 962103 - DNA, 15 bp, Homo sapiens
gctgctccaggcctg

SEQ ID NO: 962104 - DNA, 14 bp, Homo sapiens
gctgctccccaccc

SEQ ID NO: 962105 - DNA, 13 bp, Homo sapiens
gctgctccctggc

SEQ ID NO: 962106 - DNA, 16 bp, Homo sapiens
gctgctcctagaggga

SEQ ID NO: 962107 - DNA, 18 bp, Homo sapiens
gctgctcctagagggagg

SEQ ID NO: 962108 - DNA, 14 bp, Homo sapiens
gctgctcctccagg

SEQ ID NO: 962109 - DNA, 15 bp, Homo sapiens
gctgctcctccaggg

SEQ ID NO: 962110 - DNA, 15 bp, Homo sapiens
gctgctcctctttcc

SEQ ID NO: 962111 - DNA, 19 bp, Homo sapiens
gctgctcctctttcccctc

SEQ ID NO: 962112 - DNA, 20 bp, Homo sapiens
gctgctcctctttcccctcc

SEQ ID NO: 962113 - DNA, 12 bp, Homo sapiens
gctgctcctgtt

SEQ ID NO: 962114 - DNA, 15 bp, Homo sapiens
gctgctccttggctt

SEQ ID NO: 962115 - DNA, 18 bp, Homo sapiens
gctgctctgcaggctggg

SEQ ID NO: 962116 - DNA, 13 bp, Homo sapiens
gctgctctgcccc

SEQ ID NO: 962117 - DNA, 12 bp, Homo sapiens
gctgctctgcta

SEQ ID NO: 962118 - DNA, 21 bp, Homo sapiens
gctgctctgctatatgcctta

SEQ ID NO: 962119 - DNA, 18 bp, Homo sapiens
gctgctctggtgcacgcc

SEQ ID NO: 962120 - DNA, 18 bp, Homo sapiens
gctgctcttagtgcccgc

SEQ ID NO: 962121 - DNA, 11 bp, Homo sapiens
gctgctgacca

SEQ ID NO: 962122 - DNA, 13 bp, Homo sapiens
gctgctgaggccc

SEQ ID NO: 962123 - DNA, 16 bp, Homo sapiens
gctgctgatgcgctgg

SEQ ID NO: 962124 - DNA, 20 bp, Homo sapiens
gctgctgatgcgctgggatc

SEQ ID NO: 962125 - DNA, 13 bp, Homo sapiens
gctgctgcaccaa

SEQ ID NO: 962126 - DNA, 15 bp, Homo sapiens
gctgctgcaccaacc

SEQ ID NO: 962127 - DNA, 12 bp, Homo sapiens
gctgctgcaggc

SEQ ID NO: 962128 - DNA, 15 bp, Homo sapiens
gctgctgccagggct

SEQ ID NO: 962129 - DNA, 17 bp, Homo sapiens
gctgctgccagggcttc

SEQ ID NO: 962130 - DNA, 18 bp, Homo sapiens
gctgctgcccatgtttca

SEQ ID NO: 962131 - DNA, 13 bp, Homo sapiens
gctgctgcctggc

SEQ ID NO: 962132 - DNA, 12 bp, Homo sapiens
gctgctgcgccc

SEQ ID NO: 962133 - DNA, 16 bp, Homo sapiens
gctgctgctaccagcg

SEQ ID NO: 962134 - DNA, 21 bp, Homo sapiens
gctgctgctattgctgtctgg

SEQ ID NO: 962135 - DNA, 12 bp, Homo sapiens
gctgctgctctc

SEQ ID NO: 962136 - DNA, 15 bp, Homo sapiens
gctgctgctgcgccc

SEQ ID NO: 962137 - DNA, 15 bp, Homo sapiens
gctgctgctgctatt

SEQ ID NO: 962138 - DNA, 18 bp, Homo sapiens
gctgctgcttctgctcca

SEQ ID NO: 962139 - DNA, 19 bp, Homo sapiens
gctgctgcttctgctccag

SEQ ID NO: 962140 - DNA, 13 bp, Homo sapiens
gttcacctccctg

SEQ ID NO: 962141 - DNA, 18 bp, Homo sapiens
gttcacctccctgctcag

SEQ ID NO: 962142 - DNA, 22 bp, Homo sapiens
gttcaccttgaagaacctctca

SEQ ID NO: 962143 - DNA, 14 bp, Homo sapiens
gttcaccttggaag

SEQ ID NO: 962144 - DNA, 22 bp, Homo sapiens
gttcaccttggaagggcgttct

SEQ ID NO: 962145 - DNA, 13 bp, Homo sapiens
gttcactccattt

SEQ ID NO: 962146 - DNA, 24 bp, Homo sapiens
gttcactctacttagcatgtccct

SEQ ID NO: 962147 - DNA, 16 bp, Homo sapiens
gttcacttaaattctt

SEQ ID NO: 962148 - DNA, 20 bp, Homo sapiens
gttcacttgccatgcaggaa

SEQ ID NO: 962149 - DNA, 16 bp, Homo sapiens
gttcacttttgacaaa

SEQ ID NO: 962150 - DNA, 17 bp, Homo sapiens
gttcagaaatgctgcct

SEQ ID NO: 962151 - DNA, 14 bp, Homo sapiens
gttcagaagaaatt

SEQ ID NO: 962152 - DNA, 14 bp, Homo sapiens
gttcagaaggtgtg

SEQ ID NO: 962153 - DNA, 20 bp, Homo sapiens
gttcagaattaaacttttaa

SEQ ID NO: 962154 - DNA, 12 bp, Homo sapiens
gttcagaattta

SEQ ID NO: 962155 - DNA, 14 bp, Homo sapiens
gttcagacacagct

SEQ ID NO: 962156 - DNA, 16 bp, Homo sapiens
gttcagacacagctct

SEQ ID NO: 962157 - DNA, 15 bp, Homo sapiens
gttcagacccctgcc

SEQ ID NO: 962158 - DNA, 17 bp, Homo sapiens
gttcagacccctgcctg

SEQ ID NO: 962159 - DNA, 16 bp, Homo sapiens
gttcagagactcaggg

SEQ ID NO: 962160 - DNA, 14 bp, Homo sapiens
gttcagagtggctc

SEQ ID NO: 962161 - DNA, 22 bp, Homo sapiens
gttcagagtggctcactggctg

SEQ ID NO: 962162 - DNA, 19 bp, Homo sapiens
gttcagataattgaataag

SEQ ID NO: 962163 - DNA, 14 bp, Homo sapiens
gttcagatgtgcat

SEQ ID NO: 962164 - DNA, 14 bp, Homo sapiens
gttcagcactgtcc

SEQ ID NO: 962165 - DNA, 16 bp, Homo sapiens
gttcagcactgtccct

SEQ ID NO: 962166 - DNA, 15 bp, Homo sapiens
gttcagcagaacctg

SEQ ID NO: 962167 - DNA, 22 bp, Homo sapiens
gttcagcagaacctgcacacag

SEQ ID NO: 962168 - DNA, 19 bp, Homo sapiens
gttcagcatggcatccaag

SEQ ID NO: 962169 - DNA, 14 bp, Homo sapiens
gttcagccattgtg

SEQ ID NO: 962170 - DNA, 22 bp, Homo sapiens
gttcagccattgtggaagacag

SEQ ID NO: 962171 - DNA, 16 bp, Homo sapiens
gttcagcccctcctct

SEQ ID NO: 962172 - DNA, 21 bp, Homo sapiens
gttcagcccctcctctgccac

SEQ ID NO: 962173 - DNA, 21 bp, Homo sapiens
gttcagccttcgtgtggctcc

SEQ ID NO: 962174 - DNA, 22 bp, Homo sapiens
gttcagccttcgtgtggctcct

SEQ ID NO: 962175 - DNA, 24 bp, Homo sapiens
gttcagccttcgtgtggctcctgg

SEQ ID NO: 962176 - DNA, 22 bp, Homo sapiens
gttcagctaagctaggaatgaa

SEQ ID NO: 962177 - DNA, 18 bp, Homo sapiens
gttcagctctttccaaat

SEQ ID NO: 962178 - DNA, 15 bp, Homo sapiens
gttcagctgccccac

SEQ ID NO: 962179 - DNA, 15 bp, Homo sapiens
gttcagctgcttctc

SEQ ID NO: 962180 - DNA, 15 bp, Homo sapiens
gttcaggagtcccaa

SEQ ID NO: 962181 - DNA, 19 bp, Homo sapiens
gttcaggctctgagacaca

SEQ ID NO: 962182 - DNA, 17 bp, Homo sapiens
gttcagggaactgcttg

SEQ ID NO: 962183 - DNA, 16 bp, Homo sapiens
gttcagggaggggccg

SEQ ID NO: 962184 - DNA, 17 bp, Homo sapiens
gttcagggcatcggcag

SEQ ID NO: 962185 - DNA, 21 bp, Homo sapiens
gttcagggcatcggcagctga

SEQ ID NO: 962186 - DNA, 20 bp, Homo sapiens
gttcaggggactcagccctg

SEQ ID NO: 962187 - DNA, 19 bp, Homo sapiens
gttcagtagatttcctttt

SEQ ID NO: 962188 - DNA, 16 bp, Homo sapiens
gttcagtgccttcctc

SEQ ID NO: 962189 - DNA, 16 bp, Homo sapiens
gttcagtgtcccaggc

SEQ ID NO: 962190 - DNA, 21 bp, Homo sapiens
gttcagtgtcgggaattttcc

SEQ ID NO: 962191 - DNA, 20 bp, Homo sapiens
gttcagtttttttttttcca

SEQ ID NO: 962192 - DNA, 14 bp, Homo sapiens
gttcatacatttga

SEQ ID NO: 962193 - DNA, 22 bp, Homo sapiens
gttcatacgcatcccatctctc

SEQ ID NO: 962194 - DNA, 13 bp, Homo sapiens
gttcatagcccag

SEQ ID NO: 962195 - DNA, 14 bp, Homo sapiens
gttcatagcccagt

SEQ ID NO: 962196 - DNA, 22 bp, Homo sapiens
gttcatagggtctcttcaggtt

SEQ ID NO: 962197 - DNA, 12 bp, Homo sapiens
gttcatatatac

SEQ ID NO: 962198 - DNA, 14 bp, Homo sapiens
gttcatatatacat

SEQ ID NO: 962199 - DNA, 21 bp, Homo sapiens
gttcatatgcagaacgtattt

SEQ ID NO: 962200 - DNA, 22 bp, Homo sapiens
gttcatatgtaccatgtacatg

SEQ ID NO: 962201 - DNA, 14 bp, Homo sapiens
gttcatcagtgtta

SEQ ID NO: 962202 - DNA, 21 bp, Homo sapiens
gttcatcagtgttaaaaaatt

SEQ ID NO: 962203 - DNA, 19 bp, Homo sapiens
gttcatccaatcctcactg

SEQ ID NO: 962204 - DNA, 22 bp, Homo sapiens
gttcatccaatcctcactgggt

SEQ ID NO: 962205 - DNA, 21 bp, Homo sapiens
gttcatcctcattgcctcctg

SEQ ID NO: 962206 - DNA, 22 bp, Homo sapiens
gttcatcctcattgcctcctgt

SEQ ID NO: 962207 - DNA, 17 bp, Homo sapiens
gttcatcgtataacaca

SEQ ID NO: 962208 - DNA, 12 bp, Homo sapiens
gttcatgagaat

SEQ ID NO: 962209 - DNA, 15 bp, Homo sapiens
gttcatgcagctgtg

SEQ ID NO: 962210 - DNA, 14 bp, Homo sapiens
gttcatggagagct

SEQ ID NO: 962211 - DNA, 18 bp, Homo sapiens
gttcatggattacttctc

SEQ ID NO: 962212 - DNA, 24 bp, Homo sapiens
gttcatgtttgcttcataaatgaa

SEQ ID NO: 962213 - DNA, 20 bp, Homo sapiens
gttcattaaagcatgaatgg

SEQ ID NO: 962214 - DNA, 18 bp, Homo sapiens
gttcattagaaatatttt

SEQ ID NO: 962215 - DNA, 15 bp, Homo sapiens
gttcattattggaat

SEQ ID NO: 962216 - DNA, 19 bp, Homo sapiens
gttcattgatggatgtctt

SEQ ID NO: 962217 - DNA, 16 bp, Homo sapiens
gttcattgcactttga

SEQ ID NO: 962218 - DNA, 14 bp, Homo sapiens
gttcattgtaatgt

SEQ ID NO: 962219 - DNA, 21 bp, Homo sapiens
gttcattgtaatgttactgat

SEQ ID NO: 962220 - DNA, 20 bp, Homo sapiens
gttcatttcaaatacatctt

SEQ ID NO: 962221 - DNA, 11 bp, Homo sapiens
gttcatttcac

SEQ ID NO: 962222 - DNA, 12 bp, Homo sapiens
gttcatttcatt

SEQ ID NO: 962223 - DNA, 22 bp, Homo sapiens
gttcatttggtgttcctggaag

SEQ ID NO: 962224 - DNA, 13 bp, Homo sapiens
gttcatttgtgta

SEQ ID NO: 962225 - DNA, 20 bp, Homo sapiens
gttcattttctctgtatgaa

SEQ ID NO: 962226 - DNA, 19 bp, Homo sapiens
gttcattttgagtattttt

SEQ ID NO: 962227 - DNA, 20 bp, Homo sapiens
gttcattttgagtattttta

SEQ ID NO: 962228 - DNA, 15 bp, Homo sapiens
gttcatttttaaagc

SEQ ID NO: 962229 - DNA, 19 bp, Homo sapiens
gttcatttttaaagcctgg

SEQ ID NO: 962230 - DNA, 22 bp, Homo sapiens
gttcatttttaaagcctggctt

SEQ ID NO: 962231 - DNA, 23 bp, Homo sapiens
gttcatttttaaagcctggcttc

SEQ ID NO: 962232 - DNA, 15 bp, Homo sapiens
gttccaaatgaatgt

SEQ ID NO: 962233 - DNA, 21 bp, Homo sapiens
ctttccacatttgtcacagaa

SEQ ID NO: 962234 - DNA, 22 bp, Homo sapiens
ctttccacatttgtcacagaaa

SEQ ID NO: 962235 - DNA, 21 bp, Homo sapiens
ctttccaccacagccagcacc

SEQ ID NO: 962236 - DNA, 22 bp, Homo sapiens
ctttccaccacagccagcacct

SEQ ID NO: 962237 - DNA, 21 bp, Homo sapiens
ctttccacggagccactcctc

SEQ ID NO: 962238 - DNA, 13 bp, Homo sapiens
ctttccactctgg

SEQ ID NO: 962239 - DNA, 14 bp, Homo sapiens
ctttccactctgga

SEQ ID NO: 962240 - DNA, 14 bp, Homo sapiens
ctttccacttcttc

SEQ ID NO: 962241 - DNA, 17 bp, Homo sapiens
ctttccacttcttcctt

SEQ ID NO: 962242 - DNA, 20 bp, Homo sapiens
ctttccagcctcctgctggc

SEQ ID NO: 962243 - DNA, 17 bp, Homo sapiens
ctttccagggttattta

SEQ ID NO: 962244 - DNA, 17 bp, Homo sapiens
ctttccatctgtccaca

SEQ ID NO: 962245 - DNA, 14 bp, Homo sapiens
ctttccatgggccc

SEQ ID NO: 962246 - DNA, 23 bp, Homo sapiens
ctttccatgggcccgctgcctct

SEQ ID NO: 962247 - DNA, 18 bp, Homo sapiens
ctttccatgttgctgcca

SEQ ID NO: 962248 - DNA, 19 bp, Homo sapiens
ctttccattcttcttgcta

SEQ ID NO: 962249 - DNA, 20 bp, Homo sapiens
ctttcccaagtattgcgaat

SEQ ID NO: 962250 - DNA, 13 bp, Homo sapiens
ctttcccaccatt

SEQ ID NO: 962251 - DNA, 22 bp, Homo sapiens
ctttcccaccattcctgccttt

SEQ ID NO: 962252 - DNA, 17 bp, Homo sapiens
ctttcccagaagtggct

SEQ ID NO: 962253 - DNA, 19 bp, Homo sapiens
ctttcccaggtaatttaaa

SEQ ID NO: 962254 - DNA, 16 bp, Homo sapiens
ctttcccatggggagg

SEQ ID NO: 962255 - DNA, 14 bp, Homo sapiens
ctttccccacacct

SEQ ID NO: 962256 - DNA, 23 bp, Homo sapiens
ctttccccagcagtttctgtcct

SEQ ID NO: 962257 - DNA, 15 bp, Homo sapiens
ctttcccccttcccg

SEQ ID NO: 962258 - DNA, 22 bp, Homo sapiens
ctttccccgggggaggaagggg

SEQ ID NO: 962259 - DNA, 15 bp, Homo sapiens
ctttcccctgtgggg

SEQ ID NO: 962260 - DNA, 15 bp, Homo sapiens
ctttccctagaaagc

SEQ ID NO: 962261 - DNA, 14 bp, Homo sapiens
gttcccaataaaag

SEQ ID NO: 962262 - DNA, 15 bp, Homo sapiens
gttcccaataaaagt

SEQ ID NO: 962263 - DNA, 16 bp, Homo sapiens
gttcccaataaaagtg

SEQ ID NO: 962264 - DNA, 22 bp, Homo sapiens
gttcccacccaagccctccttt

SEQ ID NO: 962265 - DNA, 23 bp, Homo sapiens
gttcccacccaagccctcctttg

SEQ ID NO: 962266 - DNA, 17 bp, Homo sapiens
gttcccactgaggccct

SEQ ID NO: 962267 - DNA, 21 bp, Homo sapiens
gttcccagatggctggaaggg

SEQ ID NO: 962268 - DNA, 13 bp, Homo sapiens
gttcccagctccc

SEQ ID NO: 962269 - DNA, 19 bp, Homo sapiens
gttcccatggtgtatgtgg

SEQ ID NO: 962270 - DNA, 18 bp, Homo sapiens
gttcccatgtagccccct

SEQ ID NO: 962271 - DNA, 22 bp, Homo sapiens
gttcccattattatttctgttc

SEQ ID NO: 962272 - DNA, 16 bp, Homo sapiens
gttcccatttcagctg

SEQ ID NO: 962273 - DNA, 21 bp, Homo sapiens
gttccccagagagcaggcagg

SEQ ID NO: 962274 - DNA, 22 bp, Homo sapiens
gttccccagagagcaggcaggg

SEQ ID NO: 962275 - DNA, 18 bp, Homo sapiens
gttccccatctgggtcct

SEQ ID NO: 962276 - DNA, 18 bp, Homo sapiens
gttccccctgtttcagag

SEQ ID NO: 962277 - DNA, 21 bp, Homo sapiens
gttcccccttcacaaagccca

SEQ ID NO: 962278 - DNA, 23 bp, Homo sapiens
gttcccctctcccttccctcctc

SEQ ID NO: 962279 - DNA, 17 bp, Homo sapiens
gttcccctgttcactct

SEQ ID NO: 962280 - DNA, 13 bp, Homo sapiens
gttccccttccac

SEQ ID NO: 962281 - DNA, 15 bp, Homo sapiens
gttccccttccactg

SEQ ID NO: 962282 - DNA, 20 bp, Homo sapiens
gttcccgagggagctgctgg

SEQ ID NO: 962283 - DNA, 23 bp, Homo sapiens
gttcccgagggagctgctggctg

SEQ ID NO: 962284 - DNA, 20 bp, Homo sapiens
gttcccgatggtctctctcc

SEQ ID NO: 962285 - DNA, 19 bp, Homo sapiens
gttcccggagcacagccct

SEQ ID NO: 962286 - DNA, 21 bp, Homo sapiens
gttcccggagcacagccctgg

SEQ ID NO: 962287 - DNA, 15 bp, Homo sapiens
gttcccggtcccgag

SEQ ID NO: 962288 - DNA, 19 bp, Homo sapiens
gttcccgtttctccaccta

SEQ ID NO: 962289 - DNA, 13 bp, Homo sapiens
gttccctcccaga

SEQ ID NO: 962290 - DNA, 19 bp, Homo sapiens
gttccctcctagctctccc

SEQ ID NO: 962291 - DNA, 20 bp, Homo sapiens
gttccctcctagctctccca

SEQ ID NO: 962292 - DNA, 23 bp, Homo sapiens
gttccctcctgcccaggactgca

SEQ ID NO: 962293 - DNA, 20 bp, Homo sapiens
gttccctcctggtcctggac

SEQ ID NO: 962294 - DNA, 17 bp, Homo sapiens
gttccctctccctgttg

SEQ ID NO: 962295 - DNA, 14 bp, Homo sapiens
gttccctctgagaa

SEQ ID NO: 962296 - DNA, 22 bp, Homo sapiens
gttccctctgagaattccaagg

SEQ ID NO: 962297 - DNA, 18 bp, Homo sapiens
gttccctgaaaacccaga

SEQ ID NO: 962298 - DNA, 15 bp, Homo sapiens
gttccctgaaacacg

SEQ ID NO: 962299 - DNA, 16 bp, Homo sapiens
gttccctgcaccctgg

SEQ ID NO: 962300 - DNA, 18 bp, Homo sapiens
gttccctgcgcttcatct

SEQ ID NO: 962301 - DNA, 19 bp, Homo sapiens
gttccctgcgcttcatctc

SEQ ID NO: 962302 - DNA, 22 bp, Homo sapiens
gttccctgcgcttcatctcatg

SEQ ID NO: 962303 - DNA, 16 bp, Homo sapiens
gttccctgtcttgtcc

SEQ ID NO: 962304 - DNA, 15 bp, Homo sapiens
gttccctgttcttcc

SEQ ID NO: 962305 - DNA, 13 bp, Homo sapiens
gttcccttcctct

SEQ ID NO: 962306 - DNA, 23 bp, Homo sapiens
gttcccttcctcttcctgccctt

SEQ ID NO: 962307 - DNA, 14 bp, Homo sapiens
gttcccttctcccc

SEQ ID NO: 962308 - DNA, 17 bp, Homo sapiens
gttcccttctccccctt

SEQ ID NO: 962309 - DNA, 20 bp, Homo sapiens
gttcccttctcccccttgtc

SEQ ID NO: 962310 - DNA, 14 bp, Homo sapiens
gttcccttgaccat

SEQ ID NO: 962311 - DNA, 15 bp, Homo sapiens
gttcccttgaccatt

SEQ ID NO: 962312 - DNA, 23 bp, Homo sapiens
gttcccttgaccattggctgcgc

SEQ ID NO: 962313 - DNA, 12 bp, Homo sapiens
gttcccttggcc

SEQ ID NO: 962314 - DNA, 13 bp, Homo sapiens
gttcccttggcct

SEQ ID NO: 962315 - DNA, 16 bp, Homo sapiens
gttcccttgtggcttg

SEQ ID NO: 962316 - DNA, 19 bp, Homo sapiens
gttccctttccttccatcc

SEQ ID NO: 962317 - DNA, 14 bp, Homo sapiens
gttccctttgcctt

SEQ ID NO: 962318 - DNA, 22 bp, Homo sapiens
gttccctttgccttaaacctga

SEQ ID NO: 962319 - DNA, 21 bp, Homo sapiens
gttccgaaaccaaagaagaaa

SEQ ID NO: 962320 - DNA, 14 bp, Homo sapiens
gttccgcactttcc

SEQ ID NO: 962321 - DNA, 23 bp, Homo sapiens
gttccgcactttccacttcttcc

SEQ ID NO: 962322 - DNA, 22 bp, Homo sapiens
gttccgcttctctcttttaaag

SEQ ID NO: 962323 - DNA, 18 bp, Homo sapiens
gttccgggcaaatgccag

SEQ ID NO: 962324 - DNA, 17 bp, Homo sapiens
gttccggtccccacaga

SEQ ID NO: 962325 - DNA, 17 bp, Homo sapiens
gttcctaacaggatgaa

SEQ ID NO: 962326 - DNA, 14 bp, Homo sapiens
gttcctattgtcat

SEQ ID NO: 962327 - DNA, 20 bp, Homo sapiens
gttcctcaaattttttgact

SEQ ID NO: 962328 - DNA, 15 bp, Homo sapiens
gttcctcgccctggg

SEQ ID NO: 962329 - DNA, 16 bp, Homo sapiens
gttcctctcccttccc

SEQ ID NO: 962330 - DNA, 17 bp, Homo sapiens
gttcctctcccttccct

SEQ ID NO: 962331 - DNA, 14 bp, Homo sapiens
gttcctctctccca

SEQ ID NO: 962332 - DNA, 18 bp, Homo sapiens
gttcctgaagctgctgtg

SEQ ID NO: 962333 - DNA, 14 bp, Homo sapiens
gttcctgctccgtg

SEQ ID NO: 962334 - DNA, 12 bp, Homo sapiens
gttcctggaagc

SEQ ID NO: 962335 - DNA, 18 bp, Homo sapiens
gttcctggaagcaggtgc

SEQ ID NO: 962336 - DNA, 16 bp, Homo sapiens
gttcctggagttttga

SEQ ID NO: 962337 - DNA, 21 bp, Homo sapiens
gttcctggcaatagtgtgttc

SEQ ID NO: 962338 - DNA, 23 bp, Homo sapiens
gttcctggcagtttaaaaaaatt

SEQ ID NO: 962339 - DNA, 22 bp, Homo sapiens
gttcctggccttctgaactcca

SEQ ID NO: 962340 - DNA, 12 bp, Homo sapiens
gttcctggctga

SEQ ID NO: 962341 - DNA, 15 bp, Homo sapiens
gttcctggctgatga

SEQ ID NO: 962342 - DNA, 22 bp, Homo sapiens
gttcctggggccgcctgccctg

SEQ ID NO: 962343 - DNA, 17 bp, Homo sapiens
gttcctgtgcagatgct

SEQ ID NO: 962344 - DNA, 16 bp, Homo sapiens
gttcctgtggctccct

SEQ ID NO: 962345 - DNA, 15 bp, Homo sapiens
gttccttactgcaga

SEQ ID NO: 962346 - DNA, 19 bp, Homo sapiens
gttccttcctatgcccagg

SEQ ID NO: 962347 - DNA, 20 bp, Homo sapiens
gttccttctggtgtctgctt

SEQ ID NO: 962348 - DNA, 20 bp, Homo sapiens
gttccttgccttaataaata

SEQ ID NO: 962349 - DNA, 18 bp, Homo sapiens
gttccttggggggccaaa

SEQ ID NO: 962350 - DNA, 14 bp, Homo sapiens
gttcctttatttag

SEQ ID NO: 962351 - DNA, 21 bp, Homo sapiens
gttcctttatttaggaaacac

SEQ ID NO: 962352 - DNA, 22 bp, Homo sapiens
gttcctttatttaggaaacacc

SEQ ID NO: 962353 - DNA, 21 bp, Homo sapiens
gttcctttcatctctctacct

SEQ ID NO: 962354 - DNA, 19 bp, Homo sapiens
gttcctttttaaatgtgaa

SEQ ID NO: 962355 - DNA, 21 bp, Homo sapiens
gttcgaaatagatatcctctc

SEQ ID NO: 962356 - DNA, 17 bp, Homo sapiens
gttcgagaccagcctgg

SEQ ID NO: 962357 - DNA, 18 bp, Homo sapiens
gttcgagaccagcctggc

SEQ ID NO: 962358 - DNA, 23 bp, Homo sapiens
ctttctctccgacttcccctggg

SEQ ID NO: 962359 - DNA, 15 bp, Homo sapiens
ctttctctcctggct

SEQ ID NO: 962360 - DNA, 16 bp, Homo sapiens
ctttctctcctttctt

SEQ ID NO: 962361 - DNA, 19 bp, Homo sapiens
ctttctctctcctctctgc

SEQ ID NO: 962362 - DNA, 12 bp, Homo sapiens
ctttctctgaga

SEQ ID NO: 962363 - DNA, 14 bp, Homo sapiens
ctttctctgaggac

SEQ ID NO: 962364 - DNA, 11 bp, Homo sapiens
ctttctctgcc

SEQ ID NO: 962365 - DNA, 13 bp, Homo sapiens
ctttctctgcctc

SEQ ID NO: 962366 - DNA, 14 bp, Homo sapiens
ctttctctgcctct

SEQ ID NO: 962367 - DNA, 20 bp, Homo sapiens
ctttctctggcttccttggc

SEQ ID NO: 962368 - DNA, 13 bp, Homo sapiens
ctttctcttacct

SEQ ID NO: 962369 - DNA, 22 bp, Homo sapiens
ctttctcttccccttcctgttt

SEQ ID NO: 962370 - DNA, 13 bp, Homo sapiens
ctttctcttccct

SEQ ID NO: 962371 - DNA, 14 bp, Homo sapiens
ctttctcttccctg

SEQ ID NO: 962372 - DNA, 16 bp, Homo sapiens
ctttctcttccctgaa

SEQ ID NO: 962373 - DNA, 18 bp, Homo sapiens
ctttctctttcttccttt

SEQ ID NO: 962374 - DNA, 13 bp, Homo sapiens
ctttctcttttcc

SEQ ID NO: 962375 - DNA, 22 bp, Homo sapiens
ctttctgagagttggctcaggc

SEQ ID NO: 962376 - DNA, 17 bp, Homo sapiens
ctttctgagcacacttt

SEQ ID NO: 962377 - DNA, 21 bp, Homo sapiens
ctttctgagcacactttagtg

SEQ ID NO: 962378 - DNA, 20 bp, Homo sapiens
ctttctgagtgagttttact

SEQ ID NO: 962379 - DNA, 23 bp, Homo sapiens
ctttctgcatgaccaaagtgata

SEQ ID NO: 962380 - DNA, 21 bp, Homo sapiens
ctttctgccatctagccagcc

SEQ ID NO: 962381 - DNA, 22 bp, Homo sapiens
ctttctgccatctagccagccc

SEQ ID NO: 962382 - DNA, 17 bp, Homo sapiens
ctttggggggccacccg

SEQ ID NO: 962383 - DNA, 17 bp, Homo sapiens
ctttggggggtgtgctg

SEQ ID NO: 962384 - DNA, 20 bp, Homo sapiens
ctttgggggtggaaaaggaa

SEQ ID NO: 962385 - DNA, 20 bp, Homo sapiens
ctttggggtagaccttgagg

SEQ ID NO: 962386 - DNA, 22 bp, Homo sapiens
ctttggggtcctagcccagtgc

SEQ ID NO: 962387 - DNA, 20 bp, Homo sapiens
ctttgggtggctcactactg

SEQ ID NO: 962388 - DNA, 21 bp, Homo sapiens
ctttgggtggctcactactga

SEQ ID NO: 962389 - DNA, 18 bp, Homo sapiens
ctttggtaattggtttta

SEQ ID NO: 962390 - DNA, 23 bp, Homo sapiens
ctttggtactgctgtcttccaag

SEQ ID NO: 962391 - DNA, 17 bp, Homo sapiens
ctttggtccccagcatt

SEQ ID NO: 962392 - DNA, 18 bp, Homo sapiens
ctttggtccccagcattg

SEQ ID NO: 962393 - DNA, 14 bp, Homo sapiens
ctttggtccttcaa

SEQ ID NO: 962394 - DNA, 14 bp, Homo sapiens
ctttggtctatttt

SEQ ID NO: 962395 - DNA, 15 bp, Homo sapiens
ctttggtcttgcccc

SEQ ID NO: 962396 - DNA, 17 bp, Homo sapiens
ctttggtgaattccttc

SEQ ID NO: 962397 - DNA, 19 bp, Homo sapiens
ctttggtgttacacagccc

SEQ ID NO: 962398 - DNA, 17 bp, Homo sapiens
ctttggttaatacatct

SEQ ID NO: 962399 - DNA, 15 bp, Homo sapiens
ctttggttcctgtga

SEQ ID NO: 962400 - DNA, 19 bp, Homo sapiens
ctttggttccttctctggg

SEQ ID NO: 962401 - DNA, 11 bp, Homo sapiens
ctttggttttg

SEQ ID NO: 962402 - DNA, 18 bp, Homo sapiens
ctttggttttggaggagg

SEQ ID NO: 962403 - DNA, 17 bp, Homo sapiens
ctttggtttttttcttc

SEQ ID NO: 962404 - DNA, 18 bp, Homo sapiens
ctttgtaagacatttgta

SEQ ID NO: 962405 - DNA, 14 bp, Homo sapiens
ctttgtaataaaat

SEQ ID NO: 962406 - DNA, 17 bp, Homo sapiens
ctttgtaatgtcaccac

SEQ ID NO: 962407 - DNA, 22 bp, Homo sapiens
ctttgtacagaccgagaggcca

SEQ ID NO: 962408 - DNA, 15 bp, Homo sapiens
ctttgtacagagtgc

SEQ ID NO: 962409 - DNA, 15 bp, Homo sapiens
ctttgtaccaaaatt

SEQ ID NO: 962410 - DNA, 22 bp, Homo sapiens
ctttgtactcctgctgtctacc

SEQ ID NO: 962411 - DNA, 16 bp, Homo sapiens
ctttgtacttgtgttt

SEQ ID NO: 962412 - DNA, 21 bp, Homo sapiens
ctttgtacttgtgtttgctta

SEQ ID NO: 962413 - DNA, 20 bp, Homo sapiens
ctttgtagactgtttcacat

SEQ ID NO: 962414 - DNA, 12 bp, Homo sapiens
ctttgtataaat

SEQ ID NO: 962415 - DNA, 18 bp, Homo sapiens
ctttgtatataggcttct

SEQ ID NO: 962416 - DNA, 21 bp, Homo sapiens
ctttgtatataggcttctcac

SEQ ID NO: 962417 - DNA, 16 bp, Homo sapiens
ctttgtatgtggaagt

SEQ ID NO: 962418 - DNA, 14 bp, Homo sapiens
ctttgtattataaa

SEQ ID NO: 962419 - DNA, 13 bp, Homo sapiens
ctttgtattcaaa

SEQ ID NO: 962420 - DNA, 22 bp, Homo sapiens
ctttgtattctctcctgtacct

SEQ ID NO: 962421 - DNA, 15 bp, Homo sapiens
ctttgtcacttgcca

SEQ ID NO: 962422 - DNA, 14 bp, Homo sapiens
ctttgtcattttca

SEQ ID NO: 962423 - DNA, 11 bp, Homo sapiens
ctttgtccagg

SEQ ID NO: 962424 - DNA, 19 bp, Homo sapiens
ctttgtccccacacagcct

SEQ ID NO: 962425 - DNA, 20 bp, Homo sapiens
ctttgtccccacacagcctc

SEQ ID NO: 962426 - DNA, 20 bp, Homo sapiens
ctttgtcctaagagatttat

SEQ ID NO: 962427 - DNA, 17 bp, Homo sapiens
ctttgtcctttttgtta

SEQ ID NO: 962428 - DNA, 23 bp, Homo sapiens
ctttgtcgtggttcttaaatgtt

SEQ ID NO: 962429 - DNA, 23 bp, Homo sapiens
ctttgtctacttcaaaagtttgt

SEQ ID NO: 962430 - DNA, 20 bp, Homo sapiens
ctttgtctcaaaataaagca

SEQ ID NO: 962431 - DNA, 14 bp, Homo sapiens
ctttgtctgccttc

SEQ ID NO: 962432 - DNA, 19 bp, Homo sapiens
ctttgtctggatgcacact

SEQ ID NO: 962433 - DNA, 13 bp, Homo sapiens
ctttgtctgtaca

SEQ ID NO: 962434 - DNA, 17 bp, Homo sapiens
ctttgtctgtacatact

SEQ ID NO: 962435 - DNA, 21 bp, Homo sapiens
ctttgtctgtacatactggcc

SEQ ID NO: 962436 - DNA, 14 bp, Homo sapiens
ctttgtcttaatcg

SEQ ID NO: 962437 - DNA, 17 bp, Homo sapiens
ctttgtcttgtacttct

SEQ ID NO: 962438 - DNA, 19 bp, Homo sapiens
ctttgtcttgtacttctgt

SEQ ID NO: 962439 - DNA, 13 bp, Homo sapiens
ctttgtgaatctg

SEQ ID NO: 962440 - DNA, 14 bp, Homo sapiens
ctttgtgacaggaa

SEQ ID NO: 962441 - DNA, 23 bp, Homo sapiens
ctttgtgacaggaaagccctccc

SEQ ID NO: 962442 - DNA, 14 bp, Homo sapiens
ctttgtgataattc

SEQ ID NO: 962443 - DNA, 17 bp, Homo sapiens
ctttgtgattatttcac

SEQ ID NO: 962444 - DNA, 19 bp, Homo sapiens
ctttgtgatttttgtaatt

SEQ ID NO: 962445 - DNA, 14 bp, Homo sapiens
ctttgtgctttcct

SEQ ID NO: 962446 - DNA, 16 bp, Homo sapiens
ctttgtggatgtcttc

SEQ ID NO: 962447 - DNA, 17 bp, Homo sapiens
ctttgtggatgtcttcc

SEQ ID NO: 962448 - DNA, 11 bp, Homo sapiens
ctttgtggcca

SEQ ID NO: 962449 - DNA, 20 bp, Homo sapiens
ctttgtggccaaggagctgc

SEQ ID NO: 962450 - DNA, 16 bp, Homo sapiens
ctttgtggggaagagg

SEQ ID NO: 962451 - DNA, 18 bp, Homo sapiens
ctttgtgtaatctaagta

SEQ ID NO: 962452 - DNA, 15 bp, Homo sapiens
ctttgtgtgattgaa

SEQ ID NO: 962453 - DNA, 17 bp, Homo sapiens
ctttgtgtggctcctgg

SEQ ID NO: 962454 - DNA, 19 bp, Homo sapiens
ctttgtgtggctcctggta

SEQ ID NO: 962455 - DNA, 15 bp, Homo sapiens
ctttgtgtgttatat

SEQ ID NO: 962456 - DNA, 20 bp, Homo sapiens
ctttgtgtgttatattccaa

SEQ ID NO: 962457 - DNA, 18 bp, Homo sapiens
ctttgtgttcatttcatt

SEQ ID NO: 962458 - DNA, 14 bp, Homo sapiens
ctttgtgtttctat

SEQ ID NO: 962459 - DNA, 22 bp, Homo sapiens
ctttgtgtttttttaatttcta

SEQ ID NO: 962460 - DNA, 14 bp, Homo sapiens
ctttgttataccat

SEQ ID NO: 962461 - DNA, 18 bp, Homo sapiens
ctttgttcttcctgtctc

SEQ ID NO: 962462 - DNA, 11 bp, Homo sapiens
ctttgttgaag

SEQ ID NO: 962463 - DNA, 19 bp, Homo sapiens
ctttgttgcaagatgtgaa

SEQ ID NO: 962464 - DNA, 20 bp, Homo sapiens
ctttgttgcaagatgtgaat

SEQ ID NO: 962465 - DNA, 21 bp, Homo sapiens
ctttgttgcaagtactgctgt

SEQ ID NO: 962466 - DNA, 13 bp, Homo sapiens
ctttgtttagaaa

SEQ ID NO: 962467 - DNA, 14 bp, Homo sapiens
ctttgtttatgcat

SEQ ID NO: 962468 - DNA, 15 bp, Homo sapiens
ctttgtttccttgtt

SEQ ID NO: 962469 - DNA, 22 bp, Homo sapiens
ctttgtttctttttacagcatt

SEQ ID NO: 962470 - DNA, 20 bp, Homo sapiens
ctttgtttgaggcctgacgt

SEQ ID NO: 962471 - DNA, 14 bp, Homo sapiens
ctttgttttaataa

SEQ ID NO: 962472 - DNA, 19 bp, Homo sapiens
ctttgttttgcacactttg

SEQ ID NO: 962473 - DNA, 21 bp, Homo sapiens
ctttgtttttaaaatagaatg

SEQ ID NO: 962474 - DNA, 19 bp, Homo sapiens
cttttaaaaaaatttttat

SEQ ID NO: 962475 - DNA, 18 bp, Homo sapiens
cttttaaaaaacaaaaaa

SEQ ID NO: 962476 - DNA, 12 bp, Homo sapiens
cttttaaaaaat

SEQ ID NO: 962477 - DNA, 20 bp, Homo sapiens
cttttaaaataagctttctc

SEQ ID NO: 962478 - DNA, 13 bp, Homo sapiens
cttttaaaatgca

SEQ ID NO: 962479 - DNA, 15 bp, Homo sapiens
cttttaaactgtgta

SEQ ID NO: 962480 - DNA, 20 bp, Homo sapiens
cttttaaaggaatgtgaaat

SEQ ID NO: 962481 - DNA, 21 bp, Homo sapiens
cttttaaaggaatgtgaaatt

SEQ ID NO: 962482 - DNA, 10 bp, Homo sapiens
cttttaaata

SEQ ID NO: 962483 - DNA, 13 bp, Homo sapiens
cttttaaatcatc

SEQ ID NO: 962484 - DNA, 19 bp, Homo sapiens
cttttaaattagaaaatat

SEQ ID NO: 962485 - DNA, 22 bp, Homo sapiens
cttttaactgttgtagaagaca

SEQ ID NO: 962486 - DNA, 14 bp, Homo sapiens
cttttaacttcttt

SEQ ID NO: 962487 - DNA, 19 bp, Homo sapiens
gttcgagaccagcctggcc

SEQ ID NO: 962488 - DNA, 16 bp, Homo sapiens
gttcgagactccatct

SEQ ID NO: 962489 - DNA, 20 bp, Homo sapiens
gttcgcatggtcacacactg

SEQ ID NO: 962490 - DNA, 15 bp, Homo sapiens
gttcgcctctggccc

SEQ ID NO: 962491 - DNA, 14 bp, Homo sapiens
gttcgctcctccca

SEQ ID NO: 962492 - DNA, 20 bp, Homo sapiens
gttcgggggagcagagagag

SEQ ID NO: 962493 - DNA, 23 bp, Homo sapiens
gttcgtacgcccaggacagctgg

SEQ ID NO: 962494 - DNA, 17 bp, Homo sapiens
gttcgtggaaagggtgc

SEQ ID NO: 962495 - DNA, 20 bp, Homo sapiens
gttcgttggtagagccctca

SEQ ID NO: 962496 - DNA, 16 bp, Homo sapiens
gttctaagtctttcca

SEQ ID NO: 962497 - DNA, 17 bp, Homo sapiens
gttctacaagcatattt

SEQ ID NO: 962498 - DNA, 20 bp, Homo sapiens
gttctacctcaggcagctca

SEQ ID NO: 962499 - DNA, 13 bp, Homo sapiens
gttctactcaggc

SEQ ID NO: 962500 - DNA, 17 bp, Homo sapiens
gttctactgacccaact

SEQ ID NO: 962501 - DNA, 17 bp, Homo sapiens
gttctagacgcccctcc

SEQ ID NO: 962502 - DNA, 17 bp, Homo sapiens
gttctagacttccccat

SEQ ID NO: 962503 - DNA, 21 bp, Homo sapiens
gttctagacttccccatcccg

SEQ ID NO: 962504 - DNA, 18 bp, Homo sapiens
gttcttgaattgttatga

SEQ ID NO: 962505 - DNA, 22 bp, Homo sapiens
gttcttgaattgttatgaaaat

SEQ ID NO: 962506 - DNA, 19 bp, Homo sapiens
gttcttgccactgcactcc

SEQ ID NO: 962507 - DNA, 19 bp, Homo sapiens
gttcttggggccctacacc

SEQ ID NO: 962508 - DNA, 15 bp, Homo sapiens
gttcttgggggaggc

SEQ ID NO: 962509 - DNA, 22 bp, Homo sapiens
gttcttgggggaggccacccca

SEQ ID NO: 962510 - DNA, 15 bp, Homo sapiens
gttcttggtgctctg

SEQ ID NO: 962511 - DNA, 16 bp, Homo sapiens
gttcttggtgctctgt

SEQ ID NO: 962512 - DNA, 18 bp, Homo sapiens
gttcttggtgctctgtgt

SEQ ID NO: 962513 - DNA, 15 bp, Homo sapiens
gttcttggtttgtaa

SEQ ID NO: 962514 - DNA, 18 bp, Homo sapiens
gttcttggtttgtaaatt

SEQ ID NO: 962515 - DNA, 21 bp, Homo sapiens
gttcttggtttgtaaattaac

SEQ ID NO: 962516 - DNA, 16 bp, Homo sapiens
gttcttgtgcatgttt

SEQ ID NO: 962517 - DNA, 16 bp, Homo sapiens
gttcttgttttatata

SEQ ID NO: 962518 - DNA, 15 bp, Homo sapiens
gttctttaggagatt

SEQ ID NO: 962519 - DNA, 16 bp, Homo sapiens
gttctttaggagattt

SEQ ID NO: 962520 - DNA, 17 bp, Homo sapiens
gttctttaggagatttt

SEQ ID NO: 962521 - DNA, 13 bp, Homo sapiens
gttctttccaaag

SEQ ID NO: 962522 - DNA, 18 bp, Homo sapiens
gttctttccaaagtacac

SEQ ID NO: 962523 - DNA, 16 bp, Homo sapiens
gttctttcctctttct

SEQ ID NO: 962524 - DNA, 12 bp, Homo sapiens
gttctttctggg

SEQ ID NO: 962525 - DNA, 15 bp, Homo sapiens
gttctttctgggggg

SEQ ID NO: 962526 - DNA, 14 bp, Homo sapiens
gttctttcttcctc

SEQ ID NO: 962527 - DNA, 18 bp, Homo sapiens
gttctttgatttgtacca

SEQ ID NO: 962528 - DNA, 21 bp, Homo sapiens
gttctttgttcatagcccagt

SEQ ID NO: 962529 - DNA, 12 bp, Homo sapiens
gttcttttgcat

SEQ ID NO: 962530 - DNA, 13 bp, Homo sapiens
gttctttttctga

SEQ ID NO: 962531 - DNA, 21 bp, Homo sapiens
gttcttttttaagactcaatc

SEQ ID NO: 962532 - DNA, 17 bp, Homo sapiens
gttgaaaaacagctgag

SEQ ID NO: 962533 - DNA, 22 bp, Homo sapiens
gttgaaaatggtttcaagttat

SEQ ID NO: 962534 - DNA, 20 bp, Homo sapiens
gttgaaaggttttttttcag

SEQ ID NO: 962535 - DNA, 21 bp, Homo sapiens
gttgaaaggttttttttcagt

SEQ ID NO: 962536 - DNA, 23 bp, Homo sapiens
gttgaaaggttttttttcagttg

SEQ ID NO: 962537 - DNA, 16 bp, Homo sapiens
gttgaaatatgatgtt

SEQ ID NO: 962538 - DNA, 16 bp, Homo sapiens
gttgaaatatgcatac

SEQ ID NO: 962539 - DNA, 20 bp, Homo sapiens
gttgaaattatgtatgttta

SEQ ID NO: 962540 - DNA, 21 bp, Homo sapiens
gttgaacactagtctgtgtaa

SEQ ID NO: 962541 - DNA, 20 bp, Homo sapiens
gttgaaccacgtgaaactgc

SEQ ID NO: 962542 - DNA, 20 bp, Homo sapiens
gttgaactatgactggagta

SEQ ID NO: 962543 - DNA, 12 bp, Homo sapiens
gttgaacttttt

SEQ ID NO: 962544 - DNA, 22 bp, Homo sapiens
gttgaagctaagatttagagat

SEQ ID NO: 962545 - DNA, 15 bp, Homo sapiens
gttgaagggaggtga

SEQ ID NO: 962546 - DNA, 19 bp, Homo sapiens
gttgaaggtgccattttaa

SEQ ID NO: 962547 - DNA, 14 bp, Homo sapiens
gttgacaactgtga

SEQ ID NO: 962548 - DNA, 16 bp, Homo sapiens
gttgacaactgtgact

SEQ ID NO: 962549 - DNA, 19 bp, Homo sapiens
gttgacaggtacttggagg

SEQ ID NO: 962550 - DNA, 22 bp, Homo sapiens
gttgacatatttaatgttttaa

SEQ ID NO: 962551 - DNA, 23 bp, Homo sapiens
gttgacatatttaatgttttaaa

SEQ ID NO: 962552 - DNA, 18 bp, Homo sapiens
gttgacatccaaatctag

SEQ ID NO: 962553 - DNA, 18 bp, Homo sapiens
gttgacattcagaaaact

SEQ ID NO: 962554 - DNA, 17 bp, Homo sapiens
gttgacattctgaatgc

SEQ ID NO: 962555 - DNA, 18 bp, Homo sapiens
gttgacattctgaatgct

SEQ ID NO: 962556 - DNA, 21 bp, Homo sapiens
gttgacattttctttttaaat

SEQ ID NO: 962557 - DNA, 23 bp, Homo sapiens
gttgaccagataaatagaactat

SEQ ID NO: 962558 - DNA, 22 bp, Homo sapiens
gttgacctttgaggtctaaaca

SEQ ID NO: 962559 - DNA, 20 bp, Homo sapiens
gttgacttattttctctgtg

SEQ ID NO: 962560 - DNA, 21 bp, Homo sapiens
gttgacttattttctctgtgt

SEQ ID NO: 962561 - DNA, 22 bp, Homo sapiens
gttgacttccaggcacggtttg

SEQ ID NO: 962562 - DNA, 16 bp, Homo sapiens
gttgagaagcgttttt

SEQ ID NO: 962563 - DNA, 19 bp, Homo sapiens
gttgagaatcccaaatttg

SEQ ID NO: 962564 - DNA, 12 bp, Homo sapiens
gttgagacagag

SEQ ID NO: 962565 - DNA, 15 bp, Homo sapiens
gttgagagtgtgacc

SEQ ID NO: 962566 - DNA, 17 bp, Homo sapiens
gttgagagtgtgaccaa

SEQ ID NO: 962567 - DNA, 17 bp, Homo sapiens
gttgagatagttttcat

SEQ ID NO: 962568 - DNA, 19 bp, Homo sapiens
gttgagccccaagtcctga

SEQ ID NO: 962569 - DNA, 17 bp, Homo sapiens
gttgagccccagtgctg

SEQ ID NO: 962570 - DNA, 13 bp, Homo sapiens
gttgagctgtttt

SEQ ID NO: 962571 - DNA, 17 bp, Homo sapiens
gttgagggcaagccacc

SEQ ID NO: 962572 - DNA, 13 bp, Homo sapiens
gttgaggggagga

SEQ ID NO: 962573 - DNA, 17 bp, Homo sapiens
gttgaggggctcctgga

SEQ ID NO: 962574 - DNA, 20 bp, Homo sapiens
gttgaggtggaagccctcct

SEQ ID NO: 962575 - DNA, 23 bp, Homo sapiens
gttgaggtggtctgaatgttctg

SEQ ID NO: 962576 - DNA, 13 bp, Homo sapiens
gttgagtgcactg

SEQ ID NO: 962577 - DNA, 18 bp, Homo sapiens
gttgagtgcactgactgt

SEQ ID NO: 962578 - DNA, 16 bp, Homo sapiens
gttgagttctgattgt

SEQ ID NO: 962579 - DNA, 12 bp, Homo sapiens
gttgataaaaac

SEQ ID NO: 962580 - DNA, 18 bp, Homo sapiens
gttgatacaaaccactgt

SEQ ID NO: 962581 - DNA, 12 bp, Homo sapiens
gttgatagttta

SEQ ID NO: 962582 - DNA, 20 bp, Homo sapiens
gttgatctgcatatttctgt

SEQ ID NO: 962583 - DNA, 22 bp, Homo sapiens
gttgatctgcatatttctgtat

SEQ ID NO: 962584 - DNA, 19 bp, Homo sapiens
gttgatgactcgaaactga

SEQ ID NO: 962585 - DNA, 13 bp, Homo sapiens
gttgatggaaaat

SEQ ID NO: 962586 - DNA, 14 bp, Homo sapiens
gttgatggaaaata

SEQ ID NO: 962587 - DNA, 22 bp, Homo sapiens
gttgatggcaaaaaaaaaaaag

SEQ ID NO: 962588 - DNA, 17 bp, Homo sapiens
gttgatgggttctaatt

SEQ ID NO: 962589 - DNA, 21 bp, Homo sapiens
gttgatggtagggtataatgt

SEQ ID NO: 962590 - DNA, 13 bp, Homo sapiens
gttgatgtatctg

SEQ ID NO: 962591 - DNA, 14 bp, Homo sapiens
gttgatgtatctga

SEQ ID NO: 962592 - DNA, 14 bp, Homo sapiens
gttgattaaagatg

SEQ ID NO: 962593 - DNA, 13 bp, Homo sapiens
gttgattatcttc

SEQ ID NO: 962594 - DNA, 22 bp, Homo sapiens
gttgattgttataaaataacat

SEQ ID NO: 962595 - DNA, 23 bp, Homo sapiens
gttgatttcagcacctacagtgt

SEQ ID NO: 962596 - DNA, 17 bp, Homo sapiens
gttgattttgaactttt

SEQ ID NO: 962597 - DNA, 18 bp, Homo sapiens
gttgattttgaacttttt

SEQ ID NO: 962598 - DNA, 13 bp, Homo sapiens
gttgcaaccactg

SEQ ID NO: 962599 - DNA, 14 bp, Homo sapiens
gttgcaaccactgc

SEQ ID NO: 962600 - DNA, 15 bp, Homo sapiens
gttgcaaggccgctg

SEQ ID NO: 962601 - DNA, 17 bp, Homo sapiens
gttgcaaggccgctgtt

SEQ ID NO: 962602 - DNA, 17 bp, Homo sapiens
gttgcaagtactgctgt

SEQ ID NO: 962603 - DNA, 16 bp, Homo sapiens
gttgcagatgtattga

SEQ ID NO: 962604 - DNA, 17 bp, Homo sapiens
gttgcaggttcatggat

SEQ ID NO: 962605 - DNA, 17 bp, Homo sapiens
gttgcagtgagctgaga

SEQ ID NO: 962606 - DNA, 15 bp, Homo sapiens
gttgcagtggagagg

SEQ ID NO: 962607 - DNA, 16 bp, Homo sapiens
gttgcatagcagtata

SEQ ID NO: 962608 - DNA, 23 bp, Homo sapiens
gttgcatagcagtatatgttaat

SEQ ID NO: 962609 - DNA, 13 bp, Homo sapiens
gttgcatggaaat

SEQ ID NO: 962610 - DNA, 18 bp, Homo sapiens
gttgcatttgtaaaaatg

SEQ ID NO: 962611 - DNA, 17 bp, Homo sapiens
gttgccaaacagccaca

SEQ ID NO: 962612 - DNA, 15 bp, Homo sapiens
gttgccaacagttgt

SEQ ID NO: 962613 - DNA, 15 bp, Homo sapiens
gttgccaagacaaat

SEQ ID NO: 962614 - DNA, 17 bp, Homo sapiens
gttgccaccacctctgt

SEQ ID NO: 962615 - DNA, 14 bp, Homo sapiens
gttgcccaagctgg

SEQ ID NO: 962616 - DNA, 11 bp, Homo sapiens
gttgccccaga

SEQ ID NO: 962617 - DNA, 17 bp, Homo sapiens
cttttctattttttata

SEQ ID NO: 962618 - DNA, 17 bp, Homo sapiens
cttttctccaatatcag

SEQ ID NO: 962619 - DNA, 21 bp, Homo sapiens
cttttctccaatatcagtgct

SEQ ID NO: 962620 - DNA, 15 bp, Homo sapiens
cttttctccccacga

SEQ ID NO: 962621 - DNA, 15 bp, Homo sapiens
cttttctctgctctt

SEQ ID NO: 962622 - DNA, 17 bp, Homo sapiens
cttttctctggtaatat

SEQ ID NO: 962623 - DNA, 22 bp, Homo sapiens
cttttctctttaattttaactg

SEQ ID NO: 962624 - DNA, 20 bp, Homo sapiens
cttttctgattaatatattt

SEQ ID NO: 962625 - DNA, 15 bp, Homo sapiens
cttttctgcagaggg

SEQ ID NO: 962626 - DNA, 22 bp, Homo sapiens
ctttttaaaaactcttcagtgc

SEQ ID NO: 962627 - DNA, 18 bp, Homo sapiens
ctttttaaaaattgttat

SEQ ID NO: 962628 - DNA, 16 bp, Homo sapiens
ctttttaaaatatatg

SEQ ID NO: 962629 - DNA, 23 bp, Homo sapiens
ctttttaaaatatatgtatttaa

SEQ ID NO: 962630 - DNA, 13 bp, Homo sapiens
ctttttaaagttt

SEQ ID NO: 962631 - DNA, 17 bp, Homo sapiens
ctttttaaagtttgttc

SEQ ID NO: 962632 - DNA, 21 bp, Homo sapiens
ctttttaaatgtaaagatatt

SEQ ID NO: 962633 - DNA, 16 bp, Homo sapiens
ctttttaacctgcaaa

SEQ ID NO: 962634 - DNA, 16 bp, Homo sapiens
ctttttaatagcacta

SEQ ID NO: 962635 - DNA, 16 bp, Homo sapiens
ctttttaatatgctta

SEQ ID NO: 962636 - DNA, 18 bp, Homo sapiens
ctttttaatcatgaatat

SEQ ID NO: 962637 - DNA, 14 bp, Homo sapiens
ctttttaattattt

SEQ ID NO: 962638 - DNA, 14 bp, Homo sapiens
ctttttacagcatt

SEQ ID NO: 962639 - DNA, 16 bp, Homo sapiens
ctttttacctttcata

SEQ ID NO: 962640 - DNA, 15 bp, Homo sapiens
ctttttactcccctt

SEQ ID NO: 962641 - DNA, 16 bp, Homo sapiens
ctttttagaaagcatt

SEQ ID NO: 962642 - DNA, 13 bp, Homo sapiens
ctttttagttttt

SEQ ID NO: 962643 - DNA, 11 bp, Homo sapiens
ctttttataaa

SEQ ID NO: 962644 - DNA, 13 bp, Homo sapiens
ctttttataaaaa

SEQ ID NO: 962645 - DNA, 14 bp, Homo sapiens
ctttttataaaaag

SEQ ID NO: 962646 - DNA, 12 bp, Homo sapiens
ctttttatactc

SEQ ID NO: 962647 - DNA, 13 bp, Homo sapiens
ctttttatactcc

SEQ ID NO: 962648 - DNA, 23 bp, Homo sapiens
ctttttatcccatttagtgtgaa

SEQ ID NO: 962649 - DNA, 19 bp, Homo sapiens
ctttttatctgatctgtga

SEQ ID NO: 962650 - DNA, 13 bp, Homo sapiens
ctttttattaaaa

SEQ ID NO: 962651 - DNA, 18 bp, Homo sapiens
ctttttattaaaatattt

SEQ ID NO: 962652 - DNA, 15 bp, Homo sapiens
ctttttattccctgc

SEQ ID NO: 962653 - DNA, 17 bp, Homo sapiens
ctttttattccctgccc

SEQ ID NO: 962654 - DNA, 15 bp, Homo sapiens
ctttttattgaatct

SEQ ID NO: 962655 - DNA, 16 bp, Homo sapiens
ctttttatttaaatgt

SEQ ID NO: 962656 - DNA, 18 bp, Homo sapiens
ctttttatttaattaaat

SEQ ID NO: 962657 - DNA, 16 bp, Homo sapiens
ctttttatttctgata

SEQ ID NO: 962658 - DNA, 16 bp, Homo sapiens
ctttttatttctgcat

SEQ ID NO: 962659 - DNA, 15 bp, Homo sapiens
ctttttatttgagga

SEQ ID NO: 962660 - DNA, 14 bp, Homo sapiens
ctttttatttgcat

SEQ ID NO: 962661 - DNA, 21 bp, Homo sapiens
ctttttcaaaaaccagccagg

SEQ ID NO: 962662 - DNA, 21 bp, Homo sapiens
ctttttcaatggttgggacaa

SEQ ID NO: 962663 - DNA, 23 bp, Homo sapiens
ctttttcaatggttgggacaatg

SEQ ID NO: 962664 - DNA, 16 bp, Homo sapiens
ctttttcactttgaaa

SEQ ID NO: 962665 - DNA, 21 bp, Homo sapiens
ctttttcagaaacagggcagc

SEQ ID NO: 962666 - DNA, 15 bp, Homo sapiens
ctttttcattttgca

SEQ ID NO: 962667 - DNA, 23 bp, Homo sapiens
ctttttcattttgcagaaggaaa

SEQ ID NO: 962668 - DNA, 18 bp, Homo sapiens
ctttttccaatgttttat

SEQ ID NO: 962669 - DNA, 17 bp, Homo sapiens
ctttttccagcaaaatg

SEQ ID NO: 962670 - DNA, 17 bp, Homo sapiens
ctttttcccctttctgt

SEQ ID NO: 962671 - DNA, 17 bp, Homo sapiens
ctttttccttatttcaa

SEQ ID NO: 962672 - DNA, 14 bp, Homo sapiens
ctttttccttcttc

SEQ ID NO: 962673 - DNA, 16 bp, Homo sapiens
ctttttcgtctatata

SEQ ID NO: 962674 - DNA, 20 bp, Homo sapiens
ctttttctaaagtgttggtc

SEQ ID NO: 962675 - DNA, 12 bp, Homo sapiens
ctttttctaatg

SEQ ID NO: 962676 - DNA, 21 bp, Homo sapiens
ctttttctaccttgttgtgtt

SEQ ID NO: 962677 - DNA, 13 bp, Homo sapiens
ctttttctccacc

SEQ ID NO: 962678 - DNA, 21 bp, Homo sapiens
ctttttctccagctgggctct

SEQ ID NO: 962679 - DNA, 19 bp, Homo sapiens
ctttttctggaaattttgt

SEQ ID NO: 962680 - DNA, 15 bp, Homo sapiens
ctttttctgggtctc

SEQ ID NO: 962681 - DNA, 22 bp, Homo sapiens
ctttttcttaccagtctcctcc

SEQ ID NO: 962682 - DNA, 14 bp, Homo sapiens
ctttttcttgatct

SEQ ID NO: 962683 - DNA, 13 bp, Homo sapiens
ctttttgaagtgt

SEQ ID NO: 962684 - DNA, 22 bp, Homo sapiens
ctttttgaagtgtaggcagaca

SEQ ID NO: 962685 - DNA, 14 bp, Homo sapiens
ctttttgacactga

SEQ ID NO: 962686 - DNA, 15 bp, Homo sapiens
ctttttgacactgaa

SEQ ID NO: 962687 - DNA, 19 bp, Homo sapiens
ctttttgataagcacatta

SEQ ID NO: 962688 - DNA, 16 bp, Homo sapiens
ctttttgccctttagg

SEQ ID NO: 962689 - DNA, 15 bp, Homo sapiens
ctttttggaggtgct

SEQ ID NO: 962690 - DNA, 18 bp, Homo sapiens
ctttttgtaaatactgct

SEQ ID NO: 962691 - DNA, 21 bp, Homo sapiens
ctttttgtaaatactgcttga

SEQ ID NO: 962692 - DNA, 18 bp, Homo sapiens
ctttttgtataaaataga

SEQ ID NO: 962693 - DNA, 23 bp, Homo sapiens
ctttttgtttgggatcagcttct

SEQ ID NO: 962694 - DNA, 18 bp, Homo sapiens
cttttttaaaatcaactt

SEQ ID NO: 962695 - DNA, 12 bp, Homo sapiens
cttttttaaagt

SEQ ID NO: 962696 - DNA, 22 bp, Homo sapiens
cttttttaaatattttctattt

SEQ ID NO: 962697 - DNA, 16 bp, Homo sapiens
cttttttaaattaata

SEQ ID NO: 962698 - DNA, 17 bp, Homo sapiens
cttttttaacatgtgtt

SEQ ID NO: 962699 - DNA, 12 bp, Homo sapiens
cttttttaagtt

SEQ ID NO: 962700 - DNA, 16 bp, Homo sapiens
cttttttaataaacta

SEQ ID NO: 962701 - DNA, 15 bp, Homo sapiens
cttttttatatctct

SEQ ID NO: 962702 - DNA, 15 bp, Homo sapiens
cttttttatgaagaa

SEQ ID NO: 962703 - DNA, 13 bp, Homo sapiens
cttttttatgtga

SEQ ID NO: 962704 - DNA, 12 bp, Homo sapiens
cttttttatgtt

SEQ ID NO: 962705 - DNA, 12 bp, Homo sapiens
cttttttcaaaa

SEQ ID NO: 962706 - DNA, 21 bp, Homo sapiens
cttttttcacggaagttttca

SEQ ID NO: 962707 - DNA, 22 bp, Homo sapiens
cttttttcatggacactttgaa

SEQ ID NO: 962708 - DNA, 18 bp, Homo sapiens
cttttttccttaatccag

SEQ ID NO: 962709 - DNA, 20 bp, Homo sapiens
cttttttgagacatgggatc

SEQ ID NO: 962710 - DNA, 19 bp, Homo sapiens
cttttttgtacttttctgg

SEQ ID NO: 962711 - DNA, 19 bp, Homo sapiens
cttttttgtcccccaactt

SEQ ID NO: 962712 - DNA, 12 bp, Homo sapiens
cttttttgtcta

SEQ ID NO: 962713 - DNA, 21 bp, Homo sapiens
cttttttgtcttattgaaaaa

SEQ ID NO: 962714 - DNA, 14 bp, Homo sapiens
cttttttgtgtatg

SEQ ID NO: 962715 - DNA, 17 bp, Homo sapiens
cttttttgtgtatgtac

SEQ ID NO: 962716 - DNA, 18 bp, Homo sapiens
cttttttgtgtatgtact

SEQ ID NO: 962717 - DNA, 13 bp, Homo sapiens
cttttttgttttg

SEQ ID NO: 962718 - DNA, 16 bp, Homo sapiens
cttttttgttttttca

SEQ ID NO: 962719 - DNA, 15 bp, Homo sapiens
ctttttttaagtgct

SEQ ID NO: 962720 - DNA, 19 bp, Homo sapiens
ctttttttaagtgcttaca

SEQ ID NO: 962721 - DNA, 12 bp, Homo sapiens
ctttttttactt

SEQ ID NO: 962722 - DNA, 19 bp, Homo sapiens
ctttttttccatctttaca

SEQ ID NO: 962723 - DNA, 11 bp, Homo sapiens
ctttttttccc

SEQ ID NO: 962724 - DNA, 16 bp, Homo sapiens
ctttttttccttttta

SEQ ID NO: 962725 - DNA, 18 bp, Homo sapiens
ctttttttctatattatt

SEQ ID NO: 962726 - DNA, 19 bp, Homo sapiens
ctttttttctatattattg

SEQ ID NO: 962727 - DNA, 14 bp, Homo sapiens
ctttttttcttaaa

SEQ ID NO: 962728 - DNA, 18 bp, Homo sapiens
ctttttttctttaataac

SEQ ID NO: 962729 - DNA, 19 bp, Homo sapiens
ctttttttggtaaattttt

SEQ ID NO: 962730 - DNA, 21 bp, Homo sapiens
ctttttttggtaaatttttga

SEQ ID NO: 962731 - DNA, 14 bp, Homo sapiens
cttttttttaagtt

SEQ ID NO: 962732 - DNA, 13 bp, Homo sapiens
cttttttttccta

SEQ ID NO: 962733 - DNA, 16 bp, Homo sapiens
cttttttttctgattc

SEQ ID NO: 962734 - DNA, 15 bp, Homo sapiens
cttttttttctttaa

SEQ ID NO: 962735 - DNA, 18 bp, Homo sapiens
ctttttttttaagttctt

SEQ ID NO: 962736 - DNA, 21 bp, Homo sapiens
ctttttttttaagttcttatg

SEQ ID NO: 962737 - DNA, 17 bp, Homo sapiens
ctttttttttctctttc

SEQ ID NO: 962738 - DNA, 18 bp, Homo sapiens
ctttttttttctctttct

SEQ ID NO: 962739 - DNA, 22 bp, Homo sapiens
ctttttttttctctttctctcc

SEQ ID NO: 962740 - DNA, 17 bp, Homo sapiens
cttttttttttccaaat

SEQ ID NO: 962741 - DNA, 20 bp, Homo sapiens
cttttttttttccaaattat

SEQ ID NO: 962742 - DNA, 15 bp, Homo sapiens
cttttttttttttcc

SEQ ID NO: 962743 - DNA, 16 bp, Homo sapiens
cttttttttttttcca

SEQ ID NO: 962744 - DNA, 22 bp, Homo sapiens
ctttttttttttttaaagacag

SEQ ID NO: 962745 - DNA, 21 bp, Homo sapiens
ctttttttttttttttgaaag

SEQ ID NO: 962746 - DNA, 22 bp, Homo sapiens
cttttttttttttttttttaaa

SEQ ID NO: 962747 - DNA, 18 bp, Homo sapiens
gaaaaaaaaaaaagaaaa

SEQ ID NO: 962748 - DNA, 17 bp, Homo sapiens
gaaaaaaaaaaagaaaa

SEQ ID NO: 962749 - DNA, 14 bp, Homo sapiens
gtttaggctatttg

SEQ ID NO: 962750 - DNA, 16 bp, Homo sapiens
gtttagggaacaattt

SEQ ID NO: 962751 - DNA, 22 bp, Homo sapiens
gtttagtagaaacggggtttca

SEQ ID NO: 962752 - DNA, 18 bp, Homo sapiens
gaaaaaaaaaaagaaaaa

SEQ ID NO: 962753 - DNA, 20 bp, Homo sapiens
gaaaaaaaaaatgctgaaca

SEQ ID NO: 962754 - DNA, 16 bp, Homo sapiens
gaaaaaaaaaatgttg

SEQ ID NO: 962755 - DNA, 14 bp, Homo sapiens
gaaaaaaaaagaaa

SEQ ID NO: 962756 - DNA, 21 bp, Homo sapiens
gaaaaaaaaagtcagactgct

SEQ ID NO: 962757 - DNA, 13 bp, Homo sapiens
gaaaaaaaacctt

SEQ ID NO: 962758 - DNA, 15 bp, Homo sapiens
gaaaaaaaaccttgt

SEQ ID NO: 962759 - DNA, 16 bp, Homo sapiens
gaaaaaaaaccttgta

SEQ ID NO: 962760 - DNA, 19 bp, Homo sapiens
gaaaaaaaaccttgtaaaa

SEQ ID NO: 962761 - DNA, 20 bp, Homo sapiens
gaaaaaaaataacacagaga

SEQ ID NO: 962762 - DNA, 16 bp, Homo sapiens
gaaaaaaaatatatat

SEQ ID NO: 962763 - DNA, 23 bp, Homo sapiens
gaaaaaaacaaaaacagaatttg

SEQ ID NO: 962764 - DNA, 14 bp, Homo sapiens
gaaaaaaactgaag

SEQ ID NO: 962765 - DNA, 14 bp, Homo sapiens
gaaaaaaacttcat

SEQ ID NO: 962766 - DNA, 14 bp, Homo sapiens
gaaaaaaactttta

SEQ ID NO: 962767 - DNA, 12 bp, Homo sapiens
gaaaaaaagaaa

SEQ ID NO: 962768 - DNA, 17 bp, Homo sapiens
gaaaaaaataactattt

SEQ ID NO: 962769 - DNA, 13 bp, Homo sapiens
gaaaaaaatgact

SEQ ID NO: 962770 - DNA, 16 bp, Homo sapiens
gaaaaaaatgactaaa

SEQ ID NO: 962771 - DNA, 17 bp, Homo sapiens
gaaaaaaatgagactta

SEQ ID NO: 962772 - DNA, 20 bp, Homo sapiens
gaaaaaaatgtacatttatt

SEQ ID NO: 962773 - DNA, 19 bp, Homo sapiens
gaaaaaaattgaaatgtaa

SEQ ID NO: 962774 - DNA, 11 bp, Homo sapiens
gaaaaaagaaa

SEQ ID NO: 962775 - DNA, 18 bp, Homo sapiens
gaaaaaagtggaaaacat

SEQ ID NO: 962776 - DNA, 17 bp, Homo sapiens
gaaaaaagttccttcct

SEQ ID NO: 962777 - DNA, 22 bp, Homo sapiens
gaaaaaagttgtaggcgaatca

SEQ ID NO: 962778 - DNA, 17 bp, Homo sapiens
gaaaaaataacacacat

SEQ ID NO: 962779 - DNA, 14 bp, Homo sapiens
gaaaaaatactacc

SEQ ID NO: 962780 - DNA, 19 bp, Homo sapiens
gaaaaaatattttcctgcc

SEQ ID NO: 962781 - DNA, 19 bp, Homo sapiens
gaaaaaattgaaagaactt

SEQ ID NO: 962782 - DNA, 14 bp, Homo sapiens
gaaaaaatttaaaa

SEQ ID NO: 962783 - DNA, 18 bp, Homo sapiens
gaaaaacacggcagctgt

SEQ ID NO: 962784 - DNA, 14 bp, Homo sapiens
gaaaaacatcccaa

SEQ ID NO: 962785 - DNA, 21 bp, Homo sapiens
gaaaaacatcccaaactttaa

SEQ ID NO: 962786 - DNA, 18 bp, Homo sapiens
gaaaaacatctgaaagcc

SEQ ID NO: 962787 - DNA, 20 bp, Homo sapiens
gaaaaacatttaaacttttt

SEQ ID NO: 962788 - DNA, 12 bp, Homo sapiens
gaaaaacttgtg

SEQ ID NO: 962789 - DNA, 21 bp, Homo sapiens
gaaaaactttggaaccagact

SEQ ID NO: 962790 - DNA, 22 bp, Homo sapiens
gaaaaactttggaaccagactc

SEQ ID NO: 962791 - DNA, 21 bp, Homo sapiens
gaaaaacttttaggttgttac

SEQ ID NO: 962792 - DNA, 13 bp, Homo sapiens
gaaaaagaaaaaa

SEQ ID NO: 962793 - DNA, 13 bp, Homo sapiens
gaaaaagaaatgc

SEQ ID NO: 962794 - DNA, 22 bp, Homo sapiens
gaaaaagaaatgcaaaaatctc

SEQ ID NO: 962795 - DNA, 23 bp, Homo sapiens
gaaaaagaaggactgaactccat

SEQ ID NO: 962796 - DNA, 20 bp, Homo sapiens
gaaaaagagaacagaaaaca

SEQ ID NO: 962797 - DNA, 23 bp, Homo sapiens
gaaaaagatggcttatgtcatca

SEQ ID NO: 962798 - DNA, 20 bp, Homo sapiens
gaaaaagcatgatgggaaaa

SEQ ID NO: 962799 - DNA, 21 bp, Homo sapiens
gaaaaagctcctgtcctccca

SEQ ID NO: 962800 - DNA, 17 bp, Homo sapiens
gaaaaagctgcttctta

SEQ ID NO: 962801 - DNA, 17 bp, Homo sapiens
gaaaaaggatgcacaga

SEQ ID NO: 962802 - DNA, 16 bp, Homo sapiens
gaaaaaggctgtgctg

SEQ ID NO: 962803 - DNA, 23 bp, Homo sapiens
gaaaaagtacaatgaactgcttt

SEQ ID NO: 962804 - DNA, 17 bp, Homo sapiens
gaaaaataaatgtcact

SEQ ID NO: 962805 - DNA, 19 bp, Homo sapiens
gaaaaataacttcaagcaa

SEQ ID NO: 962806 - DNA, 19 bp, Homo sapiens
gaaaaatagagcaaaatca

SEQ ID NO: 962807 - DNA, 15 bp, Homo sapiens
gaaaaatagtaaaca

SEQ ID NO: 962808 - DNA, 17 bp, Homo sapiens
gaaaaatagtgtctttg

SEQ ID NO: 962809 - DNA, 16 bp, Homo sapiens
gaaaaatatcttggcc

SEQ ID NO: 962810 - DNA, 11 bp, Homo sapiens
gaaaaatattg

SEQ ID NO: 962811 - DNA, 16 bp, Homo sapiens
gaaaaatatttattca

SEQ ID NO: 962812 - DNA, 18 bp, Homo sapiens
gaaaaatatttattcatt

SEQ ID NO: 962813 - DNA, 13 bp, Homo sapiens
gaaaaatcctctt

SEQ ID NO: 962814 - DNA, 16 bp, Homo sapiens
gaaaaatctaagtgat

SEQ ID NO: 962815 - DNA, 22 bp, Homo sapiens
gaaaaatcttaagtaccaatgg

SEQ ID NO: 962816 - DNA, 14 bp, Homo sapiens
gaaaaatcttgtgc

SEQ ID NO: 962817 - DNA, 20 bp, Homo sapiens
gaaaaatgagaattttatat

SEQ ID NO: 962818 - DNA, 19 bp, Homo sapiens
gaaaaatgaggaatccaaa

SEQ ID NO: 962819 - DNA, 17 bp, Homo sapiens
gaaaaatgccactccct

SEQ ID NO: 962820 - DNA, 20 bp, Homo sapiens
gaaaaatgcccttaaatcat

SEQ ID NO: 962821 - DNA, 18 bp, Homo sapiens
gaaaaatggttgatggaa

SEQ ID NO: 962822 - DNA, 14 bp, Homo sapiens
gaaaaatgtaaata

SEQ ID NO: 962823 - DNA, 15 bp, Homo sapiens
gaaaaatgttcttta

SEQ ID NO: 962824 - DNA, 11 bp, Homo sapiens
gaaaaattaac

SEQ ID NO: 962825 - DNA, 15 bp, Homo sapiens
gaaaaattaactttt

SEQ ID NO: 962826 - DNA, 16 bp, Homo sapiens
gaaaaattaacttttt

SEQ ID NO: 962827 - DNA, 21 bp, Homo sapiens
gaaaaattattagaacattca

SEQ ID NO: 962828 - DNA, 16 bp, Homo sapiens
gaaaaatttaagcatt

SEQ ID NO: 962829 - DNA, 19 bp, Homo sapiens
gaaaaatttaagcattgtt

SEQ ID NO: 962830 - DNA, 22 bp, Homo sapiens
gaaaaatttaagcattgtttgc

SEQ ID NO: 962831 - DNA, 22 bp, Homo sapiens
gaaaacaaaaacgccttttctt

SEQ ID NO: 962832 - DNA, 18 bp, Homo sapiens
gaaaacaacttggcattt

SEQ ID NO: 962833 - DNA, 23 bp, Homo sapiens
gaaaacaacttggcatttctata

SEQ ID NO: 962834 - DNA, 12 bp, Homo sapiens
gaaaacaaggaa

SEQ ID NO: 962835 - DNA, 15 bp, Homo sapiens
gaaaacaattcagtg

SEQ ID NO: 962836 - DNA, 18 bp, Homo sapiens
gaaaacacaataaaaaat

SEQ ID NO: 962837 - DNA, 14 bp, Homo sapiens
gaaaacacagcctc

SEQ ID NO: 962838 - DNA, 17 bp, Homo sapiens
gaaaacacagcctccct

SEQ ID NO: 962839 - DNA, 14 bp, Homo sapiens
gaaaacacattttt

SEQ ID NO: 962840 - DNA, 21 bp, Homo sapiens
gaaaacactgtgcacatctgt

SEQ ID NO: 962841 - DNA, 16 bp, Homo sapiens
gaaaacagaacactta

SEQ ID NO: 962842 - DNA, 21 bp, Homo sapiens
gaaaacagaatcagtgttaaa

SEQ ID NO: 962843 - DNA, 17 bp, Homo sapiens
gaaaacagactcaggtt

SEQ ID NO: 962844 - DNA, 16 bp, Homo sapiens
gaaaacagatgaccat

SEQ ID NO: 962845 - DNA, 22 bp, Homo sapiens
gaaaacaggacttaaaatgaca

SEQ ID NO: 962846 - DNA, 14 bp, Homo sapiens
gaaaacagtacaga

SEQ ID NO: 962847 - DNA, 12 bp, Homo sapiens
gaaaacatctgg

SEQ ID NO: 962848 - DNA, 18 bp, Homo sapiens
gaaaacatgctacacact

SEQ ID NO: 962849 - DNA, 17 bp, Homo sapiens
gaaaacatttaacataa

SEQ ID NO: 962850 - DNA, 19 bp, Homo sapiens
gaaaaccacaaacggagcc

SEQ ID NO: 962851 - DNA, 20 bp, Homo sapiens
gaaaaccaggaaaagggagc

SEQ ID NO: 962852 - DNA, 22 bp, Homo sapiens
gaaaacccagagaggaatcaga

SEQ ID NO: 962853 - DNA, 20 bp, Homo sapiens
gaaaacccttgggccagaag

SEQ ID NO: 962854 - DNA, 17 bp, Homo sapiens
gaaaacctctcctgacc

SEQ ID NO: 962855 - DNA, 13 bp, Homo sapiens
gaaaacctggggg

SEQ ID NO: 962856 - DNA, 11 bp, Homo sapiens
gaaaacctttc

SEQ ID NO: 962857 - DNA, 13 bp, Homo sapiens
gaaaacggagctg

SEQ ID NO: 962858 - DNA, 22 bp, Homo sapiens
gaaaacgggcagtctgctctgc

SEQ ID NO: 962859 - DNA, 20 bp, Homo sapiens
gaaaacgttttattgtgttt

SEQ ID NO: 962860 - DNA, 18 bp, Homo sapiens
gaaaactaatgtactgta

SEQ ID NO: 962861 - DNA, 21 bp, Homo sapiens
gaaaactaatgtactgtacat

SEQ ID NO: 962862 - DNA, 22 bp, Homo sapiens
gaaaactagcattacattatta

SEQ ID NO: 962863 - DNA, 16 bp, Homo sapiens
gaaaactgaaaatcta

SEQ ID NO: 962864 - DNA, 20 bp, Homo sapiens
gaaaactgaaaatctaatat

SEQ ID NO: 962865 - DNA, 21 bp, Homo sapiens
gaaaactgctgataaaatatg

SEQ ID NO: 962866 - DNA, 18 bp, Homo sapiens
gaaaactgtgcaactttt

SEQ ID NO: 962867 - DNA, 12 bp, Homo sapiens
gaaaactgtgtt

SEQ ID NO: 962868 - DNA, 13 bp, Homo sapiens
gaaaactgtgttg

SEQ ID NO: 962869 - DNA, 14 bp, Homo sapiens
gaaaacttagccag

SEQ ID NO: 962870 - DNA, 21 bp, Homo sapiens
gaaaacttttgttttttgggg

SEQ ID NO: 962871 - DNA, 22 bp, Homo sapiens
gaaaatggctaataaactgtat

SEQ ID NO: 962872 - DNA, 14 bp, Homo sapiens
gaaaatggtatttt

SEQ ID NO: 962873 - DNA, 12 bp, Homo sapiens
gaaaatgtactg

SEQ ID NO: 962874 - DNA, 17 bp, Homo sapiens
gaaaatgtatccagagg

SEQ ID NO: 962875 - DNA, 15 bp, Homo sapiens
gaaaatgtatgtgta

SEQ ID NO: 962876 - DNA, 21 bp, Homo sapiens
gaaaatgtcagaaaccagtta

SEQ ID NO: 962877 - DNA, 13 bp, Homo sapiens
gaaaatgtcctgt

SEQ ID NO: 962878 - DNA, 23 bp, Homo sapiens
gaaaatgtctattcaaaatatca

SEQ ID NO: 962879 - DNA, 17 bp, Homo sapiens
gaaaatgtgtctctgct

SEQ ID NO: 962880 - DNA, 16 bp, Homo sapiens
gaaaatgttatttaac

SEQ ID NO: 962881 - DNA, 15 bp, Homo sapiens
gaaaatgttctgttt

SEQ ID NO: 962882 - DNA, 15 bp, Homo sapiens
gaaaatgttgagaat

SEQ ID NO: 962883 - DNA, 13 bp, Homo sapiens
gtttctgagacca

SEQ ID NO: 962884 - DNA, 22 bp, Homo sapiens
gtttctgatctgtactttgtgt

SEQ ID NO: 962885 - DNA, 22 bp, Homo sapiens
gtttctgcagcccttgggcagt

SEQ ID NO: 962886 - DNA, 14 bp, Homo sapiens
gtttctgcagtagt

SEQ ID NO: 962887 - DNA, 20 bp, Homo sapiens
gtttctgcagtagtctctgt

SEQ ID NO: 962888 - DNA, 22 bp, Homo sapiens
gtttctgcatgaatatcataca

SEQ ID NO: 962889 - DNA, 20 bp, Homo sapiens
gtttctgcattcatttttat

SEQ ID NO: 962890 - DNA, 15 bp, Homo sapiens
gtttctggataaacc

SEQ ID NO: 962891 - DNA, 16 bp, Homo sapiens
gtttctggataaacca

SEQ ID NO: 962892 - DNA, 21 bp, Homo sapiens
gtttctggataaaccaccctc

SEQ ID NO: 962893 - DNA, 20 bp, Homo sapiens
gtttctgggtccctgctccc

SEQ ID NO: 962894 - DNA, 19 bp, Homo sapiens
gtttctgggtcctgaagaa

SEQ ID NO: 962895 - DNA, 16 bp, Homo sapiens
gtttctgtcaagcata

SEQ ID NO: 962896 - DNA, 20 bp, Homo sapiens
gtttctgtctgaattattct

SEQ ID NO: 962897 - DNA, 13 bp, Homo sapiens
gtttctgtgcccc

SEQ ID NO: 962898 - DNA, 20 bp, Homo sapiens
gtttctgtggagtaaatatt

SEQ ID NO: 962899 - DNA, 12 bp, Homo sapiens
gtttctgttcca

SEQ ID NO: 962900 - DNA, 18 bp, Homo sapiens
gtttctgtttgattcttt

SEQ ID NO: 962901 - DNA, 22 bp, Homo sapiens
gtttcttaaccctttccagagt

SEQ ID NO: 962902 - DNA, 17 bp, Homo sapiens
gtttcttcctgccagca

SEQ ID NO: 962903 - DNA, 18 bp, Homo sapiens
gtttcttcctgccagcag

SEQ ID NO: 962904 - DNA, 22 bp, Homo sapiens
gtttcttctcttggtgaaataa

SEQ ID NO: 962905 - DNA, 18 bp, Homo sapiens
gtttcttgacaagctgac

SEQ ID NO: 962906 - DNA, 20 bp, Homo sapiens
gtttcttgccccagtgtggt

SEQ ID NO: 962907 - DNA, 16 bp, Homo sapiens
gtttcttgctctctct

SEQ ID NO: 962908 - DNA, 21 bp, Homo sapiens
gtttcttgctgccatgatgta

SEQ ID NO: 962909 - DNA, 15 bp, Homo sapiens
gtttcttgtgtagat

SEQ ID NO: 962910 - DNA, 17 bp, Homo sapiens
gtttcttgtgtagattt

SEQ ID NO: 962911 - DNA, 21 bp, Homo sapiens
gtttcttgtgtagatttgaaa

SEQ ID NO: 962912 - DNA, 14 bp, Homo sapiens
gtttctttacttct

SEQ ID NO: 962913 - DNA, 15 bp, Homo sapiens
gtttctttcttcctc

SEQ ID NO: 962914 - DNA, 19 bp, Homo sapiens
gtttctttcttcctcttct

SEQ ID NO: 962915 - DNA, 15 bp, Homo sapiens
gtttctttttacagc

SEQ ID NO: 962916 - DNA, 22 bp, Homo sapiens
gtttcttttttttttttttaca

SEQ ID NO: 962917 - DNA, 20 bp, Homo sapiens
gtttgaaaagcaatattgta

SEQ ID NO: 962918 - DNA, 17 bp, Homo sapiens
gtttgaaacaaagaagg

SEQ ID NO: 962919 - DNA, 21 bp, Homo sapiens
gtttgaacacgaaagaaatgt

SEQ ID NO: 962920 - DNA, 12 bp, Homo sapiens
gtttgaacttca

SEQ ID NO: 962921 - DNA, 14 bp, Homo sapiens
gtttgaatatttgt

SEQ ID NO: 962922 - DNA, 21 bp, Homo sapiens
gtttgaattcctcctctattt

SEQ ID NO: 962923 - DNA, 17 bp, Homo sapiens
gtttgactttttggaat

SEQ ID NO: 962924 - DNA, 18 bp, Homo sapiens
gtttgagatcagcctggg

SEQ ID NO: 962925 - DNA, 13 bp, Homo sapiens
gtttgagctcaga

SEQ ID NO: 962926 - DNA, 15 bp, Homo sapiens
gtttgagctcagacc

SEQ ID NO: 962927 - DNA, 16 bp, Homo sapiens
gtttgagctcagaccc

SEQ ID NO: 962928 - DNA, 13 bp, Homo sapiens
gtttgagctgcct

SEQ ID NO: 962929 - DNA, 15 bp, Homo sapiens
gtttgagctgccttc

SEQ ID NO: 962930 - DNA, 21 bp, Homo sapiens
gtttgaggcaaattaactgta

SEQ ID NO: 962931 - DNA, 16 bp, Homo sapiens
gtttgaggctgcagcg

SEQ ID NO: 962932 - DNA, 19 bp, Homo sapiens
gtttgagtttttcctccca

SEQ ID NO: 962933 - DNA, 14 bp, Homo sapiens
gtttgatcatttct

SEQ ID NO: 962934 - DNA, 20 bp, Homo sapiens
gtttgatgcattaaaagaaa

SEQ ID NO: 962935 - DNA, 19 bp, Homo sapiens
gtttgatgctatttatgca

SEQ ID NO: 962936 - DNA, 18 bp, Homo sapiens
gtttgatgtatgtgtgaa

SEQ ID NO: 962937 - DNA, 19 bp, Homo sapiens
gtttgatgtatgtgtgaaa

SEQ ID NO: 962938 - DNA, 18 bp, Homo sapiens
gtttgatgtccccaaagt

SEQ ID NO: 962939 - DNA, 18 bp, Homo sapiens
gtttgatgtttttaaagg

SEQ ID NO: 962940 - DNA, 23 bp, Homo sapiens
gtttgattaaattcttgcaaagt

SEQ ID NO: 962941 - DNA, 17 bp, Homo sapiens
gtttgatttttttaaag

SEQ ID NO: 962942 - DNA, 18 bp, Homo sapiens
gtttgcaaagaccacctc

SEQ ID NO: 962943 - DNA, 19 bp, Homo sapiens
gtttgcaaagaccacctcc

SEQ ID NO: 962944 - DNA, 20 bp, Homo sapiens
gtttgcaaatgtcagtttcc

SEQ ID NO: 962945 - DNA, 19 bp, Homo sapiens
gtttgcaccgcctgccctc

SEQ ID NO: 962946 - DNA, 14 bp, Homo sapiens
gtttgcacttcctc

SEQ ID NO: 962947 - DNA, 19 bp, Homo sapiens
gtttgcagaaaagcacctg

SEQ ID NO: 962948 - DNA, 21 bp, Homo sapiens
gtttgcagaaaagcacctgcc

SEQ ID NO: 962949 - DNA, 11 bp, Homo sapiens
gtttgcagcct

SEQ ID NO: 962950 - DNA, 19 bp, Homo sapiens
gtttgcatgattcttctct

SEQ ID NO: 962951 - DNA, 20 bp, Homo sapiens
gtttgccactttgcaaagga

SEQ ID NO: 962952 - DNA, 14 bp, Homo sapiens
gtttgccatacttt

SEQ ID NO: 962953 - DNA, 18 bp, Homo sapiens
gtttgcccagtcctgggt

SEQ ID NO: 962954 - DNA, 23 bp, Homo sapiens
gtttgcctaaaacaatctaaaac

SEQ ID NO: 962955 - DNA, 11 bp, Homo sapiens
gtttgcctgtg

SEQ ID NO: 962956 - DNA, 12 bp, Homo sapiens
gtttgcctgtga

SEQ ID NO: 962957 - DNA, 18 bp, Homo sapiens
gtttgccttctactttta

SEQ ID NO: 962958 - DNA, 17 bp, Homo sapiens
gtttgctaaaagaagag

SEQ ID NO: 962959 - DNA, 20 bp, Homo sapiens
gtttgctaatgtttccatag

SEQ ID NO: 962960 - DNA, 17 bp, Homo sapiens
gtttgctattagagcat

SEQ ID NO: 962961 - DNA, 14 bp, Homo sapiens
gtttgctcatgtaa

SEQ ID NO: 962962 - DNA, 13 bp, Homo sapiens
gtttgctgacagg

SEQ ID NO: 962963 - DNA, 16 bp, Homo sapiens
gtttgctgtgccagga

SEQ ID NO: 962964 - DNA, 17 bp, Homo sapiens
gtttgctgtgccaggag

SEQ ID NO: 962965 - DNA, 14 bp, Homo sapiens
gtttgcttaaaata

SEQ ID NO: 962966 - DNA, 15 bp, Homo sapiens
gtttgcttaaaatat

SEQ ID NO: 962967 - DNA, 18 bp, Homo sapiens
gtttgcttaaaatatgtg

SEQ ID NO: 962968 - DNA, 20 bp, Homo sapiens
gtttgctttgtatgcacttt

SEQ ID NO: 962969 - DNA, 16 bp, Homo sapiens
gtttggaatattaaaa

SEQ ID NO: 962970 - DNA, 18 bp, Homo sapiens
gtttggaccccagctggg

SEQ ID NO: 962971 - DNA, 17 bp, Homo sapiens
gtttggactgttttcaa

SEQ ID NO: 962972 - DNA, 16 bp, Homo sapiens
gtttggatacagctgc

SEQ ID NO: 962973 - DNA, 20 bp, Homo sapiens
gtttggatatgtaaaacatt

SEQ ID NO: 962974 - DNA, 15 bp, Homo sapiens
gtttggcaatagttt

SEQ ID NO: 962975 - DNA, 14 bp, Homo sapiens
gtttggcacttgta

SEQ ID NO: 962976 - DNA, 15 bp, Homo sapiens
gtttggcacttgtat

SEQ ID NO: 962977 - DNA, 17 bp, Homo sapiens
gtttggcacttgtattt

SEQ ID NO: 962978 - DNA, 21 bp, Homo sapiens
gtttggcatggtgagtgttgg

SEQ ID NO: 962979 - DNA, 15 bp, Homo sapiens
gtttggccagggagg

SEQ ID NO: 962980 - DNA, 20 bp, Homo sapiens
gtttggcccaagactgggct

SEQ ID NO: 962981 - DNA, 21 bp, Homo sapiens
gtttggcccaagactgggctg

SEQ ID NO: 962982 - DNA, 14 bp, Homo sapiens
gtttggccctggag

SEQ ID NO: 962983 - DNA, 18 bp, Homo sapiens
gtttggcctcaaaacaga

SEQ ID NO: 962984 - DNA, 21 bp, Homo sapiens
gtttggcctttcttggggaga

SEQ ID NO: 962985 - DNA, 17 bp, Homo sapiens
gtttggctataagtgct

SEQ ID NO: 962986 - DNA, 17 bp, Homo sapiens
gtttggctgtgtctaaa

SEQ ID NO: 962987 - DNA, 21 bp, Homo sapiens
gtttggctgtgtctaaactgc

SEQ ID NO: 962988 - DNA, 17 bp, Homo sapiens
gtttggcttggccttgg

SEQ ID NO: 962989 - DNA, 16 bp, Homo sapiens
gtttgggaaagatgga

SEQ ID NO: 962990 - DNA, 14 bp, Homo sapiens
gtttgggagacatg

SEQ ID NO: 962991 - DNA, 21 bp, Homo sapiens
gtttgggcagaagggagaagg

SEQ ID NO: 962992 - DNA, 20 bp, Homo sapiens
gtttggggatcgatgtgctc

SEQ ID NO: 962993 - DNA, 22 bp, Homo sapiens
gaaaggcagccctcacctctga

SEQ ID NO: 962994 - DNA, 19 bp, Homo sapiens
gaaaggcaggaagggaagc

SEQ ID NO: 962995 - DNA, 11 bp, Homo sapiens
gaaaggcaggt

SEQ ID NO: 962996 - DNA, 17 bp, Homo sapiens
gaaaggcattctctgaa

SEQ ID NO: 962997 - DNA, 20 bp, Homo sapiens
gaaaggccccaatcttgccc

SEQ ID NO: 962998 - DNA, 21 bp, Homo sapiens
gaaaggctcagtctcaggagc

SEQ ID NO: 962999 - DNA, 22 bp, Homo sapiens
gaaaggctcatttaaaacaggc

SEQ ID NO: 963000 - DNA, 15 bp, Homo sapiens
gaaaggctctgaaag

SEQ ID NO: 963001 - DNA, 17 bp, Homo sapiens
gaaaggctctgaaagcc

SEQ ID NO: 963002 - DNA, 19 bp, Homo sapiens
gaaaggctctgaaagccag

SEQ ID NO: 963003 - DNA, 22 bp, Homo sapiens
gaaaggctgttaaatacaggaa

SEQ ID NO: 963004 - DNA, 19 bp, Homo sapiens
gaaagggatgaacttggcc

SEQ ID NO: 963005 - DNA, 23 bp, Homo sapiens
gaaagggcaaagtagggcgtgtg

SEQ ID NO: 963006 - DNA, 21 bp, Homo sapiens
gaaagggcacttaatttgtaa

SEQ ID NO: 963007 - DNA, 15 bp, Homo sapiens
gaaagggccaggaga

SEQ ID NO: 963008 - DNA, 16 bp, Homo sapiens
gaaagggcctggccag

SEQ ID NO: 963009 - DNA, 20 bp, Homo sapiens
gaaagggccttgacatcagt

SEQ ID NO: 963010 - DNA, 15 bp, Homo sapiens
gaaagggctggctcc

SEQ ID NO: 963011 - DNA, 17 bp, Homo sapiens
gaaaggggacacctgta

SEQ ID NO: 963012 - DNA, 18 bp, Homo sapiens
gaaaggggagagcctgct

SEQ ID NO: 963013 - DNA, 20 bp, Homo sapiens
gaaaggggctcttctgagca

SEQ ID NO: 963014 - DNA, 17 bp, Homo sapiens
gaaaggggggagctggg

SEQ ID NO: 963015 - DNA, 16 bp, Homo sapiens
gaaagggggtcccagt

SEQ ID NO: 963016 - DNA, 16 bp, Homo sapiens
gttttctgttctttct

SEQ ID NO: 963017 - DNA, 18 bp, Homo sapiens
gttttctgtttgtaaatt

SEQ ID NO: 963018 - DNA, 16 bp, Homo sapiens
gttttcttaaccatct

SEQ ID NO: 963019 - DNA, 11 bp, Homo sapiens
gttttcttctt

SEQ ID NO: 963020 - DNA, 17 bp, Homo sapiens
gttttcttctttccctg

SEQ ID NO: 963021 - DNA, 19 bp, Homo sapiens
gttttcttgccaccctctg

SEQ ID NO: 963022 - DNA, 12 bp, Homo sapiens
gttttcttgtaa

SEQ ID NO: 963023 - DNA, 17 bp, Homo sapiens
gttttctttatgtcttt

SEQ ID NO: 963024 - DNA, 16 bp, Homo sapiens
gttttctttttctttt

SEQ ID NO: 963025 - DNA, 14 bp, Homo sapiens
gttttgaaagaaaa

SEQ ID NO: 963026 - DNA, 18 bp, Homo sapiens
gttttgaaagaaaaatac

SEQ ID NO: 963027 - DNA, 17 bp, Homo sapiens
gttttgaactaataaaa

SEQ ID NO: 963028 - DNA, 22 bp, Homo sapiens
gttttgaactaataaaagcata

SEQ ID NO: 963029 - DNA, 23 bp, Homo sapiens
gttttgaactaataaaagcataa

SEQ ID NO: 963030 - DNA, 19 bp, Homo sapiens
gttttgaagctactgtgtg

SEQ ID NO: 963031 - DNA, 21 bp, Homo sapiens
gttttgaaggcaaaattgcaa

SEQ ID NO: 963032 - DNA, 23 bp, Homo sapiens
gttttgacctttctaggttcaaa

SEQ ID NO: 963033 - DNA, 18 bp, Homo sapiens
gttttgatatttatttcc

SEQ ID NO: 963034 - DNA, 15 bp, Homo sapiens
gttttgatgctgtat

SEQ ID NO: 963035 - DNA, 20 bp, Homo sapiens
gttttgcaaagggaaacagg

SEQ ID NO: 963036 - DNA, 15 bp, Homo sapiens
gttttgcacagccaa

SEQ ID NO: 963037 - DNA, 19 bp, Homo sapiens
gttttgcacgtcttgctat

SEQ ID NO: 963038 - DNA, 13 bp, Homo sapiens
gttttgcactttt

SEQ ID NO: 963039 - DNA, 18 bp, Homo sapiens
gttttggacagtttacca

SEQ ID NO: 963040 - DNA, 14 bp, Homo sapiens
gttttggcagccag

SEQ ID NO: 963041 - DNA, 14 bp, Homo sapiens
gttttggcagctga

SEQ ID NO: 963042 - DNA, 18 bp, Homo sapiens
gttttgggatcaggagcc

SEQ ID NO: 963043 - DNA, 21 bp, Homo sapiens
gttttgggggtgtgagtgttt

SEQ ID NO: 963044 - DNA, 14 bp, Homo sapiens
gttttggtcccctc

SEQ ID NO: 963045 - DNA, 15 bp, Homo sapiens
gttttggtcccctcc

SEQ ID NO: 963046 - DNA, 17 bp, Homo sapiens
gttttggtcccctccct

SEQ ID NO: 963047 - DNA, 20 bp, Homo sapiens
gttttggtcccctccctcgt

SEQ ID NO: 963048 - DNA, 15 bp, Homo sapiens
gttttgtaaaagaaa

SEQ ID NO: 963049 - DNA, 18 bp, Homo sapiens
gttttgtaagatgctggg

SEQ ID NO: 963050 - DNA, 23 bp, Homo sapiens
gttttgtaagatgctgggttggt

SEQ ID NO: 963051 - DNA, 17 bp, Homo sapiens
gttttgtaagtaacaat

SEQ ID NO: 963052 - DNA, 18 bp, Homo sapiens
gttttgtacatagattta

SEQ ID NO: 963053 - DNA, 9 bp, Homo sapiens
gttttgtag

SEQ ID NO: 963054 - DNA, 21 bp, Homo sapiens
gttttgtataaataataaaga

SEQ ID NO: 963055 - DNA, 13 bp, Homo sapiens
gttttgtgtatat

SEQ ID NO: 963056 - DNA, 15 bp, Homo sapiens
gttttgtgtatattg

SEQ ID NO: 963057 - DNA, 20 bp, Homo sapiens
gttttgtgtatattggtgta

SEQ ID NO: 963058 - DNA, 23 bp, Homo sapiens
gttttgttcacttgttatctaat

SEQ ID NO: 963059 - DNA, 18 bp, Homo sapiens
gttttgttgacattctga

SEQ ID NO: 963060 - DNA, 19 bp, Homo sapiens
gttttgttgtgttctgttg

SEQ ID NO: 963061 - DNA, 13 bp, Homo sapiens
gttttgttgtttg

SEQ ID NO: 963062 - DNA, 16 bp, Homo sapiens
gttttgtttattaaat

SEQ ID NO: 963063 - DNA, 20 bp, Homo sapiens
gttttgtttggcaaggaaag

SEQ ID NO: 963064 - DNA, 19 bp, Homo sapiens
gttttgttttcgtttttca

SEQ ID NO: 963065 - DNA, 12 bp, Homo sapiens
gttttgttttgg

SEQ ID NO: 963066 - DNA, 13 bp, Homo sapiens
gttttgttttgta

SEQ ID NO: 963067 - DNA, 13 bp, Homo sapiens
gtttttaaaagtt

SEQ ID NO: 963068 - DNA, 18 bp, Homo sapiens
gtttttaaaagtttcaat

SEQ ID NO: 963069 - DNA, 18 bp, Homo sapiens
gtttttaaactgtacagt

SEQ ID NO: 963070 - DNA, 20 bp, Homo sapiens
gtttttaaactgtacagtgt

SEQ ID NO: 963071 - DNA, 18 bp, Homo sapiens
gtttttaaatagagtttg

SEQ ID NO: 963072 - DNA, 18 bp, Homo sapiens
gtttttaaatgaggatta

SEQ ID NO: 963073 - DNA, 17 bp, Homo sapiens
gtttttaaattgtttca

SEQ ID NO: 963074 - DNA, 15 bp, Homo sapiens
gtttttaaattttgt

SEQ ID NO: 963075 - DNA, 19 bp, Homo sapiens
gtttttaaattttgtaatg

SEQ ID NO: 963076 - DNA, 15 bp, Homo sapiens
gtttttaagctgttt

SEQ ID NO: 963077 - DNA, 15 bp, Homo sapiens
gtttttaagtcctgt

SEQ ID NO: 963078 - DNA, 16 bp, Homo sapiens
gtttttaagtcctgta

SEQ ID NO: 963079 - DNA, 24 bp, Homo sapiens
gtttttaatgaccaattgagtaag

SEQ ID NO: 963080 - DNA, 20 bp, Homo sapiens
gtttttacaaaactgctttg

SEQ ID NO: 963081 - DNA, 13 bp, Homo sapiens
gtttttacagtta

SEQ ID NO: 963082 - DNA, 14 bp, Homo sapiens
gtttttactccagt

SEQ ID NO: 963083 - DNA, 16 bp, Homo sapiens
gtttttactgctctga

SEQ ID NO: 963084 - DNA, 18 bp, Homo sapiens
gtttttactgctctgaga

SEQ ID NO: 963085 - DNA, 19 bp, Homo sapiens
gtttttagagcttccaaat

SEQ ID NO: 963086 - DNA, 20 bp, Homo sapiens
gtttttagcatgttcctcct

SEQ ID NO: 963087 - DNA, 20 bp, Homo sapiens
gtttttatattacttttgta

SEQ ID NO: 963088 - DNA, 17 bp, Homo sapiens
gtttttatgagaaactt

SEQ ID NO: 963089 - DNA, 19 bp, Homo sapiens
gtttttatggcttttgtgc

SEQ ID NO: 963090 - DNA, 16 bp, Homo sapiens
gtttttattaaaacat

SEQ ID NO: 963091 - DNA, 23 bp, Homo sapiens
gtttttattacaaattttcactg

SEQ ID NO: 963092 - DNA, 14 bp, Homo sapiens
gtttttattagtac

SEQ ID NO: 963093 - DNA, 16 bp, Homo sapiens
gtttttattttcaaga

SEQ ID NO: 963094 - DNA, 12 bp, Homo sapiens
gtttttcacatt

SEQ ID NO: 963095 - DNA, 20 bp, Homo sapiens
gtttttcagcacccccaccc

SEQ ID NO: 963096 - DNA, 14 bp, Homo sapiens
gtttttcagttttc

SEQ ID NO: 963097 - DNA, 17 bp, Homo sapiens
gtttttcatcttttgaa

SEQ ID NO: 963098 - DNA, 15 bp, Homo sapiens
gtttttcatttgttt

SEQ ID NO: 963099 - DNA, 17 bp, Homo sapiens
gtttttcatttgttttg

SEQ ID NO: 963100 - DNA, 18 bp, Homo sapiens
gtttttcatttgttttgc

SEQ ID NO: 963101 - DNA, 16 bp, Homo sapiens
gtttttcattttaaaa

SEQ ID NO: 963102 - DNA, 16 bp, Homo sapiens
gtttttccactactgc

SEQ ID NO: 963103 - DNA, 17 bp, Homo sapiens
gtttttccactactgct

SEQ ID NO: 963104 - DNA, 16 bp, Homo sapiens
gtttttcccctgctcc

SEQ ID NO: 963105 - DNA, 13 bp, Homo sapiens
gtttttccctccc

SEQ ID NO: 963106 - DNA, 17 bp, Homo sapiens
gtttttccctccccaga

SEQ ID NO: 963107 - DNA, 19 bp, Homo sapiens
gtttttccctccccagaat

SEQ ID NO: 963108 - DNA, 19 bp, Homo sapiens
gtttttccttgtatttaaa

SEQ ID NO: 963109 - DNA, 12 bp, Homo sapiens
gtttttctatat

SEQ ID NO: 963110 - DNA, 16 bp, Homo sapiens
gtttttctgggtggcc

SEQ ID NO: 963111 - DNA, 18 bp, Homo sapiens
gtttttctttttccacaa

SEQ ID NO: 963112 - DNA, 14 bp, Homo sapiens
gtttttgactcttt

SEQ ID NO: 963113 - DNA, 18 bp, Homo sapiens
gtttttgatagctttatt

SEQ ID NO: 963114 - DNA, 23 bp, Homo sapiens
gtttttgatcaaaaactatttgg

SEQ ID NO: 963115 - DNA, 12 bp, Homo sapiens
gaaattccagta

SEQ ID NO: 963116 - DNA, 14 bp, Homo sapiens
gaaattcctccttc

SEQ ID NO: 963117 - DNA, 15 bp, Homo sapiens
gaaattcctccttcc

SEQ ID NO: 963118 - DNA, 15 bp, Homo sapiens
gaaattcctgtagca

SEQ ID NO: 963119 - DNA, 19 bp, Homo sapiens
gaaattcctgtagcatctt

SEQ ID NO: 963120 - DNA, 19 bp, Homo sapiens
gaaattcgtgtgttttttt

SEQ ID NO: 963121 - DNA, 15 bp, Homo sapiens
gaaattctcctggag

SEQ ID NO: 963122 - DNA, 16 bp, Homo sapiens
gaaattctcctggagg

SEQ ID NO: 963123 - DNA, 23 bp, Homo sapiens
gaaattctttcccagtctgtcga

SEQ ID NO: 963124 - DNA, 15 bp, Homo sapiens
gaaattgaagtgtct

SEQ ID NO: 963125 - DNA, 13 bp, Homo sapiens
gaaattgacagat

SEQ ID NO: 963126 - DNA, 18 bp, Homo sapiens
gaaattgctttgtattgt

SEQ ID NO: 963127 - DNA, 14 bp, Homo sapiens
gaaattggctggat

SEQ ID NO: 963128 - DNA, 17 bp, Homo sapiens
gaaattgggtgaagagc

SEQ ID NO: 963129 - DNA, 21 bp, Homo sapiens
gaaattgtctagcagagcagg

SEQ ID NO: 963130 - DNA, 22 bp, Homo sapiens
gaaattgtttaagtgttgtaaa

SEQ ID NO: 963131 - DNA, 16 bp, Homo sapiens
gaaattgtttatgtgt

SEQ ID NO: 963132 - DNA, 20 bp, Homo sapiens
gaaatttaaactataagcaa

SEQ ID NO: 963133 - DNA, 20 bp, Homo sapiens
gaaatttaattcatgtttct

SEQ ID NO: 963134 - DNA, 16 bp, Homo sapiens
gaaatttattcacata

SEQ ID NO: 963135 - DNA, 23 bp, Homo sapiens
gaaatttcagattcccagagcaa

SEQ ID NO: 963136 - DNA, 15 bp, Homo sapiens
gaaatttgatttcta

SEQ ID NO: 963137 - DNA, 21 bp, Homo sapiens
gaaatttgatttctattcaag

SEQ ID NO: 963138 - DNA, 23 bp, Homo sapiens
gaaatttgggagagccatacata

SEQ ID NO: 963139 - DNA, 20 bp, Homo sapiens
gaaatttgttatacttcaaa

SEQ ID NO: 963140 - DNA, 21 bp, Homo sapiens
gaaatttgttatacttcaaaa

SEQ ID NO: 963141 - DNA, 22 bp, Homo sapiens
gaaattttaacctatgatattt

SEQ ID NO: 963142 - DNA, 15 bp, Homo sapiens
gaaattttatatgct

SEQ ID NO: 963143 - DNA, 20 bp, Homo sapiens
gaaattttctagactttctg

SEQ ID NO: 963144 - DNA, 13 bp, Homo sapiens
gaaattttggttt

SEQ ID NO: 963145 - DNA, 15 bp, Homo sapiens
gaaattttgtaagaa

SEQ ID NO: 963146 - DNA, 17 bp, Homo sapiens
gaaattttgtaagaagg

SEQ ID NO: 963147 - DNA, 19 bp, Homo sapiens
gaaatttttattaaattat

SEQ ID NO: 963148 - DNA, 17 bp, Homo sapiens
gaaatttttatttttct

SEQ ID NO: 963149 - DNA, 20 bp, Homo sapiens
taaaaatgtaaatattctat

SEQ ID NO: 963150 - DNA, 21 bp, Homo sapiens
taaaaatgtaaatattctata

SEQ ID NO: 963151 - DNA, 23 bp, Homo sapiens
taaaaatgtcttgctgttgacat

SEQ ID NO: 963152 - DNA, 12 bp, Homo sapiens
taaaaatgttac

SEQ ID NO: 963153 - DNA, 11 bp, Homo sapiens
taaaaatgttc

SEQ ID NO: 963154 - DNA, 17 bp, Homo sapiens
taaaaattcccttcctg

SEQ ID NO: 963155 - DNA, 13 bp, Homo sapiens
taaaaattgaact

SEQ ID NO: 963156 - DNA, 15 bp, Homo sapiens
taaaaattgaactgt

SEQ ID NO: 963157 - DNA, 14 bp, Homo sapiens
taaaaattgataga

SEQ ID NO: 963158 - DNA, 22 bp, Homo sapiens
taaaaattgttaatttttccta

SEQ ID NO: 963159 - DNA, 17 bp, Homo sapiens
taaaaattgtttcttga

SEQ ID NO: 963160 - DNA, 11 bp, Homo sapiens
taaaaatttat

SEQ ID NO: 963161 - DNA, 12 bp, Homo sapiens
taaaaatttata

SEQ ID NO: 963162 - DNA, 22 bp, Homo sapiens
taaaaatttatacaccagcaat

SEQ ID NO: 963163 - DNA, 14 bp, Homo sapiens
taaaacaaaatctg

SEQ ID NO: 963164 - DNA, 16 bp, Homo sapiens
taaaacaaaatctgaa

SEQ ID NO: 963165 - DNA, 21 bp, Homo sapiens
taaaacaaaatttgactaatt

SEQ ID NO: 963166 - DNA, 23 bp, Homo sapiens
taaaacaaagccatgccaataaa

SEQ ID NO: 963167 - DNA, 16 bp, Homo sapiens
taaaacaaaggaacta

SEQ ID NO: 963168 - DNA, 11 bp, Homo sapiens
taaaacaaata

SEQ ID NO: 963169 - DNA, 13 bp, Homo sapiens
taaaacaaccagt

SEQ ID NO: 963170 - DNA, 22 bp, Homo sapiens
taaaacaaccagttaaagccac

SEQ ID NO: 963171 - DNA, 12 bp, Homo sapiens
taaaacaagcct

SEQ ID NO: 963172 - DNA, 13 bp, Homo sapiens
taaaacaagcctt

SEQ ID NO: 963173 - DNA, 18 bp, Homo sapiens
taaaacaagccttaatct

SEQ ID NO: 963174 - DNA, 18 bp, Homo sapiens
taaaacaatattgtttct

SEQ ID NO: 963175 - DNA, 16 bp, Homo sapiens
taaaacaatgactttt

SEQ ID NO: 963176 - DNA, 19 bp, Homo sapiens
taaaacacatacaaaagaa

SEQ ID NO: 963177 - DNA, 23 bp, Homo sapiens
taaaacacttattccctcatcct

SEQ ID NO: 963178 - DNA, 17 bp, Homo sapiens
taaaacactttcaaaac

SEQ ID NO: 963179 - DNA, 21 bp, Homo sapiens
taaaacaggttataacagtgt

SEQ ID NO: 963180 - DNA, 23 bp, Homo sapiens
taaaacagtattctgtaaagctt

SEQ ID NO: 963181 - DNA, 14 bp, Homo sapiens
taaaacatagcaaa

SEQ ID NO: 963182 - DNA, 12 bp, Homo sapiens
taaaacattaat

SEQ ID NO: 963183 - DNA, 19 bp, Homo sapiens
taaaacattacttatttaa

SEQ ID NO: 963184 - DNA, 20 bp, Homo sapiens
taaaacattacttatttaac

SEQ ID NO: 963185 - DNA, 13 bp, Homo sapiens
taaaacattcaca

SEQ ID NO: 963186 - DNA, 14 bp, Homo sapiens
taaaacattcccct

SEQ ID NO: 963187 - DNA, 20 bp, Homo sapiens
taaaacatttattttgacat

SEQ ID NO: 963188 - DNA, 18 bp, Homo sapiens
taaaacatttgtttcccc

SEQ ID NO: 963189 - DNA, 13 bp, Homo sapiens
taaaaccagtaac

SEQ ID NO: 963190 - DNA, 15 bp, Homo sapiens
taaaaccagtaacgt

SEQ ID NO: 963191 - DNA, 13 bp, Homo sapiens
taaaacccaagtg

SEQ ID NO: 963192 - DNA, 19 bp, Homo sapiens
taaaacccacaagtgtcta

SEQ ID NO: 963193 - DNA, 22 bp, Homo sapiens
taaaacctaaaggttatagtag

SEQ ID NO: 963194 - DNA, 23 bp, Homo sapiens
taaaacctgggtatgttcctaag

SEQ ID NO: 963195 - DNA, 22 bp, Homo sapiens
taaaaccttgaaggtctgtcat

SEQ ID NO: 963196 - DNA, 14 bp, Homo sapiens
taaaaccttgttct

SEQ ID NO: 963197 - DNA, 10 bp, Homo sapiens
taaaaccttt

SEQ ID NO: 963198 - DNA, 14 bp, Homo sapiens
taaaacctttcaaa

SEQ ID NO: 963199 - DNA, 16 bp, Homo sapiens
taaaacctttcaaatt

SEQ ID NO: 963200 - DNA, 21 bp, Homo sapiens
taaaacctttcaaatttcaca

SEQ ID NO: 963201 - DNA, 19 bp, Homo sapiens
taaaacgaatggtctttgc

SEQ ID NO: 963202 - DNA, 19 bp, Homo sapiens
taaaacgcgtctgcctggg

SEQ ID NO: 963203 - DNA, 23 bp, Homo sapiens
taaaacggtgctgtgagggaggg

SEQ ID NO: 963204 - DNA, 14 bp, Homo sapiens
taaaactaagcaca

SEQ ID NO: 963205 - DNA, 19 bp, Homo sapiens
taaaactaaggcttttatt

SEQ ID NO: 963206 - DNA, 22 bp, Homo sapiens
taaaactatattcatttccact

SEQ ID NO: 963207 - DNA, 15 bp, Homo sapiens
taaaactatttaaaa

SEQ ID NO: 963208 - DNA, 17 bp, Homo sapiens
taaaactcactgtgatc

SEQ ID NO: 963209 - DNA, 22 bp, Homo sapiens
taaaactcagaatataacatgt

SEQ ID NO: 963210 - DNA, 17 bp, Homo sapiens
taaaactgaaataaacc

SEQ ID NO: 963211 - DNA, 22 bp, Homo sapiens
taaaactgaaataaacctgcac

SEQ ID NO: 963212 - DNA, 20 bp, Homo sapiens
taaaactgagtccatgaaaa

SEQ ID NO: 963213 - DNA, 21 bp, Homo sapiens
taaaactgagtccatgaaaat

SEQ ID NO: 963214 - DNA, 19 bp, Homo sapiens
taaaactgcacagtgctgt

SEQ ID NO: 963215 - DNA, 10 bp, Homo sapiens
taaaactgcg

SEQ ID NO: 963216 - DNA, 22 bp, Homo sapiens
taaaactgcgaggacatcaaag

SEQ ID NO: 963217 - DNA, 21 bp, Homo sapiens
taaaactgcttttttttttcc

SEQ ID NO: 963218 - DNA, 18 bp, Homo sapiens
taaaactggctttggctt

SEQ ID NO: 963219 - DNA, 22 bp, Homo sapiens
taaaactggtgggtctttaata

SEQ ID NO: 963220 - DNA, 18 bp, Homo sapiens
taaaactgtatttaagga

SEQ ID NO: 963221 - DNA, 12 bp, Homo sapiens
taaaactgtgta

SEQ ID NO: 963222 - DNA, 13 bp, Homo sapiens
taaaactgtgtaa

SEQ ID NO: 963223 - DNA, 16 bp, Homo sapiens
taaaactgtgtaaacc

SEQ ID NO: 963224 - DNA, 20 bp, Homo sapiens
taaaacttctcaagatactg

SEQ ID NO: 963225 - DNA, 20 bp, Homo sapiens
taaaacttgatgtgttatct

SEQ ID NO: 963226 - DNA, 22 bp, Homo sapiens
taaaacttgatgtgttatctct

SEQ ID NO: 963227 - DNA, 13 bp, Homo sapiens
taaaacttgctgc

SEQ ID NO: 963228 - DNA, 20 bp, Homo sapiens
taaaactttaaaaggcaact

SEQ ID NO: 963229 - DNA, 18 bp, Homo sapiens
taaaactttccaaatatt

SEQ ID NO: 963230 - DNA, 16 bp, Homo sapiens
taaaactttgctgcca

SEQ ID NO: 963231 - DNA, 15 bp, Homo sapiens
taaaactttttaaaa

SEQ ID NO: 963232 - DNA, 17 bp, Homo sapiens
taaaagaaaataaaaaa

SEQ ID NO: 963233 - DNA, 14 bp, Homo sapiens
taaaagaaataaac

SEQ ID NO: 963234 - DNA, 16 bp, Homo sapiens
taaaagaaataaacca

SEQ ID NO: 963235 - DNA, 19 bp, Homo sapiens
taaaagaaatatacagttt

SEQ ID NO: 963236 - DNA, 18 bp, Homo sapiens
taaaagaacatgcttgaa

SEQ ID NO: 963237 - DNA, 18 bp, Homo sapiens
gaacctgagctattttcc

SEQ ID NO: 963238 - DNA, 16 bp, Homo sapiens
gaacctgcacacagga

SEQ ID NO: 963239 - DNA, 15 bp, Homo sapiens
gaacctgcttcctgg

SEQ ID NO: 963240 - DNA, 21 bp, Homo sapiens
gaacctgtctccattgtgtga

SEQ ID NO: 963241 - DNA, 20 bp, Homo sapiens
gaacctgttagtctccccac

SEQ ID NO: 963242 - DNA, 20 bp, Homo sapiens
gaacctgtttaatgttatga

SEQ ID NO: 963243 - DNA, 19 bp, Homo sapiens
gaaccttccttcctgcttg

SEQ ID NO: 963244 - DNA, 21 bp, Homo sapiens
gaaccttctggcctcccacag

SEQ ID NO: 963245 - DNA, 18 bp, Homo sapiens
gaaccttggaccactcct

SEQ ID NO: 963246 - DNA, 16 bp, Homo sapiens
gaacgaaaatgaaagc

SEQ ID NO: 963247 - DNA, 18 bp, Homo sapiens
gaacgatatgtagcagaa

SEQ ID NO: 963248 - DNA, 18 bp, Homo sapiens
gaacgatccttcaaagtc

SEQ ID NO: 963249 - DNA, 18 bp, Homo sapiens
gaacgcccccccccaccc

SEQ ID NO: 963250 - DNA, 20 bp, Homo sapiens
gaacgcccccccccacccct

SEQ ID NO: 963251 - DNA, 20 bp, Homo sapiens
gaacgcgtgtgtacacggga

SEQ ID NO: 963252 - DNA, 13 bp, Homo sapiens
gaacgctctcctc

SEQ ID NO: 963253 - DNA, 13 bp, Homo sapiens
gaacgctcttagc

SEQ ID NO: 963254 - DNA, 15 bp, Homo sapiens
gaacggaagggttgg

SEQ ID NO: 963255 - DNA, 23 bp, Homo sapiens
gaacggagccccaggcctctgtg

SEQ ID NO: 963256 - DNA, 23 bp, Homo sapiens
gaacgggcagccacaggactgag

SEQ ID NO: 963257 - DNA, 18 bp, Homo sapiens
gaacgtatttagccatta

SEQ ID NO: 963258 - DNA, 15 bp, Homo sapiens
gaacgtatttctcca

SEQ ID NO: 963259 - DNA, 17 bp, Homo sapiens
gaacgtatttctccaga

SEQ ID NO: 963260 - DNA, 16 bp, Homo sapiens
gaacgtggctctgctg

SEQ ID NO: 963261 - DNA, 12 bp, Homo sapiens
gaacgtgtatgt

SEQ ID NO: 963262 - DNA, 15 bp, Homo sapiens
gaacgtgtgtccagg

SEQ ID NO: 963263 - DNA, 14 bp, Homo sapiens
gaacgttaaactat

SEQ ID NO: 963264 - DNA, 13 bp, Homo sapiens
gaacgtttctggc

SEQ ID NO: 963265 - DNA, 19 bp, Homo sapiens
gaacgttttaataattttt

SEQ ID NO: 963266 - DNA, 13 bp, Homo sapiens
gaacgttttcttc

SEQ ID NO: 963267 - DNA, 19 bp, Homo sapiens
gaacgttttcttctttccc

SEQ ID NO: 963268 - DNA, 23 bp, Homo sapiens
gaacgttttcttctttccctgga

SEQ ID NO: 963269 - DNA, 19 bp, Homo sapiens
gaacgttttttcctcagtg

SEQ ID NO: 963270 - DNA, 17 bp, Homo sapiens
gaactaaatttttcata

SEQ ID NO: 963271 - DNA, 18 bp, Homo sapiens
gaactaaatttttcatag

SEQ ID NO: 963272 - DNA, 21 bp, Homo sapiens
gaactagttttgggaaatgta

SEQ ID NO: 963273 - DNA, 22 bp, Homo sapiens
gaactatatcagtagtgtacat

SEQ ID NO: 963274 - DNA, 18 bp, Homo sapiens
gaactatctgcattatct

SEQ ID NO: 963275 - DNA, 22 bp, Homo sapiens
gaactattttcaaagacttaag

SEQ ID NO: 963276 - DNA, 15 bp, Homo sapiens
gaactcaactttgac

SEQ ID NO: 963277 - DNA, 17 bp, Homo sapiens
gaactcaccctgggagc

SEQ ID NO: 963278 - DNA, 14 bp, Homo sapiens
gaactcagaagaga

SEQ ID NO: 963279 - DNA, 20 bp, Homo sapiens
gaactcagcacattcgggac

SEQ ID NO: 963280 - DNA, 22 bp, Homo sapiens
gaactccaccgaccaactgccc

SEQ ID NO: 963281 - DNA, 19 bp, Homo sapiens
taaaatgtatatttttaaa

SEQ ID NO: 963282 - DNA, 22 bp, Homo sapiens
taaaatgtatctaagaataata

SEQ ID NO: 963283 - DNA, 15 bp, Homo sapiens
taaaatgtattcaag

SEQ ID NO: 963284 - DNA, 16 bp, Homo sapiens
taaaatgtctttccaa

SEQ ID NO: 963285 - DNA, 19 bp, Homo sapiens
taaaatgtgatttttctga

SEQ ID NO: 963286 - DNA, 13 bp, Homo sapiens
taaaatgtgtaca

SEQ ID NO: 963287 - DNA, 16 bp, Homo sapiens
taaaatgtgtacagtg

SEQ ID NO: 963288 - DNA, 18 bp, Homo sapiens
taaaatgtgtacagtgaa

SEQ ID NO: 963289 - DNA, 20 bp, Homo sapiens
taaaatgtgtatttttcaag

SEQ ID NO: 963290 - DNA, 22 bp, Homo sapiens
taaaatgttcacttttgacaaa

SEQ ID NO: 963291 - DNA, 17 bp, Homo sapiens
taaaatgttgaaaagtc

SEQ ID NO: 963292 - DNA, 20 bp, Homo sapiens
taaaatgttgaaaagtcaaa

SEQ ID NO: 963293 - DNA, 14 bp, Homo sapiens
taaaatgttgaata

SEQ ID NO: 963294 - DNA, 22 bp, Homo sapiens
taaaatgtttattccttctgta

SEQ ID NO: 963295 - DNA, 14 bp, Homo sapiens
taaaattaaatgcc

SEQ ID NO: 963296 - DNA, 14 bp, Homo sapiens
taaaattaacaaat

SEQ ID NO: 963297 - DNA, 16 bp, Homo sapiens
taaaattacgtttgtt

SEQ ID NO: 963298 - DNA, 18 bp, Homo sapiens
taaaattaggactgtata

SEQ ID NO: 963299 - DNA, 15 bp, Homo sapiens
taaaattatactgtg

SEQ ID NO: 963300 - DNA, 19 bp, Homo sapiens
taaaattatactgtgtgtg

SEQ ID NO: 963301 - DNA, 13 bp, Homo sapiens
taaaattatgagt

SEQ ID NO: 963302 - DNA, 19 bp, Homo sapiens
taaaattatggaaacagat

SEQ ID NO: 963303 - DNA, 13 bp, Homo sapiens
taaaattattcaa

SEQ ID NO: 963304 - DNA, 18 bp, Homo sapiens
taaaattcaaaagtattg

SEQ ID NO: 963305 - DNA, 17 bp, Homo sapiens
taaaattcaaacatatt

SEQ ID NO: 963306 - DNA, 18 bp, Homo sapiens
taaaattcagtttttgta

SEQ ID NO: 963307 - DNA, 18 bp, Homo sapiens
taaaattgagtgcactaa

SEQ ID NO: 963308 - DNA, 23 bp, Homo sapiens
taaaattgagttcttcctgtaat

SEQ ID NO: 963309 - DNA, 23 bp, Homo sapiens
taaaattgagtttgtagaacttt

SEQ ID NO: 963310 - DNA, 22 bp, Homo sapiens
taaaattgatttttctcttcat

SEQ ID NO: 963311 - DNA, 18 bp, Homo sapiens
taaaattgcagtttcatg

SEQ ID NO: 963312 - DNA, 24 bp, Homo sapiens
taaaattgcagtttcatgtatgta

SEQ ID NO: 963313 - DNA, 23 bp, Homo sapiens
taaaattgctatgttactatttt

SEQ ID NO: 963314 - DNA, 23 bp, Homo sapiens
taaaattgggcttgtgatttcca

SEQ ID NO: 963315 - DNA, 18 bp, Homo sapiens
taaaattgtaacctgcat

SEQ ID NO: 963316 - DNA, 14 bp, Homo sapiens
taaaattgtatgaa

SEQ ID NO: 963317 - DNA, 17 bp, Homo sapiens
taaaattgtatgaaaat

SEQ ID NO: 963318 - DNA, 23 bp, Homo sapiens
taaaattgtgatgttttgttcaa

SEQ ID NO: 963319 - DNA, 15 bp, Homo sapiens
taaaattgttatcaa

SEQ ID NO: 963320 - DNA, 15 bp, Homo sapiens
taaaattgttctact

SEQ ID NO: 963321 - DNA, 21 bp, Homo sapiens
taaaatttcataattctgaaa

SEQ ID NO: 963322 - DNA, 20 bp, Homo sapiens
taaaatttgtgtaaatttgt

SEQ ID NO: 963323 - DNA, 22 bp, Homo sapiens
taaaattttggaatatttgctt

SEQ ID NO: 963324 - DNA, 19 bp, Homo sapiens
taaaattttttaaaagttt

SEQ ID NO: 963325 - DNA, 15 bp, Homo sapiens
taaacaaaatagaaa

SEQ ID NO: 963326 - DNA, 16 bp, Homo sapiens
taaacaaaatagaaag

SEQ ID NO: 963327 - DNA, 18 bp, Homo sapiens
taaacaaaccacagcagg

SEQ ID NO: 963328 - DNA, 19 bp, Homo sapiens
taaacaaagcagtatataa

SEQ ID NO: 963329 - DNA, 23 bp, Homo sapiens
taaacaaagtttcagagtatatt

SEQ ID NO: 963330 - DNA, 19 bp, Homo sapiens
taaacaaataaaatacttt

SEQ ID NO: 963331 - DNA, 23 bp, Homo sapiens
taaacaaatatgaaaaatgtaaa

SEQ ID NO: 963332 - DNA, 17 bp, Homo sapiens
taaacaaattcatattc

SEQ ID NO: 963333 - DNA, 18 bp, Homo sapiens
taaacaaatttagaagaa

SEQ ID NO: 963334 - DNA, 21 bp, Homo sapiens
taaacaacgtgtatagtgcct

SEQ ID NO: 963335 - DNA, 23 bp, Homo sapiens
taaacaagaccacgtttctaaag

SEQ ID NO: 963336 - DNA, 15 bp, Homo sapiens
taaacaagtaagaaa

SEQ ID NO: 963337 - DNA, 21 bp, Homo sapiens
taaacaataaaaacaactttc

SEQ ID NO: 963338 - DNA, 23 bp, Homo sapiens
taaacaatctttcatgtcttgtc

SEQ ID NO: 963339 - DNA, 23 bp, Homo sapiens
taaacaatgaaatattgctgtat

SEQ ID NO: 963340 - DNA, 16 bp, Homo sapiens
taaacaatgtaaagta

SEQ ID NO: 963341 - DNA, 20 bp, Homo sapiens
taaacaatgtataaagattg

SEQ ID NO: 963342 - DNA, 22 bp, Homo sapiens
taaacaatgtataaagattgta

SEQ ID NO: 963343 - DNA, 21 bp, Homo sapiens
taaacacaacaataactttta

SEQ ID NO: 963344 - DNA, 21 bp, Homo sapiens
taaacacacagatacacacac

SEQ ID NO: 963345 - DNA, 18 bp, Homo sapiens
taaacacatgccttaaat

SEQ ID NO: 963346 - DNA, 16 bp, Homo sapiens
taaacactcaccttct

SEQ ID NO: 963347 - DNA, 15 bp, Homo sapiens
taaacactccacagt

SEQ ID NO: 963348 - DNA, 19 bp, Homo sapiens
taaacactccacagtgttt

SEQ ID NO: 963349 - DNA, 13 bp, Homo sapiens
taaacactgtaat

SEQ ID NO: 963350 - DNA, 16 bp, Homo sapiens
taaacactgtattgta

SEQ ID NO: 963351 - DNA, 16 bp, Homo sapiens
taaacagatgtattat

SEQ ID NO: 963352 - DNA, 19 bp, Homo sapiens
taaacagatttttacaaat

SEQ ID NO: 963353 - DNA, 20 bp, Homo sapiens
taaacagatttttacaaatg

SEQ ID NO: 963354 - DNA, 22 bp, Homo sapiens
taaacagcagtgttccccatct

SEQ ID NO: 963355 - DNA, 18 bp, Homo sapiens
taaacagcttcatgcctt

SEQ ID NO: 963356 - DNA, 22 bp, Homo sapiens
taaacaggaattttattttgct

SEQ ID NO: 963357 - DNA, 16 bp, Homo sapiens
tatatctgcttcagtg

SEQ ID NO: 963358 - DNA, 17 bp, Homo sapiens
tatatctgcttcagtgg

SEQ ID NO: 963359 - DNA, 13 bp, Homo sapiens
tatatctggcctc

SEQ ID NO: 963360 - DNA, 20 bp, Homo sapiens
tatatctgggttaagtgttt

SEQ ID NO: 963361 - DNA, 15 bp, Homo sapiens
tatatctgtctttta

SEQ ID NO: 963362 - DNA, 16 bp, Homo sapiens
tatatctgtttgtata

SEQ ID NO: 963363 - DNA, 21 bp, Homo sapiens
tatatctgtttgtatatttgc

SEQ ID NO: 963364 - DNA, 12 bp, Homo sapiens
tatatcttgttt

SEQ ID NO: 963365 - DNA, 17 bp, Homo sapiens
tatatcttgtttacaat

SEQ ID NO: 963366 - DNA, 18 bp, Homo sapiens
tatatcttgtttacaata

SEQ ID NO: 963367 - DNA, 17 bp, Homo sapiens
tatatgaccagaagcct

SEQ ID NO: 963368 - DNA, 19 bp, Homo sapiens
tatatgatctaatacaaag

SEQ ID NO: 963369 - DNA, 15 bp, Homo sapiens
tatatgctaattaaa

SEQ ID NO: 963370 - DNA, 16 bp, Homo sapiens
tatatgctgtatttct

SEQ ID NO: 963371 - DNA, 19 bp, Homo sapiens
tatatgctgtatttctttg

SEQ ID NO: 963372 - DNA, 23 bp, Homo sapiens
tatatgctgtatttctttgtaga

SEQ ID NO: 963373 - DNA, 15 bp, Homo sapiens
tatatggaagaaagt

SEQ ID NO: 963374 - DNA, 16 bp, Homo sapiens
tatatggaagaaagta

SEQ ID NO: 963375 - DNA, 21 bp, Homo sapiens
tatatggaggattctttcccc

SEQ ID NO: 963376 - DNA, 23 bp, Homo sapiens
tatatggaggattctttccccag

SEQ ID NO: 963377 - DNA, 18 bp, Homo sapiens
tatatggatgattcagaa

SEQ ID NO: 963378 - DNA, 19 bp, Homo sapiens
tatatggatgattcagaaa

SEQ ID NO: 963379 - DNA, 12 bp, Homo sapiens
gagggaggggaa

SEQ ID NO: 963380 - DNA, 18 bp, Homo sapiens
gagggaggggaaatgtaa

SEQ ID NO: 963381 - DNA, 12 bp, Homo sapiens
gagggaggggcc

SEQ ID NO: 963382 - DNA, 20 bp, Homo sapiens
gagggagggggcgctcagga

SEQ ID NO: 963383 - DNA, 23 bp, Homo sapiens
gagggagggggcgctcaggaccc

SEQ ID NO: 963384 - DNA, 23 bp, Homo sapiens
gagggagtctcaggaggaggctg

SEQ ID NO: 963385 - DNA, 16 bp, Homo sapiens
gagggagtgcagaaca

SEQ ID NO: 963386 - DNA, 23 bp, Homo sapiens
gagggataaccccaggcactgtt

SEQ ID NO: 963387 - DNA, 23 bp, Homo sapiens
gagggatgaagggcgagtgaatc

SEQ ID NO: 963388 - DNA, 15 bp, Homo sapiens
gagggatgctgcctg

SEQ ID NO: 963389 - DNA, 20 bp, Homo sapiens
gagggatgctgcctgagtca

SEQ ID NO: 963390 - DNA, 13 bp, Homo sapiens
gagggatgggcct

SEQ ID NO: 963391 - DNA, 20 bp, Homo sapiens
gagggatgtttggaaaaaac

SEQ ID NO: 963392 - DNA, 21 bp, Homo sapiens
gagggattctggttccagggt

SEQ ID NO: 963393 - DNA, 22 bp, Homo sapiens
gagggattttagcctcttccct

SEQ ID NO: 963394 - DNA, 22 bp, Homo sapiens
gagggcaaagatggtggctgtg

SEQ ID NO: 963395 - DNA, 20 bp, Homo sapiens
gagggcaaggggtttccaca

SEQ ID NO: 963396 - DNA, 22 bp, Homo sapiens
gagggcacattaactccctcca

SEQ ID NO: 963397 - DNA, 20 bp, Homo sapiens
gagggcactggagctgggag

SEQ ID NO: 963398 - DNA, 16 bp, Homo sapiens
gagggcactggtggcc

SEQ ID NO: 963399 - DNA, 13 bp, Homo sapiens
gagggcacttcag

SEQ ID NO: 963400 - DNA, 16 bp, Homo sapiens
gagggcacttcaggtc

SEQ ID NO: 963401 - DNA, 17 bp, Homo sapiens
gagggcagactggggca

SEQ ID NO: 963402 - DNA, 23 bp, Homo sapiens
gagggcagactggggcatcctgt

SEQ ID NO: 963403 - DNA, 16 bp, Homo sapiens
gagggcagaggctgga

SEQ ID NO: 963404 - DNA, 20 bp, Homo sapiens
gagggcagagggagaatcca

SEQ ID NO: 963405 - DNA, 21 bp, Homo sapiens
gagggcagcactgggaagctg

SEQ ID NO: 963406 - DNA, 22 bp, Homo sapiens
gagggcagcactgggaagctgg

SEQ ID NO: 963407 - DNA, 14 bp, Homo sapiens
gagggcagctgcta

SEQ ID NO: 963408 - DNA, 13 bp, Homo sapiens
gagggcaggcttg

SEQ ID NO: 963409 - DNA, 16 bp, Homo sapiens
gagggcaggcttgggg

SEQ ID NO: 963410 - DNA, 20 bp, Homo sapiens
gagggcagggtccacgcctc

SEQ ID NO: 963411 - DNA, 18 bp, Homo sapiens
gagggcatgcgcacaagg

SEQ ID NO: 963412 - DNA, 22 bp, Homo sapiens
gagggcatgcgcacaaggctga

SEQ ID NO: 963413 - DNA, 18 bp, Homo sapiens
gagggccaagacttggca

SEQ ID NO: 963414 - DNA, 12 bp, Homo sapiens
gagggccagagc

SEQ ID NO: 963415 - DNA, 21 bp, Homo sapiens
gagggccagagctagggctgc

SEQ ID NO: 963416 - DNA, 13 bp, Homo sapiens
gagggccagcagg

SEQ ID NO: 963417 - DNA, 22 bp, Homo sapiens
gagggccaggcagaatggctgc

SEQ ID NO: 963418 - DNA, 15 bp, Homo sapiens
gagggccagggaggc

SEQ ID NO: 963419 - DNA, 17 bp, Homo sapiens
gagggccagggaggcag

SEQ ID NO: 963420 - DNA, 11 bp, Homo sapiens
gagggccagtg

SEQ ID NO: 963421 - DNA, 12 bp, Homo sapiens
gagggccagtga

SEQ ID NO: 963422 - DNA, 20 bp, Homo sapiens
gagggcccagagcaggaagc

SEQ ID NO: 963423 - DNA, 14 bp, Homo sapiens
gagggcccagccca

SEQ ID NO: 963424 - DNA, 16 bp, Homo sapiens
gagggcccagcccaga

SEQ ID NO: 963425 - DNA, 14 bp, Homo sapiens
gagggcccagctgt

SEQ ID NO: 963426 - DNA, 18 bp, Homo sapiens
gagggcccagctgtagcc

SEQ ID NO: 963427 - DNA, 13 bp, Homo sapiens
gagggcccaggca

SEQ ID NO: 963428 - DNA, 16 bp, Homo sapiens
gagggcccaggcaggc

SEQ ID NO: 963429 - DNA, 11 bp, Homo sapiens
gagggcccctc

SEQ ID NO: 963430 - DNA, 17 bp, Homo sapiens
gagggcccctctgccca

SEQ ID NO: 963431 - DNA, 22 bp, Homo sapiens
gagggcccctctgcccagcttg

SEQ ID NO: 963432 - DNA, 22 bp, Homo sapiens
gagggccctgtggagtccagct

SEQ ID NO: 963433 - DNA, 14 bp, Homo sapiens
gagggccgcagggc

SEQ ID NO: 963434 - DNA, 15 bp, Homo sapiens
gagggccgcagggcc

SEQ ID NO: 963435 - DNA, 14 bp, Homo sapiens
gagggccgcccgct

SEQ ID NO: 963436 - DNA, 18 bp, Homo sapiens
gagggccggcggctctga

SEQ ID NO: 963437 - DNA, 22 bp, Homo sapiens
gagggccggcggctctgagcag

SEQ ID NO: 963438 - DNA, 23 bp, Homo sapiens
gagggccggcggctctgagcagg

SEQ ID NO: 963439 - DNA, 21 bp, Homo sapiens
gagggcctcagagcctgacct

SEQ ID NO: 963440 - DNA, 18 bp, Homo sapiens
gagggccttgcttctctt

SEQ ID NO: 963441 - DNA, 13 bp, Homo sapiens
gagggcggcaggg

SEQ ID NO: 963442 - DNA, 23 bp, Homo sapiens
gagggcggcaggggcctggagat

SEQ ID NO: 963443 - DNA, 13 bp, Homo sapiens
gagggcggccagg

SEQ ID NO: 963444 - DNA, 14 bp, Homo sapiens
gagggcggccaggg

SEQ ID NO: 963445 - DNA, 17 bp, Homo sapiens
gagggcgtcaggcagag

SEQ ID NO: 963446 - DNA, 17 bp, Homo sapiens
gagggctcagggcagtg

SEQ ID NO: 963447 - DNA, 13 bp, Homo sapiens
gagggctcctggg

SEQ ID NO: 963448 - DNA, 18 bp, Homo sapiens
gagggctcctggggcaga

SEQ ID NO: 963449 - DNA, 14 bp, Homo sapiens
gagggctgaggagc

SEQ ID NO: 963450 - DNA, 21 bp, Homo sapiens
gagggctgaggagcagccagg

SEQ ID NO: 963451 - DNA, 23 bp, Homo sapiens
gagggctgaggagcagccaggac

SEQ ID NO: 963452 - DNA, 13 bp, Homo sapiens
gagggctgccctg

SEQ ID NO: 963453 - DNA, 16 bp, Homo sapiens
gagggctggaggccca

SEQ ID NO: 963454 - DNA, 23 bp, Homo sapiens
gagggctggaggcccaggctggg

SEQ ID NO: 963455 - DNA, 10 bp, Homo sapiens
gagggctggc

SEQ ID NO: 963456 - DNA, 14 bp, Homo sapiens
gagggctggctggc

SEQ ID NO: 963457 - DNA, 21 bp, Homo sapiens
gagggctgttggacagctgct

SEQ ID NO: 963458 - DNA, 19 bp, Homo sapiens
gagggcttcctctagaagc

SEQ ID NO: 963459 - DNA, 21 bp, Homo sapiens
gagggcttcctctagaagcca

SEQ ID NO: 963460 - DNA, 17 bp, Homo sapiens
gagggcttggcccagcg

SEQ ID NO: 963461 - DNA, 19 bp, Homo sapiens
gaggggaaacaatgaaaac

SEQ ID NO: 963462 - DNA, 15 bp, Homo sapiens
gaggggaaatgtaat

SEQ ID NO: 963463 - DNA, 23 bp, Homo sapiens
gaggggaagaaggaaagggaaga

SEQ ID NO: 963464 - DNA, 13 bp, Homo sapiens
gaggggaagctgg

SEQ ID NO: 963465 - DNA, 15 bp, Homo sapiens
gaggggaagggccag

SEQ ID NO: 963466 - DNA, 16 bp, Homo sapiens
gaggggaaggggccgg

SEQ ID NO: 963467 - DNA, 18 bp, Homo sapiens
gaggggaataatagaaga

SEQ ID NO: 963468 - DNA, 19 bp, Homo sapiens
gaggggaataatagaagaa

SEQ ID NO: 963469 - DNA, 13 bp, Homo sapiens
gaggggacagagc

SEQ ID NO: 963470 - DNA, 16 bp, Homo sapiens
gaggggacagaggccc

SEQ ID NO: 963471 - DNA, 17 bp, Homo sapiens
gaggggacagaggccct

SEQ ID NO: 963472 - DNA, 17 bp, Homo sapiens
gaggggacccagctcct

SEQ ID NO: 963473 - DNA, 20 bp, Homo sapiens
gaggggacccagctcctctg

SEQ ID NO: 963474 - DNA, 22 bp, Homo sapiens
gaggggacccagctcctctgag

SEQ ID NO: 963475 - DNA, 22 bp, Homo sapiens
gaggggactatttatgaaggca

SEQ ID NO: 963476 - DNA, 12 bp, Homo sapiens
gaggggactctg

SEQ ID NO: 963477 - DNA, 15 bp, Homo sapiens
gaggggactctgggc

SEQ ID NO: 963478 - DNA, 23 bp, Homo sapiens
gaggggactctgggctatggaca

SEQ ID NO: 963479 - DNA, 17 bp, Homo sapiens
gaggtcccagccccagg

SEQ ID NO: 963480 - DNA, 22 bp, Homo sapiens
gaggtcccagccccaggcctgg

SEQ ID NO: 963481 - DNA, 17 bp, Homo sapiens
gaggtccccggttgctg

SEQ ID NO: 963482 - DNA, 18 bp, Homo sapiens
gaggtcccttcaaggcct

SEQ ID NO: 963483 - DNA, 22 bp, Homo sapiens
gaggtcccttcaaggcctcccc

SEQ ID NO: 963484 - DNA, 21 bp, Homo sapiens
gaggtcctcaggtcagctggg

SEQ ID NO: 963485 - DNA, 16 bp, Homo sapiens
gaggtctccaaactga

SEQ ID NO: 963486 - DNA, 16 bp, Homo sapiens
gaggtctctgccggct

SEQ ID NO: 963487 - DNA, 15 bp, Homo sapiens
gaggtctcttgaggg

SEQ ID NO: 963488 - DNA, 17 bp, Homo sapiens
gaggtctcttgagggag

SEQ ID NO: 963489 - DNA, 18 bp, Homo sapiens
gaggtctcttgagggagc

SEQ ID NO: 963490 - DNA, 14 bp, Homo sapiens
gaggtctgaaatgg

SEQ ID NO: 963491 - DNA, 12 bp, Homo sapiens
gaggtctgagcc

SEQ ID NO: 963492 - DNA, 19 bp, Homo sapiens
gaggtctgagccctggtgt

SEQ ID NO: 963493 - DNA, 21 bp, Homo sapiens
gaggtctgtacgttacctctt

SEQ ID NO: 963494 - DNA, 15 bp, Homo sapiens
gaggtctgtgctgag

SEQ ID NO: 963495 - DNA, 13 bp, Homo sapiens
gaggtctgtttaa

SEQ ID NO: 963496 - DNA, 14 bp, Homo sapiens
gaggtcttcagggc

SEQ ID NO: 963497 - DNA, 19 bp, Homo sapiens
gaggtctttctcctcagga

SEQ ID NO: 963498 - DNA, 16 bp, Homo sapiens
gaggtgaaagggagct

SEQ ID NO: 963499 - DNA, 17 bp, Homo sapiens
gaggtgaaattcagtta

SEQ ID NO: 963500 - DNA, 18 bp, Homo sapiens
gaggtgaacattaaaata

SEQ ID NO: 963501 - DNA, 16 bp, Homo sapiens
gaggtgagaactcaga

SEQ ID NO: 963502 - DNA, 17 bp, Homo sapiens
gaggtgagcggatcaca

SEQ ID NO: 963503 - DNA, 20 bp, Homo sapiens
gaggtgattctcagggctgg

SEQ ID NO: 963504 - DNA, 21 bp, Homo sapiens
gaggtgattctcagggctgga

SEQ ID NO: 963505 - DNA, 17 bp, Homo sapiens
gaggtgccagcaactga

SEQ ID NO: 963506 - DNA, 19 bp, Homo sapiens
gaggtggaagaagggagaa

SEQ ID NO: 963507 - DNA, 12 bp, Homo sapiens
gaggtggagaaa

SEQ ID NO: 963508 - DNA, 18 bp, Homo sapiens
tatatttttttaatttaa

SEQ ID NO: 963509 - DNA, 14 bp, Homo sapiens
tatcaaaatagtct

SEQ ID NO: 963510 - DNA, 13 bp, Homo sapiens
tatcaaaatgtag

SEQ ID NO: 963511 - DNA, 13 bp, Homo sapiens
tatcaaaattcta

SEQ ID NO: 963512 - DNA, 19 bp, Homo sapiens
tatcaaacaccaacataaa

SEQ ID NO: 963513 - DNA, 20 bp, Homo sapiens
tatcaaacagccccagtctt

SEQ ID NO: 963514 - DNA, 21 bp, Homo sapiens
tatcaaaccctagccttgctt

SEQ ID NO: 963515 - DNA, 13 bp, Homo sapiens
tatcaaactgaag

SEQ ID NO: 963516 - DNA, 16 bp, Homo sapiens
tatcaaagagaagatg

SEQ ID NO: 963517 - DNA, 21 bp, Homo sapiens
tatcaaagagaagatgcctgt

SEQ ID NO: 963518 - DNA, 19 bp, Homo sapiens
tatcaaatgcagtatattt

SEQ ID NO: 963519 - DNA, 18 bp, Homo sapiens
tatcaaatgccttcatga

SEQ ID NO: 963520 - DNA, 19 bp, Homo sapiens
tatcaaccccagacactgg

SEQ ID NO: 963521 - DNA, 21 bp, Homo sapiens
tatcaaccccagacactggtt

SEQ ID NO: 963522 - DNA, 14 bp, Homo sapiens
tatcaactctgaag

SEQ ID NO: 963523 - DNA, 16 bp, Homo sapiens
tatcaactctgaagct

SEQ ID NO: 963524 - DNA, 20 bp, Homo sapiens
tatcaagagagtaaacagac

SEQ ID NO: 963525 - DNA, 21 bp, Homo sapiens
tatcaagcttaatatgtgctg

SEQ ID NO: 963526 - DNA, 20 bp, Homo sapiens
tatcaaggattttcatgttg

SEQ ID NO: 963527 - DNA, 22 bp, Homo sapiens
tatcaaggattttcatgttgat

SEQ ID NO: 963528 - DNA, 18 bp, Homo sapiens
tatcaagtccatgttatt

SEQ ID NO: 963529 - DNA, 22 bp, Homo sapiens
tatcaagtccatgttattctct

SEQ ID NO: 963530 - DNA, 17 bp, Homo sapiens
tatcaagtggcatgtgc

SEQ ID NO: 963531 - DNA, 19 bp, Homo sapiens
tatcaatataatgttttta

SEQ ID NO: 963532 - DNA, 14 bp, Homo sapiens
tatcaatatctaat

SEQ ID NO: 963533 - DNA, 18 bp, Homo sapiens
tatcaatatctaatatat

SEQ ID NO: 963534 - DNA, 21 bp, Homo sapiens
tatcaatatctaatatatatg

SEQ ID NO: 963535 - DNA, 14 bp, Homo sapiens
tatcaattcttgag

SEQ ID NO: 963536 - DNA, 16 bp, Homo sapiens
tatcaattggcagtga

SEQ ID NO: 963537 - DNA, 21 bp, Homo sapiens
tatcaattggcagtgactttg

SEQ ID NO: 963538 - DNA, 13 bp, Homo sapiens
tatcacacttctg

SEQ ID NO: 963539 - DNA, 12 bp, Homo sapiens
tatcacagtgtt

SEQ ID NO: 963540 - DNA, 15 bp, Homo sapiens
tatcacatgtgaaaa

SEQ ID NO: 963541 - DNA, 20 bp, Homo sapiens
tatcacatgtgaaaagctta

SEQ ID NO: 963542 - DNA, 20 bp, Homo sapiens
tatcacattaatctcaaaga

SEQ ID NO: 963543 - DNA, 15 bp, Homo sapiens
tatcaccagctgcct

SEQ ID NO: 963544 - DNA, 17 bp, Homo sapiens
tatcaccagctgcctct

SEQ ID NO: 963545 - DNA, 18 bp, Homo sapiens
tatcacccagaagaaaat

SEQ ID NO: 963546 - DNA, 22 bp, Homo sapiens
tatcacccagaagaaaatagtg

SEQ ID NO: 963547 - DNA, 20 bp, Homo sapiens
tatcaccctaattaatagaa

SEQ ID NO: 963548 - DNA, 23 bp, Homo sapiens
tatcacctaagcacttctagaat

SEQ ID NO: 963549 - DNA, 14 bp, Homo sapiens
tatcacctcatggc

SEQ ID NO: 963550 - DNA, 15 bp, Homo sapiens
tatcacctcattctg

SEQ ID NO: 963551 - DNA, 18 bp, Homo sapiens
tatcacctcattctgaac

SEQ ID NO: 963552 - DNA, 15 bp, Homo sapiens
tatcacctcccctcc

SEQ ID NO: 963553 - DNA, 18 bp, Homo sapiens
tatcacctctcttcagcc

SEQ ID NO: 963554 - DNA, 15 bp, Homo sapiens
tatcacgatttgcag

SEQ ID NO: 963555 - DNA, 21 bp, Homo sapiens
tatcacgttgaaccacgtgaa

SEQ ID NO: 963556 - DNA, 13 bp, Homo sapiens
tatcactaaataa

SEQ ID NO: 963557 - DNA, 16 bp, Homo sapiens
tatcactaaataaaca

SEQ ID NO: 963558 - DNA, 20 bp, Homo sapiens
tatcactaaataaacacgat

SEQ ID NO: 963559 - DNA, 20 bp, Homo sapiens
tatcactgtgcagttgctgt

SEQ ID NO: 963560 - DNA, 14 bp, Homo sapiens
tatcagaagaccac

SEQ ID NO: 963561 - DNA, 23 bp, Homo sapiens
tatcagaagaccacaaaaattga

SEQ ID NO: 963562 - DNA, 20 bp, Homo sapiens
tatcagaatacttgcactct

SEQ ID NO: 963563 - DNA, 10 bp, Homo sapiens
tatcagaatt

SEQ ID NO: 963564 - DNA, 23 bp, Homo sapiens
tatcagacgtgctccctcccatc

SEQ ID NO: 963565 - DNA, 16 bp, Homo sapiens
tatcagaggtctattt

SEQ ID NO: 963566 - DNA, 13 bp, Homo sapiens
tatcagatacatc

SEQ ID NO: 963567 - DNA, 15 bp, Homo sapiens
tatcagatacatcac

SEQ ID NO: 963568 - DNA, 16 bp, Homo sapiens
tatcagatacatcact

SEQ ID NO: 963569 - DNA, 19 bp, Homo sapiens
tatcagatacatcactgct

SEQ ID NO: 963570 - DNA, 22 bp, Homo sapiens
tatcagcaatactcatcagagc

SEQ ID NO: 963571 - DNA, 15 bp, Homo sapiens
tatcagccagccttc

SEQ ID NO: 963572 - DNA, 13 bp, Homo sapiens
tatcagcctgagt

SEQ ID NO: 963573 - DNA, 22 bp, Homo sapiens
tatcagggaaactaagattctt

SEQ ID NO: 963574 - DNA, 15 bp, Homo sapiens
tatcagtaaataact

SEQ ID NO: 963575 - DNA, 12 bp, Homo sapiens
tatcagtacctc

SEQ ID NO: 963576 - DNA, 9 bp, Homo sapiens
tatcagtag

SEQ ID NO: 963577 - DNA, 15 bp, Homo sapiens
tatcagtagtgtaca

SEQ ID NO: 963578 - DNA, 16 bp, Homo sapiens
tatcagtagtgtacat

SEQ ID NO: 963579 - DNA, 14 bp, Homo sapiens
tatcagtattctga

SEQ ID NO: 963580 - DNA, 20 bp, Homo sapiens
tatcagtattctgacatgta

SEQ ID NO: 963581 - DNA, 20 bp, Homo sapiens
tatcagtcaatatttttaga

SEQ ID NO: 963582 - DNA, 22 bp, Homo sapiens
tatcagtcataactaaataaag

SEQ ID NO: 963583 - DNA, 16 bp, Homo sapiens
tatcagtgacagagtt

SEQ ID NO: 963584 - DNA, 13 bp, Homo sapiens
tatcagtgcttcc

SEQ ID NO: 963585 - DNA, 22 bp, Homo sapiens
tatcagttaaaatcacatttta

SEQ ID NO: 963586 - DNA, 16 bp, Homo sapiens
tatcagttactcagcc

SEQ ID NO: 963587 - DNA, 17 bp, Homo sapiens
tatcagttactcagccc

SEQ ID NO: 963588 - DNA, 19 bp, Homo sapiens
tatcagttactcagccctg

SEQ ID NO: 963589 - DNA, 21 bp, Homo sapiens
tatcagttgagcttcatatac

SEQ ID NO: 963590 - DNA, 13 bp, Homo sapiens
tatcataaagcat

SEQ ID NO: 963591 - DNA, 23 bp, Homo sapiens
tatcataagttatgcctctgaca

SEQ ID NO: 963592 - DNA, 16 bp, Homo sapiens
tatcatacaaatcagt

SEQ ID NO: 963593 - DNA, 13 bp, Homo sapiens
tatcatacagttt

SEQ ID NO: 963594 - DNA, 15 bp, Homo sapiens
tatcatactgagact

SEQ ID NO: 963595 - DNA, 15 bp, Homo sapiens
tatcatactgttcaa

SEQ ID NO: 963596 - DNA, 15 bp, Homo sapiens
tatcatattggtatt

SEQ ID NO: 963597 - DNA, 20 bp, Homo sapiens
tatcatcacgtatgttatac

SEQ ID NO: 963598 - DNA, 18 bp, Homo sapiens
tatcatcagatagcatct

SEQ ID NO: 963599 - DNA, 20 bp, Homo sapiens
tatcatcccaacagccaaga

SEQ ID NO: 963600 - DNA, 15 bp, Homo sapiens
tatcatctcttaaat

SEQ ID NO: 963601 - DNA, 12 bp, Homo sapiens
gagtcacactca

SEQ ID NO: 963602 - DNA, 17 bp, Homo sapiens
gagtcacattctgctta

SEQ ID NO: 963603 - DNA, 12 bp, Homo sapiens
gagtcacctgca

SEQ ID NO: 963604 - DNA, 15 bp, Homo sapiens
gagtcacctgcaagc

SEQ ID NO: 963605 - DNA, 23 bp, Homo sapiens
gagtcacctgcaagccccagggc

SEQ ID NO: 963606 - DNA, 14 bp, Homo sapiens
gagtcacctgctcc

SEQ ID NO: 963607 - DNA, 22 bp, Homo sapiens
gagtcaccttcccttgccactt

SEQ ID NO: 963608 - DNA, 14 bp, Homo sapiens
gagtcaccttttct

SEQ ID NO: 963609 - DNA, 21 bp, Homo sapiens
gagtcaccttttctgtggctg

SEQ ID NO: 963610 - DNA, 15 bp, Homo sapiens
gagtcactacaactg

SEQ ID NO: 963611 - DNA, 22 bp, Homo sapiens
gagtcagaatgtgaaaaaggaa

SEQ ID NO: 963612 - DNA, 22 bp, Homo sapiens
gagtcagacattttaagatggt

SEQ ID NO: 963613 - DNA, 22 bp, Homo sapiens
gagtcagagccctggctgggtt

SEQ ID NO: 963614 - DNA, 14 bp, Homo sapiens
gagtcagaggagaa

SEQ ID NO: 963615 - DNA, 14 bp, Homo sapiens
gagtcagccaggag

SEQ ID NO: 963616 - DNA, 12 bp, Homo sapiens
gagtcagccctt

SEQ ID NO: 963617 - DNA, 22 bp, Homo sapiens
gagtcagcccttggcttctgct

SEQ ID NO: 963618 - DNA, 11 bp, Homo sapiens
gagtcagcctt

SEQ ID NO: 963619 - DNA, 15 bp, Homo sapiens
gagtcagctctctgc

SEQ ID NO: 963620 - DNA, 17 bp, Homo sapiens
gagtcagctctctgccc

SEQ ID NO: 963621 - DNA, 17 bp, Homo sapiens
gagtcaggggctctgtg

SEQ ID NO: 963622 - DNA, 18 bp, Homo sapiens
gagtcaggggctctgtgt

SEQ ID NO: 963623 - DNA, 18 bp, Homo sapiens
gagtcatgatctccctgc

SEQ ID NO: 963624 - DNA, 18 bp, Homo sapiens
gagtcattcgttctgtgg

SEQ ID NO: 963625 - DNA, 13 bp, Homo sapiens
gagtcatttgagt

SEQ ID NO: 963626 - DNA, 20 bp, Homo sapiens
gagtcatttgtttaaacaat

SEQ ID NO: 963627 - DNA, 21 bp, Homo sapiens
gagtccaactcacttccagtg

SEQ ID NO: 963628 - DNA, 12 bp, Homo sapiens
gagtccaaggcc

SEQ ID NO: 963629 - DNA, 13 bp, Homo sapiens
gagtccaaggcca

SEQ ID NO: 963630 - DNA, 17 bp, Homo sapiens
gagtccactgtggcact

SEQ ID NO: 963631 - DNA, 21 bp, Homo sapiens
gagtccagctccccccaagat

SEQ ID NO: 963632 - DNA, 16 bp, Homo sapiens
gagtccaggcacagga

SEQ ID NO: 963633 - DNA, 18 bp, Homo sapiens
gagtccagtgctctgcct

SEQ ID NO: 963634 - DNA, 21 bp, Homo sapiens
gagtccagtgctctgcctcag

SEQ ID NO: 963635 - DNA, 13 bp, Homo sapiens
gagtccatgaaaa

SEQ ID NO: 963636 - DNA, 22 bp, Homo sapiens
tatccacaaagtactcctcact

SEQ ID NO: 963637 - DNA, 22 bp, Homo sapiens
tatccacataaatgctccttgt

SEQ ID NO: 963638 - DNA, 15 bp, Homo sapiens
tatccacccagcagg

SEQ ID NO: 963639 - DNA, 14 bp, Homo sapiens
tatccacctcccta

SEQ ID NO: 963640 - DNA, 15 bp, Homo sapiens
tatccacttttcttc

SEQ ID NO: 963641 - DNA, 16 bp, Homo sapiens
tatccagaaggggagc

SEQ ID NO: 963642 - DNA, 12 bp, Homo sapiens
tatccagaggaa

SEQ ID NO: 963643 - DNA, 11 bp, Homo sapiens
tatccaggact

SEQ ID NO: 963644 - DNA, 15 bp, Homo sapiens
tatccaggcaccagg

SEQ ID NO: 963645 - DNA, 15 bp, Homo sapiens
tatccagttcctgct

SEQ ID NO: 963646 - DNA, 20 bp, Homo sapiens
tatccagttcctgctctctg

SEQ ID NO: 963647 - DNA, 23 bp, Homo sapiens
tatccataggtttctctccctcc

SEQ ID NO: 963648 - DNA, 22 bp, Homo sapiens
tatccatattgagtcaaatggt

SEQ ID NO: 963649 - DNA, 13 bp, Homo sapiens
tatccatctcctg

SEQ ID NO: 963650 - DNA, 12 bp, Homo sapiens
tatccatctttt

SEQ ID NO: 963651 - DNA, 15 bp, Homo sapiens
tatccatgtactgta

SEQ ID NO: 963652 - DNA, 22 bp, Homo sapiens
tatccatgtactgtagtttttc

SEQ ID NO: 963653 - DNA, 15 bp, Homo sapiens
tatccatgtacttgt

SEQ ID NO: 963654 - DNA, 15 bp, Homo sapiens
tatccattacgtgca

SEQ ID NO: 963655 - DNA, 23 bp, Homo sapiens
tatccatttcttttactctgtgt

SEQ ID NO: 963656 - DNA, 17 bp, Homo sapiens
tatcccaaacttcggaa

SEQ ID NO: 963657 - DNA, 20 bp, Homo sapiens
tatcccaagaccctgccccc

SEQ ID NO: 963658 - DNA, 20 bp, Homo sapiens
tatcccaatcaaagaattac

SEQ ID NO: 963659 - DNA, 16 bp, Homo sapiens
tatcccacatccaact

SEQ ID NO: 963660 - DNA, 20 bp, Homo sapiens
tatcccacccaacagctcag

SEQ ID NO: 963661 - DNA, 22 bp, Homo sapiens
tatcccacctgacatgtccttc

SEQ ID NO: 963662 - DNA, 18 bp, Homo sapiens
tatcccagagaacaatca

SEQ ID NO: 963663 - DNA, 14 bp, Homo sapiens
tatcccctgcctcc

SEQ ID NO: 963664 - DNA, 15 bp, Homo sapiens
tatccctacatgtat

SEQ ID NO: 963665 - DNA, 14 bp, Homo sapiens
tatccctcccctct

SEQ ID NO: 963666 - DNA, 14 bp, Homo sapiens
tatccctcttgtaa

SEQ ID NO: 963667 - DNA, 11 bp, Homo sapiens
tatccctgccc

SEQ ID NO: 963668 - DNA, 16 bp, Homo sapiens
tatccctgcccagcct

SEQ ID NO: 963669 - DNA, 17 bp, Homo sapiens
tatccctgcccagcctg

SEQ ID NO: 963670 - DNA, 13 bp, Homo sapiens
tatccctttcctg

SEQ ID NO: 963671 - DNA, 16 bp, Homo sapiens
tatcctaaacatcatt

SEQ ID NO: 963672 - DNA, 14 bp, Homo sapiens
tatcctaaacttta

SEQ ID NO: 963673 - DNA, 14 bp, Homo sapiens
tatcctacttcccc

SEQ ID NO: 963674 - DNA, 13 bp, Homo sapiens
tatcctcacataa

SEQ ID NO: 963675 - DNA, 11 bp, Homo sapiens
tatcctcaggg

SEQ ID NO: 963676 - DNA, 13 bp, Homo sapiens
tatcctccctgcc

SEQ ID NO: 963677 - DNA, 20 bp, Homo sapiens
tatcctccctggcagacaca

SEQ ID NO: 963678 - DNA, 17 bp, Homo sapiens
tatcctctctctcttct

SEQ ID NO: 963679 - DNA, 15 bp, Homo sapiens
tatcctctcttcctc

SEQ ID NO: 963680 - DNA, 12 bp, Homo sapiens
tatcctctgtaa

SEQ ID NO: 963681 - DNA, 16 bp, Homo sapiens
tatcctgaaatttcag

SEQ ID NO: 963682 - DNA, 14 bp, Homo sapiens
tatcctgataaaca

SEQ ID NO: 963683 - DNA, 15 bp, Homo sapiens
tatcctgattccaaa

SEQ ID NO: 963684 - DNA, 18 bp, Homo sapiens
tatcctgattccaaatat

SEQ ID NO: 963685 - DNA, 19 bp, Homo sapiens
tatcctgattccaaatatg

SEQ ID NO: 963686 - DNA, 10 bp, Homo sapiens
tatcctgccc

SEQ ID NO: 963687 - DNA, 11 bp, Homo sapiens
tatcctgcctc

SEQ ID NO: 963688 - DNA, 12 bp, Homo sapiens
tatcctgcctca

SEQ ID NO: 963689 - DNA, 17 bp, Homo sapiens
tatcctgcgaccttgca

SEQ ID NO: 963690 - DNA, 20 bp, Homo sapiens
tatcctgctagcaggccccc

SEQ ID NO: 963691 - DNA, 22 bp, Homo sapiens
tatcctgctgaaagtcctgctt

SEQ ID NO: 963692 - DNA, 22 bp, Homo sapiens
tatcctgcttctgatatgcagt

SEQ ID NO: 963693 - DNA, 15 bp, Homo sapiens
tatcctggccctggg

SEQ ID NO: 963694 - DNA, 16 bp, Homo sapiens
tatcctggccctgggg

SEQ ID NO: 963695 - DNA, 17 bp, Homo sapiens
tatcctggccctggggg

SEQ ID NO: 963696 - DNA, 19 bp, Homo sapiens
tatcctggccttgtacttg

SEQ ID NO: 963697 - DNA, 22 bp, Homo sapiens
tatcctggggctcccttcatct

SEQ ID NO: 963698 - DNA, 11 bp, Homo sapiens
tatcctggtgc

SEQ ID NO: 963699 - DNA, 12 bp, Homo sapiens
tatcctgtattc

SEQ ID NO: 963700 - DNA, 16 bp, Homo sapiens
tatcctgtgactgtct

SEQ ID NO: 963701 - DNA, 19 bp, Homo sapiens
tatccttaggaaaatgctt

SEQ ID NO: 963702 - DNA, 21 bp, Homo sapiens
tatccttaggaaaatgcttct

SEQ ID NO: 963703 - DNA, 16 bp, Homo sapiens
tatccttctacttgtc

SEQ ID NO: 963704 - DNA, 18 bp, Homo sapiens
tatcctttcatatagtta

SEQ ID NO: 963705 - DNA, 24 bp, Homo sapiens
tatcctttcctcattaaattacct

SEQ ID NO: 963706 - DNA, 22 bp, Homo sapiens
tatcctttgtggcaccttttct

SEQ ID NO: 963707 - DNA, 17 bp, Homo sapiens
tatcgaatatagttctg

SEQ ID NO: 963708 - DNA, 18 bp, Homo sapiens
tatcgaatatagttctgt

SEQ ID NO: 963709 - DNA, 16 bp, Homo sapiens
tatcgagtttgcaatg

SEQ ID NO: 963710 - DNA, 20 bp, Homo sapiens
tatcgcaccactgtgtattt

SEQ ID NO: 963711 - DNA, 18 bp, Homo sapiens
tatcgccctcctttccct

SEQ ID NO: 963712 - DNA, 15 bp, Homo sapiens
tatcggaagcagtgc

SEQ ID NO: 963713 - DNA, 16 bp, Homo sapiens
tatcggagacagtgat

SEQ ID NO: 963714 - DNA, 14 bp, Homo sapiens
tatcgggaacagtg

SEQ ID NO: 963715 - DNA, 17 bp, Homo sapiens
tatcgggagcagtgtct

SEQ ID NO: 963716 - DNA, 18 bp, Homo sapiens
tatcgggagcagtgtctt

SEQ ID NO: 963717 - DNA, 13 bp, Homo sapiens
tatctaaagttat

SEQ ID NO: 963718 - DNA, 18 bp, Homo sapiens
tatctaaagttatatttc

SEQ ID NO: 963719 - DNA, 20 bp, Homo sapiens
tatctaaagttatatttcag

SEQ ID NO: 963720 - DNA, 22 bp, Homo sapiens
tatctaaatatggactgctcag

SEQ ID NO: 963721 - DNA, 16 bp, Homo sapiens
tatctaaatgttgaaa

SEQ ID NO: 963722 - DNA, 20 bp, Homo sapiens
tatctaagttaatttaaagt

SEQ ID NO: 963723 - DNA, 14 bp, Homo sapiens
tatctaatacaaaa

SEQ ID NO: 963724 - DNA, 18 bp, Homo sapiens
gagtgagtcacctgctcc

SEQ ID NO: 963725 - DNA, 19 bp, Homo sapiens
gagtgagtcacctgctcca

SEQ ID NO: 963726 - DNA, 22 bp, Homo sapiens
gagtgataatattgtttccctc

SEQ ID NO: 963727 - DNA, 21 bp, Homo sapiens
gagtgataatctggtgacaaa

SEQ ID NO: 963728 - DNA, 20 bp, Homo sapiens
gagtgatggtgtccttccct

SEQ ID NO: 963729 - DNA, 17 bp, Homo sapiens
gagtgcagaacacctgg

SEQ ID NO: 963730 - DNA, 16 bp, Homo sapiens
gagtgcagccaaaggg

SEQ ID NO: 963731 - DNA, 12 bp, Homo sapiens
gagtgcagcctt

SEQ ID NO: 963732 - DNA, 17 bp, Homo sapiens
gagtgcagtcctgatca

SEQ ID NO: 963733 - DNA, 18 bp, Homo sapiens
gagtgcagtcctgatcag

SEQ ID NO: 963734 - DNA, 12 bp, Homo sapiens
gagtgccaggac

SEQ ID NO: 963735 - DNA, 13 bp, Homo sapiens
gagtgccaggact

SEQ ID NO: 963736 - DNA, 19 bp, Homo sapiens
gagtgccaggactccccag

SEQ ID NO: 963737 - DNA, 20 bp, Homo sapiens
gagtgccaggactccccagg

SEQ ID NO: 963738 - DNA, 23 bp, Homo sapiens
gagtgccccattcttttgtaatt

SEQ ID NO: 963739 - DNA, 14 bp, Homo sapiens
gagtgcccccggga

SEQ ID NO: 963740 - DNA, 15 bp, Homo sapiens
gagtgcccctgtccc

SEQ ID NO: 963741 - DNA, 15 bp, Homo sapiens
gagtgccctgcaggc

SEQ ID NO: 963742 - DNA, 16 bp, Homo sapiens
gagtgccctgcaggca

SEQ ID NO: 963743 - DNA, 22 bp, Homo sapiens
gagtgccctgcaggcacagagg

SEQ ID NO: 963744 - DNA, 14 bp, Homo sapiens
gagtgccttttgca

SEQ ID NO: 963745 - DNA, 18 bp, Homo sapiens
gagtgccttttgcagaag

SEQ ID NO: 963746 - DNA, 20 bp, Homo sapiens
gagtgcgcagatctgtgcct

SEQ ID NO: 963747 - DNA, 23 bp, Homo sapiens
gagtgcgcagatctgtgcctggg

SEQ ID NO: 963748 - DNA, 21 bp, Homo sapiens
gagtgcgctcttggtccctgg

SEQ ID NO: 963749 - DNA, 18 bp, Homo sapiens
gagtgctgcttgtgcctc

SEQ ID NO: 963750 - DNA, 13 bp, Homo sapiens
gagtgctggactg

SEQ ID NO: 963751 - DNA, 18 bp, Homo sapiens
gagtgctggctcacagta

SEQ ID NO: 963752 - DNA, 16 bp, Homo sapiens
gagtgctgtcgggacc

SEQ ID NO: 963753 - DNA, 19 bp, Homo sapiens
gagtgctgtcgggaccaca

SEQ ID NO: 963754 - DNA, 21 bp, Homo sapiens
gagtgctgtcgggaccacatc

SEQ ID NO: 963755 - DNA, 15 bp, Homo sapiens
gagtgctgttttgtt

SEQ ID NO: 963756 - DNA, 13 bp, Homo sapiens
gagtggaaggtga

SEQ ID NO: 963757 - DNA, 16 bp, Homo sapiens
gagtggacaccgctca

SEQ ID NO: 963758 - DNA, 22 bp, Homo sapiens
gagtggacaccgctcagtatta

SEQ ID NO: 963759 - DNA, 14 bp, Homo sapiens
gagtggactgcatt

SEQ ID NO: 963760 - DNA, 20 bp, Homo sapiens
gagtggaggtgggctgggcc

SEQ ID NO: 963761 - DNA, 12 bp, Homo sapiens
gagtggagtctg

SEQ ID NO: 963762 - DNA, 14 bp, Homo sapiens
gagtggagttgaaa

SEQ ID NO: 963763 - DNA, 16 bp, Homo sapiens
gagtggataatcagga

SEQ ID NO: 963764 - DNA, 19 bp, Homo sapiens
tatctccctggagaagcac

SEQ ID NO: 963765 - DNA, 19 bp, Homo sapiens
tatctcctccaatgtcctg

SEQ ID NO: 963766 - DNA, 13 bp, Homo sapiens
tatctcctgctct

SEQ ID NO: 963767 - DNA, 23 bp, Homo sapiens
tatctccttcccctacacctccc

SEQ ID NO: 963768 - DNA, 16 bp, Homo sapiens
tatctcgtgggagagc

SEQ ID NO: 963769 - DNA, 16 bp, Homo sapiens
tatctctatttaatat

SEQ ID NO: 963770 - DNA, 14 bp, Homo sapiens
tatctctgaggcta

SEQ ID NO: 963771 - DNA, 16 bp, Homo sapiens
tatctctgtgtgcaca

SEQ ID NO: 963772 - DNA, 17 bp, Homo sapiens
tatctcttgcccttcct

SEQ ID NO: 963773 - DNA, 21 bp, Homo sapiens
tatctcttttatatttgtagg

SEQ ID NO: 963774 - DNA, 19 bp, Homo sapiens
tatctgaaccaagatgtaa

SEQ ID NO: 963775 - DNA, 19 bp, Homo sapiens
tatctgaagagtatccttc

SEQ ID NO: 963776 - DNA, 16 bp, Homo sapiens
tatctgagcaataact

SEQ ID NO: 963777 - DNA, 22 bp, Homo sapiens
tatctgagcaataacttctatg

SEQ ID NO: 963778 - DNA, 18 bp, Homo sapiens
tatctgagggaggaggcc

SEQ ID NO: 963779 - DNA, 13 bp, Homo sapiens
tatctgaggtcac

SEQ ID NO: 963780 - DNA, 17 bp, Homo sapiens
tatctgagttgccaaga

SEQ ID NO: 963781 - DNA, 18 bp, Homo sapiens
tatctgagttgccaagac

SEQ ID NO: 963782 - DNA, 19 bp, Homo sapiens
tatctgagttgccaagaca

SEQ ID NO: 963783 - DNA, 21 bp, Homo sapiens
tatctgagttgccaagacaaa

SEQ ID NO: 963784 - DNA, 23 bp, Homo sapiens
tatctgagttgccaagacaaatc

SEQ ID NO: 963785 - DNA, 19 bp, Homo sapiens
tatctgatattaaagattt

SEQ ID NO: 963786 - DNA, 15 bp, Homo sapiens
tatctgattccttta

SEQ ID NO: 963787 - DNA, 16 bp, Homo sapiens
tatctgattttgtgca

SEQ ID NO: 963788 - DNA, 16 bp, Homo sapiens
tatctgcaggcagaca

SEQ ID NO: 963789 - DNA, 18 bp, Homo sapiens
tatctgcaggcagacacg

SEQ ID NO: 963790 - DNA, 13 bp, Homo sapiens
tatctgcctcccc

SEQ ID NO: 963791 - DNA, 14 bp, Homo sapiens
tatctgcctcccct

SEQ ID NO: 963792 - DNA, 14 bp, Homo sapiens
tatctgcctggcct

SEQ ID NO: 963793 - DNA, 21 bp, Homo sapiens
tatctgcctggcctggctccc

SEQ ID NO: 963794 - DNA, 19 bp, Homo sapiens
tatctggaacaacttgtag

SEQ ID NO: 963795 - DNA, 19 bp, Homo sapiens
tatctggaagtaaccattt

SEQ ID NO: 963796 - DNA, 20 bp, Homo sapiens
tatctggaggccttccagct

SEQ ID NO: 963797 - DNA, 21 bp, Homo sapiens
tatctgtcatctctctggggc

SEQ ID NO: 963798 - DNA, 12 bp, Homo sapiens
tatctgtctttc

SEQ ID NO: 963799 - DNA, 16 bp, Homo sapiens
tatctgtgaaatatca

SEQ ID NO: 963800 - DNA, 17 bp, Homo sapiens
tatctgtgaaatatcat

SEQ ID NO: 963801 - DNA, 19 bp, Homo sapiens
tatctgtgcgtgaaacaca

SEQ ID NO: 963802 - DNA, 19 bp, Homo sapiens
tatctgtgcttctaatatt

SEQ ID NO: 963803 - DNA, 14 bp, Homo sapiens
tatctgttcacttt

SEQ ID NO: 963804 - DNA, 20 bp, Homo sapiens
tatctgtttcctgacattgt

SEQ ID NO: 963805 - DNA, 22 bp, Homo sapiens
tatctgtttcctgacattgtct

SEQ ID NO: 963806 - DNA, 17 bp, Homo sapiens
tatctgtttgtatattt

SEQ ID NO: 963807 - DNA, 23 bp, Homo sapiens
tatctgtttgtatatttgcaaac

SEQ ID NO: 963808 - DNA, 18 bp, Homo sapiens
tatcttaaagaaacagct

SEQ ID NO: 963809 - DNA, 23 bp, Homo sapiens
tatcttaaagaaacagctttcaa

SEQ ID NO: 963810 - DNA, 20 bp, Homo sapiens
tatcttacctgtaaagtcta

SEQ ID NO: 963811 - DNA, 18 bp, Homo sapiens
tatcttactatttcacaa

SEQ ID NO: 963812 - DNA, 22 bp, Homo sapiens
tatcttataaagtggaagtatg

SEQ ID NO: 963813 - DNA, 23 bp, Homo sapiens
tatcttataaagtggaagtatgt

SEQ ID NO: 963814 - DNA, 16 bp, Homo sapiens
tatcttataactgttt

SEQ ID NO: 963815 - DNA, 17 bp, Homo sapiens
tatcttataactgtttt

SEQ ID NO: 963816 - DNA, 14 bp, Homo sapiens
tatcttatgaaaac

SEQ ID NO: 963817 - DNA, 16 bp, Homo sapiens
tatcttcaaactttca

SEQ ID NO: 963818 - DNA, 23 bp, Homo sapiens
tatcttcagcccaggcttttgct

SEQ ID NO: 963819 - DNA, 18 bp, Homo sapiens
tatcttcagctctttttg

SEQ ID NO: 963820 - DNA, 15 bp, Homo sapiens
tatcttcatgtaaat

SEQ ID NO: 963821 - DNA, 23 bp, Homo sapiens
tatcttcatgtaaattgactgta

SEQ ID NO: 963822 - DNA, 13 bp, Homo sapiens
tatcttccaaatg

SEQ ID NO: 963823 - DNA, 22 bp, Homo sapiens
tatcttcccatttaacattgtt

SEQ ID NO: 963824 - DNA, 21 bp, Homo sapiens
tatcttcgttagtaatctgta

SEQ ID NO: 963825 - DNA, 14 bp, Homo sapiens
tatcttctgatttg

SEQ ID NO: 963826 - DNA, 17 bp, Homo sapiens
tatcttggactgacatt

SEQ ID NO: 963827 - DNA, 20 bp, Homo sapiens
tatcttggactgacatttag

SEQ ID NO: 963828 - DNA, 20 bp, Homo sapiens
tatcttggggcaagactgca

SEQ ID NO: 963829 - DNA, 23 bp, Homo sapiens
tatcttggtgaatttttttttcc

SEQ ID NO: 963830 - DNA, 14 bp, Homo sapiens
tatcttgtcctgga

SEQ ID NO: 963831 - DNA, 17 bp, Homo sapiens
tatcttgttattaatgt

SEQ ID NO: 963832 - DNA, 15 bp, Homo sapiens
tatcttgtttggcct

SEQ ID NO: 963833 - DNA, 22 bp, Homo sapiens
tatcttgtttttccactactgc

SEQ ID NO: 963834 - DNA, 13 bp, Homo sapiens
tatctttaaacat

SEQ ID NO: 963835 - DNA, 22 bp, Homo sapiens
tatctttaacaattgtcttaaa

SEQ ID NO: 963836 - DNA, 21 bp, Homo sapiens
tatctttaccaaaaaccatgt

SEQ ID NO: 963837 - DNA, 17 bp, Homo sapiens
tatctttatacagattt

SEQ ID NO: 963838 - DNA, 12 bp, Homo sapiens
tatctttatgct

SEQ ID NO: 963839 - DNA, 15 bp, Homo sapiens
tatctttattaatca

SEQ ID NO: 963840 - DNA, 16 bp, Homo sapiens
tatctttcacctttct

SEQ ID NO: 963841 - DNA, 14 bp, Homo sapiens
tatctttcctccct

SEQ ID NO: 963842 - DNA, 14 bp, Homo sapiens
tatctttctttcca

SEQ ID NO: 963843 - DNA, 15 bp, Homo sapiens
tatctttgaatatgt

SEQ ID NO: 963844 - DNA, 23 bp, Homo sapiens
tatcttttctattgtttattctt

SEQ ID NO: 963845 - DNA, 20 bp, Homo sapiens
gagttcaccttggaagggcg

SEQ ID NO: 963846 - DNA, 21 bp, Homo sapiens
gagttcatggggatctggggg

SEQ ID NO: 963847 - DNA, 19 bp, Homo sapiens
gagttccagttcctctttg

SEQ ID NO: 963848 - DNA, 15 bp, Homo sapiens
gagttccatgaagac

SEQ ID NO: 963849 - DNA, 14 bp, Homo sapiens
gagttcccacccaa

SEQ ID NO: 963850 - DNA, 17 bp, Homo sapiens
gagttcctctgcagttt

SEQ ID NO: 963851 - DNA, 23 bp, Homo sapiens
gagttcctgcggagtgaagaggg

SEQ ID NO: 963852 - DNA, 13 bp, Homo sapiens
gagttcctgctcc

SEQ ID NO: 963853 - DNA, 15 bp, Homo sapiens
gagttcctgctccgt

SEQ ID NO: 963854 - DNA, 17 bp, Homo sapiens
gagttcgagaccagcct

SEQ ID NO: 963855 - DNA, 21 bp, Homo sapiens
gagttcgagaccagcctggcc

SEQ ID NO: 963856 - DNA, 20 bp, Homo sapiens
gagttctatccccaagctgg

SEQ ID NO: 963857 - DNA, 20 bp, Homo sapiens
gagttctatggagactttgc

SEQ ID NO: 963858 - DNA, 20 bp, Homo sapiens
gagttctcctggaggcaggg

SEQ ID NO: 963859 - DNA, 19 bp, Homo sapiens
gagttctctgatgcagaaa

SEQ ID NO: 963860 - DNA, 12 bp, Homo sapiens
gagttctttgct

SEQ ID NO: 963861 - DNA, 22 bp, Homo sapiens
gagttctttgctgcccctgtct

SEQ ID NO: 963862 - DNA, 22 bp, Homo sapiens
gagttgaaagagttaagaatgt

SEQ ID NO: 963863 - DNA, 20 bp, Homo sapiens
gagttgccaagacaaatcaa

SEQ ID NO: 963864 - DNA, 22 bp, Homo sapiens
gagttgcttttcagctgaggtt

SEQ ID NO: 963865 - DNA, 22 bp, Homo sapiens
gagttggattaaattctgggtg

SEQ ID NO: 963866 - DNA, 16 bp, Homo sapiens
gagttggctgtgttcg

SEQ ID NO: 963867 - DNA, 22 bp, Homo sapiens
gagttggctgtgttcgggggag

SEQ ID NO: 963868 - DNA, 15 bp, Homo sapiens
gagttgggattggac

SEQ ID NO: 963869 - DNA, 14 bp, Homo sapiens
gagttgtaaatata

SEQ ID NO: 963870 - DNA, 19 bp, Homo sapiens
gagttgtaaatatataaat

SEQ ID NO: 963871 - DNA, 17 bp, Homo sapiens
gagttgtcgtttttagc

SEQ ID NO: 963872 - DNA, 22 bp, Homo sapiens
gagttgtcgtttttagctttgt

SEQ ID NO: 963873 - DNA, 16 bp, Homo sapiens
gagttgtctctgttgg

SEQ ID NO: 963874 - DNA, 21 bp, Homo sapiens
gagttgtgagccctctagggc

SEQ ID NO: 963875 - DNA, 16 bp, Homo sapiens
gagttgttacattttt

SEQ ID NO: 963876 - DNA, 22 bp, Homo sapiens
gagttgttacatttttaagtgc

SEQ ID NO: 963877 - DNA, 22 bp, Homo sapiens
gagttgttttcagactcagact

SEQ ID NO: 963878 - DNA, 13 bp, Homo sapiens
gagtttaaagcaa

SEQ ID NO: 963879 - DNA, 19 bp, Homo sapiens
gagtttaagaccagcctgg

SEQ ID NO: 963880 - DNA, 14 bp, Homo sapiens
gagtttaccatttg

SEQ ID NO: 963881 - DNA, 22 bp, Homo sapiens
gagtttaccatttgtaataaag

SEQ ID NO: 963882 - DNA, 18 bp, Homo sapiens
gagtttagccctgaacat

SEQ ID NO: 963883 - DNA, 14 bp, Homo sapiens
gagtttatattctg

SEQ ID NO: 963884 - DNA, 17 bp, Homo sapiens
gagtttattacaatgta

SEQ ID NO: 963885 - DNA, 20 bp, Homo sapiens
gagtttattacaatgtatct

SEQ ID NO: 963886 - DNA, 18 bp, Homo sapiens
gagtttcatgtacaagat

SEQ ID NO: 963887 - DNA, 19 bp, Homo sapiens
gagtttcattctcctgcct

SEQ ID NO: 963888 - DNA, 20 bp, Homo sapiens
gagtttcattctcctgcctg

SEQ ID NO: 963889 - DNA, 18 bp, Homo sapiens
gagtttccactatcccaa

SEQ ID NO: 963890 - DNA, 15 bp, Homo sapiens
tatgaatattactct

SEQ ID NO: 963891 - DNA, 13 bp, Homo sapiens
tatgaatctataa

SEQ ID NO: 963892 - DNA, 15 bp, Homo sapiens
tatgaatctatgcca

SEQ ID NO: 963893 - DNA, 20 bp, Homo sapiens
tatgaatctgtgctggccat

SEQ ID NO: 963894 - DNA, 18 bp, Homo sapiens
tatgaatgggttgttaaa

SEQ ID NO: 963895 - DNA, 19 bp, Homo sapiens
tatgaattattcaatttat

SEQ ID NO: 963896 - DNA, 13 bp, Homo sapiens
tatgaattcaaga

SEQ ID NO: 963897 - DNA, 14 bp, Homo sapiens
tatgacaaattcaa

SEQ ID NO: 963898 - DNA, 20 bp, Homo sapiens
tatgacacaaaggtggaata

SEQ ID NO: 963899 - DNA, 11 bp, Homo sapiens
tatgacacagt

SEQ ID NO: 963900 - DNA, 13 bp, Homo sapiens
tatgacagctggc

SEQ ID NO: 963901 - DNA, 16 bp, Homo sapiens
tatgacagctgtccct

SEQ ID NO: 963902 - DNA, 20 bp, Homo sapiens
tatgacagctgtccctgtca

SEQ ID NO: 963903 - DNA, 14 bp, Homo sapiens
tatgacagtaaaca

SEQ ID NO: 963904 - DNA, 19 bp, Homo sapiens
tatgacatcacttgtacaa

SEQ ID NO: 963905 - DNA, 23 bp, Homo sapiens
tatgacatcacttgtacaaaata

SEQ ID NO: 963906 - DNA, 24 bp, Homo sapiens
tatgacatcacttgtacaaaataa

SEQ ID NO: 963907 - DNA, 13 bp, Homo sapiens
tatgacatctaag

SEQ ID NO: 963908 - DNA, 17 bp, Homo sapiens
tatgaccagaagccttg

SEQ ID NO: 963909 - DNA, 14 bp, Homo sapiens
tatgaccctgttta

SEQ ID NO: 963910 - DNA, 20 bp, Homo sapiens
tatgacggaagaacatagaa

SEQ ID NO: 963911 - DNA, 14 bp, Homo sapiens
tatgactaaagaga

SEQ ID NO: 963912 - DNA, 16 bp, Homo sapiens
tatgactatgtaaact

SEQ ID NO: 963913 - DNA, 22 bp, Homo sapiens
tatgactgctccccagccctgg

SEQ ID NO: 963914 - DNA, 12 bp, Homo sapiens
tatgactttgtc

SEQ ID NO: 963915 - DNA, 15 bp, Homo sapiens
tatgagaaaaatatt

SEQ ID NO: 963916 - DNA, 22 bp, Homo sapiens
tatgagaacaagtcacagctgc

SEQ ID NO: 963917 - DNA, 21 bp, Homo sapiens
tatgagagggccctgcctgct

SEQ ID NO: 963918 - DNA, 17 bp, Homo sapiens
tatgagatggttaaaaa

SEQ ID NO: 963919 - DNA, 18 bp, Homo sapiens
tatgagatggttaaaaag

SEQ ID NO: 963920 - DNA, 22 bp, Homo sapiens
tatgagatggttaaaaaggcca

SEQ ID NO: 963921 - DNA, 17 bp, Homo sapiens
tatgagcatcctgagcc

SEQ ID NO: 963922 - DNA, 22 bp, Homo sapiens
tatgagcatcctgagccccgcc

SEQ ID NO: 963923 - DNA, 16 bp, Homo sapiens
tatgagccagacaaat

SEQ ID NO: 963924 - DNA, 15 bp, Homo sapiens
tatgagcctgccctc

SEQ ID NO: 963925 - DNA, 20 bp, Homo sapiens
tatgagcctgccctcactcc

SEQ ID NO: 963926 - DNA, 22 bp, Homo sapiens
tatgagcctgccctcactccct

SEQ ID NO: 963927 - DNA, 13 bp, Homo sapiens
tatgagcttcaat

SEQ ID NO: 963928 - DNA, 23 bp, Homo sapiens
tatgagcttcaatataagaagca

SEQ ID NO: 963929 - DNA, 18 bp, Homo sapiens
tatgaggaaagcgtttct

SEQ ID NO: 963930 - DNA, 13 bp, Homo sapiens
tatgaggaaaggt

SEQ ID NO: 963931 - DNA, 20 bp, Homo sapiens
tatgaggacaaggtatacac

SEQ ID NO: 963932 - DNA, 17 bp, Homo sapiens
tatgaggacttgtgtct

SEQ ID NO: 963933 - DNA, 23 bp, Homo sapiens
tatgaggacttgtgtctctgtgc

SEQ ID NO: 963934 - DNA, 14 bp, Homo sapiens
tatgaggaggggag

SEQ ID NO: 963935 - DNA, 20 bp, Homo sapiens
tatgaggataatgggaagag

SEQ ID NO: 963936 - DNA, 14 bp, Homo sapiens
tatgaggcatttgt

SEQ ID NO: 963937 - DNA, 23 bp, Homo sapiens
tatgaggcatttgtttgaactga

SEQ ID NO: 963938 - DNA, 21 bp, Homo sapiens
tatgagggttgaagacggaaa

SEQ ID NO: 963939 - DNA, 21 bp, Homo sapiens
tatgagtcttctgtaattcat

SEQ ID NO: 963940 - DNA, 20 bp, Homo sapiens
tatgagtgctgattcaaacc

SEQ ID NO: 963941 - DNA, 18 bp, Homo sapiens
tatgagtgtgagtgtgtg

SEQ ID NO: 963942 - DNA, 15 bp, Homo sapiens
tatgagttactgaag

SEQ ID NO: 963943 - DNA, 19 bp, Homo sapiens
tatgagttgcatttgtaaa

SEQ ID NO: 963944 - DNA, 20 bp, Homo sapiens
tatgagttgcatttgtaaaa

SEQ ID NO: 963945 - DNA, 18 bp, Homo sapiens
tatgagttgttttcagac

SEQ ID NO: 963946 - DNA, 22 bp, Homo sapiens
tatgagttgttttcagactcag

SEQ ID NO: 963947 - DNA, 22 bp, Homo sapiens
tatgagtttttgatagctttat

SEQ ID NO: 963948 - DNA, 15 bp, Homo sapiens
tatgataaaacactg

SEQ ID NO: 963949 - DNA, 14 bp, Homo sapiens
tatgatactgatgc

SEQ ID NO: 963950 - DNA, 16 bp, Homo sapiens
tatgatacttgaattt

SEQ ID NO: 963951 - DNA, 13 bp, Homo sapiens
tatgatattgttt

SEQ ID NO: 963952 - DNA, 15 bp, Homo sapiens
tatgatattgtttaa

SEQ ID NO: 963953 - DNA, 16 bp, Homo sapiens
tatgatattgtttaaa

SEQ ID NO: 963954 - DNA, 13 bp, Homo sapiens
tatgatatttctt

SEQ ID NO: 963955 - DNA, 22 bp, Homo sapiens
tatgatattttctgtgcctgaa

SEQ ID NO: 963956 - DNA, 21 bp, Homo sapiens
tatgatattttgtctcctacc

SEQ ID NO: 963957 - DNA, 14 bp, Homo sapiens
tatgatcagtgttg

SEQ ID NO: 963958 - DNA, 15 bp, Homo sapiens
tatgatctaatacaa

SEQ ID NO: 963959 - DNA, 16 bp, Homo sapiens
tatgatctgtctgtgg

SEQ ID NO: 963960 - DNA, 15 bp, Homo sapiens
tatgatgaaaataat

SEQ ID NO: 963961 - DNA, 22 bp, Homo sapiens
tatgatgatacaagattagaag

SEQ ID NO: 963962 - DNA, 21 bp, Homo sapiens
tatgatgcatacagttttcta

SEQ ID NO: 963963 - DNA, 22 bp, Homo sapiens
tatgatgcatacagttttctag

SEQ ID NO: 963964 - DNA, 18 bp, Homo sapiens
tatgatgctaatcttgtc

SEQ ID NO: 963965 - DNA, 17 bp, Homo sapiens
tatgatgggcttctgtt

SEQ ID NO: 963966 - DNA, 13 bp, Homo sapiens
tatgatggtgaca

SEQ ID NO: 963967 - DNA, 23 bp, Homo sapiens
tatgatgtggacatatgtatact

SEQ ID NO: 963968 - DNA, 17 bp, Homo sapiens
tatgatgtgttgtgata

SEQ ID NO: 963969 - DNA, 21 bp, Homo sapiens
tatgattcagattgttatcta

SEQ ID NO: 963970 - DNA, 17 bp, Homo sapiens
tatgattctagtacata

SEQ ID NO: 963971 - DNA, 22 bp, Homo sapiens
tatgattctagtacataattga

SEQ ID NO: 963972 - DNA, 17 bp, Homo sapiens
tatgatttaatttgaaa

SEQ ID NO: 963973 - DNA, 18 bp, Homo sapiens
tatgatttaatttgaaat

SEQ ID NO: 963974 - DNA, 20 bp, Homo sapiens
tatgatttataaacagacaa

SEQ ID NO: 963975 - DNA, 22 bp, Homo sapiens
tatgatttgttttgaattttgt

SEQ ID NO: 963976 - DNA, 16 bp, Homo sapiens
tatgattttatttgac

SEQ ID NO: 963977 - DNA, 19 bp, Homo sapiens
tatgatttttttttcatac

SEQ ID NO: 963978 - DNA, 16 bp, Homo sapiens
tatgcaaaaaattctt

SEQ ID NO: 963979 - DNA, 15 bp, Homo sapiens
tatgcaaaagcagct

SEQ ID NO: 963980 - DNA, 16 bp, Homo sapiens
tatgcaaaagcagcta

SEQ ID NO: 963981 - DNA, 22 bp, Homo sapiens
tatgcaaaagcagctaaatgta

SEQ ID NO: 963982 - DNA, 16 bp, Homo sapiens
tatgcaaaataaagaa

SEQ ID NO: 963983 - DNA, 16 bp, Homo sapiens
tatgcaaaatgtctgt

SEQ ID NO: 963984 - DNA, 20 bp, Homo sapiens
tatgcaaagcactctctgca

SEQ ID NO: 963985 - DNA, 15 bp, Homo sapiens
tatgcaagcagcttt

SEQ ID NO: 963986 - DNA, 19 bp, Homo sapiens
tatgcaagcagctttttat

SEQ ID NO: 963987 - DNA, 21 bp, Homo sapiens
tatgcaagttttgtgactgag

SEQ ID NO: 963988 - DNA, 18 bp, Homo sapiens
tatgcaataatccacccc

SEQ ID NO: 963989 - DNA, 15 bp, Homo sapiens
tatgcaatgcttcat

SEQ ID NO: 963990 - DNA, 16 bp, Homo sapiens
tatgcacacacatata

SEQ ID NO: 963991 - DNA, 23 bp, Homo sapiens
tatgcacagtctattttttgtat

SEQ ID NO: 963992 - DNA, 20 bp, Homo sapiens
tatgcaccaggtctcaaggt

SEQ ID NO: 963993 - DNA, 20 bp, Homo sapiens
tatgcacttataattttcct

SEQ ID NO: 963994 - DNA, 17 bp, Homo sapiens
tatgcactttccctaga

SEQ ID NO: 963995 - DNA, 19 bp, Homo sapiens
tatgcacttttagaaatgc

SEQ ID NO: 963996 - DNA, 19 bp, Homo sapiens
tatgcagaacgtatttagc

SEQ ID NO: 963997 - DNA, 19 bp, Homo sapiens
tatgcagacagtctgttat

SEQ ID NO: 963998 - DNA, 16 bp, Homo sapiens
tatgcagtatctctta

SEQ ID NO: 963999 - DNA, 18 bp, Homo sapiens
tatgcagttgataagagg

SEQ ID NO: 964000 - DNA, 22 bp, Homo sapiens
tatgcagttgataagaggaatt

SEQ ID NO: 964001 - DNA, 17 bp, Homo sapiens
tatgcataaaaaaatga

SEQ ID NO: 964002 - DNA, 18 bp, Homo sapiens
tatgcataaaaaaatgat

SEQ ID NO: 964003 - DNA, 15 bp, Homo sapiens
tatgcataaagtcag

SEQ ID NO: 964004 - DNA, 18 bp, Homo sapiens
tatgcatgaagtaatatg

SEQ ID NO: 964005 - DNA, 22 bp, Homo sapiens
tatgcatgaagtaatatgcaca

SEQ ID NO: 964006 - DNA, 12 bp, Homo sapiens
tatgcatgccag

SEQ ID NO: 964007 - DNA, 15 bp, Homo sapiens
tatgcatgtgaagaa

SEQ ID NO: 964008 - DNA, 21 bp, Homo sapiens
tatgcatttaaatacagtctt

SEQ ID NO: 964009 - DNA, 11 bp, Homo sapiens
tatgcatttga

SEQ ID NO: 964010 - DNA, 23 bp, Homo sapiens
tatgcatttgaaaattttgatgt

SEQ ID NO: 964011 - DNA, 15 bp, Homo sapiens
tatgcattttcttca

SEQ ID NO: 964012 - DNA, 21 bp, Homo sapiens
tatgcattttcttcacagtgc

SEQ ID NO: 964013 - DNA, 17 bp, Homo sapiens
tatgccaaagatcactt

SEQ ID NO: 964014 - DNA, 14 bp, Homo sapiens
gagtttcccttcct

SEQ ID NO: 964015 - DNA, 15 bp, Homo sapiens
gagtttcgaggtaga

SEQ ID NO: 964016 - DNA, 12 bp, Homo sapiens
gagtttctctaa

SEQ ID NO: 964017 - DNA, 12 bp, Homo sapiens
gagtttctctct

SEQ ID NO: 964018 - DNA, 22 bp, Homo sapiens
gagtttgaaggaggtgagggat

SEQ ID NO: 964019 - DNA, 17 bp, Homo sapiens
gagtttgagacaagccc

SEQ ID NO: 964020 - DNA, 20 bp, Homo sapiens
gagtttggatgttgtaaata

SEQ ID NO: 964021 - DNA, 19 bp, Homo sapiens
gagtttgtattattacaaa

SEQ ID NO: 964022 - DNA, 17 bp, Homo sapiens
gagtttgtcgctcatgt

SEQ ID NO: 964023 - DNA, 18 bp, Homo sapiens
gagtttgtcgctcatgtg

SEQ ID NO: 964024 - DNA, 22 bp, Homo sapiens
gagtttgtcgctcatgtgtgca

SEQ ID NO: 964025 - DNA, 17 bp, Homo sapiens
gagttttacccagactc

SEQ ID NO: 964026 - DNA, 18 bp, Homo sapiens
gagttttatttttaagaa

SEQ ID NO: 964027 - DNA, 22 bp, Homo sapiens
gagttttcctctatacatctct

SEQ ID NO: 964028 - DNA, 22 bp, Homo sapiens
gagttttgtgtttgttgtagat

SEQ ID NO: 964029 - DNA, 17 bp, Homo sapiens
gagttttgtttcctctg

SEQ ID NO: 964030 - DNA, 13 bp, Homo sapiens
gagttttgtttta

SEQ ID NO: 964031 - DNA, 15 bp, Homo sapiens
gagtttttcctccca

SEQ ID NO: 964032 - DNA, 19 bp, Homo sapiens
gataaaaagccagggctgg

SEQ ID NO: 964033 - DNA, 20 bp, Homo sapiens
gataaaaagccagggctgga

SEQ ID NO: 964034 - DNA, 14 bp, Homo sapiens
gataaaaaggaagg

SEQ ID NO: 964035 - DNA, 14 bp, Homo sapiens
gataaaaataaagc

SEQ ID NO: 964036 - DNA, 13 bp, Homo sapiens
gataaaaataata

SEQ ID NO: 964037 - DNA, 20 bp, Homo sapiens
gataaaacagaatcttctgg

SEQ ID NO: 964038 - DNA, 13 bp, Homo sapiens
gataaaactgtgt

SEQ ID NO: 964039 - DNA, 14 bp, Homo sapiens
gataaaactgtgta

SEQ ID NO: 964040 - DNA, 17 bp, Homo sapiens
gataaaactgtgtaaac

SEQ ID NO: 964041 - DNA, 19 bp, Homo sapiens
gataaaataaataatttta

SEQ ID NO: 964042 - DNA, 22 bp, Homo sapiens
gataaacaccaacccaggaatt

SEQ ID NO: 964043 - DNA, 19 bp, Homo sapiens
gataaacattaaacactgt

SEQ ID NO: 964044 - DNA, 16 bp, Homo sapiens
gataaaccaataaatc

SEQ ID NO: 964045 - DNA, 19 bp, Homo sapiens
gataaaccaccctctgggg

SEQ ID NO: 964046 - DNA, 21 bp, Homo sapiens
gataaaccaccctctggggac

SEQ ID NO: 964047 - DNA, 14 bp, Homo sapiens
gataaagaaaagaa

SEQ ID NO: 964048 - DNA, 18 bp, Homo sapiens
gataaagaccagaaattc

SEQ ID NO: 964049 - DNA, 12 bp, Homo sapiens
gataaagacttt

SEQ ID NO: 964050 - DNA, 12 bp, Homo sapiens
gataaagatgat

SEQ ID NO: 964051 - DNA, 14 bp, Homo sapiens
gataaagcacagct

SEQ ID NO: 964052 - DNA, 21 bp, Homo sapiens
gataaagccacttctggcttc

SEQ ID NO: 964053 - DNA, 15 bp, Homo sapiens
gataaagttccttaa

SEQ ID NO: 964054 - DNA, 13 bp, Homo sapiens
gataaatatttat

SEQ ID NO: 964055 - DNA, 20 bp, Homo sapiens
gataaatcagtcaagctgtt

SEQ ID NO: 964056 - DNA, 19 bp, Homo sapiens
gataaatcataaagtcagt

SEQ ID NO: 964057 - DNA, 23 bp, Homo sapiens
gataaatcatttcagtatcatct

SEQ ID NO: 964058 - DNA, 15 bp, Homo sapiens
gataaatgatagaca

SEQ ID NO: 964059 - DNA, 15 bp, Homo sapiens
gataacaagatcttt

SEQ ID NO: 964060 - DNA, 18 bp, Homo sapiens
gataacaagcaaggatat

SEQ ID NO: 964061 - DNA, 12 bp, Homo sapiens
gataacaccttg

SEQ ID NO: 964062 - DNA, 17 bp, Homo sapiens
gataaccccaggcactg

SEQ ID NO: 964063 - DNA, 17 bp, Homo sapiens
gataacctatatgattt

SEQ ID NO: 964064 - DNA, 15 bp, Homo sapiens
gataactagccagac

SEQ ID NO: 964065 - DNA, 21 bp, Homo sapiens
gataactctgcaaaggcctgg

SEQ ID NO: 964066 - DNA, 20 bp, Homo sapiens
gataactgaaaattatttaa

SEQ ID NO: 964067 - DNA, 21 bp, Homo sapiens
gataactgcaattttaattga

SEQ ID NO: 964068 - DNA, 19 bp, Homo sapiens
gataactttacagaaatgg

SEQ ID NO: 964069 - DNA, 16 bp, Homo sapiens
gataaggcaagccagt

SEQ ID NO: 964070 - DNA, 14 bp, Homo sapiens
gataagggaaaaga

SEQ ID NO: 964071 - DNA, 15 bp, Homo sapiens
gataaggggccttgc

SEQ ID NO: 964072 - DNA, 15 bp, Homo sapiens
gataaggtttcctgc

SEQ ID NO: 964073 - DNA, 22 bp, Homo sapiens
gataagtttctattctgtcagt

SEQ ID NO: 964074 - DNA, 12 bp, Homo sapiens
gataatacacca

SEQ ID NO: 964075 - DNA, 14 bp, Homo sapiens
gataatacaccact

SEQ ID NO: 964076 - DNA, 22 bp, Homo sapiens
gataatacaccactacattctg

SEQ ID NO: 964077 - DNA, 17 bp, Homo sapiens
gataatacttgacctct

SEQ ID NO: 964078 - DNA, 13 bp, Homo sapiens
gataataggaatt

SEQ ID NO: 964079 - DNA, 14 bp, Homo sapiens
gataataggaattc

SEQ ID NO: 964080 - DNA, 22 bp, Homo sapiens
gataataggtagcctgctgtgg

SEQ ID NO: 964081 - DNA, 17 bp, Homo sapiens
gataatatattttcaag

SEQ ID NO: 964082 - DNA, 21 bp, Homo sapiens
gataatattagtgattctgat

SEQ ID NO: 964083 - DNA, 21 bp, Homo sapiens
gataatcaattattacattta

SEQ ID NO: 964084 - DNA, 14 bp, Homo sapiens
gataatcagcctct

SEQ ID NO: 964085 - DNA, 16 bp, Homo sapiens
gataatcagcctctta

SEQ ID NO: 964086 - DNA, 18 bp, Homo sapiens
gataatcaggaaaaatga

SEQ ID NO: 964087 - DNA, 15 bp, Homo sapiens
gataatcattttgag

SEQ ID NO: 964088 - DNA, 21 bp, Homo sapiens
tatggcacttattatgaggct

SEQ ID NO: 964089 - DNA, 23 bp, Homo sapiens
tatggcagaagggaattgctcag

SEQ ID NO: 964090 - DNA, 17 bp, Homo sapiens
tatggcagaggtgcaag

SEQ ID NO: 964091 - DNA, 20 bp, Homo sapiens
tatggcagagttgtaaatat

SEQ ID NO: 964092 - DNA, 13 bp, Homo sapiens
tatggcagcccgg

SEQ ID NO: 964093 - DNA, 18 bp, Homo sapiens
tatggcaggactcctggc

SEQ ID NO: 964094 - DNA, 22 bp, Homo sapiens
tatggcaggactcctggcaggg

SEQ ID NO: 964095 - DNA, 17 bp, Homo sapiens
tatggcatatttatatt

SEQ ID NO: 964096 - DNA, 19 bp, Homo sapiens
tatggcatatttatattgt

SEQ ID NO: 964097 - DNA, 16 bp, Homo sapiens
tatggcatgatttata

SEQ ID NO: 964098 - DNA, 19 bp, Homo sapiens
tatggccacatttaatatc

SEQ ID NO: 964099 - DNA, 19 bp, Homo sapiens
tatggccatgccctagacc

SEQ ID NO: 964100 - DNA, 23 bp, Homo sapiens
tatggcccagaaacaacagggga

SEQ ID NO: 964101 - DNA, 13 bp, Homo sapiens
tatggcccagcct

SEQ ID NO: 964102 - DNA, 15 bp, Homo sapiens
tatggcccagccttg

SEQ ID NO: 964103 - DNA, 13 bp, Homo sapiens
tatggcccaggca

SEQ ID NO: 964104 - DNA, 15 bp, Homo sapiens
tatggcccaggcagc

SEQ ID NO: 964105 - DNA, 16 bp, Homo sapiens
tatggcccaggcagcc

SEQ ID NO: 964106 - DNA, 17 bp, Homo sapiens
tatggcccaggcagcct

SEQ ID NO: 964107 - DNA, 20 bp, Homo sapiens
tatggccctggcctagcata

SEQ ID NO: 964108 - DNA, 16 bp, Homo sapiens
tatggcggcctgcagt

SEQ ID NO: 964109 - DNA, 19 bp, Homo sapiens
tatggcggcctgcagtggt

SEQ ID NO: 964110 - DNA, 21 bp, Homo sapiens
tatggctagacaggaaccctt

SEQ ID NO: 964111 - DNA, 22 bp, Homo sapiens
tatggctatctatacctgcctt

SEQ ID NO: 964112 - DNA, 14 bp, Homo sapiens
tatggctgcccagg

SEQ ID NO: 964113 - DNA, 15 bp, Homo sapiens
tatggcttatttcta

SEQ ID NO: 964114 - DNA, 22 bp, Homo sapiens
tatggcttatttctatgacaaa

SEQ ID NO: 964115 - DNA, 18 bp, Homo sapiens
tatggcttttgtgcatta

SEQ ID NO: 964116 - DNA, 19 bp, Homo sapiens
tatgggaaaaaaactgaag

SEQ ID NO: 964117 - DNA, 19 bp, Homo sapiens
tatgggagcttaactttat

SEQ ID NO: 964118 - DNA, 21 bp, Homo sapiens
tatggggaaggttatcagtgc

SEQ ID NO: 964119 - DNA, 20 bp, Homo sapiens
tatggggctgaacggggaga

SEQ ID NO: 964120 - DNA, 19 bp, Homo sapiens
tatgggggcatctcttccc

SEQ ID NO: 964121 - DNA, 23 bp, Homo sapiens
tatggggggccaacaccagggat

SEQ ID NO: 964122 - DNA, 23 bp, Homo sapiens
tatgggggttgtaaattggcatg

SEQ ID NO: 964123 - DNA, 14 bp, Homo sapiens
tatgggtcctctgg

SEQ ID NO: 964124 - DNA, 14 bp, Homo sapiens
tatggtagaaaaat

SEQ ID NO: 964125 - DNA, 19 bp, Homo sapiens
tatggtagaaaaatttcac

SEQ ID NO: 964126 - DNA, 18 bp, Homo sapiens
tatggtaggggagggcag

SEQ ID NO: 964127 - DNA, 17 bp, Homo sapiens
tatggtatgctggccag

SEQ ID NO: 964128 - DNA, 18 bp, Homo sapiens
tatggtatgctggccagc

SEQ ID NO: 964129 - DNA, 19 bp, Homo sapiens
tatggtatgctggccagca

SEQ ID NO: 964130 - DNA, 14 bp, Homo sapiens
tatggtatgtagcc

SEQ ID NO: 964131 - DNA, 15 bp, Homo sapiens
tatggtattacaaaa

SEQ ID NO: 964132 - DNA, 21 bp, Homo sapiens
tatggtatttattttttcttt

SEQ ID NO: 964133 - DNA, 22 bp, Homo sapiens
tatggtcaacacttaagggttt

SEQ ID NO: 964134 - DNA, 15 bp, Homo sapiens
tatggtcatagccca

SEQ ID NO: 964135 - DNA, 16 bp, Homo sapiens
tatggtccagaaactc

SEQ ID NO: 964136 - DNA, 22 bp, Homo sapiens
tatggtcttgagccagtaatct

SEQ ID NO: 964137 - DNA, 20 bp, Homo sapiens
tatggtgagatgcagctgga

SEQ ID NO: 964138 - DNA, 23 bp, Homo sapiens
tatggtgtgttgtatctttgtaa

SEQ ID NO: 964139 - DNA, 13 bp, Homo sapiens
tatggttatgttt

SEQ ID NO: 964140 - DNA, 17 bp, Homo sapiens
tatggttcccaataaaa

SEQ ID NO: 964141 - DNA, 21 bp, Homo sapiens
gatactacaacttttgttttc

SEQ ID NO: 964142 - DNA, 16 bp, Homo sapiens
gatactacagtttgtt

SEQ ID NO: 964143 - DNA, 13 bp, Homo sapiens
gatactacatctt

SEQ ID NO: 964144 - DNA, 15 bp, Homo sapiens
gatactctcagattt

SEQ ID NO: 964145 - DNA, 18 bp, Homo sapiens
gatactgcgactttctgc

SEQ ID NO: 964146 - DNA, 14 bp, Homo sapiens
gatactggaagttt

SEQ ID NO: 964147 - DNA, 19 bp, Homo sapiens
gatactggaagttttgcat

SEQ ID NO: 964148 - DNA, 13 bp, Homo sapiens
gatactggcacag

SEQ ID NO: 964149 - DNA, 17 bp, Homo sapiens
gatactgtcttagaaga

SEQ ID NO: 964150 - DNA, 17 bp, Homo sapiens
gatactgtttcttgcac

SEQ ID NO: 964151 - DNA, 13 bp, Homo sapiens
gatacttcaggtg

SEQ ID NO: 964152 - DNA, 15 bp, Homo sapiens
gatacttcaggtgct

SEQ ID NO: 964153 - DNA, 21 bp, Homo sapiens
gatacttcctgccctaactct

SEQ ID NO: 964154 - DNA, 14 bp, Homo sapiens
gatacttcctgggt

SEQ ID NO: 964155 - DNA, 15 bp, Homo sapiens
gatacttgaattttt

SEQ ID NO: 964156 - DNA, 13 bp, Homo sapiens
gatacttggattt

SEQ ID NO: 964157 - DNA, 20 bp, Homo sapiens
gatacttggatttagtttca

SEQ ID NO: 964158 - DNA, 23 bp, Homo sapiens
gatacttggatttagtttcagta

SEQ ID NO: 964159 - DNA, 13 bp, Homo sapiens
gatactttacatg

SEQ ID NO: 964160 - DNA, 17 bp, Homo sapiens
gatactttagccatcat

SEQ ID NO: 964161 - DNA, 16 bp, Homo sapiens
gatagaaataaatagc

SEQ ID NO: 964162 - DNA, 23 bp, Homo sapiens
gatagaacacaaaacttgaaaga

SEQ ID NO: 964163 - DNA, 13 bp, Homo sapiens
gatagaactactt

SEQ ID NO: 964164 - DNA, 21 bp, Homo sapiens
gatagaactttgccagtcttt

SEQ ID NO: 964165 - DNA, 23 bp, Homo sapiens
gatagaatgatgttttaaaaaaa

SEQ ID NO: 964166 - DNA, 14 bp, Homo sapiens
gatagacactggac

SEQ ID NO: 964167 - DNA, 15 bp, Homo sapiens
gatagacactggaca

SEQ ID NO: 964168 - DNA, 11 bp, Homo sapiens
gatagagaaat

SEQ ID NO: 964169 - DNA, 21 bp, Homo sapiens
gatagatgcacttatgcagta

SEQ ID NO: 964170 - DNA, 20 bp, Homo sapiens
gatagcatggggcccctggc

SEQ ID NO: 964171 - DNA, 22 bp, Homo sapiens
gatagcatggggcccctggccc

SEQ ID NO: 964172 - DNA, 23 bp, Homo sapiens
gatagcatggggcccctggccca

SEQ ID NO: 964173 - DNA, 14 bp, Homo sapiens
gatagcccagaaca

SEQ ID NO: 964174 - DNA, 13 bp, Homo sapiens
gatagcccaggag

SEQ ID NO: 964175 - DNA, 14 bp, Homo sapiens
gatagcccaggagc

SEQ ID NO: 964176 - DNA, 16 bp, Homo sapiens
gatagctaacatttta

SEQ ID NO: 964177 - DNA, 20 bp, Homo sapiens
gatagctaacattttaaata

SEQ ID NO: 964178 - DNA, 20 bp, Homo sapiens
gatagctaactgtaaatcat

SEQ ID NO: 964179 - DNA, 16 bp, Homo sapiens
gatagctattaagata

SEQ ID NO: 964180 - DNA, 16 bp, Homo sapiens
gatagctggggcttca

SEQ ID NO: 964181 - DNA, 19 bp, Homo sapiens
gataggaagaaagaagaca

SEQ ID NO: 964182 - DNA, 17 bp, Homo sapiens
gataggagttctctgat

SEQ ID NO: 964183 - DNA, 13 bp, Homo sapiens
gataggctctgca

SEQ ID NO: 964184 - DNA, 18 bp, Homo sapiens
gatagtagcatacattta

SEQ ID NO: 964185 - DNA, 22 bp, Homo sapiens
gatagtagttaaataactgtgt

SEQ ID NO: 964186 - DNA, 23 bp, Homo sapiens
gatagtcttttgcttttggcaaa

SEQ ID NO: 964187 - DNA, 14 bp, Homo sapiens
gatagtgccaggtg

SEQ ID NO: 964188 - DNA, 20 bp, Homo sapiens
gatagtgttctgctcctgct

SEQ ID NO: 964189 - DNA, 22 bp, Homo sapiens
gatagtgttctgctcctgcttt

SEQ ID NO: 964190 - DNA, 21 bp, Homo sapiens
gatagttaaaagactgcagct

SEQ ID NO: 964191 - DNA, 19 bp, Homo sapiens
gatagttctataagaataa

SEQ ID NO: 964192 - DNA, 22 bp, Homo sapiens
gatagttttcatccataactga

SEQ ID NO: 964193 - DNA, 23 bp, Homo sapiens
gatagttttcatccataactgaa

SEQ ID NO: 964194 - DNA, 16 bp, Homo sapiens
gatataaaactctggg

SEQ ID NO: 964195 - DNA, 18 bp, Homo sapiens
gatataaaagactgacca

SEQ ID NO: 964196 - DNA, 14 bp, Homo sapiens
gatataaaatgtgc

SEQ ID NO: 964197 - DNA, 15 bp, Homo sapiens
gatataaaatgtgca

SEQ ID NO: 964198 - DNA, 23 bp, Homo sapiens
gatataaaggaccctgtttctgt

SEQ ID NO: 964199 - DNA, 12 bp, Homo sapiens
gatataagagaa

SEQ ID NO: 964200 - DNA, 18 bp, Homo sapiens
gatataagagggcttttt

SEQ ID NO: 964201 - DNA, 17 bp, Homo sapiens
gatataatcttggcttc

SEQ ID NO: 964202 - DNA, 14 bp, Homo sapiens
gatataatctttca

SEQ ID NO: 964203 - DNA, 14 bp, Homo sapiens
gatataatgaacaa

SEQ ID NO: 964204 - DNA, 18 bp, Homo sapiens
gatataatgaacaaaatt

SEQ ID NO: 964205 - DNA, 14 bp, Homo sapiens
gatataatgtattt

SEQ ID NO: 964206 - DNA, 16 bp, Homo sapiens
gatatacaaagtgtac

SEQ ID NO: 964207 - DNA, 16 bp, Homo sapiens
gatatagccagaaaaa

SEQ ID NO: 964208 - DNA, 21 bp, Homo sapiens
gatatagctaggtgacatata

SEQ ID NO: 964209 - DNA, 21 bp, Homo sapiens
tatgtctcatgtaatttgcat

SEQ ID NO: 964210 - DNA, 13 bp, Homo sapiens
tatgtctcttgag

SEQ ID NO: 964211 - DNA, 18 bp, Homo sapiens
tatgtctcttgagcatca

SEQ ID NO: 964212 - DNA, 14 bp, Homo sapiens
tatgtctgaacata

SEQ ID NO: 964213 - DNA, 14 bp, Homo sapiens
tatgtctgccttcg

SEQ ID NO: 964214 - DNA, 21 bp, Homo sapiens
tatgtctgcttctgtccagga

SEQ ID NO: 964215 - DNA, 10 bp, Homo sapiens
tatgtctgtt

SEQ ID NO: 964216 - DNA, 21 bp, Homo sapiens
tatgtctgtttttgtatcttt

SEQ ID NO: 964217 - DNA, 17 bp, Homo sapiens
tatgtcttcttttgtgg

SEQ ID NO: 964218 - DNA, 17 bp, Homo sapiens
tatgtgaaaggaacatt

SEQ ID NO: 964219 - DNA, 19 bp, Homo sapiens
tatgtgaaaggaacatttt

SEQ ID NO: 964220 - DNA, 18 bp, Homo sapiens
tatgtgaagaaaaagacc

SEQ ID NO: 964221 - DNA, 12 bp, Homo sapiens
tatgtgaagttt

SEQ ID NO: 964222 - DNA, 13 bp, Homo sapiens
tatgtgaagtttt

SEQ ID NO: 964223 - DNA, 14 bp, Homo sapiens
tatgtgaagttttc

SEQ ID NO: 964224 - DNA, 18 bp, Homo sapiens
tatgtgaatttttaagct

SEQ ID NO: 964225 - DNA, 19 bp, Homo sapiens
tatgtgacattttacatta

SEQ ID NO: 964226 - DNA, 21 bp, Homo sapiens
tatgtgacattttacattaaa

SEQ ID NO: 964227 - DNA, 15 bp, Homo sapiens
tatgtgacttttctg

SEQ ID NO: 964228 - DNA, 23 bp, Homo sapiens
tatgtgagctgtaaaaatgttac

SEQ ID NO: 964229 - DNA, 19 bp, Homo sapiens
tatgtgagtagtcttatgt

SEQ ID NO: 964230 - DNA, 22 bp, Homo sapiens
tatgtgagtagtcttatgtaaa

SEQ ID NO: 964231 - DNA, 13 bp, Homo sapiens
tatgtgagtgtgt

SEQ ID NO: 964232 - DNA, 15 bp, Homo sapiens
tatgtgatggactgg

SEQ ID NO: 964233 - DNA, 13 bp, Homo sapiens
tatgtgattacaa

SEQ ID NO: 964234 - DNA, 23 bp, Homo sapiens
tatgtgcattattcataaaaaat

SEQ ID NO: 964235 - DNA, 19 bp, Homo sapiens
tatgtgctagaacaatggg

SEQ ID NO: 964236 - DNA, 19 bp, Homo sapiens
tatgtgctatcacatgtga

SEQ ID NO: 964237 - DNA, 18 bp, Homo sapiens
tatgtggaagtatacctg

SEQ ID NO: 964238 - DNA, 19 bp, Homo sapiens
tatgtggattttgcatgta

SEQ ID NO: 964239 - DNA, 23 bp, Homo sapiens
tatgtgggcagattttcagcaaa

SEQ ID NO: 964240 - DNA, 14 bp, Homo sapiens
tatgtggtcttatg

SEQ ID NO: 964241 - DNA, 12 bp, Homo sapiens
tatgtgtaaaga

SEQ ID NO: 964242 - DNA, 12 bp, Homo sapiens
tatgtgtatgta

SEQ ID NO: 964243 - DNA, 16 bp, Homo sapiens
tatgtgtctttataga

SEQ ID NO: 964244 - DNA, 21 bp, Homo sapiens
tatgtgtgaggagctgctggc

SEQ ID NO: 964245 - DNA, 16 bp, Homo sapiens
tatgtgtgtagactgt

SEQ ID NO: 964246 - DNA, 20 bp, Homo sapiens
tatgtgtgtaggttatcttt

SEQ ID NO: 964247 - DNA, 13 bp, Homo sapiens
tatgtgtgtttaa

SEQ ID NO: 964248 - DNA, 20 bp, Homo sapiens
tatgtgtgtttaaataaagt

SEQ ID NO: 964249 - DNA, 18 bp, Homo sapiens
tatgtgtgtttctgtcct

SEQ ID NO: 964250 - DNA, 13 bp, Homo sapiens
tatgtgttacatt

SEQ ID NO: 964251 - DNA, 13 bp, Homo sapiens
tatgtgtttctgt

SEQ ID NO: 964252 - DNA, 15 bp, Homo sapiens
tatgttaaaagattt

SEQ ID NO: 964253 - DNA, 13 bp, Homo sapiens
tatgttaaatact

SEQ ID NO: 964254 - DNA, 22 bp, Homo sapiens
tatgttaagcagctaaattttc

SEQ ID NO: 964255 - DNA, 19 bp, Homo sapiens
tatgttaagctctttatga

SEQ ID NO: 964256 - DNA, 19 bp, Homo sapiens
tatgttaagggaagaattc

SEQ ID NO: 964257 - DNA, 14 bp, Homo sapiens
tatgttaatatgtt

SEQ ID NO: 964258 - DNA, 20 bp, Homo sapiens
tatgttatacaaccttcatt

SEQ ID NO: 964259 - DNA, 21 bp, Homo sapiens
tatgttatacaaccttcattt

SEQ ID NO: 964260 - DNA, 22 bp, Homo sapiens
tatgttatagaacttcatggat

SEQ ID NO: 964261 - DNA, 14 bp, Homo sapiens
tatgttatatcaac

SEQ ID NO: 964262 - DNA, 22 bp, Homo sapiens
tatgttattcctggttaagcag

SEQ ID NO: 964263 - DNA, 20 bp, Homo sapiens
tatgttcagaaatgtaaatg

SEQ ID NO: 964264 - DNA, 14 bp, Homo sapiens
tatgttcatttgtt

SEQ ID NO: 964265 - DNA, 17 bp, Homo sapiens
tatgttcatttgtttgt

SEQ ID NO: 964266 - DNA, 12 bp, Homo sapiens
tatgttcctaag

SEQ ID NO: 964267 - DNA, 12 bp, Homo sapiens
tatgttcttggc

SEQ ID NO: 964268 - DNA, 21 bp, Homo sapiens
tatgttgcccaagctggtctt

SEQ ID NO: 964269 - DNA, 16 bp, Homo sapiens
gatattgtacataaaa

SEQ ID NO: 964270 - DNA, 17 bp, Homo sapiens
gatattgtacataaaag

SEQ ID NO: 964271 - DNA, 14 bp, Homo sapiens
gatattgttctcca

SEQ ID NO: 964272 - DNA, 16 bp, Homo sapiens
gatattgtttaaaatt

SEQ ID NO: 964273 - DNA, 18 bp, Homo sapiens
gatattgtttaaaattca

SEQ ID NO: 964274 - DNA, 11 bp, Homo sapiens
gatattgtttg

SEQ ID NO: 964275 - DNA, 16 bp, Homo sapiens
gatatttaagaaaata

SEQ ID NO: 964276 - DNA, 22 bp, Homo sapiens
gatatttaattcacctcagcct

SEQ ID NO: 964277 - DNA, 22 bp, Homo sapiens
gatatttaggagtgtgtgacat

SEQ ID NO: 964278 - DNA, 23 bp, Homo sapiens
gatatttatatttttattttatt

SEQ ID NO: 964279 - DNA, 11 bp, Homo sapiens
gatatttccta

SEQ ID NO: 964280 - DNA, 16 bp, Homo sapiens
gatatttcttgctttc

SEQ ID NO: 964281 - DNA, 17 bp, Homo sapiens
gatatttcttgctttca

SEQ ID NO: 964282 - DNA, 18 bp, Homo sapiens
gatatttgcagtttttca

SEQ ID NO: 964283 - DNA, 22 bp, Homo sapiens
gatatttgtcatgctgggattt

SEQ ID NO: 964284 - DNA, 23 bp, Homo sapiens
gatattttatctattggcctgtt

SEQ ID NO: 964285 - DNA, 19 bp, Homo sapiens
gatattttcaacgcagccc

SEQ ID NO: 964286 - DNA, 16 bp, Homo sapiens
gatattttcccttttt

SEQ ID NO: 964287 - DNA, 21 bp, Homo sapiens
gatattttccctttttaaaaa

SEQ ID NO: 964288 - DNA, 22 bp, Homo sapiens
gatattttccctttttaaaaaa

SEQ ID NO: 964289 - DNA, 14 bp, Homo sapiens
gatattttctctag

SEQ ID NO: 964290 - DNA, 15 bp, Homo sapiens
gatattttgctttgt

SEQ ID NO: 964291 - DNA, 17 bp, Homo sapiens
gatattttgtaaaatgt

SEQ ID NO: 964292 - DNA, 20 bp, Homo sapiens
gatattttgtaaaatgtatt

SEQ ID NO: 964293 - DNA, 17 bp, Homo sapiens
gatatttttatctttat

SEQ ID NO: 964294 - DNA, 19 bp, Homo sapiens
gatatttttatgtgcagcg

SEQ ID NO: 964295 - DNA, 17 bp, Homo sapiens
gatatttttgtacttga

SEQ ID NO: 964296 - DNA, 16 bp, Homo sapiens
gatattttttctgaat

SEQ ID NO: 964297 - DNA, 17 bp, Homo sapiens
gatcaaaataaaaagtg

SEQ ID NO: 964298 - DNA, 15 bp, Homo sapiens
gatcaaacctttctg

SEQ ID NO: 964299 - DNA, 19 bp, Homo sapiens
gatcaaacctttctggcct

SEQ ID NO: 964300 - DNA, 12 bp, Homo sapiens
gatcaaagatga

SEQ ID NO: 964301 - DNA, 16 bp, Homo sapiens
gatcaaatactttaaa

SEQ ID NO: 964302 - DNA, 17 bp, Homo sapiens
gatcaaatactttaaag

SEQ ID NO: 964303 - DNA, 16 bp, Homo sapiens
gatcaaatagttgcat

SEQ ID NO: 964304 - DNA, 17 bp, Homo sapiens
gatcaacaatacctttt

SEQ ID NO: 964305 - DNA, 12 bp, Homo sapiens
gatcaacattta

SEQ ID NO: 964306 - DNA, 17 bp, Homo sapiens
gatcaacatttatgacc

SEQ ID NO: 964307 - DNA, 18 bp, Homo sapiens
gatcaacgcctcactgaa

SEQ ID NO: 964308 - DNA, 17 bp, Homo sapiens
gatcaagaaatgtctct

SEQ ID NO: 964309 - DNA, 15 bp, Homo sapiens
gatcaagagaatcaa

SEQ ID NO: 964310 - DNA, 22 bp, Homo sapiens
gatcaagagaatcaacagatga

SEQ ID NO: 964311 - DNA, 20 bp, Homo sapiens
gatcaagcttgtgtacttga

SEQ ID NO: 964312 - DNA, 13 bp, Homo sapiens
gatcaagtattac

SEQ ID NO: 964313 - DNA, 18 bp, Homo sapiens
gatcaataaaatgtgatt

SEQ ID NO: 964314 - DNA, 19 bp, Homo sapiens
gatcaataaaatgtgattt

SEQ ID NO: 964315 - DNA, 21 bp, Homo sapiens
gatcaataaaatgtgattttt

SEQ ID NO: 964316 - DNA, 13 bp, Homo sapiens
gatcacaaaaaca

SEQ ID NO: 964317 - DNA, 14 bp, Homo sapiens
gatcacaagatgga

SEQ ID NO: 964318 - DNA, 12 bp, Homo sapiens
gatcacacagtg

SEQ ID NO: 964319 - DNA, 15 bp, Homo sapiens
gatcacacagtgtta

SEQ ID NO: 964320 - DNA, 18 bp, Homo sapiens
gatcacacctcagtggga

SEQ ID NO: 964321 - DNA, 14 bp, Homo sapiens
gatcacagcctcca

SEQ ID NO: 964322 - DNA, 16 bp, Homo sapiens
gatcacagcctccagg

SEQ ID NO: 964323 - DNA, 20 bp, Homo sapiens
gatcacagcctccagggccc

SEQ ID NO: 964324 - DNA, 12 bp, Homo sapiens
gatcacagctcc

SEQ ID NO: 964325 - DNA, 13 bp, Homo sapiens
gatcacatctaaa

SEQ ID NO: 964326 - DNA, 20 bp, Homo sapiens
gatcaccatgttagccttag

SEQ ID NO: 964327 - DNA, 14 bp, Homo sapiens
gatcacctgaggtt

SEQ ID NO: 964328 - DNA, 13 bp, Homo sapiens
gatcactcctgga

SEQ ID NO: 964329 - DNA, 17 bp, Homo sapiens
gatcactgaatttataa

SEQ ID NO: 964330 - DNA, 13 bp, Homo sapiens
gatcactgccaca

SEQ ID NO: 964331 - DNA, 16 bp, Homo sapiens
gatcactgccacactc

SEQ ID NO: 964332 - DNA, 17 bp, Homo sapiens
tattaactttaatgttt

SEQ ID NO: 964333 - DNA, 12 bp, Homo sapiens
tattaagaaagg

SEQ ID NO: 964334 - DNA, 23 bp, Homo sapiens
tattaagaaaggaagcattgtaa

SEQ ID NO: 964335 - DNA, 24 bp, Homo sapiens
tattaagaaaggaagcattgtaaa

SEQ ID NO: 964336 - DNA, 13 bp, Homo sapiens
tattaagacagtg

SEQ ID NO: 964337 - DNA, 15 bp, Homo sapiens
tattaagacagtgta

SEQ ID NO: 964338 - DNA, 16 bp, Homo sapiens
tattaagacagtgtac

SEQ ID NO: 964339 - DNA, 17 bp, Homo sapiens
tattaagacagtgtaca

SEQ ID NO: 964340 - DNA, 19 bp, Homo sapiens
tattaagatggattctcag

SEQ ID NO: 964341 - DNA, 20 bp, Homo sapiens
tattaagatggattctcaga

SEQ ID NO: 964342 - DNA, 15 bp, Homo sapiens
tattaagatttccaa

SEQ ID NO: 964343 - DNA, 13 bp, Homo sapiens
tattaagcacttt

SEQ ID NO: 964344 - DNA, 20 bp, Homo sapiens
tattaagcagtaaaaactgt

SEQ ID NO: 964345 - DNA, 21 bp, Homo sapiens
tattaagccaggaaacatgaa

SEQ ID NO: 964346 - DNA, 20 bp, Homo sapiens
tattaagcctaccgtatttc

SEQ ID NO: 964347 - DNA, 17 bp, Homo sapiens
tattaagggtaggatgt

SEQ ID NO: 964348 - DNA, 14 bp, Homo sapiens
tattaagtaaaatc

SEQ ID NO: 964349 - DNA, 17 bp, Homo sapiens
tattaagtgtgccaaat

SEQ ID NO: 964350 - DNA, 22 bp, Homo sapiens
tattaagtgtgccaaatcagtt

SEQ ID NO: 964351 - DNA, 15 bp, Homo sapiens
tattaatactggtat

SEQ ID NO: 964352 - DNA, 21 bp, Homo sapiens
tattaatataataatgatgat

SEQ ID NO: 964353 - DNA, 20 bp, Homo sapiens
tattaatatcaactctgaag

SEQ ID NO: 964354 - DNA, 13 bp, Homo sapiens
tattaatattatt

SEQ ID NO: 964355 - DNA, 12 bp, Homo sapiens
tattaatattta

SEQ ID NO: 964356 - DNA, 13 bp, Homo sapiens
tattaatatttaa

SEQ ID NO: 964357 - DNA, 19 bp, Homo sapiens
tattaatcatagattatta

SEQ ID NO: 964358 - DNA, 12 bp, Homo sapiens
tattaatctgtt

SEQ ID NO: 964359 - DNA, 12 bp, Homo sapiens
tattaatgcact

SEQ ID NO: 964360 - DNA, 17 bp, Homo sapiens
tattaatgcactttcta

SEQ ID NO: 964361 - DNA, 18 bp, Homo sapiens
tattaatgtctaactaca

SEQ ID NO: 964362 - DNA, 16 bp, Homo sapiens
tattaatgtttcttct

SEQ ID NO: 964363 - DNA, 20 bp, Homo sapiens
tattaattgcctgttaaata

SEQ ID NO: 964364 - DNA, 13 bp, Homo sapiens
tattaattgcttt

SEQ ID NO: 964365 - DNA, 14 bp, Homo sapiens
tattaattgctttg

SEQ ID NO: 964366 - DNA, 18 bp, Homo sapiens
tattaattgtcctgtgtc

SEQ ID NO: 964367 - DNA, 19 bp, Homo sapiens
tattaattgtcctgtgtct

SEQ ID NO: 964368 - DNA, 21 bp, Homo sapiens
tattaattttagtttttcatt

SEQ ID NO: 964369 - DNA, 16 bp, Homo sapiens
tattacaaaaacaaaa

SEQ ID NO: 964370 - DNA, 20 bp, Homo sapiens
tattacaaatattgtcatct

SEQ ID NO: 964371 - DNA, 11 bp, Homo sapiens
tattacaaatc

SEQ ID NO: 964372 - DNA, 22 bp, Homo sapiens
tattacaaattttcactgctgc

SEQ ID NO: 964373 - DNA, 15 bp, Homo sapiens
tattacaagtggctc

SEQ ID NO: 964374 - DNA, 12 bp, Homo sapiens
tattacaatgta

SEQ ID NO: 964375 - DNA, 18 bp, Homo sapiens
tattacaatgtatcttta

SEQ ID NO: 964376 - DNA, 19 bp, Homo sapiens
tattacaatgtatctttat

SEQ ID NO: 964377 - DNA, 13 bp, Homo sapiens
tattacaattttt

SEQ ID NO: 964378 - DNA, 16 bp, Homo sapiens
tattacaatttttaat

SEQ ID NO: 964379 - DNA, 19 bp, Homo sapiens
tattacagtgtttatcctt

SEQ ID NO: 964380 - DNA, 13 bp, Homo sapiens
tattacataaata

SEQ ID NO: 964381 - DNA, 16 bp, Homo sapiens
tattacatctaatgct

SEQ ID NO: 964382 - DNA, 17 bp, Homo sapiens
tattacatctaatgctt

SEQ ID NO: 964383 - DNA, 12 bp, Homo sapiens
tattacatcttt

SEQ ID NO: 964384 - DNA, 14 bp, Homo sapiens
tattacatgactgt

SEQ ID NO: 964385 - DNA, 16 bp, Homo sapiens
tattacatggcagtgt

SEQ ID NO: 964386 - DNA, 15 bp, Homo sapiens
tattacattttcagt

SEQ ID NO: 964387 - DNA, 19 bp, Homo sapiens
tattaccaccctttcacaa

SEQ ID NO: 964388 - DNA, 21 bp, Homo sapiens
tattaccccctccttcagaca

SEQ ID NO: 964389 - DNA, 13 bp, Homo sapiens
tattacctctgat

SEQ ID NO: 964390 - DNA, 19 bp, Homo sapiens
tattacctctgatacctca

SEQ ID NO: 964391 - DNA, 14 bp, Homo sapiens
tattactaaattga

SEQ ID NO: 964392 - DNA, 22 bp, Homo sapiens
tattactaaggagtaatctgtg

SEQ ID NO: 964393 - DNA, 18 bp, Homo sapiens
tattactaatgatgcttt

SEQ ID NO: 964394 - DNA, 18 bp, Homo sapiens
tattactctacactgaaa

SEQ ID NO: 964395 - DNA, 17 bp, Homo sapiens
tattactctcattcttt

SEQ ID NO: 964396 - DNA, 20 bp, Homo sapiens
tattactctcattctttgaa

SEQ ID NO: 964397 - DNA, 13 bp, Homo sapiens
tattactgattta

SEQ ID NO: 964398 - DNA, 10 bp, Homo sapiens
gatccagccc

SEQ ID NO: 964399 - DNA, 14 bp, Homo sapiens
gatccagccctggt

SEQ ID NO: 964400 - DNA, 13 bp, Homo sapiens
gatccagggatgg

SEQ ID NO: 964401 - DNA, 17 bp, Homo sapiens
gatccagtataagacta

SEQ ID NO: 964402 - DNA, 22 bp, Homo sapiens
gatccataggactaccgcaggc

SEQ ID NO: 964403 - DNA, 17 bp, Homo sapiens
gatccatccatctccag

SEQ ID NO: 964404 - DNA, 23 bp, Homo sapiens
gatcccaccccctcctcccccag

SEQ ID NO: 964405 - DNA, 13 bp, Homo sapiens
gatcccagaaagt

SEQ ID NO: 964406 - DNA, 17 bp, Homo sapiens
gatcccatgtcacctca

SEQ ID NO: 964407 - DNA, 22 bp, Homo sapiens
gatccccaagacatgtggaggg

SEQ ID NO: 964408 - DNA, 14 bp, Homo sapiens
gatccccagctgtt

SEQ ID NO: 964409 - DNA, 16 bp, Homo sapiens
gatccccagctttctc

SEQ ID NO: 964410 - DNA, 17 bp, Homo sapiens
gatccccagctttctcc

SEQ ID NO: 964411 - DNA, 14 bp, Homo sapiens
gatccccagggcag

SEQ ID NO: 964412 - DNA, 12 bp, Homo sapiens
gatcccccagaa

SEQ ID NO: 964413 - DNA, 18 bp, Homo sapiens
gatccccgacagtggctc

SEQ ID NO: 964414 - DNA, 21 bp, Homo sapiens
gatccccgacagtggctctcc

SEQ ID NO: 964415 - DNA, 14 bp, Homo sapiens
gatccccgcctggc

SEQ ID NO: 964416 - DNA, 19 bp, Homo sapiens
gatccccgcctggccagga

SEQ ID NO: 964417 - DNA, 20 bp, Homo sapiens
gatccccgcctggccaggag

SEQ ID NO: 964418 - DNA, 13 bp, Homo sapiens
gatcccctccccc

SEQ ID NO: 964419 - DNA, 21 bp, Homo sapiens
gatcccgcctcttcttcttca

SEQ ID NO: 964420 - DNA, 18 bp, Homo sapiens
gatccctaatgtgtttct

SEQ ID NO: 964421 - DNA, 18 bp, Homo sapiens
gatccctcatctgtccct

SEQ ID NO: 964422 - DNA, 11 bp, Homo sapiens
gatccctccac

SEQ ID NO: 964423 - DNA, 21 bp, Homo sapiens
gatccctgaacccctggccag

SEQ ID NO: 964424 - DNA, 17 bp, Homo sapiens
gatcccttaagaagtta

SEQ ID NO: 964425 - DNA, 20 bp, Homo sapiens
gatccgactgctttggacct

SEQ ID NO: 964426 - DNA, 19 bp, Homo sapiens
gatccgagcgacggctcct

SEQ ID NO: 964427 - DNA, 16 bp, Homo sapiens
gatccgcaagagtaaa

SEQ ID NO: 964428 - DNA, 21 bp, Homo sapiens
gatccgcctacctcagcctcc

SEQ ID NO: 964429 - DNA, 15 bp, Homo sapiens
gatccgctgccacca

SEQ ID NO: 964430 - DNA, 15 bp, Homo sapiens
gatcctaaactctct

SEQ ID NO: 964431 - DNA, 15 bp, Homo sapiens
gatcctaagaatttt

SEQ ID NO: 964432 - DNA, 18 bp, Homo sapiens
gatcctatcctcctacct

SEQ ID NO: 964433 - DNA, 19 bp, Homo sapiens
gatcctcacaaccacctaa

SEQ ID NO: 964434 - DNA, 18 bp, Homo sapiens
gatcctcagcccctccag

SEQ ID NO: 964435 - DNA, 18 bp, Homo sapiens
gatcctcccatctcagcc

SEQ ID NO: 964436 - DNA, 19 bp, Homo sapiens
gatcctcctatgtgtgcct

SEQ ID NO: 964437 - DNA, 16 bp, Homo sapiens
gatcctcctgcagacc

SEQ ID NO: 964438 - DNA, 17 bp, Homo sapiens
gatcctctccaccctcc

SEQ ID NO: 964439 - DNA, 20 bp, Homo sapiens
gatcctctccaccctcctct

SEQ ID NO: 964440 - DNA, 13 bp, Homo sapiens
gatcctgagctgc

SEQ ID NO: 964441 - DNA, 16 bp, Homo sapiens
gatcctgcaccccagc

SEQ ID NO: 964442 - DNA, 22 bp, Homo sapiens
gatcctgcaggaacgagcactg

SEQ ID NO: 964443 - DNA, 11 bp, Homo sapiens
gatcctgcccc

SEQ ID NO: 964444 - DNA, 17 bp, Homo sapiens
gatcctgcgggtggggc

SEQ ID NO: 964445 - DNA, 17 bp, Homo sapiens
gatcctggattcactca

SEQ ID NO: 964446 - DNA, 19 bp, Homo sapiens
gatcctggattcactcact

SEQ ID NO: 964447 - DNA, 20 bp, Homo sapiens
gatcctggttaccactcttt

SEQ ID NO: 964448 - DNA, 20 bp, Homo sapiens
gatcctgtctttaaggaaaa

SEQ ID NO: 964449 - DNA, 16 bp, Homo sapiens
gatccttcacaggcag

SEQ ID NO: 964450 - DNA, 22 bp, Homo sapiens
gatccttcacaggcagtgcatg

SEQ ID NO: 964451 - DNA, 13 bp, Homo sapiens
gatccttccatct

SEQ ID NO: 964452 - DNA, 21 bp, Homo sapiens
gatccttccatcttgtggggc

SEQ ID NO: 964453 - DNA, 19 bp, Homo sapiens
gatccttctgagctccacc

SEQ ID NO: 964454 - DNA, 20 bp, Homo sapiens
gatccttctgagctccacct

SEQ ID NO: 964455 - DNA, 15 bp, Homo sapiens
tattattctgttttg

SEQ ID NO: 964456 - DNA, 14 bp, Homo sapiens
tattattcttgagt

SEQ ID NO: 964457 - DNA, 16 bp, Homo sapiens
tattattgaaattgta

SEQ ID NO: 964458 - DNA, 14 bp, Homo sapiens
tattattgaagatt

SEQ ID NO: 964459 - DNA, 15 bp, Homo sapiens
tattattgtgtgtta

SEQ ID NO: 964460 - DNA, 22 bp, Homo sapiens
tattatttacatcactttgtga

SEQ ID NO: 964461 - DNA, 22 bp, Homo sapiens
tattatttaccgttgcttgaaa

SEQ ID NO: 964462 - DNA, 13 bp, Homo sapiens
tattatttatata

SEQ ID NO: 964463 - DNA, 14 bp, Homo sapiens
tattatttcttctc

SEQ ID NO: 964464 - DNA, 21 bp, Homo sapiens
tattatttgcagtgcagtata

SEQ ID NO: 964465 - DNA, 12 bp, Homo sapiens
tattatttggag

SEQ ID NO: 964466 - DNA, 22 bp, Homo sapiens
tattatttgggggaactggaca

SEQ ID NO: 964467 - DNA, 14 bp, Homo sapiens
tattatttgtgttt

SEQ ID NO: 964468 - DNA, 16 bp, Homo sapiens
tattattttcacctgt

SEQ ID NO: 964469 - DNA, 16 bp, Homo sapiens
tattatttttacctaa

SEQ ID NO: 964470 - DNA, 15 bp, Homo sapiens
tattcaaaccaattt

SEQ ID NO: 964471 - DNA, 22 bp, Homo sapiens
tattcaaaccaatttcttcctt

SEQ ID NO: 964472 - DNA, 13 bp, Homo sapiens
tattcaaattcct

SEQ ID NO: 964473 - DNA, 13 bp, Homo sapiens
tattcaaatttgt

SEQ ID NO: 964474 - DNA, 17 bp, Homo sapiens
tattcaaatttgtacag

SEQ ID NO: 964475 - DNA, 20 bp, Homo sapiens
tattcaacacattggaattg

SEQ ID NO: 964476 - DNA, 19 bp, Homo sapiens
tattcaactcataagactt

SEQ ID NO: 964477 - DNA, 21 bp, Homo sapiens
tattcaaggctttaaaagtca

SEQ ID NO: 964478 - DNA, 13 bp, Homo sapiens
tattcaagtaaca

SEQ ID NO: 964479 - DNA, 15 bp, Homo sapiens
tattcaagtgcctct

SEQ ID NO: 964480 - DNA, 22 bp, Homo sapiens
tattcaataaaaaaaagaaatg

SEQ ID NO: 964481 - DNA, 20 bp, Homo sapiens
tattcaataccgctcagtat

SEQ ID NO: 964482 - DNA, 14 bp, Homo sapiens
tattcaatgcaagt

SEQ ID NO: 964483 - DNA, 15 bp, Homo sapiens
tattcaattcctctg

SEQ ID NO: 964484 - DNA, 16 bp, Homo sapiens
tattcaattcttttaa

SEQ ID NO: 964485 - DNA, 17 bp, Homo sapiens
tattcacaacctcacca

SEQ ID NO: 964486 - DNA, 22 bp, Homo sapiens
tattcacaacctcaccaaacta

SEQ ID NO: 964487 - DNA, 18 bp, Homo sapiens
tattcacaggtggacaaa

SEQ ID NO: 964488 - DNA, 13 bp, Homo sapiens
tattcacagtttt

SEQ ID NO: 964489 - DNA, 21 bp, Homo sapiens
tattcacatcgcttctgtgta

SEQ ID NO: 964490 - DNA, 22 bp, Homo sapiens
tattcacatcgcttctgtgtat

SEQ ID NO: 964491 - DNA, 16 bp, Homo sapiens
tattcaccccacaccc

SEQ ID NO: 964492 - DNA, 18 bp, Homo sapiens
tattcaccccacacccag

SEQ ID NO: 964493 - DNA, 20 bp, Homo sapiens
tattcaccctccacttcccg

SEQ ID NO: 964494 - DNA, 17 bp, Homo sapiens
tattcacctcagtagaa

SEQ ID NO: 964495 - DNA, 14 bp, Homo sapiens
tattcactggcccc

SEQ ID NO: 964496 - DNA, 19 bp, Homo sapiens
tattcactggttttacaca

SEQ ID NO: 964497 - DNA, 20 bp, Homo sapiens
tattcactgtaagtttattt

SEQ ID NO: 964498 - DNA, 18 bp, Homo sapiens
tattcagaaattaaaata

SEQ ID NO: 964499 - DNA, 21 bp, Homo sapiens
tattcagaaattaaaatatta

SEQ ID NO: 964500 - DNA, 17 bp, Homo sapiens
tattcagaactatttaa

SEQ ID NO: 964501 - DNA, 16 bp, Homo sapiens
tattcagaatctttgt

SEQ ID NO: 964502 - DNA, 15 bp, Homo sapiens
tattcagacaaaatg

SEQ ID NO: 964503 - DNA, 21 bp, Homo sapiens
tattcagacaaaatggataca

SEQ ID NO: 964504 - DNA, 22 bp, Homo sapiens
tattcagacaagcaacaggttt

SEQ ID NO: 964505 - DNA, 18 bp, Homo sapiens
tattcagaggcagtgatg

SEQ ID NO: 964506 - DNA, 12 bp, Homo sapiens
tattcagagtta

SEQ ID NO: 964507 - DNA, 19 bp, Homo sapiens
tattcagcttcatttgtgt

SEQ ID NO: 964508 - DNA, 21 bp, Homo sapiens
tattcagcttcatttgtgtca

SEQ ID NO: 964509 - DNA, 20 bp, Homo sapiens
tattcaggacttgaaagaaa

SEQ ID NO: 964510 - DNA, 18 bp, Homo sapiens
tattcagtgaaaagattt

SEQ ID NO: 964511 - DNA, 20 bp, Homo sapiens
tattcataaaaaataatggt

SEQ ID NO: 964512 - DNA, 11 bp, Homo sapiens
tattcatatta

SEQ ID NO: 964513 - DNA, 16 bp, Homo sapiens
tattcatctaatgtat

SEQ ID NO: 964514 - DNA, 12 bp, Homo sapiens
tattcatcttgt

SEQ ID NO: 964515 - DNA, 15 bp, Homo sapiens
tattcatgaaatgtg

SEQ ID NO: 964516 - DNA, 18 bp, Homo sapiens
tattcatgccatctgttt

SEQ ID NO: 964517 - DNA, 16 bp, Homo sapiens
tattcattaagctttt

SEQ ID NO: 964518 - DNA, 22 bp, Homo sapiens
tattcattatttgtcaaattgt

SEQ ID NO: 964519 - DNA, 13 bp, Homo sapiens
tattcatttaaaa

SEQ ID NO: 964520 - DNA, 17 bp, Homo sapiens
tattcatttaaaatgat

SEQ ID NO: 964521 - DNA, 14 bp, Homo sapiens
tattcattttctct

SEQ ID NO: 964522 - DNA, 16 bp, Homo sapiens
tattccaaaccaaatt

SEQ ID NO: 964523 - DNA, 17 bp, Homo sapiens
tattccaaaccaaattt

SEQ ID NO: 964524 - DNA, 18 bp, Homo sapiens
tattccaaggaaaattga

SEQ ID NO: 964525 - DNA, 19 bp, Homo sapiens
gatctggtggtcagcccta

SEQ ID NO: 964526 - DNA, 14 bp, Homo sapiens
gatctgtaccatga

SEQ ID NO: 964527 - DNA, 14 bp, Homo sapiens
gatctgtataaata

SEQ ID NO: 964528 - DNA, 22 bp, Homo sapiens
gatctgtataaataagagcatg

SEQ ID NO: 964529 - DNA, 14 bp, Homo sapiens
gatctgtgccccat

SEQ ID NO: 964530 - DNA, 13 bp, Homo sapiens
gatctgttttgaa

SEQ ID NO: 964531 - DNA, 14 bp, Homo sapiens
gatcttcaatggct

SEQ ID NO: 964532 - DNA, 15 bp, Homo sapiens
gatcttcaatggctt

SEQ ID NO: 964533 - DNA, 18 bp, Homo sapiens
gatcttcagaactgccct

SEQ ID NO: 964534 - DNA, 19 bp, Homo sapiens
gatcttcagaactgccctt

SEQ ID NO: 964535 - DNA, 21 bp, Homo sapiens
gatcttcagaactgcccttgc

SEQ ID NO: 964536 - DNA, 15 bp, Homo sapiens
gatcttcccacagga

SEQ ID NO: 964537 - DNA, 17 bp, Homo sapiens
gatcttcccacaggagg

SEQ ID NO: 964538 - DNA, 23 bp, Homo sapiens
gatcttccttccgctctgaggca

SEQ ID NO: 964539 - DNA, 14 bp, Homo sapiens
gatcttctgaaatg

SEQ ID NO: 964540 - DNA, 20 bp, Homo sapiens
gatcttctgggagcaggaac

SEQ ID NO: 964541 - DNA, 19 bp, Homo sapiens
gatcttctttataattcta

SEQ ID NO: 964542 - DNA, 13 bp, Homo sapiens
gatcttgaatgtg

SEQ ID NO: 964543 - DNA, 14 bp, Homo sapiens
gatcttgaatgtgg

SEQ ID NO: 964544 - DNA, 19 bp, Homo sapiens
gatcttgagcaagttcctt

SEQ ID NO: 964545 - DNA, 13 bp, Homo sapiens
gatcttgcctgtc

SEQ ID NO: 964546 - DNA, 14 bp, Homo sapiens
gatcttgtgctcag

SEQ ID NO: 964547 - DNA, 11 bp, Homo sapiens
gatctttactc

SEQ ID NO: 964548 - DNA, 13 bp, Homo sapiens
gatctttctcttc

SEQ ID NO: 964549 - DNA, 15 bp, Homo sapiens
gatctttctcttccc

SEQ ID NO: 964550 - DNA, 18 bp, Homo sapiens
gatctttctttccaaaac

SEQ ID NO: 964551 - DNA, 23 bp, Homo sapiens
gatctttgagcccattcttctgg

SEQ ID NO: 964552 - DNA, 11 bp, Homo sapiens
gatctttgtgg

SEQ ID NO: 964553 - DNA, 14 bp, Homo sapiens
gatctttgtggcca

SEQ ID NO: 964554 - DNA, 15 bp, Homo sapiens
gatctttgtggccaa

SEQ ID NO: 964555 - DNA, 17 bp, Homo sapiens
gatctttgtttaaatgc

SEQ ID NO: 964556 - DNA, 18 bp, Homo sapiens
gatctttgtttaaatgcc

SEQ ID NO: 964557 - DNA, 16 bp, Homo sapiens
gatcttttaaaatcat

SEQ ID NO: 964558 - DNA, 16 bp, Homo sapiens
gatctttttatacaca

SEQ ID NO: 964559 - DNA, 18 bp, Homo sapiens
gatgaaaactaaggattt

SEQ ID NO: 964560 - DNA, 15 bp, Homo sapiens
gatgaaaagtacatg

SEQ ID NO: 964561 - DNA, 14 bp, Homo sapiens
gatgaaaataattt

SEQ ID NO: 964562 - DNA, 14 bp, Homo sapiens
gatgaaacattcat

SEQ ID NO: 964563 - DNA, 13 bp, Homo sapiens
gatgaaataattt

SEQ ID NO: 964564 - DNA, 14 bp, Homo sapiens
gatgaaataatttt

SEQ ID NO: 964565 - DNA, 18 bp, Homo sapiens
gatgaaatctgctagaaa

SEQ ID NO: 964566 - DNA, 21 bp, Homo sapiens
gatgaaatctgctagaaagtt

SEQ ID NO: 964567 - DNA, 15 bp, Homo sapiens
gatgaaatgcactgt

SEQ ID NO: 964568 - DNA, 20 bp, Homo sapiens
gatgaaatttatttccatct

SEQ ID NO: 964569 - DNA, 14 bp, Homo sapiens
gatgaacatctaac

SEQ ID NO: 964570 - DNA, 23 bp, Homo sapiens
gatgaacatttcaaattgaattt

SEQ ID NO: 964571 - DNA, 18 bp, Homo sapiens
gatgaactcttagaaatg

SEQ ID NO: 964572 - DNA, 22 bp, Homo sapiens
gatgaactcttagaaatgaagg

SEQ ID NO: 964573 - DNA, 18 bp, Homo sapiens
gatgaactgactgaagga

SEQ ID NO: 964574 - DNA, 19 bp, Homo sapiens
gatgaacttattctgtaga

SEQ ID NO: 964575 - DNA, 14 bp, Homo sapiens
gatgaagaaattta

SEQ ID NO: 964576 - DNA, 19 bp, Homo sapiens
gatgaagaacacagcatgt

SEQ ID NO: 964577 - DNA, 21 bp, Homo sapiens
gatgaagagtgagagggcatg

SEQ ID NO: 964578 - DNA, 19 bp, Homo sapiens
tattctctctatgcaaaat

SEQ ID NO: 964579 - DNA, 18 bp, Homo sapiens
tattctctgagctgtgca

SEQ ID NO: 964580 - DNA, 21 bp, Homo sapiens
tattctcttaatttttcttaa

SEQ ID NO: 964581 - DNA, 12 bp, Homo sapiens
tattctcttcac

SEQ ID NO: 964582 - DNA, 15 bp, Homo sapiens
tattctgacatgtaa

SEQ ID NO: 964583 - DNA, 20 bp, Homo sapiens
tattctgacatgtaagaaaa

SEQ ID NO: 964584 - DNA, 13 bp, Homo sapiens
tattctgagcctt

SEQ ID NO: 964585 - DNA, 15 bp, Homo sapiens
tattctgagccttga

SEQ ID NO: 964586 - DNA, 23 bp, Homo sapiens
tattctgcctacgttctctttaa

SEQ ID NO: 964587 - DNA, 14 bp, Homo sapiens
tattctggaaaaaa

SEQ ID NO: 964588 - DNA, 19 bp, Homo sapiens
tattctggaaaaaaaatat

SEQ ID NO: 964589 - DNA, 23 bp, Homo sapiens
tattctggaaaaaaaatatatat

SEQ ID NO: 964590 - DNA, 9 bp, Homo sapiens
tattctgtc

SEQ ID NO: 964591 - DNA, 22 bp, Homo sapiens
tattctgtcagtgttaaagatt

SEQ ID NO: 964592 - DNA, 11 bp, Homo sapiens
tattctgtcat

SEQ ID NO: 964593 - DNA, 15 bp, Homo sapiens
tattctgtcatttac

SEQ ID NO: 964594 - DNA, 14 bp, Homo sapiens
tattctgtgttgaa

SEQ ID NO: 964595 - DNA, 15 bp, Homo sapiens
tattctgtttctagg

SEQ ID NO: 964596 - DNA, 16 bp, Homo sapiens
tattctgtttctaggc

SEQ ID NO: 964597 - DNA, 23 bp, Homo sapiens
tattcttaacagatctttactct

SEQ ID NO: 964598 - DNA, 22 bp, Homo sapiens
tattcttattaaggaaatactt

SEQ ID NO: 964599 - DNA, 15 bp, Homo sapiens
tattcttattggaaa

SEQ ID NO: 964600 - DNA, 19 bp, Homo sapiens
tattcttattggaaatgta

SEQ ID NO: 964601 - DNA, 20 bp, Homo sapiens
tattcttattggaaatgtac

SEQ ID NO: 964602 - DNA, 15 bp, Homo sapiens
tattcttatttaatg

SEQ ID NO: 964603 - DNA, 12 bp, Homo sapiens
tattcttccaga

SEQ ID NO: 964604 - DNA, 14 bp, Homo sapiens
tattcttccagaat

SEQ ID NO: 964605 - DNA, 13 bp, Homo sapiens
tattcttctcttc

SEQ ID NO: 964606 - DNA, 18 bp, Homo sapiens
tattcttggaccatgcca

SEQ ID NO: 964607 - DNA, 14 bp, Homo sapiens
tattcttggttttc

SEQ ID NO: 964608 - DNA, 18 bp, Homo sapiens
tattcttgttagaatctg

SEQ ID NO: 964609 - DNA, 15 bp, Homo sapiens
tattctttctgcctt

SEQ ID NO: 964610 - DNA, 23 bp, Homo sapiens
tattgaaaaatacgttttgtgta

SEQ ID NO: 964611 - DNA, 14 bp, Homo sapiens
tattgaaaacttca

SEQ ID NO: 964612 - DNA, 18 bp, Homo sapiens
tattgaaagaattatcct

SEQ ID NO: 964613 - DNA, 21 bp, Homo sapiens
tattgaaaggggacacctgta

SEQ ID NO: 964614 - DNA, 17 bp, Homo sapiens
tattgaaagttgctttt

SEQ ID NO: 964615 - DNA, 13 bp, Homo sapiens
tattgaaatatta

SEQ ID NO: 964616 - DNA, 12 bp, Homo sapiens
tattgaaatgta

SEQ ID NO: 964617 - DNA, 16 bp, Homo sapiens
tattgaaatgtataat

SEQ ID NO: 964618 - DNA, 13 bp, Homo sapiens
tattgaaattcta

SEQ ID NO: 964619 - DNA, 20 bp, Homo sapiens
tattgaaattgtacatattt

SEQ ID NO: 964620 - DNA, 18 bp, Homo sapiens
tattgaacttggaaagaa

SEQ ID NO: 964621 - DNA, 17 bp, Homo sapiens
tattgaagacaatttga

SEQ ID NO: 964622 - DNA, 21 bp, Homo sapiens
tattgaagacaatttgataca

SEQ ID NO: 964623 - DNA, 22 bp, Homo sapiens
tattgaagacaatttgatacat

SEQ ID NO: 964624 - DNA, 14 bp, Homo sapiens
tattgaaggaattt

SEQ ID NO: 964625 - DNA, 18 bp, Homo sapiens
tattgaaggctttaataa

SEQ ID NO: 964626 - DNA, 21 bp, Homo sapiens
tattgaagttgtttatcaact

SEQ ID NO: 964627 - DNA, 17 bp, Homo sapiens
tattgaattagaaaatt

SEQ ID NO: 964628 - DNA, 13 bp, Homo sapiens
tattgaatttttc

SEQ ID NO: 964629 - DNA, 21 bp, Homo sapiens
tattgacaataaaatattatt

SEQ ID NO: 964630 - DNA, 17 bp, Homo sapiens
tattgacaataatttca

SEQ ID NO: 964631 - DNA, 11 bp, Homo sapiens
tattgacactg

SEQ ID NO: 964632 - DNA, 16 bp, Homo sapiens
tattgacatttgtagt

SEQ ID NO: 964633 - DNA, 17 bp, Homo sapiens
tattgacatttgtagtt

SEQ ID NO: 964634 - DNA, 21 bp, Homo sapiens
tattgactgggcaacactgca

SEQ ID NO: 964635 - DNA, 19 bp, Homo sapiens
tattgacttcaatgatagt

SEQ ID NO: 964636 - DNA, 22 bp, Homo sapiens
tattgagaatcccttaaaatta

SEQ ID NO: 964637 - DNA, 19 bp, Homo sapiens
tattgagatttcttaaata

SEQ ID NO: 964638 - DNA, 19 bp, Homo sapiens
tattgagcagaattcattc

SEQ ID NO: 964639 - DNA, 20 bp, Homo sapiens
tattgaggatcagggctcct

SEQ ID NO: 964640 - DNA, 17 bp, Homo sapiens
tattgaggccaagaata

SEQ ID NO: 964641 - DNA, 19 bp, Homo sapiens
tattgaggccaagaatatt

SEQ ID NO: 964642 - DNA, 21 bp, Homo sapiens
tattgagggccagtgatgatg

SEQ ID NO: 964643 - DNA, 23 bp, Homo sapiens
tattgagggccagtgatgatgtt

SEQ ID NO: 964644 - DNA, 23 bp, Homo sapiens
tattgagtcttaactgtatttca

SEQ ID NO: 964645 - DNA, 11 bp, Homo sapiens
tattgatattc

SEQ ID NO: 964646 - DNA, 14 bp, Homo sapiens
tattgatattcaat

SEQ ID NO: 964647 - DNA, 21 bp, Homo sapiens
tattgatcccacatttccatg

SEQ ID NO: 964648 - DNA, 16 bp, Homo sapiens
tattgatgttaacaag

SEQ ID NO: 964649 - DNA, 12 bp, Homo sapiens
tattgattacaa

SEQ ID NO: 964650 - DNA, 18 bp, Homo sapiens
tattgattacaaataaac

SEQ ID NO: 964651 - DNA, 16 bp, Homo sapiens
tattgatttaaaagtg

SEQ ID NO: 964652 - DNA, 23 bp, Homo sapiens
gatgattttgcaaaatgagttgt

SEQ ID NO: 964653 - DNA, 15 bp, Homo sapiens
gatgattttgtaatt

SEQ ID NO: 964654 - DNA, 23 bp, Homo sapiens
gatgcaaatgttttgaaatgata

SEQ ID NO: 964655 - DNA, 18 bp, Homo sapiens
gatgcaacctcactatgg

SEQ ID NO: 964656 - DNA, 14 bp, Homo sapiens
gatgcaaggaccag

SEQ ID NO: 964657 - DNA, 18 bp, Homo sapiens
gatgcaaggaccaggact

SEQ ID NO: 964658 - DNA, 12 bp, Homo sapiens
gatgcaatataa

SEQ ID NO: 964659 - DNA, 18 bp, Homo sapiens
gatgcaatgtgctactga

SEQ ID NO: 964660 - DNA, 13 bp, Homo sapiens
gatgcacagagaa

SEQ ID NO: 964661 - DNA, 19 bp, Homo sapiens
gatgcacagagaagctggg

SEQ ID NO: 964662 - DNA, 21 bp, Homo sapiens
gatgcacagagttgttacatt

SEQ ID NO: 964663 - DNA, 22 bp, Homo sapiens
gatgcacagagttgttacattt

SEQ ID NO: 964664 - DNA, 18 bp, Homo sapiens
gatgcacatttctggatt

SEQ ID NO: 964665 - DNA, 15 bp, Homo sapiens
gatgcactgacctgc

SEQ ID NO: 964666 - DNA, 23 bp, Homo sapiens
gatgcagaggtaaaagtgtgagc

SEQ ID NO: 964667 - DNA, 12 bp, Homo sapiens
gatgcagctact

SEQ ID NO: 964668 - DNA, 13 bp, Homo sapiens
gatgcatcactgg

SEQ ID NO: 964669 - DNA, 16 bp, Homo sapiens
gatgcatcactgggtg

SEQ ID NO: 964670 - DNA, 22 bp, Homo sapiens
gatgcatcactgggtgttgatc

SEQ ID NO: 964671 - DNA, 20 bp, Homo sapiens
gatgcatcgggaaagaagaa

SEQ ID NO: 964672 - DNA, 23 bp, Homo sapiens
gatgcatcgggaaagaagaaact

SEQ ID NO: 964673 - DNA, 17 bp, Homo sapiens
gatgcatgatgccctcc

SEQ ID NO: 964674 - DNA, 15 bp, Homo sapiens
gatgcattaaaagaa

SEQ ID NO: 964675 - DNA, 16 bp, Homo sapiens
gatgcattaaaagaaa

SEQ ID NO: 964676 - DNA, 19 bp, Homo sapiens
gatgcattctgataggagg

SEQ ID NO: 964677 - DNA, 22 bp, Homo sapiens
gatgccaacctctggagcaatg

SEQ ID NO: 964678 - DNA, 17 bp, Homo sapiens
gatgccacacagagtgg

SEQ ID NO: 964679 - DNA, 16 bp, Homo sapiens
gatgccaccctagcca

SEQ ID NO: 964680 - DNA, 18 bp, Homo sapiens
gatgccactcctccctcc

SEQ ID NO: 964681 - DNA, 19 bp, Homo sapiens
gatgccactcctccctccg

SEQ ID NO: 964682 - DNA, 18 bp, Homo sapiens
gatgccacttctcactca

SEQ ID NO: 964683 - DNA, 11 bp, Homo sapiens
gatgccagagg

SEQ ID NO: 964684 - DNA, 14 bp, Homo sapiens
gatgccagagggcc

SEQ ID NO: 964685 - DNA, 21 bp, Homo sapiens
gatgccagagggccagcaggc

SEQ ID NO: 964686 - DNA, 12 bp, Homo sapiens
gatgccagcttc

SEQ ID NO: 964687 - DNA, 18 bp, Homo sapiens
gatgccagttacttgctt

SEQ ID NO: 964688 - DNA, 15 bp, Homo sapiens
gatgccatagcataa

SEQ ID NO: 964689 - DNA, 21 bp, Homo sapiens
gatgccatagcataatatgaa

SEQ ID NO: 964690 - DNA, 20 bp, Homo sapiens
gatgccattcttccttgcaa

SEQ ID NO: 964691 - DNA, 15 bp, Homo sapiens
gatgcccactgagga

SEQ ID NO: 964692 - DNA, 18 bp, Homo sapiens
gatgcccagagggcccag

SEQ ID NO: 964693 - DNA, 20 bp, Homo sapiens
gatgcccagagggcccaggc

SEQ ID NO: 964694 - DNA, 14 bp, Homo sapiens
gatgcccccctaga

SEQ ID NO: 964695 - DNA, 18 bp, Homo sapiens
gatgccccctccaggaga

SEQ ID NO: 964696 - DNA, 22 bp, Homo sapiens
gatgcccctgcagtttggccct

SEQ ID NO: 964697 - DNA, 16 bp, Homo sapiens
gatgcccctgctccct

SEQ ID NO: 964698 - DNA, 18 bp, Homo sapiens
gatgcccctgctccctct

SEQ ID NO: 964699 - DNA, 21 bp, Homo sapiens
gatgcccctgctccctctggg

SEQ ID NO: 964700 - DNA, 14 bp, Homo sapiens
gatggcccctcctt

SEQ ID NO: 964701 - DNA, 22 bp, Homo sapiens
gatggcccttcccactggaggt

SEQ ID NO: 964702 - DNA, 18 bp, Homo sapiens
gatggccggagaggaccg

SEQ ID NO: 964703 - DNA, 14 bp, Homo sapiens
gatggcctttcctt

SEQ ID NO: 964704 - DNA, 18 bp, Homo sapiens
gatggcctttccttccct

SEQ ID NO: 964705 - DNA, 20 bp, Homo sapiens
gatggcctttccttccctct

SEQ ID NO: 964706 - DNA, 21 bp, Homo sapiens
gatggcctttccttccctctc

SEQ ID NO: 964707 - DNA, 19 bp, Homo sapiens
gatggcctttggacccagg

SEQ ID NO: 964708 - DNA, 21 bp, Homo sapiens
gatggcgattccctctcaccc

SEQ ID NO: 964709 - DNA, 13 bp, Homo sapiens
gatggcgcgggag

SEQ ID NO: 964710 - DNA, 24 bp, Homo sapiens
gatggctcagagggggactgctgc

SEQ ID NO: 964711 - DNA, 18 bp, Homo sapiens
gatggctcccaaggttcc

SEQ ID NO: 964712 - DNA, 12 bp, Homo sapiens
gatggctcctct

SEQ ID NO: 964713 - DNA, 13 bp, Homo sapiens
gatggctcctctc

SEQ ID NO: 964714 - DNA, 21 bp, Homo sapiens
gatggctgctagattttaatt

SEQ ID NO: 964715 - DNA, 19 bp, Homo sapiens
gatggctgtgcctctgcct

SEQ ID NO: 964716 - DNA, 14 bp, Homo sapiens
gatggctgtggcat

SEQ ID NO: 964717 - DNA, 16 bp, Homo sapiens
gatggcttatttttta

SEQ ID NO: 964718 - DNA, 23 bp, Homo sapiens
gatggcttattttttaaaatatt

SEQ ID NO: 964719 - DNA, 16 bp, Homo sapiens
gatggcttcggagggc

SEQ ID NO: 964720 - DNA, 21 bp, Homo sapiens
gatggcttcggagggccgcag

SEQ ID NO: 964721 - DNA, 17 bp, Homo sapiens
gatggcttgacatgtgc

SEQ ID NO: 964722 - DNA, 19 bp, Homo sapiens
gatgggaacactggtgggc

SEQ ID NO: 964723 - DNA, 20 bp, Homo sapiens
gatgggaatagggagacagg

SEQ ID NO: 964724 - DNA, 20 bp, Homo sapiens
gatgggaccagggatggggg

SEQ ID NO: 964725 - DNA, 18 bp, Homo sapiens
gatgggactcattgtaga

SEQ ID NO: 964726 - DNA, 14 bp, Homo sapiens
gatgggaggagagc

SEQ ID NO: 964727 - DNA, 22 bp, Homo sapiens
gatgggaggagagccactgggc

SEQ ID NO: 964728 - DNA, 17 bp, Homo sapiens
gatgggagtctccctcc

SEQ ID NO: 964729 - DNA, 15 bp, Homo sapiens
gatgggagtgagaca

SEQ ID NO: 964730 - DNA, 15 bp, Homo sapiens
gatgggagtgggcac

SEQ ID NO: 964731 - DNA, 19 bp, Homo sapiens
gatgggagtgggcacctca

SEQ ID NO: 964732 - DNA, 19 bp, Homo sapiens
gatgggatggtggagggcc

SEQ ID NO: 964733 - DNA, 20 bp, Homo sapiens
gatgggatggtggagggcca

SEQ ID NO: 964734 - DNA, 16 bp, Homo sapiens
gatgggcaaagcttgt

SEQ ID NO: 964735 - DNA, 22 bp, Homo sapiens
gatgggcaaagcttgtcaaaga

SEQ ID NO: 964736 - DNA, 18 bp, Homo sapiens
gatgggcattgggctgac

SEQ ID NO: 964737 - DNA, 19 bp, Homo sapiens
gatgggccaaacccagaca

SEQ ID NO: 964738 - DNA, 17 bp, Homo sapiens
gatgggcccctggcccc

SEQ ID NO: 964739 - DNA, 22 bp, Homo sapiens
gatgggctctacctctctttct

SEQ ID NO: 964740 - DNA, 23 bp, Homo sapiens
gatgggctctacctctctttctc

SEQ ID NO: 964741 - DNA, 16 bp, Homo sapiens
gatgggcttctgttct

SEQ ID NO: 964742 - DNA, 19 bp, Homo sapiens
gatgggcttctgttctctg

SEQ ID NO: 964743 - DNA, 21 bp, Homo sapiens
gatgggcttctgttctctgct

SEQ ID NO: 964744 - DNA, 22 bp, Homo sapiens
gatgggcttctgttctctgctg

SEQ ID NO: 964745 - DNA, 18 bp, Homo sapiens
gatgggcttttgttctga

SEQ ID NO: 964746 - DNA, 21 bp, Homo sapiens
gatgggcttttgttctgaggg

SEQ ID NO: 964747 - DNA, 23 bp, Homo sapiens
gatgggcttttgttctgaggggt

SEQ ID NO: 964748 - DNA, 14 bp, Homo sapiens
gatggggactctgc

SEQ ID NO: 964749 - DNA, 11 bp, Homo sapiens
gatggggagaa

SEQ ID NO: 964750 - DNA, 13 bp, Homo sapiens
gatggggagaaag

SEQ ID NO: 964751 - DNA, 14 bp, Homo sapiens
gatggggagaaagg

SEQ ID NO: 964752 - DNA, 13 bp, Homo sapiens
gatggggagggaa

SEQ ID NO: 964753 - DNA, 18 bp, Homo sapiens
gatggggcggcggtagca

SEQ ID NO: 964754 - DNA, 15 bp, Homo sapiens
gatgggggatgcttc

SEQ ID NO: 964755 - DNA, 20 bp, Homo sapiens
gatggggtccagagagcctc

SEQ ID NO: 964756 - DNA, 23 bp, Homo sapiens
gatggggtctcacagtgttgccc

SEQ ID NO: 964757 - DNA, 18 bp, Homo sapiens
gatggggtctgtgactgg

SEQ ID NO: 964758 - DNA, 17 bp, Homo sapiens
gatggggtttcaccatg

SEQ ID NO: 964759 - DNA, 22 bp, Homo sapiens
gatgggtattaaacttgtcaga

SEQ ID NO: 964760 - DNA, 14 bp, Homo sapiens
gatgggtctgatat

SEQ ID NO: 964761 - DNA, 21 bp, Homo sapiens
gatgggtctggctgagctgaa

SEQ ID NO: 964762 - DNA, 21 bp, Homo sapiens
gatgggttctaattttggatg

SEQ ID NO: 964763 - DNA, 15 bp, Homo sapiens
gatggtaagaaacaa

SEQ ID NO: 964764 - DNA, 14 bp, Homo sapiens
gatggtaagagaaa

SEQ ID NO: 964765 - DNA, 18 bp, Homo sapiens
gatggtaagagaaaagag

SEQ ID NO: 964766 - DNA, 15 bp, Homo sapiens
gatggtactgctgag

SEQ ID NO: 964767 - DNA, 14 bp, Homo sapiens
gatggtattaatct

SEQ ID NO: 964768 - DNA, 17 bp, Homo sapiens
gatggtcagagcccagt

SEQ ID NO: 964769 - DNA, 19 bp, Homo sapiens
gatggtccatttgttcctg

SEQ ID NO: 964770 - DNA, 19 bp, Homo sapiens
gatggtcccaggaagcagg

SEQ ID NO: 964771 - DNA, 20 bp, Homo sapiens
gatggtcccaggaagcaggg

SEQ ID NO: 964772 - DNA, 21 bp, Homo sapiens
gatggtccgtgcccaggccct

SEQ ID NO: 964773 - DNA, 16 bp, Homo sapiens
gatggtcctaaataaa

SEQ ID NO: 964774 - DNA, 24 bp, Homo sapiens
gatggtcctggggctctgtgcagg

SEQ ID NO: 964775 - DNA, 17 bp, Homo sapiens
gatggtctctctccctc

SEQ ID NO: 964776 - DNA, 18 bp, Homo sapiens
gatggtggcacaggcact

SEQ ID NO: 964777 - DNA, 20 bp, Homo sapiens
gatggtggccgcccacccgc

SEQ ID NO: 964778 - DNA, 16 bp, Homo sapiens
gatggtgtccttccct

SEQ ID NO: 964779 - DNA, 17 bp, Homo sapiens
gatggtgtccttccctg

SEQ ID NO: 964780 - DNA, 14 bp, Homo sapiens
gatggtgttaaagc

SEQ ID NO: 964781 - DNA, 13 bp, Homo sapiens
tatttaactacat

SEQ ID NO: 964782 - DNA, 16 bp, Homo sapiens
tatttaactgattaaa

SEQ ID NO: 964783 - DNA, 19 bp, Homo sapiens
tatttaagaaaatacaata

SEQ ID NO: 964784 - DNA, 17 bp, Homo sapiens
tatttaagataattata

SEQ ID NO: 964785 - DNA, 17 bp, Homo sapiens
tatttaagatgtacatt

SEQ ID NO: 964786 - DNA, 22 bp, Homo sapiens
tatttaagatgtacatttaata

SEQ ID NO: 964787 - DNA, 23 bp, Homo sapiens
tatttaagatgtacatttaataa

SEQ ID NO: 964788 - DNA, 17 bp, Homo sapiens
tatttaagcaacatctt

SEQ ID NO: 964789 - DNA, 20 bp, Homo sapiens
tatttaagcctcatatttaa

SEQ ID NO: 964790 - DNA, 21 bp, Homo sapiens
tatttaaggtagcttcagcta

SEQ ID NO: 964791 - DNA, 19 bp, Homo sapiens
tatttaagtatatagtata

SEQ ID NO: 964792 - DNA, 20 bp, Homo sapiens
tatttaagttatcaacttta

SEQ ID NO: 964793 - DNA, 18 bp, Homo sapiens
tatttaatagcaaagaat

SEQ ID NO: 964794 - DNA, 22 bp, Homo sapiens
tatttaatagcaaagaattgac

SEQ ID NO: 964795 - DNA, 15 bp, Homo sapiens
tatttaattaaagca

SEQ ID NO: 964796 - DNA, 16 bp, Homo sapiens
tatttaattatgaaaa

SEQ ID NO: 964797 - DNA, 23 bp, Homo sapiens
tatttaattgaaactctctgttc

SEQ ID NO: 964798 - DNA, 20 bp, Homo sapiens
tatttaattttttactttca

SEQ ID NO: 964799 - DNA, 14 bp, Homo sapiens
tatttacaaatgtt

SEQ ID NO: 964800 - DNA, 21 bp, Homo sapiens
tatttacaaatgttttgctca

SEQ ID NO: 964801 - DNA, 15 bp, Homo sapiens
tatttacaagaagaa

SEQ ID NO: 964802 - DNA, 16 bp, Homo sapiens
tatttacaagaagaac

SEQ ID NO: 964803 - DNA, 15 bp, Homo sapiens
tatttacaatgtatt

SEQ ID NO: 964804 - DNA, 16 bp, Homo sapiens
tatttacaatgtatta

SEQ ID NO: 964805 - DNA, 17 bp, Homo sapiens
tatttacaatgtattaa

SEQ ID NO: 964806 - DNA, 15 bp, Homo sapiens
tatttacactggtct

SEQ ID NO: 964807 - DNA, 17 bp, Homo sapiens
tatttacactggtctaa

SEQ ID NO: 964808 - DNA, 15 bp, Homo sapiens
tatttacatcacttt

SEQ ID NO: 964809 - DNA, 14 bp, Homo sapiens
tatttaccaaaaat

SEQ ID NO: 964810 - DNA, 18 bp, Homo sapiens
tatttaccaaaaattttg

SEQ ID NO: 964811 - DNA, 15 bp, Homo sapiens
tatttaccttgaaaa

SEQ ID NO: 964812 - DNA, 16 bp, Homo sapiens
tatttactctttgcaa

SEQ ID NO: 964813 - DNA, 21 bp, Homo sapiens
tatttactgagcttctctgtg

SEQ ID NO: 964814 - DNA, 16 bp, Homo sapiens
tatttagaaaattttg

SEQ ID NO: 964815 - DNA, 19 bp, Homo sapiens
tatttagacaagagatggg

SEQ ID NO: 964816 - DNA, 23 bp, Homo sapiens
tatttagatgataaagagacagt

SEQ ID NO: 964817 - DNA, 22 bp, Homo sapiens
tatttagattgttaaaataact

SEQ ID NO: 964818 - DNA, 21 bp, Homo sapiens
tatttagcatgacaagcccca

SEQ ID NO: 964819 - DNA, 15 bp, Homo sapiens
tatttagccattacc

SEQ ID NO: 964820 - DNA, 18 bp, Homo sapiens
tatttagccattacccac

SEQ ID NO: 964821 - DNA, 14 bp, Homo sapiens
tatttctgttctta

SEQ ID NO: 964822 - DNA, 15 bp, Homo sapiens
tatttcttaaagctt

SEQ ID NO: 964823 - DNA, 23 bp, Homo sapiens
tatttcttaacctttgctatgta

SEQ ID NO: 964824 - DNA, 23 bp, Homo sapiens
tatttcttcaaatatctctattt

SEQ ID NO: 964825 - DNA, 20 bp, Homo sapiens
tatttcttcgtgaacataga

SEQ ID NO: 964826 - DNA, 14 bp, Homo sapiens
tatttcttctctta

SEQ ID NO: 964827 - DNA, 20 bp, Homo sapiens
tatttcttgtggttataact

SEQ ID NO: 964828 - DNA, 23 bp, Homo sapiens
tatttcttgtggttataacttaa

SEQ ID NO: 964829 - DNA, 14 bp, Homo sapiens
tatttcttgtttgt

SEQ ID NO: 964830 - DNA, 13 bp, Homo sapiens
tatttctttgtag

SEQ ID NO: 964831 - DNA, 16 bp, Homo sapiens
tatttctttgtagaat

SEQ ID NO: 964832 - DNA, 17 bp, Homo sapiens
tatttctttgtagaata

SEQ ID NO: 964833 - DNA, 23 bp, Homo sapiens
tatttgaaaaaaacttcattctc

SEQ ID NO: 964834 - DNA, 20 bp, Homo sapiens
tatttgaaaattacatgttt

SEQ ID NO: 964835 - DNA, 18 bp, Homo sapiens
tatttgaaaattttactt

SEQ ID NO: 964836 - DNA, 13 bp, Homo sapiens
tatttgaagaaaa

SEQ ID NO: 964837 - DNA, 20 bp, Homo sapiens
tatttgaagaaaaaaatgta

SEQ ID NO: 964838 - DNA, 11 bp, Homo sapiens
tatttgaagag

SEQ ID NO: 964839 - DNA, 21 bp, Homo sapiens
tatttgactctttcaaagaaa

SEQ ID NO: 964840 - DNA, 22 bp, Homo sapiens
tatttgacttgcatgaagagaa

SEQ ID NO: 964841 - DNA, 20 bp, Homo sapiens
tatttgactttaatttatgt

SEQ ID NO: 964842 - DNA, 16 bp, Homo sapiens
tatttgagaaaatata

SEQ ID NO: 964843 - DNA, 19 bp, Homo sapiens
tatttgagaaaatataata

SEQ ID NO: 964844 - DNA, 22 bp, Homo sapiens
tatttgagaaaatataataaaa

SEQ ID NO: 964845 - DNA, 13 bp, Homo sapiens
tatttgattattt

SEQ ID NO: 964846 - DNA, 15 bp, Homo sapiens
tatttgattcaaaat

SEQ ID NO: 964847 - DNA, 14 bp, Homo sapiens
tatttgattcttaa

SEQ ID NO: 964848 - DNA, 15 bp, Homo sapiens
tatttgatttctaat

SEQ ID NO: 964849 - DNA, 18 bp, Homo sapiens
tatttgatttctaattgt

SEQ ID NO: 964850 - DNA, 16 bp, Homo sapiens
tatttgcagactagaa

SEQ ID NO: 964851 - DNA, 22 bp, Homo sapiens
tatttgcagtgcagtatagaat

SEQ ID NO: 964852 - DNA, 18 bp, Homo sapiens
tatttgcagttcacctgc

SEQ ID NO: 964853 - DNA, 16 bp, Homo sapiens
tatttgcatgttacct

SEQ ID NO: 964854 - DNA, 15 bp, Homo sapiens
tatttgcatgttatg

SEQ ID NO: 964855 - DNA, 19 bp, Homo sapiens
tatttgcatgttatgttta

SEQ ID NO: 964856 - DNA, 14 bp, Homo sapiens
tatttgcattatgt

SEQ ID NO: 964857 - DNA, 16 bp, Homo sapiens
tatttgcattatgtat

SEQ ID NO: 964858 - DNA, 17 bp, Homo sapiens
tatttgcattatgtatt

SEQ ID NO: 964859 - DNA, 15 bp, Homo sapiens
tatttgctaagcata

SEQ ID NO: 964860 - DNA, 18 bp, Homo sapiens
tatttgctgacaaccatt

SEQ ID NO: 964861 - DNA, 14 bp, Homo sapiens
tatttgctgcaaag

SEQ ID NO: 964862 - DNA, 14 bp, Homo sapiens
tatttgctgccaga

SEQ ID NO: 964863 - DNA, 17 bp, Homo sapiens
tatttgcttatttttat

SEQ ID NO: 964864 - DNA, 16 bp, Homo sapiens
tatttggaaataaagt

SEQ ID NO: 964865 - DNA, 17 bp, Homo sapiens
tatttggaaataaagtc

SEQ ID NO: 964866 - DNA, 19 bp, Homo sapiens
tatttggaaataaagtcag

SEQ ID NO: 964867 - DNA, 19 bp, Homo sapiens
tatttggaaattttagtta

SEQ ID NO: 964868 - DNA, 17 bp, Homo sapiens
tatttggaatatttgaa

SEQ ID NO: 964869 - DNA, 15 bp, Homo sapiens
tatttgggaagtgaa

SEQ ID NO: 964870 - DNA, 15 bp, Homo sapiens
tatttggtccaaaaa

SEQ ID NO: 964871 - DNA, 13 bp, Homo sapiens
tatttgtaaatct

SEQ ID NO: 964872 - DNA, 18 bp, Homo sapiens
tatttgtaacattgtaaa

SEQ ID NO: 964873 - DNA, 20 bp, Homo sapiens
tatttgtaatagatgtttga

SEQ ID NO: 964874 - DNA, 14 bp, Homo sapiens
tatttgtaattaaa

SEQ ID NO: 964875 - DNA, 14 bp, Homo sapiens
tatttgtagtgtta

SEQ ID NO: 964876 - DNA, 12 bp, Homo sapiens
tatttgtatctc

SEQ ID NO: 964877 - DNA, 20 bp, Homo sapiens
tatttgtatgatattttaaa

SEQ ID NO: 964878 - DNA, 11 bp, Homo sapiens
tatttgtatta

SEQ ID NO: 964879 - DNA, 15 bp, Homo sapiens
tatttgtcatgacag

SEQ ID NO: 964880 - DNA, 21 bp, Homo sapiens
tatttgtcttaaaaaatgtga

SEQ ID NO: 964881 - DNA, 12 bp, Homo sapiens
tatttgtcttcc

SEQ ID NO: 964882 - DNA, 13 bp, Homo sapiens
tatttgtcttccg

SEQ ID NO: 964883 - DNA, 17 bp, Homo sapiens
tatttgtgacttttaaa

SEQ ID NO: 964884 - DNA, 20 bp, Homo sapiens
tatttgtgggaggagtgaca

SEQ ID NO: 964885 - DNA, 14 bp, Homo sapiens
tatttgtgtaatag

SEQ ID NO: 964886 - DNA, 13 bp, Homo sapiens
tatttgtgtattt

SEQ ID NO: 964887 - DNA, 19 bp, Homo sapiens
tatttgtgttttaatttaa

SEQ ID NO: 964888 - DNA, 22 bp, Homo sapiens
tatttgttacttttagttctat

SEQ ID NO: 964889 - DNA, 14 bp, Homo sapiens
tatttgttatttat

SEQ ID NO: 964890 - DNA, 14 bp, Homo sapiens
tatttgttattttc

SEQ ID NO: 964891 - DNA, 14 bp, Homo sapiens
tatttgttttaata

SEQ ID NO: 964892 - DNA, 14 bp, Homo sapiens
tattttaaaaatat

SEQ ID NO: 964893 - DNA, 19 bp, Homo sapiens
tattttaaaatctcctaaa

SEQ ID NO: 964894 - DNA, 12 bp, Homo sapiens
tattttaaacaa

SEQ ID NO: 964895 - DNA, 14 bp, Homo sapiens
tattttaaacaaaa

SEQ ID NO: 964896 - DNA, 20 bp, Homo sapiens
tattttaaatataaatagct

SEQ ID NO: 964897 - DNA, 17 bp, Homo sapiens
tattttaaatcttaaca

SEQ ID NO: 964898 - DNA, 19 bp, Homo sapiens
tattttaaatcttaacatc

SEQ ID NO: 964899 - DNA, 17 bp, Homo sapiens
tattttaacactttgta

SEQ ID NO: 964900 - DNA, 19 bp, Homo sapiens
tattttaagaaagagaatg

SEQ ID NO: 964901 - DNA, 18 bp, Homo sapiens
tattttaagactgatttt

SEQ ID NO: 964902 - DNA, 15 bp, Homo sapiens
tattttaatagaatt

SEQ ID NO: 964903 - DNA, 16 bp, Homo sapiens
tattttaatagaattt

SEQ ID NO: 964904 - DNA, 16 bp, Homo sapiens
tattttaatattttgt

SEQ ID NO: 964905 - DNA, 15 bp, Homo sapiens
tattttaatgaatat

SEQ ID NO: 964906 - DNA, 13 bp, Homo sapiens
tattttaatgtaa

SEQ ID NO: 964907 - DNA, 18 bp, Homo sapiens
tattttacatttagagta

SEQ ID NO: 964908 - DNA, 14 bp, Homo sapiens
tattttacttttat

SEQ ID NO: 964909 - DNA, 15 bp, Homo sapiens
tattttagattgcta

SEQ ID NO: 964910 - DNA, 13 bp, Homo sapiens
tattttagcagtt

SEQ ID NO: 964911 - DNA, 14 bp, Homo sapiens
tattttaggaaatt

SEQ ID NO: 964912 - DNA, 13 bp, Homo sapiens
gatgtttgcccaa

SEQ ID NO: 964913 - DNA, 22 bp, Homo sapiens
gatgtttgctcttgtttttatt

SEQ ID NO: 964914 - DNA, 14 bp, Homo sapiens
gatgtttggaaaaa

SEQ ID NO: 964915 - DNA, 13 bp, Homo sapiens
gatgtttgtggcc

SEQ ID NO: 964916 - DNA, 16 bp, Homo sapiens
gatgtttgtggcctca

SEQ ID NO: 964917 - DNA, 18 bp, Homo sapiens
gatgtttgtggcctcaga

SEQ ID NO: 964918 - DNA, 23 bp, Homo sapiens
gatgttttagccattgttggctt

SEQ ID NO: 964919 - DNA, 21 bp, Homo sapiens
gatgttttgacatttacagga

SEQ ID NO: 964920 - DNA, 18 bp, Homo sapiens
gatgttttgggatcagga

SEQ ID NO: 964921 - DNA, 22 bp, Homo sapiens
gatgtttttaaaagtttcaatg

SEQ ID NO: 964922 - DNA, 16 bp, Homo sapiens
gatgtttttcatgaaa

SEQ ID NO: 964923 - DNA, 14 bp, Homo sapiens
gattaaaacaattt

SEQ ID NO: 964924 - DNA, 15 bp, Homo sapiens
gattaaaagcacaag

SEQ ID NO: 964925 - DNA, 22 bp, Homo sapiens
gattaaaaggtatactttagta

SEQ ID NO: 964926 - DNA, 19 bp, Homo sapiens
gattaaaatgtttgagcac

SEQ ID NO: 964927 - DNA, 15 bp, Homo sapiens
gattaaacttaatct

SEQ ID NO: 964928 - DNA, 20 bp, Homo sapiens
gattaaagatgagctttgtc

SEQ ID NO: 964929 - DNA, 14 bp, Homo sapiens
gattaaaggaagga

SEQ ID NO: 964930 - DNA, 20 bp, Homo sapiens
gattaaatacatatggatgt

SEQ ID NO: 964931 - DNA, 17 bp, Homo sapiens
gattaacctctgcacta

SEQ ID NO: 964932 - DNA, 12 bp, Homo sapiens
gattaagggcaa

SEQ ID NO: 964933 - DNA, 22 bp, Homo sapiens
gattaatagagttggagtttta

SEQ ID NO: 964934 - DNA, 10 bp, Homo sapiens
gattaatcaa

SEQ ID NO: 964935 - DNA, 17 bp, Homo sapiens
gattaatgttttcatta

SEQ ID NO: 964936 - DNA, 16 bp, Homo sapiens
gattacaaatcagaag

SEQ ID NO: 964937 - DNA, 21 bp, Homo sapiens
gattacaaatcagaagtcatc

SEQ ID NO: 964938 - DNA, 23 bp, Homo sapiens
gattacaattgagggaagtttga

SEQ ID NO: 964939 - DNA, 14 bp, Homo sapiens
gattacacacgtga

SEQ ID NO: 964940 - DNA, 15 bp, Homo sapiens
gattacaccactgca

SEQ ID NO: 964941 - DNA, 18 bp, Homo sapiens
gattacagggatgagcca

SEQ ID NO: 964942 - DNA, 20 bp, Homo sapiens
gattacagggatgagccacc

SEQ ID NO: 964943 - DNA, 20 bp, Homo sapiens
gattacataatcaaagctac

SEQ ID NO: 964944 - DNA, 19 bp, Homo sapiens
tcaaaatgtccagatgtag

SEQ ID NO: 964945 - DNA, 13 bp, Homo sapiens
tcaaaattccaaa

SEQ ID NO: 964946 - DNA, 19 bp, Homo sapiens
tcaaaattctagctgtatg

SEQ ID NO: 964947 - DNA, 13 bp, Homo sapiens
tcaaaatttgctg

SEQ ID NO: 964948 - DNA, 20 bp, Homo sapiens
tcaaacacagttacacttgt

SEQ ID NO: 964949 - DNA, 16 bp, Homo sapiens
tcaaacagaattttaa

SEQ ID NO: 964950 - DNA, 22 bp, Homo sapiens
tcaaacagtaatctaggtgtgg

SEQ ID NO: 964951 - DNA, 17 bp, Homo sapiens
tcaaacatttgccaagt

SEQ ID NO: 964952 - DNA, 17 bp, Homo sapiens
tcaaacattttgaaagt

SEQ ID NO: 964953 - DNA, 18 bp, Homo sapiens
tcaaacattttgaaagtc

SEQ ID NO: 964954 - DNA, 15 bp, Homo sapiens
tcaaaccaaagctgc

SEQ ID NO: 964955 - DNA, 16 bp, Homo sapiens
tcaaaccaaagctgcc

SEQ ID NO: 964956 - DNA, 21 bp, Homo sapiens
tcaaaccaaagctgcctgtgc

SEQ ID NO: 964957 - DNA, 22 bp, Homo sapiens
tcaaaccaaagctgcctgtgcc

SEQ ID NO: 964958 - DNA, 15 bp, Homo sapiens
tcaaaccaatttctt

SEQ ID NO: 964959 - DNA, 15 bp, Homo sapiens
tcaaacccacatatt

SEQ ID NO: 964960 - DNA, 22 bp, Homo sapiens
tcaaacccacgattttctccag

SEQ ID NO: 964961 - DNA, 16 bp, Homo sapiens
tcaaaccctagccttg

SEQ ID NO: 964962 - DNA, 19 bp, Homo sapiens
tcaaaccctagccttgctt

SEQ ID NO: 964963 - DNA, 21 bp, Homo sapiens
tcaaaccctagccttgcttgt

SEQ ID NO: 964964 - DNA, 17 bp, Homo sapiens
tcaaacctcctcttctg

SEQ ID NO: 964965 - DNA, 15 bp, Homo sapiens
tcaaacctggagctg

SEQ ID NO: 964966 - DNA, 19 bp, Homo sapiens
tcaaacctttctggcctgt

SEQ ID NO: 964967 - DNA, 16 bp, Homo sapiens
tcaaactcaatgcttt

SEQ ID NO: 964968 - DNA, 19 bp, Homo sapiens
tcaaactccctagtctcca

SEQ ID NO: 964969 - DNA, 19 bp, Homo sapiens
tcaaactcctgacctcagg

SEQ ID NO: 964970 - DNA, 16 bp, Homo sapiens
tcaaactgaagccaga

SEQ ID NO: 964971 - DNA, 19 bp, Homo sapiens
tcaaactgaggaatttcac

SEQ ID NO: 964972 - DNA, 16 bp, Homo sapiens
tcaaactggggcctcc

SEQ ID NO: 964973 - DNA, 20 bp, Homo sapiens
tcaaactggggcctccagaa

SEQ ID NO: 964974 - DNA, 14 bp, Homo sapiens
tcaaactgtagaaa

SEQ ID NO: 964975 - DNA, 20 bp, Homo sapiens
tcaaactgtagaaatgatga

SEQ ID NO: 964976 - DNA, 17 bp, Homo sapiens
tcaaacttactattttg

SEQ ID NO: 964977 - DNA, 16 bp, Homo sapiens
tcaaacttgtggcctc

SEQ ID NO: 964978 - DNA, 22 bp, Homo sapiens
tcaaagaaaaacaatgaaattg

SEQ ID NO: 964979 - DNA, 12 bp, Homo sapiens
tcaaagaaaaga

SEQ ID NO: 964980 - DNA, 22 bp, Homo sapiens
tcaaagaaatccaaatttctca

SEQ ID NO: 964981 - DNA, 12 bp, Homo sapiens
tcaaagaacaga

SEQ ID NO: 964982 - DNA, 11 bp, Homo sapiens
tcaaagaagct

SEQ ID NO: 964983 - DNA, 15 bp, Homo sapiens
tcaaagaagcttcca

SEQ ID NO: 964984 - DNA, 16 bp, Homo sapiens
tcaaagaaggatggca

SEQ ID NO: 964985 - DNA, 14 bp, Homo sapiens
tcaaagaaggcatt

SEQ ID NO: 964986 - DNA, 15 bp, Homo sapiens
tcaaagaattacagt

SEQ ID NO: 964987 - DNA, 17 bp, Homo sapiens
tcaaagaattacagtac

SEQ ID NO: 964988 - DNA, 16 bp, Homo sapiens
tcaaagaggtaactga

SEQ ID NO: 964989 - DNA, 18 bp, Homo sapiens
tcaaagaggtgaacatta

SEQ ID NO: 964990 - DNA, 21 bp, Homo sapiens
tcaaagaggtgaacattaaaa

SEQ ID NO: 964991 - DNA, 15 bp, Homo sapiens
tcaaagagtctgtct

SEQ ID NO: 964992 - DNA, 20 bp, Homo sapiens
tcaaagatggattaaactca

SEQ ID NO: 964993 - DNA, 15 bp, Homo sapiens
tcaaagcaagcattc

SEQ ID NO: 964994 - DNA, 21 bp, Homo sapiens
tcaaagcaagcattcagaaga

SEQ ID NO: 964995 - DNA, 20 bp, Homo sapiens
tcaaagcaaggaaactatgt

SEQ ID NO: 964996 - DNA, 18 bp, Homo sapiens
tcaaagcaagggctccag

SEQ ID NO: 964997 - DNA, 19 bp, Homo sapiens
tcaaagcaattgaaatgca

SEQ ID NO: 964998 - DNA, 18 bp, Homo sapiens
tcaaagcaccaaaataag

SEQ ID NO: 964999 - DNA, 20 bp, Homo sapiens
tcaaagcaccaaaataagaa

SEQ ID NO: 965000 - DNA, 20 bp, Homo sapiens
tcaaagcagaagtctggctt

SEQ ID NO: 965001 - DNA, 21 bp, Homo sapiens
tcaaagcagaagtctggcttt

SEQ ID NO: 965002 - DNA, 12 bp, Homo sapiens
tcaaagcagagt

SEQ ID NO: 965003 - DNA, 12 bp, Homo sapiens
tcaaagccctgc

SEQ ID NO: 965004 - DNA, 15 bp, Homo sapiens
tcaaagccctgcctc

SEQ ID NO: 965005 - DNA, 17 bp, Homo sapiens
tcaaagccctgcctctg

SEQ ID NO: 965006 - DNA, 18 bp, Homo sapiens
tcaaagccctgcctctgt

SEQ ID NO: 965007 - DNA, 19 bp, Homo sapiens
tcaaagctcacaccaaatt

SEQ ID NO: 965008 - DNA, 12 bp, Homo sapiens
tcaaaggaagac

SEQ ID NO: 965009 - DNA, 15 bp, Homo sapiens
tcaaaggaatataag

SEQ ID NO: 965010 - DNA, 16 bp, Homo sapiens
tcaaaggagctttctc

SEQ ID NO: 965011 - DNA, 19 bp, Homo sapiens
tcaaaggtagccatcatgg

SEQ ID NO: 965012 - DNA, 14 bp, Homo sapiens
tcaaagtaaaactt

SEQ ID NO: 965013 - DNA, 15 bp, Homo sapiens
tcaaagtatgcaatg

SEQ ID NO: 965014 - DNA, 17 bp, Homo sapiens
tcaaagtcccttgagac

SEQ ID NO: 965015 - DNA, 22 bp, Homo sapiens
tcaaagtgagaaaatgcctcaa

SEQ ID NO: 965016 - DNA, 19 bp, Homo sapiens
tcaaagtggtaaatactgt

SEQ ID NO: 965017 - DNA, 22 bp, Homo sapiens
tcaaagtgtatatttattcata

SEQ ID NO: 965018 - DNA, 20 bp, Homo sapiens
tcaaataaaatatcataaag

SEQ ID NO: 965019 - DNA, 13 bp, Homo sapiens
tcaaataaagaaa

SEQ ID NO: 965020 - DNA, 17 bp, Homo sapiens
tcaaataaagaaatttg

SEQ ID NO: 965021 - DNA, 18 bp, Homo sapiens
tcaaataaagaaatttgg

SEQ ID NO: 965022 - DNA, 20 bp, Homo sapiens
tcaaataaatttctgggata

SEQ ID NO: 965023 - DNA, 18 bp, Homo sapiens
tcaaataactaaaaggta

SEQ ID NO: 965024 - DNA, 19 bp, Homo sapiens
tcaaataagtatttataat

SEQ ID NO: 965025 - DNA, 20 bp, Homo sapiens
tcaaataagtatttataata

SEQ ID NO: 965026 - DNA, 14 bp, Homo sapiens
tcaaataattaaat

SEQ ID NO: 965027 - DNA, 12 bp, Homo sapiens
tcaaatagattt

SEQ ID NO: 965028 - DNA, 13 bp, Homo sapiens
tcaaatagatttt

SEQ ID NO: 965029 - DNA, 15 bp, Homo sapiens
tcaaatagatttttg

SEQ ID NO: 965030 - DNA, 23 bp, Homo sapiens
tcaaataggctattaaaaaagtc

SEQ ID NO: 965031 - DNA, 13 bp, Homo sapiens
tcaaatatagaaa

SEQ ID NO: 965032 - DNA, 15 bp, Homo sapiens
tcaaatatagaaagt

SEQ ID NO: 965033 - DNA, 14 bp, Homo sapiens
tcaaatcaactgaa

SEQ ID NO: 965034 - DNA, 18 bp, Homo sapiens
tcaaatcagtgatctatg

SEQ ID NO: 965035 - DNA, 21 bp, Homo sapiens
tcaaatcagtgatctatgttt

SEQ ID NO: 965036 - DNA, 16 bp, Homo sapiens
tcaaatctattcagac

SEQ ID NO: 965037 - DNA, 14 bp, Homo sapiens
tcaaatctcagcaa

SEQ ID NO: 965038 - DNA, 12 bp, Homo sapiens
tcaaatctgtat

SEQ ID NO: 965039 - DNA, 17 bp, Homo sapiens
tcaaatcttacaaaatc

SEQ ID NO: 965040 - DNA, 14 bp, Homo sapiens
tcaaatgaaatgta

SEQ ID NO: 965041 - DNA, 23 bp, Homo sapiens
tcaaatgaaatgtatgcattcac

SEQ ID NO: 965042 - DNA, 12 bp, Homo sapiens
tcaaatgaactt

SEQ ID NO: 965043 - DNA, 18 bp, Homo sapiens
tcaaatgaacttttacag

SEQ ID NO: 965044 - DNA, 19 bp, Homo sapiens
tcaaatgaacttttacaga

SEQ ID NO: 965045 - DNA, 16 bp, Homo sapiens
tcaaatgaaggtggtt

SEQ ID NO: 965046 - DNA, 21 bp, Homo sapiens
gatttatagtatgtgactttt

SEQ ID NO: 965047 - DNA, 21 bp, Homo sapiens
gatttatagtttgtacatgca

SEQ ID NO: 965048 - DNA, 15 bp, Homo sapiens
gatttatctttatac

SEQ ID NO: 965049 - DNA, 18 bp, Homo sapiens
gatttatctttatacaga

SEQ ID NO: 965050 - DNA, 12 bp, Homo sapiens
gatttatctttc

SEQ ID NO: 965051 - DNA, 12 bp, Homo sapiens
gatttatttcta

SEQ ID NO: 965052 - DNA, 11 bp, Homo sapiens
gatttatttgc

SEQ ID NO: 965053 - DNA, 17 bp, Homo sapiens
gatttattttacattta

SEQ ID NO: 965054 - DNA, 21 bp, Homo sapiens
gatttattttgtatgaaatat

SEQ ID NO: 965055 - DNA, 20 bp, Homo sapiens
gatttcaaaagattgtgttc

SEQ ID NO: 965056 - DNA, 14 bp, Homo sapiens
gatttcaaaatcag

SEQ ID NO: 965057 - DNA, 21 bp, Homo sapiens
gatttcaacatgagtgtattt

SEQ ID NO: 965058 - DNA, 15 bp, Homo sapiens
gatttcaagcctgcc

SEQ ID NO: 965059 - DNA, 14 bp, Homo sapiens
gatttcagaagaga

SEQ ID NO: 965060 - DNA, 14 bp, Homo sapiens
gatttcagtagaat

SEQ ID NO: 965061 - DNA, 15 bp, Homo sapiens
gatttcagtagaatt

SEQ ID NO: 965062 - DNA, 22 bp, Homo sapiens
gatttcagtagaattttagtcc

SEQ ID NO: 965063 - DNA, 23 bp, Homo sapiens
gatttcatacctcagaatgtaaa

SEQ ID NO: 965064 - DNA, 15 bp, Homo sapiens
gatttcatagttcag

SEQ ID NO: 965065 - DNA, 18 bp, Homo sapiens
gatttcatagttcagaat

SEQ ID NO: 965066 - DNA, 20 bp, Homo sapiens
tcaagatggattaaagactt

SEQ ID NO: 965067 - DNA, 21 bp, Homo sapiens
tcaagatgggggcagggctgt

SEQ ID NO: 965068 - DNA, 17 bp, Homo sapiens
tcaagatgtcagactgg

SEQ ID NO: 965069 - DNA, 19 bp, Homo sapiens
tcaagattctaaagctcaa

SEQ ID NO: 965070 - DNA, 15 bp, Homo sapiens
tcaagattctacttg

SEQ ID NO: 965071 - DNA, 18 bp, Homo sapiens
tcaagatttgaccaaatc

SEQ ID NO: 965072 - DNA, 16 bp, Homo sapiens
tcaagattttgaatgc

SEQ ID NO: 965073 - DNA, 12 bp, Homo sapiens
tcaagcaaacat

SEQ ID NO: 965074 - DNA, 18 bp, Homo sapiens
tcaagcaataattgtttc

SEQ ID NO: 965075 - DNA, 22 bp, Homo sapiens
tcaagcaatccacctgccttgg

SEQ ID NO: 965076 - DNA, 15 bp, Homo sapiens
tcaagcaatcctcct

SEQ ID NO: 965077 - DNA, 14 bp, Homo sapiens
tcaagcacatgtaa

SEQ ID NO: 965078 - DNA, 15 bp, Homo sapiens
tcaagcaccaggaag

SEQ ID NO: 965079 - DNA, 16 bp, Homo sapiens
tcaagcaccaggaagt

SEQ ID NO: 965080 - DNA, 22 bp, Homo sapiens
tcaagcaccaggaagtgtttat

SEQ ID NO: 965081 - DNA, 23 bp, Homo sapiens
tcaagcaccaggaagtgtttatg

SEQ ID NO: 965082 - DNA, 20 bp, Homo sapiens
tcaagcagtcgtgcctgtgt

SEQ ID NO: 965083 - DNA, 21 bp, Homo sapiens
tcaagcagtcgtgcctgtgtc

SEQ ID NO: 965084 - DNA, 18 bp, Homo sapiens
tcaagcatattggaaagt

SEQ ID NO: 965085 - DNA, 13 bp, Homo sapiens
tcaagcatgcaat

SEQ ID NO: 965086 - DNA, 20 bp, Homo sapiens
tcaagcatgcaataatgtgc

SEQ ID NO: 965087 - DNA, 17 bp, Homo sapiens
tcaagccaatcccctcc

SEQ ID NO: 965088 - DNA, 19 bp, Homo sapiens
tcaagccagccccctccag

SEQ ID NO: 965089 - DNA, 20 bp, Homo sapiens
tcaagccagccccctccagc

SEQ ID NO: 965090 - DNA, 21 bp, Homo sapiens
tcaagccagccccctccagct

SEQ ID NO: 965091 - DNA, 23 bp, Homo sapiens
tcaagccccaccacatagcatgc

SEQ ID NO: 965092 - DNA, 19 bp, Homo sapiens
tcaagcctgtgcaaaaaaa

SEQ ID NO: 965093 - DNA, 14 bp, Homo sapiens
tcaagcctgtgggc

SEQ ID NO: 965094 - DNA, 17 bp, Homo sapiens
tcaagctagtgtttcta

SEQ ID NO: 965095 - DNA, 22 bp, Homo sapiens
tcaagctatccttgcacctcag

SEQ ID NO: 965096 - DNA, 16 bp, Homo sapiens
tcaagctgagaaaagt

SEQ ID NO: 965097 - DNA, 17 bp, Homo sapiens
tcaagctgagaaaagta

SEQ ID NO: 965098 - DNA, 20 bp, Homo sapiens
tcaagctgtcccctctgtca

SEQ ID NO: 965099 - DNA, 21 bp, Homo sapiens
tcaagctgtcccctctgtcat

SEQ ID NO: 965100 - DNA, 14 bp, Homo sapiens
tcaagcttgtgtac

SEQ ID NO: 965101 - DNA, 21 bp, Homo sapiens
tcaagcttttgcttgatccag

SEQ ID NO: 965102 - DNA, 13 bp, Homo sapiens
tcaaggaagaaaa

SEQ ID NO: 965103 - DNA, 14 bp, Homo sapiens
tcaaggaagaaaac

SEQ ID NO: 965104 - DNA, 16 bp, Homo sapiens
tcaaggaagaagaaat

SEQ ID NO: 965105 - DNA, 19 bp, Homo sapiens
tcaaggaatccatcctgca

SEQ ID NO: 965106 - DNA, 23 bp, Homo sapiens
tcaaggaatccatcctgcaaagg

SEQ ID NO: 965107 - DNA, 12 bp, Homo sapiens
tcaaggacaggg

SEQ ID NO: 965108 - DNA, 16 bp, Homo sapiens
tcaaggacagggctga

SEQ ID NO: 965109 - DNA, 18 bp, Homo sapiens
tcaaggacagggctgagc

SEQ ID NO: 965110 - DNA, 20 bp, Homo sapiens
tcaaggacagggctgagcgt

SEQ ID NO: 965111 - DNA, 16 bp, Homo sapiens
tcaaggaccaagagca

SEQ ID NO: 965112 - DNA, 22 bp, Homo sapiens
tcaaggactagaacctatcttt

SEQ ID NO: 965113 - DNA, 21 bp, Homo sapiens
tcaaggactgtttcagtgtga

SEQ ID NO: 965114 - DNA, 22 bp, Homo sapiens
tcaaggactgtttcagtgtgag

SEQ ID NO: 965115 - DNA, 19 bp, Homo sapiens
tcaaggacttgaaagcatc

SEQ ID NO: 965116 - DNA, 20 bp, Homo sapiens
tcaaggaggtggtgaatttt

SEQ ID NO: 965117 - DNA, 19 bp, Homo sapiens
tcaaggataccttcttatt

SEQ ID NO: 965118 - DNA, 22 bp, Homo sapiens
tcaaggatggttttgggactag

SEQ ID NO: 965119 - DNA, 18 bp, Homo sapiens
tcaaggatgtttttcttt

SEQ ID NO: 965120 - DNA, 18 bp, Homo sapiens
tcaaggccaccttggagg

SEQ ID NO: 965121 - DNA, 23 bp, Homo sapiens
tcaaggccctcggagctggctgt

SEQ ID NO: 965122 - DNA, 14 bp, Homo sapiens
tcaaggccgagggc

SEQ ID NO: 965123 - DNA, 19 bp, Homo sapiens
tcaaggccgagggccaggc

SEQ ID NO: 965124 - DNA, 22 bp, Homo sapiens
tcaaggccgagggccaggcaga

SEQ ID NO: 965125 - DNA, 10 bp, Homo sapiens
tcaaggcctt

SEQ ID NO: 965126 - DNA, 16 bp, Homo sapiens
tcaaggccttcagttt

SEQ ID NO: 965127 - DNA, 13 bp, Homo sapiens
tcaaggctggggc

SEQ ID NO: 965128 - DNA, 14 bp, Homo sapiens
tcaaggctggggca

SEQ ID NO: 965129 - DNA, 15 bp, Homo sapiens
tcaaggctgtgcagg

SEQ ID NO: 965130 - DNA, 13 bp, Homo sapiens
tcaagggacaggg

SEQ ID NO: 965131 - DNA, 17 bp, Homo sapiens
tcaagggaccctgggtg

SEQ ID NO: 965132 - DNA, 19 bp, Homo sapiens
tcaagggaccctgggtggg

SEQ ID NO: 965133 - DNA, 20 bp, Homo sapiens
tcaagggaccctgggtggga

SEQ ID NO: 965134 - DNA, 16 bp, Homo sapiens
tcaagggggactgtct

SEQ ID NO: 965135 - DNA, 14 bp, Homo sapiens
tcaagggtggcagg

SEQ ID NO: 965136 - DNA, 21 bp, Homo sapiens
tcaagggtggcaggtcactgt

SEQ ID NO: 965137 - DNA, 22 bp, Homo sapiens
tcaagggtggcaggtcactgtc

SEQ ID NO: 965138 - DNA, 20 bp, Homo sapiens
tcaagggttctttcctccca

SEQ ID NO: 965139 - DNA, 21 bp, Homo sapiens
tcaaggtcacttaaagggtct

SEQ ID NO: 965140 - DNA, 15 bp, Homo sapiens
tcaaggtccagtgga

SEQ ID NO: 965141 - DNA, 16 bp, Homo sapiens
tcaaggtccagtggaa

SEQ ID NO: 965142 - DNA, 15 bp, Homo sapiens
tcaaggtgagaatta

SEQ ID NO: 965143 - DNA, 22 bp, Homo sapiens
tcaaggtgagaattaagtttta

SEQ ID NO: 965144 - DNA, 17 bp, Homo sapiens
tcaaggttctcatttct

SEQ ID NO: 965145 - DNA, 18 bp, Homo sapiens
tcaaggttctcatttctc

SEQ ID NO: 965146 - DNA, 16 bp, Homo sapiens
tcaaggttttaaaaca

SEQ ID NO: 965147 - DNA, 18 bp, Homo sapiens
tcaaggttttaaaacagt

SEQ ID NO: 965148 - DNA, 13 bp, Homo sapiens
tcaagtaacactt

SEQ ID NO: 965149 - DNA, 18 bp, Homo sapiens
tcaagtaagaagacatga

SEQ ID NO: 965150 - DNA, 19 bp, Homo sapiens
tcaagtaatccacctgcct

SEQ ID NO: 965151 - DNA, 15 bp, Homo sapiens
tcaagtaattgtgaa

SEQ ID NO: 965152 - DNA, 24 bp, Homo sapiens
tcaagtacataaagtacataacaa

SEQ ID NO: 965153 - DNA, 17 bp, Homo sapiens
tcaagtatagaaaatct

SEQ ID NO: 965154 - DNA, 15 bp, Homo sapiens
tcaagtcacctcctt

SEQ ID NO: 965155 - DNA, 19 bp, Homo sapiens
tcaagtccatctgacaaaa

SEQ ID NO: 965156 - DNA, 18 bp, Homo sapiens
tcaagtccttacctcttc

SEQ ID NO: 965157 - DNA, 16 bp, Homo sapiens
tcaagtctctgctggc

SEQ ID NO: 965158 - DNA, 23 bp, Homo sapiens
tcaagtgaaaaaggaggaagaga

SEQ ID NO: 965159 - DNA, 20 bp, Homo sapiens
tcaagtgaggggccctttgc

SEQ ID NO: 965160 - DNA, 12 bp, Homo sapiens
tcaagtgattct

SEQ ID NO: 965161 - DNA, 18 bp, Homo sapiens
tcaagtgattctcctgcc

SEQ ID NO: 965162 - DNA, 20 bp, Homo sapiens
tcaagtgcatgctctctgca

SEQ ID NO: 965163 - DNA, 22 bp, Homo sapiens
tcaagtgcatgctctctgcagc

SEQ ID NO: 965164 - DNA, 23 bp, Homo sapiens
tcaagtgttaaattattttttct

SEQ ID NO: 965165 - DNA, 18 bp, Homo sapiens
tcaagtgttttggagaaa

SEQ ID NO: 965166 - DNA, 19 bp, Homo sapiens
tcaagtgttttggagaaaa

SEQ ID NO: 965167 - DNA, 16 bp, Homo sapiens
tcaagttaacaaggaa

SEQ ID NO: 965168 - DNA, 15 bp, Homo sapiens
tcaagttattcaaat

SEQ ID NO: 965169 - DNA, 21 bp, Homo sapiens
tcaagttattcaaatttgtac

SEQ ID NO: 965170 - DNA, 17 bp, Homo sapiens
tcaagttcttggaccag

SEQ ID NO: 965171 - DNA, 13 bp, Homo sapiens
tcaagttgtaaaa

SEQ ID NO: 965172 - DNA, 13 bp, Homo sapiens
tcaagttgtgcca

SEQ ID NO: 965173 - DNA, 13 bp, Homo sapiens
tcaagttgtgctt

SEQ ID NO: 965174 - DNA, 14 bp, Homo sapiens
tcaagttgtgcttg

SEQ ID NO: 965175 - DNA, 23 bp, Homo sapiens
tcaagttgttccttaagtcagaa

SEQ ID NO: 965176 - DNA, 18 bp, Homo sapiens
tcaagttgttgactgtga

SEQ ID NO: 965177 - DNA, 14 bp, Homo sapiens
tcaagtttaaaagc

SEQ ID NO: 965178 - DNA, 15 bp, Homo sapiens
gcaaatattgaagtt

SEQ ID NO: 965179 - DNA, 20 bp, Homo sapiens
gcaaatattgaagttgttta

SEQ ID NO: 965180 - DNA, 19 bp, Homo sapiens
gcaaatcagtgtttttctt

SEQ ID NO: 965181 - DNA, 15 bp, Homo sapiens
gcaaatcatagctgg

SEQ ID NO: 965182 - DNA, 22 bp, Homo sapiens
gcaaatcgaatgaaattaactg

SEQ ID NO: 965183 - DNA, 18 bp, Homo sapiens
gcaaatctattacttttg

SEQ ID NO: 965184 - DNA, 15 bp, Homo sapiens
gcaaatgaaggatga

SEQ ID NO: 965185 - DNA, 14 bp, Homo sapiens
gcaaatgagggagg

SEQ ID NO: 965186 - DNA, 21 bp, Homo sapiens
gcaaatggaggcttttcactg

SEQ ID NO: 965187 - DNA, 19 bp, Homo sapiens
gcaagccagggcccagagc

SEQ ID NO: 965188 - DNA, 13 bp, Homo sapiens
gcaagccataacg

SEQ ID NO: 965189 - DNA, 21 bp, Homo sapiens
gcaagccataacgtgccccca

SEQ ID NO: 965190 - DNA, 22 bp, Homo sapiens
gcaagccataacgtgcccccag

SEQ ID NO: 965191 - DNA, 15 bp, Homo sapiens
gcaagccccagggcc

SEQ ID NO: 965192 - DNA, 19 bp, Homo sapiens
gcaagccccagggcctggg

SEQ ID NO: 965193 - DNA, 20 bp, Homo sapiens
gcaagccccagggcctgggg

SEQ ID NO: 965194 - DNA, 16 bp, Homo sapiens
gcaagcccctctttct

SEQ ID NO: 965195 - DNA, 15 bp, Homo sapiens
gcaagcccctgctcc

SEQ ID NO: 965196 - DNA, 22 bp, Homo sapiens
gcaagcccgttaaataattccc

SEQ ID NO: 965197 - DNA, 15 bp, Homo sapiens
gcaagccctacagag

SEQ ID NO: 965198 - DNA, 23 bp, Homo sapiens
gcaagccctgttgacacaggtct

SEQ ID NO: 965199 - DNA, 20 bp, Homo sapiens
gcaagcccttcggtcacctg

SEQ ID NO: 965200 - DNA, 15 bp, Homo sapiens
gcaagcgagcacagt

SEQ ID NO: 965201 - DNA, 19 bp, Homo sapiens
gcaagcgagcacagtatta

SEQ ID NO: 965202 - DNA, 17 bp, Homo sapiens
gcaagctgaaattttag

SEQ ID NO: 965203 - DNA, 11 bp, Homo sapiens
gcaagctgcag

SEQ ID NO: 965204 - DNA, 12 bp, Homo sapiens
gcaagctgcagg

SEQ ID NO: 965205 - DNA, 23 bp, Homo sapiens
gcaagcttaatggctgataattt

SEQ ID NO: 965206 - DNA, 19 bp, Homo sapiens
gcaagcttggtcaaacttt

SEQ ID NO: 965207 - DNA, 18 bp, Homo sapiens
gcaaggaaacaggctcca

SEQ ID NO: 965208 - DNA, 17 bp, Homo sapiens
gcaaggaaatgtcctgc

SEQ ID NO: 965209 - DNA, 14 bp, Homo sapiens
gcaaggaaggaaag

SEQ ID NO: 965210 - DNA, 16 bp, Homo sapiens
gcaaggactttgtaca

SEQ ID NO: 965211 - DNA, 17 bp, Homo sapiens
gcaaggagtgtaaaatg

SEQ ID NO: 965212 - DNA, 22 bp, Homo sapiens
gcaaggagtttattacaatgta

SEQ ID NO: 965213 - DNA, 22 bp, Homo sapiens
gcaaggcaaatgtttatttaaa

SEQ ID NO: 965214 - DNA, 19 bp, Homo sapiens
gcaaggcaggtgcctccag

SEQ ID NO: 965215 - DNA, 21 bp, Homo sapiens
gcaaggcagtctctatattat

SEQ ID NO: 965216 - DNA, 15 bp, Homo sapiens
gcaaggctatgtgat

SEQ ID NO: 965217 - DNA, 19 bp, Homo sapiens
gcaagggagaaaagagaaa

SEQ ID NO: 965218 - DNA, 13 bp, Homo sapiens
gcaagggaggcgc

SEQ ID NO: 965219 - DNA, 21 bp, Homo sapiens
gcaagggcacaaactgcagct

SEQ ID NO: 965220 - DNA, 22 bp, Homo sapiens
gcaagggcacaagtcctggatg

SEQ ID NO: 965221 - DNA, 14 bp, Homo sapiens
gcaagggcatcagg

SEQ ID NO: 965222 - DNA, 15 bp, Homo sapiens
gcaagggccatgctg

SEQ ID NO: 965223 - DNA, 12 bp, Homo sapiens
gcaagggcctgg

SEQ ID NO: 965224 - DNA, 17 bp, Homo sapiens
gcaagggctccagcatc

SEQ ID NO: 965225 - DNA, 16 bp, Homo sapiens
gcaaggggaaaatctc

SEQ ID NO: 965226 - DNA, 16 bp, Homo sapiens
gcaaggggtgggactg

SEQ ID NO: 965227 - DNA, 21 bp, Homo sapiens
gcaaggggtgggactggtggg

SEQ ID NO: 965228 - DNA, 17 bp, Homo sapiens
gcaagggtgcctcagga

SEQ ID NO: 965229 - DNA, 15 bp, Homo sapiens
gcaaggtactctggt

SEQ ID NO: 965230 - DNA, 15 bp, Homo sapiens
gcaaggtagcatggg

SEQ ID NO: 965231 - DNA, 14 bp, Homo sapiens
gcaaggtgctcaca

SEQ ID NO: 965232 - DNA, 15 bp, Homo sapiens
gcaaggtggccacag

SEQ ID NO: 965233 - DNA, 21 bp, Homo sapiens
gcaaggtggcctctgcctggg

SEQ ID NO: 965234 - DNA, 19 bp, Homo sapiens
gcaaggttaagcaaggtgg

SEQ ID NO: 965235 - DNA, 22 bp, Homo sapiens
gcaaggtttaggctggtggccc

SEQ ID NO: 965236 - DNA, 14 bp, Homo sapiens
gcaagtagataaat

SEQ ID NO: 965237 - DNA, 22 bp, Homo sapiens
gcaagtcattattactggtatt

SEQ ID NO: 965238 - DNA, 14 bp, Homo sapiens
gcaagtccacccca

SEQ ID NO: 965239 - DNA, 20 bp, Homo sapiens
gcaagtccctgactctctgt

SEQ ID NO: 965240 - DNA, 17 bp, Homo sapiens
gcaagtctggatctggg

SEQ ID NO: 965241 - DNA, 13 bp, Homo sapiens
gcaagtcttaaca

SEQ ID NO: 965242 - DNA, 17 bp, Homo sapiens
gcaagtgagcagagatg

SEQ ID NO: 965243 - DNA, 18 bp, Homo sapiens
gcaagtggatggcccagc

SEQ ID NO: 965244 - DNA, 21 bp, Homo sapiens
gcaagtggatggcccagcagg

SEQ ID NO: 965245 - DNA, 22 bp, Homo sapiens
gcaagtggatggcccagcaggc

SEQ ID NO: 965246 - DNA, 21 bp, Homo sapiens
gcaagtgtatgcacgtgtgca

SEQ ID NO: 965247 - DNA, 17 bp, Homo sapiens
gcaagtgtctgtgtgca

SEQ ID NO: 965248 - DNA, 22 bp, Homo sapiens
gcaagtgtgctggcctctctga

SEQ ID NO: 965249 - DNA, 12 bp, Homo sapiens
gcaagtgtgtgc

SEQ ID NO: 965250 - DNA, 23 bp, Homo sapiens
gcaagtgtgtgcacatgtgtgcg

SEQ ID NO: 965251 - DNA, 13 bp, Homo sapiens
gcaagtgttcact

SEQ ID NO: 965252 - DNA, 16 bp, Homo sapiens
gcaagtgtttcttctg

SEQ ID NO: 965253 - DNA, 22 bp, Homo sapiens
gcaagttatattagtgaagatg

SEQ ID NO: 965254 - DNA, 14 bp, Homo sapiens
gcaagtttactttt

SEQ ID NO: 965255 - DNA, 18 bp, Homo sapiens
gcaagtttccatcatcta

SEQ ID NO: 965256 - DNA, 16 bp, Homo sapiens
gcaagtttctgtttca

SEQ ID NO: 965257 - DNA, 13 bp, Homo sapiens
gcaataaactcct

SEQ ID NO: 965258 - DNA, 21 bp, Homo sapiens
gcaataaagcagcgtttctat

SEQ ID NO: 965259 - DNA, 13 bp, Homo sapiens
gcaataaagtata

SEQ ID NO: 965260 - DNA, 12 bp, Homo sapiens
gcaataaatgaa

SEQ ID NO: 965261 - DNA, 21 bp, Homo sapiens
gcaataaccagcataataaaa

SEQ ID NO: 965262 - DNA, 20 bp, Homo sapiens
gcaataacctcaaagtgact

SEQ ID NO: 965263 - DNA, 16 bp, Homo sapiens
gcaataactccaagca

SEQ ID NO: 965264 - DNA, 20 bp, Homo sapiens
gcaataacttctatatttta

SEQ ID NO: 965265 - DNA, 15 bp, Homo sapiens
gcaataagaaatgaa

SEQ ID NO: 965266 - DNA, 16 bp, Homo sapiens
gcaataagaaatgaac

SEQ ID NO: 965267 - DNA, 21 bp, Homo sapiens
gcaataagctggactagtgtc

SEQ ID NO: 965268 - DNA, 14 bp, Homo sapiens
gcaataatgtgcaa

SEQ ID NO: 965269 - DNA, 17 bp, Homo sapiens
gcaataatgtgcaaatt

SEQ ID NO: 965270 - DNA, 20 bp, Homo sapiens
gcaataattgtttccaactt

SEQ ID NO: 965271 - DNA, 17 bp, Homo sapiens
gcaataatttgtacaat

SEQ ID NO: 965272 - DNA, 13 bp, Homo sapiens
gcaatacaacttt

SEQ ID NO: 965273 - DNA, 17 bp, Homo sapiens
gcaatactcatcagagc

SEQ ID NO: 965274 - DNA, 22 bp, Homo sapiens
gcaatactcatcagagcagcta

SEQ ID NO: 965275 - DNA, 18 bp, Homo sapiens
gcaatagattactgatgt

SEQ ID NO: 965276 - DNA, 19 bp, Homo sapiens
gcaatagattactgatgtg

SEQ ID NO: 965277 - DNA, 21 bp, Homo sapiens
gcaataggtaaatggggccca

SEQ ID NO: 965278 - DNA, 21 bp, Homo sapiens
gcaatagttttttacttctct

SEQ ID NO: 965279 - DNA, 16 bp, Homo sapiens
gcaatataagcataaa

SEQ ID NO: 965280 - DNA, 21 bp, Homo sapiens
gcaatatattaccagcaagaa

SEQ ID NO: 965281 - DNA, 19 bp, Homo sapiens
gcaatatcttcgttagtaa

SEQ ID NO: 965282 - DNA, 21 bp, Homo sapiens
gcaatattaatgcctttaaag

SEQ ID NO: 965283 - DNA, 14 bp, Homo sapiens
gcaatatttgaatt

SEQ ID NO: 965284 - DNA, 22 bp, Homo sapiens
gcaatcacagctcactgcagcc

SEQ ID NO: 965285 - DNA, 13 bp, Homo sapiens
gcaatcattttat

SEQ ID NO: 965286 - DNA, 16 bp, Homo sapiens
gcaatcattttatgct

SEQ ID NO: 965287 - DNA, 20 bp, Homo sapiens
gcaatccacctgccttggcc

SEQ ID NO: 965288 - DNA, 20 bp, Homo sapiens
gcaatccatgttagttttta

SEQ ID NO: 965289 - DNA, 21 bp, Homo sapiens
gcaatccatgttagtttttac

SEQ ID NO: 965290 - DNA, 22 bp, Homo sapiens
gcaatccatgttagtttttact

SEQ ID NO: 965291 - DNA, 21 bp, Homo sapiens
gcaatctccccttgatttaaa

SEQ ID NO: 965292 - DNA, 22 bp, Homo sapiens
gcaatctgaccctatgggtcta

SEQ ID NO: 965293 - DNA, 17 bp, Homo sapiens
gcaatcttggctcactg

SEQ ID NO: 965294 - DNA, 15 bp, Homo sapiens
gcaatctttgaaata

SEQ ID NO: 965295 - DNA, 13 bp, Homo sapiens
gcaatgaaacaga

SEQ ID NO: 965296 - DNA, 23 bp, Homo sapiens
gcaatgaaaggtactatatttgc

SEQ ID NO: 965297 - DNA, 16 bp, Homo sapiens
gcaatgacatctcagg

SEQ ID NO: 965298 - DNA, 15 bp, Homo sapiens
gcaatgatgtccaga

SEQ ID NO: 965299 - DNA, 14 bp, Homo sapiens
gcaatgattactct

SEQ ID NO: 965300 - DNA, 16 bp, Homo sapiens
gcaatgattactcttt

SEQ ID NO: 965301 - DNA, 15 bp, Homo sapiens
gcaatgccatcagcc

SEQ ID NO: 965302 - DNA, 18 bp, Homo sapiens
gcaatgccatcatctcct

SEQ ID NO: 965303 - DNA, 19 bp, Homo sapiens
gcaatgccatcatctcctg

SEQ ID NO: 965304 - DNA, 14 bp, Homo sapiens
gcaatgctgtactt

SEQ ID NO: 965305 - DNA, 15 bp, Homo sapiens
gcaatgctgtacttt

SEQ ID NO: 965306 - DNA, 22 bp, Homo sapiens
gcaatgcttaaactaaataatg

SEQ ID NO: 965307 - DNA, 21 bp, Homo sapiens
gcaatgcttttaatgaattta

SEQ ID NO: 965308 - DNA, 17 bp, Homo sapiens
tcacataaaacctcatt

SEQ ID NO: 965309 - DNA, 13 bp, Homo sapiens
tcacatactgact

SEQ ID NO: 965310 - DNA, 15 bp, Homo sapiens
tcacatagatgtccc

SEQ ID NO: 965311 - DNA, 19 bp, Homo sapiens
gcaatggccagagcctctg

SEQ ID NO: 965312 - DNA, 20 bp, Homo sapiens
gcaatggccagagcctctgg

SEQ ID NO: 965313 - DNA, 16 bp, Homo sapiens
gcaatgggcactggga

SEQ ID NO: 965314 - DNA, 22 bp, Homo sapiens
gcaatgggcagctatccagtga

SEQ ID NO: 965315 - DNA, 19 bp, Homo sapiens
gcaatgggccgtcccctct

SEQ ID NO: 965316 - DNA, 16 bp, Homo sapiens
gcaatgggtcactcat

SEQ ID NO: 965317 - DNA, 23 bp, Homo sapiens
gcaatgggtcttagctctttctc

SEQ ID NO: 965318 - DNA, 23 bp, Homo sapiens
gcaatggtgttgccctgagtgga

SEQ ID NO: 965319 - DNA, 18 bp, Homo sapiens
gcaatgtaaatattttaa

SEQ ID NO: 965320 - DNA, 14 bp, Homo sapiens
gcaatgtatagtgt

SEQ ID NO: 965321 - DNA, 20 bp, Homo sapiens
gcaatgtcaggaacagaagg

SEQ ID NO: 965322 - DNA, 15 bp, Homo sapiens
gcaatgtctgtgcta

SEQ ID NO: 965323 - DNA, 21 bp, Homo sapiens
gcaatgtcttaaataaaacta

SEQ ID NO: 965324 - DNA, 14 bp, Homo sapiens
gcaatgtgataaaa

SEQ ID NO: 965325 - DNA, 14 bp, Homo sapiens
gcaatgttttcctt

SEQ ID NO: 965326 - DNA, 14 bp, Homo sapiens
gcaattaaaaataa

SEQ ID NO: 965327 - DNA, 18 bp, Homo sapiens
gcaattatttaaagaaag

SEQ ID NO: 965328 - DNA, 18 bp, Homo sapiens
gcaattcccctctgctgc

SEQ ID NO: 965329 - DNA, 17 bp, Homo sapiens
gcaattccgcatttaat

SEQ ID NO: 965330 - DNA, 19 bp, Homo sapiens
gcaattctctttcttttac

SEQ ID NO: 965331 - DNA, 15 bp, Homo sapiens
gcaattgaaatgcat

SEQ ID NO: 965332 - DNA, 18 bp, Homo sapiens
gcaatttaaatgttatga

SEQ ID NO: 965333 - DNA, 22 bp, Homo sapiens
gcaatttctaatttttaagaat

SEQ ID NO: 965334 - DNA, 23 bp, Homo sapiens
gcaattttacctagtttgcacta

SEQ ID NO: 965335 - DNA, 15 bp, Homo sapiens
gcaattttctttgtt

SEQ ID NO: 965336 - DNA, 23 bp, Homo sapiens
gcacaaaacccagacctgttagc

SEQ ID NO: 965337 - DNA, 15 bp, Homo sapiens
gcacaaaatgataat

SEQ ID NO: 965338 - DNA, 20 bp, Homo sapiens
gcacaaactgcagctgtgag

SEQ ID NO: 965339 - DNA, 13 bp, Homo sapiens
gcacaaatattta

SEQ ID NO: 965340 - DNA, 14 bp, Homo sapiens
gcacaaatatttat

SEQ ID NO: 965341 - DNA, 16 bp, Homo sapiens
gcacaaccggtccctt

SEQ ID NO: 965342 - DNA, 15 bp, Homo sapiens
gcacaagaatggatc

SEQ ID NO: 965343 - DNA, 16 bp, Homo sapiens
gcacaagaatggatca

SEQ ID NO: 965344 - DNA, 19 bp, Homo sapiens
gcacaagaggaagagagag

SEQ ID NO: 965345 - DNA, 18 bp, Homo sapiens
gcacaagctcagaataga

SEQ ID NO: 965346 - DNA, 22 bp, Homo sapiens
gcacaagctgcaccctcaggca

SEQ ID NO: 965347 - DNA, 16 bp, Homo sapiens
gcacaaggagtgcccg

SEQ ID NO: 965348 - DNA, 22 bp, Homo sapiens
gcacaaggagtgcccgccttga

SEQ ID NO: 965349 - DNA, 23 bp, Homo sapiens
gcacaaggccttgcctggcctga

SEQ ID NO: 965350 - DNA, 15 bp, Homo sapiens
gcacaagggcacatt

SEQ ID NO: 965351 - DNA, 16 bp, Homo sapiens
gcacaagggcacattg

SEQ ID NO: 965352 - DNA, 13 bp, Homo sapiens
gcacaatatttct

SEQ ID NO: 965353 - DNA, 19 bp, Homo sapiens
gcacaatcactaaacttta

SEQ ID NO: 965354 - DNA, 16 bp, Homo sapiens
gcacaattctgtccct

SEQ ID NO: 965355 - DNA, 18 bp, Homo sapiens
gcacaattctgtccctgt

SEQ ID NO: 965356 - DNA, 20 bp, Homo sapiens
gcacacaaggggcccttgga

SEQ ID NO: 965357 - DNA, 23 bp, Homo sapiens
gcacacacaaacctactgcccac

SEQ ID NO: 965358 - DNA, 18 bp, Homo sapiens
gcacacacacatacagag

SEQ ID NO: 965359 - DNA, 16 bp, Homo sapiens
gcacacacatctggcc

SEQ ID NO: 965360 - DNA, 19 bp, Homo sapiens
gcacacacatctggccctg

SEQ ID NO: 965361 - DNA, 13 bp, Homo sapiens
gcacacagactgg

SEQ ID NO: 965362 - DNA, 13 bp, Homo sapiens
gcacacagagatt

SEQ ID NO: 965363 - DNA, 15 bp, Homo sapiens
gcacacagagatttg

SEQ ID NO: 965364 - DNA, 23 bp, Homo sapiens
gcacacagcacgggggccaagga

SEQ ID NO: 965365 - DNA, 16 bp, Homo sapiens
gcacacagcagccccc

SEQ ID NO: 965366 - DNA, 21 bp, Homo sapiens
gcacacagcagccccccagca

SEQ ID NO: 965367 - DNA, 23 bp, Homo sapiens
gcacacagctgagcacttagcag

SEQ ID NO: 965368 - DNA, 11 bp, Homo sapiens
gcacacagggc

SEQ ID NO: 965369 - DNA, 13 bp, Homo sapiens
gcacacagggcag

SEQ ID NO: 965370 - DNA, 14 bp, Homo sapiens
gcacacagggcccg

SEQ ID NO: 965371 - DNA, 23 bp, Homo sapiens
gcacacagggcccggccacaccc

SEQ ID NO: 965372 - DNA, 14 bp, Homo sapiens
gcacacagggctca

SEQ ID NO: 965373 - DNA, 17 bp, Homo sapiens
gcacacagggctcacag

SEQ ID NO: 965374 - DNA, 19 bp, Homo sapiens
gcacacagggctcacaggg

SEQ ID NO: 965375 - DNA, 12 bp, Homo sapiens
gcacaccagccg

SEQ ID NO: 965376 - DNA, 17 bp, Homo sapiens
gcacaccagccgctgca

SEQ ID NO: 965377 - DNA, 19 bp, Homo sapiens
gcacaccagtgcaagcaga

SEQ ID NO: 965378 - DNA, 14 bp, Homo sapiens
gcacaccccactcc

SEQ ID NO: 965379 - DNA, 17 bp, Homo sapiens
gcacacgagttccagac

SEQ ID NO: 965380 - DNA, 17 bp, Homo sapiens
gcacacgcctcccactg

SEQ ID NO: 965381 - DNA, 11 bp, Homo sapiens
gcacactattt

SEQ ID NO: 965382 - DNA, 20 bp, Homo sapiens
gcacactcatcccctcactt

SEQ ID NO: 965383 - DNA, 17 bp, Homo sapiens
gcacactctctaaggcc

SEQ ID NO: 965384 - DNA, 18 bp, Homo sapiens
gcacactgctcttaagaa

SEQ ID NO: 965385 - DNA, 13 bp, Homo sapiens
gcacactggaata

SEQ ID NO: 965386 - DNA, 14 bp, Homo sapiens
gcacactggaatat

SEQ ID NO: 965387 - DNA, 22 bp, Homo sapiens
gcacactgtgattttgccctcc

SEQ ID NO: 965388 - DNA, 14 bp, Homo sapiens
gcacactttgccat

SEQ ID NO: 965389 - DNA, 21 bp, Homo sapiens
gcacagaaaaccgagaatatt

SEQ ID NO: 965390 - DNA, 13 bp, Homo sapiens
gcacagaatgagt

SEQ ID NO: 965391 - DNA, 16 bp, Homo sapiens
gcacagaccaggcctt

SEQ ID NO: 965392 - DNA, 14 bp, Homo sapiens
gcacagacttctgg

SEQ ID NO: 965393 - DNA, 19 bp, Homo sapiens
gcacagacttctggaaggc

SEQ ID NO: 965394 - DNA, 21 bp, Homo sapiens
gcacagacttctggaaggctg

SEQ ID NO: 965395 - DNA, 18 bp, Homo sapiens
gcacagagacggtctgga

SEQ ID NO: 965396 - DNA, 12 bp, Homo sapiens
gcacagagaggg

SEQ ID NO: 965397 - DNA, 22 bp, Homo sapiens
gcacagagagggacacatgccc

SEQ ID NO: 965398 - DNA, 23 bp, Homo sapiens
gcacagagagggacacatgcccc

SEQ ID NO: 965399 - DNA, 13 bp, Homo sapiens
gcacagagccctg

SEQ ID NO: 965400 - DNA, 16 bp, Homo sapiens
gcacagagcctggccc

SEQ ID NO: 965401 - DNA, 19 bp, Homo sapiens
gcacagagcctggccccag

SEQ ID NO: 965402 - DNA, 18 bp, Homo sapiens
gcacagagcgtccttccc

SEQ ID NO: 965403 - DNA, 19 bp, Homo sapiens
gcacagagcgtccttcccc

SEQ ID NO: 965404 - DNA, 19 bp, Homo sapiens
gcacagagttgttacattt

SEQ ID NO: 965405 - DNA, 21 bp, Homo sapiens
gcacagagttgttacattttt

SEQ ID NO: 965406 - DNA, 18 bp, Homo sapiens
gcacagatgaccaaagtc

SEQ ID NO: 965407 - DNA, 16 bp, Homo sapiens
gcacagatgaggagca

SEQ ID NO: 965408 - DNA, 14 bp, Homo sapiens
gcacagatgcccac

SEQ ID NO: 965409 - DNA, 17 bp, Homo sapiens
gcacagatgctccaggg

SEQ ID NO: 965410 - DNA, 18 bp, Homo sapiens
gcacagatggatttgcct

SEQ ID NO: 965411 - DNA, 19 bp, Homo sapiens
gcacagatggatttgcctg

SEQ ID NO: 965412 - DNA, 16 bp, Homo sapiens
gcacagattgaagaat

SEQ ID NO: 965413 - DNA, 20 bp, Homo sapiens
gcacagattgctgaaactgt

SEQ ID NO: 965414 - DNA, 22 bp, Homo sapiens
gcacagcaggacctgtgctttg

SEQ ID NO: 965415 - DNA, 23 bp, Homo sapiens
gcacagcaggacctgtgctttga

SEQ ID NO: 965416 - DNA, 20 bp, Homo sapiens
gcacagcaggggagccctga

SEQ ID NO: 965417 - DNA, 23 bp, Homo sapiens
gcacagcaggggagccctgattt

SEQ ID NO: 965418 - DNA, 14 bp, Homo sapiens
gcacagcatgaggc

SEQ ID NO: 965419 - DNA, 14 bp, Homo sapiens
gcacagccacccgt

SEQ ID NO: 965420 - DNA, 16 bp, Homo sapiens
gcacagccacccgtgg

SEQ ID NO: 965421 - DNA, 12 bp, Homo sapiens
gcacagccacct

SEQ ID NO: 965422 - DNA, 22 bp, Homo sapiens
gcacagccagcccaaaccttgg

SEQ ID NO: 965423 - DNA, 14 bp, Homo sapiens
gcacagcccagggc

SEQ ID NO: 965424 - DNA, 11 bp, Homo sapiens
gcacagccctg

SEQ ID NO: 965425 - DNA, 12 bp, Homo sapiens
gcacagccctgg

SEQ ID NO: 965426 - DNA, 11 bp, Homo sapiens
gcacagcctag

SEQ ID NO: 965427 - DNA, 15 bp, Homo sapiens
gcacagctcaggagg

SEQ ID NO: 965428 - DNA, 20 bp, Homo sapiens
gcacagctcaggaggcgccc

SEQ ID NO: 965429 - DNA, 12 bp, Homo sapiens
gcacagctgccc

SEQ ID NO: 965430 - DNA, 14 bp, Homo sapiens
tcacgctttcatga

SEQ ID NO: 965431 - DNA, 15 bp, Homo sapiens
tcacgctttcctgaa

SEQ ID NO: 965432 - DNA, 15 bp, Homo sapiens
tcacggaagttttca

SEQ ID NO: 965433 - DNA, 16 bp, Homo sapiens
tcacggaagttttcaa

SEQ ID NO: 965434 - DNA, 21 bp, Homo sapiens
tcacggatggtgcatgggctc

SEQ ID NO: 965435 - DNA, 23 bp, Homo sapiens
tcacgggccctgccccagcccct

SEQ ID NO: 965436 - DNA, 22 bp, Homo sapiens
tcacggtgacacaggtcagggc

SEQ ID NO: 965437 - DNA, 18 bp, Homo sapiens
tcacgtaaagctagaaat

SEQ ID NO: 965438 - DNA, 19 bp, Homo sapiens
tcacgtaaagctagaaatg

SEQ ID NO: 965439 - DNA, 17 bp, Homo sapiens
tcacgtaagatacaagt

SEQ ID NO: 965440 - DNA, 21 bp, Homo sapiens
tcacgtaccccactgggccag

SEQ ID NO: 965441 - DNA, 17 bp, Homo sapiens
tcacgtcatttgtttca

SEQ ID NO: 965442 - DNA, 22 bp, Homo sapiens
tcacgtgaaatatttaagtata

SEQ ID NO: 965443 - DNA, 22 bp, Homo sapiens
tcacgtggcctccgcagtgtct

SEQ ID NO: 965444 - DNA, 20 bp, Homo sapiens
gcacccaccgtggaggagga

SEQ ID NO: 965445 - DNA, 14 bp, Homo sapiens
gcacccacctccac

SEQ ID NO: 965446 - DNA, 23 bp, Homo sapiens
gcacccacctgttttctgaaaca

SEQ ID NO: 965447 - DNA, 17 bp, Homo sapiens
gcacccactcaccaggg

SEQ ID NO: 965448 - DNA, 18 bp, Homo sapiens
gcacccactcaccagggt

SEQ ID NO: 965449 - DNA, 19 bp, Homo sapiens
gcacccactcaccagggtc

SEQ ID NO: 965450 - DNA, 11 bp, Homo sapiens
gcacccagaac

SEQ ID NO: 965451 - DNA, 12 bp, Homo sapiens
gcacccagaaca

SEQ ID NO: 965452 - DNA, 14 bp, Homo sapiens
gcacccagaacagt

SEQ ID NO: 965453 - DNA, 14 bp, Homo sapiens
gcacccagagaaaa

SEQ ID NO: 965454 - DNA, 12 bp, Homo sapiens
gcacccagagca

SEQ ID NO: 965455 - DNA, 15 bp, Homo sapiens
gcacccagagcaccc

SEQ ID NO: 965456 - DNA, 22 bp, Homo sapiens
gcacccagagcaccccctgctc

SEQ ID NO: 965457 - DNA, 14 bp, Homo sapiens
gcaccccagctacc

SEQ ID NO: 965458 - DNA, 21 bp, Homo sapiens
gcaccccatcccaccagcccc

SEQ ID NO: 965459 - DNA, 15 bp, Homo sapiens
gcacccccacccacc

SEQ ID NO: 965460 - DNA, 15 bp, Homo sapiens
gcacccccacccttt

SEQ ID NO: 965461 - DNA, 13 bp, Homo sapiens
gcacccccatgct

SEQ ID NO: 965462 - DNA, 14 bp, Homo sapiens
gcacccccatgctg

SEQ ID NO: 965463 - DNA, 13 bp, Homo sapiens
gcacccccgccag

SEQ ID NO: 965464 - DNA, 19 bp, Homo sapiens
gcaccccctgctccaccag

SEQ ID NO: 965465 - DNA, 21 bp, Homo sapiens
gcaccccctgctccaccagca

SEQ ID NO: 965466 - DNA, 15 bp, Homo sapiens
gcacccctccctgct

SEQ ID NO: 965467 - DNA, 22 bp, Homo sapiens
gcacccctccctgcttgcacac

SEQ ID NO: 965468 - DNA, 13 bp, Homo sapiens
gcaccccttccat

SEQ ID NO: 965469 - DNA, 17 bp, Homo sapiens
gcaccccttctctcctc

SEQ ID NO: 965470 - DNA, 18 bp, Homo sapiens
gcaccccttctctcctcc

SEQ ID NO: 965471 - DNA, 19 bp, Homo sapiens
gcaccccttctctcctccc

SEQ ID NO: 965472 - DNA, 18 bp, Homo sapiens
gcacccctttcctcccca

SEQ ID NO: 965473 - DNA, 16 bp, Homo sapiens
gcacccgcctctcccg

SEQ ID NO: 965474 - DNA, 20 bp, Homo sapiens
gcacccggggccagagacat

SEQ ID NO: 965475 - DNA, 18 bp, Homo sapiens
gcaccctaggcagcctgc

SEQ ID NO: 965476 - DNA, 14 bp, Homo sapiens
gcaccctataaatc

SEQ ID NO: 965477 - DNA, 22 bp, Homo sapiens
gcaccctcagggagcctcccca

SEQ ID NO: 965478 - DNA, 13 bp, Homo sapiens
gcaccctccaccc

SEQ ID NO: 965479 - DNA, 17 bp, Homo sapiens
gcaccctccaccctgtc

SEQ ID NO: 965480 - DNA, 22 bp, Homo sapiens
gcaccctccaccctgtccccca

SEQ ID NO: 965481 - DNA, 16 bp, Homo sapiens
gcaccctctcctgggg

SEQ ID NO: 965482 - DNA, 17 bp, Homo sapiens
gcaccctctcctggggg

SEQ ID NO: 965483 - DNA, 22 bp, Homo sapiens
gcaccctctcctgggggtggca

SEQ ID NO: 965484 - DNA, 21 bp, Homo sapiens
gcaccctgccctcatgggacc

SEQ ID NO: 965485 - DNA, 16 bp, Homo sapiens
gcaccctgcgcctcca

SEQ ID NO: 965486 - DNA, 17 bp, Homo sapiens
gcaccctgcgcctccag

SEQ ID NO: 965487 - DNA, 18 bp, Homo sapiens
gcaccctgcgcctccaga

SEQ ID NO: 965488 - DNA, 19 bp, Homo sapiens
gcaccctgcgcctccagag

SEQ ID NO: 965489 - DNA, 18 bp, Homo sapiens
gcaccctggaaaggggag

SEQ ID NO: 965490 - DNA, 15 bp, Homo sapiens
gcaccctggggcctg

SEQ ID NO: 965491 - DNA, 20 bp, Homo sapiens
gcaccctggggcctggacct

SEQ ID NO: 965492 - DNA, 15 bp, Homo sapiens
gcacccttcttttct

SEQ ID NO: 965493 - DNA, 18 bp, Homo sapiens
gcaccgccacgtcccagc

SEQ ID NO: 965494 - DNA, 16 bp, Homo sapiens
gcaccgccgccaccct

SEQ ID NO: 965495 - DNA, 17 bp, Homo sapiens
gcaccgccgccaccctg

SEQ ID NO: 965496 - DNA, 13 bp, Homo sapiens
gcaccgccttctc

SEQ ID NO: 965497 - DNA, 14 bp, Homo sapiens
gcaccgccttctct

SEQ ID NO: 965498 - DNA, 20 bp, Homo sapiens
gcaccgcttttgttctcgca

SEQ ID NO: 965499 - DNA, 18 bp, Homo sapiens
gcaccggcgctgcaggta

SEQ ID NO: 965500 - DNA, 18 bp, Homo sapiens
gcaccgggctccatgcct

SEQ ID NO: 965501 - DNA, 19 bp, Homo sapiens
gcaccgggctggctgcttg

SEQ ID NO: 965502 - DNA, 14 bp, Homo sapiens
gcaccgtactgtgg

SEQ ID NO: 965503 - DNA, 17 bp, Homo sapiens
gcaccgtcatggcttaa

SEQ ID NO: 965504 - DNA, 14 bp, Homo sapiens
gcaccgtctcactg

SEQ ID NO: 965505 - DNA, 19 bp, Homo sapiens
gcaccgtctcactgtgtgt

SEQ ID NO: 965506 - DNA, 16 bp, Homo sapiens
gcaccgtgatggagag

SEQ ID NO: 965507 - DNA, 22 bp, Homo sapiens
gcaccgtgatggagaggacaga

SEQ ID NO: 965508 - DNA, 22 bp, Homo sapiens
gcaccgtgccaaccccacccag

SEQ ID NO: 965509 - DNA, 19 bp, Homo sapiens
gcaccgtgtcaagctgctc

SEQ ID NO: 965510 - DNA, 21 bp, Homo sapiens
gcaccgtgtcaagctgctctg

SEQ ID NO: 965511 - DNA, 13 bp, Homo sapiens
gcaccgtgtcctc

SEQ ID NO: 965512 - DNA, 15 bp, Homo sapiens
gcaccgtgtcctcct

SEQ ID NO: 965513 - DNA, 16 bp, Homo sapiens
gcaccgtgtcctcctc

SEQ ID NO: 965514 - DNA, 18 bp, Homo sapiens
gcaccgtgtcctcctctg

SEQ ID NO: 965515 - DNA, 15 bp, Homo sapiens
gcaccgttctgtgca

SEQ ID NO: 965516 - DNA, 18 bp, Homo sapiens
gcacctacagtgtacagt

SEQ ID NO: 965517 - DNA, 23 bp, Homo sapiens
gcacctaccaccagggccagcta

SEQ ID NO: 965518 - DNA, 17 bp, Homo sapiens
gcacctaccatcaggga

SEQ ID NO: 965519 - DNA, 14 bp, Homo sapiens
gcacctacgggggc

SEQ ID NO: 965520 - DNA, 21 bp, Homo sapiens
gcacctactatgtgctgggtg

SEQ ID NO: 965521 - DNA, 18 bp, Homo sapiens
gcacctatagtcccagct

SEQ ID NO: 965522 - DNA, 14 bp, Homo sapiens
gcacctattgaatt

SEQ ID NO: 965523 - DNA, 14 bp, Homo sapiens
gcacctcaggctga

SEQ ID NO: 965524 - DNA, 12 bp, Homo sapiens
gcacctcagggc

SEQ ID NO: 965525 - DNA, 13 bp, Homo sapiens
gcacctccacgcc

SEQ ID NO: 965526 - DNA, 15 bp, Homo sapiens
gcacctccacgccac

SEQ ID NO: 965527 - DNA, 14 bp, Homo sapiens
gcacctccagctgt

SEQ ID NO: 965528 - DNA, 14 bp, Homo sapiens
gcacctccaggcag

SEQ ID NO: 965529 - DNA, 13 bp, Homo sapiens
gcacctcccccca

SEQ ID NO: 965530 - DNA, 17 bp, Homo sapiens
gcacctccccccactgc

SEQ ID NO: 965531 - DNA, 18 bp, Homo sapiens
gcacctccccccactgca

SEQ ID NO: 965532 - DNA, 15 bp, Homo sapiens
gcacctccctcccca

SEQ ID NO: 965533 - DNA, 19 bp, Homo sapiens
gcacctccctccccagctc

SEQ ID NO: 965534 - DNA, 21 bp, Homo sapiens
gcacctccctccccagctccg

SEQ ID NO: 965535 - DNA, 22 bp, Homo sapiens
gcacctccgcgggctgactggg

SEQ ID NO: 965536 - DNA, 17 bp, Homo sapiens
gcacctccgcttgccag

SEQ ID NO: 965537 - DNA, 13 bp, Homo sapiens
gcacctccggctg

SEQ ID NO: 965538 - DNA, 15 bp, Homo sapiens
gcacctccggctgcc

SEQ ID NO: 965539 - DNA, 20 bp, Homo sapiens
gcacctcctgagaaggcgag

SEQ ID NO: 965540 - DNA, 15 bp, Homo sapiens
gcacctctgcccttc

SEQ ID NO: 965541 - DNA, 17 bp, Homo sapiens
gcacctctgttcatttc

SEQ ID NO: 965542 - DNA, 20 bp, Homo sapiens
gcacctcttccttgatgttt

SEQ ID NO: 965543 - DNA, 22 bp, Homo sapiens
gcacctgaaattaatttgtgaa

SEQ ID NO: 965544 - DNA, 19 bp, Homo sapiens
gcacctgaaccccatgggc

SEQ ID NO: 965545 - DNA, 13 bp, Homo sapiens
gcacctgagaccc

SEQ ID NO: 965546 - DNA, 18 bp, Homo sapiens
gcacctgagaccctactg

SEQ ID NO: 965547 - DNA, 13 bp, Homo sapiens
gcacctgccagcc

SEQ ID NO: 965548 - DNA, 14 bp, Homo sapiens
gcacctgccagcct

SEQ ID NO: 965549 - DNA, 17 bp, Homo sapiens
gcacctgccagcctggc

SEQ ID NO: 965550 - DNA, 13 bp, Homo sapiens
gcacctgcccagc

SEQ ID NO: 965551 - DNA, 18 bp, Homo sapiens
gcacctgccccctggtgg

SEQ ID NO: 965552 - DNA, 20 bp, Homo sapiens
tcacttgtattgactttatg

SEQ ID NO: 965553 - DNA, 21 bp, Homo sapiens
tcacttgtctcctttctgact

SEQ ID NO: 965554 - DNA, 18 bp, Homo sapiens
tcacttgtcttgctctta

SEQ ID NO: 965555 - DNA, 14 bp, Homo sapiens
tcactttaagtttt

SEQ ID NO: 965556 - DNA, 16 bp, Homo sapiens
tcactttagatgctga

SEQ ID NO: 965557 - DNA, 16 bp, Homo sapiens
tcactttattacaaga

SEQ ID NO: 965558 - DNA, 18 bp, Homo sapiens
tcactttccaccaagtgt

SEQ ID NO: 965559 - DNA, 13 bp, Homo sapiens
tcactttcctcag

SEQ ID NO: 965560 - DNA, 18 bp, Homo sapiens
tcactttcctcagttgat

SEQ ID NO: 965561 - DNA, 11 bp, Homo sapiens
tcactttgaaa

SEQ ID NO: 965562 - DNA, 19 bp, Homo sapiens
tcactttgacacttttcat

SEQ ID NO: 965563 - DNA, 15 bp, Homo sapiens
tcactttgccattat

SEQ ID NO: 965564 - DNA, 14 bp, Homo sapiens
tcactttgctctgg

SEQ ID NO: 965565 - DNA, 20 bp, Homo sapiens
tcactttgggagtttttgtt

SEQ ID NO: 965566 - DNA, 13 bp, Homo sapiens
tcactttgtgtat

SEQ ID NO: 965567 - DNA, 21 bp, Homo sapiens
tcacttttaatgaacaaatgg

SEQ ID NO: 965568 - DNA, 13 bp, Homo sapiens
tcacttttcagtg

SEQ ID NO: 965569 - DNA, 14 bp, Homo sapiens
tcacttttcatcct

SEQ ID NO: 965570 - DNA, 19 bp, Homo sapiens
tcacttttcatccttcccc

SEQ ID NO: 965571 - DNA, 11 bp, Homo sapiens
tcacttttcct

SEQ ID NO: 965572 - DNA, 13 bp, Homo sapiens
tcacttttcctcc

SEQ ID NO: 965573 - DNA, 13 bp, Homo sapiens
tcacttttctgag

SEQ ID NO: 965574 - DNA, 18 bp, Homo sapiens
tcacttttctgagttctt

SEQ ID NO: 965575 - DNA, 21 bp, Homo sapiens
tcacttttgttaacagtattt

SEQ ID NO: 965576 - DNA, 15 bp, Homo sapiens
tcacttttgttctgc

SEQ ID NO: 965577 - DNA, 19 bp, Homo sapiens
tcacttttgttctgcttta

SEQ ID NO: 965578 - DNA, 20 bp, Homo sapiens
tcactttttggaattgtctt

SEQ ID NO: 965579 - DNA, 17 bp, Homo sapiens
tcacttttttctgcctt

SEQ ID NO: 965580 - DNA, 17 bp, Homo sapiens
gcactgaagtgcttagt

SEQ ID NO: 965581 - DNA, 17 bp, Homo sapiens
gcactgaagtggccctc

SEQ ID NO: 965582 - DNA, 20 bp, Homo sapiens
gcactgaagtggccctccct

SEQ ID NO: 965583 - DNA, 20 bp, Homo sapiens
gcactgaatatataaacact

SEQ ID NO: 965584 - DNA, 16 bp, Homo sapiens
gcactgacagccttgc

SEQ ID NO: 965585 - DNA, 17 bp, Homo sapiens
gcactgactgggcatag

SEQ ID NO: 965586 - DNA, 11 bp, Homo sapiens
gcactgagccc

SEQ ID NO: 965587 - DNA, 12 bp, Homo sapiens
gcactgagcccc

SEQ ID NO: 965588 - DNA, 20 bp, Homo sapiens
gcactgagctcacatgggac

SEQ ID NO: 965589 - DNA, 22 bp, Homo sapiens
gcactgagctcacatgggactg

SEQ ID NO: 965590 - DNA, 23 bp, Homo sapiens
gcactgagctcacatgggactgg

SEQ ID NO: 965591 - DNA, 11 bp, Homo sapiens
gcactgagggc

SEQ ID NO: 965592 - DNA, 16 bp, Homo sapiens
gcactgagggccacac

SEQ ID NO: 965593 - DNA, 18 bp, Homo sapiens
gcactgatgttgtgtttt

SEQ ID NO: 965594 - DNA, 19 bp, Homo sapiens
gcactgatttcacaacaga

SEQ ID NO: 965595 - DNA, 20 bp, Homo sapiens
gcactgatttcacaacagat

SEQ ID NO: 965596 - DNA, 16 bp, Homo sapiens
gcactgcagtctgcag

SEQ ID NO: 965597 - DNA, 14 bp, Homo sapiens
gcactgcagtgatg

SEQ ID NO: 965598 - DNA, 19 bp, Homo sapiens
gcactgcccacatgggacc

SEQ ID NO: 965599 - DNA, 22 bp, Homo sapiens
gcactgcccacatgggacctgg

SEQ ID NO: 965600 - DNA, 21 bp, Homo sapiens
gcactgcccatggacaggctg

SEQ ID NO: 965601 - DNA, 12 bp, Homo sapiens
gcactgccccct

SEQ ID NO: 965602 - DNA, 21 bp, Homo sapiens
gcactgccccctgcttggcca

SEQ ID NO: 965603 - DNA, 20 bp, Homo sapiens
gcactgcctcctgttttctc

SEQ ID NO: 965604 - DNA, 22 bp, Homo sapiens
gcactgcctcctgttttctccc

SEQ ID NO: 965605 - DNA, 22 bp, Homo sapiens
gcactgcctctatgccctgcag

SEQ ID NO: 965606 - DNA, 14 bp, Homo sapiens
gcactgccttctcc

SEQ ID NO: 965607 - DNA, 13 bp, Homo sapiens
gcactgcgcctgt

SEQ ID NO: 965608 - DNA, 23 bp, Homo sapiens
gcactgctaggcgagtgccagga

SEQ ID NO: 965609 - DNA, 19 bp, Homo sapiens
gcactgctccaagggacag

SEQ ID NO: 965610 - DNA, 11 bp, Homo sapiens
gcactgctgtt

SEQ ID NO: 965611 - DNA, 22 bp, Homo sapiens
gcactgctgttcctgctccatg

SEQ ID NO: 965612 - DNA, 17 bp, Homo sapiens
gcactggactccggggc

SEQ ID NO: 965613 - DNA, 14 bp, Homo sapiens
gcactggagccaca

SEQ ID NO: 965614 - DNA, 15 bp, Homo sapiens
gcactggagctggga

SEQ ID NO: 965615 - DNA, 16 bp, Homo sapiens
gcactggagctgggag

SEQ ID NO: 965616 - DNA, 17 bp, Homo sapiens
gcactggagctgggagg

SEQ ID NO: 965617 - DNA, 14 bp, Homo sapiens
gcactggagtgcag

SEQ ID NO: 965618 - DNA, 20 bp, Homo sapiens
gcactggcattgtccctgtg

SEQ ID NO: 965619 - DNA, 23 bp, Homo sapiens
gcactggccagagagggcccagc

SEQ ID NO: 965620 - DNA, 16 bp, Homo sapiens
gcactggctctctcca

SEQ ID NO: 965621 - DNA, 15 bp, Homo sapiens
gcactgggaggcagg

SEQ ID NO: 965622 - DNA, 23 bp, Homo sapiens
gcactgggatgagccgctgtgag

SEQ ID NO: 965623 - DNA, 19 bp, Homo sapiens
gcactgggcaggttcctgg

SEQ ID NO: 965624 - DNA, 22 bp, Homo sapiens
gcactgggcaggttcctggggc

SEQ ID NO: 965625 - DNA, 19 bp, Homo sapiens
gcactggggagcccgtctc

SEQ ID NO: 965626 - DNA, 22 bp, Homo sapiens
gcactggggagcccgtctcagt

SEQ ID NO: 965627 - DNA, 18 bp, Homo sapiens
gcactgggttgcagggga

SEQ ID NO: 965628 - DNA, 21 bp, Homo sapiens
gcactgggttgcaggggattg

SEQ ID NO: 965629 - DNA, 19 bp, Homo sapiens
gcactggtaggttgggaca

SEQ ID NO: 965630 - DNA, 22 bp, Homo sapiens
gcactggtaggttgggacacca

SEQ ID NO: 965631 - DNA, 23 bp, Homo sapiens
gcactggtaggttgggacaccag

SEQ ID NO: 965632 - DNA, 23 bp, Homo sapiens
gcactggtgaactgagctgggca

SEQ ID NO: 965633 - DNA, 12 bp, Homo sapiens
gcactgtaaata

SEQ ID NO: 965634 - DNA, 15 bp, Homo sapiens
gcactgtatgctgga

SEQ ID NO: 965635 - DNA, 16 bp, Homo sapiens
gcactgtatgctggac

SEQ ID NO: 965636 - DNA, 16 bp, Homo sapiens
gcactgtcaggaatgg

SEQ ID NO: 965637 - DNA, 18 bp, Homo sapiens
gcactgtcccttgcctca

SEQ ID NO: 965638 - DNA, 11 bp, Homo sapiens
gcactgtctgc

SEQ ID NO: 965639 - DNA, 18 bp, Homo sapiens
gcactgtggattatttca

SEQ ID NO: 965640 - DNA, 13 bp, Homo sapiens
gcactgtggtttc

SEQ ID NO: 965641 - DNA, 16 bp, Homo sapiens
gcactgttcacatcat

SEQ ID NO: 965642 - DNA, 17 bp, Homo sapiens
gcactgttgatgtatct

SEQ ID NO: 965643 - DNA, 19 bp, Homo sapiens
gcacttaaggcactctgtt

SEQ ID NO: 965644 - DNA, 17 bp, Homo sapiens
gcacttaagtgcacttt

SEQ ID NO: 965645 - DNA, 16 bp, Homo sapiens
gcacttaatttgtaaa

SEQ ID NO: 965646 - DNA, 18 bp, Homo sapiens
gcacttaatttgtaaact

SEQ ID NO: 965647 - DNA, 12 bp, Homo sapiens
gcacttacaagt

SEQ ID NO: 965648 - DNA, 17 bp, Homo sapiens
gcacttagctatcagaa

SEQ ID NO: 965649 - DNA, 21 bp, Homo sapiens
gcacttataggtaacgtgatt

SEQ ID NO: 965650 - DNA, 20 bp, Homo sapiens
gcacttattgaatatatgat

SEQ ID NO: 965651 - DNA, 19 bp, Homo sapiens
gcacttcaaataattaaat

SEQ ID NO: 965652 - DNA, 18 bp, Homo sapiens
gcacttcaaattcaaata

SEQ ID NO: 965653 - DNA, 17 bp, Homo sapiens
gcacttcagaattccat

SEQ ID NO: 965654 - DNA, 19 bp, Homo sapiens
gcacttcaggtccgtgggc

SEQ ID NO: 965655 - DNA, 17 bp, Homo sapiens
gcacttcctccacagtc

SEQ ID NO: 965656 - DNA, 16 bp, Homo sapiens
gcacttgcagaggagc

SEQ ID NO: 965657 - DNA, 12 bp, Homo sapiens
gcacttgcctgg

SEQ ID NO: 965658 - DNA, 13 bp, Homo sapiens
gcacttgcctgga

SEQ ID NO: 965659 - DNA, 17 bp, Homo sapiens
gcacttgcgtcctgcag

SEQ ID NO: 965660 - DNA, 18 bp, Homo sapiens
gcacttggactcttgctc

SEQ ID NO: 965661 - DNA, 16 bp, Homo sapiens
gcacttggagccaagg

SEQ ID NO: 965662 - DNA, 12 bp, Homo sapiens
gcacttgtatat

SEQ ID NO: 965663 - DNA, 16 bp, Homo sapiens
gcacttgtccagctga

SEQ ID NO: 965664 - DNA, 17 bp, Homo sapiens
gcacttgtgattattta

SEQ ID NO: 965665 - DNA, 20 bp, Homo sapiens
gcacttgtgattatttatta

SEQ ID NO: 965666 - DNA, 15 bp, Homo sapiens
gcacttgttatatta

SEQ ID NO: 965667 - DNA, 20 bp, Homo sapiens
gcactttaaagaggctgtgt

SEQ ID NO: 965668 - DNA, 23 bp, Homo sapiens
gcactttaaagaggctgtgtggc

SEQ ID NO: 965669 - DNA, 18 bp, Homo sapiens
gcactttaaatgaagcta

SEQ ID NO: 965670 - DNA, 16 bp, Homo sapiens
gcactttaaccctctc

SEQ ID NO: 965671 - DNA, 18 bp, Homo sapiens
gcactttaaccctctctt

SEQ ID NO: 965672 - DNA, 20 bp, Homo sapiens
gcactttaaccctctcttcc

SEQ ID NO: 965673 - DNA, 21 bp, Homo sapiens
gcactttaaccctctcttccc

SEQ ID NO: 965674 - DNA, 15 bp, Homo sapiens
tcagatatttcttat

SEQ ID NO: 965675 - DNA, 21 bp, Homo sapiens
tcagatattttttcagaaata

SEQ ID NO: 965676 - DNA, 16 bp, Homo sapiens
tcagatcctgttactt

SEQ ID NO: 965677 - DNA, 13 bp, Homo sapiens
tcagatcgttcat

SEQ ID NO: 965678 - DNA, 14 bp, Homo sapiens
tcagatcgttcatt

SEQ ID NO: 965679 - DNA, 16 bp, Homo sapiens
tcagatcgttcattgc

SEQ ID NO: 965680 - DNA, 19 bp, Homo sapiens
tcagatcgttcattgcctt

SEQ ID NO: 965681 - DNA, 15 bp, Homo sapiens
tcagatctctaactt

SEQ ID NO: 965682 - DNA, 16 bp, Homo sapiens
tcagatctctaacttc

SEQ ID NO: 965683 - DNA, 13 bp, Homo sapiens
tcagatctgatca

SEQ ID NO: 965684 - DNA, 22 bp, Homo sapiens
tcagatctggtctagttaacct

SEQ ID NO: 965685 - DNA, 19 bp, Homo sapiens
tcagatcttaatataaatt

SEQ ID NO: 965686 - DNA, 21 bp, Homo sapiens
tcagatcttaatataaattca

SEQ ID NO: 965687 - DNA, 19 bp, Homo sapiens
tcagatctttctccttgaa

SEQ ID NO: 965688 - DNA, 13 bp, Homo sapiens
tcagatgaattta

SEQ ID NO: 965689 - DNA, 23 bp, Homo sapiens
tcagatgactatgcagaggcctg

SEQ ID NO: 965690 - DNA, 16 bp, Homo sapiens
tcagatgagaacaaag

SEQ ID NO: 965691 - DNA, 10 bp, Homo sapiens
tcagatgagg

SEQ ID NO: 965692 - DNA, 12 bp, Homo sapiens
tcagatgatggc

SEQ ID NO: 965693 - DNA, 16 bp, Homo sapiens
tcagatgcctcagagg

SEQ ID NO: 965694 - DNA, 17 bp, Homo sapiens
tcagatgcgtgcccagc

SEQ ID NO: 965695 - DNA, 21 bp, Homo sapiens
tcagatgcgtgcccagctctt

SEQ ID NO: 965696 - DNA, 22 bp, Homo sapiens
tcagatgcgttcgcctctggcc

SEQ ID NO: 965697 - DNA, 15 bp, Homo sapiens
tcagatgctcttggg

SEQ ID NO: 965698 - DNA, 16 bp, Homo sapiens
tcagatgctgaattga

SEQ ID NO: 965699 - DNA, 14 bp, Homo sapiens
tcagatgcttctgg

SEQ ID NO: 965700 - DNA, 19 bp, Homo sapiens
tcagatgcttgcggcaaaa

SEQ ID NO: 965701 - DNA, 18 bp, Homo sapiens
tcagatgggaagacatga

SEQ ID NO: 965702 - DNA, 19 bp, Homo sapiens
tcagatgtcttctgcctgt

SEQ ID NO: 965703 - DNA, 21 bp, Homo sapiens
tcagatgtcttctgcctgtta

SEQ ID NO: 965704 - DNA, 14 bp, Homo sapiens
tcagatgtgcaata

SEQ ID NO: 965705 - DNA, 23 bp, Homo sapiens
tcagatgtgttcctccattttct

SEQ ID NO: 965706 - DNA, 15 bp, Homo sapiens
tcagatgttaaaata

SEQ ID NO: 965707 - DNA, 17 bp, Homo sapiens
tcagatgttaaaataaa

SEQ ID NO: 965708 - DNA, 18 bp, Homo sapiens
tcagatgttaaaataaat

SEQ ID NO: 965709 - DNA, 11 bp, Homo sapiens
tcagatgtttt

SEQ ID NO: 965710 - DNA, 22 bp, Homo sapiens
tcagattcaataatgagagctc

SEQ ID NO: 965711 - DNA, 15 bp, Homo sapiens
tcagattgctgaatc

SEQ ID NO: 965712 - DNA, 18 bp, Homo sapiens
tcagattgtcttgcaact

SEQ ID NO: 965713 - DNA, 16 bp, Homo sapiens
gcagaggggcagccgc

SEQ ID NO: 965714 - DNA, 17 bp, Homo sapiens
gcagaggggcagccgct

SEQ ID NO: 965715 - DNA, 18 bp, Homo sapiens
gcagaggggcagccgcta

SEQ ID NO: 965716 - DNA, 12 bp, Homo sapiens
gcagaggggctt

SEQ ID NO: 965717 - DNA, 20 bp, Homo sapiens
gcagaggggctttctggaga

SEQ ID NO: 965718 - DNA, 23 bp, Homo sapiens
gcagagggggagtagccaagctg

SEQ ID NO: 965719 - DNA, 20 bp, Homo sapiens
gcagaggtaaaagtgtgagc

SEQ ID NO: 965720 - DNA, 23 bp, Homo sapiens
gcagaggtaaaagtgtgagcagt

SEQ ID NO: 965721 - DNA, 14 bp, Homo sapiens
gcagaggtcccagc

SEQ ID NO: 965722 - DNA, 22 bp, Homo sapiens
gcagaggtcccagccccaggcc

SEQ ID NO: 965723 - DNA, 23 bp, Homo sapiens
gcagaggtcccagccccaggcct

SEQ ID NO: 965724 - DNA, 14 bp, Homo sapiens
gcagaggtctccaa

SEQ ID NO: 965725 - DNA, 16 bp, Homo sapiens
gcagaggtctgtgctg

SEQ ID NO: 965726 - DNA, 18 bp, Homo sapiens
gcagaggtctgtgctgag

SEQ ID NO: 965727 - DNA, 21 bp, Homo sapiens
gcagaggtgagaactcagaag

SEQ ID NO: 965728 - DNA, 16 bp, Homo sapiens
gcagaggtttcttgaa

SEQ ID NO: 965729 - DNA, 22 bp, Homo sapiens
gcagaggttttaatgtctgttt

SEQ ID NO: 965730 - DNA, 18 bp, Homo sapiens
gcagagtctgggcctctg

SEQ ID NO: 965731 - DNA, 19 bp, Homo sapiens
gcagagtgaggatgtgttt

SEQ ID NO: 965732 - DNA, 14 bp, Homo sapiens
gcagagtggactgc

SEQ ID NO: 965733 - DNA, 19 bp, Homo sapiens
gcagagtggactgcattta

SEQ ID NO: 965734 - DNA, 21 bp, Homo sapiens
gcagagtggcgtggcctcccc

SEQ ID NO: 965735 - DNA, 22 bp, Homo sapiens
gcagagtggcgtggcctcccca

SEQ ID NO: 965736 - DNA, 19 bp, Homo sapiens
gcagagtgggacttggaga

SEQ ID NO: 965737 - DNA, 21 bp, Homo sapiens
gcagagtgggacttggagagc

SEQ ID NO: 965738 - DNA, 22 bp, Homo sapiens
gcagagtgggacttggagagca

SEQ ID NO: 965739 - DNA, 17 bp, Homo sapiens
gcagagttacagttctg

SEQ ID NO: 965740 - DNA, 20 bp, Homo sapiens
gcagagttacagttctgtgg

SEQ ID NO: 965741 - DNA, 17 bp, Homo sapiens
gcagagttctgtgaaga

SEQ ID NO: 965742 - DNA, 21 bp, Homo sapiens
gcagagttgtaaatatataaa

SEQ ID NO: 965743 - DNA, 16 bp, Homo sapiens
gcagatagcccaggag

SEQ ID NO: 965744 - DNA, 20 bp, Homo sapiens
gcagatagcccaggagcaac

SEQ ID NO: 965745 - DNA, 14 bp, Homo sapiens
gcagatcatctggg

SEQ ID NO: 965746 - DNA, 18 bp, Homo sapiens
gcagatccccactgtcct

SEQ ID NO: 965747 - DNA, 14 bp, Homo sapiens
gcagatctgtgcct

SEQ ID NO: 965748 - DNA, 16 bp, Homo sapiens
gcagatctgtgcctgg

SEQ ID NO: 965749 - DNA, 22 bp, Homo sapiens
gcagatgacacgcgctctccac

SEQ ID NO: 965750 - DNA, 13 bp, Homo sapiens
gcagatgactgag

SEQ ID NO: 965751 - DNA, 17 bp, Homo sapiens
gcagatgaggggccact

SEQ ID NO: 965752 - DNA, 22 bp, Homo sapiens
gcagatgaggggccactgaccc

SEQ ID NO: 965753 - DNA, 16 bp, Homo sapiens
gcagatgagtgtgtgt

SEQ ID NO: 965754 - DNA, 17 bp, Homo sapiens
gcagatgataaaaggaa

SEQ ID NO: 965755 - DNA, 13 bp, Homo sapiens
gcagatgcaatga

SEQ ID NO: 965756 - DNA, 18 bp, Homo sapiens
gcagatgccaccctagcc

SEQ ID NO: 965757 - DNA, 15 bp, Homo sapiens
gcagatgccagtgaa

SEQ ID NO: 965758 - DNA, 21 bp, Homo sapiens
gcagatgctgttgtgaagcta

SEQ ID NO: 965759 - DNA, 17 bp, Homo sapiens
gcagatggtactgctga

SEQ ID NO: 965760 - DNA, 20 bp, Homo sapiens
gcagatggtactgctgaggt

SEQ ID NO: 965761 - DNA, 17 bp, Homo sapiens
gcagatgtcccccactg

SEQ ID NO: 965762 - DNA, 18 bp, Homo sapiens
gcagatgtcccccactgc

SEQ ID NO: 965763 - DNA, 19 bp, Homo sapiens
gcagatgtcccccactgct

SEQ ID NO: 965764 - DNA, 18 bp, Homo sapiens
gcagatgtcttccctggg

SEQ ID NO: 965765 - DNA, 19 bp, Homo sapiens
gcagatgtcttccctgggc

SEQ ID NO: 965766 - DNA, 17 bp, Homo sapiens
gcagatgtgagccaccg

SEQ ID NO: 965767 - DNA, 23 bp, Homo sapiens
gcagatgtgagccaccgtgcctg

SEQ ID NO: 965768 - DNA, 19 bp, Homo sapiens
gcagatgttttgggggaac

SEQ ID NO: 965769 - DNA, 15 bp, Homo sapiens
gcagattcctgggcc

SEQ ID NO: 965770 - DNA, 18 bp, Homo sapiens
gcagattcctgggcctgt

SEQ ID NO: 965771 - DNA, 22 bp, Homo sapiens
gcagattcctgggcctgtcccc

SEQ ID NO: 965772 - DNA, 14 bp, Homo sapiens
gcagattctatttc

SEQ ID NO: 965773 - DNA, 19 bp, Homo sapiens
gcagattgagacctacagg

SEQ ID NO: 965774 - DNA, 16 bp, Homo sapiens
gcagcaaacactccac

SEQ ID NO: 965775 - DNA, 14 bp, Homo sapiens
gcagcaaattttca

SEQ ID NO: 965776 - DNA, 11 bp, Homo sapiens
gcagcaacaat

SEQ ID NO: 965777 - DNA, 19 bp, Homo sapiens
gcagcaagaagcagcctgt

SEQ ID NO: 965778 - DNA, 11 bp, Homo sapiens
gcagcaaggcc

SEQ ID NO: 965779 - DNA, 13 bp, Homo sapiens
gcagcaaggctgc

SEQ ID NO: 965780 - DNA, 16 bp, Homo sapiens
gcagcaaggctgctgc

SEQ ID NO: 965781 - DNA, 14 bp, Homo sapiens
gcagcaagggacct

SEQ ID NO: 965782 - DNA, 17 bp, Homo sapiens
gcagcaatttaaatgtt

SEQ ID NO: 965783 - DNA, 13 bp, Homo sapiens
gcagcacaaggaa

SEQ ID NO: 965784 - DNA, 11 bp, Homo sapiens
gcagcacaatt

SEQ ID NO: 965785 - DNA, 13 bp, Homo sapiens
gcagcacacctct

SEQ ID NO: 965786 - DNA, 22 bp, Homo sapiens
gcagcacagagtcgctggcatg

SEQ ID NO: 965787 - DNA, 16 bp, Homo sapiens
gcagcacagcccaggg

SEQ ID NO: 965788 - DNA, 17 bp, Homo sapiens
gcagcacagcccagggc

SEQ ID NO: 965789 - DNA, 14 bp, Homo sapiens
gcagcaccaaccac

SEQ ID NO: 965790 - DNA, 13 bp, Homo sapiens
gcagcaccacact

SEQ ID NO: 965791 - DNA, 17 bp, Homo sapiens
gcagcacccacagcacc

SEQ ID NO: 965792 - DNA, 19 bp, Homo sapiens
gcagcaccctcccccgcag

SEQ ID NO: 965793 - DNA, 17 bp, Homo sapiens
gcagcaccgttctgtgc

SEQ ID NO: 965794 - DNA, 18 bp, Homo sapiens
gcagcaccgttctgtgca

SEQ ID NO: 965795 - DNA, 16 bp, Homo sapiens
gcagcacctccaggcc

SEQ ID NO: 965796 - DNA, 15 bp, Homo sapiens
tcagcgggtctcctc

SEQ ID NO: 965797 - DNA, 23 bp, Homo sapiens
tcagcgggtctcctcccagcggc

SEQ ID NO: 965798 - DNA, 14 bp, Homo sapiens
tcagcgtcccctgc

SEQ ID NO: 965799 - DNA, 18 bp, Homo sapiens
tcagctaaagcccaacct

SEQ ID NO: 965800 - DNA, 17 bp, Homo sapiens
tcagctaaatgcaggga

SEQ ID NO: 965801 - DNA, 20 bp, Homo sapiens
tcagctactaatgatgtttt

SEQ ID NO: 965802 - DNA, 19 bp, Homo sapiens
tcagctactctagttctgt

SEQ ID NO: 965803 - DNA, 15 bp, Homo sapiens
tcagctactgatttt

SEQ ID NO: 965804 - DNA, 19 bp, Homo sapiens
tcagctactgatttttgtg

SEQ ID NO: 965805 - DNA, 18 bp, Homo sapiens
tcagctcaactcacagct

SEQ ID NO: 965806 - DNA, 20 bp, Homo sapiens
tcagctcaactcacagcttc

SEQ ID NO: 965807 - DNA, 14 bp, Homo sapiens
tcagctcaattgtt

SEQ ID NO: 965808 - DNA, 16 bp, Homo sapiens
tcagctcattatgaaa

SEQ ID NO: 965809 - DNA, 18 bp, Homo sapiens
tcagctcattatgaaaaa

SEQ ID NO: 965810 - DNA, 19 bp, Homo sapiens
tcagctcattatgaaaaac

SEQ ID NO: 965811 - DNA, 20 bp, Homo sapiens
tcagctcattatgaaaaaca

SEQ ID NO: 965812 - DNA, 19 bp, Homo sapiens
tcagctccagaataccttc

SEQ ID NO: 965813 - DNA, 19 bp, Homo sapiens
tcagctccaggtggctctg

SEQ ID NO: 965814 - DNA, 17 bp, Homo sapiens
tcagctcccttcccttg

SEQ ID NO: 965815 - DNA, 11 bp, Homo sapiens
tcagctcctga

SEQ ID NO: 965816 - DNA, 20 bp, Homo sapiens
tcagctcctgagtagctggg

SEQ ID NO: 965817 - DNA, 22 bp, Homo sapiens
tcagctcctgagtagctgggcc

SEQ ID NO: 965818 - DNA, 15 bp, Homo sapiens
tcagctccttcctgg

SEQ ID NO: 965819 - DNA, 15 bp, Homo sapiens
tcagctctcctggct

SEQ ID NO: 965820 - DNA, 14 bp, Homo sapiens
tcagctctctgccc

SEQ ID NO: 965821 - DNA, 21 bp, Homo sapiens
tcagctctctgccctgtgtac

SEQ ID NO: 965822 - DNA, 21 bp, Homo sapiens
tcagctctctgggacctcctt

SEQ ID NO: 965823 - DNA, 22 bp, Homo sapiens
tcagctctctgggacctcctta

SEQ ID NO: 965824 - DNA, 14 bp, Homo sapiens
tcagctctgaaaga

SEQ ID NO: 965825 - DNA, 18 bp, Homo sapiens
tcagctctgaaagagaaa

SEQ ID NO: 965826 - DNA, 11 bp, Homo sapiens
tcagctctggg

SEQ ID NO: 965827 - DNA, 21 bp, Homo sapiens
tcagctgaatgcctcctgtgg

SEQ ID NO: 965828 - DNA, 23 bp, Homo sapiens
tcagctgaatgcctcctgtgggg

SEQ ID NO: 965829 - DNA, 21 bp, Homo sapiens
tcagctgcaaggtactctggt

SEQ ID NO: 965830 - DNA, 20 bp, Homo sapiens
tcagctgcattccgcagccc

SEQ ID NO: 965831 - DNA, 12 bp, Homo sapiens
tcagctgcctca

SEQ ID NO: 965832 - DNA, 15 bp, Homo sapiens
tcagctgcctcactt

SEQ ID NO: 965833 - DNA, 15 bp, Homo sapiens
tcagctgctactact

SEQ ID NO: 965834 - DNA, 23 bp, Homo sapiens
tcagctgctcccacacttgtgcc

SEQ ID NO: 965835 - DNA, 15 bp, Homo sapiens
tcagctgctccctgg

SEQ ID NO: 965836 - DNA, 19 bp, Homo sapiens
tcagctgcttctgctgcct

SEQ ID NO: 965837 - DNA, 20 bp, Homo sapiens
tcagctggacatactgctgg

SEQ ID NO: 965838 - DNA, 14 bp, Homo sapiens
tcagctgggcagtg

SEQ ID NO: 965839 - DNA, 20 bp, Homo sapiens
tcagctgtaagaagagactg

SEQ ID NO: 965840 - DNA, 23 bp, Homo sapiens
tcagctgtaagaagagactggga

SEQ ID NO: 965841 - DNA, 12 bp, Homo sapiens
tcagctgtactt

SEQ ID NO: 965842 - DNA, 17 bp, Homo sapiens
tcagctgtacttcgtct

SEQ ID NO: 965843 - DNA, 16 bp, Homo sapiens
tcagctgtcacctgct

SEQ ID NO: 965844 - DNA, 19 bp, Homo sapiens
tcagctgtcctgcagcaaa

SEQ ID NO: 965845 - DNA, 18 bp, Homo sapiens
tcagcttcatttgtgtca

SEQ ID NO: 965846 - DNA, 16 bp, Homo sapiens
gcagcgacccttggtg

SEQ ID NO: 965847 - DNA, 13 bp, Homo sapiens
gcagcgagggcgg

SEQ ID NO: 965848 - DNA, 18 bp, Homo sapiens
gcagcgcagccgccgggc

SEQ ID NO: 965849 - DNA, 14 bp, Homo sapiens
gcagcgcagggctg

SEQ ID NO: 965850 - DNA, 18 bp, Homo sapiens
gcagcgcagggctggcac

SEQ ID NO: 965851 - DNA, 18 bp, Homo sapiens
gcagcgcccaggcctgct

SEQ ID NO: 965852 - DNA, 21 bp, Homo sapiens
gcagcgcccaggcctgctggc

SEQ ID NO: 965853 - DNA, 17 bp, Homo sapiens
gcagcgcggggagcccg

SEQ ID NO: 965854 - DNA, 19 bp, Homo sapiens
gcagcgctcggcccggagc

SEQ ID NO: 965855 - DNA, 17 bp, Homo sapiens
gcagcggattgctctgg

SEQ ID NO: 965856 - DNA, 14 bp, Homo sapiens
gcagcggctccact

SEQ ID NO: 965857 - DNA, 22 bp, Homo sapiens
gcagcggctctggtcctcggag

SEQ ID NO: 965858 - DNA, 22 bp, Homo sapiens
gcagcgggcaaagagctcccga

SEQ ID NO: 965859 - DNA, 20 bp, Homo sapiens
gcagcgtgggctctgccaat

SEQ ID NO: 965860 - DNA, 21 bp, Homo sapiens
gcagcgtttatggtgcttcct

SEQ ID NO: 965861 - DNA, 17 bp, Homo sapiens
gcagctaacaatgtctg

SEQ ID NO: 965862 - DNA, 13 bp, Homo sapiens
gcagctactggaa

SEQ ID NO: 965863 - DNA, 15 bp, Homo sapiens
gcagctactgtaact

SEQ ID NO: 965864 - DNA, 14 bp, Homo sapiens
gcagctagactgga

SEQ ID NO: 965865 - DNA, 22 bp, Homo sapiens
gcagctagactggagtgaggct

SEQ ID NO: 965866 - DNA, 14 bp, Homo sapiens
gcagctaggactga

SEQ ID NO: 965867 - DNA, 17 bp, Homo sapiens
gcagctaggactgagga

SEQ ID NO: 965868 - DNA, 21 bp, Homo sapiens
gcagctaggactgaggagtgg

SEQ ID NO: 965869 - DNA, 13 bp, Homo sapiens
gcagctaggcgcg

SEQ ID NO: 965870 - DNA, 14 bp, Homo sapiens
gcagctatctgcac

SEQ ID NO: 965871 - DNA, 21 bp, Homo sapiens
gcagctatgcgcaatgtggca

SEQ ID NO: 965872 - DNA, 15 bp, Homo sapiens
gcagctatttcagcc

SEQ ID NO: 965873 - DNA, 13 bp, Homo sapiens
gcagctcacccct

SEQ ID NO: 965874 - DNA, 14 bp, Homo sapiens
gcagctcacccctg

SEQ ID NO: 965875 - DNA, 19 bp, Homo sapiens
gcagctcacccctgggcag

SEQ ID NO: 965876 - DNA, 20 bp, Homo sapiens
gcagctcacccctgggcagg

SEQ ID NO: 965877 - DNA, 16 bp, Homo sapiens
gcagctccatcctctt

SEQ ID NO: 965878 - DNA, 13 bp, Homo sapiens
gcagctccctcct

SEQ ID NO: 965879 - DNA, 15 bp, Homo sapiens
gcagctccctcctgc

SEQ ID NO: 965880 - DNA, 16 bp, Homo sapiens
gcagctcctccctgtg

SEQ ID NO: 965881 - DNA, 20 bp, Homo sapiens
gcagctcctccctgtgcccc

SEQ ID NO: 965882 - DNA, 14 bp, Homo sapiens
gcagctcctctcct

SEQ ID NO: 965883 - DNA, 16 bp, Homo sapiens
gcagctctagctttgc

SEQ ID NO: 965884 - DNA, 18 bp, Homo sapiens
gcagctctagctttgcag

SEQ ID NO: 965885 - DNA, 19 bp, Homo sapiens
gcagctcttctgggcagag

SEQ ID NO: 965886 - DNA, 15 bp, Homo sapiens
gcagctcttgccctt

SEQ ID NO: 965887 - DNA, 16 bp, Homo sapiens
gcagctcttgcccttc

SEQ ID NO: 965888 - DNA, 23 bp, Homo sapiens
gcagctcttgcccttccctgtcc

SEQ ID NO: 965889 - DNA, 15 bp, Homo sapiens
gcagctgagaccagg

SEQ ID NO: 965890 - DNA, 18 bp, Homo sapiens
gcagctgagaccagggtc

SEQ ID NO: 965891 - DNA, 15 bp, Homo sapiens
gcagctgagagccct

SEQ ID NO: 965892 - DNA, 23 bp, Homo sapiens
gcagctgagagccctgctgtggg

SEQ ID NO: 965893 - DNA, 18 bp, Homo sapiens
gcagctgcaccagcaggt

SEQ ID NO: 965894 - DNA, 20 bp, Homo sapiens
gcagctgcaccccagcgtca

SEQ ID NO: 965895 - DNA, 15 bp, Homo sapiens
gcagctgccagagaa

SEQ ID NO: 965896 - DNA, 18 bp, Homo sapiens
gcagctgcccctcctgga

SEQ ID NO: 965897 - DNA, 15 bp, Homo sapiens
gcagctgcctctgct

SEQ ID NO: 965898 - DNA, 16 bp, Homo sapiens
gcagctgcctctgctc

SEQ ID NO: 965899 - DNA, 21 bp, Homo sapiens
gcagctgcctctgctccctct

SEQ ID NO: 965900 - DNA, 13 bp, Homo sapiens
gcagctgcctggc

SEQ ID NO: 965901 - DNA, 14 bp, Homo sapiens
gcagctgcctggcc

SEQ ID NO: 965902 - DNA, 16 bp, Homo sapiens
gcagctgcctggccat

SEQ ID NO: 965903 - DNA, 14 bp, Homo sapiens
gcagctgcctgggg

SEQ ID NO: 965904 - DNA, 16 bp, Homo sapiens
gcagctgcctggggcc

SEQ ID NO: 965905 - DNA, 19 bp, Homo sapiens
gcagctgcgggtctgaagg

SEQ ID NO: 965906 - DNA, 20 bp, Homo sapiens
gcagctgcgggtctgaagga

SEQ ID NO: 965907 - DNA, 22 bp, Homo sapiens
gcagctgctgtgggtggggccc

SEQ ID NO: 965908 - DNA, 12 bp, Homo sapiens
gcagctggacag

SEQ ID NO: 965909 - DNA, 15 bp, Homo sapiens
gcagctggacagagg

SEQ ID NO: 965910 - DNA, 22 bp, Homo sapiens
gcagctggactctgcatcccag

SEQ ID NO: 965911 - DNA, 16 bp, Homo sapiens
gcagctggcccccagc

SEQ ID NO: 965912 - DNA, 19 bp, Homo sapiens
gcagctggcccccagccct

SEQ ID NO: 965913 - DNA, 15 bp, Homo sapiens
gcagctggctctcca

SEQ ID NO: 965914 - DNA, 19 bp, Homo sapiens
gcagctgggacccctccca

SEQ ID NO: 965915 - DNA, 20 bp, Homo sapiens
gcagctgggacccctcccaa

SEQ ID NO: 965916 - DNA, 22 bp, Homo sapiens
gcagctgggacccctcccaacc

SEQ ID NO: 965917 - DNA, 20 bp, Homo sapiens
gcagctgggccccatgctct

SEQ ID NO: 965918 - DNA, 21 bp, Homo sapiens
gcaggcaggggcatctgtctg

SEQ ID NO: 965919 - DNA, 17 bp, Homo sapiens
gcaggcatagaggcttc

SEQ ID NO: 965920 - DNA, 20 bp, Homo sapiens
gcaggccaagagcagaggca

SEQ ID NO: 965921 - DNA, 22 bp, Homo sapiens
gcaggccaagagcagaggcagc

SEQ ID NO: 965922 - DNA, 19 bp, Homo sapiens
gcaggccaaggccttctcc

SEQ ID NO: 965923 - DNA, 21 bp, Homo sapiens
gcaggccaaggccttctcctc

SEQ ID NO: 965924 - DNA, 18 bp, Homo sapiens
gcaggccacccgggctgc

SEQ ID NO: 965925 - DNA, 19 bp, Homo sapiens
gcaggccacccgggctgcc

SEQ ID NO: 965926 - DNA, 17 bp, Homo sapiens
gcaggccagatggcccc

SEQ ID NO: 965927 - DNA, 19 bp, Homo sapiens
gcaggccagatggcccctc

SEQ ID NO: 965928 - DNA, 16 bp, Homo sapiens
gcaggccaggccagct

SEQ ID NO: 965929 - DNA, 14 bp, Homo sapiens
gcaggccaggctgc

SEQ ID NO: 965930 - DNA, 18 bp, Homo sapiens
gcaggcccactccccagc

SEQ ID NO: 965931 - DNA, 20 bp, Homo sapiens
gcaggcccactccccagccc

SEQ ID NO: 965932 - DNA, 18 bp, Homo sapiens
gcaggcccagcatgcagg

SEQ ID NO: 965933 - DNA, 13 bp, Homo sapiens
gcaggcccagtga

SEQ ID NO: 965934 - DNA, 15 bp, Homo sapiens
gcaggccccctagga

SEQ ID NO: 965935 - DNA, 14 bp, Homo sapiens
gcaggccctccctc

SEQ ID NO: 965936 - DNA, 14 bp, Homo sapiens
gcaggccctgtcca

SEQ ID NO: 965937 - DNA, 15 bp, Homo sapiens
gcaggccctgtccag

SEQ ID NO: 965938 - DNA, 23 bp, Homo sapiens
gcaggcctccaacgcccctgtgg

SEQ ID NO: 965939 - DNA, 16 bp, Homo sapiens
gcaggcctccctgaaa

SEQ ID NO: 965940 - DNA, 14 bp, Homo sapiens
gcaggcctctggtt

SEQ ID NO: 965941 - DNA, 13 bp, Homo sapiens
gcaggcctgaccc

SEQ ID NO: 965942 - DNA, 15 bp, Homo sapiens
gcaggcctgacccac

SEQ ID NO: 965943 - DNA, 16 bp, Homo sapiens
gcaggcctgacccacg

SEQ ID NO: 965944 - DNA, 12 bp, Homo sapiens
gcaggcctgaga

SEQ ID NO: 965945 - DNA, 15 bp, Homo sapiens
gcaggcctgagaatg

SEQ ID NO: 965946 - DNA, 12 bp, Homo sapiens
gcaggcctggga

SEQ ID NO: 965947 - DNA, 19 bp, Homo sapiens
gcaggcctgggacccagct

SEQ ID NO: 965948 - DNA, 20 bp, Homo sapiens
gcaggccttgctggggtcca

SEQ ID NO: 965949 - DNA, 23 bp, Homo sapiens
gcaggcgcggcggctctgcccac

SEQ ID NO: 965950 - DNA, 13 bp, Homo sapiens
gcaggcggccagg

SEQ ID NO: 965951 - DNA, 14 bp, Homo sapiens
gcaggcggccaggg

SEQ ID NO: 965952 - DNA, 15 bp, Homo sapiens
gcaggcggccagggc

SEQ ID NO: 965953 - DNA, 20 bp, Homo sapiens
gcaggcggccagggcggcca

SEQ ID NO: 965954 - DNA, 16 bp, Homo sapiens
gcaggcggtgggcacc

SEQ ID NO: 965955 - DNA, 22 bp, Homo sapiens
gcaggcgtgtggcagccacacg

SEQ ID NO: 965956 - DNA, 22 bp, Homo sapiens
gcaggctcactgccaggccagc

SEQ ID NO: 965957 - DNA, 17 bp, Homo sapiens
gcaggctcagactctgg

SEQ ID NO: 965958 - DNA, 18 bp, Homo sapiens
gcaggctccagttgaaca

SEQ ID NO: 965959 - DNA, 21 bp, Homo sapiens
gcaggctcctggctgtgccca

SEQ ID NO: 965960 - DNA, 13 bp, Homo sapiens
gcaggctctgggc

SEQ ID NO: 965961 - DNA, 15 bp, Homo sapiens
gcaggctgaggtggg

SEQ ID NO: 965962 - DNA, 20 bp, Homo sapiens
gcaggctgaggtggggaagg

SEQ ID NO: 965963 - DNA, 17 bp, Homo sapiens
gcaggctgatttctagg

SEQ ID NO: 965964 - DNA, 12 bp, Homo sapiens
gcaggctgcaga

SEQ ID NO: 965965 - DNA, 15 bp, Homo sapiens
gcaggctgcagagcc

SEQ ID NO: 965966 - DNA, 16 bp, Homo sapiens
gcaggctggcaccgcc

SEQ ID NO: 965967 - DNA, 18 bp, Homo sapiens
gcaggctggcagctctcc

SEQ ID NO: 965968 - DNA, 22 bp, Homo sapiens
gcaggctggccagtccaggctg

SEQ ID NO: 965969 - DNA, 15 bp, Homo sapiens
gcaggctggctggcc

SEQ ID NO: 965970 - DNA, 10 bp, Homo sapiens
gcaggctggg

SEQ ID NO: 965971 - DNA, 19 bp, Homo sapiens
gcaggctggggaggccagt

SEQ ID NO: 965972 - DNA, 17 bp, Homo sapiens
gcaggctgtctggccag

SEQ ID NO: 965973 - DNA, 12 bp, Homo sapiens
gcaggctgttcc

SEQ ID NO: 965974 - DNA, 13 bp, Homo sapiens
gcaggcttgggga

SEQ ID NO: 965975 - DNA, 15 bp, Homo sapiens
gcaggcttggggaaa

SEQ ID NO: 965976 - DNA, 20 bp, Homo sapiens
tcagggacctcaggggcacc

SEQ ID NO: 965977 - DNA, 22 bp, Homo sapiens
tcagggagcgatccaggggaag

SEQ ID NO: 965978 - DNA, 23 bp, Homo sapiens
tcagggagcgatccaggggaagc

SEQ ID NO: 965979 - DNA, 10 bp, Homo sapiens
tcagggaggg

SEQ ID NO: 965980 - DNA, 21 bp, Homo sapiens
tcagggagggaaggggatgga

SEQ ID NO: 965981 - DNA, 22 bp, Homo sapiens
tcagggagggaaggggatggag

SEQ ID NO: 965982 - DNA, 14 bp, Homo sapiens
tcagggagggccag

SEQ ID NO: 965983 - DNA, 15 bp, Homo sapiens
tcagggagggccagg

SEQ ID NO: 965984 - DNA, 16 bp, Homo sapiens
tcagggagggccaggg

SEQ ID NO: 965985 - DNA, 19 bp, Homo sapiens
tcagggagggttagcctgc

SEQ ID NO: 965986 - DNA, 22 bp, Homo sapiens
tcagggagggttagcctgcacc

SEQ ID NO: 965987 - DNA, 13 bp, Homo sapiens
tcagggagtgctg

SEQ ID NO: 965988 - DNA, 15 bp, Homo sapiens
tcagggatcttgcat

SEQ ID NO: 965989 - DNA, 16 bp, Homo sapiens
tcagggcacagctgcc

SEQ ID NO: 965990 - DNA, 19 bp, Homo sapiens
tcagggcacagctgccctg

SEQ ID NO: 965991 - DNA, 20 bp, Homo sapiens
tcagggcacagctgccctgc

SEQ ID NO: 965992 - DNA, 22 bp, Homo sapiens
tcagggcacagctgccctgctg

SEQ ID NO: 965993 - DNA, 19 bp, Homo sapiens
tcagggcacgcaggaccag

SEQ ID NO: 965994 - DNA, 14 bp, Homo sapiens
tcagggcagctgcc

SEQ ID NO: 965995 - DNA, 16 bp, Homo sapiens
tcagggcagctgcctg

SEQ ID NO: 965996 - DNA, 19 bp, Homo sapiens
tcagggcagctgcctggcc

SEQ ID NO: 965997 - DNA, 18 bp, Homo sapiens
tcagggcatcggcagctg

SEQ ID NO: 965998 - DNA, 16 bp, Homo sapiens
tcagggccagaaggag

SEQ ID NO: 965999 - DNA, 16 bp, Homo sapiens
tcagggccagactgga

SEQ ID NO: 966000 - DNA, 13 bp, Homo sapiens
tcagggccagtcc

SEQ ID NO: 966001 - DNA, 20 bp, Homo sapiens
tcagggccagtcctcctggg

SEQ ID NO: 966002 - DNA, 17 bp, Homo sapiens
tcagggccatgcctgcc

SEQ ID NO: 966003 - DNA, 13 bp, Homo sapiens
tcagggccatgct

SEQ ID NO: 966004 - DNA, 19 bp, Homo sapiens
tcagggccatgctgaggcc

SEQ ID NO: 966005 - DNA, 23 bp, Homo sapiens
tcagggccatgctgaggcctggg

SEQ ID NO: 966006 - DNA, 15 bp, Homo sapiens
tcagggcccaagtcc

SEQ ID NO: 966007 - DNA, 19 bp, Homo sapiens
tcagggcccaagtccctgt

SEQ ID NO: 966008 - DNA, 23 bp, Homo sapiens
tcagggccccagcactaaagcag

SEQ ID NO: 966009 - DNA, 13 bp, Homo sapiens
tcagggccctgcc

SEQ ID NO: 966010 - DNA, 15 bp, Homo sapiens
tcagggccctgcccc

SEQ ID NO: 966011 - DNA, 15 bp, Homo sapiens
tcagggctcagagtg

SEQ ID NO: 966012 - DNA, 16 bp, Homo sapiens
tcagggctcctcccag

SEQ ID NO: 966013 - DNA, 17 bp, Homo sapiens
tcagggctcctcccagc

SEQ ID NO: 966014 - DNA, 20 bp, Homo sapiens
tcagggctggagcctggggt

SEQ ID NO: 966015 - DNA, 23 bp, Homo sapiens
tcagggctggagtgcgctcttgg

SEQ ID NO: 966016 - DNA, 20 bp, Homo sapiens
tcaggggaagagaagacaaa

SEQ ID NO: 966017 - DNA, 16 bp, Homo sapiens
tcaggggacactggcc

SEQ ID NO: 966018 - DNA, 18 bp, Homo sapiens
tcaggggacactggcccc

SEQ ID NO: 966019 - DNA, 20 bp, Homo sapiens
tcaggggacactggccccac

SEQ ID NO: 966020 - DNA, 18 bp, Homo sapiens
tcaggggaccccactccc

SEQ ID NO: 966021 - DNA, 18 bp, Homo sapiens
tcaggggagaagctgaag

SEQ ID NO: 966022 - DNA, 20 bp, Homo sapiens
tcaggggagtcccgtcagga

SEQ ID NO: 966023 - DNA, 14 bp, Homo sapiens
tcaggggatgttta

SEQ ID NO: 966024 - DNA, 13 bp, Homo sapiens
tcaggggcacctc

SEQ ID NO: 966025 - DNA, 14 bp, Homo sapiens
tcaggggccagagg

SEQ ID NO: 966026 - DNA, 19 bp, Homo sapiens
tcaggggcctctctcctgc

SEQ ID NO: 966027 - DNA, 14 bp, Homo sapiens
tcaggggctcccta

SEQ ID NO: 966028 - DNA, 20 bp, Homo sapiens
tcaggggctctagggactgc

SEQ ID NO: 966029 - DNA, 12 bp, Homo sapiens
tcaggggctctg

SEQ ID NO: 966030 - DNA, 17 bp, Homo sapiens
tcaggggctttgggccc

SEQ ID NO: 966031 - DNA, 22 bp, Homo sapiens
tcaggggctttgggcccaagaa

SEQ ID NO: 966032 - DNA, 19 bp, Homo sapiens
tcagggggaagaagcagag

SEQ ID NO: 966033 - DNA, 17 bp, Homo sapiens
tcagggggagtctttgc

SEQ ID NO: 966034 - DNA, 12 bp, Homo sapiens
tcagggggccag

SEQ ID NO: 966035 - DNA, 18 bp, Homo sapiens
tcagggggccagctgggg

SEQ ID NO: 966036 - DNA, 13 bp, Homo sapiens
tcaggggggagaa

SEQ ID NO: 966037 - DNA, 20 bp, Homo sapiens
tcaggggggttgtgaggcct

SEQ ID NO: 966038 - DNA, 19 bp, Homo sapiens
tcagggggtaggagagcac

SEQ ID NO: 966039 - DNA, 21 bp, Homo sapiens
tcaggggtcaggtgtcaggcc

SEQ ID NO: 966040 - DNA, 14 bp, Homo sapiens
gcagtgagactggg

SEQ ID NO: 966041 - DNA, 14 bp, Homo sapiens
gcagtgagcggaga

SEQ ID NO: 966042 - DNA, 14 bp, Homo sapiens
gcagtgatggcgcg

SEQ ID NO: 966043 - DNA, 21 bp, Homo sapiens
gcagtgatggcgcgggaggca

SEQ ID NO: 966044 - DNA, 16 bp, Homo sapiens
gcagtgattctgtttg

SEQ ID NO: 966045 - DNA, 14 bp, Homo sapiens
gcagtgcatgcatg

SEQ ID NO: 966046 - DNA, 15 bp, Homo sapiens
gcagtgcatgcatgt

SEQ ID NO: 966047 - DNA, 12 bp, Homo sapiens
gcagtgccacag

SEQ ID NO: 966048 - DNA, 15 bp, Homo sapiens
gcagtgccacagcct

SEQ ID NO: 966049 - DNA, 12 bp, Homo sapiens
gcagtgccaccc

SEQ ID NO: 966050 - DNA, 13 bp, Homo sapiens
gcagtgccagcca

SEQ ID NO: 966051 - DNA, 14 bp, Homo sapiens
gcagtgccagccaa

SEQ ID NO: 966052 - DNA, 21 bp, Homo sapiens
gcagtgccccagggagtccag

SEQ ID NO: 966053 - DNA, 18 bp, Homo sapiens
gcagtgcctcgaggcacc

SEQ ID NO: 966054 - DNA, 22 bp, Homo sapiens
gcagtgcgcgtgcacgtggaga

SEQ ID NO: 966055 - DNA, 18 bp, Homo sapiens
gcagtgctgatccggctg

SEQ ID NO: 966056 - DNA, 23 bp, Homo sapiens
gcagtgcttccaaggatggacca

SEQ ID NO: 966057 - DNA, 22 bp, Homo sapiens
gcagtggactcagaaagccaac

SEQ ID NO: 966058 - DNA, 12 bp, Homo sapiens
gcagtggcacaa

SEQ ID NO: 966059 - DNA, 12 bp, Homo sapiens
gcagtggcctta

SEQ ID NO: 966060 - DNA, 17 bp, Homo sapiens
gcagtggctctcagagc

SEQ ID NO: 966061 - DNA, 14 bp, Homo sapiens
gcagtggctggtcc

SEQ ID NO: 966062 - DNA, 15 bp, Homo sapiens
gcagtggctggtcca

SEQ ID NO: 966063 - DNA, 19 bp, Homo sapiens
gcagtggctggtccagggc

SEQ ID NO: 966064 - DNA, 13 bp, Homo sapiens
gcagtggctggtg

SEQ ID NO: 966065 - DNA, 20 bp, Homo sapiens
gcagtggcttttgccccaga

SEQ ID NO: 966066 - DNA, 17 bp, Homo sapiens
gcagtgggcaggtggcc

SEQ ID NO: 966067 - DNA, 16 bp, Homo sapiens
gcagtgggcctgctga

SEQ ID NO: 966068 - DNA, 17 bp, Homo sapiens
gcagtgggcctgctgag

SEQ ID NO: 966069 - DNA, 20 bp, Homo sapiens
gcagtgggcctgctgaggcc

SEQ ID NO: 966070 - DNA, 18 bp, Homo sapiens
gcagtggtaagctctggc

SEQ ID NO: 966071 - DNA, 19 bp, Homo sapiens
gcagtggtggttttctgtt

SEQ ID NO: 966072 - DNA, 20 bp, Homo sapiens
gcagtggtggttttctgttc

SEQ ID NO: 966073 - DNA, 18 bp, Homo sapiens
gcagtgtcatcagaagat

SEQ ID NO: 966074 - DNA, 19 bp, Homo sapiens
gcagtgtcctgtgctttct

SEQ ID NO: 966075 - DNA, 14 bp, Homo sapiens
gcagtgtctccacc

SEQ ID NO: 966076 - DNA, 14 bp, Homo sapiens
gcagtgtctgtcag

SEQ ID NO: 966077 - DNA, 12 bp, Homo sapiens
gcagtgtgaaaa

SEQ ID NO: 966078 - DNA, 20 bp, Homo sapiens
gcagtgtgaatagcctggcc

SEQ ID NO: 966079 - DNA, 19 bp, Homo sapiens
gcagtgtgacctcctgtga

SEQ ID NO: 966080 - DNA, 21 bp, Homo sapiens
gcagtgtgaggccagggcaga

SEQ ID NO: 966081 - DNA, 14 bp, Homo sapiens
gcagtgtgagtgtg

SEQ ID NO: 966082 - DNA, 20 bp, Homo sapiens
gcagtgtgcactaaggggcc

SEQ ID NO: 966083 - DNA, 21 bp, Homo sapiens
gcagtgtgcactaaggggccc

SEQ ID NO: 966084 - DNA, 12 bp, Homo sapiens
gcagtgtgcagg

SEQ ID NO: 966085 - DNA, 23 bp, Homo sapiens
gcagtgtggagaccctgccacag

SEQ ID NO: 966086 - DNA, 20 bp, Homo sapiens
gcagtgttccccatctgggt

SEQ ID NO: 966087 - DNA, 14 bp, Homo sapiens
gcagtgtttccttt

SEQ ID NO: 966088 - DNA, 15 bp, Homo sapiens
gcagtgtttcctttt

SEQ ID NO: 966089 - DNA, 15 bp, Homo sapiens
gcagtgttttgcaag

SEQ ID NO: 966090 - DNA, 22 bp, Homo sapiens
gcagtgttttgcaagtgctgga

SEQ ID NO: 966091 - DNA, 11 bp, Homo sapiens
gcagttagagc

SEQ ID NO: 966092 - DNA, 16 bp, Homo sapiens
gcagttatattttgca

SEQ ID NO: 966093 - DNA, 20 bp, Homo sapiens
gcagttatggtgatgactta

SEQ ID NO: 966094 - DNA, 19 bp, Homo sapiens
gcagttcaaatcctcacca

SEQ ID NO: 966095 - DNA, 22 bp, Homo sapiens
gcagttcccacattaaagaaga

SEQ ID NO: 966096 - DNA, 23 bp, Homo sapiens
gcagttcccccaacctcagactt

SEQ ID NO: 966097 - DNA, 20 bp, Homo sapiens
gcagttctcccagggagtga

SEQ ID NO: 966098 - DNA, 15 bp, Homo sapiens
gcagttctgcaaata

SEQ ID NO: 966099 - DNA, 18 bp, Homo sapiens
gcagttctgcaaatagaa

SEQ ID NO: 966100 - DNA, 15 bp, Homo sapiens
gcagttgaacagact

SEQ ID NO: 966101 - DNA, 15 bp, Homo sapiens
gcagttgacagcagg

SEQ ID NO: 966102 - DNA, 17 bp, Homo sapiens
gcagttggactctcagg

SEQ ID NO: 966103 - DNA, 18 bp, Homo sapiens
gcagttggccaagcagaa

SEQ ID NO: 966104 - DNA, 21 bp, Homo sapiens
gcagttggggccctcttgcca

SEQ ID NO: 966105 - DNA, 15 bp, Homo sapiens
gcagtttatatttaa

SEQ ID NO: 966106 - DNA, 14 bp, Homo sapiens
gcagtttatcattc

SEQ ID NO: 966107 - DNA, 15 bp, Homo sapiens
gcagtttatcattca

SEQ ID NO: 966108 - DNA, 20 bp, Homo sapiens
gcagtttggccctggagcca

SEQ ID NO: 966109 - DNA, 21 bp, Homo sapiens
gcagtttggccctggagccag

SEQ ID NO: 966110 - DNA, 23 bp, Homo sapiens
tcagttcccggagcacagccctg

SEQ ID NO: 966111 - DNA, 18 bp, Homo sapiens
tcagttccctcctgccca

SEQ ID NO: 966112 - DNA, 18 bp, Homo sapiens
tcagttcccttggcctca

SEQ ID NO: 966113 - DNA, 19 bp, Homo sapiens
tcagttcccttggcctcag

SEQ ID NO: 966114 - DNA, 16 bp, Homo sapiens
tcagttcgtgtttgat

SEQ ID NO: 966115 - DNA, 19 bp, Homo sapiens
tcagttcgtgtttgattcc

SEQ ID NO: 966116 - DNA, 20 bp, Homo sapiens
tcagttcgttggtagagccc

SEQ ID NO: 966117 - DNA, 16 bp, Homo sapiens
tcagttctcttgcttt

SEQ ID NO: 966118 - DNA, 21 bp, Homo sapiens
tcagttcttggtgctctgtgt

SEQ ID NO: 966119 - DNA, 18 bp, Homo sapiens
tcagttgctcaaaaagaa

SEQ ID NO: 966120 - DNA, 22 bp, Homo sapiens
tcagttgtaataaatctaggat

SEQ ID NO: 966121 - DNA, 18 bp, Homo sapiens
tcagttgtacttctgctc

SEQ ID NO: 966122 - DNA, 14 bp, Homo sapiens
tcagttgtgttttt

SEQ ID NO: 966123 - DNA, 16 bp, Homo sapiens
tcagttgtgtttttta

SEQ ID NO: 966124 - DNA, 19 bp, Homo sapiens
tcagttgtttgcttcttgc

SEQ ID NO: 966125 - DNA, 16 bp, Homo sapiens
tcagtttaatccttct

SEQ ID NO: 966126 - DNA, 23 bp, Homo sapiens
tcagtttatccaaggtgtaactc

SEQ ID NO: 966127 - DNA, 16 bp, Homo sapiens
tcagtttatttccact

SEQ ID NO: 966128 - DNA, 18 bp, Homo sapiens
tcagtttcacagaaaata

SEQ ID NO: 966129 - DNA, 14 bp, Homo sapiens
tcagtttcactccc

SEQ ID NO: 966130 - DNA, 15 bp, Homo sapiens
tcagtttcactccct

SEQ ID NO: 966131 - DNA, 14 bp, Homo sapiens
tcagtttcatgaaa

SEQ ID NO: 966132 - DNA, 16 bp, Homo sapiens
tcagtttcatgaaatg

SEQ ID NO: 966133 - DNA, 21 bp, Homo sapiens
tcagtttccgaatctctttcc

SEQ ID NO: 966134 - DNA, 15 bp, Homo sapiens
tcagtttgtgtgtct

SEQ ID NO: 966135 - DNA, 19 bp, Homo sapiens
tcagttttccttctgttaa

SEQ ID NO: 966136 - DNA, 14 bp, Homo sapiens
tcagttttggaatc

SEQ ID NO: 966137 - DNA, 14 bp, Homo sapiens
tcagtttttcattt

SEQ ID NO: 966138 - DNA, 23 bp, Homo sapiens
tcagtttttcatttgttttgctt

SEQ ID NO: 966139 - DNA, 20 bp, Homo sapiens
tcagttttttgttttacaat

SEQ ID NO: 966140 - DNA, 15 bp, Homo sapiens
tcataaaaactgctt

SEQ ID NO: 966141 - DNA, 12 bp, Homo sapiens
tcataaaactgt

SEQ ID NO: 966142 - DNA, 17 bp, Homo sapiens
tcataaaactgtgacta

SEQ ID NO: 966143 - DNA, 13 bp, Homo sapiens
tcataaaagagac

SEQ ID NO: 966144 - DNA, 16 bp, Homo sapiens
tcataaaatagaataa

SEQ ID NO: 966145 - DNA, 13 bp, Homo sapiens
tcataaaatgcat

SEQ ID NO: 966146 - DNA, 15 bp, Homo sapiens
tcataaaatgcatac

SEQ ID NO: 966147 - DNA, 22 bp, Homo sapiens
tcataaaatgcatactgttgat

SEQ ID NO: 966148 - DNA, 21 bp, Homo sapiens
tcataaagggttgaaaatgtg

SEQ ID NO: 966149 - DNA, 21 bp, Homo sapiens
tcataaagtaatgatgaaatc

SEQ ID NO: 966150 - DNA, 11 bp, Homo sapiens
tcataaagtca

SEQ ID NO: 966151 - DNA, 22 bp, Homo sapiens
tcataaagtgagaaaactgtga

SEQ ID NO: 966152 - DNA, 21 bp, Homo sapiens
tcataaataaaggtgtagaaa

SEQ ID NO: 966153 - DNA, 13 bp, Homo sapiens
tcataaatactgt

SEQ ID NO: 966154 - DNA, 16 bp, Homo sapiens
tcataaatactgtcaa

SEQ ID NO: 966155 - DNA, 22 bp, Homo sapiens
tcataaatactgtcaaacaata

SEQ ID NO: 966156 - DNA, 23 bp, Homo sapiens
tcataaatactgtcaaacaataa

SEQ ID NO: 966157 - DNA, 11 bp, Homo sapiens
tcataaatgaa

SEQ ID NO: 966158 - DNA, 14 bp, Homo sapiens
tcataaatgaattt

SEQ ID NO: 966159 - DNA, 22 bp, Homo sapiens
tcataaattatttgattattta

SEQ ID NO: 966160 - DNA, 19 bp, Homo sapiens
tcataaggaagttattaac

SEQ ID NO: 966161 - DNA, 18 bp, Homo sapiens
tcataaggcctgccctcc

SEQ ID NO: 966162 - DNA, 18 bp, Homo sapiens
gcatctgcccctccccca

SEQ ID NO: 966163 - DNA, 18 bp, Homo sapiens
gcatctggctgtctagaa

SEQ ID NO: 966164 - DNA, 20 bp, Homo sapiens
gcatctgggattcccaccaa

SEQ ID NO: 966165 - DNA, 19 bp, Homo sapiens
gcatctggtcttgtttcca

SEQ ID NO: 966166 - DNA, 18 bp, Homo sapiens
gcatctggtgtaggaagt

SEQ ID NO: 966167 - DNA, 19 bp, Homo sapiens
gcatctggtgtaggaagtt

SEQ ID NO: 966168 - DNA, 21 bp, Homo sapiens
gcatctgtataagtaagaaaa

SEQ ID NO: 966169 - DNA, 23 bp, Homo sapiens
gcatctgtataagtaagaaaata

SEQ ID NO: 966170 - DNA, 12 bp, Homo sapiens
gcatctgtctgt

SEQ ID NO: 966171 - DNA, 15 bp, Homo sapiens
gcatctgtctgtctg

SEQ ID NO: 966172 - DNA, 16 bp, Homo sapiens
gcatctgtctgtctgt

SEQ ID NO: 966173 - DNA, 17 bp, Homo sapiens
gcatctgtctgtctgtg

SEQ ID NO: 966174 - DNA, 18 bp, Homo sapiens
gcatctgtctgtctgtgg

SEQ ID NO: 966175 - DNA, 14 bp, Homo sapiens
gcatctgtgatggg

SEQ ID NO: 966176 - DNA, 11 bp, Homo sapiens
gcatctgtgtg

SEQ ID NO: 966177 - DNA, 12 bp, Homo sapiens
gcatctgtgtgc

SEQ ID NO: 966178 - DNA, 17 bp, Homo sapiens
gcatctgttagcagagt

SEQ ID NO: 966179 - DNA, 23 bp, Homo sapiens
gcatctgttagcagagtctgtct

SEQ ID NO: 966180 - DNA, 14 bp, Homo sapiens
gcatcttcctctgc

SEQ ID NO: 966181 - DNA, 15 bp, Homo sapiens
gcatcttcctctgca

SEQ ID NO: 966182 - DNA, 14 bp, Homo sapiens
gcatcttctccatc

SEQ ID NO: 966183 - DNA, 15 bp, Homo sapiens
gcatcttctggcttg

SEQ ID NO: 966184 - DNA, 19 bp, Homo sapiens
gcatcttcttgcatctaat

SEQ ID NO: 966185 - DNA, 15 bp, Homo sapiens
gcatcttgctggcta

SEQ ID NO: 966186 - DNA, 13 bp, Homo sapiens
gcatctttccctg

SEQ ID NO: 966187 - DNA, 22 bp, Homo sapiens
gcatctttgccttgggctgctc

SEQ ID NO: 966188 - DNA, 19 bp, Homo sapiens
gcatcttttgtattaagaa

SEQ ID NO: 966189 - DNA, 23 bp, Homo sapiens
gcatcttttgtattaagaaagga

SEQ ID NO: 966190 - DNA, 13 bp, Homo sapiens
gcatgaaactagg

SEQ ID NO: 966191 - DNA, 18 bp, Homo sapiens
gcatgaaataaaatatat

SEQ ID NO: 966192 - DNA, 16 bp, Homo sapiens
gcatgaaattgtatct

SEQ ID NO: 966193 - DNA, 23 bp, Homo sapiens
gcatgaacttgtgggatggtggg

SEQ ID NO: 966194 - DNA, 22 bp, Homo sapiens
gcatgaagagaagcaattttgg

SEQ ID NO: 966195 - DNA, 21 bp, Homo sapiens
gcatgaagtaatatgcacaca

SEQ ID NO: 966196 - DNA, 23 bp, Homo sapiens
gcatgaagtaatatgcacacatt

SEQ ID NO: 966197 - DNA, 21 bp, Homo sapiens
gcatgaataacatttaaattc

SEQ ID NO: 966198 - DNA, 23 bp, Homo sapiens
gcatgaatcgggctaaggtccct

SEQ ID NO: 966199 - DNA, 15 bp, Homo sapiens
gcatgacaaaaataa

SEQ ID NO: 966200 - DNA, 16 bp, Homo sapiens
gcatgacaaaaataac

SEQ ID NO: 966201 - DNA, 17 bp, Homo sapiens
gcatgacaagccccagg

SEQ ID NO: 966202 - DNA, 14 bp, Homo sapiens
gcatgacagcctgc

SEQ ID NO: 966203 - DNA, 13 bp, Homo sapiens
gcatgaccacata

SEQ ID NO: 966204 - DNA, 22 bp, Homo sapiens
gcatgacctaccaggacagaac

SEQ ID NO: 966205 - DNA, 23 bp, Homo sapiens
gcatgacctaccaggacagaact

SEQ ID NO: 966206 - DNA, 16 bp, Homo sapiens
gcatgacctgtgacca

SEQ ID NO: 966207 - DNA, 17 bp, Homo sapiens
gcatgacctgtgaccag

SEQ ID NO: 966208 - DNA, 18 bp, Homo sapiens
gcatgactaatgcttttt

SEQ ID NO: 966209 - DNA, 15 bp, Homo sapiens
gcatgagattttgga

SEQ ID NO: 966210 - DNA, 15 bp, Homo sapiens
gcatgagccactgca

SEQ ID NO: 966211 - DNA, 13 bp, Homo sapiens
gcatgagctgctg

SEQ ID NO: 966212 - DNA, 18 bp, Homo sapiens
gcatgaggcaaaaatgtc

SEQ ID NO: 966213 - DNA, 21 bp, Homo sapiens
gcatgagttatctgatttttt

SEQ ID NO: 966214 - DNA, 16 bp, Homo sapiens
gcatgatctgaaaaat

SEQ ID NO: 966215 - DNA, 18 bp, Homo sapiens
gcatgatctgaaaaatac

SEQ ID NO: 966216 - DNA, 14 bp, Homo sapiens
gcatgatgccctcc

SEQ ID NO: 966217 - DNA, 13 bp, Homo sapiens
gcatgatgggaaa

SEQ ID NO: 966218 - DNA, 22 bp, Homo sapiens
gcatgattcttctcttgtgatt

SEQ ID NO: 966219 - DNA, 16 bp, Homo sapiens
gcatgatttatatatg

SEQ ID NO: 966220 - DNA, 21 bp, Homo sapiens
gcatgatttatatatggcata

SEQ ID NO: 966221 - DNA, 11 bp, Homo sapiens
gcatgatttga

SEQ ID NO: 966222 - DNA, 13 bp, Homo sapiens
gcatgatttgaaa

SEQ ID NO: 966223 - DNA, 14 bp, Homo sapiens
gcatgatttgaaaa

SEQ ID NO: 966224 - DNA, 16 bp, Homo sapiens
gcatgatttgaaaaaa

SEQ ID NO: 966225 - DNA, 20 bp, Homo sapiens
gcatgattttaagaggcttt

SEQ ID NO: 966226 - DNA, 15 bp, Homo sapiens
gcatgattttgtaac

SEQ ID NO: 966227 - DNA, 12 bp, Homo sapiens
gcatgcaactaa

SEQ ID NO: 966228 - DNA, 19 bp, Homo sapiens
gcatgcaagcttggtcaaa

SEQ ID NO: 966229 - DNA, 21 bp, Homo sapiens
gcatgcaagcttggtcaaact

SEQ ID NO: 966230 - DNA, 14 bp, Homo sapiens
gcatgcaataatgt

SEQ ID NO: 966231 - DNA, 14 bp, Homo sapiens
gcatgcaccacggg

SEQ ID NO: 966232 - DNA, 15 bp, Homo sapiens
gcatgcacgggcatg

SEQ ID NO: 966233 - DNA, 24 bp, Homo sapiens
gcatgcacgggcatgcacacggct

SEQ ID NO: 966234 - DNA, 17 bp, Homo sapiens
gcatgcactgttccccc

SEQ ID NO: 966235 - DNA, 22 bp, Homo sapiens
gcatgcactgttccccctgtgc

SEQ ID NO: 966236 - DNA, 13 bp, Homo sapiens
gcatgcagctgcc

SEQ ID NO: 966237 - DNA, 17 bp, Homo sapiens
gcatgcagctgcctggg

SEQ ID NO: 966238 - DNA, 12 bp, Homo sapiens
gcatgcagtgtt

SEQ ID NO: 966239 - DNA, 17 bp, Homo sapiens
gcatgccccttggctgg

SEQ ID NO: 966240 - DNA, 13 bp, Homo sapiens
gcatgcctgtgtg

SEQ ID NO: 966241 - DNA, 15 bp, Homo sapiens
gcatgcctgtgtgac

SEQ ID NO: 966242 - DNA, 15 bp, Homo sapiens
gcatgcgaaatgttc

SEQ ID NO: 966243 - DNA, 21 bp, Homo sapiens
gcatgcgaaatgttctcatga

SEQ ID NO: 966244 - DNA, 19 bp, Homo sapiens
tcatccttttttctcttct

SEQ ID NO: 966245 - DNA, 20 bp, Homo sapiens
tcatcgaagggattgtgtat

SEQ ID NO: 966246 - DNA, 14 bp, Homo sapiens
tcatcgaatctact

SEQ ID NO: 966247 - DNA, 17 bp, Homo sapiens
tcatcgccagacaactg

SEQ ID NO: 966248 - DNA, 23 bp, Homo sapiens
tcatcggaggctgggcccctggg

SEQ ID NO: 966249 - DNA, 17 bp, Homo sapiens
tcatcgggcccagggac

SEQ ID NO: 966250 - DNA, 15 bp, Homo sapiens
tcatcgttccccacc

SEQ ID NO: 966251 - DNA, 23 bp, Homo sapiens
tcatctataaagaagaacttgca

SEQ ID NO: 966252 - DNA, 22 bp, Homo sapiens
tcatctatagttgatatgtttt

SEQ ID NO: 966253 - DNA, 15 bp, Homo sapiens
tcatctattcaagca

SEQ ID NO: 966254 - DNA, 20 bp, Homo sapiens
tcatctcagagtccactgtg

SEQ ID NO: 966255 - DNA, 22 bp, Homo sapiens
tcatctcagtgaagaatacttc

SEQ ID NO: 966256 - DNA, 16 bp, Homo sapiens
tcatctcattcaaacc

SEQ ID NO: 966257 - DNA, 16 bp, Homo sapiens
tcatctcatttaaggg

SEQ ID NO: 966258 - DNA, 21 bp, Homo sapiens
tcatctcatttaagggaaaaa

SEQ ID NO: 966259 - DNA, 22 bp, Homo sapiens
tcatctcatttaagggaaaaat

SEQ ID NO: 966260 - DNA, 23 bp, Homo sapiens
tcatctcatttaagggaaaaata

SEQ ID NO: 966261 - DNA, 13 bp, Homo sapiens
tcatctccatcag

SEQ ID NO: 966262 - DNA, 16 bp, Homo sapiens
tcatctccatcagctg

SEQ ID NO: 966263 - DNA, 17 bp, Homo sapiens
tcatctccatcagctgt

SEQ ID NO: 966264 - DNA, 13 bp, Homo sapiens
tcatctcccctcc

SEQ ID NO: 966265 - DNA, 15 bp, Homo sapiens
tcatctccctgccat

SEQ ID NO: 966266 - DNA, 19 bp, Homo sapiens
tcatctccctgccatcccc

SEQ ID NO: 966267 - DNA, 22 bp, Homo sapiens
tcatctccggggtggccacagg

SEQ ID NO: 966268 - DNA, 18 bp, Homo sapiens
tcatctcctgccttcctc

SEQ ID NO: 966269 - DNA, 13 bp, Homo sapiens
tcatctccttttg

SEQ ID NO: 966270 - DNA, 16 bp, Homo sapiens
tcatctctctacctcc

SEQ ID NO: 966271 - DNA, 17 bp, Homo sapiens
tcatctctctacctcca

SEQ ID NO: 966272 - DNA, 13 bp, Homo sapiens
tcatctctctggg

SEQ ID NO: 966273 - DNA, 15 bp, Homo sapiens
tcatctctctggggc

SEQ ID NO: 966274 - DNA, 21 bp, Homo sapiens
tcatctctggaaggggcagcc

SEQ ID NO: 966275 - DNA, 17 bp, Homo sapiens
tcatctgaaacccacag

SEQ ID NO: 966276 - DNA, 13 bp, Homo sapiens
tcatctgaagggg

SEQ ID NO: 966277 - DNA, 19 bp, Homo sapiens
tcatctgagaggctctccg

SEQ ID NO: 966278 - DNA, 23 bp, Homo sapiens
tcatctgagaggctctccgtgca

SEQ ID NO: 966279 - DNA, 11 bp, Homo sapiens
tcatctgagga

SEQ ID NO: 966280 - DNA, 13 bp, Homo sapiens
tcatctgcaaaag

SEQ ID NO: 966281 - DNA, 14 bp, Homo sapiens
tcatctgcaaaggg

SEQ ID NO: 966282 - DNA, 21 bp, Homo sapiens
tcatctgcacccttcttttct

SEQ ID NO: 966283 - DNA, 14 bp, Homo sapiens
tcatctgctggtcc

SEQ ID NO: 966284 - DNA, 14 bp, Homo sapiens
gcattccctgagtc

SEQ ID NO: 966285 - DNA, 22 bp, Homo sapiens
gcattccctgagtcaccaggaa

SEQ ID NO: 966286 - DNA, 19 bp, Homo sapiens
gcattccttacttgcactg

SEQ ID NO: 966287 - DNA, 16 bp, Homo sapiens
gcattcctttgtcttc

SEQ ID NO: 966288 - DNA, 15 bp, Homo sapiens
gcattctacacctgg

SEQ ID NO: 966289 - DNA, 18 bp, Homo sapiens
gcattctagattactttt

SEQ ID NO: 966290 - DNA, 17 bp, Homo sapiens
gcattctgataggaggg

SEQ ID NO: 966291 - DNA, 16 bp, Homo sapiens
gcattctgcacgctgc

SEQ ID NO: 966292 - DNA, 22 bp, Homo sapiens
gcattctggaggggagagcttt

SEQ ID NO: 966293 - DNA, 17 bp, Homo sapiens
gcattctggcataattt

SEQ ID NO: 966294 - DNA, 18 bp, Homo sapiens
gcattctgtttcctcttg

SEQ ID NO: 966295 - DNA, 13 bp, Homo sapiens
gcattcttctctg

SEQ ID NO: 966296 - DNA, 19 bp, Homo sapiens
gcattcttgtcacaataaa

SEQ ID NO: 966297 - DNA, 21 bp, Homo sapiens
gcattcttgtcacaataaatg

SEQ ID NO: 966298 - DNA, 21 bp, Homo sapiens
gcattcttttaaaagacaaga

SEQ ID NO: 966299 - DNA, 16 bp, Homo sapiens
gcattcttttaaagtt

SEQ ID NO: 966300 - DNA, 19 bp, Homo sapiens
gcattgaacacaaactgta

SEQ ID NO: 966301 - DNA, 21 bp, Homo sapiens
gcattgaacacaaactgtaaa

SEQ ID NO: 966302 - DNA, 23 bp, Homo sapiens
gcattgaacacaaactgtaaata

SEQ ID NO: 966303 - DNA, 21 bp, Homo sapiens
gcattgagaactgcatatgtt

SEQ ID NO: 966304 - DNA, 16 bp, Homo sapiens
gcattgagcttgcatg

SEQ ID NO: 966305 - DNA, 14 bp, Homo sapiens
gcattgataatctt

SEQ ID NO: 966306 - DNA, 15 bp, Homo sapiens
gcattgataatcttc

SEQ ID NO: 966307 - DNA, 16 bp, Homo sapiens
gcattgatccaggaga

SEQ ID NO: 966308 - DNA, 14 bp, Homo sapiens
gcattgccaagggc

SEQ ID NO: 966309 - DNA, 14 bp, Homo sapiens
gcattgctagataa

SEQ ID NO: 966310 - DNA, 17 bp, Homo sapiens
gcattgctagataaaag

SEQ ID NO: 966311 - DNA, 16 bp, Homo sapiens
gcattgctctggatct

SEQ ID NO: 966312 - DNA, 13 bp, Homo sapiens
gcattgctttcgt

SEQ ID NO: 966313 - DNA, 12 bp, Homo sapiens
gcattgctttct

SEQ ID NO: 966314 - DNA, 13 bp, Homo sapiens
gcattgctttctg

SEQ ID NO: 966315 - DNA, 14 bp, Homo sapiens
gcattgctttgccc

SEQ ID NO: 966316 - DNA, 22 bp, Homo sapiens
gcattgctttgccctggagcag

SEQ ID NO: 966317 - DNA, 21 bp, Homo sapiens
gcattggaaaccctatttccc

SEQ ID NO: 966318 - DNA, 16 bp, Homo sapiens
gcattggaagacccca

SEQ ID NO: 966319 - DNA, 15 bp, Homo sapiens
gcattggaagagccc

SEQ ID NO: 966320 - DNA, 15 bp, Homo sapiens
gcattgggctgacac

SEQ ID NO: 966321 - DNA, 20 bp, Homo sapiens
gcattgggctgacacctacc

SEQ ID NO: 966322 - DNA, 19 bp, Homo sapiens
gcattggggggccgggcag

SEQ ID NO: 966323 - DNA, 13 bp, Homo sapiens
gcattggtgactc

SEQ ID NO: 966324 - DNA, 11 bp, Homo sapiens
gcattgtaaat

SEQ ID NO: 966325 - DNA, 13 bp, Homo sapiens
gcattgtctctct

SEQ ID NO: 966326 - DNA, 14 bp, Homo sapiens
gcattgtcttgtgg

SEQ ID NO: 966327 - DNA, 13 bp, Homo sapiens
gcattgtctttgc

SEQ ID NO: 966328 - DNA, 15 bp, Homo sapiens
gcattgtctttgctg

SEQ ID NO: 966329 - DNA, 16 bp, Homo sapiens
gcattgtctttgctgt

SEQ ID NO: 966330 - DNA, 17 bp, Homo sapiens
gcattgtgaactgacag

SEQ ID NO: 966331 - DNA, 18 bp, Homo sapiens
gcattgtgaactgacagg

SEQ ID NO: 966332 - DNA, 22 bp, Homo sapiens
gcattgtgattggcctgtagag

SEQ ID NO: 966333 - DNA, 17 bp, Homo sapiens
gcattgttattgtggaa

SEQ ID NO: 966334 - DNA, 23 bp, Homo sapiens
gcattgttgaggtggtctgaatg

SEQ ID NO: 966335 - DNA, 17 bp, Homo sapiens
gcattgtttgcttattg

SEQ ID NO: 966336 - DNA, 18 bp, Homo sapiens
gcattgtttgcttattgt

SEQ ID NO: 966337 - DNA, 18 bp, Homo sapiens
gcatttaaaacagacact

SEQ ID NO: 966338 - DNA, 16 bp, Homo sapiens
gcatttaaacatgttt

SEQ ID NO: 966339 - DNA, 20 bp, Homo sapiens
gcatttaacccccctgtaca

SEQ ID NO: 966340 - DNA, 17 bp, Homo sapiens
gcatttaacttacattt

SEQ ID NO: 966341 - DNA, 14 bp, Homo sapiens
gcatttaaggagat

SEQ ID NO: 966342 - DNA, 15 bp, Homo sapiens
gcatttaaggagatt

SEQ ID NO: 966343 - DNA, 15 bp, Homo sapiens
gcatttaataaagat

SEQ ID NO: 966344 - DNA, 20 bp, Homo sapiens
gcatttaataaagatgagtt

SEQ ID NO: 966345 - DNA, 18 bp, Homo sapiens
gcatttaatggcagctag

SEQ ID NO: 966346 - DNA, 14 bp, Homo sapiens
gcatttacaaggtt

SEQ ID NO: 966347 - DNA, 22 bp, Homo sapiens
gcatttagaactttctgctttg

SEQ ID NO: 966348 - DNA, 20 bp, Homo sapiens
gcatttagttttatggcatg

SEQ ID NO: 966349 - DNA, 17 bp, Homo sapiens
gcatttcaattcctggc

SEQ ID NO: 966350 - DNA, 23 bp, Homo sapiens
gcatttcacctgtgacaaaggat

SEQ ID NO: 966351 - DNA, 17 bp, Homo sapiens
gcatttcacgaactgtt

SEQ ID NO: 966352 - DNA, 16 bp, Homo sapiens
gcatttcattatgctt

SEQ ID NO: 966353 - DNA, 13 bp, Homo sapiens
gcatttccaaaca

SEQ ID NO: 966354 - DNA, 23 bp, Homo sapiens
gcatttccaacaccacagacaca

SEQ ID NO: 966355 - DNA, 14 bp, Homo sapiens
gcatttccagagca

SEQ ID NO: 966356 - DNA, 12 bp, Homo sapiens
gcatttcctgct

SEQ ID NO: 966357 - DNA, 13 bp, Homo sapiens
gcatttcctgctg

SEQ ID NO: 966358 - DNA, 18 bp, Homo sapiens
gcatttcctgctggtcaa

SEQ ID NO: 966359 - DNA, 12 bp, Homo sapiens
gcatttctattg

SEQ ID NO: 966360 - DNA, 17 bp, Homo sapiens
gcatttctcttctcagc

SEQ ID NO: 966361 - DNA, 14 bp, Homo sapiens
gcatttctctttaa

SEQ ID NO: 966362 - DNA, 14 bp, Homo sapiens
gcatttgaggggcc

SEQ ID NO: 966363 - DNA, 18 bp, Homo sapiens
gcatttgaggtctgttct

SEQ ID NO: 966364 - DNA, 19 bp, Homo sapiens
gcatttgaggtctgttctt

SEQ ID NO: 966365 - DNA, 22 bp, Homo sapiens
gcatttgctggttataacagca

SEQ ID NO: 966366 - DNA, 22 bp, Homo sapiens
gcatttggattggggtccctct

SEQ ID NO: 966367 - DNA, 21 bp, Homo sapiens
gcatttggtgagagtcaaagc

SEQ ID NO: 966368 - DNA, 21 bp, Homo sapiens
gcatttggtggtttcagaaat

SEQ ID NO: 966369 - DNA, 12 bp, Homo sapiens
gcatttgtatta

SEQ ID NO: 966370 - DNA, 21 bp, Homo sapiens
gcatttgtattttgtgtgacc

SEQ ID NO: 966371 - DNA, 17 bp, Homo sapiens
gcatttgtgctagaaat

SEQ ID NO: 966372 - DNA, 12 bp, Homo sapiens
gcatttgttcac

SEQ ID NO: 966373 - DNA, 15 bp, Homo sapiens
gcattttaagtaaaa

SEQ ID NO: 966374 - DNA, 17 bp, Homo sapiens
gcattttagaaactaca

SEQ ID NO: 966375 - DNA, 16 bp, Homo sapiens
gcattttcctcgccta

SEQ ID NO: 966376 - DNA, 15 bp, Homo sapiens
tcattccattgccta

SEQ ID NO: 966377 - DNA, 20 bp, Homo sapiens
tcattccattgcctagctct

SEQ ID NO: 966378 - DNA, 13 bp, Homo sapiens
tcattcccagagt

SEQ ID NO: 966379 - DNA, 12 bp, Homo sapiens
tcattcccctcg

SEQ ID NO: 966380 - DNA, 20 bp, Homo sapiens
tcattcctgaaagaaacagt

SEQ ID NO: 966381 - DNA, 15 bp, Homo sapiens
tcattccttcactca

SEQ ID NO: 966382 - DNA, 15 bp, Homo sapiens
tcattccttctggcc

SEQ ID NO: 966383 - DNA, 23 bp, Homo sapiens
tcattcgctactatgatttaatt

SEQ ID NO: 966384 - DNA, 15 bp, Homo sapiens
tcattcgggatgatt

SEQ ID NO: 966385 - DNA, 14 bp, Homo sapiens
tcattcggtgtgaa

SEQ ID NO: 966386 - DNA, 15 bp, Homo sapiens
tcattcggtgtgaac

SEQ ID NO: 966387 - DNA, 22 bp, Homo sapiens
tcattcggtgtgaacttttctc

SEQ ID NO: 966388 - DNA, 17 bp, Homo sapiens
tcattcgtggcatgttt

SEQ ID NO: 966389 - DNA, 16 bp, Homo sapiens
tcattctacagaataa

SEQ ID NO: 966390 - DNA, 13 bp, Homo sapiens
tcattctcctgcc

SEQ ID NO: 966391 - DNA, 16 bp, Homo sapiens
tcattctcctgcctgt

SEQ ID NO: 966392 - DNA, 15 bp, Homo sapiens
tcattctctgtctca

SEQ ID NO: 966393 - DNA, 16 bp, Homo sapiens
tcattctgcattgcta

SEQ ID NO: 966394 - DNA, 14 bp, Homo sapiens
tcattctgcctgct

SEQ ID NO: 966395 - DNA, 20 bp, Homo sapiens
tcattcttactaaaaagtat

SEQ ID NO: 966396 - DNA, 17 bp, Homo sapiens
tcattcttgaggagcat

SEQ ID NO: 966397 - DNA, 21 bp, Homo sapiens
tcattctttcccctcagagct

SEQ ID NO: 966398 - DNA, 22 bp, Homo sapiens
tcattctttcccctcagagctc

SEQ ID NO: 966399 - DNA, 21 bp, Homo sapiens
tcattgaaatttactgtgaga

SEQ ID NO: 966400 - DNA, 20 bp, Homo sapiens
tcattgactatcaaactgaa

SEQ ID NO: 966401 - DNA, 18 bp, Homo sapiens
tcattgagggaccaaaaa

SEQ ID NO: 966402 - DNA, 19 bp, Homo sapiens
tcattgcacctatctcagc

SEQ ID NO: 966403 - DNA, 21 bp, Homo sapiens
tcattgcacctatctcagcca

SEQ ID NO: 966404 - DNA, 14 bp, Homo sapiens
tcattgcatttcca

SEQ ID NO: 966405 - DNA, 18 bp, Homo sapiens
tcattgcctcctgttctg

SEQ ID NO: 966406 - DNA, 20 bp, Homo sapiens
tcattgcctcttctacttgt

SEQ ID NO: 966407 - DNA, 17 bp, Homo sapiens
tccaagcatttcatgaa

SEQ ID NO: 966408 - DNA, 20 bp, Homo sapiens
tccaagcatttcatgaaaaa

SEQ ID NO: 966409 - DNA, 21 bp, Homo sapiens
tccaagcatttcatgaaaaag

SEQ ID NO: 966410 - DNA, 23 bp, Homo sapiens
tccaagcatttcatgaaaaagct

SEQ ID NO: 966411 - DNA, 15 bp, Homo sapiens
tccaagccagcggga

SEQ ID NO: 966412 - DNA, 15 bp, Homo sapiens
tccaagcctccacag

SEQ ID NO: 966413 - DNA, 17 bp, Homo sapiens
tccaagcctccacagcg

SEQ ID NO: 966414 - DNA, 20 bp, Homo sapiens
tccaagcctccacagcgagg

SEQ ID NO: 966415 - DNA, 21 bp, Homo sapiens
tccaagcctccacagcgaggg

SEQ ID NO: 966416 - DNA, 19 bp, Homo sapiens
tccaagcctgcctcccaag

SEQ ID NO: 966417 - DNA, 16 bp, Homo sapiens
tccaagcctggcaccc

SEQ ID NO: 966418 - DNA, 17 bp, Homo sapiens
tccaagcctggcaccca

SEQ ID NO: 966419 - DNA, 23 bp, Homo sapiens
tccaagcctggcacccaccgtct

SEQ ID NO: 966420 - DNA, 18 bp, Homo sapiens
tccaagctccatctccac

SEQ ID NO: 966421 - DNA, 12 bp, Homo sapiens
tccaagctccct

SEQ ID NO: 966422 - DNA, 14 bp, Homo sapiens
tccaagctccctgc

SEQ ID NO: 966423 - DNA, 18 bp, Homo sapiens
tccaagctccctgcccca

SEQ ID NO: 966424 - DNA, 14 bp, Homo sapiens
tccaagctccttat

SEQ ID NO: 966425 - DNA, 22 bp, Homo sapiens
tccaagctgggagattcaaggg

SEQ ID NO: 966426 - DNA, 15 bp, Homo sapiens
tccaaggagaaacag

SEQ ID NO: 966427 - DNA, 16 bp, Homo sapiens
tccaaggagaaacaga

SEQ ID NO: 966428 - DNA, 22 bp, Homo sapiens
tccaaggagaaacagagacagg

SEQ ID NO: 966429 - DNA, 23 bp, Homo sapiens
tccaaggagaaacagagacaggc

SEQ ID NO: 966430 - DNA, 14 bp, Homo sapiens
tccaaggagaccaa

SEQ ID NO: 966431 - DNA, 13 bp, Homo sapiens
tccaaggagcaga

SEQ ID NO: 966432 - DNA, 18 bp, Homo sapiens
tccaaggagcagagaggt

SEQ ID NO: 966433 - DNA, 12 bp, Homo sapiens
tccaaggagttc

SEQ ID NO: 966434 - DNA, 13 bp, Homo sapiens
tccaaggcaaaca

SEQ ID NO: 966435 - DNA, 19 bp, Homo sapiens
tccaaggccgcggcccaga

SEQ ID NO: 966436 - DNA, 20 bp, Homo sapiens
tccaaggctttaaagctgag

SEQ ID NO: 966437 - DNA, 16 bp, Homo sapiens
tccaagggacaggtgg

SEQ ID NO: 966438 - DNA, 17 bp, Homo sapiens
tccaagggacaggtggg

SEQ ID NO: 966439 - DNA, 19 bp, Homo sapiens
tccaagggaccctttgcct

SEQ ID NO: 966440 - DNA, 18 bp, Homo sapiens
tccaagggccgtgccctt

SEQ ID NO: 966441 - DNA, 23 bp, Homo sapiens
tccaagggcttctgcaccctcca

SEQ ID NO: 966442 - DNA, 18 bp, Homo sapiens
tccaagggtactaaggaa

SEQ ID NO: 966443 - DNA, 21 bp, Homo sapiens
tccaagggtatgggaagccat

SEQ ID NO: 966444 - DNA, 22 bp, Homo sapiens
tccaagggtatgggaagccata

SEQ ID NO: 966445 - DNA, 20 bp, Homo sapiens
tccaagggttgagagccagt

SEQ ID NO: 966446 - DNA, 21 bp, Homo sapiens
tccaagggttgagagccagtg

SEQ ID NO: 966447 - DNA, 14 bp, Homo sapiens
tccaagggtttcga

SEQ ID NO: 966448 - DNA, 19 bp, Homo sapiens
tccaagggtttcgactggt

SEQ ID NO: 966449 - DNA, 22 bp, Homo sapiens
tccaagggtttcgactggtcca

SEQ ID NO: 966450 - DNA, 18 bp, Homo sapiens
tccaaggtcactcttggt

SEQ ID NO: 966451 - DNA, 17 bp, Homo sapiens
tccaagtcactagaagt

SEQ ID NO: 966452 - DNA, 20 bp, Homo sapiens
tccaagtctctctgtgaata

SEQ ID NO: 966453 - DNA, 23 bp, Homo sapiens
tccaagtctttcttcttttttaa

SEQ ID NO: 966454 - DNA, 20 bp, Homo sapiens
tccaagtgaacactagccag

SEQ ID NO: 966455 - DNA, 18 bp, Homo sapiens
tccaagtgtgtgtgcgtg

SEQ ID NO: 966456 - DNA, 14 bp, Homo sapiens
tccaagttcacagt

SEQ ID NO: 966457 - DNA, 21 bp, Homo sapiens
tccaagttcttcacctctatc

SEQ ID NO: 966458 - DNA, 23 bp, Homo sapiens
tccaataaaaacattttgaagtg

SEQ ID NO: 966459 - DNA, 16 bp, Homo sapiens
tccaataaagtgcctt

SEQ ID NO: 966460 - DNA, 15 bp, Homo sapiens
tccaataatcagaaa

SEQ ID NO: 966461 - DNA, 14 bp, Homo sapiens
tccaataccctaga

SEQ ID NO: 966462 - DNA, 19 bp, Homo sapiens
tccaataccctagaagaaa

SEQ ID NO: 966463 - DNA, 20 bp, Homo sapiens
tccaatatcatgtcttgtgc

SEQ ID NO: 966464 - DNA, 18 bp, Homo sapiens
tccaatcccaccaaccct

SEQ ID NO: 966465 - DNA, 16 bp, Homo sapiens
tccaatcctatgtttt

SEQ ID NO: 966466 - DNA, 14 bp, Homo sapiens
tccaatcctcactg

SEQ ID NO: 966467 - DNA, 16 bp, Homo sapiens
tccaatgttgtgtgca

SEQ ID NO: 966468 - DNA, 14 bp, Homo sapiens
tccaatgttttatt

SEQ ID NO: 966469 - DNA, 16 bp, Homo sapiens
tccaattagtttcctt

SEQ ID NO: 966470 - DNA, 13 bp, Homo sapiens
tccaattccccct

SEQ ID NO: 966471 - DNA, 23 bp, Homo sapiens
tccaattctaaatccgacttgaa

SEQ ID NO: 966472 - DNA, 22 bp, Homo sapiens
tccaattgatgtatatgtttat

SEQ ID NO: 966473 - DNA, 23 bp, Homo sapiens
tccaattgcctcttgcaggctga

SEQ ID NO: 966474 - DNA, 21 bp, Homo sapiens
tccaattgttgacagttctga

SEQ ID NO: 966475 - DNA, 17 bp, Homo sapiens
tccaatttacatactct

SEQ ID NO: 966476 - DNA, 13 bp, Homo sapiens
tccaatttattat

SEQ ID NO: 966477 - DNA, 12 bp, Homo sapiens
tccaatttcccc

SEQ ID NO: 966478 - DNA, 17 bp, Homo sapiens
tccaattttaatttagt

SEQ ID NO: 966479 - DNA, 13 bp, Homo sapiens
tccaatttttact

SEQ ID NO: 966480 - DNA, 15 bp, Homo sapiens
tccaatttttactca

SEQ ID NO: 966481 - DNA, 19 bp, Homo sapiens
tccacaaagaaaattccta

SEQ ID NO: 966482 - DNA, 16 bp, Homo sapiens
tccacaaagcaaaggc

SEQ ID NO: 966483 - DNA, 14 bp, Homo sapiens
tccacaacacacag

SEQ ID NO: 966484 - DNA, 18 bp, Homo sapiens
tccacaaggaataaatga

SEQ ID NO: 966485 - DNA, 16 bp, Homo sapiens
tccacaattcttctgt

SEQ ID NO: 966486 - DNA, 23 bp, Homo sapiens
tccacacacagaggaagagcagg

SEQ ID NO: 966487 - DNA, 15 bp, Homo sapiens
tccacacacgcagga

SEQ ID NO: 966488 - DNA, 16 bp, Homo sapiens
tccacacattccagcc

SEQ ID NO: 966489 - DNA, 15 bp, Homo sapiens
tccacacatttaaaa

SEQ ID NO: 966490 - DNA, 23 bp, Homo sapiens
tccacaccactgttgccttttaa

SEQ ID NO: 966491 - DNA, 22 bp, Homo sapiens
tccacagagagggagagcagag

SEQ ID NO: 966492 - DNA, 23 bp, Homo sapiens
tccacagagagggagagcagaga

SEQ ID NO: 966493 - DNA, 17 bp, Homo sapiens
tccacagaggacacaga

SEQ ID NO: 966494 - DNA, 19 bp, Homo sapiens
tccacagcaaccccaggct

SEQ ID NO: 966495 - DNA, 23 bp, Homo sapiens
tccacagccgcctgaaagccaca

SEQ ID NO: 966496 - DNA, 17 bp, Homo sapiens
tccacagcgagggcagc

SEQ ID NO: 966497 - DNA, 20 bp, Homo sapiens
tccacagcgagggcagctgc

SEQ ID NO: 966498 - DNA, 12 bp, Homo sapiens
tccacagctgca

SEQ ID NO: 966499 - DNA, 14 bp, Homo sapiens
tccacagctgcagc

SEQ ID NO: 966500 - DNA, 16 bp, Homo sapiens
tccacagctgcagctg

SEQ ID NO: 966501 - DNA, 18 bp, Homo sapiens
tccacaggcaaaactcag

SEQ ID NO: 966502 - DNA, 13 bp, Homo sapiens
tccacaggggcag

SEQ ID NO: 966503 - DNA, 20 bp, Homo sapiens
tccacaggggcaggcctggg

SEQ ID NO: 966504 - DNA, 23 bp, Homo sapiens
tccacaggggcaggcctgggacc

SEQ ID NO: 966505 - DNA, 19 bp, Homo sapiens
tccacaggggtgtttgtgt

SEQ ID NO: 966506 - DNA, 14 bp, Homo sapiens
tccacagtgctgct

SEQ ID NO: 966507 - DNA, 13 bp, Homo sapiens
tccacagtgttta

SEQ ID NO: 966508 - DNA, 14 bp, Homo sapiens
tccacagttatctt

SEQ ID NO: 966509 - DNA, 13 bp, Homo sapiens
gccaccagccccc

SEQ ID NO: 966510 - DNA, 15 bp, Homo sapiens
gccaccaggccacct

SEQ ID NO: 966511 - DNA, 18 bp, Homo sapiens
gccaccaggccacctccc

SEQ ID NO: 966512 - DNA, 19 bp, Homo sapiens
gccaccaggctggcgcagc

SEQ ID NO: 966513 - DNA, 20 bp, Homo sapiens
gccaccagggagcttcctgg

SEQ ID NO: 966514 - DNA, 21 bp, Homo sapiens
gccaccaggtgcctttcaaat

SEQ ID NO: 966515 - DNA, 16 bp, Homo sapiens
gccaccagtcactgtc

SEQ ID NO: 966516 - DNA, 11 bp, Homo sapiens
gccaccagttc

SEQ ID NO: 966517 - DNA, 13 bp, Homo sapiens
gccaccagttctc

SEQ ID NO: 966518 - DNA, 19 bp, Homo sapiens
gccaccagttctcatgggt

SEQ ID NO: 966519 - DNA, 19 bp, Homo sapiens
gccaccatgaccccttctc

SEQ ID NO: 966520 - DNA, 20 bp, Homo sapiens
gccaccatgcttgcctgaag

SEQ ID NO: 966521 - DNA, 14 bp, Homo sapiens
gccaccatggccag

SEQ ID NO: 966522 - DNA, 16 bp, Homo sapiens
gccacccaagcctgct

SEQ ID NO: 966523 - DNA, 18 bp, Homo sapiens
gccacccaagcctgctgg

SEQ ID NO: 966524 - DNA, 14 bp, Homo sapiens
gccacccactcagg

SEQ ID NO: 966525 - DNA, 17 bp, Homo sapiens
gccacccattcttcccg

SEQ ID NO: 966526 - DNA, 19 bp, Homo sapiens
gccaccccaaaccccagcc

SEQ ID NO: 966527 - DNA, 23 bp, Homo sapiens
gccaccccaaaccccagccccaa

SEQ ID NO: 966528 - DNA, 16 bp, Homo sapiens
tccactcttctctcct

SEQ ID NO: 966529 - DNA, 22 bp, Homo sapiens
tccactcttctctcctttctcc

SEQ ID NO: 966530 - DNA, 20 bp, Homo sapiens
tccactgaaaatttaacagt

SEQ ID NO: 966531 - DNA, 15 bp, Homo sapiens
tccactgataagact

SEQ ID NO: 966532 - DNA, 18 bp, Homo sapiens
tccactgcaaataaagcc

SEQ ID NO: 966533 - DNA, 22 bp, Homo sapiens
tccactgcaaataaagcctttt

SEQ ID NO: 966534 - DNA, 17 bp, Homo sapiens
tccactgccctggcagc

SEQ ID NO: 966535 - DNA, 21 bp, Homo sapiens
tccactgccctggcagcagca

SEQ ID NO: 966536 - DNA, 15 bp, Homo sapiens
tccactgccttcgat

SEQ ID NO: 966537 - DNA, 10 bp, Homo sapiens
tccactggac

SEQ ID NO: 966538 - DNA, 16 bp, Homo sapiens
tccactggacttgagc

SEQ ID NO: 966539 - DNA, 23 bp, Homo sapiens
tccactggcttttgcctgtaaga

SEQ ID NO: 966540 - DNA, 15 bp, Homo sapiens
tccactgtatatttt

SEQ ID NO: 966541 - DNA, 12 bp, Homo sapiens
tccactgtgcta

SEQ ID NO: 966542 - DNA, 19 bp, Homo sapiens
tccactgtgctattacaaa

SEQ ID NO: 966543 - DNA, 13 bp, Homo sapiens
tccactgtggcac

SEQ ID NO: 966544 - DNA, 12 bp, Homo sapiens
tccactgtgtat

SEQ ID NO: 966545 - DNA, 20 bp, Homo sapiens
tccactgtgtgttgacactg

SEQ ID NO: 966546 - DNA, 16 bp, Homo sapiens
tccacttaagttcttt

SEQ ID NO: 966547 - DNA, 21 bp, Homo sapiens
tccacttagaaattgcatttc

SEQ ID NO: 966548 - DNA, 12 bp, Homo sapiens
tccacttcccgt

SEQ ID NO: 966549 - DNA, 13 bp, Homo sapiens
tccacttcccgtc

SEQ ID NO: 966550 - DNA, 19 bp, Homo sapiens
tccacttcccgtctcagaa

SEQ ID NO: 966551 - DNA, 20 bp, Homo sapiens
tccacttcccgtctcagaat

SEQ ID NO: 966552 - DNA, 21 bp, Homo sapiens
tccacttctggtcccctgtgg

SEQ ID NO: 966553 - DNA, 17 bp, Homo sapiens
tccacttcttggttcct

SEQ ID NO: 966554 - DNA, 18 bp, Homo sapiens
tccacttcttggttcctg

SEQ ID NO: 966555 - DNA, 23 bp, Homo sapiens
tccacttcttggttcctgggatg

SEQ ID NO: 966556 - DNA, 15 bp, Homo sapiens
tccactttgtttcgt

SEQ ID NO: 966557 - DNA, 17 bp, Homo sapiens
tccacttttcttcttcc

SEQ ID NO: 966558 - DNA, 20 bp, Homo sapiens
tccagaaaaatgaaaagcaa

SEQ ID NO: 966559 - DNA, 18 bp, Homo sapiens
tccagaaaaccccagcat

SEQ ID NO: 966560 - DNA, 16 bp, Homo sapiens
tccagaaacagctgct

SEQ ID NO: 966561 - DNA, 19 bp, Homo sapiens
tccagaaacagctgcttct

SEQ ID NO: 966562 - DNA, 23 bp, Homo sapiens
tccagaaacagctgcttctcccc

SEQ ID NO: 966563 - DNA, 16 bp, Homo sapiens
tccagaaactcctgtt

SEQ ID NO: 966564 - DNA, 19 bp, Homo sapiens
tccagaaagctgaggaaca

SEQ ID NO: 966565 - DNA, 23 bp, Homo sapiens
tccagaaagctgaggaacaggtt

SEQ ID NO: 966566 - DNA, 22 bp, Homo sapiens
tccagaaaggatatttaagaaa

SEQ ID NO: 966567 - DNA, 19 bp, Homo sapiens
tccagaaatacaattttag

SEQ ID NO: 966568 - DNA, 18 bp, Homo sapiens
tccagaaatacctgtcta

SEQ ID NO: 966569 - DNA, 19 bp, Homo sapiens
tccagaagaagagaagctg

SEQ ID NO: 966570 - DNA, 21 bp, Homo sapiens
tccagaagaagagaagctgct

SEQ ID NO: 966571 - DNA, 17 bp, Homo sapiens
tccagaagatgccctcc

SEQ ID NO: 966572 - DNA, 17 bp, Homo sapiens
tccagaagcctctggct

SEQ ID NO: 966573 - DNA, 18 bp, Homo sapiens
tccagaagcctctggcta

SEQ ID NO: 966574 - DNA, 14 bp, Homo sapiens
tccagaagctgctc

SEQ ID NO: 966575 - DNA, 16 bp, Homo sapiens
tccagaaggggagctt

SEQ ID NO: 966576 - DNA, 18 bp, Homo sapiens
tccagaaggggagctttt

SEQ ID NO: 966577 - DNA, 21 bp, Homo sapiens
tccagaaggggtttggtctgg

SEQ ID NO: 966578 - DNA, 22 bp, Homo sapiens
tccagaagtttgagatcagcct

SEQ ID NO: 966579 - DNA, 20 bp, Homo sapiens
tccagaagttttaacttcca

SEQ ID NO: 966580 - DNA, 22 bp, Homo sapiens
tccagaataaaacgcaaagggc

SEQ ID NO: 966581 - DNA, 16 bp, Homo sapiens
tccagaatgctgtaca

SEQ ID NO: 966582 - DNA, 21 bp, Homo sapiens
tccagaatgctgtacatctat

SEQ ID NO: 966583 - DNA, 18 bp, Homo sapiens
tccagaatggtctttcta

SEQ ID NO: 966584 - DNA, 12 bp, Homo sapiens
tccagaatgtaa

SEQ ID NO: 966585 - DNA, 17 bp, Homo sapiens
tccagaatgtaagaaaa

SEQ ID NO: 966586 - DNA, 18 bp, Homo sapiens
tccagaatgtaagaaaac

SEQ ID NO: 966587 - DNA, 16 bp, Homo sapiens
tccagaattgaccttt

SEQ ID NO: 966588 - DNA, 21 bp, Homo sapiens
tccagaatttattagtttaaa

SEQ ID NO: 966589 - DNA, 18 bp, Homo sapiens
tccagaatttggaaatcc

SEQ ID NO: 966590 - DNA, 22 bp, Homo sapiens
tccagaatttggaaatcctagt

SEQ ID NO: 966591 - DNA, 13 bp, Homo sapiens
tccagacccaagt

SEQ ID NO: 966592 - DNA, 11 bp, Homo sapiens
tccagacccag

SEQ ID NO: 966593 - DNA, 12 bp, Homo sapiens
tccagacccaga

SEQ ID NO: 966594 - DNA, 13 bp, Homo sapiens
tccagacccccac

SEQ ID NO: 966595 - DNA, 15 bp, Homo sapiens
tccagacccccagca

SEQ ID NO: 966596 - DNA, 15 bp, Homo sapiens
tccagacccctggct

SEQ ID NO: 966597 - DNA, 23 bp, Homo sapiens
tccagacccctggcttttcactg

SEQ ID NO: 966598 - DNA, 15 bp, Homo sapiens
tccagaccctgcctg

SEQ ID NO: 966599 - DNA, 22 bp, Homo sapiens
tccagaccctgcctgagcccag

SEQ ID NO: 966600 - DNA, 17 bp, Homo sapiens
tccagactcacttgcca

SEQ ID NO: 966601 - DNA, 19 bp, Homo sapiens
tccagactcaggttccaga

SEQ ID NO: 966602 - DNA, 22 bp, Homo sapiens
tccagactgcttccaattttct

SEQ ID NO: 966603 - DNA, 17 bp, Homo sapiens
tccagagaactgcagac

SEQ ID NO: 966604 - DNA, 13 bp, Homo sapiens
tccagagaagccc

SEQ ID NO: 966605 - DNA, 16 bp, Homo sapiens
tccagagacaacaggt

SEQ ID NO: 966606 - DNA, 20 bp, Homo sapiens
tccagagacagggaaaggtc

SEQ ID NO: 966607 - DNA, 19 bp, Homo sapiens
tccagagagagaagtgccc

SEQ ID NO: 966608 - DNA, 21 bp, Homo sapiens
tccagagagagaagtgcccct

SEQ ID NO: 966609 - DNA, 17 bp, Homo sapiens
tccagagagcagctccc

SEQ ID NO: 966610 - DNA, 19 bp, Homo sapiens
tccagagagtcctctggat

SEQ ID NO: 966611 - DNA, 17 bp, Homo sapiens
tccagagagtggctcct

SEQ ID NO: 966612 - DNA, 22 bp, Homo sapiens
tccagagagtggctcctcccgg

SEQ ID NO: 966613 - DNA, 19 bp, Homo sapiens
tccagagattcattttcta

SEQ ID NO: 966614 - DNA, 20 bp, Homo sapiens
tccagagattcattttctag

SEQ ID NO: 966615 - DNA, 14 bp, Homo sapiens
tccagagccagcct

SEQ ID NO: 966616 - DNA, 18 bp, Homo sapiens
tccagagccagcctggga

SEQ ID NO: 966617 - DNA, 19 bp, Homo sapiens
tccagagccagcctgggac

SEQ ID NO: 966618 - DNA, 14 bp, Homo sapiens
tccagagcccaagg

SEQ ID NO: 966619 - DNA, 20 bp, Homo sapiens
tccagagcggaggctgtgtg

SEQ ID NO: 966620 - DNA, 10 bp, Homo sapiens
tccagagctt

SEQ ID NO: 966621 - DNA, 13 bp, Homo sapiens
tccagagcttgtg

SEQ ID NO: 966622 - DNA, 18 bp, Homo sapiens
tccagagcttgtgctcct

SEQ ID NO: 966623 - DNA, 15 bp, Homo sapiens
tccagaggactctgc

SEQ ID NO: 966624 - DNA, 15 bp, Homo sapiens
tccagaggtattcct

SEQ ID NO: 966625 - DNA, 17 bp, Homo sapiens
tccagaggtcctccgta

SEQ ID NO: 966626 - DNA, 19 bp, Homo sapiens
tccagaggtggaggtgggc

SEQ ID NO: 966627 - DNA, 14 bp, Homo sapiens
tccagagtagtttc

SEQ ID NO: 966628 - DNA, 19 bp, Homo sapiens
tccagagtccggaggcagc

SEQ ID NO: 966629 - DNA, 15 bp, Homo sapiens
tccagagtctgagcc

SEQ ID NO: 966630 - DNA, 16 bp, Homo sapiens
tccagagtctgagccc

SEQ ID NO: 966631 - DNA, 17 bp, Homo sapiens
tccagagtctgagcccc

SEQ ID NO: 966632 - DNA, 22 bp, Homo sapiens
tccagagtctgagcccccggct

SEQ ID NO: 966633 - DNA, 13 bp, Homo sapiens
tccagagtgctga

SEQ ID NO: 966634 - DNA, 17 bp, Homo sapiens
tccagataactctcttt

SEQ ID NO: 966635 - DNA, 19 bp, Homo sapiens
tccagataactctctttcc

SEQ ID NO: 966636 - DNA, 22 bp, Homo sapiens
tccagataactctctttccttg

SEQ ID NO: 966637 - DNA, 23 bp, Homo sapiens
tccagataactctctttccttga

SEQ ID NO: 966638 - DNA, 14 bp, Homo sapiens
tccagatagagaaa

SEQ ID NO: 966639 - DNA, 22 bp, Homo sapiens
tccagatatgaacagggcccag

SEQ ID NO: 966640 - DNA, 16 bp, Homo sapiens
tccagatgcagggcag

SEQ ID NO: 966641 - DNA, 21 bp, Homo sapiens
taaagtcacatccctgtaaat

SEQ ID NO: 966642 - DNA, 15 bp, Homo sapiens
taaagtcagaagttt

SEQ ID NO: 966643 - DNA, 13 bp, Homo sapiens
taaagtcagatgg

SEQ ID NO: 966644 - DNA, 17 bp, Homo sapiens
taaagtcaggtccaatt

SEQ ID NO: 966645 - DNA, 23 bp, Homo sapiens
taaagtcatggtcattgcaggaa

SEQ ID NO: 966646 - DNA, 15 bp, Homo sapiens
taaagtccaaagtca

SEQ ID NO: 966647 - DNA, 18 bp, Homo sapiens
taaagtcggtgattatat

SEQ ID NO: 966648 - DNA, 14 bp, Homo sapiens
taaagtctgagaaa

SEQ ID NO: 966649 - DNA, 18 bp, Homo sapiens
taaagtctgagaaatagg

SEQ ID NO: 966650 - DNA, 21 bp, Homo sapiens
taaagtctgttgattaaagat

SEQ ID NO: 966651 - DNA, 15 bp, Homo sapiens
taaagtgatgtttgt

SEQ ID NO: 966652 - DNA, 18 bp, Homo sapiens
taaagtgattaaacgtgc

SEQ ID NO: 966653 - DNA, 15 bp, Homo sapiens
taaagtgccagtatt

SEQ ID NO: 966654 - DNA, 16 bp, Homo sapiens
taaagtgctggaactt

SEQ ID NO: 966655 - DNA, 21 bp, Homo sapiens
taaagtggcaatttctttaga

SEQ ID NO: 966656 - DNA, 22 bp, Homo sapiens
taaagtgtaaatcctttttctt

SEQ ID NO: 966657 - DNA, 19 bp, Homo sapiens
taaagtgtatttttttact

SEQ ID NO: 966658 - DNA, 18 bp, Homo sapiens
taaagtgtgttgttgctt

SEQ ID NO: 966659 - DNA, 17 bp, Homo sapiens
taaagtgtgtttctatg

SEQ ID NO: 966660 - DNA, 17 bp, Homo sapiens
taaagtgtttagctgtc

SEQ ID NO: 966661 - DNA, 14 bp, Homo sapiens
taaagttaagttga

SEQ ID NO: 966662 - DNA, 19 bp, Homo sapiens
taaagttactactgatttt

SEQ ID NO: 966663 - DNA, 18 bp, Homo sapiens
taaagttacttgaatttc

SEQ ID NO: 966664 - DNA, 15 bp, Homo sapiens
taaagttcaacatgt

SEQ ID NO: 966665 - DNA, 20 bp, Homo sapiens
taaagttccttaagcatctg

SEQ ID NO: 966666 - DNA, 17 bp, Homo sapiens
taaagttctgagtgttt

SEQ ID NO: 966667 - DNA, 14 bp, Homo sapiens
taaagttcttattt

SEQ ID NO: 966668 - DNA, 21 bp, Homo sapiens
taaagttcttattttagtata

SEQ ID NO: 966669 - DNA, 20 bp, Homo sapiens
taaagttgaagctaagattt

SEQ ID NO: 966670 - DNA, 14 bp, Homo sapiens
taaagttggaattt

SEQ ID NO: 966671 - DNA, 18 bp, Homo sapiens
taaagttggaatttacca

SEQ ID NO: 966672 - DNA, 19 bp, Homo sapiens
taaagttggtattaataaa

SEQ ID NO: 966673 - DNA, 13 bp, Homo sapiens
taaagttgtaaca

SEQ ID NO: 966674 - DNA, 14 bp, Homo sapiens
taaagttgtaacaa

SEQ ID NO: 966675 - DNA, 18 bp, Homo sapiens
taaagttgtttgtgcctt

SEQ ID NO: 966676 - DNA, 13 bp, Homo sapiens
taaagttgtttta

SEQ ID NO: 966677 - DNA, 16 bp, Homo sapiens
taaagtttaatgccta

SEQ ID NO: 966678 - DNA, 23 bp, Homo sapiens
taaagtttggtattgtaaaacat

SEQ ID NO: 966679 - DNA, 13 bp, Homo sapiens
taaagtttgttca

SEQ ID NO: 966680 - DNA, 14 bp, Homo sapiens
taaagttttgcaac

SEQ ID NO: 966681 - DNA, 16 bp, Homo sapiens
taaagttttgcaacaa

SEQ ID NO: 966682 - DNA, 15 bp, Homo sapiens
taaagtttttttcct

SEQ ID NO: 966683 - DNA, 16 bp, Homo sapiens
taaataaaaataatag

SEQ ID NO: 966684 - DNA, 18 bp, Homo sapiens
taaataaaaatttataag

SEQ ID NO: 966685 - DNA, 12 bp, Homo sapiens
taaataaaacta

SEQ ID NO: 966686 - DNA, 14 bp, Homo sapiens
taaataaaactatt

SEQ ID NO: 966687 - DNA, 15 bp, Homo sapiens
taaataaaactattt

SEQ ID NO: 966688 - DNA, 16 bp, Homo sapiens
taaataaaactattta

SEQ ID NO: 966689 - DNA, 15 bp, Homo sapiens
taaataaaactgaat

SEQ ID NO: 966690 - DNA, 14 bp, Homo sapiens
taaataaaagcagc

SEQ ID NO: 966691 - DNA, 15 bp, Homo sapiens
taaataaaagcagca

SEQ ID NO: 966692 - DNA, 22 bp, Homo sapiens
taaataaaatgcacaaaacttt

SEQ ID NO: 966693 - DNA, 18 bp, Homo sapiens
taaataaaatgtgtacag

SEQ ID NO: 966694 - DNA, 17 bp, Homo sapiens
taaataaaattcatttc

SEQ ID NO: 966695 - DNA, 12 bp, Homo sapiens
taaataaaattg

SEQ ID NO: 966696 - DNA, 20 bp, Homo sapiens
taaataaacacatagattca

SEQ ID NO: 966697 - DNA, 23 bp, Homo sapiens
taaataaacacatagattcacct

SEQ ID NO: 966698 - DNA, 20 bp, Homo sapiens
taaataaactgttgctcgtt

SEQ ID NO: 966699 - DNA, 14 bp, Homo sapiens
taaataaactgttt

SEQ ID NO: 966700 - DNA, 12 bp, Homo sapiens
taaataaataca

SEQ ID NO: 966701 - DNA, 22 bp, Homo sapiens
taaataaatgaagtatttctca

SEQ ID NO: 966702 - DNA, 22 bp, Homo sapiens
taaataaatgtatcttattcac

SEQ ID NO: 966703 - DNA, 15 bp, Homo sapiens
taaataaatttccca

SEQ ID NO: 966704 - DNA, 17 bp, Homo sapiens
taaataacacagatatt

SEQ ID NO: 966705 - DNA, 14 bp, Homo sapiens
taaataacctctgg

SEQ ID NO: 966706 - DNA, 12 bp, Homo sapiens
taaatgattcca

SEQ ID NO: 966707 - DNA, 19 bp, Homo sapiens
taaatgattttaattttat

SEQ ID NO: 966708 - DNA, 14 bp, Homo sapiens
taaatgcaataatt

SEQ ID NO: 966709 - DNA, 21 bp, Homo sapiens
taaatgcaccaagaaagcttc

SEQ ID NO: 966710 - DNA, 10 bp, Homo sapiens
taaatgcata

SEQ ID NO: 966711 - DNA, 12 bp, Homo sapiens
taaatgcatgtc

SEQ ID NO: 966712 - DNA, 19 bp, Homo sapiens
taaatgcatgtcttaaatg

SEQ ID NO: 966713 - DNA, 16 bp, Homo sapiens
taaatgccaaaatgta

SEQ ID NO: 966714 - DNA, 19 bp, Homo sapiens
taaatgccaaaatgtactt

SEQ ID NO: 966715 - DNA, 20 bp, Homo sapiens
taaatgccaaaatgtactta

SEQ ID NO: 966716 - DNA, 16 bp, Homo sapiens
taaatgccatgtttat

SEQ ID NO: 966717 - DNA, 14 bp, Homo sapiens
taaatgcccagttc

SEQ ID NO: 966718 - DNA, 18 bp, Homo sapiens
taaatgccttgtataaaa

SEQ ID NO: 966719 - DNA, 23 bp, Homo sapiens
taaatgctattttttattttact

SEQ ID NO: 966720 - DNA, 18 bp, Homo sapiens
taaatgctcataaagatg

SEQ ID NO: 966721 - DNA, 19 bp, Homo sapiens
taaatgctcattttcttta

SEQ ID NO: 966722 - DNA, 22 bp, Homo sapiens
taaatggaattattttgaatgt

SEQ ID NO: 966723 - DNA, 23 bp, Homo sapiens
taaatggaattattttgaatgtc

SEQ ID NO: 966724 - DNA, 21 bp, Homo sapiens
taaatggaattcgtgttatga

SEQ ID NO: 966725 - DNA, 15 bp, Homo sapiens
taaatggccagtgct

SEQ ID NO: 966726 - DNA, 22 bp, Homo sapiens
taaatggcctcatgtggctgga

SEQ ID NO: 966727 - DNA, 16 bp, Homo sapiens
taaatggcttgatttt

SEQ ID NO: 966728 - DNA, 22 bp, Homo sapiens
taaatgggactggagtccctgt

SEQ ID NO: 966729 - DNA, 22 bp, Homo sapiens
taaatggggacattcactataa

SEQ ID NO: 966730 - DNA, 18 bp, Homo sapiens
taaatgggggtgcatttg

SEQ ID NO: 966731 - DNA, 19 bp, Homo sapiens
taaatgggggtgcatttga

SEQ ID NO: 966732 - DNA, 17 bp, Homo sapiens
taaatggtgtacataat

SEQ ID NO: 966733 - DNA, 14 bp, Homo sapiens
taaatggtgttaca

SEQ ID NO: 966734 - DNA, 16 bp, Homo sapiens
taaatggtgttacatt

SEQ ID NO: 966735 - DNA, 21 bp, Homo sapiens
taaatggtttggtgcttttta

SEQ ID NO: 966736 - DNA, 16 bp, Homo sapiens
taaatggtttttaaat

SEQ ID NO: 966737 - DNA, 13 bp, Homo sapiens
taaatgtaaaaat

SEQ ID NO: 966738 - DNA, 13 bp, Homo sapiens
taaatgtaaagat

SEQ ID NO: 966739 - DNA, 21 bp, Homo sapiens
taaatgtacagacatatttaa

SEQ ID NO: 966740 - DNA, 17 bp, Homo sapiens
taaatgtacctgatgta

SEQ ID NO: 966741 - DNA, 12 bp, Homo sapiens
taaatgtatact

SEQ ID NO: 966742 - DNA, 17 bp, Homo sapiens
taaatgtatactatagt

SEQ ID NO: 966743 - DNA, 18 bp, Homo sapiens
taaatgtatgattatata

SEQ ID NO: 966744 - DNA, 18 bp, Homo sapiens
taaatgtattttaaaata

SEQ ID NO: 966745 - DNA, 15 bp, Homo sapiens
taaatgtcactgcca

SEQ ID NO: 966746 - DNA, 20 bp, Homo sapiens
taaatgtctagttgtaacac

SEQ ID NO: 966747 - DNA, 19 bp, Homo sapiens
taaatgtctgacacattaa

SEQ ID NO: 966748 - DNA, 11 bp, Homo sapiens
taaatgtgaat

SEQ ID NO: 966749 - DNA, 16 bp, Homo sapiens
taaatgtgcattcttt

SEQ ID NO: 966750 - DNA, 21 bp, Homo sapiens
taaatgtgcattcttttaaaa

SEQ ID NO: 966751 - DNA, 11 bp, Homo sapiens
taaatgtgtgt

SEQ ID NO: 966752 - DNA, 15 bp, Homo sapiens
taaatgtgtgtatgt

SEQ ID NO: 966753 - DNA, 16 bp, Homo sapiens
taaatgtgttagcact

SEQ ID NO: 966754 - DNA, 20 bp, Homo sapiens
taaatgtgttagcactgata

SEQ ID NO: 966755 - DNA, 15 bp, Homo sapiens
taaatgtgttttgtt

SEQ ID NO: 966756 - DNA, 23 bp, Homo sapiens
taaatgttaatggatttcagaag

SEQ ID NO: 966757 - DNA, 12 bp, Homo sapiens
taaatgttacct

SEQ ID NO: 966758 - DNA, 23 bp, Homo sapiens
taaatgttatgactatgtaaact

SEQ ID NO: 966759 - DNA, 19 bp, Homo sapiens
taaatgttgctttaacctg

SEQ ID NO: 966760 - DNA, 13 bp, Homo sapiens
taaattaaaatgt

SEQ ID NO: 966761 - DNA, 16 bp, Homo sapiens
taaattaaacaattta

SEQ ID NO: 966762 - DNA, 20 bp, Homo sapiens
taaattaaacatttttcaca

SEQ ID NO: 966763 - DNA, 16 bp, Homo sapiens
taaattaaataaaata

SEQ ID NO: 966764 - DNA, 21 bp, Homo sapiens
taaattaaataaactgttttc

SEQ ID NO: 966765 - DNA, 13 bp, Homo sapiens
taaattaaatata

SEQ ID NO: 966766 - DNA, 12 bp, Homo sapiens
taaattaacttt

SEQ ID NO: 966767 - DNA, 15 bp, Homo sapiens
taaattaacttttat

SEQ ID NO: 966768 - DNA, 16 bp, Homo sapiens
taaattaacttttata

SEQ ID NO: 966769 - DNA, 22 bp, Homo sapiens
taaattaacttttataaacttt

SEQ ID NO: 966770 - DNA, 19 bp, Homo sapiens
taaattaagatcctaaact

SEQ ID NO: 966771 - DNA, 12 bp, Homo sapiens
taaattaatact

SEQ ID NO: 966772 - DNA, 19 bp, Homo sapiens
taaattacaattgtcattt

SEQ ID NO: 966773 - DNA, 22 bp, Homo sapiens
gaagaactgtgtttcaagttca

SEQ ID NO: 966774 - DNA, 16 bp, Homo sapiens
gaagaacttgcatgga

SEQ ID NO: 966775 - DNA, 13 bp, Homo sapiens
gaagaagaaatct

SEQ ID NO: 966776 - DNA, 16 bp, Homo sapiens
gaagaagagaagctgc

SEQ ID NO: 966777 - DNA, 13 bp, Homo sapiens
gaagaagcagaga

SEQ ID NO: 966778 - DNA, 15 bp, Homo sapiens
gaagaagcagagaga

SEQ ID NO: 966779 - DNA, 14 bp, Homo sapiens
gaagaagctggcta

SEQ ID NO: 966780 - DNA, 11 bp, Homo sapiens
gaagaaggaaa

SEQ ID NO: 966781 - DNA, 23 bp, Homo sapiens
gaagaaggaggaatgctggactg

SEQ ID NO: 966782 - DNA, 17 bp, Homo sapiens
gaagaagggagaagaaa

SEQ ID NO: 966783 - DNA, 20 bp, Homo sapiens
gaagaaggggctgttcttcc

SEQ ID NO: 966784 - DNA, 15 bp, Homo sapiens
gaagaagtgggagca

SEQ ID NO: 966785 - DNA, 18 bp, Homo sapiens
gaagaagtgggagcagct

SEQ ID NO: 966786 - DNA, 20 bp, Homo sapiens
gaagaagtgggagcagcttc

SEQ ID NO: 966787 - DNA, 14 bp, Homo sapiens
gaagaatattcagg

SEQ ID NO: 966788 - DNA, 17 bp, Homo sapiens
gaagaatattcaggact

SEQ ID NO: 966789 - DNA, 15 bp, Homo sapiens
gaagaatattgtatt

SEQ ID NO: 966790 - DNA, 16 bp, Homo sapiens
gaagaatcaggagagg

SEQ ID NO: 966791 - DNA, 16 bp, Homo sapiens
gaagaatgcattcaaa

SEQ ID NO: 966792 - DNA, 17 bp, Homo sapiens
gaagaatgcattcaaaa

SEQ ID NO: 966793 - DNA, 17 bp, Homo sapiens
gaagaatggctttcaat

SEQ ID NO: 966794 - DNA, 16 bp, Homo sapiens
gaagaattaagataca

SEQ ID NO: 966795 - DNA, 17 bp, Homo sapiens
gaagaattgtcttgcaa

SEQ ID NO: 966796 - DNA, 14 bp, Homo sapiens
gaagaatttaatgg

SEQ ID NO: 966797 - DNA, 13 bp, Homo sapiens
gaagaatttgtta

SEQ ID NO: 966798 - DNA, 20 bp, Homo sapiens
gaagaattttcagaccccag

SEQ ID NO: 966799 - DNA, 20 bp, Homo sapiens
gaagacaaaaagacaaacat

SEQ ID NO: 966800 - DNA, 12 bp, Homo sapiens
gaagacaaactt

SEQ ID NO: 966801 - DNA, 14 bp, Homo sapiens
gaagacaaatgaca

SEQ ID NO: 966802 - DNA, 23 bp, Homo sapiens
gaagacaatgtgaaaagaaaaat

SEQ ID NO: 966803 - DNA, 12 bp, Homo sapiens
gaagacacagac

SEQ ID NO: 966804 - DNA, 14 bp, Homo sapiens
gaagacagaaaccc

SEQ ID NO: 966805 - DNA, 13 bp, Homo sapiens
gaagacagagcaa

SEQ ID NO: 966806 - DNA, 22 bp, Homo sapiens
gaagacagtgtggggataaaga

SEQ ID NO: 966807 - DNA, 23 bp, Homo sapiens
gaagacatagccgattctctgcc

SEQ ID NO: 966808 - DNA, 20 bp, Homo sapiens
gaagacatggagactcctgc

SEQ ID NO: 966809 - DNA, 12 bp, Homo sapiens
gaagacattttg

SEQ ID NO: 966810 - DNA, 15 bp, Homo sapiens
gaagacattttttgc

SEQ ID NO: 966811 - DNA, 19 bp, Homo sapiens
gaagacattttttgctata

SEQ ID NO: 966812 - DNA, 20 bp, Homo sapiens
gaagaccacatccacacacg

SEQ ID NO: 966813 - DNA, 22 bp, Homo sapiens
gaagaccagaattcccttgaat

SEQ ID NO: 966814 - DNA, 15 bp, Homo sapiens
gaagacccacgtgct

SEQ ID NO: 966815 - DNA, 14 bp, Homo sapiens
gaagaccccaccca

SEQ ID NO: 966816 - DNA, 15 bp, Homo sapiens
gaagaccccacccaa

SEQ ID NO: 966817 - DNA, 14 bp, Homo sapiens
gaagaccctccccg

SEQ ID NO: 966818 - DNA, 23 bp, Homo sapiens
gaagaccttctagtgagcctggg

SEQ ID NO: 966819 - DNA, 16 bp, Homo sapiens
gaagacgcctgagctc

SEQ ID NO: 966820 - DNA, 15 bp, Homo sapiens
gaagacggaaaacaa

SEQ ID NO: 966821 - DNA, 15 bp, Homo sapiens
gaagacgttttcttt

SEQ ID NO: 966822 - DNA, 21 bp, Homo sapiens
gaagactcaggagtctgccac

SEQ ID NO: 966823 - DNA, 22 bp, Homo sapiens
gaagactcaggagtctgccact

SEQ ID NO: 966824 - DNA, 16 bp, Homo sapiens
gaagactggaagctaa

SEQ ID NO: 966825 - DNA, 17 bp, Homo sapiens
gaagactggaagctaat

SEQ ID NO: 966826 - DNA, 16 bp, Homo sapiens
gaagacttcctctcta

SEQ ID NO: 966827 - DNA, 20 bp, Homo sapiens
gaagagaaatacagctggct

SEQ ID NO: 966828 - DNA, 23 bp, Homo sapiens
gaagagaaatacagctggctatc

SEQ ID NO: 966829 - DNA, 20 bp, Homo sapiens
taaattgtcagatcgttcat

SEQ ID NO: 966830 - DNA, 22 bp, Homo sapiens
taaattgtcagatcgttcattg

SEQ ID NO: 966831 - DNA, 23 bp, Homo sapiens
taaattgtccgtgttcatacatt

SEQ ID NO: 966832 - DNA, 15 bp, Homo sapiens
taaattgtctttaaa

SEQ ID NO: 966833 - DNA, 16 bp, Homo sapiens
taaattgtctttaaaa

SEQ ID NO: 966834 - DNA, 22 bp, Homo sapiens
taaattgtctttaaaaactgtt

SEQ ID NO: 966835 - DNA, 15 bp, Homo sapiens
taaattgtgattgtt

SEQ ID NO: 966836 - DNA, 20 bp, Homo sapiens
taaattgtttagtggaaaat

SEQ ID NO: 966837 - DNA, 16 bp, Homo sapiens
taaatttaagaaaaca

SEQ ID NO: 966838 - DNA, 13 bp, Homo sapiens
taaatttagtgtt

SEQ ID NO: 966839 - DNA, 19 bp, Homo sapiens
taaatttatatactttttg

SEQ ID NO: 966840 - DNA, 18 bp, Homo sapiens
taaatttatttactgcta

SEQ ID NO: 966841 - DNA, 17 bp, Homo sapiens
taaatttcttggcaaat

SEQ ID NO: 966842 - DNA, 14 bp, Homo sapiens
taaatttgctagca

SEQ ID NO: 966843 - DNA, 11 bp, Homo sapiens
taaatttgttg

SEQ ID NO: 966844 - DNA, 12 bp, Homo sapiens
taaattttaaag

SEQ ID NO: 966845 - DNA, 14 bp, Homo sapiens
taaattttaaagcc

SEQ ID NO: 966846 - DNA, 15 bp, Homo sapiens
taaattttaatttat

SEQ ID NO: 966847 - DNA, 13 bp, Homo sapiens
taaattttacatg

SEQ ID NO: 966848 - DNA, 17 bp, Homo sapiens
taaattttcatgaatgt

SEQ ID NO: 966849 - DNA, 20 bp, Homo sapiens
taaattttcttttaagcatt

SEQ ID NO: 966850 - DNA, 14 bp, Homo sapiens
taaatttttgtcat

SEQ ID NO: 966851 - DNA, 19 bp, Homo sapiens
taacaaaagattaatcttt

SEQ ID NO: 966852 - DNA, 21 bp, Homo sapiens
taacaaaagttccctgaaaca

SEQ ID NO: 966853 - DNA, 16 bp, Homo sapiens
taacaaaatgtatgtc

SEQ ID NO: 966854 - DNA, 13 bp, Homo sapiens
taacaaaattttt

SEQ ID NO: 966855 - DNA, 22 bp, Homo sapiens
taacaaacatcactctgctgct

SEQ ID NO: 966856 - DNA, 23 bp, Homo sapiens
taacaaagcacataactggattt

SEQ ID NO: 966857 - DNA, 21 bp, Homo sapiens
taacaaatctaaaaaagcact

SEQ ID NO: 966858 - DNA, 18 bp, Homo sapiens
taacaaatgactgtatct

SEQ ID NO: 966859 - DNA, 13 bp, Homo sapiens
taacaaatgtaaa

SEQ ID NO: 966860 - DNA, 14 bp, Homo sapiens
taacaaatgtaaaa

SEQ ID NO: 966861 - DNA, 20 bp, Homo sapiens
taacaactcattctgatcct

SEQ ID NO: 966862 - DNA, 19 bp, Homo sapiens
taacaactgctcttacttt

SEQ ID NO: 966863 - DNA, 16 bp, Homo sapiens
taacaactttcagtgg

SEQ ID NO: 966864 - DNA, 12 bp, Homo sapiens
taacaagagttt

SEQ ID NO: 966865 - DNA, 16 bp, Homo sapiens
taacaagatctttcag

SEQ ID NO: 966866 - DNA, 18 bp, Homo sapiens
taacaagatctttcagga

SEQ ID NO: 966867 - DNA, 15 bp, Homo sapiens
taacaagccagattt

SEQ ID NO: 966868 - DNA, 19 bp, Homo sapiens
taacaaggaatgcctgtgc

SEQ ID NO: 966869 - DNA, 21 bp, Homo sapiens
taacaaggaatgcctgtgcca

SEQ ID NO: 966870 - DNA, 15 bp, Homo sapiens
taacaaggagatttc

SEQ ID NO: 966871 - DNA, 16 bp, Homo sapiens
taacaaggagatttct

SEQ ID NO: 966872 - DNA, 16 bp, Homo sapiens
taacaataactactgt

SEQ ID NO: 966873 - DNA, 19 bp, Homo sapiens
taacaatacaaatggattt

SEQ ID NO: 966874 - DNA, 14 bp, Homo sapiens
taacaatagttctt

SEQ ID NO: 966875 - DNA, 15 bp, Homo sapiens
taacaatattttatc

SEQ ID NO: 966876 - DNA, 17 bp, Homo sapiens
taacaatccattcacaa

SEQ ID NO: 966877 - DNA, 13 bp, Homo sapiens
taacaattcctct

SEQ ID NO: 966878 - DNA, 14 bp, Homo sapiens
taacaattcctcta

SEQ ID NO: 966879 - DNA, 14 bp, Homo sapiens
taacaattgtgtag

SEQ ID NO: 966880 - DNA, 16 bp, Homo sapiens
taacaatttctgtcct

SEQ ID NO: 966881 - DNA, 22 bp, Homo sapiens
taacaatttctgtccttcagat

SEQ ID NO: 966882 - DNA, 18 bp, Homo sapiens
taacacaaatgctcaaag

SEQ ID NO: 966883 - DNA, 16 bp, Homo sapiens
taacacaagccacaga

SEQ ID NO: 966884 - DNA, 23 bp, Homo sapiens
taacacaagtcctgtgaatttct

SEQ ID NO: 966885 - DNA, 21 bp, Homo sapiens
taacacactaccgaatgtgtc

SEQ ID NO: 966886 - DNA, 22 bp, Homo sapiens
taacacactaccgaatgtgtct

SEQ ID NO: 966887 - DNA, 12 bp, Homo sapiens
taacacagagag

SEQ ID NO: 966888 - DNA, 12 bp, Homo sapiens
taacacagatat

SEQ ID NO: 966889 - DNA, 17 bp, Homo sapiens
taacacagcatgtgtat

SEQ ID NO: 966890 - DNA, 21 bp, Homo sapiens
taacacagcattgtatatgtg

SEQ ID NO: 966891 - DNA, 14 bp, Homo sapiens
taacacagccttcc

SEQ ID NO: 966892 - DNA, 19 bp, Homo sapiens
taacacagccttccttctg

SEQ ID NO: 966893 - DNA, 20 bp, Homo sapiens
taacacagccttccttctgc

SEQ ID NO: 966894 - DNA, 20 bp, Homo sapiens
taacacagtgtttcaattct

SEQ ID NO: 966895 - DNA, 17 bp, Homo sapiens
taacacattaaatgtgg

SEQ ID NO: 966896 - DNA, 22 bp, Homo sapiens
taacacattatcgggagcagtg

SEQ ID NO: 966897 - DNA, 14 bp, Homo sapiens
taacacattcttta

SEQ ID NO: 966898 - DNA, 21 bp, Homo sapiens
taacacatttcatagcctaca

SEQ ID NO: 966899 - DNA, 21 bp, Homo sapiens
taacaccgtcccagggctctg

SEQ ID NO: 966900 - DNA, 13 bp, Homo sapiens
gaagatgaaagag

SEQ ID NO: 966901 - DNA, 22 bp, Homo sapiens
gaagatgaatggtctggcaata

SEQ ID NO: 966902 - DNA, 12 bp, Homo sapiens
gaagatgagcct

SEQ ID NO: 966903 - DNA, 20 bp, Homo sapiens
gaagatgccagcttctctct

SEQ ID NO: 966904 - DNA, 12 bp, Homo sapiens
gaagatgccctc

SEQ ID NO: 966905 - DNA, 15 bp, Homo sapiens
gaagatggtggccac

SEQ ID NO: 966906 - DNA, 17 bp, Homo sapiens
gaagatggtttcaattc

SEQ ID NO: 966907 - DNA, 18 bp, Homo sapiens
gaagatgtgtaaacaggt

SEQ ID NO: 966908 - DNA, 16 bp, Homo sapiens
gaagatgtttacattt

SEQ ID NO: 966909 - DNA, 16 bp, Homo sapiens
gaagattcccacccct

SEQ ID NO: 966910 - DNA, 18 bp, Homo sapiens
gaagattctctattggct

SEQ ID NO: 966911 - DNA, 13 bp, Homo sapiens
gaagattgtgaat

SEQ ID NO: 966912 - DNA, 22 bp, Homo sapiens
gaagatttgatgctggagaggt

SEQ ID NO: 966913 - DNA, 23 bp, Homo sapiens
gaagattttatgcacagcctagt

SEQ ID NO: 966914 - DNA, 23 bp, Homo sapiens
gaagattttgaaatttttattaa

SEQ ID NO: 966915 - DNA, 17 bp, Homo sapiens
gaagcaaactaagcccc

SEQ ID NO: 966916 - DNA, 12 bp, Homo sapiens
gaagcaaagaca

SEQ ID NO: 966917 - DNA, 17 bp, Homo sapiens
gaagcaaaggggggagg

SEQ ID NO: 966918 - DNA, 15 bp, Homo sapiens
gaagcaacagcttca

SEQ ID NO: 966919 - DNA, 23 bp, Homo sapiens
gaagcaacagcttcagaaagagc

SEQ ID NO: 966920 - DNA, 13 bp, Homo sapiens
gaagcaagacgta

SEQ ID NO: 966921 - DNA, 13 bp, Homo sapiens
gaagcaagccaga

SEQ ID NO: 966922 - DNA, 14 bp, Homo sapiens
gaagcaagccagac

SEQ ID NO: 966923 - DNA, 20 bp, Homo sapiens
gaagcaagtaaaaaggctaa

SEQ ID NO: 966924 - DNA, 19 bp, Homo sapiens
gaagcaataaagaagagtg

SEQ ID NO: 966925 - DNA, 16 bp, Homo sapiens
gaagcaataaagctct

SEQ ID NO: 966926 - DNA, 12 bp, Homo sapiens
gaagcaataact

SEQ ID NO: 966927 - DNA, 15 bp, Homo sapiens
gaagcaattatttaa

SEQ ID NO: 966928 - DNA, 15 bp, Homo sapiens
gaagcacagaatatt

SEQ ID NO: 966929 - DNA, 16 bp, Homo sapiens
gaagcacagctcctgc

SEQ ID NO: 966930 - DNA, 17 bp, Homo sapiens
gaagcacagctcctgcc

SEQ ID NO: 966931 - DNA, 18 bp, Homo sapiens
gaagcacagctcctgcca

SEQ ID NO: 966932 - DNA, 21 bp, Homo sapiens
gaagcaccccatgccaaagct

SEQ ID NO: 966933 - DNA, 23 bp, Homo sapiens
gaagcactttgggattctttcca

SEQ ID NO: 966934 - DNA, 14 bp, Homo sapiens
gaagcagagagatg

SEQ ID NO: 966935 - DNA, 15 bp, Homo sapiens
gaagcagaggaagga

SEQ ID NO: 966936 - DNA, 22 bp, Homo sapiens
gaagcagaggtcttcagggctc

SEQ ID NO: 966937 - DNA, 12 bp, Homo sapiens
gaagcagcccct

SEQ ID NO: 966938 - DNA, 13 bp, Homo sapiens
gaagcagctcaag

SEQ ID NO: 966939 - DNA, 15 bp, Homo sapiens
gaagcaggctggagg

SEQ ID NO: 966940 - DNA, 17 bp, Homo sapiens
gaagcagggagagttgg

SEQ ID NO: 966941 - DNA, 23 bp, Homo sapiens
gaagcagggagagttggggaagg

SEQ ID NO: 966942 - DNA, 17 bp, Homo sapiens
gaagcagggtttctttt

SEQ ID NO: 966943 - DNA, 19 bp, Homo sapiens
gaagcaggttcccaagctc

SEQ ID NO: 966944 - DNA, 15 bp, Homo sapiens
gaagcagtcagccct

SEQ ID NO: 966945 - DNA, 15 bp, Homo sapiens
gaagcagtcttgctc

SEQ ID NO: 966946 - DNA, 15 bp, Homo sapiens
gaagcagtgagccgc

SEQ ID NO: 966947 - DNA, 18 bp, Homo sapiens
gaagcagtgcctcgaggc

SEQ ID NO: 966948 - DNA, 20 bp, Homo sapiens
gaagcagtgcctcgaggcac

SEQ ID NO: 966949 - DNA, 19 bp, Homo sapiens
gaagcagtgccttccataa

SEQ ID NO: 966950 - DNA, 14 bp, Homo sapiens
gaagcagtggcctt

SEQ ID NO: 966951 - DNA, 17 bp, Homo sapiens
taacagttttccatgaa

SEQ ID NO: 966952 - DNA, 16 bp, Homo sapiens
taacataaaatctgtg

SEQ ID NO: 966953 - DNA, 20 bp, Homo sapiens
taacatacaagaaaatgtat

SEQ ID NO: 966954 - DNA, 23 bp, Homo sapiens
taacatacaagaaaatgtatcca

SEQ ID NO: 966955 - DNA, 14 bp, Homo sapiens
taacatatgtatta

SEQ ID NO: 966956 - DNA, 21 bp, Homo sapiens
taacatcagccatttttagat

SEQ ID NO: 966957 - DNA, 14 bp, Homo sapiens
taacatcataatta

SEQ ID NO: 966958 - DNA, 23 bp, Homo sapiens
taacatcataattacattcctaa

SEQ ID NO: 966959 - DNA, 13 bp, Homo sapiens
taacatccagaag

SEQ ID NO: 966960 - DNA, 16 bp, Homo sapiens
taacatcgtgggtcac

SEQ ID NO: 966961 - DNA, 22 bp, Homo sapiens
taacatctacaatcagttgact

SEQ ID NO: 966962 - DNA, 23 bp, Homo sapiens
taacatcttgaatactctgccct

SEQ ID NO: 966963 - DNA, 12 bp, Homo sapiens
taacatctttac

SEQ ID NO: 966964 - DNA, 21 bp, Homo sapiens
taacatctttacgtactgtaa

SEQ ID NO: 966965 - DNA, 17 bp, Homo sapiens
taacatctttattgaaa

SEQ ID NO: 966966 - DNA, 22 bp, Homo sapiens
taacatctttattgaaattcta

SEQ ID NO: 966967 - DNA, 20 bp, Homo sapiens
taacatgaaaaacacggcag

SEQ ID NO: 966968 - DNA, 21 bp, Homo sapiens
taacatgaacacccttagaaa

SEQ ID NO: 966969 - DNA, 17 bp, Homo sapiens
taacatgaagcaaacta

SEQ ID NO: 966970 - DNA, 20 bp, Homo sapiens
taacatgaagcaaactaact

SEQ ID NO: 966971 - DNA, 23 bp, Homo sapiens
taacatgaggggacattttggtg

SEQ ID NO: 966972 - DNA, 15 bp, Homo sapiens
taacatgatttcaaa

SEQ ID NO: 966973 - DNA, 21 bp, Homo sapiens
taacatgatttcaaaatcagt

SEQ ID NO: 966974 - DNA, 21 bp, Homo sapiens
taacatgctgccattcttgat

SEQ ID NO: 966975 - DNA, 18 bp, Homo sapiens
taacatggacatgatctt

SEQ ID NO: 966976 - DNA, 11 bp, Homo sapiens
taacatgggct

SEQ ID NO: 966977 - DNA, 18 bp, Homo sapiens
taacatgggctcttcact

SEQ ID NO: 966978 - DNA, 21 bp, Homo sapiens
taacatgggctcttcactagt

SEQ ID NO: 966979 - DNA, 19 bp, Homo sapiens
taacatgtgaaaagaatag

SEQ ID NO: 966980 - DNA, 12 bp, Homo sapiens
taacatgtgtta

SEQ ID NO: 966981 - DNA, 16 bp, Homo sapiens
taacatgttaaaatgt

SEQ ID NO: 966982 - DNA, 22 bp, Homo sapiens
taacattatctagttcattgaa

SEQ ID NO: 966983 - DNA, 16 bp, Homo sapiens
taacattatttatatg

SEQ ID NO: 966984 - DNA, 14 bp, Homo sapiens
taacattcacagcc

SEQ ID NO: 966985 - DNA, 16 bp, Homo sapiens
taacattcacagccca

SEQ ID NO: 966986 - DNA, 16 bp, Homo sapiens
taacattctgaatcaa

SEQ ID NO: 966987 - DNA, 22 bp, Homo sapiens
taacattctgtaaaatgtctgt

SEQ ID NO: 966988 - DNA, 23 bp, Homo sapiens
taacattgaccaagaactgcatg

SEQ ID NO: 966989 - DNA, 14 bp, Homo sapiens
taacattgacttct

SEQ ID NO: 966990 - DNA, 23 bp, Homo sapiens
taacattgcactttataaacact

SEQ ID NO: 966991 - DNA, 13 bp, Homo sapiens
taacattgtaaag

SEQ ID NO: 966992 - DNA, 14 bp, Homo sapiens
taacattgtaaagt

SEQ ID NO: 966993 - DNA, 15 bp, Homo sapiens
taacatttaaagaga

SEQ ID NO: 966994 - DNA, 17 bp, Homo sapiens
taacatttatagaagaa

SEQ ID NO: 966995 - DNA, 11 bp, Homo sapiens
taacatttgcc

SEQ ID NO: 966996 - DNA, 21 bp, Homo sapiens
taacattttaaataaaagaaa

SEQ ID NO: 966997 - DNA, 15 bp, Homo sapiens
taacattttatacaa

SEQ ID NO: 966998 - DNA, 21 bp, Homo sapiens
taaccaaaggtgaaggaatat

SEQ ID NO: 966999 - DNA, 15 bp, Homo sapiens
taaccaaatattaaa

SEQ ID NO: 967000 - DNA, 19 bp, Homo sapiens
taaccaacattaaaactca

SEQ ID NO: 967001 - DNA, 20 bp, Homo sapiens
taaccaacattaaaactcat

SEQ ID NO: 967002 - DNA, 16 bp, Homo sapiens
taaccaagaggctggt

SEQ ID NO: 967003 - DNA, 19 bp, Homo sapiens
taaccaagctgagtttcct

SEQ ID NO: 967004 - DNA, 14 bp, Homo sapiens
taaccaataatggt

SEQ ID NO: 967005 - DNA, 14 bp, Homo sapiens
taaccacaactttc

SEQ ID NO: 967006 - DNA, 15 bp, Homo sapiens
taaccacaaggtcca

SEQ ID NO: 967007 - DNA, 24 bp, Homo sapiens
taaccaccgcatatgcatgccagg

SEQ ID NO: 967008 - DNA, 13 bp, Homo sapiens
taaccacggaaaa

SEQ ID NO: 967009 - DNA, 19 bp, Homo sapiens
taaccacttaaaaaatgtc

SEQ ID NO: 967010 - DNA, 20 bp, Homo sapiens
taaccagacacatactcatt

SEQ ID NO: 967011 - DNA, 19 bp, Homo sapiens
taaccagatggaacactgg

SEQ ID NO: 967012 - DNA, 14 bp, Homo sapiens
taaccagcagaaat

SEQ ID NO: 967013 - DNA, 19 bp, Homo sapiens
taaccagcagaaatgcctt

SEQ ID NO: 967014 - DNA, 21 bp, Homo sapiens
taaccagcattccctacagcc

SEQ ID NO: 967015 - DNA, 15 bp, Homo sapiens
taaccagctgtaaca

SEQ ID NO: 967016 - DNA, 21 bp, Homo sapiens
taaccagtctgaagtttcatt

SEQ ID NO: 967017 - DNA, 14 bp, Homo sapiens
taaccatccccaac

SEQ ID NO: 967018 - DNA, 17 bp, Homo sapiens
taaccatccccaactcc

SEQ ID NO: 967019 - DNA, 17 bp, Homo sapiens
taaccatggtgcttgtt

SEQ ID NO: 967020 - DNA, 18 bp, Homo sapiens
taaccattacatgtttaa

SEQ ID NO: 967021 - DNA, 18 bp, Homo sapiens
taaccattttcctttgga

SEQ ID NO: 967022 - DNA, 18 bp, Homo sapiens
taacccaaggagcacagg

SEQ ID NO: 967023 - DNA, 14 bp, Homo sapiens
taacccaatgcctg

SEQ ID NO: 967024 - DNA, 15 bp, Homo sapiens
taaccccaggcactg

SEQ ID NO: 967025 - DNA, 17 bp, Homo sapiens
taacccccctgtacaca

SEQ ID NO: 967026 - DNA, 22 bp, Homo sapiens
taaccccctctgctctgtcctc

SEQ ID NO: 967027 - DNA, 22 bp, Homo sapiens
gaagcctgttttgttggaaggt

SEQ ID NO: 967028 - DNA, 15 bp, Homo sapiens
gaagccttcagctcc

SEQ ID NO: 967029 - DNA, 16 bp, Homo sapiens
gaagccttcagctcca

SEQ ID NO: 967030 - DNA, 16 bp, Homo sapiens
gaagccttcttctgcc

SEQ ID NO: 967031 - DNA, 19 bp, Homo sapiens
gaagccttggaaccagccc

SEQ ID NO: 967032 - DNA, 23 bp, Homo sapiens
gaagcgacttttgttctcttctg

SEQ ID NO: 967033 - DNA, 17 bp, Homo sapiens
gaagcgccgactccctg

SEQ ID NO: 967034 - DNA, 18 bp, Homo sapiens
gaagcgccgactccctga

SEQ ID NO: 967035 - DNA, 21 bp, Homo sapiens
gaagcgcctcagttacacagg

SEQ ID NO: 967036 - DNA, 20 bp, Homo sapiens
gaagcggccctaagggagtg

SEQ ID NO: 967037 - DNA, 17 bp, Homo sapiens
gaagctaccagagctct

SEQ ID NO: 967038 - DNA, 15 bp, Homo sapiens
gaagctacttctcca

SEQ ID NO: 967039 - DNA, 21 bp, Homo sapiens
gaagctagacacatgaaggta

SEQ ID NO: 967040 - DNA, 21 bp, Homo sapiens
gaagctatttttttaagctat

SEQ ID NO: 967041 - DNA, 12 bp, Homo sapiens
gaagctcagccc

SEQ ID NO: 967042 - DNA, 21 bp, Homo sapiens
gaagctcagcccacccccctc

SEQ ID NO: 967043 - DNA, 18 bp, Homo sapiens
gaagctccactgtcaccc

SEQ ID NO: 967044 - DNA, 19 bp, Homo sapiens
gaagctccactgtcaccct

SEQ ID NO: 967045 - DNA, 23 bp, Homo sapiens
gaagctccactgtcaccctccac

SEQ ID NO: 967046 - DNA, 14 bp, Homo sapiens
gaagctcccacccc

SEQ ID NO: 967047 - DNA, 20 bp, Homo sapiens
gaagctcgcatccagacagt

SEQ ID NO: 967048 - DNA, 20 bp, Homo sapiens
gaagctctgaagtcacatca

SEQ ID NO: 967049 - DNA, 23 bp, Homo sapiens
gaagctctggctgaaccctgtgc

SEQ ID NO: 967050 - DNA, 15 bp, Homo sapiens
gaagctcttggacaa

SEQ ID NO: 967051 - DNA, 22 bp, Homo sapiens
gaagctcttggacaacagctct

SEQ ID NO: 967052 - DNA, 16 bp, Homo sapiens
gaagctgagcttttga

SEQ ID NO: 967053 - DNA, 13 bp, Homo sapiens
gaagctgaggcct

SEQ ID NO: 967054 - DNA, 17 bp, Homo sapiens
gaagctgatgctttgct

SEQ ID NO: 967055 - DNA, 21 bp, Homo sapiens
gaagctgccaggtgagaaact

SEQ ID NO: 967056 - DNA, 13 bp, Homo sapiens
gaagctgctccag

SEQ ID NO: 967057 - DNA, 11 bp, Homo sapiens
gaagctgctga

SEQ ID NO: 967058 - DNA, 17 bp, Homo sapiens
gaagctgctgaggcccc

SEQ ID NO: 967059 - DNA, 11 bp, Homo sapiens
gaagctgctgt

SEQ ID NO: 967060 - DNA, 15 bp, Homo sapiens
gaagctgctgtgtcc

SEQ ID NO: 967061 - DNA, 13 bp, Homo sapiens
gaagctggagtgc

SEQ ID NO: 967062 - DNA, 15 bp, Homo sapiens
gaagctggcctgaga

SEQ ID NO: 967063 - DNA, 23 bp, Homo sapiens
gaagctggctttgaaacctcagg

SEQ ID NO: 967064 - DNA, 19 bp, Homo sapiens
gaagctgggcccaaaggcc

SEQ ID NO: 967065 - DNA, 19 bp, Homo sapiens
gaagctgtactcagagcag

SEQ ID NO: 967066 - DNA, 24 bp, Homo sapiens
gaagctgtgtccttgcacctgcat

SEQ ID NO: 967067 - DNA, 20 bp, Homo sapiens
gaagctgttaatttttctta

SEQ ID NO: 967068 - DNA, 23 bp, Homo sapiens
gaagctgttcagggcatcggcag

SEQ ID NO: 967069 - DNA, 15 bp, Homo sapiens
gaagctgtttggaaa

SEQ ID NO: 967070 - DNA, 17 bp, Homo sapiens
gaagcttaacactattt

SEQ ID NO: 967071 - DNA, 15 bp, Homo sapiens
gaagcttcagaagtt

SEQ ID NO: 967072 - DNA, 17 bp, Homo sapiens
taactaaaatgtatcta

SEQ ID NO: 967073 - DNA, 15 bp, Homo sapiens
taactaaaattgttc

SEQ ID NO: 967074 - DNA, 12 bp, Homo sapiens
taactaaatgct

SEQ ID NO: 967075 - DNA, 19 bp, Homo sapiens
taactaaattttaaagcca

SEQ ID NO: 967076 - DNA, 16 bp, Homo sapiens
taactaacatgtcctg

SEQ ID NO: 967077 - DNA, 19 bp, Homo sapiens
taactaatctattgggttc

SEQ ID NO: 967078 - DNA, 22 bp, Homo sapiens
taactaatctattgggttcatt

SEQ ID NO: 967079 - DNA, 19 bp, Homo sapiens
taactacaaagctttgcta

SEQ ID NO: 967080 - DNA, 22 bp, Homo sapiens
taactactatattgattgtcct

SEQ ID NO: 967081 - DNA, 15 bp, Homo sapiens
taactactgctaatg

SEQ ID NO: 967082 - DNA, 19 bp, Homo sapiens
taactactgctaatgttga

SEQ ID NO: 967083 - DNA, 16 bp, Homo sapiens
taactactgtgttcct

SEQ ID NO: 967084 - DNA, 13 bp, Homo sapiens
taactactttata

SEQ ID NO: 967085 - DNA, 17 bp, Homo sapiens
taactactttataacta

SEQ ID NO: 967086 - DNA, 20 bp, Homo sapiens
taactagaattagtatgtct

SEQ ID NO: 967087 - DNA, 22 bp, Homo sapiens
taactagaattagtatgtctgt

SEQ ID NO: 967088 - DNA, 23 bp, Homo sapiens
taactagaattagtatgtctgtt

SEQ ID NO: 967089 - DNA, 16 bp, Homo sapiens
taactaggatatgtat

SEQ ID NO: 967090 - DNA, 15 bp, Homo sapiens
taactagtaatacca

SEQ ID NO: 967091 - DNA, 16 bp, Homo sapiens
taactataaggtgcct

SEQ ID NO: 967092 - DNA, 17 bp, Homo sapiens
taactatatttgctttt

SEQ ID NO: 967093 - DNA, 13 bp, Homo sapiens
taactatctcact

SEQ ID NO: 967094 - DNA, 17 bp, Homo sapiens
taactatctcacttcca

SEQ ID NO: 967095 - DNA, 13 bp, Homo sapiens
taactatgcaata

SEQ ID NO: 967096 - DNA, 14 bp, Homo sapiens
taactattaacctt

SEQ ID NO: 967097 - DNA, 21 bp, Homo sapiens
taactattgcatttatatgta

SEQ ID NO: 967098 - DNA, 18 bp, Homo sapiens
taactattgggtgaatat

SEQ ID NO: 967099 - DNA, 18 bp, Homo sapiens
taactatttttcctcatt

SEQ ID NO: 967100 - DNA, 23 bp, Homo sapiens
taactcaaggataccttcttatt

SEQ ID NO: 967101 - DNA, 22 bp, Homo sapiens
taactcagaaacatcagttact

SEQ ID NO: 967102 - DNA, 17 bp, Homo sapiens
taactcagacattccaa

SEQ ID NO: 967103 - DNA, 14 bp, Homo sapiens
taactcatcataaa

SEQ ID NO: 967104 - DNA, 15 bp, Homo sapiens
taactcatcataaaa

SEQ ID NO: 967105 - DNA, 12 bp, Homo sapiens
taactcatttgt

SEQ ID NO: 967106 - DNA, 12 bp, Homo sapiens
taactccctcca

SEQ ID NO: 967107 - DNA, 17 bp, Homo sapiens
taactccctccaccagc

SEQ ID NO: 967108 - DNA, 19 bp, Homo sapiens
taactccctccaccagcct

SEQ ID NO: 967109 - DNA, 20 bp, Homo sapiens
taactccctccaccagcctg

SEQ ID NO: 967110 - DNA, 21 bp, Homo sapiens
taactccctccaccagcctgc

SEQ ID NO: 967111 - DNA, 16 bp, Homo sapiens
taactctaaaagatcc

SEQ ID NO: 967112 - DNA, 17 bp, Homo sapiens
taactctaaccctgtgg

SEQ ID NO: 967113 - DNA, 20 bp, Homo sapiens
taactctaaccctgtggaag

SEQ ID NO: 967114 - DNA, 21 bp, Homo sapiens
taactctaaccctgtggaagc

SEQ ID NO: 967115 - DNA, 22 bp, Homo sapiens
taactctagggatataaaaaca

SEQ ID NO: 967116 - DNA, 19 bp, Homo sapiens
taactctcaagctaagtaa

SEQ ID NO: 967117 - DNA, 15 bp, Homo sapiens
taactctcgggacct

SEQ ID NO: 967118 - DNA, 18 bp, Homo sapiens
taactctcgggacctcgt

SEQ ID NO: 967119 - DNA, 19 bp, Homo sapiens
taactctctacaggaatat

SEQ ID NO: 967120 - DNA, 15 bp, Homo sapiens
taactctctttcctt

SEQ ID NO: 967121 - DNA, 22 bp, Homo sapiens
taactctctttccttgagctgt

SEQ ID NO: 967122 - DNA, 16 bp, Homo sapiens
taactctgcaaaggcc

SEQ ID NO: 967123 - DNA, 20 bp, Homo sapiens
taactctgcaaaggcctggg

SEQ ID NO: 967124 - DNA, 16 bp, Homo sapiens
taactctggattttga

SEQ ID NO: 967125 - DNA, 14 bp, Homo sapiens
taactcttgtctat

SEQ ID NO: 967126 - DNA, 16 bp, Homo sapiens
taactcttgtctattt

SEQ ID NO: 967127 - DNA, 23 bp, Homo sapiens
taactgaacatccaaaatcttga

SEQ ID NO: 967128 - DNA, 16 bp, Homo sapiens
taactgaactgtttgg

SEQ ID NO: 967129 - DNA, 13 bp, Homo sapiens
taactgaagaaaa

SEQ ID NO: 967130 - DNA, 14 bp, Homo sapiens
taactgaataccac

SEQ ID NO: 967131 - DNA, 13 bp, Homo sapiens
taactgacaactt

SEQ ID NO: 967132 - DNA, 14 bp, Homo sapiens
taactgagagaaag

SEQ ID NO: 967133 - DNA, 16 bp, Homo sapiens
taactgatgagtaaac

SEQ ID NO: 967134 - DNA, 17 bp, Homo sapiens
taactgatgagtaaact

SEQ ID NO: 967135 - DNA, 19 bp, Homo sapiens
taactgatgagtaaactga

SEQ ID NO: 967136 - DNA, 18 bp, Homo sapiens
taactgatttaacacttt

SEQ ID NO: 967137 - DNA, 20 bp, Homo sapiens
taactgcaattttaattgat

SEQ ID NO: 967138 - DNA, 14 bp, Homo sapiens
taactgcattttac

SEQ ID NO: 967139 - DNA, 16 bp, Homo sapiens
taactgcatttttaga

SEQ ID NO: 967140 - DNA, 23 bp, Homo sapiens
taactgccatcaagatgagagaa

SEQ ID NO: 967141 - DNA, 16 bp, Homo sapiens
taactgcccagcccct

SEQ ID NO: 967142 - DNA, 13 bp, Homo sapiens
taactgctcagag

SEQ ID NO: 967143 - DNA, 20 bp, Homo sapiens
taactgctcagagctttaaa

SEQ ID NO: 967144 - DNA, 16 bp, Homo sapiens
taactgctcttgaaca

SEQ ID NO: 967145 - DNA, 14 bp, Homo sapiens
taactgctttctgt

SEQ ID NO: 967146 - DNA, 21 bp, Homo sapiens
taactgctttctgttccaaat

SEQ ID NO: 967147 - DNA, 18 bp, Homo sapiens
taactggaaaacagaaca

SEQ ID NO: 967148 - DNA, 20 bp, Homo sapiens
taactggaaaacagaacact

SEQ ID NO: 967149 - DNA, 21 bp, Homo sapiens
taactggaaaacagaacactt

SEQ ID NO: 967150 - DNA, 22 bp, Homo sapiens
taactggaaggccttccactgt

SEQ ID NO: 967151 - DNA, 20 bp, Homo sapiens
taactggcctaaatttcttc

SEQ ID NO: 967152 - DNA, 16 bp, Homo sapiens
taactggcttcatttt

SEQ ID NO: 967153 - DNA, 13 bp, Homo sapiens
taactggtataga

SEQ ID NO: 967154 - DNA, 20 bp, Homo sapiens
taactggtgcactttgtaaa

SEQ ID NO: 967155 - DNA, 21 bp, Homo sapiens
gaaggcctcttgtgctcacgc

SEQ ID NO: 967156 - DNA, 15 bp, Homo sapiens
gaaggcctttcttct

SEQ ID NO: 967157 - DNA, 16 bp, Homo sapiens
gaaggcctttcttctg

SEQ ID NO: 967158 - DNA, 12 bp, Homo sapiens
gaaggcgaggag

SEQ ID NO: 967159 - DNA, 15 bp, Homo sapiens
gaaggcgagtctggg

SEQ ID NO: 967160 - DNA, 18 bp, Homo sapiens
gaaggcgagtctggggac

SEQ ID NO: 967161 - DNA, 16 bp, Homo sapiens
gaaggctaaaaagcaa

SEQ ID NO: 967162 - DNA, 17 bp, Homo sapiens
gaaggctaaaaagcaac

SEQ ID NO: 967163 - DNA, 17 bp, Homo sapiens
gaaggctctcaccccca

SEQ ID NO: 967164 - DNA, 16 bp, Homo sapiens
gaaggctggctgggca

SEQ ID NO: 967165 - DNA, 14 bp, Homo sapiens
gaaggctgtatcta

SEQ ID NO: 967166 - DNA, 16 bp, Homo sapiens
gaaggcttaagaactg

SEQ ID NO: 967167 - DNA, 18 bp, Homo sapiens
gaaggcttaagaactgct

SEQ ID NO: 967168 - DNA, 14 bp, Homo sapiens
gaaggcttctctcc

SEQ ID NO: 967169 - DNA, 23 bp, Homo sapiens
gaaggcttctctccacagtgttg

SEQ ID NO: 967170 - DNA, 16 bp, Homo sapiens
gaaggcttgggatttg

SEQ ID NO: 967171 - DNA, 23 bp, Homo sapiens
gaaggcttttatatatgaagttg

SEQ ID NO: 967172 - DNA, 19 bp, Homo sapiens
gaaggcttttggtctccct

SEQ ID NO: 967173 - DNA, 20 bp, Homo sapiens
gaagggaaagcgggcagccc

SEQ ID NO: 967174 - DNA, 23 bp, Homo sapiens
gaagggaaattgtttatgtgtta

SEQ ID NO: 967175 - DNA, 15 bp, Homo sapiens
gaagggaccaaggca

SEQ ID NO: 967176 - DNA, 20 bp, Homo sapiens
gaagggaccaaggcaaggca

SEQ ID NO: 967177 - DNA, 14 bp, Homo sapiens
gaagggactgagag

SEQ ID NO: 967178 - DNA, 23 bp, Homo sapiens
gaagggagagttctttgctgccc

SEQ ID NO: 967179 - DNA, 16 bp, Homo sapiens
gaagggaggggaaggg

SEQ ID NO: 967180 - DNA, 16 bp, Homo sapiens
gaagggaggggctgtg

SEQ ID NO: 967181 - DNA, 20 bp, Homo sapiens
gaagggagtgaggggctgtg

SEQ ID NO: 967182 - DNA, 13 bp, Homo sapiens
gaagggatggggg

SEQ ID NO: 967183 - DNA, 14 bp, Homo sapiens
gaagggcaagaaat

SEQ ID NO: 967184 - DNA, 23 bp, Homo sapiens
gaagggcaggaaggagagcctgc

SEQ ID NO: 967185 - DNA, 11 bp, Homo sapiens
gaagggcaggc

SEQ ID NO: 967186 - DNA, 22 bp, Homo sapiens
gaagggccagtcctgcctggcc

SEQ ID NO: 967187 - DNA, 19 bp, Homo sapiens
gaagggccagtctgggctg

SEQ ID NO: 967188 - DNA, 23 bp, Homo sapiens
gaagggctggggccggggctgag

SEQ ID NO: 967189 - DNA, 16 bp, Homo sapiens
gaaggggacccccgcc

SEQ ID NO: 967190 - DNA, 18 bp, Homo sapiens
gaaggggacccccgcccc

SEQ ID NO: 967191 - DNA, 20 bp, Homo sapiens
gaaggggacccccgccccct

SEQ ID NO: 967192 - DNA, 21 bp, Homo sapiens
gaaggggacccccgccccctg

SEQ ID NO: 967193 - DNA, 14 bp, Homo sapiens
gaaggggagctttt

SEQ ID NO: 967194 - DNA, 12 bp, Homo sapiens
taacttcttgct

SEQ ID NO: 967195 - DNA, 13 bp, Homo sapiens
taacttcttgctt

SEQ ID NO: 967196 - DNA, 15 bp, Homo sapiens
taacttcttgcttct

SEQ ID NO: 967197 - DNA, 13 bp, Homo sapiens
taacttctttcta

SEQ ID NO: 967198 - DNA, 22 bp, Homo sapiens
taacttgaacctatgaagcaat

SEQ ID NO: 967199 - DNA, 13 bp, Homo sapiens
taacttgctttct

SEQ ID NO: 967200 - DNA, 20 bp, Homo sapiens
taacttgctttcttctttcc

SEQ ID NO: 967201 - DNA, 21 bp, Homo sapiens
taacttgctttcttctttcct

SEQ ID NO: 967202 - DNA, 15 bp, Homo sapiens
taacttggctttcat

SEQ ID NO: 967203 - DNA, 21 bp, Homo sapiens
taacttgttaccattgtaata

SEQ ID NO: 967204 - DNA, 15 bp, Homo sapiens
taactttaaaactgt

SEQ ID NO: 967205 - DNA, 16 bp, Homo sapiens
taactttaaacatcta

SEQ ID NO: 967206 - DNA, 16 bp, Homo sapiens
taactttaatgttttt

SEQ ID NO: 967207 - DNA, 21 bp, Homo sapiens
taactttatcacattatttgc

SEQ ID NO: 967208 - DNA, 11 bp, Homo sapiens
taactttattg

SEQ ID NO: 967209 - DNA, 23 bp, Homo sapiens
taactttcagaagagatgggctt

SEQ ID NO: 967210 - DNA, 17 bp, Homo sapiens
taactttcataccactt

SEQ ID NO: 967211 - DNA, 23 bp, Homo sapiens
taactttcgaccgactttcccca

SEQ ID NO: 967212 - DNA, 21 bp, Homo sapiens
taacttttaaaatttgtctta

SEQ ID NO: 967213 - DNA, 21 bp, Homo sapiens
taacttttataaactttacct

SEQ ID NO: 967214 - DNA, 15 bp, Homo sapiens
taacttttcaccaat

SEQ ID NO: 967215 - DNA, 12 bp, Homo sapiens
taacttttgtga

SEQ ID NO: 967216 - DNA, 22 bp, Homo sapiens
taacttttgtgaattaggctgt

SEQ ID NO: 967217 - DNA, 21 bp, Homo sapiens
taacttttgtttttttttgtt

SEQ ID NO: 967218 - DNA, 15 bp, Homo sapiens
taactttttttcagt

SEQ ID NO: 967219 - DNA, 17 bp, Homo sapiens
taagaaaaaaaatgtac

SEQ ID NO: 967220 - DNA, 21 bp, Homo sapiens
taagaaaaaaagcacaaagtt

SEQ ID NO: 967221 - DNA, 22 bp, Homo sapiens
taagaaaaaattctttcacttg

SEQ ID NO: 967222 - DNA, 11 bp, Homo sapiens
taagaaaaact

SEQ ID NO: 967223 - DNA, 19 bp, Homo sapiens
taagaaaaacttttttggt

SEQ ID NO: 967224 - DNA, 20 bp, Homo sapiens
taagaaaaacttttttggtt

SEQ ID NO: 967225 - DNA, 16 bp, Homo sapiens
taagaaaaaggatgca

SEQ ID NO: 967226 - DNA, 23 bp, Homo sapiens
taagaaaaaggatgcacagagtt

SEQ ID NO: 967227 - DNA, 14 bp, Homo sapiens
taagaaaaatcatg

SEQ ID NO: 967228 - DNA, 17 bp, Homo sapiens
taagaaaaatcatgttt

SEQ ID NO: 967229 - DNA, 16 bp, Homo sapiens
taagaaaaattcacaa

SEQ ID NO: 967230 - DNA, 17 bp, Homo sapiens
taagaaaaattcacaag

SEQ ID NO: 967231 - DNA, 15 bp, Homo sapiens
taagaaaacaagtat

SEQ ID NO: 967232 - DNA, 12 bp, Homo sapiens
taagaaaagtaa

SEQ ID NO: 967233 - DNA, 23 bp, Homo sapiens
taagaaaagtaatgaagaatcac

SEQ ID NO: 967234 - DNA, 18 bp, Homo sapiens
taagaaaatacaataaac

SEQ ID NO: 967235 - DNA, 19 bp, Homo sapiens
taagaaaatacaataaact

SEQ ID NO: 967236 - DNA, 14 bp, Homo sapiens
taagaaaatgttac

SEQ ID NO: 967237 - DNA, 19 bp, Homo sapiens
taagaaacaaagtaatcta

SEQ ID NO: 967238 - DNA, 21 bp, Homo sapiens
taagaaacttttttatttaaa

SEQ ID NO: 967239 - DNA, 16 bp, Homo sapiens
taagaaagagaatgaa

SEQ ID NO: 967240 - DNA, 22 bp, Homo sapiens
taagaaagagaatgaactgtgg

SEQ ID NO: 967241 - DNA, 21 bp, Homo sapiens
taagaaagccaccttgttaca

SEQ ID NO: 967242 - DNA, 21 bp, Homo sapiens
taagaaaggaagcattgtaaa

SEQ ID NO: 967243 - DNA, 23 bp, Homo sapiens
taagaaaggaagcattgtaaaat

SEQ ID NO: 967244 - DNA, 18 bp, Homo sapiens
taagaaaggatataaaag

SEQ ID NO: 967245 - DNA, 21 bp, Homo sapiens
taagaaaggatataaaaggat

SEQ ID NO: 967246 - DNA, 16 bp, Homo sapiens
taagaaagtagaggca

SEQ ID NO: 967247 - DNA, 15 bp, Homo sapiens
taagaaagtgaagca

SEQ ID NO: 967248 - DNA, 15 bp, Homo sapiens
taagaaatactcatg

SEQ ID NO: 967249 - DNA, 16 bp, Homo sapiens
taagaaatactcatgt

SEQ ID NO: 967250 - DNA, 18 bp, Homo sapiens
taagaaatactgtacaat

SEQ ID NO: 967251 - DNA, 23 bp, Homo sapiens
taagaaatagagccaactgattt

SEQ ID NO: 967252 - DNA, 14 bp, Homo sapiens
taagaaatcaagta

SEQ ID NO: 967253 - DNA, 15 bp, Homo sapiens
taagaaatgaacaaa

SEQ ID NO: 967254 - DNA, 20 bp, Homo sapiens
taagaacaatgccagggccc

SEQ ID NO: 967255 - DNA, 12 bp, Homo sapiens
taagaacagatc

SEQ ID NO: 967256 - DNA, 18 bp, Homo sapiens
taagaaccattgatttaa

SEQ ID NO: 967257 - DNA, 23 bp, Homo sapiens
taagaacccatggaaaaatgcca

SEQ ID NO: 967258 - DNA, 15 bp, Homo sapiens
taagaaccttaatga

SEQ ID NO: 967259 - DNA, 16 bp, Homo sapiens
taagaaccttaatgac

SEQ ID NO: 967260 - DNA, 18 bp, Homo sapiens
taagaaccttaatgacaa

SEQ ID NO: 967261 - DNA, 12 bp, Homo sapiens
taagaactgctt

SEQ ID NO: 967262 - DNA, 13 bp, Homo sapiens
taagaactgtaca

SEQ ID NO: 967263 - DNA, 22 bp, Homo sapiens
taagaacttcatgggccttcca

SEQ ID NO: 967264 - DNA, 13 bp, Homo sapiens
taagaacttcatt

SEQ ID NO: 967265 - DNA, 22 bp, Homo sapiens
taagaagaaaattgctgtgcct

SEQ ID NO: 967266 - DNA, 14 bp, Homo sapiens
taagaagacatgac

SEQ ID NO: 967267 - DNA, 22 bp, Homo sapiens
taagaagacatgacaatgcaat

SEQ ID NO: 967268 - DNA, 22 bp, Homo sapiens
taagaagacattttgttacata

SEQ ID NO: 967269 - DNA, 19 bp, Homo sapiens
taagaagagactgggaaga

SEQ ID NO: 967270 - DNA, 18 bp, Homo sapiens
taagaagatacactgcag

SEQ ID NO: 967271 - DNA, 19 bp, Homo sapiens
taagaagccccttattttt

SEQ ID NO: 967272 - DNA, 19 bp, Homo sapiens
taagaagccctgcagagca

SEQ ID NO: 967273 - DNA, 13 bp, Homo sapiens
taagaaggcaaaa

SEQ ID NO: 967274 - DNA, 18 bp, Homo sapiens
taagaaggcaaaaatgta

SEQ ID NO: 967275 - DNA, 16 bp, Homo sapiens
taagaagtttgtgtct

SEQ ID NO: 967276 - DNA, 15 bp, Homo sapiens
taagaataaaatgtt

SEQ ID NO: 967277 - DNA, 21 bp, Homo sapiens
taagaatatgtttccttgttt

SEQ ID NO: 967278 - DNA, 23 bp, Homo sapiens
taagaatgcagattcctgggcct

SEQ ID NO: 967279 - DNA, 21 bp, Homo sapiens
taagaatgctggttttcctaa

SEQ ID NO: 967280 - DNA, 19 bp, Homo sapiens
taagaatggtttgtaaaat

SEQ ID NO: 967281 - DNA, 16 bp, Homo sapiens
gaagtgagcacagcct

SEQ ID NO: 967282 - DNA, 13 bp, Homo sapiens
gaagtgaggccca

SEQ ID NO: 967283 - DNA, 19 bp, Homo sapiens
gaagtgaggcccaaggagc

SEQ ID NO: 967284 - DNA, 20 bp, Homo sapiens
gaagtgagtttgtaaatatt

SEQ ID NO: 967285 - DNA, 22 bp, Homo sapiens
gaagtgatactatccagttact

SEQ ID NO: 967286 - DNA, 18 bp, Homo sapiens
gaagtgattctaagattt

SEQ ID NO: 967287 - DNA, 15 bp, Homo sapiens
gaagtgcccctgctg

SEQ ID NO: 967288 - DNA, 18 bp, Homo sapiens
gaagtgcccctgctgcct

SEQ ID NO: 967289 - DNA, 23 bp, Homo sapiens
gaagtgcccctgctgcctcccca

SEQ ID NO: 967290 - DNA, 18 bp, Homo sapiens
gaagtgctgtttattaat

SEQ ID NO: 967291 - DNA, 21 bp, Homo sapiens
gaagtgcttagtgtacttgga

SEQ ID NO: 967292 - DNA, 18 bp, Homo sapiens
gaagtgcttgatatgtaa

SEQ ID NO: 967293 - DNA, 19 bp, Homo sapiens
gaagtgcttggaacatact

SEQ ID NO: 967294 - DNA, 21 bp, Homo sapiens
gaagtggcagttctttactcg

SEQ ID NO: 967295 - DNA, 15 bp, Homo sapiens
gaagtggctctcagg

SEQ ID NO: 967296 - DNA, 16 bp, Homo sapiens
gaagtggctggtctgg

SEQ ID NO: 967297 - DNA, 19 bp, Homo sapiens
gaagtggctggtctggagt

SEQ ID NO: 967298 - DNA, 18 bp, Homo sapiens
gaagtgggaaaaaataga

SEQ ID NO: 967299 - DNA, 12 bp, Homo sapiens
gaagtgggagca

SEQ ID NO: 967300 - DNA, 15 bp, Homo sapiens
gaagtgggagcagct

SEQ ID NO: 967301 - DNA, 18 bp, Homo sapiens
gaagtgggagcagcttct

SEQ ID NO: 967302 - DNA, 18 bp, Homo sapiens
gaagtggggtctggcctg

SEQ ID NO: 967303 - DNA, 18 bp, Homo sapiens
gaagtggggtgttcttct

SEQ ID NO: 967304 - DNA, 19 bp, Homo sapiens
gaagtggggtgttcttctt

SEQ ID NO: 967305 - DNA, 16 bp, Homo sapiens
gaagtgtaacagctga

SEQ ID NO: 967306 - DNA, 17 bp, Homo sapiens
gaagtgtaacagctgag

SEQ ID NO: 967307 - DNA, 23 bp, Homo sapiens
gaagtgtaacagctgaggtctct

SEQ ID NO: 967308 - DNA, 17 bp, Homo sapiens
gaagtgtaggcagacac

SEQ ID NO: 967309 - DNA, 15 bp, Homo sapiens
gaagtgtatttattt

SEQ ID NO: 967310 - DNA, 14 bp, Homo sapiens
gaagtgtgtttgcc

SEQ ID NO: 967311 - DNA, 17 bp, Homo sapiens
gaagtgttcaagaaata

SEQ ID NO: 967312 - DNA, 18 bp, Homo sapiens
gaagtgttcaagaaataa

SEQ ID NO: 967313 - DNA, 18 bp, Homo sapiens
gaagtgttgcatggatgt

SEQ ID NO: 967314 - DNA, 17 bp, Homo sapiens
gaagtgtttcagatttt

SEQ ID NO: 967315 - DNA, 20 bp, Homo sapiens
taagagaaaagagagaaaca

SEQ ID NO: 967316 - DNA, 21 bp, Homo sapiens
taagagaagacctagctatgt

SEQ ID NO: 967317 - DNA, 15 bp, Homo sapiens
taagagaagttgtaa

SEQ ID NO: 967318 - DNA, 20 bp, Homo sapiens
taagagacagaatgtatctg

SEQ ID NO: 967319 - DNA, 13 bp, Homo sapiens
taagagacagttt

SEQ ID NO: 967320 - DNA, 18 bp, Homo sapiens
taagagagatgagaaagc

SEQ ID NO: 967321 - DNA, 12 bp, Homo sapiens
taagagattctt

SEQ ID NO: 967322 - DNA, 15 bp, Homo sapiens
taagagatttatctt

SEQ ID NO: 967323 - DNA, 18 bp, Homo sapiens
taagagatttatctttat

SEQ ID NO: 967324 - DNA, 15 bp, Homo sapiens
taagagcagtcacaa

SEQ ID NO: 967325 - DNA, 19 bp, Homo sapiens
taagagcagtcacaacaga

SEQ ID NO: 967326 - DNA, 22 bp, Homo sapiens
taagagcatccggccaaatgca

SEQ ID NO: 967327 - DNA, 17 bp, Homo sapiens
taagagcttgctccaga

SEQ ID NO: 967328 - DNA, 16 bp, Homo sapiens
taagaggatgagcaga

SEQ ID NO: 967329 - DNA, 23 bp, Homo sapiens
taagagggcagactgtgaacttg

SEQ ID NO: 967330 - DNA, 16 bp, Homo sapiens
taagaggttggtgtgg

SEQ ID NO: 967331 - DNA, 13 bp, Homo sapiens
taagagtgtttaa

SEQ ID NO: 967332 - DNA, 21 bp, Homo sapiens
taagagttagtttctttggga

SEQ ID NO: 967333 - DNA, 21 bp, Homo sapiens
taagagttgctttgccagagc

SEQ ID NO: 967334 - DNA, 22 bp, Homo sapiens
taagagttgctttgccagagca

SEQ ID NO: 967335 - DNA, 14 bp, Homo sapiens
taagataaatgtgc

SEQ ID NO: 967336 - DNA, 14 bp, Homo sapiens
taagatacaaatta

SEQ ID NO: 967337 - DNA, 22 bp, Homo sapiens
taagatacaaattaattttact

SEQ ID NO: 967338 - DNA, 15 bp, Homo sapiens
taagatagtgtaact

SEQ ID NO: 967339 - DNA, 21 bp, Homo sapiens
taagatatccctaatgttttg

SEQ ID NO: 967340 - DNA, 15 bp, Homo sapiens
taagatatttgcagt

SEQ ID NO: 967341 - DNA, 19 bp, Homo sapiens
taagatgagatttgccagc

SEQ ID NO: 967342 - DNA, 20 bp, Homo sapiens
taagatgccagcatatactg

SEQ ID NO: 967343 - DNA, 11 bp, Homo sapiens
taagatgctgg

SEQ ID NO: 967344 - DNA, 22 bp, Homo sapiens
taagatggattctcagatattt

SEQ ID NO: 967345 - DNA, 23 bp, Homo sapiens
taagatggctgtggcatttccaa

SEQ ID NO: 967346 - DNA, 18 bp, Homo sapiens
taagatgggcagctagtt

SEQ ID NO: 967347 - DNA, 22 bp, Homo sapiens
taagatgggcctgtatgagaca

SEQ ID NO: 967348 - DNA, 16 bp, Homo sapiens
taagatgtacatttaa

SEQ ID NO: 967349 - DNA, 17 bp, Homo sapiens
taagatgtacatttaat

SEQ ID NO: 967350 - DNA, 15 bp, Homo sapiens
taagatgtgttctta

SEQ ID NO: 967351 - DNA, 19 bp, Homo sapiens
taagattacaaatcagaag

SEQ ID NO: 967352 - DNA, 22 bp, Homo sapiens
taagattacaaatcagaagtca

SEQ ID NO: 967353 - DNA, 16 bp, Homo sapiens
taagattatctgggga

SEQ ID NO: 967354 - DNA, 23 bp, Homo sapiens
taagattcttttaaattagaaaa

SEQ ID NO: 967355 - DNA, 13 bp, Homo sapiens
taagattggaaat

SEQ ID NO: 967356 - DNA, 12 bp, Homo sapiens
taagatttctgt

SEQ ID NO: 967357 - DNA, 12 bp, Homo sapiens
taagatttgttt

SEQ ID NO: 967358 - DNA, 19 bp, Homo sapiens
taagatttgtttttaaact

SEQ ID NO: 967359 - DNA, 23 bp, Homo sapiens
taagatttgtttttaaactgtac

SEQ ID NO: 967360 - DNA, 23 bp, Homo sapiens
taagcaaaaacaaaaagaaaaga

SEQ ID NO: 967361 - DNA, 23 bp, Homo sapiens
taagcaaagggagcactgggttg

SEQ ID NO: 967362 - DNA, 22 bp, Homo sapiens
taagcacacacatctggccctg

SEQ ID NO: 967363 - DNA, 23 bp, Homo sapiens
taagcacacacatctggccctga

SEQ ID NO: 967364 - DNA, 13 bp, Homo sapiens
taagcactacata

SEQ ID NO: 967365 - DNA, 17 bp, Homo sapiens
taagcactacataaact

SEQ ID NO: 967366 - DNA, 20 bp, Homo sapiens
taagcactgaaaaacaacaa

SEQ ID NO: 967367 - DNA, 15 bp, Homo sapiens
taagcacttgcctgg

SEQ ID NO: 967368 - DNA, 16 bp, Homo sapiens
taagcacttgcctgga

SEQ ID NO: 967369 - DNA, 17 bp, Homo sapiens
taagcacttgcctggaa

SEQ ID NO: 967370 - DNA, 19 bp, Homo sapiens
taagcacttgcctggaata

SEQ ID NO: 967371 - DNA, 15 bp, Homo sapiens
taagcagaacaaatg

SEQ ID NO: 967372 - DNA, 16 bp, Homo sapiens
taagcagaacaaatgt

SEQ ID NO: 967373 - DNA, 20 bp, Homo sapiens
taagcagaacaaatgtgttt

SEQ ID NO: 967374 - DNA, 17 bp, Homo sapiens
taagcagaggaggggcc

SEQ ID NO: 967375 - DNA, 16 bp, Homo sapiens
taagcagattgcttta

SEQ ID NO: 967376 - DNA, 17 bp, Homo sapiens
taagcagattgctttaa

SEQ ID NO: 967377 - DNA, 22 bp, Homo sapiens
taagcagctaaattttctgaaa

SEQ ID NO: 967378 - DNA, 18 bp, Homo sapiens
taagcagtgtctgtgttt

SEQ ID NO: 967379 - DNA, 22 bp, Homo sapiens
taagcagttatggtgatgactt

SEQ ID NO: 967380 - DNA, 15 bp, Homo sapiens
taagcataaaagatc

SEQ ID NO: 967381 - DNA, 17 bp, Homo sapiens
taagcatactttgtaaa

SEQ ID NO: 967382 - DNA, 16 bp, Homo sapiens
taagcattctgagctg

SEQ ID NO: 967383 - DNA, 21 bp, Homo sapiens
taagcattctgagctgggctt

SEQ ID NO: 967384 - DNA, 18 bp, Homo sapiens
taagcattgtttgcttat

SEQ ID NO: 967385 - DNA, 13 bp, Homo sapiens
taagcatttgtat

SEQ ID NO: 967386 - DNA, 15 bp, Homo sapiens
taagcatttgtatat

SEQ ID NO: 967387 - DNA, 17 bp, Homo sapiens
taagcatttgtatatta

SEQ ID NO: 967388 - DNA, 16 bp, Homo sapiens
taagccaaaacaatgt

SEQ ID NO: 967389 - DNA, 15 bp, Homo sapiens
taagccaaaactgag

SEQ ID NO: 967390 - DNA, 16 bp, Homo sapiens
taagccaaagaaacaa

SEQ ID NO: 967391 - DNA, 17 bp, Homo sapiens
taagccaaagaaacaag

SEQ ID NO: 967392 - DNA, 19 bp, Homo sapiens
taagccactgcctctccct

SEQ ID NO: 967393 - DNA, 23 bp, Homo sapiens
taagccactgcctctccctctgg

SEQ ID NO: 967394 - DNA, 14 bp, Homo sapiens
taagccacttgaaa

SEQ ID NO: 967395 - DNA, 16 bp, Homo sapiens
taagccagagcctggg

SEQ ID NO: 967396 - DNA, 16 bp, Homo sapiens
taagccaggcctggct

SEQ ID NO: 967397 - DNA, 17 bp, Homo sapiens
taagccagttcacttag

SEQ ID NO: 967398 - DNA, 16 bp, Homo sapiens
taagccagttggatct

SEQ ID NO: 967399 - DNA, 19 bp, Homo sapiens
taagccattctgactcata

SEQ ID NO: 967400 - DNA, 17 bp, Homo sapiens
taagcccccagggcctc

SEQ ID NO: 967401 - DNA, 22 bp, Homo sapiens
taagcccccagggcctccaggg

SEQ ID NO: 967402 - DNA, 23 bp, Homo sapiens
taagcccccagggcctccagggc

SEQ ID NO: 967403 - DNA, 20 bp, Homo sapiens
taagccctcgaaccaaggca

SEQ ID NO: 967404 - DNA, 21 bp, Homo sapiens
taagccctcgaaccaaggcag

SEQ ID NO: 967405 - DNA, 14 bp, Homo sapiens
taagcccttgaaga

SEQ ID NO: 967406 - DNA, 19 bp, Homo sapiens
taagcctcatcatcagagc

SEQ ID NO: 967407 - DNA, 14 bp, Homo sapiens
taagcctccattta

SEQ ID NO: 967408 - DNA, 16 bp, Homo sapiens
gaatacacttacagtt

SEQ ID NO: 967409 - DNA, 23 bp, Homo sapiens
gaatacagggcatgcattttgca

SEQ ID NO: 967410 - DNA, 21 bp, Homo sapiens
gaatacagtaagctgctctat

SEQ ID NO: 967411 - DNA, 21 bp, Homo sapiens
gaatacattaacggtgctaaa

SEQ ID NO: 967412 - DNA, 19 bp, Homo sapiens
gaatacattgatacaaagt

SEQ ID NO: 967413 - DNA, 13 bp, Homo sapiens
gaatacattttat

SEQ ID NO: 967414 - DNA, 17 bp, Homo sapiens
gaataccactctgtaat

SEQ ID NO: 967415 - DNA, 19 bp, Homo sapiens
gaataccactctgtaattg

SEQ ID NO: 967416 - DNA, 19 bp, Homo sapiens
gaataccattaaaactgct

SEQ ID NO: 967417 - DNA, 21 bp, Homo sapiens
gaataccattaaaactgcttt

SEQ ID NO: 967418 - DNA, 22 bp, Homo sapiens
gaataccattaaaactgctttt

SEQ ID NO: 967419 - DNA, 23 bp, Homo sapiens
gaatacgctaagcctggaagcca

SEQ ID NO: 967420 - DNA, 13 bp, Homo sapiens
gaatactgaacat

SEQ ID NO: 967421 - DNA, 21 bp, Homo sapiens
gaatacttattttcagtgcat

SEQ ID NO: 967422 - DNA, 24 bp, Homo sapiens
gaatactttgcagcacagctgaga

SEQ ID NO: 967423 - DNA, 18 bp, Homo sapiens
gaatagaagctaaggttt

SEQ ID NO: 967424 - DNA, 16 bp, Homo sapiens
gaatagagctgccact

SEQ ID NO: 967425 - DNA, 14 bp, Homo sapiens
gaatagatgtcttc

SEQ ID NO: 967426 - DNA, 17 bp, Homo sapiens
gaatagcatttgccact

SEQ ID NO: 967427 - DNA, 18 bp, Homo sapiens
gaatagccacatttggaa

SEQ ID NO: 967428 - DNA, 22 bp, Homo sapiens
gaatagctttaatgatatgctt

SEQ ID NO: 967429 - DNA, 16 bp, Homo sapiens
gaataggcactttaaa

SEQ ID NO: 967430 - DNA, 16 bp, Homo sapiens
gaataggtagtatcat

SEQ ID NO: 967431 - DNA, 14 bp, Homo sapiens
gaatagtattgtgt

SEQ ID NO: 967432 - DNA, 14 bp, Homo sapiens
gaatataaaacagt

SEQ ID NO: 967433 - DNA, 13 bp, Homo sapiens
gaatataaatgtg

SEQ ID NO: 967434 - DNA, 12 bp, Homo sapiens
gaatataagaaa

SEQ ID NO: 967435 - DNA, 20 bp, Homo sapiens
gaatataatatatttgtgta

SEQ ID NO: 967436 - DNA, 23 bp, Homo sapiens
taaggaagccagtcaccttctgg

SEQ ID NO: 967437 - DNA, 15 bp, Homo sapiens
taaggaagttattaa

SEQ ID NO: 967438 - DNA, 20 bp, Homo sapiens
taaggaatatgggagaaata

SEQ ID NO: 967439 - DNA, 21 bp, Homo sapiens
taaggaatgatattgctgaag

SEQ ID NO: 967440 - DNA, 14 bp, Homo sapiens
taaggaatttcctc

SEQ ID NO: 967441 - DNA, 21 bp, Homo sapiens
taaggaatttgatgattttca

SEQ ID NO: 967442 - DNA, 12 bp, Homo sapiens
taaggacaaatt

SEQ ID NO: 967443 - DNA, 19 bp, Homo sapiens
taaggacaaattagcatgc

SEQ ID NO: 967444 - DNA, 22 bp, Homo sapiens
taaggacaaattagcatgcaag

SEQ ID NO: 967445 - DNA, 15 bp, Homo sapiens
taaggactcaagtgt

SEQ ID NO: 967446 - DNA, 21 bp, Homo sapiens
taaggactttttgatggaatt

SEQ ID NO: 967447 - DNA, 14 bp, Homo sapiens
taaggagaatggcc

SEQ ID NO: 967448 - DNA, 16 bp, Homo sapiens
taaggagatgggcctt

SEQ ID NO: 967449 - DNA, 17 bp, Homo sapiens
taaggatactttacatg

SEQ ID NO: 967450 - DNA, 17 bp, Homo sapiens
taaggatccggaaagaa

SEQ ID NO: 967451 - DNA, 19 bp, Homo sapiens
taaggatgcttgtacataa

SEQ ID NO: 967452 - DNA, 23 bp, Homo sapiens
taaggatgcttgtacataatgcg

SEQ ID NO: 967453 - DNA, 20 bp, Homo sapiens
taaggatggagccagctctg

SEQ ID NO: 967454 - DNA, 12 bp, Homo sapiens
taaggcaaaaaa

SEQ ID NO: 967455 - DNA, 16 bp, Homo sapiens
taaggcaacattcctt

SEQ ID NO: 967456 - DNA, 20 bp, Homo sapiens
taaggcacagtgggagctga

SEQ ID NO: 967457 - DNA, 13 bp, Homo sapiens
taaggcatgaagg

SEQ ID NO: 967458 - DNA, 21 bp, Homo sapiens
taaggcatgcgaaatgttctc

SEQ ID NO: 967459 - DNA, 14 bp, Homo sapiens
taaggcctgaatca

SEQ ID NO: 967460 - DNA, 12 bp, Homo sapiens
taaggcctgccc

SEQ ID NO: 967461 - DNA, 14 bp, Homo sapiens
taaggcctgccctc

SEQ ID NO: 967462 - DNA, 17 bp, Homo sapiens
taaggctccccaccccg

SEQ ID NO: 967463 - DNA, 13 bp, Homo sapiens
taaggctcctcct

SEQ ID NO: 967464 - DNA, 11 bp, Homo sapiens
taaggctgctg

SEQ ID NO: 967465 - DNA, 12 bp, Homo sapiens
taaggctgctgg

SEQ ID NO: 967466 - DNA, 14 bp, Homo sapiens
taaggctgctggct

SEQ ID NO: 967467 - DNA, 23 bp, Homo sapiens
taaggctgctggcttcagggagg

SEQ ID NO: 967468 - DNA, 16 bp, Homo sapiens
taaggcttttatttct

SEQ ID NO: 967469 - DNA, 22 bp, Homo sapiens
taagggagtggcctcatttcac

SEQ ID NO: 967470 - DNA, 22 bp, Homo sapiens
taagggcaaggagtttattaca

SEQ ID NO: 967471 - DNA, 14 bp, Homo sapiens
taagggcacacaca

SEQ ID NO: 967472 - DNA, 14 bp, Homo sapiens
taagggcattttta

SEQ ID NO: 967473 - DNA, 15 bp, Homo sapiens
taagggccctgccct

SEQ ID NO: 967474 - DNA, 17 bp, Homo sapiens
taagggccctgccctgt

SEQ ID NO: 967475 - DNA, 18 bp, Homo sapiens
taagggccctgccctgta

SEQ ID NO: 967476 - DNA, 16 bp, Homo sapiens
taagggccgccggacc

SEQ ID NO: 967477 - DNA, 19 bp, Homo sapiens
taaggggaggaaccagagt

SEQ ID NO: 967478 - DNA, 16 bp, Homo sapiens
taaggggcccggccag

SEQ ID NO: 967479 - DNA, 18 bp, Homo sapiens
taaggggccttgctctga

SEQ ID NO: 967480 - DNA, 22 bp, Homo sapiens
taaggggtgggtcagaacatgt

SEQ ID NO: 967481 - DNA, 14 bp, Homo sapiens
taagggtagaagag

SEQ ID NO: 967482 - DNA, 19 bp, Homo sapiens
taagggtaggatgttgctt

SEQ ID NO: 967483 - DNA, 19 bp, Homo sapiens
taagggtggaaaaatgccc

SEQ ID NO: 967484 - DNA, 19 bp, Homo sapiens
taagggtgggtgctcagaa

SEQ ID NO: 967485 - DNA, 16 bp, Homo sapiens
taagggttgaaggcag

SEQ ID NO: 967486 - DNA, 13 bp, Homo sapiens
taagggttttaga

SEQ ID NO: 967487 - DNA, 21 bp, Homo sapiens
taagggttttttttttttcct

SEQ ID NO: 967488 - DNA, 22 bp, Homo sapiens
taagggttttttttttttcctt

SEQ ID NO: 967489 - DNA, 23 bp, Homo sapiens
taagggttttttttttttccttt

SEQ ID NO: 967490 - DNA, 20 bp, Homo sapiens
taaggtatttcgaaactgcc

SEQ ID NO: 967491 - DNA, 15 bp, Homo sapiens
taaggtcaagggaaa

SEQ ID NO: 967492 - DNA, 20 bp, Homo sapiens
taaggtctaactgtggaata

SEQ ID NO: 967493 - DNA, 21 bp, Homo sapiens
taaggtctaactgtggaatat

SEQ ID NO: 967494 - DNA, 22 bp, Homo sapiens
taaggtctcatgctgttgctgc

SEQ ID NO: 967495 - DNA, 13 bp, Homo sapiens
taaggtctttgta

SEQ ID NO: 967496 - DNA, 14 bp, Homo sapiens
taaggtctttgtaa

SEQ ID NO: 967497 - DNA, 17 bp, Homo sapiens
taaggtctttgtaaaat

SEQ ID NO: 967498 - DNA, 18 bp, Homo sapiens
taaggtctttgtaaaatc

SEQ ID NO: 967499 - DNA, 21 bp, Homo sapiens
taaggtgctctctttctgtct

SEQ ID NO: 967500 - DNA, 16 bp, Homo sapiens
taaggtgggtccagga

SEQ ID NO: 967501 - DNA, 16 bp, Homo sapiens
taaggttctcatagga

SEQ ID NO: 967502 - DNA, 21 bp, Homo sapiens
taaggttttgttgtgttctgt

SEQ ID NO: 967503 - DNA, 22 bp, Homo sapiens
taaggttttgttgtgttctgtt

SEQ ID NO: 967504 - DNA, 19 bp, Homo sapiens
taagtaaaagtctacctgt

SEQ ID NO: 967505 - DNA, 18 bp, Homo sapiens
taagtaaattgcctgatt

SEQ ID NO: 967506 - DNA, 20 bp, Homo sapiens
taagtaacttttaaaatttg

SEQ ID NO: 967507 - DNA, 12 bp, Homo sapiens
taagtaagaaaa

SEQ ID NO: 967508 - DNA, 13 bp, Homo sapiens
taagtaagaaaat

SEQ ID NO: 967509 - DNA, 19 bp, Homo sapiens
taagtaagaaaatattttg

SEQ ID NO: 967510 - DNA, 17 bp, Homo sapiens
taagtaagtttcttcct

SEQ ID NO: 967511 - DNA, 18 bp, Homo sapiens
taagtaatcaataaagaa

SEQ ID NO: 967512 - DNA, 13 bp, Homo sapiens
taagtaatctttt

SEQ ID NO: 967513 - DNA, 18 bp, Homo sapiens
taagtaatctttttacag

SEQ ID NO: 967514 - DNA, 21 bp, Homo sapiens
taagtaatctttttacagttg

SEQ ID NO: 967515 - DNA, 18 bp, Homo sapiens
taagtaattgcatttctg

SEQ ID NO: 967516 - DNA, 17 bp, Homo sapiens
taagtaatttagaagat

SEQ ID NO: 967517 - DNA, 18 bp, Homo sapiens
taagtaccactcaggcca

SEQ ID NO: 967518 - DNA, 16 bp, Homo sapiens
taagtaccctgatgcc

SEQ ID NO: 967519 - DNA, 15 bp, Homo sapiens
taagtactagatgca

SEQ ID NO: 967520 - DNA, 13 bp, Homo sapiens
taagtactatgta

SEQ ID NO: 967521 - DNA, 16 bp, Homo sapiens
taagtagaacaaaaaa

SEQ ID NO: 967522 - DNA, 24 bp, Homo sapiens
taagtatagccactgatggtgaca

SEQ ID NO: 967523 - DNA, 17 bp, Homo sapiens
taagtatcaagtataga

SEQ ID NO: 967524 - DNA, 19 bp, Homo sapiens
taagtatggaatattcatt

SEQ ID NO: 967525 - DNA, 21 bp, Homo sapiens
taagtattatgtctcttctga

SEQ ID NO: 967526 - DNA, 13 bp, Homo sapiens
taagtatttatat

SEQ ID NO: 967527 - DNA, 14 bp, Homo sapiens
taagtatttatata

SEQ ID NO: 967528 - DNA, 15 bp, Homo sapiens
taagtatttatatat

SEQ ID NO: 967529 - DNA, 19 bp, Homo sapiens
taagtatttatatatttat

SEQ ID NO: 967530 - DNA, 20 bp, Homo sapiens
taagtatttcagatgcttta

SEQ ID NO: 967531 - DNA, 21 bp, Homo sapiens
taagtatttcagatgctttag

SEQ ID NO: 967532 - DNA, 17 bp, Homo sapiens
taagtatttgaaactga

SEQ ID NO: 967533 - DNA, 21 bp, Homo sapiens
taagtattttcctgttgtcaa

SEQ ID NO: 967534 - DNA, 14 bp, Homo sapiens
taagtcaacagtaa

SEQ ID NO: 967535 - DNA, 23 bp, Homo sapiens
gaatccccgacccccctacccca

SEQ ID NO: 967536 - DNA, 17 bp, Homo sapiens
gaatcccctccctgtca

SEQ ID NO: 967537 - DNA, 18 bp, Homo sapiens
gaatccctgttcattgta

SEQ ID NO: 967538 - DNA, 15 bp, Homo sapiens
gaatcccttaaaatt

SEQ ID NO: 967539 - DNA, 16 bp, Homo sapiens
gaatcccttaaaatta

SEQ ID NO: 967540 - DNA, 16 bp, Homo sapiens
gaatcccttaacagtt

SEQ ID NO: 967541 - DNA, 15 bp, Homo sapiens
gaatccgaagggaat

SEQ ID NO: 967542 - DNA, 20 bp, Homo sapiens
gaatcctaggctccacccca

SEQ ID NO: 967543 - DNA, 10 bp, Homo sapiens
gaatcctcct

SEQ ID NO: 967544 - DNA, 14 bp, Homo sapiens
gaatcctgcctctc

SEQ ID NO: 967545 - DNA, 20 bp, Homo sapiens
gaatcctgctcacaaaatca

SEQ ID NO: 967546 - DNA, 12 bp, Homo sapiens
gaatcctggcag

SEQ ID NO: 967547 - DNA, 13 bp, Homo sapiens
gaatcctggcagc

SEQ ID NO: 967548 - DNA, 14 bp, Homo sapiens
gaatcctgtcgatt

SEQ ID NO: 967549 - DNA, 14 bp, Homo sapiens
gaatcctttacatt

SEQ ID NO: 967550 - DNA, 14 bp, Homo sapiens
gaatcgaggaacca

SEQ ID NO: 967551 - DNA, 19 bp, Homo sapiens
gaatcgcttgaacctggga

SEQ ID NO: 967552 - DNA, 21 bp, Homo sapiens
gaatctaagctgtttgccaag

SEQ ID NO: 967553 - DNA, 15 bp, Homo sapiens
gaatctacaagccaa

SEQ ID NO: 967554 - DNA, 14 bp, Homo sapiens
gaatctacttaacc

SEQ ID NO: 967555 - DNA, 20 bp, Homo sapiens
gaatctataagtagtaaatc

SEQ ID NO: 967556 - DNA, 17 bp, Homo sapiens
gaatctatatttaacaa

SEQ ID NO: 967557 - DNA, 19 bp, Homo sapiens
gaatctatgccaaagatca

SEQ ID NO: 967558 - DNA, 19 bp, Homo sapiens
gaatgctgggtatgctctg

SEQ ID NO: 967559 - DNA, 13 bp, Homo sapiens
gaatgctgtacat

SEQ ID NO: 967560 - DNA, 14 bp, Homo sapiens
gaatgctgtacatc

SEQ ID NO: 967561 - DNA, 12 bp, Homo sapiens
gaatggaaaaat

SEQ ID NO: 967562 - DNA, 16 bp, Homo sapiens
gaatggaaagcggagt

SEQ ID NO: 967563 - DNA, 17 bp, Homo sapiens
gaatggaactactgtac

SEQ ID NO: 967564 - DNA, 21 bp, Homo sapiens
gaatggaagggttctggctgc

SEQ ID NO: 967565 - DNA, 17 bp, Homo sapiens
gaatggaatccatctgt

SEQ ID NO: 967566 - DNA, 18 bp, Homo sapiens
gaatggaatccatctgtc

SEQ ID NO: 967567 - DNA, 15 bp, Homo sapiens
gaatggacatcctgt

SEQ ID NO: 967568 - DNA, 19 bp, Homo sapiens
gaatggacatcctgtataa

SEQ ID NO: 967569 - DNA, 13 bp, Homo sapiens
gaatggagaaagt

SEQ ID NO: 967570 - DNA, 17 bp, Homo sapiens
gaatggagaaagtaagt

SEQ ID NO: 967571 - DNA, 19 bp, Homo sapiens
gaatggaggcagagacctc

SEQ ID NO: 967572 - DNA, 14 bp, Homo sapiens
gaatggaggcaggg

SEQ ID NO: 967573 - DNA, 16 bp, Homo sapiens
gaatggaggggcagag

SEQ ID NO: 967574 - DNA, 15 bp, Homo sapiens
gaatggagtcttttc

SEQ ID NO: 967575 - DNA, 17 bp, Homo sapiens
gaatggatcacaagatg

SEQ ID NO: 967576 - DNA, 20 bp, Homo sapiens
gaatggatggggagaatggt

SEQ ID NO: 967577 - DNA, 13 bp, Homo sapiens
gaatggcatttgc

SEQ ID NO: 967578 - DNA, 19 bp, Homo sapiens
gaatggctatgtttttaat

SEQ ID NO: 967579 - DNA, 17 bp, Homo sapiens
gaatggctgggtcaggg

SEQ ID NO: 967580 - DNA, 19 bp, Homo sapiens
gaatgggaagcagctcaag

SEQ ID NO: 967581 - DNA, 21 bp, Homo sapiens
gaatgggatgtgtgatgcaaa

SEQ ID NO: 967582 - DNA, 23 bp, Homo sapiens
gaatgggcaattccagaaatctt

SEQ ID NO: 967583 - DNA, 22 bp, Homo sapiens
gaatgggggctttcggggaggg

SEQ ID NO: 967584 - DNA, 19 bp, Homo sapiens
gaatggggggcgggccagg

SEQ ID NO: 967585 - DNA, 20 bp, Homo sapiens
gaatggggggcgggccaggg

SEQ ID NO: 967586 - DNA, 23 bp, Homo sapiens
gaatggggggcgggccagggtgg

SEQ ID NO: 967587 - DNA, 19 bp, Homo sapiens
gaatggggttcctgctgtg

SEQ ID NO: 967588 - DNA, 19 bp, Homo sapiens
gaatgggtctgcacagatt

SEQ ID NO: 967589 - DNA, 20 bp, Homo sapiens
gaatggtacatgtcttccat

SEQ ID NO: 967590 - DNA, 14 bp, Homo sapiens
gaatggtccagggt

SEQ ID NO: 967591 - DNA, 22 bp, Homo sapiens
gaatggtctggcaatattctgt

SEQ ID NO: 967592 - DNA, 14 bp, Homo sapiens
gaatggtctttgct

SEQ ID NO: 967593 - DNA, 22 bp, Homo sapiens
gaatggtgttttgtcagacttc

SEQ ID NO: 967594 - DNA, 19 bp, Homo sapiens
gaatggttaataaaactgc

SEQ ID NO: 967595 - DNA, 16 bp, Homo sapiens
gaatggttccatgcct

SEQ ID NO: 967596 - DNA, 12 bp, Homo sapiens
gaatggtttgta

SEQ ID NO: 967597 - DNA, 22 bp, Homo sapiens
gaatggttttcaaaataaaaat

SEQ ID NO: 967598 - DNA, 17 bp, Homo sapiens
gaatgtaagaaaacaaa

SEQ ID NO: 967599 - DNA, 20 bp, Homo sapiens
gaatgtaaggatgagggaag

SEQ ID NO: 967600 - DNA, 11 bp, Homo sapiens
gaatgtaatca

SEQ ID NO: 967601 - DNA, 13 bp, Homo sapiens
gaatgtaattgga

SEQ ID NO: 967602 - DNA, 14 bp, Homo sapiens
gaatgtaattggaa

SEQ ID NO: 967603 - DNA, 20 bp, Homo sapiens
gaatgtagcttccacctcat

SEQ ID NO: 967604 - DNA, 13 bp, Homo sapiens
gaatgtaggctgg

SEQ ID NO: 967605 - DNA, 22 bp, Homo sapiens
gaatgtaggctggctttcagag

SEQ ID NO: 967606 - DNA, 21 bp, Homo sapiens
gaatgtagtattcaatgattt

SEQ ID NO: 967607 - DNA, 16 bp, Homo sapiens
gaatgtatcaggaaat

SEQ ID NO: 967608 - DNA, 11 bp, Homo sapiens
gaatgtatgta

SEQ ID NO: 967609 - DNA, 14 bp, Homo sapiens
gaatgtatgtaatg

SEQ ID NO: 967610 - DNA, 19 bp, Homo sapiens
gaatgtcacatttgaattc

SEQ ID NO: 967611 - DNA, 15 bp, Homo sapiens
gaatgtcactgtagt

SEQ ID NO: 967612 - DNA, 18 bp, Homo sapiens
gaatgtcagatttctggt

SEQ ID NO: 967613 - DNA, 13 bp, Homo sapiens
gaatgtgattttt

SEQ ID NO: 967614 - DNA, 21 bp, Homo sapiens
gaatgtgcaggtttgttacat

SEQ ID NO: 967615 - DNA, 14 bp, Homo sapiens
gaatgtgccacctg

SEQ ID NO: 967616 - DNA, 17 bp, Homo sapiens
gaatgtgccacctgtcc

SEQ ID NO: 967617 - DNA, 19 bp, Homo sapiens
gaatgtgcccctggcccat

SEQ ID NO: 967618 - DNA, 20 bp, Homo sapiens
gaatgtggataaaactgtgt

SEQ ID NO: 967619 - DNA, 20 bp, Homo sapiens
gaatgtggatttgattcatt

SEQ ID NO: 967620 - DNA, 18 bp, Homo sapiens
gaatgtggcttgagaaat

SEQ ID NO: 967621 - DNA, 15 bp, Homo sapiens
gaatgtgggcactgg

SEQ ID NO: 967622 - DNA, 20 bp, Homo sapiens
gaatgtgggcactggcccag

SEQ ID NO: 967623 - DNA, 21 bp, Homo sapiens
gaatgtgggcactggcccagg

SEQ ID NO: 967624 - DNA, 12 bp, Homo sapiens
gaatgtgtcagg

SEQ ID NO: 967625 - DNA, 12 bp, Homo sapiens
gaatgtgtcttt

SEQ ID NO: 967626 - DNA, 21 bp, Homo sapiens
gaatgtgtgtgtgtggcaggg

SEQ ID NO: 967627 - DNA, 16 bp, Homo sapiens
gaatgttaaagtcagt

SEQ ID NO: 967628 - DNA, 15 bp, Homo sapiens
gaatgttaatttatt

SEQ ID NO: 967629 - DNA, 17 bp, Homo sapiens
gaatgttacattgtttg

SEQ ID NO: 967630 - DNA, 23 bp, Homo sapiens
gaatgttagagtaatgaaatgga

SEQ ID NO: 967631 - DNA, 17 bp, Homo sapiens
gaatgttagccatgact

SEQ ID NO: 967632 - DNA, 14 bp, Homo sapiens
gaatgttctcagat

SEQ ID NO: 967633 - DNA, 14 bp, Homo sapiens
gaatgttggataag

SEQ ID NO: 967634 - DNA, 14 bp, Homo sapiens
gaatgttgggactg

SEQ ID NO: 967635 - DNA, 23 bp, Homo sapiens
gaatgttgggactgctaaataaa

SEQ ID NO: 967636 - DNA, 16 bp, Homo sapiens
gaatgttgtacttgaa

SEQ ID NO: 967637 - DNA, 21 bp, Homo sapiens
gaatgtttaaagatcatgaca

SEQ ID NO: 967638 - DNA, 16 bp, Homo sapiens
gaatgtttatagcaaa

SEQ ID NO: 967639 - DNA, 14 bp, Homo sapiens
gaatgtttattcct

SEQ ID NO: 967640 - DNA, 21 bp, Homo sapiens
gaatgtttgtttcagtgccat

SEQ ID NO: 967641 - DNA, 19 bp, Homo sapiens
gaatgttttatttatcaaa

SEQ ID NO: 967642 - DNA, 18 bp, Homo sapiens
gaatgtttttccctcccc

SEQ ID NO: 967643 - DNA, 12 bp, Homo sapiens
gaattaaaactg

SEQ ID NO: 967644 - DNA, 14 bp, Homo sapiens
gaattaaaactgag

SEQ ID NO: 967645 - DNA, 15 bp, Homo sapiens
gaattaaaactgagt

SEQ ID NO: 967646 - DNA, 12 bp, Homo sapiens
gaattaaaatgg

SEQ ID NO: 967647 - DNA, 20 bp, Homo sapiens
gaattaaattaggaataaat

SEQ ID NO: 967648 - DNA, 17 bp, Homo sapiens
gaattaacacagtgttt

SEQ ID NO: 967649 - DNA, 22 bp, Homo sapiens
gaattaacacagtgtttcaatt

SEQ ID NO: 967650 - DNA, 19 bp, Homo sapiens
gaattaaccatttaataaa

SEQ ID NO: 967651 - DNA, 16 bp, Homo sapiens
gaattaacctggtgct

SEQ ID NO: 967652 - DNA, 18 bp, Homo sapiens
gaattaacctggtgctgg

SEQ ID NO: 967653 - DNA, 15 bp, Homo sapiens
gaattaagttatctt

SEQ ID NO: 967654 - DNA, 21 bp, Homo sapiens
gaattaatatccctacatgta

SEQ ID NO: 967655 - DNA, 21 bp, Homo sapiens
gaattaatcatctataaagaa

SEQ ID NO: 967656 - DNA, 17 bp, Homo sapiens
gaattaattaatttgga

SEQ ID NO: 967657 - DNA, 13 bp, Homo sapiens
gaattacagtgaa

SEQ ID NO: 967658 - DNA, 21 bp, Homo sapiens
gaattacatgtaaaacattat

SEQ ID NO: 967659 - DNA, 22 bp, Homo sapiens
gaattacatgtaaaacattatc

SEQ ID NO: 967660 - DNA, 18 bp, Homo sapiens
gaattaccatttgttaat

SEQ ID NO: 967661 - DNA, 22 bp, Homo sapiens
gaattactatttactttattaa

SEQ ID NO: 967662 - DNA, 15 bp, Homo sapiens
gaattactttcctcc

SEQ ID NO: 967663 - DNA, 12 bp, Homo sapiens
gaattagaaaat

SEQ ID NO: 967664 - DNA, 20 bp, Homo sapiens
gaattagaagccatctgaca

SEQ ID NO: 967665 - DNA, 15 bp, Homo sapiens
taataataaatagtt

SEQ ID NO: 967666 - DNA, 14 bp, Homo sapiens
taataataaattaa

SEQ ID NO: 967667 - DNA, 21 bp, Homo sapiens
taataatatcaaagagaagat

SEQ ID NO: 967668 - DNA, 23 bp, Homo sapiens
taataatcttattagggagaaaa

SEQ ID NO: 967669 - DNA, 16 bp, Homo sapiens
taataatggcatcaat

SEQ ID NO: 967670 - DNA, 13 bp, Homo sapiens
taataatgtattg

SEQ ID NO: 967671 - DNA, 17 bp, Homo sapiens
taataattattattaaa

SEQ ID NO: 967672 - DNA, 15 bp, Homo sapiens
taataatttgtaaat

SEQ ID NO: 967673 - DNA, 15 bp, Homo sapiens
taataatttttgctg

SEQ ID NO: 967674 - DNA, 16 bp, Homo sapiens
taatacaatggtcatt

SEQ ID NO: 967675 - DNA, 22 bp, Homo sapiens
taatacacagtactttattgta

SEQ ID NO: 967676 - DNA, 22 bp, Homo sapiens
taatacaccactacattctgtt

SEQ ID NO: 967677 - DNA, 19 bp, Homo sapiens
taatacactccacttgaag

SEQ ID NO: 967678 - DNA, 23 bp, Homo sapiens
taatacagcagtgtcatcagaag

SEQ ID NO: 967679 - DNA, 20 bp, Homo sapiens
taatacagccaaagataatc

SEQ ID NO: 967680 - DNA, 13 bp, Homo sapiens
gaattattttgaa

SEQ ID NO: 967681 - DNA, 13 bp, Homo sapiens
gaattatttttga

SEQ ID NO: 967682 - DNA, 14 bp, Homo sapiens
gaattatttttgtg

SEQ ID NO: 967683 - DNA, 20 bp, Homo sapiens
gaattatttttgtgtttcta

SEQ ID NO: 967684 - DNA, 22 bp, Homo sapiens
gaattatttttgtgtttctaaa

SEQ ID NO: 967685 - DNA, 22 bp, Homo sapiens
gaattcaaaagtgattatctct

SEQ ID NO: 967686 - DNA, 22 bp, Homo sapiens
gaattcacaaagtaatttggaa

SEQ ID NO: 967687 - DNA, 20 bp, Homo sapiens
gaattcacacaactactttc

SEQ ID NO: 967688 - DNA, 19 bp, Homo sapiens
gaattcacagatatttaaa

SEQ ID NO: 967689 - DNA, 20 bp, Homo sapiens
gaattcacagatatttaaag

SEQ ID NO: 967690 - DNA, 17 bp, Homo sapiens
gaattcactaggaggtc

SEQ ID NO: 967691 - DNA, 23 bp, Homo sapiens
gaattcagaagacccctgactca

SEQ ID NO: 967692 - DNA, 13 bp, Homo sapiens
gaattcagacatc

SEQ ID NO: 967693 - DNA, 16 bp, Homo sapiens
gaattcagcaccctgg

SEQ ID NO: 967694 - DNA, 18 bp, Homo sapiens
gaattcagcaccctgggt

SEQ ID NO: 967695 - DNA, 22 bp, Homo sapiens
gaattcagttgctttgcccaag

SEQ ID NO: 967696 - DNA, 22 bp, Homo sapiens
gaattcattttcatcactggga

SEQ ID NO: 967697 - DNA, 14 bp, Homo sapiens
gaattccaaagcaa

SEQ ID NO: 967698 - DNA, 15 bp, Homo sapiens
gaattccaaagcaaa

SEQ ID NO: 967699 - DNA, 19 bp, Homo sapiens
gaattccaacttgaaggat

SEQ ID NO: 967700 - DNA, 22 bp, Homo sapiens
gaattccatagtggaccacttg

SEQ ID NO: 967701 - DNA, 14 bp, Homo sapiens
gaattccctccccc

SEQ ID NO: 967702 - DNA, 18 bp, Homo sapiens
gaattcctaacttttcaa

SEQ ID NO: 967703 - DNA, 17 bp, Homo sapiens
gaattcctagaattaaa

SEQ ID NO: 967704 - DNA, 18 bp, Homo sapiens
gaattcctcctctattta

SEQ ID NO: 967705 - DNA, 23 bp, Homo sapiens
gaattcctcttttgcttaaatca

SEQ ID NO: 967706 - DNA, 17 bp, Homo sapiens
gaattcctgaagccaga

SEQ ID NO: 967707 - DNA, 15 bp, Homo sapiens
gaattccttaaagtt

SEQ ID NO: 967708 - DNA, 13 bp, Homo sapiens
gaattccttcgaa

SEQ ID NO: 967709 - DNA, 20 bp, Homo sapiens
gaattccttcgaaaggcctt

SEQ ID NO: 967710 - DNA, 21 bp, Homo sapiens
gaattccttcgaaaggccttc

SEQ ID NO: 967711 - DNA, 22 bp, Homo sapiens
gaattcgaaggctctctctttc

SEQ ID NO: 967712 - DNA, 19 bp, Homo sapiens
gaattcgtgttatgaatct

SEQ ID NO: 967713 - DNA, 16 bp, Homo sapiens
gaattctactggaaaa

SEQ ID NO: 967714 - DNA, 13 bp, Homo sapiens
gaattctattttt

SEQ ID NO: 967715 - DNA, 17 bp, Homo sapiens
gaattctcagaatctca

SEQ ID NO: 967716 - DNA, 17 bp, Homo sapiens
gaattctctagtttgat

SEQ ID NO: 967717 - DNA, 19 bp, Homo sapiens
gaattctctagtttgatta

SEQ ID NO: 967718 - DNA, 23 bp, Homo sapiens
gaattctgcaactagccaaggct

SEQ ID NO: 967719 - DNA, 18 bp, Homo sapiens
gaattctgctacctcact

SEQ ID NO: 967720 - DNA, 19 bp, Homo sapiens
gaattctgtttaattttca

SEQ ID NO: 967721 - DNA, 19 bp, Homo sapiens
gaattcttacatgttttct

SEQ ID NO: 967722 - DNA, 22 bp, Homo sapiens
gaattcttacatgttttctttg

SEQ ID NO: 967723 - DNA, 11 bp, Homo sapiens
gaattcttcct

SEQ ID NO: 967724 - DNA, 15 bp, Homo sapiens
gaattcttcctcctc

SEQ ID NO: 967725 - DNA, 16 bp, Homo sapiens
gaattcttcctcctct

SEQ ID NO: 967726 - DNA, 17 bp, Homo sapiens
gaattcttcctcctctg

SEQ ID NO: 967727 - DNA, 22 bp, Homo sapiens
gaattcttcctctccttcccac

SEQ ID NO: 967728 - DNA, 21 bp, Homo sapiens
gaattctttgcattccttact

SEQ ID NO: 967729 - DNA, 16 bp, Homo sapiens
gaattgaacccaggag

SEQ ID NO: 967730 - DNA, 16 bp, Homo sapiens
gaattgacattgaaat

SEQ ID NO: 967731 - DNA, 18 bp, Homo sapiens
gaattgaccatctgcttt

SEQ ID NO: 967732 - DNA, 15 bp, Homo sapiens
gaattgactgcagtt

SEQ ID NO: 967733 - DNA, 14 bp, Homo sapiens
gaattgagctgcag

SEQ ID NO: 967734 - DNA, 16 bp, Homo sapiens
gaattgagtaatggtg

SEQ ID NO: 967735 - DNA, 15 bp, Homo sapiens
gaattgagtgtttaa

SEQ ID NO: 967736 - DNA, 19 bp, Homo sapiens
gaattgagtgtttaaagtt

SEQ ID NO: 967737 - DNA, 14 bp, Homo sapiens
gaattgatttgcat

SEQ ID NO: 967738 - DNA, 15 bp, Homo sapiens
gaattgatttgcatt

SEQ ID NO: 967739 - DNA, 18 bp, Homo sapiens
gaattgatttgcattgaa

SEQ ID NO: 967740 - DNA, 22 bp, Homo sapiens
gaattgatttgcattgaacaca

SEQ ID NO: 967741 - DNA, 13 bp, Homo sapiens
gaattgcattgac

SEQ ID NO: 967742 - DNA, 23 bp, Homo sapiens
gaattgccaggggcgaggccctt

SEQ ID NO: 967743 - DNA, 21 bp, Homo sapiens
gaattgcctgcagagagaagc

SEQ ID NO: 967744 - DNA, 16 bp, Homo sapiens
gaattgcttctgtgta

SEQ ID NO: 967745 - DNA, 21 bp, Homo sapiens
gaattggaggtaggaagggga

SEQ ID NO: 967746 - DNA, 13 bp, Homo sapiens
gaattgggaagct

SEQ ID NO: 967747 - DNA, 17 bp, Homo sapiens
gaattggtcttaatgtt

SEQ ID NO: 967748 - DNA, 23 bp, Homo sapiens
gaattgtacctatttctgatgat

SEQ ID NO: 967749 - DNA, 14 bp, Homo sapiens
gaattgtccccagt

SEQ ID NO: 967750 - DNA, 23 bp, Homo sapiens
gaattgtccccagtttgcagaaa

SEQ ID NO: 967751 - DNA, 13 bp, Homo sapiens
gaattgtctttta

SEQ ID NO: 967752 - DNA, 18 bp, Homo sapiens
gaattgtgaccaagttat

SEQ ID NO: 967753 - DNA, 12 bp, Homo sapiens
gaattgtggcta

SEQ ID NO: 967754 - DNA, 12 bp, Homo sapiens
gaattgttacat

SEQ ID NO: 967755 - DNA, 16 bp, Homo sapiens
gaattgttatgaaaat

SEQ ID NO: 967756 - DNA, 22 bp, Homo sapiens
gaattgttgagatactttacta

SEQ ID NO: 967757 - DNA, 15 bp, Homo sapiens
gaattgtttttgtac

SEQ ID NO: 967758 - DNA, 21 bp, Homo sapiens
gaatttaaaattaagtagaac

SEQ ID NO: 967759 - DNA, 14 bp, Homo sapiens
gaatttaaatataa

SEQ ID NO: 967760 - DNA, 14 bp, Homo sapiens
gaatttaaggcaaa

SEQ ID NO: 967761 - DNA, 16 bp, Homo sapiens
gaatttaataatctgt

SEQ ID NO: 967762 - DNA, 19 bp, Homo sapiens
gaatttaatggactgtgaa

SEQ ID NO: 967763 - DNA, 23 bp, Homo sapiens
gaatttaatggactgtgaatttc

SEQ ID NO: 967764 - DNA, 19 bp, Homo sapiens
gaatttagggagaaatgtt

SEQ ID NO: 967765 - DNA, 23 bp, Homo sapiens
gaatttatccaattttgatcttt

SEQ ID NO: 967766 - DNA, 23 bp, Homo sapiens
gaatttatctcccttagaagaga

SEQ ID NO: 967767 - DNA, 18 bp, Homo sapiens
gaatttattagtttaaaa

SEQ ID NO: 967768 - DNA, 19 bp, Homo sapiens
gaatttattgcacattgtt

SEQ ID NO: 967769 - DNA, 13 bp, Homo sapiens
gaatttattggca

SEQ ID NO: 967770 - DNA, 17 bp, Homo sapiens
gaatttcacctgtaaac

SEQ ID NO: 967771 - DNA, 18 bp, Homo sapiens
gaatttcaggcattttgt

SEQ ID NO: 967772 - DNA, 19 bp, Homo sapiens
gaatttcctcccaattcat

SEQ ID NO: 967773 - DNA, 21 bp, Homo sapiens
gaatttcctctattgatgtac

SEQ ID NO: 967774 - DNA, 12 bp, Homo sapiens
gaatttctaaaa

SEQ ID NO: 967775 - DNA, 19 bp, Homo sapiens
gaatttctaaagtaaaatt

SEQ ID NO: 967776 - DNA, 14 bp, Homo sapiens
gaatttcttctttt

SEQ ID NO: 967777 - DNA, 17 bp, Homo sapiens
gaatttcttcttttcct

SEQ ID NO: 967778 - DNA, 20 bp, Homo sapiens
gaatttcttcttttcctgca

SEQ ID NO: 967779 - DNA, 21 bp, Homo sapiens
gaatttcttggtaagaagccg

SEQ ID NO: 967780 - DNA, 14 bp, Homo sapiens
gaatttcttttcct

SEQ ID NO: 967781 - DNA, 22 bp, Homo sapiens
gaatttcttttccttcattcat

SEQ ID NO: 967782 - DNA, 15 bp, Homo sapiens
gaatttgaagacttc

SEQ ID NO: 967783 - DNA, 21 bp, Homo sapiens
gaatttgaagacttcaaaata

SEQ ID NO: 967784 - DNA, 19 bp, Homo sapiens
gaatttgaagctgcagtga

SEQ ID NO: 967785 - DNA, 19 bp, Homo sapiens
gaatttgaatgaaaaattt

SEQ ID NO: 967786 - DNA, 16 bp, Homo sapiens
gaatttgagaaccttg

SEQ ID NO: 967787 - DNA, 22 bp, Homo sapiens
gaatttgatgattttcatttca

SEQ ID NO: 967788 - DNA, 16 bp, Homo sapiens
gaatttgattgctttg

SEQ ID NO: 967789 - DNA, 17 bp, Homo sapiens
gaatttgattgctttgc

SEQ ID NO: 967790 - DNA, 13 bp, Homo sapiens
gaatttgctgggg

SEQ ID NO: 967791 - DNA, 17 bp, Homo sapiens
taatcaatcatctgtgt

SEQ ID NO: 967792 - DNA, 15 bp, Homo sapiens
taatcacatgtgctg

SEQ ID NO: 967793 - DNA, 20 bp, Homo sapiens
taatcaccatgtaagcactc

SEQ ID NO: 967794 - DNA, 18 bp, Homo sapiens
taatcacgctttcctgaa

SEQ ID NO: 967795 - DNA, 15 bp, Homo sapiens
taatcactactgtat

SEQ ID NO: 967796 - DNA, 22 bp, Homo sapiens
taatcagaatggaagagagaaa

SEQ ID NO: 967797 - DNA, 21 bp, Homo sapiens
taatcagacaggtttaaaagt

SEQ ID NO: 967798 - DNA, 17 bp, Homo sapiens
taatcagcaatattgcc

SEQ ID NO: 967799 - DNA, 18 bp, Homo sapiens
taatcagcattattcttc

SEQ ID NO: 967800 - DNA, 13 bp, Homo sapiens
taatcagcctctt

SEQ ID NO: 967801 - DNA, 15 bp, Homo sapiens
gaattttaaagtatg

SEQ ID NO: 967802 - DNA, 15 bp, Homo sapiens
gaattttaatgtgaa

SEQ ID NO: 967803 - DNA, 17 bp, Homo sapiens
gaattttaatgtgaaga

SEQ ID NO: 967804 - DNA, 13 bp, Homo sapiens
gaattttattttg

SEQ ID NO: 967805 - DNA, 16 bp, Homo sapiens
gaattttattttgctg

SEQ ID NO: 967806 - DNA, 17 bp, Homo sapiens
gaattttcaaggccttc

SEQ ID NO: 967807 - DNA, 14 bp, Homo sapiens
gaattttcagaccc

SEQ ID NO: 967808 - DNA, 12 bp, Homo sapiens
gaattttcatcc

SEQ ID NO: 967809 - DNA, 21 bp, Homo sapiens
gaattttcatcccgtatcaca

SEQ ID NO: 967810 - DNA, 15 bp, Homo sapiens
gaattttctaaaagc

SEQ ID NO: 967811 - DNA, 16 bp, Homo sapiens
gaattttctaaaagct

SEQ ID NO: 967812 - DNA, 23 bp, Homo sapiens
gaattttctttgtgtagctttgc

SEQ ID NO: 967813 - DNA, 21 bp, Homo sapiens
gaattttgggtattgtaatct

SEQ ID NO: 967814 - DNA, 17 bp, Homo sapiens
gaattttgtatgctgaa

SEQ ID NO: 967815 - DNA, 16 bp, Homo sapiens
gaattttgtctcactt

SEQ ID NO: 967816 - DNA, 15 bp, Homo sapiens
gaattttgttgctgt

SEQ ID NO: 967817 - DNA, 16 bp, Homo sapiens
gaattttgttttactt

SEQ ID NO: 967818 - DNA, 21 bp, Homo sapiens
gaatttttatttctttttaat

SEQ ID NO: 967819 - DNA, 14 bp, Homo sapiens
gaatttttcctatg

SEQ ID NO: 967820 - DNA, 17 bp, Homo sapiens
gaatttttgcctatctt

SEQ ID NO: 967821 - DNA, 22 bp, Homo sapiens
gaatttttttcatcttctctgg

SEQ ID NO: 967822 - DNA, 22 bp, Homo sapiens
gaatttttttttcctagccctc

SEQ ID NO: 967823 - DNA, 19 bp, Homo sapiens
gacaaaaaaatttaaaatt

SEQ ID NO: 967824 - DNA, 18 bp, Homo sapiens
gacaaaaaattaaagcat

SEQ ID NO: 967825 - DNA, 22 bp, Homo sapiens
gacaaaaacaagactgcctccc

SEQ ID NO: 967826 - DNA, 18 bp, Homo sapiens
gacaaaaacagcctcaca

SEQ ID NO: 967827 - DNA, 20 bp, Homo sapiens
gacaaaaacagcctcacaga

SEQ ID NO: 967828 - DNA, 22 bp, Homo sapiens
gacaaaaatcaaagaacagatg

SEQ ID NO: 967829 - DNA, 18 bp, Homo sapiens
gacaaaagaaaattttcc

SEQ ID NO: 967830 - DNA, 15 bp, Homo sapiens
gacaaaagggccagg

SEQ ID NO: 967831 - DNA, 16 bp, Homo sapiens
gacaaaagggccaggt

SEQ ID NO: 967832 - DNA, 14 bp, Homo sapiens
gacaaaagtctgtc

SEQ ID NO: 967833 - DNA, 17 bp, Homo sapiens
gacaaaagtctgtcttt

SEQ ID NO: 967834 - DNA, 17 bp, Homo sapiens
gacaaaatggatacata

SEQ ID NO: 967835 - DNA, 17 bp, Homo sapiens
gacaaaatgggaggagg

SEQ ID NO: 967836 - DNA, 15 bp, Homo sapiens
gacaaaatttgagaa

SEQ ID NO: 967837 - DNA, 22 bp, Homo sapiens
gacaaaatttgagaatacataa

SEQ ID NO: 967838 - DNA, 19 bp, Homo sapiens
gacaaacacctcccaggag

SEQ ID NO: 967839 - DNA, 22 bp, Homo sapiens
gacaaacacctcccaggagaca

SEQ ID NO: 967840 - DNA, 18 bp, Homo sapiens
gacaaacctagcttttaa

SEQ ID NO: 967841 - DNA, 22 bp, Homo sapiens
gacaaacctagcttttaaaaaa

SEQ ID NO: 967842 - DNA, 13 bp, Homo sapiens
gacaaagaaaacg

SEQ ID NO: 967843 - DNA, 16 bp, Homo sapiens
gacaaagaattccaaa

SEQ ID NO: 967844 - DNA, 13 bp, Homo sapiens
gacaaagcaggag

SEQ ID NO: 967845 - DNA, 16 bp, Homo sapiens
gacaaagcaggagtgg

SEQ ID NO: 967846 - DNA, 20 bp, Homo sapiens
gacaaagccaaactctgcca

SEQ ID NO: 967847 - DNA, 17 bp, Homo sapiens
gacaaagccattctttt

SEQ ID NO: 967848 - DNA, 19 bp, Homo sapiens
gacaaagccattcttttaa

SEQ ID NO: 967849 - DNA, 16 bp, Homo sapiens
gacaaagccttaagca

SEQ ID NO: 967850 - DNA, 22 bp, Homo sapiens
gacaaagccttaagcaaatttt

SEQ ID NO: 967851 - DNA, 18 bp, Homo sapiens
gacaaagtcatcccctct

SEQ ID NO: 967852 - DNA, 19 bp, Homo sapiens
gacaaagtgttgaaaatgt

SEQ ID NO: 967853 - DNA, 18 bp, Homo sapiens
gacaaagttccaaaatgc

SEQ ID NO: 967854 - DNA, 18 bp, Homo sapiens
gacaaatagaaaatggtc

SEQ ID NO: 967855 - DNA, 19 bp, Homo sapiens
gacaaatattttagaagct

SEQ ID NO: 967856 - DNA, 17 bp, Homo sapiens
gacaaatcaacagaagc

SEQ ID NO: 967857 - DNA, 23 bp, Homo sapiens
gacaaatcaacagaagcatttgt

SEQ ID NO: 967858 - DNA, 18 bp, Homo sapiens
gacaaatcctttctgccc

SEQ ID NO: 967859 - DNA, 20 bp, Homo sapiens
gacaaatcctttctgccccc

SEQ ID NO: 967860 - DNA, 22 bp, Homo sapiens
gacaaatgtgtatcggatgctt

SEQ ID NO: 967861 - DNA, 16 bp, Homo sapiens
gacaaattagcatgca

SEQ ID NO: 967862 - DNA, 22 bp, Homo sapiens
gacaaattagcatgcaagcttg

SEQ ID NO: 967863 - DNA, 12 bp, Homo sapiens
gacaaattctgt

SEQ ID NO: 967864 - DNA, 16 bp, Homo sapiens
gacaaattctgtttct

SEQ ID NO: 967865 - DNA, 20 bp, Homo sapiens
gacaaattctgtttcttgag

SEQ ID NO: 967866 - DNA, 21 bp, Homo sapiens
gacaacaccttcctcctgcag

SEQ ID NO: 967867 - DNA, 18 bp, Homo sapiens
gacaacagaaaaacaatc

SEQ ID NO: 967868 - DNA, 17 bp, Homo sapiens
gacaacagaagtcatga

SEQ ID NO: 967869 - DNA, 21 bp, Homo sapiens
gacaacagctctcgttctcct

SEQ ID NO: 967870 - DNA, 23 bp, Homo sapiens
gacaacagctctcgttctccttc

SEQ ID NO: 967871 - DNA, 16 bp, Homo sapiens
gacaacatcccacagt

SEQ ID NO: 967872 - DNA, 12 bp, Homo sapiens
gacaacattaaa

SEQ ID NO: 967873 - DNA, 16 bp, Homo sapiens
gacaaccaaaacatat

SEQ ID NO: 967874 - DNA, 18 bp, Homo sapiens
gacaaccaccgctcccca

SEQ ID NO: 967875 - DNA, 22 bp, Homo sapiens
gacaaccaccgctccccagccc

SEQ ID NO: 967876 - DNA, 23 bp, Homo sapiens
gacaaccaccgctccccagccca

SEQ ID NO: 967877 - DNA, 12 bp, Homo sapiens
gacaaccatgac

SEQ ID NO: 967878 - DNA, 16 bp, Homo sapiens
gacaaccattaaagtc

SEQ ID NO: 967879 - DNA, 19 bp, Homo sapiens
gacaaccctggcctcactt

SEQ ID NO: 967880 - DNA, 20 bp, Homo sapiens
gacaaccgatgctccagcca

SEQ ID NO: 967881 - DNA, 15 bp, Homo sapiens
gacaacctagaatgt

SEQ ID NO: 967882 - DNA, 13 bp, Homo sapiens
gacaacctttctg

SEQ ID NO: 967883 - DNA, 15 bp, Homo sapiens
gacaacgtctcttca

SEQ ID NO: 967884 - DNA, 16 bp, Homo sapiens
gacaactagatttgtc

SEQ ID NO: 967885 - DNA, 13 bp, Homo sapiens
gacaactgtgact

SEQ ID NO: 967886 - DNA, 23 bp, Homo sapiens
gacaactgttttaataaaagatt

SEQ ID NO: 967887 - DNA, 19 bp, Homo sapiens
gacaagaagcaaatttttt

SEQ ID NO: 967888 - DNA, 14 bp, Homo sapiens
gacaagacaggcag

SEQ ID NO: 967889 - DNA, 18 bp, Homo sapiens
gacaagagatgggaatga

SEQ ID NO: 967890 - DNA, 20 bp, Homo sapiens
gacaagagatgggaatgagg

SEQ ID NO: 967891 - DNA, 17 bp, Homo sapiens
gacaagagctgctgtcc

SEQ ID NO: 967892 - DNA, 19 bp, Homo sapiens
gacaagagctgctgtcctt

SEQ ID NO: 967893 - DNA, 14 bp, Homo sapiens
gacaagagtgagac

SEQ ID NO: 967894 - DNA, 21 bp, Homo sapiens
gacaagataccggtgcttctg

SEQ ID NO: 967895 - DNA, 14 bp, Homo sapiens
gacaagatattgta

SEQ ID NO: 967896 - DNA, 19 bp, Homo sapiens
gacaagatattgtacataa

SEQ ID NO: 967897 - DNA, 16 bp, Homo sapiens
gacaagcactgctagg

SEQ ID NO: 967898 - DNA, 12 bp, Homo sapiens
gacaagcagagg

SEQ ID NO: 967899 - DNA, 16 bp, Homo sapiens
gacaagccccaggcag

SEQ ID NO: 967900 - DNA, 20 bp, Homo sapiens
gacaagctgacttggcactt

SEQ ID NO: 967901 - DNA, 18 bp, Homo sapiens
gacaaggaaaatctatat

SEQ ID NO: 967902 - DNA, 15 bp, Homo sapiens
gacaaggaggtagag

SEQ ID NO: 967903 - DNA, 19 bp, Homo sapiens
gacaaggccttgctcactc

SEQ ID NO: 967904 - DNA, 18 bp, Homo sapiens
gacaagtagttcatgagt

SEQ ID NO: 967905 - DNA, 15 bp, Homo sapiens
gacaataacttctta

SEQ ID NO: 967906 - DNA, 19 bp, Homo sapiens
gacaataagtttgaacctt

SEQ ID NO: 967907 - DNA, 19 bp, Homo sapiens
gacaataatttcaggtttt

SEQ ID NO: 967908 - DNA, 18 bp, Homo sapiens
gacaatacagtaagcata

SEQ ID NO: 967909 - DNA, 21 bp, Homo sapiens
gacaatactccctttaaagag

SEQ ID NO: 967910 - DNA, 22 bp, Homo sapiens
gacaatactccctttaaagaga

SEQ ID NO: 967911 - DNA, 15 bp, Homo sapiens
gacaatactgctgcc

SEQ ID NO: 967912 - DNA, 15 bp, Homo sapiens
gacaatactggggtt

SEQ ID NO: 967913 - DNA, 15 bp, Homo sapiens
gacaatatacaagct

SEQ ID NO: 967914 - DNA, 14 bp, Homo sapiens
gacaatatacttca

SEQ ID NO: 967915 - DNA, 21 bp, Homo sapiens
gacaatatgtgccaatcaata

SEQ ID NO: 967916 - DNA, 17 bp, Homo sapiens
gacaatcaaagaaaaga

SEQ ID NO: 967917 - DNA, 20 bp, Homo sapiens
gacaatcagtcccctcccat

SEQ ID NO: 967918 - DNA, 20 bp, Homo sapiens
gacaatcatgaaatatgcat

SEQ ID NO: 967919 - DNA, 19 bp, Homo sapiens
gacaatgaaatactccagc

SEQ ID NO: 967920 - DNA, 22 bp, Homo sapiens
gacaatgcacctagctgtgcaa

SEQ ID NO: 967921 - DNA, 20 bp, Homo sapiens
gacaatggaccctttttgtt

SEQ ID NO: 967922 - DNA, 21 bp, Homo sapiens
gacaatgtcgagtatattatt

SEQ ID NO: 967923 - DNA, 12 bp, Homo sapiens
gacaatgtgaaa

SEQ ID NO: 967924 - DNA, 14 bp, Homo sapiens
gacaatgttgagaa

SEQ ID NO: 967925 - DNA, 18 bp, Homo sapiens
gacaatgttttcttcaac

SEQ ID NO: 967926 - DNA, 16 bp, Homo sapiens
gacaattctgcatgta

SEQ ID NO: 967927 - DNA, 13 bp, Homo sapiens
gacaattctgttt

SEQ ID NO: 967928 - DNA, 22 bp, Homo sapiens
gacaattgaggtaagttttttg

SEQ ID NO: 967929 - DNA, 13 bp, Homo sapiens
gacaatttattat

SEQ ID NO: 967930 - DNA, 16 bp, Homo sapiens
gacaatttgatacata

SEQ ID NO: 967931 - DNA, 22 bp, Homo sapiens
gacacaaaactccgcccccagc

SEQ ID NO: 967932 - DNA, 17 bp, Homo sapiens
gacacaacccaatagga

SEQ ID NO: 967933 - DNA, 21 bp, Homo sapiens
gacacaatatgtatgcttttt

SEQ ID NO: 967934 - DNA, 14 bp, Homo sapiens
gacacacacacaca

SEQ ID NO: 967935 - DNA, 14 bp, Homo sapiens
gacacacacacgca

SEQ ID NO: 967936 - DNA, 15 bp, Homo sapiens
gacacacacacgcac

SEQ ID NO: 967937 - DNA, 19 bp, Homo sapiens
gacacacacacgcacgcac

SEQ ID NO: 967938 - DNA, 22 bp, Homo sapiens
gacacacacacgcacgcacaca

SEQ ID NO: 967939 - DNA, 21 bp, Homo sapiens
gacacacactcaccagtggcc

SEQ ID NO: 967940 - DNA, 15 bp, Homo sapiens
gacacaccaggcgct

SEQ ID NO: 967941 - DNA, 20 bp, Homo sapiens
gacacaccccacaccccagc

SEQ ID NO: 967942 - DNA, 23 bp, Homo sapiens
gacacaccccacaccccagccca

SEQ ID NO: 967943 - DNA, 19 bp, Homo sapiens
gacacacccctaagtacaa

SEQ ID NO: 967944 - DNA, 15 bp, Homo sapiens
gacacacgcacacac

SEQ ID NO: 967945 - DNA, 18 bp, Homo sapiens
gacacacggggctcgggc

SEQ ID NO: 967946 - DNA, 22 bp, Homo sapiens
gacacacgtatttatatttgga

SEQ ID NO: 967947 - DNA, 15 bp, Homo sapiens
gacacagaacacaga

SEQ ID NO: 967948 - DNA, 18 bp, Homo sapiens
gacacagacccaggaccc

SEQ ID NO: 967949 - DNA, 16 bp, Homo sapiens
gacacagcacaagggc

SEQ ID NO: 967950 - DNA, 19 bp, Homo sapiens
gacacagcacaagggcaca

SEQ ID NO: 967951 - DNA, 11 bp, Homo sapiens
gacacagcagc

SEQ ID NO: 967952 - DNA, 20 bp, Homo sapiens
gacacagcagcttcaccaga

SEQ ID NO: 967953 - DNA, 14 bp, Homo sapiens
gacacagcctcccc

SEQ ID NO: 967954 - DNA, 12 bp, Homo sapiens
gacacagctctt

SEQ ID NO: 967955 - DNA, 19 bp, Homo sapiens
gacacagctcttccagggc

SEQ ID NO: 967956 - DNA, 21 bp, Homo sapiens
gacacagctcttccagggcag

SEQ ID NO: 967957 - DNA, 14 bp, Homo sapiens
gacacaggaaaaat

SEQ ID NO: 967958 - DNA, 16 bp, Homo sapiens
gacacaggaaaaataa

SEQ ID NO: 967959 - DNA, 19 bp, Homo sapiens
gacacaggaaaaataaacg

SEQ ID NO: 967960 - DNA, 21 bp, Homo sapiens
gacacagggacttgaagttgt

SEQ ID NO: 967961 - DNA, 14 bp, Homo sapiens
gacacaggtcaggg

SEQ ID NO: 967962 - DNA, 15 bp, Homo sapiens
gacacaggtcagggc

SEQ ID NO: 967963 - DNA, 16 bp, Homo sapiens
gacacaggtcagggct

SEQ ID NO: 967964 - DNA, 16 bp, Homo sapiens
gacacaggtctttcct

SEQ ID NO: 967965 - DNA, 22 bp, Homo sapiens
gacacagtaaaattaactctgt

SEQ ID NO: 967966 - DNA, 17 bp, Homo sapiens
gacacagtgaccatact

SEQ ID NO: 967967 - DNA, 22 bp, Homo sapiens
gacacagtgatgaatgtactat

SEQ ID NO: 967968 - DNA, 18 bp, Homo sapiens
gacacagttatcaaaaag

SEQ ID NO: 967969 - DNA, 15 bp, Homo sapiens
gacacatatacatat

SEQ ID NO: 967970 - DNA, 16 bp, Homo sapiens
gacacatatgaggggg

SEQ ID NO: 967971 - DNA, 14 bp, Homo sapiens
gacacatcaaatgc

SEQ ID NO: 967972 - DNA, 18 bp, Homo sapiens
gacacatcaagcttttct

SEQ ID NO: 967973 - DNA, 19 bp, Homo sapiens
gacacatcaagcttttctg

SEQ ID NO: 967974 - DNA, 21 bp, Homo sapiens
gacacatcccggcctcttcca

SEQ ID NO: 967975 - DNA, 13 bp, Homo sapiens
gacacatgcccct

SEQ ID NO: 967976 - DNA, 15 bp, Homo sapiens
gacacatgcccctcc

SEQ ID NO: 967977 - DNA, 16 bp, Homo sapiens
gacacatgctatgttc

SEQ ID NO: 967978 - DNA, 13 bp, Homo sapiens
gacacattgcctt

SEQ ID NO: 967979 - DNA, 15 bp, Homo sapiens
gacacattgccttct

SEQ ID NO: 967980 - DNA, 22 bp, Homo sapiens
gacacattgccttctggagctg

SEQ ID NO: 967981 - DNA, 19 bp, Homo sapiens
gacacattggaatgccttg

SEQ ID NO: 967982 - DNA, 19 bp, Homo sapiens
gacacattgtcatcagagg

SEQ ID NO: 967983 - DNA, 20 bp, Homo sapiens
gacaccaccgaatatattac

SEQ ID NO: 967984 - DNA, 19 bp, Homo sapiens
gacaccaggagtccctggt

SEQ ID NO: 967985 - DNA, 13 bp, Homo sapiens
gacaccatcccct

SEQ ID NO: 967986 - DNA, 14 bp, Homo sapiens
gacaccatgtgcaa

SEQ ID NO: 967987 - DNA, 12 bp, Homo sapiens
gacacccagagg

SEQ ID NO: 967988 - DNA, 13 bp, Homo sapiens
gacacccatgcca

SEQ ID NO: 967989 - DNA, 17 bp, Homo sapiens
gacacccatgccagaga

SEQ ID NO: 967990 - DNA, 20 bp, Homo sapiens
gacacccatgccagagaggt

SEQ ID NO: 967991 - DNA, 14 bp, Homo sapiens
gacacccccagctg

SEQ ID NO: 967992 - DNA, 10 bp, Homo sapiens
gacacccggc

SEQ ID NO: 967993 - DNA, 12 bp, Homo sapiens
gacaccctggcc

SEQ ID NO: 967994 - DNA, 23 bp, Homo sapiens
gacaccctggcctgaactgagga

SEQ ID NO: 967995 - DNA, 18 bp, Homo sapiens
gacaccgtcgaccaggaa

SEQ ID NO: 967996 - DNA, 17 bp, Homo sapiens
gacaccgtttgtccccc

SEQ ID NO: 967997 - DNA, 13 bp, Homo sapiens
gacacctcccagg

SEQ ID NO: 967998 - DNA, 14 bp, Homo sapiens
gacacctcccaggg

SEQ ID NO: 967999 - DNA, 12 bp, Homo sapiens
gacacctccccc

SEQ ID NO: 968000 - DNA, 21 bp, Homo sapiens
gacacctccccctacccatat

SEQ ID NO: 968001 - DNA, 15 bp, Homo sapiens
gacacctcccccttt

SEQ ID NO: 968002 - DNA, 23 bp, Homo sapiens
gacacctccccctttcacactgg

SEQ ID NO: 968003 - DNA, 21 bp, Homo sapiens
gacacctccgagaggcagcca

SEQ ID NO: 968004 - DNA, 13 bp, Homo sapiens
gacacctcttttt

SEQ ID NO: 968005 - DNA, 17 bp, Homo sapiens
gacacctgaaccctcca

SEQ ID NO: 968006 - DNA, 13 bp, Homo sapiens
gacacctgcacct

SEQ ID NO: 968007 - DNA, 19 bp, Homo sapiens
gacacctgcacctcccccc

SEQ ID NO: 968008 - DNA, 13 bp, Homo sapiens
gacacctgccctg

SEQ ID NO: 968009 - DNA, 16 bp, Homo sapiens
gacacctgtacattct

SEQ ID NO: 968010 - DNA, 13 bp, Homo sapiens
gacacgagccaca

SEQ ID NO: 968011 - DNA, 20 bp, Homo sapiens
gacacgcacggcagccacag

SEQ ID NO: 968012 - DNA, 21 bp, Homo sapiens
gacacgcacggcagccacagc

SEQ ID NO: 968013 - DNA, 22 bp, Homo sapiens
gacacgcacggcagccacagct

SEQ ID NO: 968014 - DNA, 18 bp, Homo sapiens
gacacgcagcctgctctg

SEQ ID NO: 968015 - DNA, 17 bp, Homo sapiens
gacacgcgctctccacc

SEQ ID NO: 968016 - DNA, 19 bp, Homo sapiens
gacacgtgggctcccctct

SEQ ID NO: 968017 - DNA, 15 bp, Homo sapiens
gacacgttctgattt

SEQ ID NO: 968018 - DNA, 23 bp, Homo sapiens
gacactaaaaactgatcagtgta

SEQ ID NO: 968019 - DNA, 14 bp, Homo sapiens
gacactaactttgt

SEQ ID NO: 968020 - DNA, 18 bp, Homo sapiens
gacactaagttatagtat

SEQ ID NO: 968021 - DNA, 20 bp, Homo sapiens
gacactaagttatagtatat

SEQ ID NO: 968022 - DNA, 18 bp, Homo sapiens
gacactacacccagcaat

SEQ ID NO: 968023 - DNA, 19 bp, Homo sapiens
gacactacacccagcaata

SEQ ID NO: 968024 - DNA, 20 bp, Homo sapiens
gacactacacccagcaatag

SEQ ID NO: 968025 - DNA, 16 bp, Homo sapiens
gacactattcactaaa

SEQ ID NO: 968026 - DNA, 13 bp, Homo sapiens
gacactcagacct

SEQ ID NO: 968027 - DNA, 14 bp, Homo sapiens
gacactcagggcag

SEQ ID NO: 968028 - DNA, 23 bp, Homo sapiens
gacactcagggcagctgcctggc

SEQ ID NO: 968029 - DNA, 16 bp, Homo sapiens
gacactccagtgccag

SEQ ID NO: 968030 - DNA, 17 bp, Homo sapiens
gacactccatgagtgtc

SEQ ID NO: 968031 - DNA, 16 bp, Homo sapiens
gacactccccgaagtc

SEQ ID NO: 968032 - DNA, 21 bp, Homo sapiens
gacactcccttgggctccctg

SEQ ID NO: 968033 - DNA, 14 bp, Homo sapiens
gacactcctagact

SEQ ID NO: 968034 - DNA, 21 bp, Homo sapiens
gacactctataagattccaaa

SEQ ID NO: 968035 - DNA, 15 bp, Homo sapiens
gacactctctggaag

SEQ ID NO: 968036 - DNA, 19 bp, Homo sapiens
gacactgaaagttttgtaa

SEQ ID NO: 968037 - DNA, 12 bp, Homo sapiens
gacactgagccc

SEQ ID NO: 968038 - DNA, 16 bp, Homo sapiens
gacactgagcttctga

SEQ ID NO: 968039 - DNA, 22 bp, Homo sapiens
gacactgcacagaagacagcag

SEQ ID NO: 968040 - DNA, 19 bp, Homo sapiens
gacactgccaagagccgac

SEQ ID NO: 968041 - DNA, 20 bp, Homo sapiens
gacactgccgacatcagcat

SEQ ID NO: 968042 - DNA, 23 bp, Homo sapiens
gacactgccttagcctcttggaa

SEQ ID NO: 968043 - DNA, 15 bp, Homo sapiens
taatgaaataatcag

SEQ ID NO: 968044 - DNA, 22 bp, Homo sapiens
taatgtttatgagccagacaaa

SEQ ID NO: 968045 - DNA, 12 bp, Homo sapiens
gacactgctgca

SEQ ID NO: 968046 - DNA, 14 bp, Homo sapiens
gacactgctgcacc

SEQ ID NO: 968047 - DNA, 21 bp, Homo sapiens
gacactgctgcaccagagtga

SEQ ID NO: 968048 - DNA, 12 bp, Homo sapiens
gacactggcccc

SEQ ID NO: 968049 - DNA, 13 bp, Homo sapiens
gacactggcccca

SEQ ID NO: 968050 - DNA, 14 bp, Homo sapiens
gacactggcccctc

SEQ ID NO: 968051 - DNA, 15 bp, Homo sapiens
gacactggcccctca

SEQ ID NO: 968052 - DNA, 16 bp, Homo sapiens
gacactgggcagcaag

SEQ ID NO: 968053 - DNA, 16 bp, Homo sapiens
gacactggtttgaaga

SEQ ID NO: 968054 - DNA, 12 bp, Homo sapiens
gacactgtgaga

SEQ ID NO: 968055 - DNA, 23 bp, Homo sapiens
gacactgtgcccagcccggacct

SEQ ID NO: 968056 - DNA, 22 bp, Homo sapiens
gacactgtggagactttctgtt

SEQ ID NO: 968057 - DNA, 17 bp, Homo sapiens
gacactgttgataaaaa

SEQ ID NO: 968058 - DNA, 18 bp, Homo sapiens
gacactgttgataaaaac

SEQ ID NO: 968059 - DNA, 19 bp, Homo sapiens
gacactgtttggcctttct

SEQ ID NO: 968060 - DNA, 20 bp, Homo sapiens
gacacttaatactaccttga

SEQ ID NO: 968061 - DNA, 17 bp, Homo sapiens
gacacttcagagagctg

SEQ ID NO: 968062 - DNA, 19 bp, Homo sapiens
gacacttcagagagctggt

SEQ ID NO: 968063 - DNA, 14 bp, Homo sapiens
gacacttcctgtcc

SEQ ID NO: 968064 - DNA, 15 bp, Homo sapiens
gacactttgaaatgt

SEQ ID NO: 968065 - DNA, 18 bp, Homo sapiens
gacactttgaaatgtgtt

SEQ ID NO: 968066 - DNA, 16 bp, Homo sapiens
gacacttttaaaaaac

SEQ ID NO: 968067 - DNA, 21 bp, Homo sapiens
gacacttttaaaaaacaaaaa

SEQ ID NO: 968068 - DNA, 17 bp, Homo sapiens
gacacttttcatatcat

SEQ ID NO: 968069 - DNA, 18 bp, Homo sapiens
gacagaaaagtgcctgag

SEQ ID NO: 968070 - DNA, 21 bp, Homo sapiens
gacagaaaagtgcctgagctg

SEQ ID NO: 968071 - DNA, 21 bp, Homo sapiens
gacagaaactggattaaaaca

SEQ ID NO: 968072 - DNA, 19 bp, Homo sapiens
gacagaacattgccttcct

SEQ ID NO: 968073 - DNA, 20 bp, Homo sapiens
gacagaacattgccttcctc

SEQ ID NO: 968074 - DNA, 21 bp, Homo sapiens
gacagaacattgccttcctcg

SEQ ID NO: 968075 - DNA, 22 bp, Homo sapiens
gacagaacattgccttcctcgt

SEQ ID NO: 968076 - DNA, 14 bp, Homo sapiens
gacagaactgtcca

SEQ ID NO: 968077 - DNA, 15 bp, Homo sapiens
gacagaagcaggctg

SEQ ID NO: 968078 - DNA, 16 bp, Homo sapiens
gacagaagcaggctgg

SEQ ID NO: 968079 - DNA, 23 bp, Homo sapiens
gacagaagcctggactctgcccc

SEQ ID NO: 968080 - DNA, 17 bp, Homo sapiens
gacagaagtctcctcaa

SEQ ID NO: 968081 - DNA, 23 bp, Homo sapiens
gacagaatataaaaactcctggg

SEQ ID NO: 968082 - DNA, 15 bp, Homo sapiens
gacagaatgtatctg

SEQ ID NO: 968083 - DNA, 16 bp, Homo sapiens
gacagaatgtgttctt

SEQ ID NO: 968084 - DNA, 13 bp, Homo sapiens
gacagacacacac

SEQ ID NO: 968085 - DNA, 12 bp, Homo sapiens
gacagacacctc

SEQ ID NO: 968086 - DNA, 15 bp, Homo sapiens
gacagacacctcccc

SEQ ID NO: 968087 - DNA, 21 bp, Homo sapiens
gacagacaggctcttagcagc

SEQ ID NO: 968088 - DNA, 22 bp, Homo sapiens
gacagaccacatctttatctgt

SEQ ID NO: 968089 - DNA, 15 bp, Homo sapiens
gacagaccacttgcc

SEQ ID NO: 968090 - DNA, 19 bp, Homo sapiens
gacagaccacttgccacgc

SEQ ID NO: 968091 - DNA, 12 bp, Homo sapiens
gacagacccagt

SEQ ID NO: 968092 - DNA, 22 bp, Homo sapiens
gacagaccggggttcaagccat

SEQ ID NO: 968093 - DNA, 21 bp, Homo sapiens
gacagacggaaatgaaattgt

SEQ ID NO: 968094 - DNA, 16 bp, Homo sapiens
gacagactcctgagga

SEQ ID NO: 968095 - DNA, 19 bp, Homo sapiens
gacagactcctgaggacag

SEQ ID NO: 968096 - DNA, 15 bp, Homo sapiens
gacagactttggaca

SEQ ID NO: 968097 - DNA, 21 bp, Homo sapiens
gacagactttggacagtggcc

SEQ ID NO: 968098 - DNA, 15 bp, Homo sapiens
gacagagacacctgc

SEQ ID NO: 968099 - DNA, 16 bp, Homo sapiens
gacagagacacctgca

SEQ ID NO: 968100 - DNA, 18 bp, Homo sapiens
gacagagacgcaggaatg

SEQ ID NO: 968101 - DNA, 19 bp, Homo sapiens
gacagagaggactgtaggg

SEQ ID NO: 968102 - DNA, 18 bp, Homo sapiens
gacagagcaggggctcca

SEQ ID NO: 968103 - DNA, 19 bp, Homo sapiens
gacagagcaggggctccag

SEQ ID NO: 968104 - DNA, 19 bp, Homo sapiens
gacagagccatgctgggaa

SEQ ID NO: 968105 - DNA, 18 bp, Homo sapiens
gacagagccccacgctgt

SEQ ID NO: 968106 - DNA, 22 bp, Homo sapiens
gacagagcggaactatgaaaag

SEQ ID NO: 968107 - DNA, 18 bp, Homo sapiens
gacagaggaaagggctgg

SEQ ID NO: 968108 - DNA, 23 bp, Homo sapiens
gacagaggaaagggctggctccc

SEQ ID NO: 968109 - DNA, 18 bp, Homo sapiens
gacagaggccaaggactg

SEQ ID NO: 968110 - DNA, 19 bp, Homo sapiens
gacagaggccaaggactga

SEQ ID NO: 968111 - DNA, 17 bp, Homo sapiens
gacagaggccctgccac

SEQ ID NO: 968112 - DNA, 20 bp, Homo sapiens
gacagaggccctgccacgtc

SEQ ID NO: 968113 - DNA, 20 bp, Homo sapiens
gacagagggaaacacagcag

SEQ ID NO: 968114 - DNA, 21 bp, Homo sapiens
gacagaggggactctgggcta

SEQ ID NO: 968115 - DNA, 13 bp, Homo sapiens
gacagagtctggg

SEQ ID NO: 968116 - DNA, 21 bp, Homo sapiens
gacagagtcttgctctgtctc

SEQ ID NO: 968117 - DNA, 21 bp, Homo sapiens
gacagagttcactataaatgg

SEQ ID NO: 968118 - DNA, 17 bp, Homo sapiens
gacagatacctccaacc

SEQ ID NO: 968119 - DNA, 23 bp, Homo sapiens
gacagatcaagctgtgagacagt

SEQ ID NO: 968120 - DNA, 17 bp, Homo sapiens
gacagatcactcctgga

SEQ ID NO: 968121 - DNA, 15 bp, Homo sapiens
gacagatgaatacct

SEQ ID NO: 968122 - DNA, 14 bp, Homo sapiens
gacagatgccaact

SEQ ID NO: 968123 - DNA, 17 bp, Homo sapiens
gacagatgccaacttcc

SEQ ID NO: 968124 - DNA, 22 bp, Homo sapiens
gacagatgccaacttcccacac

SEQ ID NO: 968125 - DNA, 14 bp, Homo sapiens
gacagatgccccag

SEQ ID NO: 968126 - DNA, 18 bp, Homo sapiens
gacagatgccccagagct

SEQ ID NO: 968127 - DNA, 19 bp, Homo sapiens
gacagatgccccagagctg

SEQ ID NO: 968128 - DNA, 12 bp, Homo sapiens
gacagatggccc

SEQ ID NO: 968129 - DNA, 23 bp, Homo sapiens
gacagatggcccaagggatggca

SEQ ID NO: 968130 - DNA, 18 bp, Homo sapiens
gacagatgtcagccgagc

SEQ ID NO: 968131 - DNA, 22 bp, Homo sapiens
gacagattcataaagtaatgat

SEQ ID NO: 968132 - DNA, 18 bp, Homo sapiens
gacagatttcagtaatgt

SEQ ID NO: 968133 - DNA, 21 bp, Homo sapiens
gacagcaaaaccattgcttca

SEQ ID NO: 968134 - DNA, 22 bp, Homo sapiens
gacagcaaaaccattgcttcac

SEQ ID NO: 968135 - DNA, 23 bp, Homo sapiens
gacagcaaaatgttgaagaaaaa

SEQ ID NO: 968136 - DNA, 19 bp, Homo sapiens
gacagcaacggggaggcca

SEQ ID NO: 968137 - DNA, 16 bp, Homo sapiens
gacagcaccactgctg

SEQ ID NO: 968138 - DNA, 19 bp, Homo sapiens
gacagcaccactgctgagg

SEQ ID NO: 968139 - DNA, 14 bp, Homo sapiens
gacagcagaagcct

SEQ ID NO: 968140 - DNA, 13 bp, Homo sapiens
gacagcagctcag

SEQ ID NO: 968141 - DNA, 14 bp, Homo sapiens
gacagcagctcagg

SEQ ID NO: 968142 - DNA, 17 bp, Homo sapiens
gacagcatgactgtgca

SEQ ID NO: 968143 - DNA, 20 bp, Homo sapiens
gacagcattgatctcctgga

SEQ ID NO: 968144 - DNA, 15 bp, Homo sapiens
gacagccatgcgtgg

SEQ ID NO: 968145 - DNA, 18 bp, Homo sapiens
gacagcccaacttccaga

SEQ ID NO: 968146 - DNA, 11 bp, Homo sapiens
gacagcccaga

SEQ ID NO: 968147 - DNA, 17 bp, Homo sapiens
gacagcccagagcctgg

SEQ ID NO: 968148 - DNA, 23 bp, Homo sapiens
gacagcccaggatactggcacag

SEQ ID NO: 968149 - DNA, 18 bp, Homo sapiens
gacagcccatcacctcta

SEQ ID NO: 968150 - DNA, 20 bp, Homo sapiens
gacagcctccccctgtcccc

SEQ ID NO: 968151 - DNA, 11 bp, Homo sapiens
gacagcctggc

SEQ ID NO: 968152 - DNA, 13 bp, Homo sapiens
gacagcctggcac

SEQ ID NO: 968153 - DNA, 22 bp, Homo sapiens
gacagcctgtggcggtgcctgg

SEQ ID NO: 968154 - DNA, 23 bp, Homo sapiens
gacagcctgtggcggtgcctggg

SEQ ID NO: 968155 - DNA, 21 bp, Homo sapiens
gacagccttgggcctttcagt

SEQ ID NO: 968156 - DNA, 15 bp, Homo sapiens
gacagcgggaaaaat

SEQ ID NO: 968157 - DNA, 12 bp, Homo sapiens
gacagctccacc

SEQ ID NO: 968158 - DNA, 18 bp, Homo sapiens
gacagctccaccctggcc

SEQ ID NO: 968159 - DNA, 11 bp, Homo sapiens
gacagctgctc

SEQ ID NO: 968160 - DNA, 17 bp, Homo sapiens
gacagctgctcctagag

SEQ ID NO: 968161 - DNA, 20 bp, Homo sapiens
gacagctgctcctagaggga

SEQ ID NO: 968162 - DNA, 15 bp, Homo sapiens
gacagctgtccctgt

SEQ ID NO: 968163 - DNA, 16 bp, Homo sapiens
gacagctgtccctgtc

SEQ ID NO: 968164 - DNA, 18 bp, Homo sapiens
gacagctgtccctgtcac

SEQ ID NO: 968165 - DNA, 21 bp, Homo sapiens
taattgtcctgtgtctatgta

SEQ ID NO: 968166 - DNA, 19 bp, Homo sapiens
taattgtgtaaaaaatgga

SEQ ID NO: 968167 - DNA, 20 bp, Homo sapiens
taattgtgtaaaaaatggaa

SEQ ID NO: 968168 - DNA, 20 bp, Homo sapiens
taattgtgtggattctttaa

SEQ ID NO: 968169 - DNA, 22 bp, Homo sapiens
taattgttgattaatttgagaa

SEQ ID NO: 968170 - DNA, 14 bp, Homo sapiens
taattgttgttctg

SEQ ID NO: 968171 - DNA, 17 bp, Homo sapiens
gacagctttctgggatg

SEQ ID NO: 968172 - DNA, 18 bp, Homo sapiens
gacaggaaaatcctctgg

SEQ ID NO: 968173 - DNA, 17 bp, Homo sapiens
gacaggaaagccctccc

SEQ ID NO: 968174 - DNA, 15 bp, Homo sapiens
gacaggacagaatgt

SEQ ID NO: 968175 - DNA, 16 bp, Homo sapiens
gacaggacagaatgtg

SEQ ID NO: 968176 - DNA, 14 bp, Homo sapiens
gacaggaccccagc

SEQ ID NO: 968177 - DNA, 13 bp, Homo sapiens
gacaggacgctga

SEQ ID NO: 968178 - DNA, 21 bp, Homo sapiens
gacaggacgctgaccgtggag

SEQ ID NO: 968179 - DNA, 14 bp, Homo sapiens
gacaggagcctagc

SEQ ID NO: 968180 - DNA, 14 bp, Homo sapiens
gacaggaggaggag

SEQ ID NO: 968181 - DNA, 15 bp, Homo sapiens
gacaggatccaggcc

SEQ ID NO: 968182 - DNA, 16 bp, Homo sapiens
gacaggatgggggctg

SEQ ID NO: 968183 - DNA, 13 bp, Homo sapiens
gacaggcactcca

SEQ ID NO: 968184 - DNA, 10 bp, Homo sapiens
gacaggcagc

SEQ ID NO: 968185 - DNA, 23 bp, Homo sapiens
gacaggcagccacgtctcaacat

SEQ ID NO: 968186 - DNA, 15 bp, Homo sapiens
gacaggcagcccagc

SEQ ID NO: 968187 - DNA, 17 bp, Homo sapiens
gacaggcagcccagcag

SEQ ID NO: 968188 - DNA, 14 bp, Homo sapiens
gacaggcagcctcc

SEQ ID NO: 968189 - DNA, 12 bp, Homo sapiens
gacaggcaggcc

SEQ ID NO: 968190 - DNA, 20 bp, Homo sapiens
gacaggcaggccagatggcc

SEQ ID NO: 968191 - DNA, 18 bp, Homo sapiens
gacaggccatgtgagcca

SEQ ID NO: 968192 - DNA, 14 bp, Homo sapiens
gacaggcccaagag

SEQ ID NO: 968193 - DNA, 18 bp, Homo sapiens
gacaggcccaagagatga

SEQ ID NO: 968194 - DNA, 22 bp, Homo sapiens
gacaggcccaagagatgaagag

SEQ ID NO: 968195 - DNA, 15 bp, Homo sapiens
gacaggccctccctg

SEQ ID NO: 968196 - DNA, 17 bp, Homo sapiens
gacaggccctccctgtc

SEQ ID NO: 968197 - DNA, 20 bp, Homo sapiens
gacaggccctccctgtctcc

SEQ ID NO: 968198 - DNA, 21 bp, Homo sapiens
gacaggcctcacctctaccca

SEQ ID NO: 968199 - DNA, 14 bp, Homo sapiens
gacaggctcgtcag

SEQ ID NO: 968200 - DNA, 17 bp, Homo sapiens
gacaggctctagagaga

SEQ ID NO: 968201 - DNA, 13 bp, Homo sapiens
gacaggctgaaga

SEQ ID NO: 968202 - DNA, 23 bp, Homo sapiens
gacaggctgaagagagggacagg

SEQ ID NO: 968203 - DNA, 17 bp, Homo sapiens
gacaggctggaatgagg

SEQ ID NO: 968204 - DNA, 21 bp, Homo sapiens
gacaggctggaatgagggagg

SEQ ID NO: 968205 - DNA, 12 bp, Homo sapiens
gacaggctggct

SEQ ID NO: 968206 - DNA, 22 bp, Homo sapiens
gacaggctggctccagatgcag

SEQ ID NO: 968207 - DNA, 15 bp, Homo sapiens
gacaggctggtgcta

SEQ ID NO: 968208 - DNA, 12 bp, Homo sapiens
gacagggcaggc

SEQ ID NO: 968209 - DNA, 14 bp, Homo sapiens
gacagggcatggcc

SEQ ID NO: 968210 - DNA, 22 bp, Homo sapiens
gacagggcatggccaggtggcc

SEQ ID NO: 968211 - DNA, 20 bp, Homo sapiens
gacagggccagtggggcctg

SEQ ID NO: 968212 - DNA, 22 bp, Homo sapiens
gacagggtctcactctgtcgct

SEQ ID NO: 968213 - DNA, 21 bp, Homo sapiens
gacagggtcttgctctgtccc

SEQ ID NO: 968214 - DNA, 15 bp, Homo sapiens
gacagggtgggcttc

SEQ ID NO: 968215 - DNA, 20 bp, Homo sapiens
gacagggtgggcttcctgcc

SEQ ID NO: 968216 - DNA, 20 bp, Homo sapiens
gacagggtttggctgtgtct

SEQ ID NO: 968217 - DNA, 20 bp, Homo sapiens
gacaggtgatgctctggctt

SEQ ID NO: 968218 - DNA, 20 bp, Homo sapiens
gacaggtgggcctggcggcc

SEQ ID NO: 968219 - DNA, 18 bp, Homo sapiens
gacaggtggggcctcagc

SEQ ID NO: 968220 - DNA, 22 bp, Homo sapiens
gacaggtggggcctcagcctgg

SEQ ID NO: 968221 - DNA, 15 bp, Homo sapiens
gacagtaaaatacta

SEQ ID NO: 968222 - DNA, 17 bp, Homo sapiens
gacagtacctgattgta

SEQ ID NO: 968223 - DNA, 16 bp, Homo sapiens
gacagtatatttgaaa

SEQ ID NO: 968224 - DNA, 19 bp, Homo sapiens
gacagtattgccacctctg

SEQ ID NO: 968225 - DNA, 15 bp, Homo sapiens
gacagtcaaggtgat

SEQ ID NO: 968226 - DNA, 19 bp, Homo sapiens
gacagtccacaggggccac

SEQ ID NO: 968227 - DNA, 14 bp, Homo sapiens
gacagtcctgggag

SEQ ID NO: 968228 - DNA, 18 bp, Homo sapiens
gacagtcctgggagaacc

SEQ ID NO: 968229 - DNA, 17 bp, Homo sapiens
gacagtcggtgacccca

SEQ ID NO: 968230 - DNA, 17 bp, Homo sapiens
gacagtcgttcccagtg

SEQ ID NO: 968231 - DNA, 17 bp, Homo sapiens
gacagtctccctgatgg

SEQ ID NO: 968232 - DNA, 23 bp, Homo sapiens
gacagtctccctgatggaccctc

SEQ ID NO: 968233 - DNA, 14 bp, Homo sapiens
gacagtctggccac

SEQ ID NO: 968234 - DNA, 15 bp, Homo sapiens
gacagtcttgtgctt

SEQ ID NO: 968235 - DNA, 19 bp, Homo sapiens
gacagtgaagcagcactgt

SEQ ID NO: 968236 - DNA, 22 bp, Homo sapiens
gacagtgaattgacccatgttc

SEQ ID NO: 968237 - DNA, 15 bp, Homo sapiens
gacagtgaatttggg

SEQ ID NO: 968238 - DNA, 21 bp, Homo sapiens
gacagtgataggcccaaggtc

SEQ ID NO: 968239 - DNA, 19 bp, Homo sapiens
gacagtgatattggaactt

SEQ ID NO: 968240 - DNA, 15 bp, Homo sapiens
gacagtgatctccat

SEQ ID NO: 968241 - DNA, 15 bp, Homo sapiens
gacagtgccatcccc

SEQ ID NO: 968242 - DNA, 21 bp, Homo sapiens
gacagtgccatccccaccttc

SEQ ID NO: 968243 - DNA, 16 bp, Homo sapiens
gacagtgcctatactg

SEQ ID NO: 968244 - DNA, 17 bp, Homo sapiens
gacagtgcctcttccag

SEQ ID NO: 968245 - DNA, 16 bp, Homo sapiens
gacagtgcttcagcct

SEQ ID NO: 968246 - DNA, 17 bp, Homo sapiens
gacagtggtgggcgggg

SEQ ID NO: 968247 - DNA, 19 bp, Homo sapiens
gacagtgtggggataaaga

SEQ ID NO: 968248 - DNA, 21 bp, Homo sapiens
gacagttacaaaccaggtcac

SEQ ID NO: 968249 - DNA, 13 bp, Homo sapiens
gacagttctctgt

SEQ ID NO: 968250 - DNA, 14 bp, Homo sapiens
gacagttggcagag

SEQ ID NO: 968251 - DNA, 23 bp, Homo sapiens
gacagttggcagagaaggcctct

SEQ ID NO: 968252 - DNA, 21 bp, Homo sapiens
gacagtttaccagttgccttt

SEQ ID NO: 968253 - DNA, 19 bp, Homo sapiens
gacagtttactttgccaac

SEQ ID NO: 968254 - DNA, 17 bp, Homo sapiens
gacagtttatcctgtct

SEQ ID NO: 968255 - DNA, 22 bp, Homo sapiens
gacagtttcttttgtgttccta

SEQ ID NO: 968256 - DNA, 14 bp, Homo sapiens
gacagtttttctgt

SEQ ID NO: 968257 - DNA, 14 bp, Homo sapiens
gacataaaacttta

SEQ ID NO: 968258 - DNA, 17 bp, Homo sapiens
gacataaagttgataaa

SEQ ID NO: 968259 - DNA, 23 bp, Homo sapiens
gacataaccaacattaaaactca

SEQ ID NO: 968260 - DNA, 19 bp, Homo sapiens
gacataagcaatcatttta

SEQ ID NO: 968261 - DNA, 22 bp, Homo sapiens
gacataatggggtcctggccat

SEQ ID NO: 968262 - DNA, 16 bp, Homo sapiens
gacatacgcttttaat

SEQ ID NO: 968263 - DNA, 23 bp, Homo sapiens
gacatactaaccagcagaaatgc

SEQ ID NO: 968264 - DNA, 14 bp, Homo sapiens
gacatactgctgga

SEQ ID NO: 968265 - DNA, 16 bp, Homo sapiens
gacatactgctggagt

SEQ ID NO: 968266 - DNA, 19 bp, Homo sapiens
gacatagaagagccaagag

SEQ ID NO: 968267 - DNA, 22 bp, Homo sapiens
gacatagccaatggacaagcag

SEQ ID NO: 968268 - DNA, 22 bp, Homo sapiens
gacatagcctcatgttctgtgg

SEQ ID NO: 968269 - DNA, 15 bp, Homo sapiens
gacataggccaaggc

SEQ ID NO: 968270 - DNA, 21 bp, Homo sapiens
gacatatattttttaaaataa

SEQ ID NO: 968271 - DNA, 12 bp, Homo sapiens
gacatatttaat

SEQ ID NO: 968272 - DNA, 21 bp, Homo sapiens
gacatatttaatgttttaaat

SEQ ID NO: 968273 - DNA, 23 bp, Homo sapiens
gacatatttaatgttttaaatgt

SEQ ID NO: 968274 - DNA, 13 bp, Homo sapiens
gacatatttgcat

SEQ ID NO: 968275 - DNA, 23 bp, Homo sapiens
gacatcaaagtggtaaatactgt

SEQ ID NO: 968276 - DNA, 19 bp, Homo sapiens
gacatcaaatttgccacca

SEQ ID NO: 968277 - DNA, 21 bp, Homo sapiens
gacatcaaatttgccaccact

SEQ ID NO: 968278 - DNA, 16 bp, Homo sapiens
gacatcacttgtacaa

SEQ ID NO: 968279 - DNA, 14 bp, Homo sapiens
gacatcagcctgct

SEQ ID NO: 968280 - DNA, 21 bp, Homo sapiens
gacatcatcattcttgtggga

SEQ ID NO: 968281 - DNA, 17 bp, Homo sapiens
gacatccataaagaagc

SEQ ID NO: 968282 - DNA, 22 bp, Homo sapiens
gacatccatgtttgtaaaacta

SEQ ID NO: 968283 - DNA, 17 bp, Homo sapiens
gacatcccagaccagcc

SEQ ID NO: 968284 - DNA, 15 bp, Homo sapiens
gacatcccttcctgg

SEQ ID NO: 968285 - DNA, 16 bp, Homo sapiens
gacatccgttgtgctt

SEQ ID NO: 968286 - DNA, 19 bp, Homo sapiens
taatttttaatgatgacaa

SEQ ID NO: 968287 - DNA, 17 bp, Homo sapiens
taatttttatttcttcc

SEQ ID NO: 968288 - DNA, 18 bp, Homo sapiens
taatttttatttcttcct

SEQ ID NO: 968289 - DNA, 23 bp, Homo sapiens
taatttttatttttgctgagact

SEQ ID NO: 968290 - DNA, 18 bp, Homo sapiens
taatttttcctgcatgtt

SEQ ID NO: 968291 - DNA, 21 bp, Homo sapiens
taatttttcctgcatgttctg

SEQ ID NO: 968292 - DNA, 18 bp, Homo sapiens
taatttttgaaaagagaa

SEQ ID NO: 968293 - DNA, 17 bp, Homo sapiens
taatttttgcttaacat

SEQ ID NO: 968294 - DNA, 20 bp, Homo sapiens
taatttttgcttttagaaaa

SEQ ID NO: 968295 - DNA, 22 bp, Homo sapiens
taatttttgtgtttttaataaa

SEQ ID NO: 968296 - DNA, 22 bp, Homo sapiens
taattttttaaaaaaaatttgt

SEQ ID NO: 968297 - DNA, 17 bp, Homo sapiens
taattttttggtacaaa

SEQ ID NO: 968298 - DNA, 17 bp, Homo sapiens
taatttttttaaccaaa

SEQ ID NO: 968299 - DNA, 22 bp, Homo sapiens
gaccaccagccgccccagcccc

SEQ ID NO: 968300 - DNA, 14 bp, Homo sapiens
gaccaccagggtcc

SEQ ID NO: 968301 - DNA, 19 bp, Homo sapiens
gaccaccagggtcccagga

SEQ ID NO: 968302 - DNA, 21 bp, Homo sapiens
gaccaccagggtcccaggaag

SEQ ID NO: 968303 - DNA, 23 bp, Homo sapiens
gaccaccagggtcccaggaagcc

SEQ ID NO: 968304 - DNA, 18 bp, Homo sapiens
gaccaccccgcctgccct

SEQ ID NO: 968305 - DNA, 19 bp, Homo sapiens
gaccaccctcactggctct

SEQ ID NO: 968306 - DNA, 23 bp, Homo sapiens
gaccacctagtctgtaactcttt

SEQ ID NO: 968307 - DNA, 19 bp, Homo sapiens
gaccacgcccgtcctgcct

SEQ ID NO: 968308 - DNA, 22 bp, Homo sapiens
gaccacggacgtttccatcagg

SEQ ID NO: 968309 - DNA, 23 bp, Homo sapiens
gaccacgtgaaatttgcctctgt

SEQ ID NO: 968310 - DNA, 16 bp, Homo sapiens
gaccacgtttctaaag

SEQ ID NO: 968311 - DNA, 12 bp, Homo sapiens
gaccactcagcc

SEQ ID NO: 968312 - DNA, 13 bp, Homo sapiens
gaccactcagccc

SEQ ID NO: 968313 - DNA, 16 bp, Homo sapiens
gaccactcagccccta

SEQ ID NO: 968314 - DNA, 19 bp, Homo sapiens
gaccactcagcccctagga

SEQ ID NO: 968315 - DNA, 23 bp, Homo sapiens
gaccactcctgtccctgtagctc

SEQ ID NO: 968316 - DNA, 18 bp, Homo sapiens
gaccactcgaggcctgca

SEQ ID NO: 968317 - DNA, 22 bp, Homo sapiens
gaccactcttctttaagccata

SEQ ID NO: 968318 - DNA, 21 bp, Homo sapiens
gaccactgcatgagcttttat

SEQ ID NO: 968319 - DNA, 15 bp, Homo sapiens
gaccactgggcctgc

SEQ ID NO: 968320 - DNA, 14 bp, Homo sapiens
gaccactgttatca

SEQ ID NO: 968321 - DNA, 17 bp, Homo sapiens
gaccagaaacagggaca

SEQ ID NO: 968322 - DNA, 22 bp, Homo sapiens
gaccagaaacagggacaaagaa

SEQ ID NO: 968323 - DNA, 16 bp, Homo sapiens
gaccagaagccaaaga

SEQ ID NO: 968324 - DNA, 12 bp, Homo sapiens
gaccagaagcct

SEQ ID NO: 968325 - DNA, 15 bp, Homo sapiens
gaccagagctgtctg

SEQ ID NO: 968326 - DNA, 17 bp, Homo sapiens
gaccagataaatagaac

SEQ ID NO: 968327 - DNA, 18 bp, Homo sapiens
gaccagatctttctcttc

SEQ ID NO: 968328 - DNA, 15 bp, Homo sapiens
gaccagattgctctg

SEQ ID NO: 968329 - DNA, 13 bp, Homo sapiens
gaccagcactcag

SEQ ID NO: 968330 - DNA, 18 bp, Homo sapiens
gaccagcactcagcctca

SEQ ID NO: 968331 - DNA, 17 bp, Homo sapiens
gaccagcactgtctcag

SEQ ID NO: 968332 - DNA, 22 bp, Homo sapiens
gaccagcagacagagccaggag

SEQ ID NO: 968333 - DNA, 13 bp, Homo sapiens
gaccagcagcgcc

SEQ ID NO: 968334 - DNA, 23 bp, Homo sapiens
gaccagcagcgcctttcccaact

SEQ ID NO: 968335 - DNA, 15 bp, Homo sapiens
gaccagcccattggc

SEQ ID NO: 968336 - DNA, 20 bp, Homo sapiens
gaccagcctccatgctgcct

SEQ ID NO: 968337 - DNA, 22 bp, Homo sapiens
gaccagcctccatgctgcctcc

SEQ ID NO: 968338 - DNA, 12 bp, Homo sapiens
gaccagcctggc

SEQ ID NO: 968339 - DNA, 19 bp, Homo sapiens
gaccagcctgtaccttgct

SEQ ID NO: 968340 - DNA, 19 bp, Homo sapiens
gaccagcctgtcacccagc

SEQ ID NO: 968341 - DNA, 23 bp, Homo sapiens
gaccagcctgtcacccagctcct

SEQ ID NO: 968342 - DNA, 13 bp, Homo sapiens
gaccagctgctcc

SEQ ID NO: 968343 - DNA, 20 bp, Homo sapiens
gaccagctgctccgaggacc

SEQ ID NO: 968344 - DNA, 23 bp, Homo sapiens
gaccagctgctccgaggacccag

SEQ ID NO: 968345 - DNA, 16 bp, Homo sapiens
gaccagctggcctggg

SEQ ID NO: 968346 - DNA, 23 bp, Homo sapiens
gaccagctggggcgtggggaggg

SEQ ID NO: 968347 - DNA, 14 bp, Homo sapiens
gaccaggactatag

SEQ ID NO: 968348 - DNA, 14 bp, Homo sapiens
gaccaggactccct

SEQ ID NO: 968349 - DNA, 16 bp, Homo sapiens
gaccaggactccctcc

SEQ ID NO: 968350 - DNA, 23 bp, Homo sapiens
gaccaggactccctcctcacctc

SEQ ID NO: 968351 - DNA, 18 bp, Homo sapiens
gaccaggaggattgcctt

SEQ ID NO: 968352 - DNA, 22 bp, Homo sapiens
gaccaggatcccaagcctcctg

SEQ ID NO: 968353 - DNA, 19 bp, Homo sapiens
gaccaggccattctgccgc

SEQ ID NO: 968354 - DNA, 15 bp, Homo sapiens
gaccaggcccaagga

SEQ ID NO: 968355 - DNA, 15 bp, Homo sapiens
gaccaggctgcctcc

SEQ ID NO: 968356 - DNA, 13 bp, Homo sapiens
gaccaggctgtag

SEQ ID NO: 968357 - DNA, 15 bp, Homo sapiens
gaccaggctgtagga

SEQ ID NO: 968358 - DNA, 15 bp, Homo sapiens
gaccaggctgtgtcc

SEQ ID NO: 968359 - DNA, 14 bp, Homo sapiens
gaccagggagcctt

SEQ ID NO: 968360 - DNA, 15 bp, Homo sapiens
gaccagggagccttt

SEQ ID NO: 968361 - DNA, 22 bp, Homo sapiens
gaccagggatgggggatgggcc

SEQ ID NO: 968362 - DNA, 21 bp, Homo sapiens
gaccagggctccagcccctct

SEQ ID NO: 968363 - DNA, 23 bp, Homo sapiens
gaccagggcttttcccaggaata

SEQ ID NO: 968364 - DNA, 23 bp, Homo sapiens
gaccaggggtgatttcagagagg

SEQ ID NO: 968365 - DNA, 23 bp, Homo sapiens
gaccagggtggagctgagaagag

SEQ ID NO: 968366 - DNA, 21 bp, Homo sapiens
gaccaggttattttaaaaaga

SEQ ID NO: 968367 - DNA, 20 bp, Homo sapiens
gaccagtactgggaaggagg

SEQ ID NO: 968368 - DNA, 18 bp, Homo sapiens
gaccagtcaacctgggca

SEQ ID NO: 968369 - DNA, 15 bp, Homo sapiens
gaccagtctgaccct

SEQ ID NO: 968370 - DNA, 19 bp, Homo sapiens
gaccagtgagcgcttgggc

SEQ ID NO: 968371 - DNA, 22 bp, Homo sapiens
gaccagtggtttccagtcatga

SEQ ID NO: 968372 - DNA, 22 bp, Homo sapiens
gaccagttgaataaaagtgcac

SEQ ID NO: 968373 - DNA, 23 bp, Homo sapiens
gaccagttgaataaaagtgcaca

SEQ ID NO: 968374 - DNA, 14 bp, Homo sapiens
gaccagtttgcatg

SEQ ID NO: 968375 - DNA, 15 bp, Homo sapiens
gaccagtttgcatga

SEQ ID NO: 968376 - DNA, 19 bp, Homo sapiens
gaccataacagccaacagg

SEQ ID NO: 968377 - DNA, 20 bp, Homo sapiens
gaccataatgttacattatt

SEQ ID NO: 968378 - DNA, 12 bp, Homo sapiens
gaccataatttt

SEQ ID NO: 968379 - DNA, 19 bp, Homo sapiens
gaccatccactctaccctc

SEQ ID NO: 968380 - DNA, 23 bp, Homo sapiens
gaccatccactctaccctcccac

SEQ ID NO: 968381 - DNA, 14 bp, Homo sapiens
gaccatctgctgca

SEQ ID NO: 968382 - DNA, 18 bp, Homo sapiens
gaccatctgctgcagtta

SEQ ID NO: 968383 - DNA, 18 bp, Homo sapiens
gaccatcttcataatttg

SEQ ID NO: 968384 - DNA, 12 bp, Homo sapiens
gaccatgaaaca

SEQ ID NO: 968385 - DNA, 16 bp, Homo sapiens
gaccatgaggtggggg

SEQ ID NO: 968386 - DNA, 13 bp, Homo sapiens
gaccatgccagat

SEQ ID NO: 968387 - DNA, 15 bp, Homo sapiens
gaccatgccagattc

SEQ ID NO: 968388 - DNA, 23 bp, Homo sapiens
gaccatgccagattctgcctctc

SEQ ID NO: 968389 - DNA, 23 bp, Homo sapiens
gaccatggacactacacccagca

SEQ ID NO: 968390 - DNA, 22 bp, Homo sapiens
gaccatggccgaagccccttgg

SEQ ID NO: 968391 - DNA, 14 bp, Homo sapiens
gaccatgtggccac

SEQ ID NO: 968392 - DNA, 15 bp, Homo sapiens
gaccatgtgtcactt

SEQ ID NO: 968393 - DNA, 20 bp, Homo sapiens
gaccatgtgtcacttgtgct

SEQ ID NO: 968394 - DNA, 21 bp, Homo sapiens
gaccatgtgtcacttgtgctt

SEQ ID NO: 968395 - DNA, 17 bp, Homo sapiens
gaccattcctgtccctt

SEQ ID NO: 968396 - DNA, 11 bp, Homo sapiens
gaccattctgc

SEQ ID NO: 968397 - DNA, 15 bp, Homo sapiens
gaccattctgcctct

SEQ ID NO: 968398 - DNA, 14 bp, Homo sapiens
gaccattgacctca

SEQ ID NO: 968399 - DNA, 18 bp, Homo sapiens
gaccattgacctcagctg

SEQ ID NO: 968400 - DNA, 20 bp, Homo sapiens
gaccattgacctcagctgca

SEQ ID NO: 968401 - DNA, 21 bp, Homo sapiens
gaccatttataatgttagtag

SEQ ID NO: 968402 - DNA, 19 bp, Homo sapiens
gaccattttgttaaaatct

SEQ ID NO: 968403 - DNA, 19 bp, Homo sapiens
gacccaaaaatgttccctt

SEQ ID NO: 968404 - DNA, 14 bp, Homo sapiens
gacccaaaacacag

SEQ ID NO: 968405 - DNA, 14 bp, Homo sapiens
gacccaacttgcca

SEQ ID NO: 968406 - DNA, 12 bp, Homo sapiens
gacccacactgc

SEQ ID NO: 968407 - DNA, 19 bp, Homo sapiens
gacccggggtctcctggac

SEQ ID NO: 968408 - DNA, 15 bp, Homo sapiens
gacccggttgcagtc

SEQ ID NO: 968409 - DNA, 19 bp, Homo sapiens
gacccgtccattcttcagt

SEQ ID NO: 968410 - DNA, 14 bp, Homo sapiens
gaccctaccccacc

SEQ ID NO: 968411 - DNA, 16 bp, Homo sapiens
gaccctaccccaccac

SEQ ID NO: 968412 - DNA, 19 bp, Homo sapiens
gaccctcagccctggcctt

SEQ ID NO: 968413 - DNA, 23 bp, Homo sapiens
gaccctcagctgtcacctgctca

SEQ ID NO: 968414 - DNA, 16 bp, Homo sapiens
gaccctccactcactg

SEQ ID NO: 968415 - DNA, 14 bp, Homo sapiens
gaccctccagaggt

SEQ ID NO: 968416 - DNA, 12 bp, Homo sapiens
gaccctcccagt

SEQ ID NO: 968417 - DNA, 17 bp, Homo sapiens
gaccctccccgcacccc

SEQ ID NO: 968418 - DNA, 11 bp, Homo sapiens
gaccctcctgg

SEQ ID NO: 968419 - DNA, 17 bp, Homo sapiens
gaccctcctggccttcc

SEQ ID NO: 968420 - DNA, 18 bp, Homo sapiens
gaccctcctggccttcct

SEQ ID NO: 968421 - DNA, 21 bp, Homo sapiens
gaccctccttctattttccct

SEQ ID NO: 968422 - DNA, 20 bp, Homo sapiens
gaccctcgggccccatcctc

SEQ ID NO: 968423 - DNA, 15 bp, Homo sapiens
gaccctctgaatggt

SEQ ID NO: 968424 - DNA, 14 bp, Homo sapiens
gaccctctgggaac

SEQ ID NO: 968425 - DNA, 23 bp, Homo sapiens
gaccctctgggaacctcccagag

SEQ ID NO: 968426 - DNA, 18 bp, Homo sapiens
gaccctctgtccccaggc

SEQ ID NO: 968427 - DNA, 14 bp, Homo sapiens
tacaatacatatat

SEQ ID NO: 968428 - DNA, 13 bp, Homo sapiens
tacaatagaattt

SEQ ID NO: 968429 - DNA, 16 bp, Homo sapiens
tacaatcagttgactt

SEQ ID NO: 968430 - DNA, 19 bp, Homo sapiens
tacaatcatgaacagctct

SEQ ID NO: 968431 - DNA, 20 bp, Homo sapiens
tacaatcatggtcaagttcc

SEQ ID NO: 968432 - DNA, 22 bp, Homo sapiens
tacaatcatggtcaagttccca

SEQ ID NO: 968433 - DNA, 22 bp, Homo sapiens
tacaatcattgctgaaaatggt

SEQ ID NO: 968434 - DNA, 23 bp, Homo sapiens
tacaatcattgctgaaaatggta

SEQ ID NO: 968435 - DNA, 23 bp, Homo sapiens
tacaatcctgtttataatctgaa

SEQ ID NO: 968436 - DNA, 15 bp, Homo sapiens
tacaatgaacactta

SEQ ID NO: 968437 - DNA, 19 bp, Homo sapiens
tacaatgaactgcttttcc

SEQ ID NO: 968438 - DNA, 20 bp, Homo sapiens
tacaatgaactgcttttcct

SEQ ID NO: 968439 - DNA, 18 bp, Homo sapiens
tacaatgactttattgca

SEQ ID NO: 968440 - DNA, 13 bp, Homo sapiens
tacaatgctgtgc

SEQ ID NO: 968441 - DNA, 18 bp, Homo sapiens
tacaatggaataaattat

SEQ ID NO: 968442 - DNA, 22 bp, Homo sapiens
tacaatggcccgacatttcttc

SEQ ID NO: 968443 - DNA, 14 bp, Homo sapiens
tacaatggtttatt

SEQ ID NO: 968444 - DNA, 17 bp, Homo sapiens
tacaatggtttattccc

SEQ ID NO: 968445 - DNA, 23 bp, Homo sapiens
tacaatggtttattcccaagtat

SEQ ID NO: 968446 - DNA, 22 bp, Homo sapiens
tacaatgtacaattatgtctct

SEQ ID NO: 968447 - DNA, 20 bp, Homo sapiens
tacaatgtatctttattaaa

SEQ ID NO: 968448 - DNA, 21 bp, Homo sapiens
tacaatgtatctttattaaaa

SEQ ID NO: 968449 - DNA, 12 bp, Homo sapiens
tacaatgtatgt

SEQ ID NO: 968450 - DNA, 14 bp, Homo sapiens
tacaatgtatgtac

SEQ ID NO: 968451 - DNA, 16 bp, Homo sapiens
tacaatgtatgtacaa

SEQ ID NO: 968452 - DNA, 14 bp, Homo sapiens
tacaatgtgaactt

SEQ ID NO: 968453 - DNA, 20 bp, Homo sapiens
tacaatgtgaactttattaa

SEQ ID NO: 968454 - DNA, 13 bp, Homo sapiens
tacaatgttatca

SEQ ID NO: 968455 - DNA, 15 bp, Homo sapiens
tacaatgttatcaac

SEQ ID NO: 968456 - DNA, 20 bp, Homo sapiens
tacaatgttgtatttgttat

SEQ ID NO: 968457 - DNA, 13 bp, Homo sapiens
tacaatgttttat

SEQ ID NO: 968458 - DNA, 18 bp, Homo sapiens
tacaattactaaattgta

SEQ ID NO: 968459 - DNA, 19 bp, Homo sapiens
tacaattactaaattgtat

SEQ ID NO: 968460 - DNA, 16 bp, Homo sapiens
tacaattatgtctctt

SEQ ID NO: 968461 - DNA, 17 bp, Homo sapiens
tacaattatgtctcttg

SEQ ID NO: 968462 - DNA, 18 bp, Homo sapiens
tacaattatgtctcttga

SEQ ID NO: 968463 - DNA, 14 bp, Homo sapiens
tacaattgaaatga

SEQ ID NO: 968464 - DNA, 16 bp, Homo sapiens
tacaattgaaatgact

SEQ ID NO: 968465 - DNA, 20 bp, Homo sapiens
tacaattgagggaagtttga

SEQ ID NO: 968466 - DNA, 15 bp, Homo sapiens
tacaattgcactgct

SEQ ID NO: 968467 - DNA, 19 bp, Homo sapiens
tacaattgcactgctgttc

SEQ ID NO: 968468 - DNA, 15 bp, Homo sapiens
tacaatttacaaagt

SEQ ID NO: 968469 - DNA, 20 bp, Homo sapiens
tacaatttgttaattcctat

SEQ ID NO: 968470 - DNA, 14 bp, Homo sapiens
tacaattttaaagt

SEQ ID NO: 968471 - DNA, 18 bp, Homo sapiens
tacaattttaaagttctt

SEQ ID NO: 968472 - DNA, 19 bp, Homo sapiens
tacaattttctcccaggaa

SEQ ID NO: 968473 - DNA, 16 bp, Homo sapiens
tacaatttttaataaa

SEQ ID NO: 968474 - DNA, 13 bp, Homo sapiens
tacaatttttatt

SEQ ID NO: 968475 - DNA, 17 bp, Homo sapiens
tacaattttttatcatg

SEQ ID NO: 968476 - DNA, 23 bp, Homo sapiens
tacaattttttatcatgcatgtc

SEQ ID NO: 968477 - DNA, 14 bp, Homo sapiens
tacacaataagcaa

SEQ ID NO: 968478 - DNA, 22 bp, Homo sapiens
tacacaatatacgaaaagccag

SEQ ID NO: 968479 - DNA, 21 bp, Homo sapiens
tacacaattaattcatccctt

SEQ ID NO: 968480 - DNA, 15 bp, Homo sapiens
tacacaattaattgt

SEQ ID NO: 968481 - DNA, 13 bp, Homo sapiens
tacacacacacac

SEQ ID NO: 968482 - DNA, 16 bp, Homo sapiens
tacacacataccttca

SEQ ID NO: 968483 - DNA, 15 bp, Homo sapiens
tacacacatatacat

SEQ ID NO: 968484 - DNA, 16 bp, Homo sapiens
tacacacatgccctcc

SEQ ID NO: 968485 - DNA, 16 bp, Homo sapiens
tacacacccccagaga

SEQ ID NO: 968486 - DNA, 15 bp, Homo sapiens
tacacacccgcctga

SEQ ID NO: 968487 - DNA, 18 bp, Homo sapiens
tacacactggtacttaga

SEQ ID NO: 968488 - DNA, 15 bp, Homo sapiens
tacacagaaatgctg

SEQ ID NO: 968489 - DNA, 18 bp, Homo sapiens
tacacagaaatgctgctg

SEQ ID NO: 968490 - DNA, 16 bp, Homo sapiens
tacacagacccctccc

SEQ ID NO: 968491 - DNA, 17 bp, Homo sapiens
tacacagagaaggctat

SEQ ID NO: 968492 - DNA, 21 bp, Homo sapiens
tacacagagaaggctatgtaa

SEQ ID NO: 968493 - DNA, 18 bp, Homo sapiens
tacacagagcaggactgc

SEQ ID NO: 968494 - DNA, 20 bp, Homo sapiens
tacacagaggagtgcagcct

SEQ ID NO: 968495 - DNA, 23 bp, Homo sapiens
tacacaggatcctattctcacca

SEQ ID NO: 968496 - DNA, 13 bp, Homo sapiens
tacacagtacttt

SEQ ID NO: 968497 - DNA, 20 bp, Homo sapiens
tacacagtactttattgtac

SEQ ID NO: 968498 - DNA, 21 bp, Homo sapiens
tacacagtactttattgtaca

SEQ ID NO: 968499 - DNA, 23 bp, Homo sapiens
tacacagtactttattgtacaga

SEQ ID NO: 968500 - DNA, 17 bp, Homo sapiens
tacacagttaaataaat

SEQ ID NO: 968501 - DNA, 20 bp, Homo sapiens
tacacagttctggtgttcct

SEQ ID NO: 968502 - DNA, 11 bp, Homo sapiens
tacacagttgc

SEQ ID NO: 968503 - DNA, 21 bp, Homo sapiens
tacacataagaccgtgtccca

SEQ ID NO: 968504 - DNA, 18 bp, Homo sapiens
tacacataattttgtgca

SEQ ID NO: 968505 - DNA, 21 bp, Homo sapiens
tacacatacagaaagaagcag

SEQ ID NO: 968506 - DNA, 22 bp, Homo sapiens
tacacatacagaaagaagcagt

SEQ ID NO: 968507 - DNA, 11 bp, Homo sapiens
tacacatacat

SEQ ID NO: 968508 - DNA, 13 bp, Homo sapiens
tacacatacatac

SEQ ID NO: 968509 - DNA, 18 bp, Homo sapiens
tacacatacatacacata

SEQ ID NO: 968510 - DNA, 19 bp, Homo sapiens
tacacatacatacatacat

SEQ ID NO: 968511 - DNA, 17 bp, Homo sapiens
tacacatctcagaccct

SEQ ID NO: 968512 - DNA, 19 bp, Homo sapiens
tacacatgtaaaatatgta

SEQ ID NO: 968513 - DNA, 14 bp, Homo sapiens
tacacatgtgctga

SEQ ID NO: 968514 - DNA, 22 bp, Homo sapiens
tacacattttattttattatgc

SEQ ID NO: 968515 - DNA, 20 bp, Homo sapiens
tacaccaactcctaatttta

SEQ ID NO: 968516 - DNA, 22 bp, Homo sapiens
tacaccaatttggtaaaaatgc

SEQ ID NO: 968517 - DNA, 15 bp, Homo sapiens
tacaccactacattc

SEQ ID NO: 968518 - DNA, 20 bp, Homo sapiens
tacaccactgcaaaatgtct

SEQ ID NO: 968519 - DNA, 19 bp, Homo sapiens
tacaccagagataatatga

SEQ ID NO: 968520 - DNA, 21 bp, Homo sapiens
tacaccagcaatttagacaaa

SEQ ID NO: 968521 - DNA, 17 bp, Homo sapiens
tacaccagcattccttt

SEQ ID NO: 968522 - DNA, 14 bp, Homo sapiens
tacacccaaagagg

SEQ ID NO: 968523 - DNA, 22 bp, Homo sapiens
tacaccccaggacagtttatcc

SEQ ID NO: 968524 - DNA, 15 bp, Homo sapiens
tacacccctgtgctc

SEQ ID NO: 968525 - DNA, 12 bp, Homo sapiens
tacacctggacc

SEQ ID NO: 968526 - DNA, 15 bp, Homo sapiens
tacacctggctgagg

SEQ ID NO: 968527 - DNA, 19 bp, Homo sapiens
tacacgaatagacatcaaa

SEQ ID NO: 968528 - DNA, 21 bp, Homo sapiens
tacacggactgaggtgcctgc

SEQ ID NO: 968529 - DNA, 16 bp, Homo sapiens
tacaggagaggcagca

SEQ ID NO: 968530 - DNA, 15 bp, Homo sapiens
tacaggcatgagcca

SEQ ID NO: 968531 - DNA, 20 bp, Homo sapiens
tacaggcccgtgcccagccc

SEQ ID NO: 968532 - DNA, 18 bp, Homo sapiens
tacaggcgtgagccactg

SEQ ID NO: 968533 - DNA, 20 bp, Homo sapiens
tacaggctgacgttccgggc

SEQ ID NO: 968534 - DNA, 22 bp, Homo sapiens
tacaggctgacgttccgggcaa

SEQ ID NO: 968535 - DNA, 15 bp, Homo sapiens
tacaggggccatgcc

SEQ ID NO: 968536 - DNA, 21 bp, Homo sapiens
tacaggggccatgccccaccc

SEQ ID NO: 968537 - DNA, 18 bp, Homo sapiens
tacaggggttagcctgga

SEQ ID NO: 968538 - DNA, 18 bp, Homo sapiens
tacagggtagcaggtacc

SEQ ID NO: 968539 - DNA, 21 bp, Homo sapiens
tacagggtgctccttgtcaat

SEQ ID NO: 968540 - DNA, 23 bp, Homo sapiens
tacaggtgcatattaattttctt

SEQ ID NO: 968541 - DNA, 17 bp, Homo sapiens
tacaggttactaccctc

SEQ ID NO: 968542 - DNA, 16 bp, Homo sapiens
tacagtaactttatgt

SEQ ID NO: 968543 - DNA, 17 bp, Homo sapiens
tacagtaactttatgtg

SEQ ID NO: 968544 - DNA, 18 bp, Homo sapiens
tacagtaactttatgtgt

SEQ ID NO: 968545 - DNA, 20 bp, Homo sapiens
tacagtaactttatgtgtaa

SEQ ID NO: 968546 - DNA, 14 bp, Homo sapiens
tacagtaagctgct

SEQ ID NO: 968547 - DNA, 20 bp, Homo sapiens
tacagtaatatgtttaatgt

SEQ ID NO: 968548 - DNA, 18 bp, Homo sapiens
tacagtaatgtcataaag

SEQ ID NO: 968549 - DNA, 20 bp, Homo sapiens
tacagtacaatcagcagtct

SEQ ID NO: 968550 - DNA, 19 bp, Homo sapiens
tacagtacacatccccaga

SEQ ID NO: 968551 - DNA, 20 bp, Homo sapiens
tacagtaggagcccagctct

SEQ ID NO: 968552 - DNA, 22 bp, Homo sapiens
tacagtaggagcccagctctga

SEQ ID NO: 968553 - DNA, 15 bp, Homo sapiens
tacagtcatctgtct

SEQ ID NO: 968554 - DNA, 15 bp, Homo sapiens
tacagtctaaagctg

SEQ ID NO: 968555 - DNA, 16 bp, Homo sapiens
gacctcccctgaggct

SEQ ID NO: 968556 - DNA, 14 bp, Homo sapiens
gacctccctgtctc

SEQ ID NO: 968557 - DNA, 23 bp, Homo sapiens
gacctcccttccgaccctctggg

SEQ ID NO: 968558 - DNA, 15 bp, Homo sapiens
gacctccgcccctgc

SEQ ID NO: 968559 - DNA, 15 bp, Homo sapiens
gacctcctccctcat

SEQ ID NO: 968560 - DNA, 20 bp, Homo sapiens
gacctcctccctcattcatc

SEQ ID NO: 968561 - DNA, 21 bp, Homo sapiens
gacctcctccctcattcatct

SEQ ID NO: 968562 - DNA, 19 bp, Homo sapiens
gacctcctgtcactcactg

SEQ ID NO: 968563 - DNA, 16 bp, Homo sapiens
gacctcgtcctccccc

SEQ ID NO: 968564 - DNA, 19 bp, Homo sapiens
gacctcgtcctccccctgc

SEQ ID NO: 968565 - DNA, 21 bp, Homo sapiens
gacctcgtcctccccctgcca

SEQ ID NO: 968566 - DNA, 16 bp, Homo sapiens
gacctctagagctgga

SEQ ID NO: 968567 - DNA, 22 bp, Homo sapiens
gacctctcagcatagcctgcct

SEQ ID NO: 968568 - DNA, 23 bp, Homo sapiens
gacctctcagcatagcctgcctg

SEQ ID NO: 968569 - DNA, 19 bp, Homo sapiens
gacctctccagctctggct

SEQ ID NO: 968570 - DNA, 12 bp, Homo sapiens
gacctctcccag

SEQ ID NO: 968571 - DNA, 17 bp, Homo sapiens
gacctctctcagcccca

SEQ ID NO: 968572 - DNA, 19 bp, Homo sapiens
gacctctctcagccccatc

SEQ ID NO: 968573 - DNA, 13 bp, Homo sapiens
gacctctctgcct

SEQ ID NO: 968574 - DNA, 15 bp, Homo sapiens
gacctctctgcctct

SEQ ID NO: 968575 - DNA, 13 bp, Homo sapiens
gacctctgagcac

SEQ ID NO: 968576 - DNA, 18 bp, Homo sapiens
gacctctgcagcaataaa

SEQ ID NO: 968577 - DNA, 16 bp, Homo sapiens
gacctctgctctgagg

SEQ ID NO: 968578 - DNA, 17 bp, Homo sapiens
gacctctgctgagtgct

SEQ ID NO: 968579 - DNA, 19 bp, Homo sapiens
gacctctgctgagtgctgg

SEQ ID NO: 968580 - DNA, 21 bp, Homo sapiens
gacctctgctgagtgctgggc

SEQ ID NO: 968581 - DNA, 17 bp, Homo sapiens
gacctctgtaggcagca

SEQ ID NO: 968582 - DNA, 16 bp, Homo sapiens
gacctctgttgtcctc

SEQ ID NO: 968583 - DNA, 22 bp, Homo sapiens
gacctgaagagcgctcctctgc

SEQ ID NO: 968584 - DNA, 22 bp, Homo sapiens
gacctgacaccgtccctcagtg

SEQ ID NO: 968585 - DNA, 16 bp, Homo sapiens
gacctgagaatgtatc

SEQ ID NO: 968586 - DNA, 22 bp, Homo sapiens
gacctgagcccgcagcccagac

SEQ ID NO: 968587 - DNA, 20 bp, Homo sapiens
gacctgagcggcaccctggt

SEQ ID NO: 968588 - DNA, 23 bp, Homo sapiens
gacctgagcggcaccctggtctg

SEQ ID NO: 968589 - DNA, 14 bp, Homo sapiens
gacctgagctggga

SEQ ID NO: 968590 - DNA, 16 bp, Homo sapiens
gacctgaggcagatga

SEQ ID NO: 968591 - DNA, 14 bp, Homo sapiens
gacctgaggctgtg

SEQ ID NO: 968592 - DNA, 17 bp, Homo sapiens
gacctgaggctgtggtc

SEQ ID NO: 968593 - DNA, 22 bp, Homo sapiens
gacctgagtttgggagagtggt

SEQ ID NO: 968594 - DNA, 19 bp, Homo sapiens
gacctgatttcagaagaga

SEQ ID NO: 968595 - DNA, 23 bp, Homo sapiens
gacctgcagtgaggggccctcca

SEQ ID NO: 968596 - DNA, 16 bp, Homo sapiens
gacctgcattgtaaat

SEQ ID NO: 968597 - DNA, 21 bp, Homo sapiens
gacctgccaggcaggggtggg

SEQ ID NO: 968598 - DNA, 17 bp, Homo sapiens
gacctgcctagcatggg

SEQ ID NO: 968599 - DNA, 19 bp, Homo sapiens
gacctgcctcctgcctgcc

SEQ ID NO: 968600 - DNA, 20 bp, Homo sapiens
gacctgcctcctgcctgccc

SEQ ID NO: 968601 - DNA, 12 bp, Homo sapiens
gacctgcctgta

SEQ ID NO: 968602 - DNA, 16 bp, Homo sapiens
gacctgctccgccagg

SEQ ID NO: 968603 - DNA, 15 bp, Homo sapiens
gacctgctccgctgc

SEQ ID NO: 968604 - DNA, 18 bp, Homo sapiens
gacctgctccgctgctcc

SEQ ID NO: 968605 - DNA, 12 bp, Homo sapiens
gacctgctctgg

SEQ ID NO: 968606 - DNA, 18 bp, Homo sapiens
gacctgctgacctgtgca

SEQ ID NO: 968607 - DNA, 20 bp, Homo sapiens
gacctgcttagctgccttga

SEQ ID NO: 968608 - DNA, 16 bp, Homo sapiens
gacctggaactgtagg

SEQ ID NO: 968609 - DNA, 18 bp, Homo sapiens
gacctggagcccctgggt

SEQ ID NO: 968610 - DNA, 18 bp, Homo sapiens
gacctggcactggatgca

SEQ ID NO: 968611 - DNA, 11 bp, Homo sapiens
gacctggcctt

SEQ ID NO: 968612 - DNA, 16 bp, Homo sapiens
gacctggcctttcact

SEQ ID NO: 968613 - DNA, 16 bp, Homo sapiens
gacctggcgtgctcag

SEQ ID NO: 968614 - DNA, 18 bp, Homo sapiens
gacctgggacctcccctg

SEQ ID NO: 968615 - DNA, 13 bp, Homo sapiens
gacctggggcaca

SEQ ID NO: 968616 - DNA, 21 bp, Homo sapiens
gacctgggtatcccctgcctc

SEQ ID NO: 968617 - DNA, 17 bp, Homo sapiens
gacctggtgctgcctct

SEQ ID NO: 968618 - DNA, 21 bp, Homo sapiens
gacctggtgtgcggaggcagg

SEQ ID NO: 968619 - DNA, 22 bp, Homo sapiens
gacctggtgtgcggaggcagga

SEQ ID NO: 968620 - DNA, 24 bp, Homo sapiens
gacctggtgtgcggaggcaggagc

SEQ ID NO: 968621 - DNA, 14 bp, Homo sapiens
gacctggttcccac

SEQ ID NO: 968622 - DNA, 19 bp, Homo sapiens
gacctggtttgaatggaga

SEQ ID NO: 968623 - DNA, 13 bp, Homo sapiens
gacctggttttta

SEQ ID NO: 968624 - DNA, 15 bp, Homo sapiens
gacctgtcatgcccc

SEQ ID NO: 968625 - DNA, 21 bp, Homo sapiens
gacctgtcatgcccccctcaa

SEQ ID NO: 968626 - DNA, 10 bp, Homo sapiens
gacctgtcca

SEQ ID NO: 968627 - DNA, 13 bp, Homo sapiens
gacctgtccccca

SEQ ID NO: 968628 - DNA, 17 bp, Homo sapiens
gacctgtcccccactct

SEQ ID NO: 968629 - DNA, 18 bp, Homo sapiens
gacctgtcccccactctc

SEQ ID NO: 968630 - DNA, 24 bp, Homo sapiens
gacctgtcccccactctctcaccc

SEQ ID NO: 968631 - DNA, 18 bp, Homo sapiens
gacctgtcctctttgtga

SEQ ID NO: 968632 - DNA, 17 bp, Homo sapiens
gacctgtcttccaagga

SEQ ID NO: 968633 - DNA, 16 bp, Homo sapiens
gacctgtgagcccagc

SEQ ID NO: 968634 - DNA, 14 bp, Homo sapiens
gacctgtgcacacc

SEQ ID NO: 968635 - DNA, 13 bp, Homo sapiens
gacctgtgctagt

SEQ ID NO: 968636 - DNA, 20 bp, Homo sapiens
gacctgtgctagttttacag

SEQ ID NO: 968637 - DNA, 19 bp, Homo sapiens
gacctgtggccaagttctt

SEQ ID NO: 968638 - DNA, 21 bp, Homo sapiens
gacctgtggggatttctccca

SEQ ID NO: 968639 - DNA, 23 bp, Homo sapiens
gacctgtgttcttgctgagcacc

SEQ ID NO: 968640 - DNA, 18 bp, Homo sapiens
gacctgttagcagacagg

SEQ ID NO: 968641 - DNA, 14 bp, Homo sapiens
gacctgttggcctg

SEQ ID NO: 968642 - DNA, 20 bp, Homo sapiens
gacctgttggcctgtgggcc

SEQ ID NO: 968643 - DNA, 22 bp, Homo sapiens
gacctgttggcctgtgggcctc

SEQ ID NO: 968644 - DNA, 20 bp, Homo sapiens
gaccttaagacactgtgaga

SEQ ID NO: 968645 - DNA, 20 bp, Homo sapiens
gaccttagcgttctggactc

SEQ ID NO: 968646 - DNA, 18 bp, Homo sapiens
gaccttaggccttcctct

SEQ ID NO: 968647 - DNA, 14 bp, Homo sapiens
gaccttatctgtgc

SEQ ID NO: 968648 - DNA, 22 bp, Homo sapiens
gaccttatctgtgcgtgaaaca

SEQ ID NO: 968649 - DNA, 18 bp, Homo sapiens
gaccttcagagccagccg

SEQ ID NO: 968650 - DNA, 15 bp, Homo sapiens
gacgtggtgggactc

SEQ ID NO: 968651 - DNA, 20 bp, Homo sapiens
gacgttaggcatttcctgct

SEQ ID NO: 968652 - DNA, 12 bp, Homo sapiens
gacgtttctcat

SEQ ID NO: 968653 - DNA, 21 bp, Homo sapiens
gacgtttgcatagagagaaat

SEQ ID NO: 968654 - DNA, 12 bp, Homo sapiens
gacgttttctcc

SEQ ID NO: 968655 - DNA, 20 bp, Homo sapiens
gacgtttttgtgctgtgggc

SEQ ID NO: 968656 - DNA, 10 bp, Homo sapiens
gactaaagag

SEQ ID NO: 968657 - DNA, 17 bp, Homo sapiens
gactaaagagagaatgt

SEQ ID NO: 968658 - DNA, 19 bp, Homo sapiens
gactaaaggatccagagag

SEQ ID NO: 968659 - DNA, 12 bp, Homo sapiens
gactaaatgaaa

SEQ ID NO: 968660 - DNA, 18 bp, Homo sapiens
gactaaattttcttttaa

SEQ ID NO: 968661 - DNA, 17 bp, Homo sapiens
gactaacctatctatga

SEQ ID NO: 968662 - DNA, 18 bp, Homo sapiens
gactaactatcaaataga

SEQ ID NO: 968663 - DNA, 14 bp, Homo sapiens
gactaagccctgtc

SEQ ID NO: 968664 - DNA, 22 bp, Homo sapiens
gactaatagaaaagtatgttct

SEQ ID NO: 968665 - DNA, 23 bp, Homo sapiens
gactaatcagatgatggccattt

SEQ ID NO: 968666 - DNA, 15 bp, Homo sapiens
gactaatcttattca

SEQ ID NO: 968667 - DNA, 13 bp, Homo sapiens
gactaatgctttt

SEQ ID NO: 968668 - DNA, 20 bp, Homo sapiens
gactaatgttggacagacac

SEQ ID NO: 968669 - DNA, 18 bp, Homo sapiens
gactaattaaaatctgga

SEQ ID NO: 968670 - DNA, 15 bp, Homo sapiens
gactaattaggcaag

SEQ ID NO: 968671 - DNA, 22 bp, Homo sapiens
gactacccacgttctcacaccc

SEQ ID NO: 968672 - DNA, 16 bp, Homo sapiens
gactaccgcaggcccg

SEQ ID NO: 968673 - DNA, 15 bp, Homo sapiens
gactacctcagaaca

SEQ ID NO: 968674 - DNA, 16 bp, Homo sapiens
gactactactctgcca

SEQ ID NO: 968675 - DNA, 18 bp, Homo sapiens
gactactgctcctgtggc

SEQ ID NO: 968676 - DNA, 20 bp, Homo sapiens
gactacttgggagcaccgcc

SEQ ID NO: 968677 - DNA, 23 bp, Homo sapiens
gactagaagggccagtcctgcct

SEQ ID NO: 968678 - DNA, 18 bp, Homo sapiens
gactagaattctagtgct

SEQ ID NO: 968679 - DNA, 19 bp, Homo sapiens
gactagaattctagtgctg

SEQ ID NO: 968680 - DNA, 21 bp, Homo sapiens
gactagaattctagtgctgct

SEQ ID NO: 968681 - DNA, 15 bp, Homo sapiens
gactagagctttctt

SEQ ID NO: 968682 - DNA, 20 bp, Homo sapiens
gactagagggacctctccca

SEQ ID NO: 968683 - DNA, 14 bp, Homo sapiens
gactagatgatgga

SEQ ID NO: 968684 - DNA, 22 bp, Homo sapiens
tacatgtagagatttgagtgca

SEQ ID NO: 968685 - DNA, 23 bp, Homo sapiens
tacatgtcatttgactgtctcac

SEQ ID NO: 968686 - DNA, 19 bp, Homo sapiens
tacatgtgccgaatgtgca

SEQ ID NO: 968687 - DNA, 14 bp, Homo sapiens
tacatgtgtaaagg

SEQ ID NO: 968688 - DNA, 18 bp, Homo sapiens
tacatgtgtgaaaacaat

SEQ ID NO: 968689 - DNA, 17 bp, Homo sapiens
tacatgttcttgtcata

SEQ ID NO: 968690 - DNA, 23 bp, Homo sapiens
tacatgttcttgtcataaaatgc

SEQ ID NO: 968691 - DNA, 17 bp, Homo sapiens
tacatgttggaaatgtg

SEQ ID NO: 968692 - DNA, 15 bp, Homo sapiens
tacatgtttaaattg

SEQ ID NO: 968693 - DNA, 17 bp, Homo sapiens
tacatgtttaaattgta

SEQ ID NO: 968694 - DNA, 22 bp, Homo sapiens
tacatgtttaaattgtaaattt

SEQ ID NO: 968695 - DNA, 12 bp, Homo sapiens
tacatgtttgca

SEQ ID NO: 968696 - DNA, 15 bp, Homo sapiens
tacattaacggtgct

SEQ ID NO: 968697 - DNA, 17 bp, Homo sapiens
tacattaacggtgctaa

SEQ ID NO: 968698 - DNA, 19 bp, Homo sapiens
tacattaacggtgctaaaa

SEQ ID NO: 968699 - DNA, 14 bp, Homo sapiens
tacattaagtgggg

SEQ ID NO: 968700 - DNA, 18 bp, Homo sapiens
tacattaagtggggtaga

SEQ ID NO: 968701 - DNA, 23 bp, Homo sapiens
tacattaatgttaattcagcact

SEQ ID NO: 968702 - DNA, 14 bp, Homo sapiens
tacattatgcaaat

SEQ ID NO: 968703 - DNA, 23 bp, Homo sapiens
tacattcaacttttctaagaaaa

SEQ ID NO: 968704 - DNA, 14 bp, Homo sapiens
tacattcatcaata

SEQ ID NO: 968705 - DNA, 15 bp, Homo sapiens
tacattccatttcat

SEQ ID NO: 968706 - DNA, 22 bp, Homo sapiens
tacattcctaactagaattagt

SEQ ID NO: 968707 - DNA, 16 bp, Homo sapiens
tacattcctcagctgc

SEQ ID NO: 968708 - DNA, 17 bp, Homo sapiens
tacattctccagttgat

SEQ ID NO: 968709 - DNA, 12 bp, Homo sapiens
tacattctgtgt

SEQ ID NO: 968710 - DNA, 17 bp, Homo sapiens
tacattctgtgtgtatc

SEQ ID NO: 968711 - DNA, 19 bp, Homo sapiens
tacattcttggttgttaat

SEQ ID NO: 968712 - DNA, 15 bp, Homo sapiens
tacattgcttaaaat

SEQ ID NO: 968713 - DNA, 19 bp, Homo sapiens
tacattggaagcctgagca

SEQ ID NO: 968714 - DNA, 22 bp, Homo sapiens
tacattgtataggccatctgta

SEQ ID NO: 968715 - DNA, 13 bp, Homo sapiens
tacattgtcctgt

SEQ ID NO: 968716 - DNA, 15 bp, Homo sapiens
tacattgtgagctct

SEQ ID NO: 968717 - DNA, 23 bp, Homo sapiens
tacattgtgggatgttcagcact

SEQ ID NO: 968718 - DNA, 23 bp, Homo sapiens
tacattgtgtgaaaaaagaaaat

SEQ ID NO: 968719 - DNA, 15 bp, Homo sapiens
tacattgttcaatta

SEQ ID NO: 968720 - DNA, 23 bp, Homo sapiens
tacattgtttgtctgtcttcata

SEQ ID NO: 968721 - DNA, 15 bp, Homo sapiens
tacatttaaaacatt

SEQ ID NO: 968722 - DNA, 16 bp, Homo sapiens
tacatttaaaacatta

SEQ ID NO: 968723 - DNA, 21 bp, Homo sapiens
tacatttaaaattgctatgtt

SEQ ID NO: 968724 - DNA, 23 bp, Homo sapiens
tacatttaaaccttttattataa

SEQ ID NO: 968725 - DNA, 16 bp, Homo sapiens
tacatttaataaaact

SEQ ID NO: 968726 - DNA, 14 bp, Homo sapiens
tacatttagagtat

SEQ ID NO: 968727 - DNA, 16 bp, Homo sapiens
tacatttagagtattt

SEQ ID NO: 968728 - DNA, 18 bp, Homo sapiens
tacatttcatacaacaga

SEQ ID NO: 968729 - DNA, 21 bp, Homo sapiens
tacatttccaaattcacaagt

SEQ ID NO: 968730 - DNA, 21 bp, Homo sapiens
tacatttccatttattgtttg

SEQ ID NO: 968731 - DNA, 15 bp, Homo sapiens
tacatttctatttca

SEQ ID NO: 968732 - DNA, 18 bp, Homo sapiens
tacatttctatttcataa

SEQ ID NO: 968733 - DNA, 16 bp, Homo sapiens
tacatttctgaattgt

SEQ ID NO: 968734 - DNA, 23 bp, Homo sapiens
tacatttgagggcccagccagga

SEQ ID NO: 968735 - DNA, 12 bp, Homo sapiens
tacatttgtact

SEQ ID NO: 968736 - DNA, 13 bp, Homo sapiens
tacattttacaca

SEQ ID NO: 968737 - DNA, 11 bp, Homo sapiens
tacattttata

SEQ ID NO: 968738 - DNA, 14 bp, Homo sapiens
tacattttattctg

SEQ ID NO: 968739 - DNA, 14 bp, Homo sapiens
tacattttctaaat

SEQ ID NO: 968740 - DNA, 16 bp, Homo sapiens
tacattttctaaataa

SEQ ID NO: 968741 - DNA, 23 bp, Homo sapiens
tacattttctaaataaaaatatg

SEQ ID NO: 968742 - DNA, 23 bp, Homo sapiens
tacatttttaagtgctgcattta

SEQ ID NO: 968743 - DNA, 21 bp, Homo sapiens
tacatttttacaataaataat

SEQ ID NO: 968744 - DNA, 19 bp, Homo sapiens
tacatttttatttttggtt

SEQ ID NO: 968745 - DNA, 19 bp, Homo sapiens
tacattttttaaaactgaa

SEQ ID NO: 968746 - DNA, 14 bp, Homo sapiens
tacattttttttca

SEQ ID NO: 968747 - DNA, 17 bp, Homo sapiens
taccaaaaattgccaag

SEQ ID NO: 968748 - DNA, 21 bp, Homo sapiens
taccaaaaccatccatcccta

SEQ ID NO: 968749 - DNA, 13 bp, Homo sapiens
taccaaaatttta

SEQ ID NO: 968750 - DNA, 23 bp, Homo sapiens
taccaaaattttaaaaaagggag

SEQ ID NO: 968751 - DNA, 16 bp, Homo sapiens
taccaaacaaggaagc

SEQ ID NO: 968752 - DNA, 17 bp, Homo sapiens
taccaaacaaggaagcc

SEQ ID NO: 968753 - DNA, 23 bp, Homo sapiens
taccaaacaaggaagccaaagtt

SEQ ID NO: 968754 - DNA, 13 bp, Homo sapiens
taccaaacactca

SEQ ID NO: 968755 - DNA, 17 bp, Homo sapiens
taccaaacactcagtcc

SEQ ID NO: 968756 - DNA, 16 bp, Homo sapiens
taccaaagactatttc

SEQ ID NO: 968757 - DNA, 20 bp, Homo sapiens
taccaaagactatttcaaaa

SEQ ID NO: 968758 - DNA, 12 bp, Homo sapiens
taccaaagcaca

SEQ ID NO: 968759 - DNA, 22 bp, Homo sapiens
taccaaagtgtcttttgacatt

SEQ ID NO: 968760 - DNA, 19 bp, Homo sapiens
taccaaatgcctgttgtat

SEQ ID NO: 968761 - DNA, 23 bp, Homo sapiens
taccaaattaaaaaaaaattgta

SEQ ID NO: 968762 - DNA, 18 bp, Homo sapiens
taccaacctcatagagtt

SEQ ID NO: 968763 - DNA, 16 bp, Homo sapiens
taccaacggccaggaa

SEQ ID NO: 968764 - DNA, 19 bp, Homo sapiens
taccaacttcctctgccat

SEQ ID NO: 968765 - DNA, 17 bp, Homo sapiens
taccaactttctgtaaa

SEQ ID NO: 968766 - DNA, 19 bp, Homo sapiens
taccaactttctgtaaact

SEQ ID NO: 968767 - DNA, 15 bp, Homo sapiens
taccaagagtaactt

SEQ ID NO: 968768 - DNA, 17 bp, Homo sapiens
taccaagtatgaagtat

SEQ ID NO: 968769 - DNA, 16 bp, Homo sapiens
taccaagtgctgtctt

SEQ ID NO: 968770 - DNA, 13 bp, Homo sapiens
taccaataaactg

SEQ ID NO: 968771 - DNA, 15 bp, Homo sapiens
taccaatcattttaa

SEQ ID NO: 968772 - DNA, 13 bp, Homo sapiens
taccccctccttc

SEQ ID NO: 968773 - DNA, 17 bp, Homo sapiens
taccccctccttcagac

SEQ ID NO: 968774 - DNA, 20 bp, Homo sapiens
taccccctcttcaaagcaga

SEQ ID NO: 968775 - DNA, 21 bp, Homo sapiens
taccccctcttcaaagcagag

SEQ ID NO: 968776 - DNA, 17 bp, Homo sapiens
tacccctcttccagctt

SEQ ID NO: 968777 - DNA, 18 bp, Homo sapiens
tacccctggctgtactgc

SEQ ID NO: 968778 - DNA, 19 bp, Homo sapiens
taccccttagcctccctga

SEQ ID NO: 968779 - DNA, 20 bp, Homo sapiens
taccccttattgctgccaaa

SEQ ID NO: 968780 - DNA, 20 bp, Homo sapiens
taccccttcctgtcctgcct

SEQ ID NO: 968781 - DNA, 20 bp, Homo sapiens
tacccgaaagcatcactgcc

SEQ ID NO: 968782 - DNA, 23 bp, Homo sapiens
tacccgaaagcatcactgccttg

SEQ ID NO: 968783 - DNA, 14 bp, Homo sapiens
tacccgagcccagc

SEQ ID NO: 968784 - DNA, 19 bp, Homo sapiens
tacccgagcccagctacat

SEQ ID NO: 968785 - DNA, 13 bp, Homo sapiens
tacccggcccaga

SEQ ID NO: 968786 - DNA, 14 bp, Homo sapiens
taccctactgtggg

SEQ ID NO: 968787 - DNA, 18 bp, Homo sapiens
taccctagaagaaaaccc

SEQ ID NO: 968788 - DNA, 15 bp, Homo sapiens
taccctagccattcc

SEQ ID NO: 968789 - DNA, 16 bp, Homo sapiens
taccctagccattcct

SEQ ID NO: 968790 - DNA, 21 bp, Homo sapiens
taccctcaggcataggcctgg

SEQ ID NO: 968791 - DNA, 15 bp, Homo sapiens
taccctcatgttctt

SEQ ID NO: 968792 - DNA, 16 bp, Homo sapiens
taccctcatgttctta

SEQ ID NO: 968793 - DNA, 12 bp, Homo sapiens
taccctcccacc

SEQ ID NO: 968794 - DNA, 14 bp, Homo sapiens
taccctcccaccag

SEQ ID NO: 968795 - DNA, 13 bp, Homo sapiens
taccctcccaccc

SEQ ID NO: 968796 - DNA, 12 bp, Homo sapiens
taccctcctctg

SEQ ID NO: 968797 - DNA, 17 bp, Homo sapiens
taccctcctctgctggg

SEQ ID NO: 968798 - DNA, 19 bp, Homo sapiens
taccctcctctgctgggaa

SEQ ID NO: 968799 - DNA, 15 bp, Homo sapiens
taccctcctgtaaat

SEQ ID NO: 968800 - DNA, 17 bp, Homo sapiens
taccctcgggcccacct

SEQ ID NO: 968801 - DNA, 21 bp, Homo sapiens
taccctcgggcccacctggcc

SEQ ID NO: 968802 - DNA, 21 bp, Homo sapiens
taccctctcactagtgccaat

SEQ ID NO: 968803 - DNA, 13 bp, Homo sapiens
taccctctcagct

SEQ ID NO: 968804 - DNA, 16 bp, Homo sapiens
taccctctcagctcca

SEQ ID NO: 968805 - DNA, 20 bp, Homo sapiens
taccctctcagctccaggtg

SEQ ID NO: 968806 - DNA, 18 bp, Homo sapiens
taccctcttttaccaact

SEQ ID NO: 968807 - DNA, 19 bp, Homo sapiens
taccctcttttaccaactt

SEQ ID NO: 968808 - DNA, 20 bp, Homo sapiens
taccctgaagaaagggatgg

SEQ ID NO: 968809 - DNA, 17 bp, Homo sapiens
taccctgagttcatcca

SEQ ID NO: 968810 - DNA, 23 bp, Homo sapiens
taccctgcgcccagtccttccac

SEQ ID NO: 968811 - DNA, 20 bp, Homo sapiens
taccctggcactataatgta

SEQ ID NO: 968812 - DNA, 22 bp, Homo sapiens
taccctggcactataatgtaag

SEQ ID NO: 968813 - DNA, 19 bp, Homo sapiens
gactcggtttctccaaact

SEQ ID NO: 968814 - DNA, 15 bp, Homo sapiens
gactctaaagtctgt

SEQ ID NO: 968815 - DNA, 12 bp, Homo sapiens
gactctaaatgc

SEQ ID NO: 968816 - DNA, 23 bp, Homo sapiens
gactctaaatgcagttttaagaa

SEQ ID NO: 968817 - DNA, 23 bp, Homo sapiens
gactctaagatacactgcacttt

SEQ ID NO: 968818 - DNA, 23 bp, Homo sapiens
gactctacctcatatcagtttgc

SEQ ID NO: 968819 - DNA, 18 bp, Homo sapiens
gactctaggttatacaat

SEQ ID NO: 968820 - DNA, 14 bp, Homo sapiens
gactctattcttta

SEQ ID NO: 968821 - DNA, 20 bp, Homo sapiens
gactctcacactgaatcagc

SEQ ID NO: 968822 - DNA, 20 bp, Homo sapiens
gactctcagtctctgagcag

SEQ ID NO: 968823 - DNA, 22 bp, Homo sapiens
gactctcccaggcctgcctgca

SEQ ID NO: 968824 - DNA, 16 bp, Homo sapiens
gactctcctcctcccc

SEQ ID NO: 968825 - DNA, 18 bp, Homo sapiens
gactctcctcctcccctc

SEQ ID NO: 968826 - DNA, 15 bp, Homo sapiens
gactctgaaaaacat

SEQ ID NO: 968827 - DNA, 20 bp, Homo sapiens
gactctgaaaaacattccag

SEQ ID NO: 968828 - DNA, 18 bp, Homo sapiens
gactctgaaatctgaaga

SEQ ID NO: 968829 - DNA, 21 bp, Homo sapiens
gactctgatggaatgtgccac

SEQ ID NO: 968830 - DNA, 24 bp, Homo sapiens
gactctgatggaatgtgccacctg

SEQ ID NO: 968831 - DNA, 22 bp, Homo sapiens
gactctgcatcccagcacctgc

SEQ ID NO: 968832 - DNA, 11 bp, Homo sapiens
gactctgcccc

SEQ ID NO: 968833 - DNA, 12 bp, Homo sapiens
gactctgcccca

SEQ ID NO: 968834 - DNA, 16 bp, Homo sapiens
gactctgcctcctctt

SEQ ID NO: 968835 - DNA, 15 bp, Homo sapiens
gactctgcgggaggc

SEQ ID NO: 968836 - DNA, 18 bp, Homo sapiens
gactctgcgggaggctgg

SEQ ID NO: 968837 - DNA, 22 bp, Homo sapiens
gactctgcgggaggctggggcc

SEQ ID NO: 968838 - DNA, 13 bp, Homo sapiens
gactctgctgctc

SEQ ID NO: 968839 - DNA, 22 bp, Homo sapiens
gactctggactttctctaataa

SEQ ID NO: 968840 - DNA, 13 bp, Homo sapiens
gactctggcactt

SEQ ID NO: 968841 - DNA, 16 bp, Homo sapiens
gactctggcacttcca

SEQ ID NO: 968842 - DNA, 20 bp, Homo sapiens
gactctgggctatggacaca

SEQ ID NO: 968843 - DNA, 22 bp, Homo sapiens
gactctgggctatggacacagg

SEQ ID NO: 968844 - DNA, 18 bp, Homo sapiens
gactctgggtccctcgga

SEQ ID NO: 968845 - DNA, 21 bp, Homo sapiens
gactctgggttcgttggggac

SEQ ID NO: 968846 - DNA, 16 bp, Homo sapiens
gactctgtccagctcc

SEQ ID NO: 968847 - DNA, 17 bp, Homo sapiens
gactctgtggggccttg

SEQ ID NO: 968848 - DNA, 19 bp, Homo sapiens
gactcttcccctccctccc

SEQ ID NO: 968849 - DNA, 12 bp, Homo sapiens
gactcttcctgc

SEQ ID NO: 968850 - DNA, 11 bp, Homo sapiens
gactcttggag

SEQ ID NO: 968851 - DNA, 23 bp, Homo sapiens
gactctttattgtctgtaaatct

SEQ ID NO: 968852 - DNA, 13 bp, Homo sapiens
gactctttatttt

SEQ ID NO: 968853 - DNA, 23 bp, Homo sapiens
gactctttatttttctctttctc

SEQ ID NO: 968854 - DNA, 15 bp, Homo sapiens
gactctttcaaagaa

SEQ ID NO: 968855 - DNA, 16 bp, Homo sapiens
gactctttcaaagaaa

SEQ ID NO: 968856 - DNA, 19 bp, Homo sapiens
gactctttcaaagaaatcc

SEQ ID NO: 968857 - DNA, 19 bp, Homo sapiens
gactctttcctaaagccaa

SEQ ID NO: 968858 - DNA, 20 bp, Homo sapiens
gactctttctgaaggaagag

SEQ ID NO: 968859 - DNA, 21 bp, Homo sapiens
gactctttctgaaggaagaga

SEQ ID NO: 968860 - DNA, 22 bp, Homo sapiens
gactctttctgaaggaagagaa

SEQ ID NO: 968861 - DNA, 17 bp, Homo sapiens
gactcttttccttccct

SEQ ID NO: 968862 - DNA, 16 bp, Homo sapiens
gactctttttttgagt

SEQ ID NO: 968863 - DNA, 20 bp, Homo sapiens
gactctttttttgagtgaca

SEQ ID NO: 968864 - DNA, 18 bp, Homo sapiens
gactgaaaacctctcctc

SEQ ID NO: 968865 - DNA, 20 bp, Homo sapiens
gactgaaaatatataagctc

SEQ ID NO: 968866 - DNA, 19 bp, Homo sapiens
gactgaaaatattgtttta

SEQ ID NO: 968867 - DNA, 14 bp, Homo sapiens
gactgaaagaagaa

SEQ ID NO: 968868 - DNA, 20 bp, Homo sapiens
gactgaaagaagaaaacagt

SEQ ID NO: 968869 - DNA, 16 bp, Homo sapiens
gactgaaagaagaaca

SEQ ID NO: 968870 - DNA, 14 bp, Homo sapiens
gactgaaagcagca

SEQ ID NO: 968871 - DNA, 15 bp, Homo sapiens
gactgaaagcagcag

SEQ ID NO: 968872 - DNA, 18 bp, Homo sapiens
gactgaaatttagtacac

SEQ ID NO: 968873 - DNA, 16 bp, Homo sapiens
gactgaagcctgcagg

SEQ ID NO: 968874 - DNA, 16 bp, Homo sapiens
gactgaaggggcacac

SEQ ID NO: 968875 - DNA, 24 bp, Homo sapiens
gactgaaggggcacaccactgccc

SEQ ID NO: 968876 - DNA, 18 bp, Homo sapiens
gactgaatgttttattta

SEQ ID NO: 968877 - DNA, 16 bp, Homo sapiens
gactgaatttcttttg

SEQ ID NO: 968878 - DNA, 21 bp, Homo sapiens
gactgaccaatattgtacagt

SEQ ID NO: 968879 - DNA, 23 bp, Homo sapiens
gactgaccctgaggaggccgctt

SEQ ID NO: 968880 - DNA, 15 bp, Homo sapiens
gactgagaaccgtga

SEQ ID NO: 968881 - DNA, 18 bp, Homo sapiens
gactgagaaccgtgacat

SEQ ID NO: 968882 - DNA, 13 bp, Homo sapiens
gactgagaacttt

SEQ ID NO: 968883 - DNA, 21 bp, Homo sapiens
gactgagcaagaccctgtctc

SEQ ID NO: 968884 - DNA, 16 bp, Homo sapiens
gactgagcaccctctg

SEQ ID NO: 968885 - DNA, 16 bp, Homo sapiens
gactgagcacctgctt

SEQ ID NO: 968886 - DNA, 20 bp, Homo sapiens
gactgagcagccgccagctg

SEQ ID NO: 968887 - DNA, 21 bp, Homo sapiens
gactgagccaaggaggcctgg

SEQ ID NO: 968888 - DNA, 17 bp, Homo sapiens
gactgagccagtcccag

SEQ ID NO: 968889 - DNA, 13 bp, Homo sapiens
gactgagccccca

SEQ ID NO: 968890 - DNA, 15 bp, Homo sapiens
gactgagcccccacc

SEQ ID NO: 968891 - DNA, 16 bp, Homo sapiens
gactgagcccccaccg

SEQ ID NO: 968892 - DNA, 18 bp, Homo sapiens
gactgagctctccaggcc

SEQ ID NO: 968893 - DNA, 21 bp, Homo sapiens
gactgtcctcccacagacctg

SEQ ID NO: 968894 - DNA, 22 bp, Homo sapiens
gactgtcggagaggctgtctgg

SEQ ID NO: 968895 - DNA, 22 bp, Homo sapiens
gactgtctagccactccctccc

SEQ ID NO: 968896 - DNA, 23 bp, Homo sapiens
gactgtctagccactccctccca

SEQ ID NO: 968897 - DNA, 23 bp, Homo sapiens
gactgtctcaagagggcactggt

SEQ ID NO: 968898 - DNA, 18 bp, Homo sapiens
gactgtgaatttcaaaaa

SEQ ID NO: 968899 - DNA, 17 bp, Homo sapiens
gactgtgcctcaggcca

SEQ ID NO: 968900 - DNA, 22 bp, Homo sapiens
gactgtggccatatatgctgta

SEQ ID NO: 968901 - DNA, 14 bp, Homo sapiens
gactgtggctgcta

SEQ ID NO: 968902 - DNA, 15 bp, Homo sapiens
gactgtggctgctag

SEQ ID NO: 968903 - DNA, 18 bp, Homo sapiens
gactgtgggtggggaggc

SEQ ID NO: 968904 - DNA, 18 bp, Homo sapiens
gactgtggtaggggcagg

SEQ ID NO: 968905 - DNA, 22 bp, Homo sapiens
gactgtggtaggggcagggagg

SEQ ID NO: 968906 - DNA, 21 bp, Homo sapiens
gactgtgtctgcctgtcccca

SEQ ID NO: 968907 - DNA, 13 bp, Homo sapiens
gactgtgtgtgtg

SEQ ID NO: 968908 - DNA, 21 bp, Homo sapiens
gactgtgtttccaaaggttcc

SEQ ID NO: 968909 - DNA, 22 bp, Homo sapiens
gactgtgtttccaaaggttccc

SEQ ID NO: 968910 - DNA, 22 bp, Homo sapiens
gactgttagaaaatggacactg

SEQ ID NO: 968911 - DNA, 16 bp, Homo sapiens
gactgttccaggccct

SEQ ID NO: 968912 - DNA, 20 bp, Homo sapiens
gactgttccaggccctccag

SEQ ID NO: 968913 - DNA, 20 bp, Homo sapiens
gactgttccttatttctctc

SEQ ID NO: 968914 - DNA, 21 bp, Homo sapiens
gactgttccttatttctctct

SEQ ID NO: 968915 - DNA, 23 bp, Homo sapiens
gactgttccttatttctctctcc

SEQ ID NO: 968916 - DNA, 17 bp, Homo sapiens
gactgttgccccccagg

SEQ ID NO: 968917 - DNA, 17 bp, Homo sapiens
gactgttggctctctga

SEQ ID NO: 968918 - DNA, 19 bp, Homo sapiens
gactgttgtagcattttcc

SEQ ID NO: 968919 - DNA, 20 bp, Homo sapiens
gactgtttcattcactgtgc

SEQ ID NO: 968920 - DNA, 14 bp, Homo sapiens
gactgtttggctta

SEQ ID NO: 968921 - DNA, 22 bp, Homo sapiens
gactgtttggcttataaacaca

SEQ ID NO: 968922 - DNA, 16 bp, Homo sapiens
gactgttttctcttga

SEQ ID NO: 968923 - DNA, 19 bp, Homo sapiens
gactgttttttcctgagct

SEQ ID NO: 968924 - DNA, 21 bp, Homo sapiens
gactgttttttcctgagcttg

SEQ ID NO: 968925 - DNA, 15 bp, Homo sapiens
gacttaactttaact

SEQ ID NO: 968926 - DNA, 22 bp, Homo sapiens
gacttaactttaacttttgaaa

SEQ ID NO: 968927 - DNA, 21 bp, Homo sapiens
gacttaagcccagtgcactga

SEQ ID NO: 968928 - DNA, 14 bp, Homo sapiens
gacttaatgtgatt

SEQ ID NO: 968929 - DNA, 17 bp, Homo sapiens
gacttacaaaatgccaa

SEQ ID NO: 968930 - DNA, 14 bp, Homo sapiens
gacttaccaggaag

SEQ ID NO: 968931 - DNA, 12 bp, Homo sapiens
gacttactgtac

SEQ ID NO: 968932 - DNA, 18 bp, Homo sapiens
gacttactgtacatgaaa

SEQ ID NO: 968933 - DNA, 16 bp, Homo sapiens
gacttagaagtagtat

SEQ ID NO: 968934 - DNA, 22 bp, Homo sapiens
gacttagacctatactgaaaga

SEQ ID NO: 968935 - DNA, 20 bp, Homo sapiens
gacttagcgtcaagacattt

SEQ ID NO: 968936 - DNA, 17 bp, Homo sapiens
gacttagggcaccaggg

SEQ ID NO: 968937 - DNA, 18 bp, Homo sapiens
gacttattgccaaaaaca

SEQ ID NO: 968938 - DNA, 16 bp, Homo sapiens
gacttatttatataaa

SEQ ID NO: 968939 - DNA, 12 bp, Homo sapiens
gacttatttctg

SEQ ID NO: 968940 - DNA, 17 bp, Homo sapiens
gacttattttgtcttat

SEQ ID NO: 968941 - DNA, 22 bp, Homo sapiens
gacttcacactgcaagagcctt

SEQ ID NO: 968942 - DNA, 13 bp, Homo sapiens
taccttttttaga

SEQ ID NO: 968943 - DNA, 18 bp, Homo sapiens
taccttttttatacataa

SEQ ID NO: 968944 - DNA, 22 bp, Homo sapiens
taccttttttatacataaacaa

SEQ ID NO: 968945 - DNA, 21 bp, Homo sapiens
taccttttttgttttttcaaa

SEQ ID NO: 968946 - DNA, 15 bp, Homo sapiens
tacgaaaatcccatg

SEQ ID NO: 968947 - DNA, 20 bp, Homo sapiens
tacgagcacctccagcctga

SEQ ID NO: 968948 - DNA, 21 bp, Homo sapiens
tacgagcacctccagcctgaa

SEQ ID NO: 968949 - DNA, 14 bp, Homo sapiens
tacgatacgctact

SEQ ID NO: 968950 - DNA, 20 bp, Homo sapiens
tacgatcaagttgttgactg

SEQ ID NO: 968951 - DNA, 13 bp, Homo sapiens
tacgatgtttata

SEQ ID NO: 968952 - DNA, 15 bp, Homo sapiens
tacgcaaggaaggac

SEQ ID NO: 968953 - DNA, 16 bp, Homo sapiens
tacgcagaggaatttt

SEQ ID NO: 968954 - DNA, 21 bp, Homo sapiens
tacgcatcccatctctcccac

SEQ ID NO: 968955 - DNA, 15 bp, Homo sapiens
tacgcccaggacagc

SEQ ID NO: 968956 - DNA, 16 bp, Homo sapiens
tacgcccaggacagct

SEQ ID NO: 968957 - DNA, 20 bp, Homo sapiens
tacgctttgtcacacaaaaa

SEQ ID NO: 968958 - DNA, 17 bp, Homo sapiens
tacgcttttctttgtta

SEQ ID NO: 968959 - DNA, 15 bp, Homo sapiens
tacggagaaactcat

SEQ ID NO: 968960 - DNA, 17 bp, Homo sapiens
tacggattttcagttac

SEQ ID NO: 968961 - DNA, 14 bp, Homo sapiens
tacggcaaccacat

SEQ ID NO: 968962 - DNA, 21 bp, Homo sapiens
tacggcatcacacttatattt

SEQ ID NO: 968963 - DNA, 21 bp, Homo sapiens
tacggctatattggtttatgt

SEQ ID NO: 968964 - DNA, 21 bp, Homo sapiens
tacgggccagtttctctgcct

SEQ ID NO: 968965 - DNA, 22 bp, Homo sapiens
tacgggccagtttctctgcctt

SEQ ID NO: 968966 - DNA, 14 bp, Homo sapiens
tacgtacacatttt

SEQ ID NO: 968967 - DNA, 13 bp, Homo sapiens
tacgtataaatat

SEQ ID NO: 968968 - DNA, 17 bp, Homo sapiens
tacgtataatgctttct

SEQ ID NO: 968969 - DNA, 21 bp, Homo sapiens
tacgtcccagcggcctcaggg

SEQ ID NO: 968970 - DNA, 16 bp, Homo sapiens
tacgtcccgctgctgt

SEQ ID NO: 968971 - DNA, 18 bp, Homo sapiens
tacgtcccgctgctgtgc

SEQ ID NO: 968972 - DNA, 13 bp, Homo sapiens
tacgtctgccagg

SEQ ID NO: 968973 - DNA, 20 bp, Homo sapiens
tacgtgacctctgcaagaca

SEQ ID NO: 968974 - DNA, 16 bp, Homo sapiens
tacgtgcaaacaacct

SEQ ID NO: 968975 - DNA, 11 bp, Homo sapiens
tacgtgcattt

SEQ ID NO: 968976 - DNA, 12 bp, Homo sapiens
tacgtgcattta

SEQ ID NO: 968977 - DNA, 14 bp, Homo sapiens
tacgtgtcaaaaaa

SEQ ID NO: 968978 - DNA, 16 bp, Homo sapiens
tacgtgtcaatgtgtg

SEQ ID NO: 968979 - DNA, 16 bp, Homo sapiens
tacgtgttaggaggct

SEQ ID NO: 968980 - DNA, 22 bp, Homo sapiens
tacgtgttaggaggctgcatgc

SEQ ID NO: 968981 - DNA, 15 bp, Homo sapiens
tacgttattgttgac

SEQ ID NO: 968982 - DNA, 15 bp, Homo sapiens
tacgttcctattgtc

SEQ ID NO: 968983 - DNA, 22 bp, Homo sapiens
tacgttcctattgtcattaaag

SEQ ID NO: 968984 - DNA, 15 bp, Homo sapiens
tacgttcctggcccc

SEQ ID NO: 968985 - DNA, 14 bp, Homo sapiens
tacgttctctttaa

SEQ ID NO: 968986 - DNA, 13 bp, Homo sapiens
tacgttgtgcatt

SEQ ID NO: 968987 - DNA, 15 bp, Homo sapiens
tacgttgtgcatttg

SEQ ID NO: 968988 - DNA, 17 bp, Homo sapiens
tacgtttaaagtgcagt

SEQ ID NO: 968989 - DNA, 21 bp, Homo sapiens
tacgtttaaagtgcagtcatt

SEQ ID NO: 968990 - DNA, 14 bp, Homo sapiens
tacgtttgtatgtg

SEQ ID NO: 968991 - DNA, 16 bp, Homo sapiens
tacgttttgtgtatat

SEQ ID NO: 968992 - DNA, 18 bp, Homo sapiens
tactaaaaaaaagatgaa

SEQ ID NO: 968993 - DNA, 17 bp, Homo sapiens
tactaaaaagaaggaaa

SEQ ID NO: 968994 - DNA, 15 bp, Homo sapiens
tactaaaaagtataa

SEQ ID NO: 968995 - DNA, 12 bp, Homo sapiens
tactaaaaatac

SEQ ID NO: 968996 - DNA, 14 bp, Homo sapiens
tactaaaaatgcaa

SEQ ID NO: 968997 - DNA, 13 bp, Homo sapiens
tactaaaactcag

SEQ ID NO: 968998 - DNA, 18 bp, Homo sapiens
tactaaacattttgttat

SEQ ID NO: 968999 - DNA, 20 bp, Homo sapiens
tactaaagatatcagagctc

SEQ ID NO: 969000 - DNA, 18 bp, Homo sapiens
tactaaagcaaattgttt

SEQ ID NO: 969001 - DNA, 18 bp, Homo sapiens
tactaaatggtgttacat

SEQ ID NO: 969002 - DNA, 20 bp, Homo sapiens
tactaaattgtatacatttt

SEQ ID NO: 969003 - DNA, 18 bp, Homo sapiens
tactaaccttcatgcttt

SEQ ID NO: 969004 - DNA, 22 bp, Homo sapiens
tactaacgataaaaggtaataa

SEQ ID NO: 969005 - DNA, 16 bp, Homo sapiens
tactaactaaatacca

SEQ ID NO: 969006 - DNA, 16 bp, Homo sapiens
tactaacttttcaaca

SEQ ID NO: 969007 - DNA, 14 bp, Homo sapiens
tactaagaagaaaa

SEQ ID NO: 969008 - DNA, 16 bp, Homo sapiens
tactaagccaggaggc

SEQ ID NO: 969009 - DNA, 19 bp, Homo sapiens
tactaagccaggaggcttt

SEQ ID NO: 969010 - DNA, 13 bp, Homo sapiens
tactaaggaaaat

SEQ ID NO: 969011 - DNA, 16 bp, Homo sapiens
tactaaggacgttgtt

SEQ ID NO: 969012 - DNA, 18 bp, Homo sapiens
tactaaggagtaatctgt

SEQ ID NO: 969013 - DNA, 22 bp, Homo sapiens
tactaaggagtaatctgtgtac

SEQ ID NO: 969014 - DNA, 22 bp, Homo sapiens
tactccttaagaacacaaagcg

SEQ ID NO: 969015 - DNA, 12 bp, Homo sapiens
tactccttttgg

SEQ ID NO: 969016 - DNA, 21 bp, Homo sapiens
tactctaaaatggacattttc

SEQ ID NO: 969017 - DNA, 12 bp, Homo sapiens
tactctaaacaa

SEQ ID NO: 969018 - DNA, 16 bp, Homo sapiens
tactctaaagaaaaat

SEQ ID NO: 969019 - DNA, 16 bp, Homo sapiens
tactctaatcagtcct

SEQ ID NO: 969020 - DNA, 17 bp, Homo sapiens
tactctaatcagtcctt

SEQ ID NO: 969021 - DNA, 14 bp, Homo sapiens
tactctacactgaa

SEQ ID NO: 969022 - DNA, 19 bp, Homo sapiens
tactctacactgaaacgta

SEQ ID NO: 969023 - DNA, 16 bp, Homo sapiens
tactctaccctcttag

SEQ ID NO: 969024 - DNA, 17 bp, Homo sapiens
tactctacgccaaagtg

SEQ ID NO: 969025 - DNA, 13 bp, Homo sapiens
tactctagttctg

SEQ ID NO: 969026 - DNA, 22 bp, Homo sapiens
tactctcacactggttctcaat

SEQ ID NO: 969027 - DNA, 14 bp, Homo sapiens
tactctcattcttt

SEQ ID NO: 969028 - DNA, 13 bp, Homo sapiens
tactctccatatc

SEQ ID NO: 969029 - DNA, 15 bp, Homo sapiens
tactctccccacgag

SEQ ID NO: 969030 - DNA, 14 bp, Homo sapiens
tactctcctagaga

SEQ ID NO: 969031 - DNA, 22 bp, Homo sapiens
tactctcctggaaatattaaga

SEQ ID NO: 969032 - DNA, 23 bp, Homo sapiens
tactctcctggaaatattaagaa

SEQ ID NO: 969033 - DNA, 14 bp, Homo sapiens
tactctgaaaagca

SEQ ID NO: 969034 - DNA, 19 bp, Homo sapiens
tactctgaaacatggcctg

SEQ ID NO: 969035 - DNA, 22 bp, Homo sapiens
tactctgaagggcatcatgcat

SEQ ID NO: 969036 - DNA, 15 bp, Homo sapiens
tactctgagcccagg

SEQ ID NO: 969037 - DNA, 12 bp, Homo sapiens
tactctggcaaa

SEQ ID NO: 969038 - DNA, 13 bp, Homo sapiens
tactctgtagtct

SEQ ID NO: 969039 - DNA, 16 bp, Homo sapiens
tactctgtgtttaaaa

SEQ ID NO: 969040 - DNA, 16 bp, Homo sapiens
tactctgttgagtaaa

SEQ ID NO: 969041 - DNA, 19 bp, Homo sapiens
tactcttacagagccttga

SEQ ID NO: 969042 - DNA, 16 bp, Homo sapiens
tactcttcctgtccta

SEQ ID NO: 969043 - DNA, 16 bp, Homo sapiens
tactcttgatgtgaag

SEQ ID NO: 969044 - DNA, 14 bp, Homo sapiens
tactcttgctgatg

SEQ ID NO: 969045 - DNA, 19 bp, Homo sapiens
tactctttatttctagcag

SEQ ID NO: 969046 - DNA, 12 bp, Homo sapiens
tactctttccta

SEQ ID NO: 969047 - DNA, 14 bp, Homo sapiens
tactctttctgtat

SEQ ID NO: 969048 - DNA, 15 bp, Homo sapiens
tactctttctgtata

SEQ ID NO: 969049 - DNA, 16 bp, Homo sapiens
tactctttctgtatat

SEQ ID NO: 969050 - DNA, 14 bp, Homo sapiens
tactgaaaatccaa

SEQ ID NO: 969051 - DNA, 17 bp, Homo sapiens
tactgaaagatctctgt

SEQ ID NO: 969052 - DNA, 18 bp, Homo sapiens
tactgaaagatctctgtc

SEQ ID NO: 969053 - DNA, 22 bp, Homo sapiens
tactgaaagatctctgtcacat

SEQ ID NO: 969054 - DNA, 22 bp, Homo sapiens
tactgaaatttgttatacttca

SEQ ID NO: 969055 - DNA, 20 bp, Homo sapiens
tactgaacatctgagtcctg

SEQ ID NO: 969056 - DNA, 15 bp, Homo sapiens
tactgaaccagccac

SEQ ID NO: 969057 - DNA, 18 bp, Homo sapiens
tactgaagctttatttgc

SEQ ID NO: 969058 - DNA, 18 bp, Homo sapiens
tactgaaggaaaaacaca

SEQ ID NO: 969059 - DNA, 20 bp, Homo sapiens
tactgaaggaaaaacacaag

SEQ ID NO: 969060 - DNA, 14 bp, Homo sapiens
tactgaagtggctg

SEQ ID NO: 969061 - DNA, 16 bp, Homo sapiens
tactgaagtggctggt

SEQ ID NO: 969062 - DNA, 20 bp, Homo sapiens
tactgaagtggctggtagaa

SEQ ID NO: 969063 - DNA, 22 bp, Homo sapiens
tactgaagtggctggtagaaaa

SEQ ID NO: 969064 - DNA, 15 bp, Homo sapiens
tactgaataatatca

SEQ ID NO: 969065 - DNA, 19 bp, Homo sapiens
tactgaataatatcaaata

SEQ ID NO: 969066 - DNA, 13 bp, Homo sapiens
tactgaatattaa

SEQ ID NO: 969067 - DNA, 21 bp, Homo sapiens
tactgaatgaagcagtatttt

SEQ ID NO: 969068 - DNA, 18 bp, Homo sapiens
tactgacacttcctgtcc

SEQ ID NO: 969069 - DNA, 11 bp, Homo sapiens
tactgacctac

SEQ ID NO: 969070 - DNA, 17 bp, Homo sapiens
tactgactttgcttgct

SEQ ID NO: 969071 - DNA, 23 bp, Homo sapiens
tactgagccttgtaattctaaat

SEQ ID NO: 969072 - DNA, 17 bp, Homo sapiens
tactgagcttctctgtg

SEQ ID NO: 969073 - DNA, 23 bp, Homo sapiens
gacttttgatagttctataagaa

SEQ ID NO: 969074 - DNA, 21 bp, Homo sapiens
gacttttgcttaccttttcct

SEQ ID NO: 969075 - DNA, 16 bp, Homo sapiens
gactttttagccagtg

SEQ ID NO: 969076 - DNA, 14 bp, Homo sapiens
gacttttttataca

SEQ ID NO: 969077 - DNA, 19 bp, Homo sapiens
gactttttttaagctgaat

SEQ ID NO: 969078 - DNA, 13 bp, Homo sapiens
gactttttttgta

SEQ ID NO: 969079 - DNA, 18 bp, Homo sapiens
gagaaaaaaaaccttgta

SEQ ID NO: 969080 - DNA, 20 bp, Homo sapiens
gagaaaaaaaaccttgtaaa

SEQ ID NO: 969081 - DNA, 13 bp, Homo sapiens
gagaaaaaaacaa

SEQ ID NO: 969082 - DNA, 15 bp, Homo sapiens
gagaaaaactgttct

SEQ ID NO: 969083 - DNA, 16 bp, Homo sapiens
gagaaaaaggtgccat

SEQ ID NO: 969084 - DNA, 20 bp, Homo sapiens
gagaaaacatctcatcatgt

SEQ ID NO: 969085 - DNA, 18 bp, Homo sapiens
gagaaaacgccagtgtgt

SEQ ID NO: 969086 - DNA, 9 bp, Homo sapiens
gagaaaaga

SEQ ID NO: 969087 - DNA, 13 bp, Homo sapiens
gagaaaagaaaaa

SEQ ID NO: 969088 - DNA, 14 bp, Homo sapiens
gagaaaagaaaaaa

SEQ ID NO: 969089 - DNA, 14 bp, Homo sapiens
gagaaaagagagaa

SEQ ID NO: 969090 - DNA, 18 bp, Homo sapiens
gagaaaagcacacttgta

SEQ ID NO: 969091 - DNA, 18 bp, Homo sapiens
gagaaaaggctggagaga

SEQ ID NO: 969092 - DNA, 16 bp, Homo sapiens
gagaaaagggaaaaaa

SEQ ID NO: 969093 - DNA, 17 bp, Homo sapiens
gagaaaagggaaaaaag

SEQ ID NO: 969094 - DNA, 18 bp, Homo sapiens
gagaaaataaatttaact

SEQ ID NO: 969095 - DNA, 16 bp, Homo sapiens
gagaaaatatatgtat

SEQ ID NO: 969096 - DNA, 16 bp, Homo sapiens
gagaaaatcatcaaga

SEQ ID NO: 969097 - DNA, 16 bp, Homo sapiens
gagaaaatgaatttgg

SEQ ID NO: 969098 - DNA, 19 bp, Homo sapiens
gagaaaatgcgagactctg

SEQ ID NO: 969099 - DNA, 22 bp, Homo sapiens
gagaaaattggaactctactca

SEQ ID NO: 969100 - DNA, 15 bp, Homo sapiens
gagaaaatttatatc

SEQ ID NO: 969101 - DNA, 21 bp, Homo sapiens
gagaaaccttattgtacctct

SEQ ID NO: 969102 - DNA, 23 bp, Homo sapiens
gagaaaccttattgtacctctct

SEQ ID NO: 969103 - DNA, 17 bp, Homo sapiens
gagaaactcatcatttt

SEQ ID NO: 969104 - DNA, 19 bp, Homo sapiens
gagaaactggcaaagcaga

SEQ ID NO: 969105 - DNA, 24 bp, Homo sapiens
gagaaacttaaatgttattatctg

SEQ ID NO: 969106 - DNA, 13 bp, Homo sapiens
gagaaagaaaact

SEQ ID NO: 969107 - DNA, 15 bp, Homo sapiens
gagaaagaaaaggca

SEQ ID NO: 969108 - DNA, 16 bp, Homo sapiens
gagaaagaaaaggcaa

SEQ ID NO: 969109 - DNA, 22 bp, Homo sapiens
gagaaagaaaaggcaaaagact

SEQ ID NO: 969110 - DNA, 18 bp, Homo sapiens
gagaaagaagagacagga

SEQ ID NO: 969111 - DNA, 22 bp, Homo sapiens
gagaaagaccatgcatttaaag

SEQ ID NO: 969112 - DNA, 12 bp, Homo sapiens
gagaaagagaac

SEQ ID NO: 969113 - DNA, 18 bp, Homo sapiens
gagaaagagcacttaaga

SEQ ID NO: 969114 - DNA, 21 bp, Homo sapiens
gagaaagatctaagcagctgg

SEQ ID NO: 969115 - DNA, 16 bp, Homo sapiens
gagaaagcatattgac

SEQ ID NO: 969116 - DNA, 18 bp, Homo sapiens
gagaaagccgggggaggg

SEQ ID NO: 969117 - DNA, 14 bp, Homo sapiens
gagaaagctcaaag

SEQ ID NO: 969118 - DNA, 20 bp, Homo sapiens
gagaaagggatggtggagtg

SEQ ID NO: 969119 - DNA, 18 bp, Homo sapiens
gagaaagtgtgagcaaac

SEQ ID NO: 969120 - DNA, 23 bp, Homo sapiens
gagaaataaagtttgcttagaaa

SEQ ID NO: 969121 - DNA, 16 bp, Homo sapiens
gagaaatacagctggc

SEQ ID NO: 969122 - DNA, 17 bp, Homo sapiens
gagaaatacagctggct

SEQ ID NO: 969123 - DNA, 22 bp, Homo sapiens
gagaaatcatcctgttttctct

SEQ ID NO: 969124 - DNA, 15 bp, Homo sapiens
gagaaatgattgaca

SEQ ID NO: 969125 - DNA, 22 bp, Homo sapiens
gagaaatgcaataactctggga

SEQ ID NO: 969126 - DNA, 11 bp, Homo sapiens
gagaaattatt

SEQ ID NO: 969127 - DNA, 14 bp, Homo sapiens
gagaaattcttgtt

SEQ ID NO: 969128 - DNA, 11 bp, Homo sapiens
gagaaattggg

SEQ ID NO: 969129 - DNA, 17 bp, Homo sapiens
gagaacaaacagatcga

SEQ ID NO: 969130 - DNA, 22 bp, Homo sapiens
gagaacaagtcacagctgcagc

SEQ ID NO: 969131 - DNA, 23 bp, Homo sapiens
gagaacaagtcacagctgcagct

SEQ ID NO: 969132 - DNA, 20 bp, Homo sapiens
gagaacagtttcatcaggac

SEQ ID NO: 969133 - DNA, 13 bp, Homo sapiens
gagaaccaaatct

SEQ ID NO: 969134 - DNA, 19 bp, Homo sapiens
gagaaccactacatgcagc

SEQ ID NO: 969135 - DNA, 19 bp, Homo sapiens
gagaaccagtctcctcact

SEQ ID NO: 969136 - DNA, 12 bp, Homo sapiens
gagacaggcagc

SEQ ID NO: 969137 - DNA, 13 bp, Homo sapiens
gagacaggcagcc

SEQ ID NO: 969138 - DNA, 16 bp, Homo sapiens
gagacaggcagcccag

SEQ ID NO: 969139 - DNA, 16 bp, Homo sapiens
gagacagggctgctcc

SEQ ID NO: 969140 - DNA, 13 bp, Homo sapiens
gagacagggtttg

SEQ ID NO: 969141 - DNA, 17 bp, Homo sapiens
gagacagtcctttccca

SEQ ID NO: 969142 - DNA, 17 bp, Homo sapiens
gagacagttgagagcgg

SEQ ID NO: 969143 - DNA, 21 bp, Homo sapiens
gagacagtttactttgccaac

SEQ ID NO: 969144 - DNA, 23 bp, Homo sapiens
gagacatcaaaaccaccctaacc

SEQ ID NO: 969145 - DNA, 19 bp, Homo sapiens
gagacatggaccagcatct

SEQ ID NO: 969146 - DNA, 21 bp, Homo sapiens
gagacatggaccagcatctgg

SEQ ID NO: 969147 - DNA, 18 bp, Homo sapiens
gagacatgtaccttgacc

SEQ ID NO: 969148 - DNA, 16 bp, Homo sapiens
gagacattaactcatt

SEQ ID NO: 969149 - DNA, 14 bp, Homo sapiens
gagaccaacctgac

SEQ ID NO: 969150 - DNA, 19 bp, Homo sapiens
gagaccaacttttcaatgt

SEQ ID NO: 969151 - DNA, 18 bp, Homo sapiens
gagaccacccatatcatg

SEQ ID NO: 969152 - DNA, 14 bp, Homo sapiens
gagaccagcctggc

SEQ ID NO: 969153 - DNA, 16 bp, Homo sapiens
gagaccagcctgggca

SEQ ID NO: 969154 - DNA, 19 bp, Homo sapiens
gagaccagcctgggcagca

SEQ ID NO: 969155 - DNA, 13 bp, Homo sapiens
gagaccagggctc

SEQ ID NO: 969156 - DNA, 21 bp, Homo sapiens
gagaccagggtcttacctctc

SEQ ID NO: 969157 - DNA, 24 bp, Homo sapiens
gagaccagggtcttacctctctgg

SEQ ID NO: 969158 - DNA, 21 bp, Homo sapiens
gagaccagttgggagcactgg

SEQ ID NO: 969159 - DNA, 22 bp, Homo sapiens
gagaccatttgtattaccatta

SEQ ID NO: 969160 - DNA, 19 bp, Homo sapiens
gagacccaacagcagtgat

SEQ ID NO: 969161 - DNA, 23 bp, Homo sapiens
gagacccccccccaactccagga

SEQ ID NO: 969162 - DNA, 14 bp, Homo sapiens
gagacccctgtctc

SEQ ID NO: 969163 - DNA, 17 bp, Homo sapiens
gagaccccttcctttcc

SEQ ID NO: 969164 - DNA, 19 bp, Homo sapiens
gagaccccttcctttcctc

SEQ ID NO: 969165 - DNA, 20 bp, Homo sapiens
gagaccctactgaagtggct

SEQ ID NO: 969166 - DNA, 16 bp, Homo sapiens
gagaccctgcaagacc

SEQ ID NO: 969167 - DNA, 15 bp, Homo sapiens
gagaccctgccacag

SEQ ID NO: 969168 - DNA, 21 bp, Homo sapiens
gagaccctgccacagccagag

SEQ ID NO: 969169 - DNA, 15 bp, Homo sapiens
gagaccgagtgaacc

SEQ ID NO: 969170 - DNA, 20 bp, Homo sapiens
gagaccgcttcacccctgca

SEQ ID NO: 969171 - DNA, 20 bp, Homo sapiens
gagaccggggtatcctgggg

SEQ ID NO: 969172 - DNA, 16 bp, Homo sapiens
gagacctatgtaagaa

SEQ ID NO: 969173 - DNA, 15 bp, Homo sapiens
gagacctcagccatg

SEQ ID NO: 969174 - DNA, 11 bp, Homo sapiens
gagacctcatc

SEQ ID NO: 969175 - DNA, 12 bp, Homo sapiens
gagacctcatca

SEQ ID NO: 969176 - DNA, 18 bp, Homo sapiens
gagacctcatcaggatga

SEQ ID NO: 969177 - DNA, 21 bp, Homo sapiens
gagacctcatcaggatgaacc

SEQ ID NO: 969178 - DNA, 13 bp, Homo sapiens
gagacctcatcct

SEQ ID NO: 969179 - DNA, 22 bp, Homo sapiens
gagacctccaataaagtgcctt

SEQ ID NO: 969180 - DNA, 18 bp, Homo sapiens
gagacctgccctcaagag

SEQ ID NO: 969181 - DNA, 19 bp, Homo sapiens
gagacctggaaccagagcc

SEQ ID NO: 969182 - DNA, 18 bp, Homo sapiens
gagacctgttggcctgtg

SEQ ID NO: 969183 - DNA, 22 bp, Homo sapiens
gagacctgttggcctgtgggcc

SEQ ID NO: 969184 - DNA, 22 bp, Homo sapiens
gagacctttgatgaattcttcc

SEQ ID NO: 969185 - DNA, 23 bp, Homo sapiens
gagacgaagtgaaaacaaatcta

SEQ ID NO: 969186 - DNA, 20 bp, Homo sapiens
gagacgccactccctgggac

SEQ ID NO: 969187 - DNA, 21 bp, Homo sapiens
gagacgccactccctgggaca

SEQ ID NO: 969188 - DNA, 22 bp, Homo sapiens
gagacggcgattttcgggctga

SEQ ID NO: 969189 - DNA, 13 bp, Homo sapiens
gagacgggcatcg

SEQ ID NO: 969190 - DNA, 19 bp, Homo sapiens
gagacgggcatcgcaggag

SEQ ID NO: 969191 - DNA, 21 bp, Homo sapiens
gagacggggtctccctgtgtt

SEQ ID NO: 969192 - DNA, 22 bp, Homo sapiens
gagacggggtctccctgtgtta

SEQ ID NO: 969193 - DNA, 16 bp, Homo sapiens
gagacggggtttcacc

SEQ ID NO: 969194 - DNA, 15 bp, Homo sapiens
gagacgtggtgggac

SEQ ID NO: 969195 - DNA, 15 bp, Homo sapiens
gagactaagccctgt

SEQ ID NO: 969196 - DNA, 15 bp, Homo sapiens
gagactactaagagg

SEQ ID NO: 969197 - DNA, 16 bp, Homo sapiens
gagactagattgcctt

SEQ ID NO: 969198 - DNA, 15 bp, Homo sapiens
gagactatggcctcg

SEQ ID NO: 969199 - DNA, 16 bp, Homo sapiens
gagactcacctctgcc

SEQ ID NO: 969200 - DNA, 21 bp, Homo sapiens
gagactcagggccccagcact

SEQ ID NO: 969201 - DNA, 15 bp, Homo sapiens
gagactccacctcaa

SEQ ID NO: 969202 - DNA, 14 bp, Homo sapiens
tactgttttgggcc

SEQ ID NO: 969203 - DNA, 23 bp, Homo sapiens
tacttaaaaatagtcttccacaa

SEQ ID NO: 969204 - DNA, 18 bp, Homo sapiens
tacttaaaaatttattag

SEQ ID NO: 969205 - DNA, 13 bp, Homo sapiens
tacttaaaatgac

SEQ ID NO: 969206 - DNA, 16 bp, Homo sapiens
tacttaaagttgattt

SEQ ID NO: 969207 - DNA, 12 bp, Homo sapiens
tacttaaataaa

SEQ ID NO: 969208 - DNA, 19 bp, Homo sapiens
tacttaaatatatatttct

SEQ ID NO: 969209 - DNA, 12 bp, Homo sapiens
tacttaagactt

SEQ ID NO: 969210 - DNA, 14 bp, Homo sapiens
tacttaagacttaa

SEQ ID NO: 969211 - DNA, 17 bp, Homo sapiens
tacttaataaattcaga

SEQ ID NO: 969212 - DNA, 14 bp, Homo sapiens
tacttaatctaaga

SEQ ID NO: 969213 - DNA, 16 bp, Homo sapiens
tacttaatctaagaaa

SEQ ID NO: 969214 - DNA, 21 bp, Homo sapiens
tacttaatgtaattcaggact

SEQ ID NO: 969215 - DNA, 22 bp, Homo sapiens
tacttacctaaacagatataaa

SEQ ID NO: 969216 - DNA, 20 bp, Homo sapiens
tacttagaatgccataaaat

SEQ ID NO: 969217 - DNA, 22 bp, Homo sapiens
tacttagaatgccataaaattg

SEQ ID NO: 969218 - DNA, 18 bp, Homo sapiens
tacttagagtttctgttt

SEQ ID NO: 969219 - DNA, 19 bp, Homo sapiens
tacttagagtttctgtttg

SEQ ID NO: 969220 - DNA, 21 bp, Homo sapiens
tacttagcaagacctgaaaat

SEQ ID NO: 969221 - DNA, 18 bp, Homo sapiens
tacttagctgtactataa

SEQ ID NO: 969222 - DNA, 18 bp, Homo sapiens
tacttaggttattttgct

SEQ ID NO: 969223 - DNA, 20 bp, Homo sapiens
tacttaggttattttgcttt

SEQ ID NO: 969224 - DNA, 14 bp, Homo sapiens
tacttataaagaag

SEQ ID NO: 969225 - DNA, 16 bp, Homo sapiens
tacttatatggaaatt

SEQ ID NO: 969226 - DNA, 15 bp, Homo sapiens
tacttatcatttttg

SEQ ID NO: 969227 - DNA, 13 bp, Homo sapiens
tacttatttaact

SEQ ID NO: 969228 - DNA, 14 bp, Homo sapiens
tacttatttaactg

SEQ ID NO: 969229 - DNA, 18 bp, Homo sapiens
tacttatttacctataaa

SEQ ID NO: 969230 - DNA, 17 bp, Homo sapiens
tacttatttttgacagt

SEQ ID NO: 969231 - DNA, 16 bp, Homo sapiens
tacttcaaaagccata

SEQ ID NO: 969232 - DNA, 22 bp, Homo sapiens
tacttcaaaagtttgtttgctt

SEQ ID NO: 969233 - DNA, 18 bp, Homo sapiens
tacttcaagttaaagtga

SEQ ID NO: 969234 - DNA, 20 bp, Homo sapiens
tacttcactatacaaacaaa

SEQ ID NO: 969235 - DNA, 19 bp, Homo sapiens
tacttcaggggcacttcat

SEQ ID NO: 969236 - DNA, 14 bp, Homo sapiens
tacttcaggtgctt

SEQ ID NO: 969237 - DNA, 18 bp, Homo sapiens
tacttcagtatgtgtcaa

SEQ ID NO: 969238 - DNA, 21 bp, Homo sapiens
tacttccataggacatactgc

SEQ ID NO: 969239 - DNA, 14 bp, Homo sapiens
tacttcccaaagcc

SEQ ID NO: 969240 - DNA, 14 bp, Homo sapiens
tacttccccttctt

SEQ ID NO: 969241 - DNA, 21 bp, Homo sapiens
tacttcccgggccagggctgc

SEQ ID NO: 969242 - DNA, 17 bp, Homo sapiens
tacttcctggcctcttc

SEQ ID NO: 969243 - DNA, 20 bp, Homo sapiens
tacttctcattttttaaaaa

SEQ ID NO: 969244 - DNA, 16 bp, Homo sapiens
tacttcttatacattt

SEQ ID NO: 969245 - DNA, 14 bp, Homo sapiens
tacttcttattgca

SEQ ID NO: 969246 - DNA, 14 bp, Homo sapiens
tacttcttctgtaa

SEQ ID NO: 969247 - DNA, 13 bp, Homo sapiens
tacttcttgaata

SEQ ID NO: 969248 - DNA, 20 bp, Homo sapiens
tacttcttgaatataaaaaa

SEQ ID NO: 969249 - DNA, 16 bp, Homo sapiens
tacttctttagcattt

SEQ ID NO: 969250 - DNA, 15 bp, Homo sapiens
tacttgaaaaagtaa

SEQ ID NO: 969251 - DNA, 17 bp, Homo sapiens
tacttgacctctgtgac

SEQ ID NO: 969252 - DNA, 20 bp, Homo sapiens
tacttgacctctgtgaccaa

SEQ ID NO: 969253 - DNA, 16 bp, Homo sapiens
tacttgactcagtgat

SEQ ID NO: 969254 - DNA, 21 bp, Homo sapiens
tacttgaggaaaacactattt

SEQ ID NO: 969255 - DNA, 12 bp, Homo sapiens
tacttgcaacta

SEQ ID NO: 969256 - DNA, 13 bp, Homo sapiens
tacttgcaactaa

SEQ ID NO: 969257 - DNA, 22 bp, Homo sapiens
tacttgcaactaaggacaaatt

SEQ ID NO: 969258 - DNA, 14 bp, Homo sapiens
tagaaacattgtaa

SEQ ID NO: 969259 - DNA, 14 bp, Homo sapiens
tagaaaccttaata

SEQ ID NO: 969260 - DNA, 19 bp, Homo sapiens
tagaaactcaccatgtaaa

SEQ ID NO: 969261 - DNA, 20 bp, Homo sapiens
tagaaactctggctcagcct

SEQ ID NO: 969262 - DNA, 16 bp, Homo sapiens
tagaaagaaactaaac

SEQ ID NO: 969263 - DNA, 17 bp, Homo sapiens
tagaaagagatacagag

SEQ ID NO: 969264 - DNA, 23 bp, Homo sapiens
tagaaagcctgttcccctcactg

SEQ ID NO: 969265 - DNA, 18 bp, Homo sapiens
tagaaagctgacattgcc

SEQ ID NO: 969266 - DNA, 20 bp, Homo sapiens
tagaaaggagagaacgggcg

SEQ ID NO: 969267 - DNA, 19 bp, Homo sapiens
tagaaataaatagctatat

SEQ ID NO: 969268 - DNA, 22 bp, Homo sapiens
tagaaataagtggttatttctc

SEQ ID NO: 969269 - DNA, 23 bp, Homo sapiens
tagaaatacccaacgcacaaatg

SEQ ID NO: 969270 - DNA, 11 bp, Homo sapiens
tagaaatcata

SEQ ID NO: 969271 - DNA, 13 bp, Homo sapiens
tagaaatcatttt

SEQ ID NO: 969272 - DNA, 13 bp, Homo sapiens
tagaaatgcatat

SEQ ID NO: 969273 - DNA, 17 bp, Homo sapiens
tagaaatgccagaaaca

SEQ ID NO: 969274 - DNA, 18 bp, Homo sapiens
tagaaatggtttcctctg

SEQ ID NO: 969275 - DNA, 19 bp, Homo sapiens
tagaaatggtttcctctgg

SEQ ID NO: 969276 - DNA, 23 bp, Homo sapiens
tagaaattagaaaaaaattacta

SEQ ID NO: 969277 - DNA, 14 bp, Homo sapiens
tagaaatttccaga

SEQ ID NO: 969278 - DNA, 17 bp, Homo sapiens
tagaaattttacaatag

SEQ ID NO: 969279 - DNA, 13 bp, Homo sapiens
tagaaattttcaa

SEQ ID NO: 969280 - DNA, 16 bp, Homo sapiens
tagaaattttgtaaga

SEQ ID NO: 969281 - DNA, 19 bp, Homo sapiens
tagaaatttttcagatgct

SEQ ID NO: 969282 - DNA, 20 bp, Homo sapiens
tagaacaaaggacagagtat

SEQ ID NO: 969283 - DNA, 18 bp, Homo sapiens
tagaacaatgggaggctg

SEQ ID NO: 969284 - DNA, 17 bp, Homo sapiens
tagaacacacacactta

SEQ ID NO: 969285 - DNA, 16 bp, Homo sapiens
tagaacactaactcac

SEQ ID NO: 969286 - DNA, 20 bp, Homo sapiens
tagaacactgcctctgagtt

SEQ ID NO: 969287 - DNA, 19 bp, Homo sapiens
tagaacacttcagacacag

SEQ ID NO: 969288 - DNA, 18 bp, Homo sapiens
tagaacataaagcaaata

SEQ ID NO: 969289 - DNA, 17 bp, Homo sapiens
tagaacatccctgggca

SEQ ID NO: 969290 - DNA, 21 bp, Homo sapiens
tagaacatgcacatttatata

SEQ ID NO: 969291 - DNA, 21 bp, Homo sapiens
tagaacattcacttttgttaa

SEQ ID NO: 969292 - DNA, 16 bp, Homo sapiens
tagaaccactatgaag

SEQ ID NO: 969293 - DNA, 14 bp, Homo sapiens
tagaactagccaaa

SEQ ID NO: 969294 - DNA, 14 bp, Homo sapiens
tagaactatcattt

SEQ ID NO: 969295 - DNA, 12 bp, Homo sapiens
tagaactatctg

SEQ ID NO: 969296 - DNA, 17 bp, Homo sapiens
tagaactcactctgggc

SEQ ID NO: 969297 - DNA, 17 bp, Homo sapiens
tagaactcagcagttga

SEQ ID NO: 969298 - DNA, 19 bp, Homo sapiens
tagaactccaggccctcct

SEQ ID NO: 969299 - DNA, 19 bp, Homo sapiens
tagaactttaagcaacaag

SEQ ID NO: 969300 - DNA, 13 bp, Homo sapiens
tagaagaaaaccc

SEQ ID NO: 969301 - DNA, 16 bp, Homo sapiens
tagaagaaaagcccat

SEQ ID NO: 969302 - DNA, 12 bp, Homo sapiens
tagaagaaaata

SEQ ID NO: 969303 - DNA, 18 bp, Homo sapiens
tagaagaaccaaatacct

SEQ ID NO: 969304 - DNA, 15 bp, Homo sapiens
tagaagaagaggaag

SEQ ID NO: 969305 - DNA, 16 bp, Homo sapiens
tagaagaagaggaaga

SEQ ID NO: 969306 - DNA, 12 bp, Homo sapiens
tagaagagagcc

SEQ ID NO: 969307 - DNA, 14 bp, Homo sapiens
tagaagagcacaga

SEQ ID NO: 969308 - DNA, 19 bp, Homo sapiens
tagaagagggttttaggta

SEQ ID NO: 969309 - DNA, 13 bp, Homo sapiens
tagaagataatga

SEQ ID NO: 969310 - DNA, 20 bp, Homo sapiens
tagaagatccacatcctcta

SEQ ID NO: 969311 - DNA, 20 bp, Homo sapiens
tagaagcaaagatttcagta

SEQ ID NO: 969312 - DNA, 15 bp, Homo sapiens
tagaagcaaggagaa

SEQ ID NO: 969313 - DNA, 10 bp, Homo sapiens
tagaagccag

SEQ ID NO: 969314 - DNA, 20 bp, Homo sapiens
tagaagccatctgacagcag

SEQ ID NO: 969315 - DNA, 17 bp, Homo sapiens
tagaagccatgggacct

SEQ ID NO: 969316 - DNA, 23 bp, Homo sapiens
tagaagccatgggacctcctccc

SEQ ID NO: 969317 - DNA, 22 bp, Homo sapiens
tagaagcccaaattcatataaa

SEQ ID NO: 969318 - DNA, 15 bp, Homo sapiens
tagaagctcttggac

SEQ ID NO: 969319 - DNA, 23 bp, Homo sapiens
tagaaggaaaaaagttccttcct

SEQ ID NO: 969320 - DNA, 20 bp, Homo sapiens
tagaaggaagtgtgtttgcc

SEQ ID NO: 969321 - DNA, 11 bp, Homo sapiens
tagaaggccac

SEQ ID NO: 969322 - DNA, 15 bp, Homo sapiens
tagaaggcttctctc

SEQ ID NO: 969323 - DNA, 20 bp, Homo sapiens
tagaagtaggaggaaacagt

SEQ ID NO: 969324 - DNA, 12 bp, Homo sapiens
tagaagtagttt

SEQ ID NO: 969325 - DNA, 14 bp, Homo sapiens
tagaagtctggaaa

SEQ ID NO: 969326 - DNA, 16 bp, Homo sapiens
tagaagtcttagatgt

SEQ ID NO: 969327 - DNA, 18 bp, Homo sapiens
tagaagtcttagatgtat

SEQ ID NO: 969328 - DNA, 15 bp, Homo sapiens
tagaagtctttcaga

SEQ ID NO: 969329 - DNA, 19 bp, Homo sapiens
tagaagtgagtttgtaaat

SEQ ID NO: 969330 - DNA, 20 bp, Homo sapiens
tagaagtggaccaggacagg

SEQ ID NO: 969331 - DNA, 19 bp, Homo sapiens
tagaagtgtgaagtgcaga

SEQ ID NO: 969332 - DNA, 15 bp, Homo sapiens
tagaagttttaaatt

SEQ ID NO: 969333 - DNA, 20 bp, Homo sapiens
gagaggcagccagacccaga

SEQ ID NO: 969334 - DNA, 22 bp, Homo sapiens
gagaggcaggaatgggggtcag

SEQ ID NO: 969335 - DNA, 11 bp, Homo sapiens
gagaggcaggc

SEQ ID NO: 969336 - DNA, 18 bp, Homo sapiens
gagaggccaaaggctggt

SEQ ID NO: 969337 - DNA, 14 bp, Homo sapiens
gagaggccactgtg

SEQ ID NO: 969338 - DNA, 15 bp, Homo sapiens
gagaggcccgcccgc

SEQ ID NO: 969339 - DNA, 20 bp, Homo sapiens
gagaggccctctggagtggc

SEQ ID NO: 969340 - DNA, 23 bp, Homo sapiens
gagaggccctctggagtggccac

SEQ ID NO: 969341 - DNA, 12 bp, Homo sapiens
gagaggcctggg

SEQ ID NO: 969342 - DNA, 21 bp, Homo sapiens
gagaggcctggggtgggacag

SEQ ID NO: 969343 - DNA, 22 bp, Homo sapiens
gagaggcctggggtgggacagg

SEQ ID NO: 969344 - DNA, 18 bp, Homo sapiens
gagaggcgagtcaccctc

SEQ ID NO: 969345 - DNA, 16 bp, Homo sapiens
gagaggcggcctcgtg

SEQ ID NO: 969346 - DNA, 18 bp, Homo sapiens
gagaggcgggagaactga

SEQ ID NO: 969347 - DNA, 21 bp, Homo sapiens
gagaggctgcctcagccagtg

SEQ ID NO: 969348 - DNA, 19 bp, Homo sapiens
gagagggacagcccactga

SEQ ID NO: 969349 - DNA, 15 bp, Homo sapiens
gagagggacaggcac

SEQ ID NO: 969350 - DNA, 14 bp, Homo sapiens
gagagggagaagaa

SEQ ID NO: 969351 - DNA, 23 bp, Homo sapiens
gagagggagaagaagtcagagag

SEQ ID NO: 969352 - DNA, 17 bp, Homo sapiens
gagagggagatgtgtga

SEQ ID NO: 969353 - DNA, 19 bp, Homo sapiens
gagagggaggcaagccctg

SEQ ID NO: 969354 - DNA, 14 bp, Homo sapiens
gagagggcagaggg

SEQ ID NO: 969355 - DNA, 21 bp, Homo sapiens
gagagggcccagctgtagcca

SEQ ID NO: 969356 - DNA, 22 bp, Homo sapiens
gagagggctagccctgagcccg

SEQ ID NO: 969357 - DNA, 21 bp, Homo sapiens
gagagggctggtccttattta

SEQ ID NO: 969358 - DNA, 11 bp, Homo sapiens
gagagggcttt

SEQ ID NO: 969359 - DNA, 16 bp, Homo sapiens
gagaggggaagggcca

SEQ ID NO: 969360 - DNA, 17 bp, Homo sapiens
gagaggggaagggccag

SEQ ID NO: 969361 - DNA, 14 bp, Homo sapiens
gagaggggagggag

SEQ ID NO: 969362 - DNA, 16 bp, Homo sapiens
gagaggggagggaggg

SEQ ID NO: 969363 - DNA, 13 bp, Homo sapiens
gagagggggaggt

SEQ ID NO: 969364 - DNA, 19 bp, Homo sapiens
gagagggggcctgggactt

SEQ ID NO: 969365 - DNA, 23 bp, Homo sapiens
gagagggggcctgggacttccat

SEQ ID NO: 969366 - DNA, 13 bp, Homo sapiens
gagagggtgacaa

SEQ ID NO: 969367 - DNA, 17 bp, Homo sapiens
gagaggtgaaagcataa

SEQ ID NO: 969368 - DNA, 13 bp, Homo sapiens
gagaggtggccac

SEQ ID NO: 969369 - DNA, 21 bp, Homo sapiens
gagaggtggccaccgggggtg

SEQ ID NO: 969370 - DNA, 14 bp, Homo sapiens
gagaggtgggccag

SEQ ID NO: 969371 - DNA, 18 bp, Homo sapiens
gagaggtttttcttggga

SEQ ID NO: 969372 - DNA, 19 bp, Homo sapiens
gagagtacagtgagccaag

SEQ ID NO: 969373 - DNA, 17 bp, Homo sapiens
gagagtaccatgctggc

SEQ ID NO: 969374 - DNA, 20 bp, Homo sapiens
gagagtagccgagagcctgc

SEQ ID NO: 969375 - DNA, 17 bp, Homo sapiens
gagagtatttttataca

SEQ ID NO: 969376 - DNA, 14 bp, Homo sapiens
gagagtcaaatggg

SEQ ID NO: 969377 - DNA, 21 bp, Homo sapiens
gagagtcagctctctgccctg

SEQ ID NO: 969378 - DNA, 23 bp, Homo sapiens
gagagtcaggagttttactgcct

SEQ ID NO: 969379 - DNA, 20 bp, Homo sapiens
gagagtcatatacattagtt

SEQ ID NO: 969380 - DNA, 19 bp, Homo sapiens
gagatttgccagcacaggg

SEQ ID NO: 969381 - DNA, 16 bp, Homo sapiens
gagatttgggagctga

SEQ ID NO: 969382 - DNA, 14 bp, Homo sapiens
gagatttttaagaa

SEQ ID NO: 969383 - DNA, 20 bp, Homo sapiens
gagatttttcatacttttct

SEQ ID NO: 969384 - DNA, 15 bp, Homo sapiens
gagcaaaaggcagct

SEQ ID NO: 969385 - DNA, 14 bp, Homo sapiens
gagcaaaataagga

SEQ ID NO: 969386 - DNA, 12 bp, Homo sapiens
gagcaaaataat

SEQ ID NO: 969387 - DNA, 22 bp, Homo sapiens
gagcaaaatatgccccttcttg

SEQ ID NO: 969388 - DNA, 19 bp, Homo sapiens
gagcaaaatcgatgcagtg

SEQ ID NO: 969389 - DNA, 18 bp, Homo sapiens
gagcaaacccagaggtgg

SEQ ID NO: 969390 - DNA, 19 bp, Homo sapiens
gagcaaacccagaggtgga

SEQ ID NO: 969391 - DNA, 14 bp, Homo sapiens
gagcaaagatcaaa

SEQ ID NO: 969392 - DNA, 16 bp, Homo sapiens
gagcaaagggtggtga

SEQ ID NO: 969393 - DNA, 16 bp, Homo sapiens
gagcaaatgagggagg

SEQ ID NO: 969394 - DNA, 17 bp, Homo sapiens
gagcaaatgagggaggg

SEQ ID NO: 969395 - DNA, 15 bp, Homo sapiens
gagcaaatgtttctg

SEQ ID NO: 969396 - DNA, 13 bp, Homo sapiens
gagcaacccctgt

SEQ ID NO: 969397 - DNA, 20 bp, Homo sapiens
gagcaacctctcactcccca

SEQ ID NO: 969398 - DNA, 18 bp, Homo sapiens
gagcaactctccactcca

SEQ ID NO: 969399 - DNA, 16 bp, Homo sapiens
gagcaagaagaaaatg

SEQ ID NO: 969400 - DNA, 19 bp, Homo sapiens
gagcaagaagaaaatgtgg

SEQ ID NO: 969401 - DNA, 12 bp, Homo sapiens
gagcaagactct

SEQ ID NO: 969402 - DNA, 12 bp, Homo sapiens
gagcaagagctg

SEQ ID NO: 969403 - DNA, 20 bp, Homo sapiens
gagcaagcatttatgtttat

SEQ ID NO: 969404 - DNA, 23 bp, Homo sapiens
gagcaagggcacaaactgcagct

SEQ ID NO: 969405 - DNA, 20 bp, Homo sapiens
gagcaaggtttcgtggcagc

SEQ ID NO: 969406 - DNA, 22 bp, Homo sapiens
gagcaaggtttcgtggcagcac

SEQ ID NO: 969407 - DNA, 18 bp, Homo sapiens
gagcaagttccttctggt

SEQ ID NO: 969408 - DNA, 20 bp, Homo sapiens
gagcaataacactatattta

SEQ ID NO: 969409 - DNA, 13 bp, Homo sapiens
gagcaatcacagg

SEQ ID NO: 969410 - DNA, 20 bp, Homo sapiens
gagcaatgcttttaatgaat

SEQ ID NO: 969411 - DNA, 22 bp, Homo sapiens
gagcaatgcttttaatgaattt

SEQ ID NO: 969412 - DNA, 20 bp, Homo sapiens
gagcaatggtaactgcacct

SEQ ID NO: 969413 - DNA, 17 bp, Homo sapiens
gagcaatgtctgtgcta

SEQ ID NO: 969414 - DNA, 16 bp, Homo sapiens
gagcacaaaattcaaa

SEQ ID NO: 969415 - DNA, 22 bp, Homo sapiens
gagcacaagaggagatccaggg

SEQ ID NO: 969416 - DNA, 15 bp, Homo sapiens
gagcacaaggcctta

SEQ ID NO: 969417 - DNA, 13 bp, Homo sapiens
gagcacactgtag

SEQ ID NO: 969418 - DNA, 15 bp, Homo sapiens
gagcacactgtagca

SEQ ID NO: 969419 - DNA, 24 bp, Homo sapiens
gagcacagcccacggggatcacag

SEQ ID NO: 969420 - DNA, 12 bp, Homo sapiens
gagcacagccct

SEQ ID NO: 969421 - DNA, 13 bp, Homo sapiens
gagcacaggcagc

SEQ ID NO: 969422 - DNA, 14 bp, Homo sapiens
gagcacaggtccca

SEQ ID NO: 969423 - DNA, 13 bp, Homo sapiens
gagcacaggtgtc

SEQ ID NO: 969424 - DNA, 19 bp, Homo sapiens
gagcacaggttagggcatg

SEQ ID NO: 969425 - DNA, 18 bp, Homo sapiens
gagcacagtcaggggctg

SEQ ID NO: 969426 - DNA, 18 bp, Homo sapiens
gagcacatagtgtcctgc

SEQ ID NO: 969427 - DNA, 20 bp, Homo sapiens
gagcacatagtgtcctgccc

SEQ ID NO: 969428 - DNA, 23 bp, Homo sapiens
gagcacatctctctgccctctcc

SEQ ID NO: 969429 - DNA, 15 bp, Homo sapiens
gagcaccaggcacga

SEQ ID NO: 969430 - DNA, 23 bp, Homo sapiens
gagcaccaggcacgaacccacct

SEQ ID NO: 969431 - DNA, 14 bp, Homo sapiens
gagcacccagagca

SEQ ID NO: 969432 - DNA, 19 bp, Homo sapiens
gagcacccattccaaagct

SEQ ID NO: 969433 - DNA, 18 bp, Homo sapiens
gagcaccccctcattccc

SEQ ID NO: 969434 - DNA, 14 bp, Homo sapiens
gagcaccccctgct

SEQ ID NO: 969435 - DNA, 15 bp, Homo sapiens
gagcaccccctgctc

SEQ ID NO: 969436 - DNA, 17 bp, Homo sapiens
gagcaccccctgctcca

SEQ ID NO: 969437 - DNA, 17 bp, Homo sapiens
gagcacccctctctgca

SEQ ID NO: 969438 - DNA, 14 bp, Homo sapiens
gagcaccctctgga

SEQ ID NO: 969439 - DNA, 15 bp, Homo sapiens
gagcaccctctggat

SEQ ID NO: 969440 - DNA, 18 bp, Homo sapiens
gagcaccgtgtcaagctg

SEQ ID NO: 969441 - DNA, 19 bp, Homo sapiens
gagcacctccacatcctcc

SEQ ID NO: 969442 - DNA, 13 bp, Homo sapiens
gagcacctgaacc

SEQ ID NO: 969443 - DNA, 23 bp, Homo sapiens
gagcacctgaaccccatgggctt

SEQ ID NO: 969444 - DNA, 23 bp, Homo sapiens
gagcacctgcttcatgctcagcc

SEQ ID NO: 969445 - DNA, 14 bp, Homo sapiens
gagcacctggaccc

SEQ ID NO: 969446 - DNA, 15 bp, Homo sapiens
gagcacctggacccc

SEQ ID NO: 969447 - DNA, 16 bp, Homo sapiens
gagcacctggaccccc

SEQ ID NO: 969448 - DNA, 21 bp, Homo sapiens
gagcacctggaccccctgccc

SEQ ID NO: 969449 - DNA, 21 bp, Homo sapiens
gagcacctgggccccactgga

SEQ ID NO: 969450 - DNA, 13 bp, Homo sapiens
gagcacctgtctg

SEQ ID NO: 969451 - DNA, 14 bp, Homo sapiens
gagcacgcctgcca

SEQ ID NO: 969452 - DNA, 21 bp, Homo sapiens
gagcacgtggagatagtgcca

SEQ ID NO: 969453 - DNA, 22 bp, Homo sapiens
gagcacgtggagatagtgccag

SEQ ID NO: 969454 - DNA, 19 bp, Homo sapiens
gagcactggactccggggc

SEQ ID NO: 969455 - DNA, 13 bp, Homo sapiens
gagcactggccag

SEQ ID NO: 969456 - DNA, 18 bp, Homo sapiens
gagcactggccagagagg

SEQ ID NO: 969457 - DNA, 17 bp, Homo sapiens
gagcactgggttgactt

SEQ ID NO: 969458 - DNA, 19 bp, Homo sapiens
gagcacttaagagaatatt

SEQ ID NO: 969459 - DNA, 18 bp, Homo sapiens
gagcacttgcgtcctgca

SEQ ID NO: 969460 - DNA, 23 bp, Homo sapiens
gagcagaaaacccttgggccaga

SEQ ID NO: 969461 - DNA, 21 bp, Homo sapiens
gagcagagacactaacgactt

SEQ ID NO: 969462 - DNA, 19 bp, Homo sapiens
tagagaggcctgctttgtt

SEQ ID NO: 969463 - DNA, 16 bp, Homo sapiens
tagagagggagaagaa

SEQ ID NO: 969464 - DNA, 19 bp, Homo sapiens
tagagaggggactggggga

SEQ ID NO: 969465 - DNA, 15 bp, Homo sapiens
tagagagggggctct

SEQ ID NO: 969466 - DNA, 20 bp, Homo sapiens
tagagaggtagcgagctgct

SEQ ID NO: 969467 - DNA, 10 bp, Homo sapiens
tagagaggtt

SEQ ID NO: 969468 - DNA, 11 bp, Homo sapiens
tagagaggttt

SEQ ID NO: 969469 - DNA, 18 bp, Homo sapiens
tagagatacagtatacct

SEQ ID NO: 969470 - DNA, 16 bp, Homo sapiens
tagagatattttgtaa

SEQ ID NO: 969471 - DNA, 20 bp, Homo sapiens
tagagatgtttttaaaagtt

SEQ ID NO: 969472 - DNA, 15 bp, Homo sapiens
tagagcagacaggcc

SEQ ID NO: 969473 - DNA, 13 bp, Homo sapiens
tagagccagcttg

SEQ ID NO: 969474 - DNA, 14 bp, Homo sapiens
tagagccaggtgct

SEQ ID NO: 969475 - DNA, 15 bp, Homo sapiens
tagagccaggtgctt

SEQ ID NO: 969476 - DNA, 17 bp, Homo sapiens
tagagcctgtaaacttt

SEQ ID NO: 969477 - DNA, 19 bp, Homo sapiens
tagagcgtttggttaaagt

SEQ ID NO: 969478 - DNA, 15 bp, Homo sapiens
tagagctagctgcca

SEQ ID NO: 969479 - DNA, 18 bp, Homo sapiens
tagagctagctgccactt

SEQ ID NO: 969480 - DNA, 14 bp, Homo sapiens
tagagctgatccag

SEQ ID NO: 969481 - DNA, 11 bp, Homo sapiens
tagagctgcca

SEQ ID NO: 969482 - DNA, 13 bp, Homo sapiens
tagagctgccact

SEQ ID NO: 969483 - DNA, 15 bp, Homo sapiens
tagagctgccactgg

SEQ ID NO: 969484 - DNA, 17 bp, Homo sapiens
tagagctgccactgggc

SEQ ID NO: 969485 - DNA, 23 bp, Homo sapiens
tagagcttccaaatgtgtcagaa

SEQ ID NO: 969486 - DNA, 15 bp, Homo sapiens
tagagcttctggcac

SEQ ID NO: 969487 - DNA, 17 bp, Homo sapiens
tagagctttcaagtaca

SEQ ID NO: 969488 - DNA, 17 bp, Homo sapiens
tagaggaaaaaaatgac

SEQ ID NO: 969489 - DNA, 22 bp, Homo sapiens
tagaggaaaaaaatgactaaaa

SEQ ID NO: 969490 - DNA, 12 bp, Homo sapiens
tagaggaaaggg

SEQ ID NO: 969491 - DNA, 19 bp, Homo sapiens
tagaggaaataagaaaaat

SEQ ID NO: 969492 - DNA, 16 bp, Homo sapiens
tagaggatgtggctgt

SEQ ID NO: 969493 - DNA, 18 bp, Homo sapiens
tagaggccagccccaccc

SEQ ID NO: 969494 - DNA, 20 bp, Homo sapiens
tagaggccagccccacccag

SEQ ID NO: 969495 - DNA, 13 bp, Homo sapiens
tagaggcccaggc

SEQ ID NO: 969496 - DNA, 23 bp, Homo sapiens
tagaggcctgaggatgagctgga

SEQ ID NO: 969497 - DNA, 18 bp, Homo sapiens
tagaggcttctccgccag

SEQ ID NO: 969498 - DNA, 23 bp, Homo sapiens
tagaggcttctccgccagcctcc

SEQ ID NO: 969499 - DNA, 19 bp, Homo sapiens
tagaggctttcaaatgtac

SEQ ID NO: 969500 - DNA, 19 bp, Homo sapiens
tagagggacctctcccagg

SEQ ID NO: 969501 - DNA, 11 bp, Homo sapiens
tagagggccca

SEQ ID NO: 969502 - DNA, 19 bp, Homo sapiens
tagcacaaggagtgcccgc

SEQ ID NO: 969503 - DNA, 19 bp, Homo sapiens
tagcacaagttatttaaat

SEQ ID NO: 969504 - DNA, 12 bp, Homo sapiens
tagcacagagag

SEQ ID NO: 969505 - DNA, 14 bp, Homo sapiens
tagcacagagaggg

SEQ ID NO: 969506 - DNA, 16 bp, Homo sapiens
tagcacagagagggac

SEQ ID NO: 969507 - DNA, 17 bp, Homo sapiens
tagcacagattttgaat

SEQ ID NO: 969508 - DNA, 17 bp, Homo sapiens
tagcacataaactttgg

SEQ ID NO: 969509 - DNA, 18 bp, Homo sapiens
tagcaccttcagggctga

SEQ ID NO: 969510 - DNA, 15 bp, Homo sapiens
tagcactatttaaaa

SEQ ID NO: 969511 - DNA, 19 bp, Homo sapiens
tagcactcaagacccggtt

SEQ ID NO: 969512 - DNA, 17 bp, Homo sapiens
tagcactgatagtcctt

SEQ ID NO: 969513 - DNA, 11 bp, Homo sapiens
tagcactgttg

SEQ ID NO: 969514 - DNA, 18 bp, Homo sapiens
tagcactgttgatgtatc

SEQ ID NO: 969515 - DNA, 15 bp, Homo sapiens
tagcacttacgtaaa

SEQ ID NO: 969516 - DNA, 16 bp, Homo sapiens
tagcactttgggaggc

SEQ ID NO: 969517 - DNA, 23 bp, Homo sapiens
tagcactttgggaggctgaggca

SEQ ID NO: 969518 - DNA, 13 bp, Homo sapiens
tagcagacaggcc

SEQ ID NO: 969519 - DNA, 16 bp, Homo sapiens
tagcagagtctgtctc

SEQ ID NO: 969520 - DNA, 22 bp, Homo sapiens
tagcagagtgaggatgtgtttt

SEQ ID NO: 969521 - DNA, 13 bp, Homo sapiens
tagcagagttaaa

SEQ ID NO: 969522 - DNA, 16 bp, Homo sapiens
tagcagagttaaatct

SEQ ID NO: 969523 - DNA, 12 bp, Homo sapiens
tagcagatggtt

SEQ ID NO: 969524 - DNA, 23 bp, Homo sapiens
tagcagattgtttcctcttccaa

SEQ ID NO: 969525 - DNA, 18 bp, Homo sapiens
tagcagattttaattttg

SEQ ID NO: 969526 - DNA, 20 bp, Homo sapiens
tagcagcaccgttctgtgca

SEQ ID NO: 969527 - DNA, 12 bp, Homo sapiens
tagcagcccttg

SEQ ID NO: 969528 - DNA, 19 bp, Homo sapiens
tagcagcccttgtgtgtgc

SEQ ID NO: 969529 - DNA, 22 bp, Homo sapiens
tagcagcccttgtgtgtgccct

SEQ ID NO: 969530 - DNA, 11 bp, Homo sapiens
tagcagctgga

SEQ ID NO: 969531 - DNA, 14 bp, Homo sapiens
tagcagctggccta

SEQ ID NO: 969532 - DNA, 22 bp, Homo sapiens
tagcaggactgaattgtcccca

SEQ ID NO: 969533 - DNA, 22 bp, Homo sapiens
tagcaggggaattccctccccc

SEQ ID NO: 969534 - DNA, 16 bp, Homo sapiens
tagcaggggcaccttc

SEQ ID NO: 969535 - DNA, 15 bp, Homo sapiens
tagcaggtggtcctg

SEQ ID NO: 969536 - DNA, 15 bp, Homo sapiens
tagcaggtttcacta

SEQ ID NO: 969537 - DNA, 15 bp, Homo sapiens
tagcagtaaatactt

SEQ ID NO: 969538 - DNA, 20 bp, Homo sapiens
tagcagtaaatacttgcagt

SEQ ID NO: 969539 - DNA, 22 bp, Homo sapiens
tagcagtggatgttagcctgca

SEQ ID NO: 969540 - DNA, 14 bp, Homo sapiens
tagcagttgctcac

SEQ ID NO: 969541 - DNA, 19 bp, Homo sapiens
tagcataaataaaactgaa

SEQ ID NO: 969542 - DNA, 15 bp, Homo sapiens
tagcatacatttata

SEQ ID NO: 969543 - DNA, 18 bp, Homo sapiens
tagcatacgtacacattt

SEQ ID NO: 969544 - DNA, 14 bp, Homo sapiens
tagcatactgtgta

SEQ ID NO: 969545 - DNA, 20 bp, Homo sapiens
tagcatactgtgtatgtttt

SEQ ID NO: 969546 - DNA, 18 bp, Homo sapiens
tagcatacttaaaatatc

SEQ ID NO: 969547 - DNA, 14 bp, Homo sapiens
tagcatagccagca

SEQ ID NO: 969548 - DNA, 12 bp, Homo sapiens
tagcatatcaat

SEQ ID NO: 969549 - DNA, 15 bp, Homo sapiens
tagcatcttcctctg

SEQ ID NO: 969550 - DNA, 16 bp, Homo sapiens
tagcatcttcctctgc

SEQ ID NO: 969551 - DNA, 21 bp, Homo sapiens
tagcatgacaagccccaggca

SEQ ID NO: 969552 - DNA, 19 bp, Homo sapiens
tagcatgaggccactgctg

SEQ ID NO: 969553 - DNA, 17 bp, Homo sapiens
tagcatgcttcctttct

SEQ ID NO: 969554 - DNA, 22 bp, Homo sapiens
tagcatgcttcctttctctcct

SEQ ID NO: 969555 - DNA, 22 bp, Homo sapiens
tagcatgggtccaagagacatg

SEQ ID NO: 969556 - DNA, 17 bp, Homo sapiens
tagcatgtatgaatgta

SEQ ID NO: 969557 - DNA, 18 bp, Homo sapiens
tagcatgtcaacttttga

SEQ ID NO: 969558 - DNA, 22 bp, Homo sapiens
tagcatgtttatatctgcaaaa

SEQ ID NO: 969559 - DNA, 22 bp, Homo sapiens
tagcattaccatgagtgaattt

SEQ ID NO: 969560 - DNA, 16 bp, Homo sapiens
tagcattatgcaatta

SEQ ID NO: 969561 - DNA, 22 bp, Homo sapiens
tagcattatgcaattaggtttt

SEQ ID NO: 969562 - DNA, 16 bp, Homo sapiens
tagcattgataatctt

SEQ ID NO: 969563 - DNA, 13 bp, Homo sapiens
tagcattgttcca

SEQ ID NO: 969564 - DNA, 15 bp, Homo sapiens
tagcattgttccaca

SEQ ID NO: 969565 - DNA, 22 bp, Homo sapiens
tagcatttatttctctggcaaa

SEQ ID NO: 969566 - DNA, 23 bp, Homo sapiens
tagcatttgccacttagtatttt

SEQ ID NO: 969567 - DNA, 13 bp, Homo sapiens
tagcatttggagc

SEQ ID NO: 969568 - DNA, 14 bp, Homo sapiens
tagcattttaaaca

SEQ ID NO: 969569 - DNA, 15 bp, Homo sapiens
tagcattttaaacaa

SEQ ID NO: 969570 - DNA, 23 bp, Homo sapiens
tagcattttaaacaaaatagaaa

SEQ ID NO: 969571 - DNA, 16 bp, Homo sapiens
tagcattttgctaaat

SEQ ID NO: 969572 - DNA, 15 bp, Homo sapiens
tagcatttttatgca

SEQ ID NO: 969573 - DNA, 20 bp, Homo sapiens
tagcatttttatgcagacag

SEQ ID NO: 969574 - DNA, 21 bp, Homo sapiens
tagcatttttatgcagacagt

SEQ ID NO: 969575 - DNA, 20 bp, Homo sapiens
tagcatttttgatttatgca

SEQ ID NO: 969576 - DNA, 22 bp, Homo sapiens
tagccaaaaaggcaaataatgg

SEQ ID NO: 969577 - DNA, 16 bp, Homo sapiens
tagccaaacccttgtc

SEQ ID NO: 969578 - DNA, 14 bp, Homo sapiens
tagccaacatagta

SEQ ID NO: 969579 - DNA, 19 bp, Homo sapiens
tagccaagttatattgaat

SEQ ID NO: 969580 - DNA, 21 bp, Homo sapiens
tagccaatggacaagcagtgt

SEQ ID NO: 969581 - DNA, 20 bp, Homo sapiens
tagccacaaaattgggaaag

SEQ ID NO: 969582 - DNA, 16 bp, Homo sapiens
tagccacagctgctgt

SEQ ID NO: 969583 - DNA, 21 bp, Homo sapiens
tagccacatttggaatacttt

SEQ ID NO: 969584 - DNA, 19 bp, Homo sapiens
tagccagagaggagcacct

SEQ ID NO: 969585 - DNA, 20 bp, Homo sapiens
tagccagagaggagcacctg

SEQ ID NO: 969586 - DNA, 18 bp, Homo sapiens
tagccagcacacagggca

SEQ ID NO: 969587 - DNA, 20 bp, Homo sapiens
tagccagcattcagcacaca

SEQ ID NO: 969588 - DNA, 21 bp, Homo sapiens
tagccagcattcagcacacac

SEQ ID NO: 969589 - DNA, 18 bp, Homo sapiens
tagccagctgtcaagggc

SEQ ID NO: 969590 - DNA, 18 bp, Homo sapiens
tagccaggagtctgtgct

SEQ ID NO: 969591 - DNA, 22 bp, Homo sapiens
gagccagaaatgggcagttctc

SEQ ID NO: 969592 - DNA, 16 bp, Homo sapiens
gagccagaattcacta

SEQ ID NO: 969593 - DNA, 15 bp, Homo sapiens
gagccagatggcaag

SEQ ID NO: 969594 - DNA, 12 bp, Homo sapiens
gagccagccctc

SEQ ID NO: 969595 - DNA, 13 bp, Homo sapiens
gagccagccctcc

SEQ ID NO: 969596 - DNA, 16 bp, Homo sapiens
gagccagccctccctg

SEQ ID NO: 969597 - DNA, 19 bp, Homo sapiens
gagccagccctccctgtcc

SEQ ID NO: 969598 - DNA, 21 bp, Homo sapiens
gagccagccctccctgtcctc

SEQ ID NO: 969599 - DNA, 12 bp, Homo sapiens
gagccagcctgg

SEQ ID NO: 969600 - DNA, 20 bp, Homo sapiens
gagccagcctggctctgccc

SEQ ID NO: 969601 - DNA, 13 bp, Homo sapiens
gagccagctccct

SEQ ID NO: 969602 - DNA, 18 bp, Homo sapiens
gagccagctccctctatt

SEQ ID NO: 969603 - DNA, 15 bp, Homo sapiens
gagccagctgctttt

SEQ ID NO: 969604 - DNA, 20 bp, Homo sapiens
gagccagcttggggccacca

SEQ ID NO: 969605 - DNA, 12 bp, Homo sapiens
gagccaggagaa

SEQ ID NO: 969606 - DNA, 17 bp, Homo sapiens
gagccaggagaagctca

SEQ ID NO: 969607 - DNA, 16 bp, Homo sapiens
gagccaggatgcccag

SEQ ID NO: 969608 - DNA, 13 bp, Homo sapiens
gagccagggcaga

SEQ ID NO: 969609 - DNA, 14 bp, Homo sapiens
gagccagggcagag

SEQ ID NO: 969610 - DNA, 20 bp, Homo sapiens
gagccagggcagaggaatgt

SEQ ID NO: 969611 - DNA, 13 bp, Homo sapiens
gagccagggctgt

SEQ ID NO: 969612 - DNA, 15 bp, Homo sapiens
gagccagggctgtcc

SEQ ID NO: 969613 - DNA, 17 bp, Homo sapiens
gagccagggctgtcctt

SEQ ID NO: 969614 - DNA, 13 bp, Homo sapiens
gagccagggtaga

SEQ ID NO: 969615 - DNA, 19 bp, Homo sapiens
gagccaggttgtcgggccc

SEQ ID NO: 969616 - DNA, 17 bp, Homo sapiens
gagccagtaatctttat

SEQ ID NO: 969617 - DNA, 23 bp, Homo sapiens
gagccagtcctccactcgaccca

SEQ ID NO: 969618 - DNA, 21 bp, Homo sapiens
gagccagtgggccagccacag

SEQ ID NO: 969619 - DNA, 22 bp, Homo sapiens
gagccagttgtcctatggacaa

SEQ ID NO: 969620 - DNA, 17 bp, Homo sapiens
gagccagtttgccggat

SEQ ID NO: 969621 - DNA, 11 bp, Homo sapiens
gagccataatg

SEQ ID NO: 969622 - DNA, 16 bp, Homo sapiens
gagccatcaccctcac

SEQ ID NO: 969623 - DNA, 19 bp, Homo sapiens
gagccatcaccctcaccca

SEQ ID NO: 969624 - DNA, 14 bp, Homo sapiens
gagccgctggcaga

SEQ ID NO: 969625 - DNA, 19 bp, Homo sapiens
gagccgctggcagaaggga

SEQ ID NO: 969626 - DNA, 19 bp, Homo sapiens
gagccggcatccttgcctg

SEQ ID NO: 969627 - DNA, 16 bp, Homo sapiens
gagccggccccaggct

SEQ ID NO: 969628 - DNA, 18 bp, Homo sapiens
gagccgggaccctcaggt

SEQ ID NO: 969629 - DNA, 13 bp, Homo sapiens
gagccgggcctgg

SEQ ID NO: 969630 - DNA, 20 bp, Homo sapiens
gagccgggcctggggctcct

SEQ ID NO: 969631 - DNA, 17 bp, Homo sapiens
gagccggtaactgtcct

SEQ ID NO: 969632 - DNA, 21 bp, Homo sapiens
gagccggtaactgtcctgtcc

SEQ ID NO: 969633 - DNA, 22 bp, Homo sapiens
gagccggtaactgtcctgtcct

SEQ ID NO: 969634 - DNA, 18 bp, Homo sapiens
gagccgtgaactgtgcat

SEQ ID NO: 969635 - DNA, 19 bp, Homo sapiens
gagcctacagaagggcagt

SEQ ID NO: 969636 - DNA, 17 bp, Homo sapiens
gagcctagcggagccca

SEQ ID NO: 969637 - DNA, 19 bp, Homo sapiens
gagcctagcggagcccagc

SEQ ID NO: 969638 - DNA, 14 bp, Homo sapiens
gagcctagctcctg

SEQ ID NO: 969639 - DNA, 15 bp, Homo sapiens
gagcctaggaccact

SEQ ID NO: 969640 - DNA, 19 bp, Homo sapiens
gagcctaggaccactcagc

SEQ ID NO: 969641 - DNA, 20 bp, Homo sapiens
gagcctaggaccactcagcc

SEQ ID NO: 969642 - DNA, 21 bp, Homo sapiens
gagcctaggaccactcagccc

SEQ ID NO: 969643 - DNA, 16 bp, Homo sapiens
gagcctcaatttcctc

SEQ ID NO: 969644 - DNA, 18 bp, Homo sapiens
gagcctcacagcagtgag

SEQ ID NO: 969645 - DNA, 13 bp, Homo sapiens
gagcctcccacca

SEQ ID NO: 969646 - DNA, 21 bp, Homo sapiens
gagcctcccaccagagccggg

SEQ ID NO: 969647 - DNA, 13 bp, Homo sapiens
gagcctccccctc

SEQ ID NO: 969648 - DNA, 14 bp, Homo sapiens
gagcctccccctca

SEQ ID NO: 969649 - DNA, 17 bp, Homo sapiens
gagcctccctgcagcca

SEQ ID NO: 969650 - DNA, 24 bp, Homo sapiens
gagcctccctgcagccaccagact

SEQ ID NO: 969651 - DNA, 14 bp, Homo sapiens
gagcctcctcaggg

SEQ ID NO: 969652 - DNA, 12 bp, Homo sapiens
gagcctcctggg

SEQ ID NO: 969653 - DNA, 23 bp, Homo sapiens
gagcctcctgggaacacatctgg

SEQ ID NO: 969654 - DNA, 23 bp, Homo sapiens
gagcctcctgtgcctggccccag

SEQ ID NO: 969655 - DNA, 20 bp, Homo sapiens
gagcctcgacacccccccaa

SEQ ID NO: 969656 - DNA, 21 bp, Homo sapiens
gagcctcgacacccccccaac

SEQ ID NO: 969657 - DNA, 14 bp, Homo sapiens
gagcctcgcccctc

SEQ ID NO: 969658 - DNA, 21 bp, Homo sapiens
gagcctcgtgtccagactcag

SEQ ID NO: 969659 - DNA, 16 bp, Homo sapiens
gagcctctgctcccca

SEQ ID NO: 969660 - DNA, 23 bp, Homo sapiens
gagcctctgctggaaggggcagc

SEQ ID NO: 969661 - DNA, 13 bp, Homo sapiens
gagcctctggccc

SEQ ID NO: 969662 - DNA, 17 bp, Homo sapiens
gagcctctggcccctca

SEQ ID NO: 969663 - DNA, 12 bp, Homo sapiens
gagcctctggct

SEQ ID NO: 969664 - DNA, 14 bp, Homo sapiens
gagcctctggcttc

SEQ ID NO: 969665 - DNA, 19 bp, Homo sapiens
gagcctgaattttgttgct

SEQ ID NO: 969666 - DNA, 15 bp, Homo sapiens
gagcctgagggatct

SEQ ID NO: 969667 - DNA, 15 bp, Homo sapiens
gagcctgatctcttc

SEQ ID NO: 969668 - DNA, 17 bp, Homo sapiens
gagcctgatctcttcct

SEQ ID NO: 969669 - DNA, 19 bp, Homo sapiens
gagcctgatctcttcctgt

SEQ ID NO: 969670 - DNA, 20 bp, Homo sapiens
gagcctgcagggtggtgctg

SEQ ID NO: 969671 - DNA, 23 bp, Homo sapiens
gagcctgcagggtggtgctggga

SEQ ID NO: 969672 - DNA, 15 bp, Homo sapiens
gagcctgcattctgc

SEQ ID NO: 969673 - DNA, 19 bp, Homo sapiens
gagcctgccaaagtgcctg

SEQ ID NO: 969674 - DNA, 21 bp, Homo sapiens
gagcctgccaaagtgcctggg

SEQ ID NO: 969675 - DNA, 16 bp, Homo sapiens
gagcctgccctcactc

SEQ ID NO: 969676 - DNA, 19 bp, Homo sapiens
gagcctgcggcctgctgga

SEQ ID NO: 969677 - DNA, 13 bp, Homo sapiens
gagcctgctcccc

SEQ ID NO: 969678 - DNA, 18 bp, Homo sapiens
gagcctgctcccccaccc

SEQ ID NO: 969679 - DNA, 20 bp, Homo sapiens
gagcctgctggaagcccagc

SEQ ID NO: 969680 - DNA, 12 bp, Homo sapiens
gagcctgctggc

SEQ ID NO: 969681 - DNA, 12 bp, Homo sapiens
gagcctggcaag

SEQ ID NO: 969682 - DNA, 22 bp, Homo sapiens
gagcctggcaaggcattcctca

SEQ ID NO: 969683 - DNA, 14 bp, Homo sapiens
gagcctggccccag

SEQ ID NO: 969684 - DNA, 15 bp, Homo sapiens
gagcctggctgtcca

SEQ ID NO: 969685 - DNA, 16 bp, Homo sapiens
gagcctggctgtccaa

SEQ ID NO: 969686 - DNA, 11 bp, Homo sapiens
gagcctggctt

SEQ ID NO: 969687 - DNA, 13 bp, Homo sapiens
gagcctggctttg

SEQ ID NO: 969688 - DNA, 21 bp, Homo sapiens
gagcctggctttggtccccag

SEQ ID NO: 969689 - DNA, 11 bp, Homo sapiens
gagcctggggt

SEQ ID NO: 969690 - DNA, 23 bp, Homo sapiens
gagcctggtcccacgagggtgcc

SEQ ID NO: 969691 - DNA, 15 bp, Homo sapiens
gagcctggtcctggc

SEQ ID NO: 969692 - DNA, 16 bp, Homo sapiens
gagcctgtccccgcct

SEQ ID NO: 969693 - DNA, 19 bp, Homo sapiens
gagcctgtgcctcctcacc

SEQ ID NO: 969694 - DNA, 17 bp, Homo sapiens
gagccttcagccttaat

SEQ ID NO: 969695 - DNA, 18 bp, Homo sapiens
gagccttctcagaagcac

SEQ ID NO: 969696 - DNA, 23 bp, Homo sapiens
gagccttgcagatatctgcatgt

SEQ ID NO: 969697 - DNA, 13 bp, Homo sapiens
gagccttgcatgt

SEQ ID NO: 969698 - DNA, 16 bp, Homo sapiens
gagccttgctgggcca

SEQ ID NO: 969699 - DNA, 17 bp, Homo sapiens
gagccttgctgggccag

SEQ ID NO: 969700 - DNA, 20 bp, Homo sapiens
gagccttgctgggccaggga

SEQ ID NO: 969701 - DNA, 20 bp, Homo sapiens
gagccttggtgtccacctgg

SEQ ID NO: 969702 - DNA, 14 bp, Homo sapiens
gagcctttgccttt

SEQ ID NO: 969703 - DNA, 20 bp, Homo sapiens
gagccttttatctgcagaac

SEQ ID NO: 969704 - DNA, 20 bp, Homo sapiens
gagcgacgtttatttcatct

SEQ ID NO: 969705 - DNA, 20 bp, Homo sapiens
gagcgagagatcaaagatga

SEQ ID NO: 969706 - DNA, 17 bp, Homo sapiens
gagcgagcaagccggca

SEQ ID NO: 969707 - DNA, 16 bp, Homo sapiens
gagcgagcgctaccca

SEQ ID NO: 969708 - DNA, 17 bp, Homo sapiens
gagcgaggtcagaggag

SEQ ID NO: 969709 - DNA, 12 bp, Homo sapiens
gagcgcaagata

SEQ ID NO: 969710 - DNA, 13 bp, Homo sapiens
gagcgcaagatag

SEQ ID NO: 969711 - DNA, 18 bp, Homo sapiens
gagcgcacctgccccctg

SEQ ID NO: 969712 - DNA, 19 bp, Homo sapiens
gagcgcccccgagccctga

SEQ ID NO: 969713 - DNA, 21 bp, Homo sapiens
gagcgcccccgagccctgact

SEQ ID NO: 969714 - DNA, 22 bp, Homo sapiens
gagcgcccccgagccctgactc

SEQ ID NO: 969715 - DNA, 23 bp, Homo sapiens
gagcgcctccatccaaggccagg

SEQ ID NO: 969716 - DNA, 13 bp, Homo sapiens
gagcgcctcttcc

SEQ ID NO: 969717 - DNA, 17 bp, Homo sapiens
gagcgctagtgccttgc

SEQ ID NO: 969718 - DNA, 20 bp, Homo sapiens
gagcgctcctctgccttgga

SEQ ID NO: 969719 - DNA, 21 bp, Homo sapiens
gagcgctcctctgccttggac

SEQ ID NO: 969720 - DNA, 18 bp, Homo sapiens
gagcgctgtggactgtcc

SEQ ID NO: 969721 - DNA, 12 bp, Homo sapiens
gagcgcttgggc

SEQ ID NO: 969722 - DNA, 19 bp, Homo sapiens
tagctgtaaggcatgaagg

SEQ ID NO: 969723 - DNA, 20 bp, Homo sapiens
tagctgtaagggcagtgccc

SEQ ID NO: 969724 - DNA, 21 bp, Homo sapiens
tagctgtaagggcagtgccca

SEQ ID NO: 969725 - DNA, 17 bp, Homo sapiens
tagctgtactataagta

SEQ ID NO: 969726 - DNA, 23 bp, Homo sapiens
tagctgtactataagtagttggt

SEQ ID NO: 969727 - DNA, 13 bp, Homo sapiens
tagctgtcaagcc

SEQ ID NO: 969728 - DNA, 16 bp, Homo sapiens
tagctgtctgtgaata

SEQ ID NO: 969729 - DNA, 14 bp, Homo sapiens
tagctgtgccccct

SEQ ID NO: 969730 - DNA, 13 bp, Homo sapiens
tagctgtgggggt

SEQ ID NO: 969731 - DNA, 15 bp, Homo sapiens
tagctgttctggact

SEQ ID NO: 969732 - DNA, 16 bp, Homo sapiens
tagctgttgagctgtt

SEQ ID NO: 969733 - DNA, 15 bp, Homo sapiens
tagctgttgtaaaga

SEQ ID NO: 969734 - DNA, 14 bp, Homo sapiens
tagctgtttcaaat

SEQ ID NO: 969735 - DNA, 17 bp, Homo sapiens
tagctgttttgtgtata

SEQ ID NO: 969736 - DNA, 16 bp, Homo sapiens
tagcttaagtgtaaat

SEQ ID NO: 969737 - DNA, 21 bp, Homo sapiens
tagcttacaagccagctggag

SEQ ID NO: 969738 - DNA, 20 bp, Homo sapiens
tagcttacactgaggactgt

SEQ ID NO: 969739 - DNA, 19 bp, Homo sapiens
tagcttacccaatgggacc

SEQ ID NO: 969740 - DNA, 17 bp, Homo sapiens
tagcttagacctcagcc

SEQ ID NO: 969741 - DNA, 18 bp, Homo sapiens
tagcttagacctcagcct

SEQ ID NO: 969742 - DNA, 15 bp, Homo sapiens
tagcttatctacttc

SEQ ID NO: 969743 - DNA, 12 bp, Homo sapiens
tagcttatcttt

SEQ ID NO: 969744 - DNA, 14 bp, Homo sapiens
tagcttatctttct

SEQ ID NO: 969745 - DNA, 15 bp, Homo sapiens
tagcttatctttctt

SEQ ID NO: 969746 - DNA, 18 bp, Homo sapiens
gagctggggtctgggcag

SEQ ID NO: 969747 - DNA, 22 bp, Homo sapiens
gagctggggtctgggcagtgcc

SEQ ID NO: 969748 - DNA, 15 bp, Homo sapiens
gagctgggtggcctg

SEQ ID NO: 969749 - DNA, 16 bp, Homo sapiens
gagctggtctgccagg

SEQ ID NO: 969750 - DNA, 15 bp, Homo sapiens
gagctggtgacagcc

SEQ ID NO: 969751 - DNA, 16 bp, Homo sapiens
gagctggtgactttgg

SEQ ID NO: 969752 - DNA, 16 bp, Homo sapiens
gagctggtgcattaca

SEQ ID NO: 969753 - DNA, 17 bp, Homo sapiens
gagctggtgcattacag

SEQ ID NO: 969754 - DNA, 21 bp, Homo sapiens
gagctggtgcccggagattgg

SEQ ID NO: 969755 - DNA, 18 bp, Homo sapiens
gagctgtaaaaatgttac

SEQ ID NO: 969756 - DNA, 18 bp, Homo sapiens
gagctgtcaccaaggaaa

SEQ ID NO: 969757 - DNA, 14 bp, Homo sapiens
gagctgtctgactg

SEQ ID NO: 969758 - DNA, 18 bp, Homo sapiens
gagctgtgcaggtgggga

SEQ ID NO: 969759 - DNA, 11 bp, Homo sapiens
gagctgtgcca

SEQ ID NO: 969760 - DNA, 18 bp, Homo sapiens
gagctgtgccagcagggg

SEQ ID NO: 969761 - DNA, 19 bp, Homo sapiens
gagctgtgcctgctcagca

SEQ ID NO: 969762 - DNA, 22 bp, Homo sapiens
gagctgtggaggattgctatct

SEQ ID NO: 969763 - DNA, 16 bp, Homo sapiens
gagctgttcgctcctc

SEQ ID NO: 969764 - DNA, 14 bp, Homo sapiens
gagctgttgtgagc

SEQ ID NO: 969765 - DNA, 19 bp, Homo sapiens
gagctgtttatggcctcag

SEQ ID NO: 969766 - DNA, 20 bp, Homo sapiens
gagctgtttatggcctcagc

SEQ ID NO: 969767 - DNA, 22 bp, Homo sapiens
gagctgtttatggcctcagctg

SEQ ID NO: 969768 - DNA, 21 bp, Homo sapiens
gagctgtttggatacagctgc

SEQ ID NO: 969769 - DNA, 16 bp, Homo sapiens
gagcttaaaatacaag

SEQ ID NO: 969770 - DNA, 17 bp, Homo sapiens
gagcttaaaatacaaga

SEQ ID NO: 969771 - DNA, 15 bp, Homo sapiens
gagcttaagccactg

SEQ ID NO: 969772 - DNA, 23 bp, Homo sapiens
gagcttaagccactgcctctccc

SEQ ID NO: 969773 - DNA, 20 bp, Homo sapiens
gagcttacccaagctgtggc

SEQ ID NO: 969774 - DNA, 17 bp, Homo sapiens
gagcttagccaatgtgg

SEQ ID NO: 969775 - DNA, 18 bp, Homo sapiens
gagcttagccttgtgccc

SEQ ID NO: 969776 - DNA, 19 bp, Homo sapiens
gagcttagccttgtgccct

SEQ ID NO: 969777 - DNA, 22 bp, Homo sapiens
gagcttagccttgtgccctgcc

SEQ ID NO: 969778 - DNA, 18 bp, Homo sapiens
gagcttattggccactgg

SEQ ID NO: 969779 - DNA, 15 bp, Homo sapiens
gagcttcaatataag

SEQ ID NO: 969780 - DNA, 13 bp, Homo sapiens
gagcttcctggct

SEQ ID NO: 969781 - DNA, 18 bp, Homo sapiens
gagcttcctggctctggg

SEQ ID NO: 969782 - DNA, 18 bp, Homo sapiens
gagcttcggttctccaga

SEQ ID NO: 969783 - DNA, 10 bp, Homo sapiens
gagcttctct

SEQ ID NO: 969784 - DNA, 14 bp, Homo sapiens
gagcttctctgtga

SEQ ID NO: 969785 - DNA, 16 bp, Homo sapiens
gagcttgaggtgggag

SEQ ID NO: 969786 - DNA, 18 bp, Homo sapiens
gagcttgaggtgggagcg

SEQ ID NO: 969787 - DNA, 23 bp, Homo sapiens
gagcttgatctgtgatttcttct

SEQ ID NO: 969788 - DNA, 15 bp, Homo sapiens
gagcttgattaaatc

SEQ ID NO: 969789 - DNA, 23 bp, Homo sapiens
gagcttgcacagccaacgagaca

SEQ ID NO: 969790 - DNA, 18 bp, Homo sapiens
gagcttgggactcaggtc

SEQ ID NO: 969791 - DNA, 24 bp, Homo sapiens
gagcttgtgctcctcttgattcct

SEQ ID NO: 969792 - DNA, 23 bp, Homo sapiens
gagcttgttgtctccacttgtat

SEQ ID NO: 969793 - DNA, 17 bp, Homo sapiens
gagctttaaaagtatct

SEQ ID NO: 969794 - DNA, 19 bp, Homo sapiens
gagctttccatgttgctgc

SEQ ID NO: 969795 - DNA, 14 bp, Homo sapiens
gagctttctcaatg

SEQ ID NO: 969796 - DNA, 18 bp, Homo sapiens
gagctttctcaatgtctt

SEQ ID NO: 969797 - DNA, 14 bp, Homo sapiens
gagctttcttttgt

SEQ ID NO: 969798 - DNA, 12 bp, Homo sapiens
gagctttgctta

SEQ ID NO: 969799 - DNA, 14 bp, Homo sapiens
gagctttggaatat

SEQ ID NO: 969800 - DNA, 13 bp, Homo sapiens
gagctttgtcact

SEQ ID NO: 969801 - DNA, 16 bp, Homo sapiens
gagctttgtcacttgc

SEQ ID NO: 969802 - DNA, 13 bp, Homo sapiens
gagctttgtttca

SEQ ID NO: 969803 - DNA, 22 bp, Homo sapiens
gagctttttcagaaacagggca

SEQ ID NO: 969804 - DNA, 23 bp, Homo sapiens
gagctttttcagaaacagggcag

SEQ ID NO: 969805 - DNA, 12 bp, Homo sapiens
gaggaaaaaaga

SEQ ID NO: 969806 - DNA, 23 bp, Homo sapiens
gaggaaaaaagaaccaaaacttc

SEQ ID NO: 969807 - DNA, 23 bp, Homo sapiens
gaggaaaaccaagccgtggcttc

SEQ ID NO: 969808 - DNA, 15 bp, Homo sapiens
gaggaaaagaaacct

SEQ ID NO: 969809 - DNA, 18 bp, Homo sapiens
gaggaaacaacagcttta

SEQ ID NO: 969810 - DNA, 21 bp, Homo sapiens
gaggaaacagttctcactggg

SEQ ID NO: 969811 - DNA, 14 bp, Homo sapiens
gaggaaactcacct

SEQ ID NO: 969812 - DNA, 20 bp, Homo sapiens
gaggaaactcacctgctggc

SEQ ID NO: 969813 - DNA, 17 bp, Homo sapiens
gaggaaagcgtttctgt

SEQ ID NO: 969814 - DNA, 13 bp, Homo sapiens
gaggaaaggattt

SEQ ID NO: 969815 - DNA, 21 bp, Homo sapiens
gaggaaagggaggagtggagg

SEQ ID NO: 969816 - DNA, 17 bp, Homo sapiens
gaggaaagggcctggcc

SEQ ID NO: 969817 - DNA, 22 bp, Homo sapiens
gaggaaagggcctggccagtcc

SEQ ID NO: 969818 - DNA, 21 bp, Homo sapiens
gaggaaataaagttaagtttg

SEQ ID NO: 969819 - DNA, 19 bp, Homo sapiens
gaggaaataacagagagaa

SEQ ID NO: 969820 - DNA, 23 bp, Homo sapiens
gaggaaccacatataacacttaa

SEQ ID NO: 969821 - DNA, 21 bp, Homo sapiens
gaggaacgggcagccacagga

SEQ ID NO: 969822 - DNA, 14 bp, Homo sapiens
gaggaactccagga

SEQ ID NO: 969823 - DNA, 18 bp, Homo sapiens
gaggaactgtccagagag

SEQ ID NO: 969824 - DNA, 17 bp, Homo sapiens
gaggaagagcaggcaca

SEQ ID NO: 969825 - DNA, 19 bp, Homo sapiens
gaggaagagcaggcacatg

SEQ ID NO: 969826 - DNA, 15 bp, Homo sapiens
gaggaagcagttggg

SEQ ID NO: 969827 - DNA, 19 bp, Homo sapiens
gaggaagcagttggggccc

SEQ ID NO: 969828 - DNA, 21 bp, Homo sapiens
gaggaagccggtgtccctgga

SEQ ID NO: 969829 - DNA, 22 bp, Homo sapiens
gaggaagccgttgaatctggga

SEQ ID NO: 969830 - DNA, 19 bp, Homo sapiens
gaggaagctggacagcggc

SEQ ID NO: 969831 - DNA, 16 bp, Homo sapiens
gaggaaggcctttctt

SEQ ID NO: 969832 - DNA, 12 bp, Homo sapiens
gaggaaggctct

SEQ ID NO: 969833 - DNA, 14 bp, Homo sapiens
gaggaaggctgaac

SEQ ID NO: 969834 - DNA, 19 bp, Homo sapiens
gaggaaggggccagaggct

SEQ ID NO: 969835 - DNA, 19 bp, Homo sapiens
gaggaaggtgactgtgtgt

SEQ ID NO: 969836 - DNA, 13 bp, Homo sapiens
gaggaaggtgctg

SEQ ID NO: 969837 - DNA, 18 bp, Homo sapiens
gaggaagtcttatcttct

SEQ ID NO: 969838 - DNA, 18 bp, Homo sapiens
gaggaagtggctgtccct

SEQ ID NO: 969839 - DNA, 17 bp, Homo sapiens
gaggaagtggggtctgg

SEQ ID NO: 969840 - DNA, 21 bp, Homo sapiens
gaggaagtggggtctggcctg

SEQ ID NO: 969841 - DNA, 17 bp, Homo sapiens
gaggaataattatttat

SEQ ID NO: 969842 - DNA, 15 bp, Homo sapiens
gaggaatacatttta

SEQ ID NO: 969843 - DNA, 23 bp, Homo sapiens
gaggaatatgacggaagaacata

SEQ ID NO: 969844 - DNA, 20 bp, Homo sapiens
gaggaatcatgtcaggcctg

SEQ ID NO: 969845 - DNA, 19 bp, Homo sapiens
gaggaatccaaaagacaaa

SEQ ID NO: 969846 - DNA, 16 bp, Homo sapiens
gaggaatcctggcagc

SEQ ID NO: 969847 - DNA, 17 bp, Homo sapiens
gaggaatcctggcagcc

SEQ ID NO: 969848 - DNA, 20 bp, Homo sapiens
gaggaatcctggcagcccag

SEQ ID NO: 969849 - DNA, 20 bp, Homo sapiens
gaggaatcgaggaaccagag

SEQ ID NO: 969850 - DNA, 19 bp, Homo sapiens
gaggaatcgccccagactc

SEQ ID NO: 969851 - DNA, 15 bp, Homo sapiens
gaggaatgctccccc

SEQ ID NO: 969852 - DNA, 20 bp, Homo sapiens
gaggaatgctctgtgccaga

SEQ ID NO: 969853 - DNA, 13 bp, Homo sapiens
gaggaatgtatat

SEQ ID NO: 969854 - DNA, 22 bp, Homo sapiens
gaggaattttctttgtgtagct

SEQ ID NO: 969855 - DNA, 16 bp, Homo sapiens
tagggtcttgggggtc

SEQ ID NO: 969856 - DNA, 22 bp, Homo sapiens
tagggtgctctgaatctgtaca

SEQ ID NO: 969857 - DNA, 16 bp, Homo sapiens
tagggtggagagccac

SEQ ID NO: 969858 - DNA, 16 bp, Homo sapiens
tagggtggctttaatt

SEQ ID NO: 969859 - DNA, 21 bp, Homo sapiens
tagggtgtgtgttcaccttca

SEQ ID NO: 969860 - DNA, 17 bp, Homo sapiens
tagggttataataatgt

SEQ ID NO: 969861 - DNA, 21 bp, Homo sapiens
tagggttctgatcacattgca

SEQ ID NO: 969862 - DNA, 17 bp, Homo sapiens
taggtaaactaacctgg

SEQ ID NO: 969863 - DNA, 13 bp, Homo sapiens
taggtaacttcat

SEQ ID NO: 969864 - DNA, 12 bp, Homo sapiens
taggtaagggcc

SEQ ID NO: 969865 - DNA, 13 bp, Homo sapiens
taggtaagtgggg

SEQ ID NO: 969866 - DNA, 17 bp, Homo sapiens
taggtagagtcattcat

SEQ ID NO: 969867 - DNA, 15 bp, Homo sapiens
tagtcactaagactt

SEQ ID NO: 969868 - DNA, 17 bp, Homo sapiens
tagtcacttatttcata

SEQ ID NO: 969869 - DNA, 16 bp, Homo sapiens
tagtcagctgcctttt

SEQ ID NO: 969870 - DNA, 22 bp, Homo sapiens
tagtcagtaaagatatttgaat

SEQ ID NO: 969871 - DNA, 15 bp, Homo sapiens
tagtcataaaatagt

SEQ ID NO: 969872 - DNA, 19 bp, Homo sapiens
tagtcatcagatatgctta

SEQ ID NO: 969873 - DNA, 18 bp, Homo sapiens
tagtcatccaacaagaag

SEQ ID NO: 969874 - DNA, 19 bp, Homo sapiens
tagtcatggataactacat

SEQ ID NO: 969875 - DNA, 15 bp, Homo sapiens
tagtcattgatagaa

SEQ ID NO: 969876 - DNA, 13 bp, Homo sapiens
tagtcattgtcat

SEQ ID NO: 969877 - DNA, 14 bp, Homo sapiens
tagtcatttccaaa

SEQ ID NO: 969878 - DNA, 14 bp, Homo sapiens
tagtcatttttagc

SEQ ID NO: 969879 - DNA, 19 bp, Homo sapiens
tagtcatttttagcactgg

SEQ ID NO: 969880 - DNA, 16 bp, Homo sapiens
tagtccacggaccccc

SEQ ID NO: 969881 - DNA, 23 bp, Homo sapiens
tagtccatggacaatataaactg

SEQ ID NO: 969882 - DNA, 20 bp, Homo sapiens
tagtcccatttttctcttgc

SEQ ID NO: 969883 - DNA, 21 bp, Homo sapiens
tagtcccccaactctgagccc

SEQ ID NO: 969884 - DNA, 20 bp, Homo sapiens
tagtcccttcccctccctgg

SEQ ID NO: 969885 - DNA, 23 bp, Homo sapiens
tagtccgggggacttggggctga

SEQ ID NO: 969886 - DNA, 12 bp, Homo sapiens
tagtcctcaggg

SEQ ID NO: 969887 - DNA, 12 bp, Homo sapiens
tagtcctgtgaa

SEQ ID NO: 969888 - DNA, 15 bp, Homo sapiens
tagtccttcctggca

SEQ ID NO: 969889 - DNA, 14 bp, Homo sapiens
tagtccttggcata

SEQ ID NO: 969890 - DNA, 19 bp, Homo sapiens
tagtcgggacttgtaacat

SEQ ID NO: 969891 - DNA, 19 bp, Homo sapiens
tagtctagatggctcctct

SEQ ID NO: 969892 - DNA, 12 bp, Homo sapiens
tagtctagtttc

SEQ ID NO: 969893 - DNA, 11 bp, Homo sapiens
tagtctcagtt

SEQ ID NO: 969894 - DNA, 19 bp, Homo sapiens
tagtctcagtttgtgtgtc

SEQ ID NO: 969895 - DNA, 22 bp, Homo sapiens
tagtctcagtttgtgtgtctta

SEQ ID NO: 969896 - DNA, 21 bp, Homo sapiens
tagtctcattacttttgaagt

SEQ ID NO: 969897 - DNA, 20 bp, Homo sapiens
tagtctcctttgcactgagg

SEQ ID NO: 969898 - DNA, 23 bp, Homo sapiens
tagtctctctggggccacacaga

SEQ ID NO: 969899 - DNA, 14 bp, Homo sapiens
tagtctctgtgctt

SEQ ID NO: 969900 - DNA, 16 bp, Homo sapiens
tagtctctttaaaagg

SEQ ID NO: 969901 - DNA, 21 bp, Homo sapiens
tagtctgaagtgaagtacaga

SEQ ID NO: 969902 - DNA, 12 bp, Homo sapiens
tagtctggtttc

SEQ ID NO: 969903 - DNA, 14 bp, Homo sapiens
tagtctgtaataca

SEQ ID NO: 969904 - DNA, 18 bp, Homo sapiens
tagtcttatgtaaagtat

SEQ ID NO: 969905 - DNA, 20 bp, Homo sapiens
tagtcttatgtaaagtatgt

SEQ ID NO: 969906 - DNA, 19 bp, Homo sapiens
tagtctttagctattactg

SEQ ID NO: 969907 - DNA, 18 bp, Homo sapiens
tagtctttgccagtcatt

SEQ ID NO: 969908 - DNA, 19 bp, Homo sapiens
tagtcttttgcatgtcgca

SEQ ID NO: 969909 - DNA, 12 bp, Homo sapiens
tagtcttttgct

SEQ ID NO: 969910 - DNA, 13 bp, Homo sapiens
tagtcttttgctt

SEQ ID NO: 969911 - DNA, 15 bp, Homo sapiens
tagtcttttgctttt

SEQ ID NO: 969912 - DNA, 17 bp, Homo sapiens
tagtcttttgcttttgc

SEQ ID NO: 969913 - DNA, 15 bp, Homo sapiens
tagtctttttttcct

SEQ ID NO: 969914 - DNA, 21 bp, Homo sapiens
tagtctttttttccttccttt

SEQ ID NO: 969915 - DNA, 24 bp, Homo sapiens
tagtgaaaccccatctctactgaa

SEQ ID NO: 969916 - DNA, 16 bp, Homo sapiens
tagtgaagatggtttc

SEQ ID NO: 969917 - DNA, 18 bp, Homo sapiens
tagtgaatttctgaaaga

SEQ ID NO: 969918 - DNA, 17 bp, Homo sapiens
tagtgacaagtgaagaa

SEQ ID NO: 969919 - DNA, 22 bp, Homo sapiens
tagtgacctgtgtttcacttaa

SEQ ID NO: 969920 - DNA, 18 bp, Homo sapiens
tagtgagacccctgtctc

SEQ ID NO: 969921 - DNA, 17 bp, Homo sapiens
tagtgagccatgatttt

SEQ ID NO: 969922 - DNA, 13 bp, Homo sapiens
tagtgagcctggg

SEQ ID NO: 969923 - DNA, 13 bp, Homo sapiens
tagtgattctgat

SEQ ID NO: 969924 - DNA, 16 bp, Homo sapiens
tagtgcaaaaaacata

SEQ ID NO: 969925 - DNA, 16 bp, Homo sapiens
tagtgcaaaactgtgt

SEQ ID NO: 969926 - DNA, 18 bp, Homo sapiens
tagtgcaacatctctgaa

SEQ ID NO: 969927 - DNA, 19 bp, Homo sapiens
tagtgcaacatctctgaat

SEQ ID NO: 969928 - DNA, 15 bp, Homo sapiens
tagtgcaacttagat

SEQ ID NO: 969929 - DNA, 19 bp, Homo sapiens
tagtgcaatagtgcaacat

SEQ ID NO: 969930 - DNA, 12 bp, Homo sapiens
tagtgcagctga

SEQ ID NO: 969931 - DNA, 14 bp, Homo sapiens
tagtgcagctgatt

SEQ ID NO: 969932 - DNA, 19 bp, Homo sapiens
tagtgcagctgattttaac

SEQ ID NO: 969933 - DNA, 18 bp, Homo sapiens
tagtgcatttttaaactt

SEQ ID NO: 969934 - DNA, 23 bp, Homo sapiens
tagtgcatttttaaacttgaaat

SEQ ID NO: 969935 - DNA, 16 bp, Homo sapiens
tagtgccaaataattg

SEQ ID NO: 969936 - DNA, 22 bp, Homo sapiens
tagtgccacttaatgtatgtta

SEQ ID NO: 969937 - DNA, 20 bp, Homo sapiens
tagtgccagctactcaggag

SEQ ID NO: 969938 - DNA, 19 bp, Homo sapiens
tagtgccaggagggcacag

SEQ ID NO: 969939 - DNA, 18 bp, Homo sapiens
tagtgccccacctcccgc

SEQ ID NO: 969940 - DNA, 23 bp, Homo sapiens
tagtgccgtagggagtacctgct

SEQ ID NO: 969941 - DNA, 15 bp, Homo sapiens
tagtgccttgcccac

SEQ ID NO: 969942 - DNA, 16 bp, Homo sapiens
tagtgccttgcccaca

SEQ ID NO: 969943 - DNA, 17 bp, Homo sapiens
tagtgccttgcccacag

SEQ ID NO: 969944 - DNA, 17 bp, Homo sapiens
tagtgctattctgtgtt

SEQ ID NO: 969945 - DNA, 21 bp, Homo sapiens
tagtgctattctgtgttgaac

SEQ ID NO: 969946 - DNA, 17 bp, Homo sapiens
tagtgctcttaacttgt

SEQ ID NO: 969947 - DNA, 18 bp, Homo sapiens
tagtgctgcaataaacat

SEQ ID NO: 969948 - DNA, 13 bp, Homo sapiens
tagtgctgctgaa

SEQ ID NO: 969949 - DNA, 22 bp, Homo sapiens
tagtgctgctgaagatgaatca

SEQ ID NO: 969950 - DNA, 22 bp, Homo sapiens
tagtgctgctgtgtgctttttt

SEQ ID NO: 969951 - DNA, 12 bp, Homo sapiens
tagtgctgtgaa

SEQ ID NO: 969952 - DNA, 16 bp, Homo sapiens
tagtgctgtttaagct

SEQ ID NO: 969953 - DNA, 19 bp, Homo sapiens
tagtggaagagcagcctga

SEQ ID NO: 969954 - DNA, 13 bp, Homo sapiens
tagtggagccagg

SEQ ID NO: 969955 - DNA, 14 bp, Homo sapiens
tagtggagccaggt

SEQ ID NO: 969956 - DNA, 19 bp, Homo sapiens
tagtggaggaggtggcttc

SEQ ID NO: 969957 - DNA, 14 bp, Homo sapiens
tagtggatgactgt

SEQ ID NO: 969958 - DNA, 23 bp, Homo sapiens
tagtggatgactgttgatgaagt

SEQ ID NO: 969959 - DNA, 21 bp, Homo sapiens
tagtggcaagacagtggttct

SEQ ID NO: 969960 - DNA, 18 bp, Homo sapiens
tagtgggcaccccactgc

SEQ ID NO: 969961 - DNA, 20 bp, Homo sapiens
tagtgggccctctctctggg

SEQ ID NO: 969962 - DNA, 22 bp, Homo sapiens
tagtggggaaaggaatcaatta

SEQ ID NO: 969963 - DNA, 17 bp, Homo sapiens
tagtggggcctgggagg

SEQ ID NO: 969964 - DNA, 20 bp, Homo sapiens
tagtggggtctccctctcct

SEQ ID NO: 969965 - DNA, 22 bp, Homo sapiens
tagtggggtctccctctcctgc

SEQ ID NO: 969966 - DNA, 15 bp, Homo sapiens
tagtgggtacatcaa

SEQ ID NO: 969967 - DNA, 12 bp, Homo sapiens
tagtgggttgac

SEQ ID NO: 969968 - DNA, 14 bp, Homo sapiens
tagtggtcataaaa

SEQ ID NO: 969969 - DNA, 15 bp, Homo sapiens
tagtgtaagaactgt

SEQ ID NO: 969970 - DNA, 18 bp, Homo sapiens
tagtgtaagaactgtaca

SEQ ID NO: 969971 - DNA, 22 bp, Homo sapiens
tagtgtacctcctctcagtgtt

SEQ ID NO: 969972 - DNA, 22 bp, Homo sapiens
tagtgtaggataatataaaaag

SEQ ID NO: 969973 - DNA, 21 bp, Homo sapiens
tagtgtataccacctgtacat

SEQ ID NO: 969974 - DNA, 14 bp, Homo sapiens
tagtgtattaatca

SEQ ID NO: 969975 - DNA, 20 bp, Homo sapiens
tagtgtattaatctctgtgt

SEQ ID NO: 969976 - DNA, 20 bp, Homo sapiens
tagtgtcaacttttaacttt

SEQ ID NO: 969977 - DNA, 20 bp, Homo sapiens
tagtgtccataaataaagtt

SEQ ID NO: 969978 - DNA, 13 bp, Homo sapiens
tagtgtcccccct

SEQ ID NO: 969979 - DNA, 17 bp, Homo sapiens
tagtgtccccccttgaa

SEQ ID NO: 969980 - DNA, 21 bp, Homo sapiens
tagtgtccccccttgaagcaa

SEQ ID NO: 969981 - DNA, 21 bp, Homo sapiens
tagtgtctgggtttggcccaa

SEQ ID NO: 969982 - DNA, 12 bp, Homo sapiens
tagtgtctgtcc

SEQ ID NO: 969983 - DNA, 22 bp, Homo sapiens
tagtgtctgtccatctgtctgt

SEQ ID NO: 969984 - DNA, 22 bp, Homo sapiens
gaggatttaagggatggaaaag

SEQ ID NO: 969985 - DNA, 17 bp, Homo sapiens
gaggatttcaagcctgc

SEQ ID NO: 969986 - DNA, 24 bp, Homo sapiens
gaggatttcctggagtgccctgca

SEQ ID NO: 969987 - DNA, 14 bp, Homo sapiens
gaggcaaaaatgtc

SEQ ID NO: 969988 - DNA, 15 bp, Homo sapiens
gagggagcttagcca

SEQ ID NO: 969989 - DNA, 14 bp, Homo sapiens
gagggaggacctgg

SEQ ID NO: 969990 - DNA, 13 bp, Homo sapiens
gagggagggagcc

SEQ ID NO: 969991 - DNA, 17 bp, Homo sapiens
gagggagggcagctggc

SEQ ID NO: 969992 - DNA, 13 bp, Homo sapiens
tagttttttgctt

SEQ ID NO: 969993 - DNA, 19 bp, Homo sapiens
tagttttttgcttctcttt

SEQ ID NO: 969994 - DNA, 19 bp, Homo sapiens
tataaaaaactcacaggtg

SEQ ID NO: 969995 - DNA, 13 bp, Homo sapiens
tataaaaaagaaa

SEQ ID NO: 969996 - DNA, 15 bp, Homo sapiens
tataaaaaatatgta

SEQ ID NO: 969997 - DNA, 16 bp, Homo sapiens
tataaaaaatatgtat

SEQ ID NO: 969998 - DNA, 14 bp, Homo sapiens
tataaaaaatggtt

SEQ ID NO: 969999 - DNA, 16 bp, Homo sapiens
tataaaaaatggttca

SEQ ID NO: 970000 - DNA, 13 bp, Homo sapiens
tataaaaacactt

SEQ ID NO: 970001 - DNA, 15 bp, Homo sapiens
tataaaaacacttat

SEQ ID NO: 970002 - DNA, 20 bp, Homo sapiens
tataaaaacagattctgatt

SEQ ID NO: 970003 - DNA, 19 bp, Homo sapiens
tataaaaactcctgggctt

SEQ ID NO: 970004 - DNA, 21 bp, Homo sapiens
tataaaaagaaaagataaaga

SEQ ID NO: 970005 - DNA, 23 bp, Homo sapiens
tataaaaagaaaagataaagatg

SEQ ID NO: 970006 - DNA, 17 bp, Homo sapiens
tataaaaagcagcagag

SEQ ID NO: 970007 - DNA, 23 bp, Homo sapiens
tataaaaaggaagtggggacaga

SEQ ID NO: 970008 - DNA, 14 bp, Homo sapiens
tataaaacagtcat

SEQ ID NO: 970009 - DNA, 13 bp, Homo sapiens
tataaaactcagt

SEQ ID NO: 970010 - DNA, 21 bp, Homo sapiens
tataaaactcagttaaaatgt

SEQ ID NO: 970011 - DNA, 14 bp, Homo sapiens
tataaaactgaaat

SEQ ID NO: 970012 - DNA, 16 bp, Homo sapiens
tataaaactgtacttc

SEQ ID NO: 970013 - DNA, 12 bp, Homo sapiens
tataaaacttct

SEQ ID NO: 970014 - DNA, 12 bp, Homo sapiens
tataaaagcctt

SEQ ID NO: 970015 - DNA, 20 bp, Homo sapiens
tataaaaggatgttacaagt

SEQ ID NO: 970016 - DNA, 15 bp, Homo sapiens
tataaaataaatata

SEQ ID NO: 970017 - DNA, 21 bp, Homo sapiens
tataaaatgcccatttcgaag

SEQ ID NO: 970018 - DNA, 15 bp, Homo sapiens
tataaaatggacaca

SEQ ID NO: 970019 - DNA, 18 bp, Homo sapiens
tataaaatgtattcaagc

SEQ ID NO: 970020 - DNA, 12 bp, Homo sapiens
tataaaatgtgc

SEQ ID NO: 970021 - DNA, 21 bp, Homo sapiens
tataaaatgtgcagatgcaat

SEQ ID NO: 970022 - DNA, 20 bp, Homo sapiens
tataaacaataaaaacaact

SEQ ID NO: 970023 - DNA, 18 bp, Homo sapiens
tataaacactgtattgta

SEQ ID NO: 970024 - DNA, 19 bp, Homo sapiens
tataaacactgtattgtaa

SEQ ID NO: 970025 - DNA, 19 bp, Homo sapiens
tataaacagaactcccttc

SEQ ID NO: 970026 - DNA, 21 bp, Homo sapiens
tataaacatatttttatactt

SEQ ID NO: 970027 - DNA, 18 bp, Homo sapiens
tataaacctaaaaaagat

SEQ ID NO: 970028 - DNA, 19 bp, Homo sapiens
tataaacctaaaaaagata

SEQ ID NO: 970029 - DNA, 18 bp, Homo sapiens
tataaaccttcagaagct

SEQ ID NO: 970030 - DNA, 23 bp, Homo sapiens
tataaactgagaggtcacaaaga

SEQ ID NO: 970031 - DNA, 18 bp, Homo sapiens
tataaactgctgtcaata

SEQ ID NO: 970032 - DNA, 12 bp, Homo sapiens
tataaactgtag

SEQ ID NO: 970033 - DNA, 15 bp, Homo sapiens
tataaactttacctt

SEQ ID NO: 970034 - DNA, 17 bp, Homo sapiens
tataaactttacctttt

SEQ ID NO: 970035 - DNA, 13 bp, Homo sapiens
tataaactttaga

SEQ ID NO: 970036 - DNA, 15 bp, Homo sapiens
tataaactttagagt

SEQ ID NO: 970037 - DNA, 22 bp, Homo sapiens
tataaactttagagtagcatga

SEQ ID NO: 970038 - DNA, 15 bp, Homo sapiens
tataaagaaaaatag

SEQ ID NO: 970039 - DNA, 17 bp, Homo sapiens
tataaagagaagacgaa

SEQ ID NO: 970040 - DNA, 15 bp, Homo sapiens
tataaagataaaata

SEQ ID NO: 970041 - DNA, 13 bp, Homo sapiens
tataaagatatat

SEQ ID NO: 970042 - DNA, 15 bp, Homo sapiens
tataaagatatatag

SEQ ID NO: 970043 - DNA, 14 bp, Homo sapiens
tataaagattgtac

SEQ ID NO: 970044 - DNA, 16 bp, Homo sapiens
tataaagattgtactt

SEQ ID NO: 970045 - DNA, 14 bp, Homo sapiens
tataaagcagatta

SEQ ID NO: 970046 - DNA, 18 bp, Homo sapiens
tataaagcagattacctc

SEQ ID NO: 970047 - DNA, 15 bp, Homo sapiens
tataaagcagtagac

SEQ ID NO: 970048 - DNA, 16 bp, Homo sapiens
tataaagctagatgct

SEQ ID NO: 970049 - DNA, 20 bp, Homo sapiens
tataaaggaccctgtttctg

SEQ ID NO: 970050 - DNA, 21 bp, Homo sapiens
tataaaggaccctgtttctgt

SEQ ID NO: 970051 - DNA, 15 bp, Homo sapiens
tataaaggttatgaa

SEQ ID NO: 970052 - DNA, 19 bp, Homo sapiens
tataaaggttatgaaacat

SEQ ID NO: 970053 - DNA, 21 bp, Homo sapiens
tataaaggttatgaaacatat

SEQ ID NO: 970054 - DNA, 19 bp, Homo sapiens
tataaagtacccatctagt

SEQ ID NO: 970055 - DNA, 23 bp, Homo sapiens
tataaagtacccatctagtactt

SEQ ID NO: 970056 - DNA, 18 bp, Homo sapiens
tataaagtagtcctgtga

SEQ ID NO: 970057 - DNA, 14 bp, Homo sapiens
tataaagtattctt

SEQ ID NO: 970058 - DNA, 15 bp, Homo sapiens
tataaagtattcttt

SEQ ID NO: 970059 - DNA, 15 bp, Homo sapiens
tataaagtcacttcc

SEQ ID NO: 970060 - DNA, 19 bp, Homo sapiens
tataaagtggaagtatgta

SEQ ID NO: 970061 - DNA, 20 bp, Homo sapiens
tataaataaatgtttctagt

SEQ ID NO: 970062 - DNA, 21 bp, Homo sapiens
tataaataagagcatgatttg

SEQ ID NO: 970063 - DNA, 17 bp, Homo sapiens
tataaatacgtattaca

SEQ ID NO: 970064 - DNA, 18 bp, Homo sapiens
tataaatactgcaaatca

SEQ ID NO: 970065 - DNA, 15 bp, Homo sapiens
tataaatagctgaaa

SEQ ID NO: 970066 - DNA, 20 bp, Homo sapiens
tataaatagctgaaaactaa

SEQ ID NO: 970067 - DNA, 19 bp, Homo sapiens
tataaatatcagtattctg

SEQ ID NO: 970068 - DNA, 15 bp, Homo sapiens
tataaatcaatgtca

SEQ ID NO: 970069 - DNA, 16 bp, Homo sapiens
tataaatcaatgtcac

SEQ ID NO: 970070 - DNA, 14 bp, Homo sapiens
tataaatcagtatt

SEQ ID NO: 970071 - DNA, 22 bp, Homo sapiens
tataaatctggggaagaggttt

SEQ ID NO: 970072 - DNA, 21 bp, Homo sapiens
tataaatgacaaagtgttgaa

SEQ ID NO: 970073 - DNA, 12 bp, Homo sapiens
tataaatgagca

SEQ ID NO: 970074 - DNA, 16 bp, Homo sapiens
tataaatgctattttt

SEQ ID NO: 970075 - DNA, 14 bp, Homo sapiens
tataaatgtaaaaa

SEQ ID NO: 970076 - DNA, 14 bp, Homo sapiens
tataaatgtgtgta

SEQ ID NO: 970077 - DNA, 14 bp, Homo sapiens
tataaatgtttgga

SEQ ID NO: 970078 - DNA, 16 bp, Homo sapiens
tataaatgtttggaaa

SEQ ID NO: 970079 - DNA, 23 bp, Homo sapiens
tataaatgtttggaaaggttcta

SEQ ID NO: 970080 - DNA, 11 bp, Homo sapiens
tataaattaaa

SEQ ID NO: 970081 - DNA, 16 bp, Homo sapiens
tataaattaaataaac

SEQ ID NO: 970082 - DNA, 20 bp, Homo sapiens
tataaattaaataaactgtt

SEQ ID NO: 970083 - DNA, 22 bp, Homo sapiens
tataaattaaatatatgtatgt

SEQ ID NO: 970084 - DNA, 17 bp, Homo sapiens
tataaattaagaagagt

SEQ ID NO: 970085 - DNA, 21 bp, Homo sapiens
tataaattgggataaacatca

SEQ ID NO: 970086 - DNA, 22 bp, Homo sapiens
tataaattgtctttaaaaactg

SEQ ID NO: 970087 - DNA, 20 bp, Homo sapiens
tataacaattcagtaacaaa

SEQ ID NO: 970088 - DNA, 20 bp, Homo sapiens
tataacagatacatttccct

SEQ ID NO: 970089 - DNA, 20 bp, Homo sapiens
tataacagtgtctttctagc

SEQ ID NO: 970090 - DNA, 14 bp, Homo sapiens
tataacagttatat

SEQ ID NO: 970091 - DNA, 13 bp, Homo sapiens
tataacatgtaaa

SEQ ID NO: 970092 - DNA, 14 bp, Homo sapiens
tataacatgtaaaa

SEQ ID NO: 970093 - DNA, 22 bp, Homo sapiens
tataacatgtctttcagcatta

SEQ ID NO: 970094 - DNA, 15 bp, Homo sapiens
tataaccatatgata

SEQ ID NO: 970095 - DNA, 17 bp, Homo sapiens
tataaccattacatgtt

SEQ ID NO: 970096 - DNA, 20 bp, Homo sapiens
tataacctagttaaagaaag

SEQ ID NO: 970097 - DNA, 20 bp, Homo sapiens
tataaccttaatttattatt

SEQ ID NO: 970098 - DNA, 20 bp, Homo sapiens
tataacgtgttcaatatttt

SEQ ID NO: 970099 - DNA, 14 bp, Homo sapiens
tataactaacatgt

SEQ ID NO: 970100 - DNA, 19 bp, Homo sapiens
tataactactccggagaca

SEQ ID NO: 970101 - DNA, 21 bp, Homo sapiens
tataactcatcataaaataaa

SEQ ID NO: 970102 - DNA, 23 bp, Homo sapiens
tataactgtatttgaaataagaa

SEQ ID NO: 970103 - DNA, 14 bp, Homo sapiens
tataactgtcttgt

SEQ ID NO: 970104 - DNA, 19 bp, Homo sapiens
tataactgttttagaaatt

SEQ ID NO: 970105 - DNA, 18 bp, Homo sapiens
tataacttaaaaaaatga

SEQ ID NO: 970106 - DNA, 22 bp, Homo sapiens
tataacttaaaaaaatgacaga

SEQ ID NO: 970107 - DNA, 18 bp, Homo sapiens
tataacttaatgaaaaca

SEQ ID NO: 970108 - DNA, 17 bp, Homo sapiens
tataacttatattgtaa

SEQ ID NO: 970109 - DNA, 21 bp, Homo sapiens
tataacttatattgtaagaaa

SEQ ID NO: 970110 - DNA, 19 bp, Homo sapiens
aaaaatgtccagccacccc

SEQ ID NO: 970111 - DNA, 12 bp, Homo sapiens
aaaaatgtgtaa

SEQ ID NO: 970112 - DNA, 20 bp, Homo sapiens
aaaaatgttttttcatgtgt

SEQ ID NO: 970113 - DNA, 11 bp, Homo sapiens
aaaaattaaaa

SEQ ID NO: 970114 - DNA, 18 bp, Homo sapiens
aaaaattaaaacgaaaat

SEQ ID NO: 970115 - DNA, 14 bp, Homo sapiens
aaaaattaactttt

SEQ ID NO: 970116 - DNA, 17 bp, Homo sapiens
aaaaattacatatataa

SEQ ID NO: 970117 - DNA, 19 bp, Homo sapiens
aaaaattacctttaatttt

SEQ ID NO: 970118 - DNA, 20 bp, Homo sapiens
aaaaattacctttaatttta

SEQ ID NO: 970119 - DNA, 14 bp, Homo sapiens
aaaaattactaatt

SEQ ID NO: 970120 - DNA, 14 bp, Homo sapiens
aaaaattgaaatgt

SEQ ID NO: 970121 - DNA, 22 bp, Homo sapiens
aaaaattgaaatgtaaggctgt

SEQ ID NO: 970122 - DNA, 18 bp, Homo sapiens
aaaaattggttctttatt

SEQ ID NO: 970123 - DNA, 11 bp, Homo sapiens
aaaaattgtta

SEQ ID NO: 970124 - DNA, 18 bp, Homo sapiens
aaaaattgtttcttgaca

SEQ ID NO: 970125 - DNA, 12 bp, Homo sapiens
aaaaattgtttt

SEQ ID NO: 970126 - DNA, 15 bp, Homo sapiens
aaaaatttaaaagta

SEQ ID NO: 970127 - DNA, 14 bp, Homo sapiens
aaaaatttaagcat

SEQ ID NO: 970128 - DNA, 15 bp, Homo sapiens
aaaaatttaagcatt

SEQ ID NO: 970129 - DNA, 18 bp, Homo sapiens
aaaaatttaagcattgtt

SEQ ID NO: 970130 - DNA, 20 bp, Homo sapiens
aaaaatttaagcattgtttg

SEQ ID NO: 970131 - DNA, 21 bp, Homo sapiens
aaaaatttaagcattgtttgc

SEQ ID NO: 970132 - DNA, 13 bp, Homo sapiens
aaaaatttattat

SEQ ID NO: 970133 - DNA, 22 bp, Homo sapiens
aaaaatttattatatatttaca

SEQ ID NO: 970134 - DNA, 11 bp, Homo sapiens
aaaaatttcac

SEQ ID NO: 970135 - DNA, 22 bp, Homo sapiens
aaaaattttataaaattaagca

SEQ ID NO: 970136 - DNA, 10 bp, Homo sapiens
aaaacaaaaa

SEQ ID NO: 970137 - DNA, 20 bp, Homo sapiens
aaaacaaaaacgccttttct

SEQ ID NO: 970138 - DNA, 15 bp, Homo sapiens
aaaacaaaaagaaca

SEQ ID NO: 970139 - DNA, 19 bp, Homo sapiens
aaaacaaaagggtgtatag

SEQ ID NO: 970140 - DNA, 22 bp, Homo sapiens
aaaacaaaatttgactaatttt

SEQ ID NO: 970141 - DNA, 13 bp, Homo sapiens
aaaacaaacaaaa

SEQ ID NO: 970142 - DNA, 13 bp, Homo sapiens
aaaacaaacttcc

SEQ ID NO: 970143 - DNA, 12 bp, Homo sapiens
aaaacaaagaag

SEQ ID NO: 970144 - DNA, 17 bp, Homo sapiens
aaaacaaatatacattt

SEQ ID NO: 970145 - DNA, 18 bp, Homo sapiens
aaaacaacaaaagaattt

SEQ ID NO: 970146 - DNA, 22 bp, Homo sapiens
aaaacaaccgtcctgctgtccc

SEQ ID NO: 970147 - DNA, 20 bp, Homo sapiens
aaaacaacttggcatttcta

SEQ ID NO: 970148 - DNA, 22 bp, Homo sapiens
aaaacaactttcacttcttcct

SEQ ID NO: 970149 - DNA, 21 bp, Homo sapiens
aaaacaagaggacacaatggc

SEQ ID NO: 970150 - DNA, 18 bp, Homo sapiens
aaaacaatatctgcagcg

SEQ ID NO: 970151 - DNA, 19 bp, Homo sapiens
aaaacaatcatttgctttt

SEQ ID NO: 970152 - DNA, 12 bp, Homo sapiens
aaaacaattcag

SEQ ID NO: 970153 - DNA, 16 bp, Homo sapiens
aaaacaatttcttttt

SEQ ID NO: 970154 - DNA, 18 bp, Homo sapiens
aaaacacagcctccctga

SEQ ID NO: 970155 - DNA, 12 bp, Homo sapiens
aaaacacatttt

SEQ ID NO: 970156 - DNA, 21 bp, Homo sapiens
aaaacaccgcttctgcctttt

SEQ ID NO: 970157 - DNA, 21 bp, Homo sapiens
aaaacactaaaaataaaaatg

SEQ ID NO: 970158 - DNA, 14 bp, Homo sapiens
aaaacactagtttt

SEQ ID NO: 970159 - DNA, 18 bp, Homo sapiens
aaaacactgccatcttag

SEQ ID NO: 970160 - DNA, 14 bp, Homo sapiens
aaaacactgtggaa

SEQ ID NO: 970161 - DNA, 19 bp, Homo sapiens
aaaacacttggcatacaaa

SEQ ID NO: 970162 - DNA, 18 bp, Homo sapiens
aaaacagaacatcattag

SEQ ID NO: 970163 - DNA, 13 bp, Homo sapiens
aaaacagaagcct

SEQ ID NO: 970164 - DNA, 15 bp, Homo sapiens
aaaacagacgggtct

SEQ ID NO: 970165 - DNA, 15 bp, Homo sapiens
aaaacagactcaggt

SEQ ID NO: 970166 - DNA, 16 bp, Homo sapiens
aaaacagcattgcttt

SEQ ID NO: 970167 - DNA, 19 bp, Homo sapiens
aaaacaggcaaagttttac

SEQ ID NO: 970168 - DNA, 20 bp, Homo sapiens
aaaacagggtgggcaaactc

SEQ ID NO: 970169 - DNA, 19 bp, Homo sapiens
aaaacaggtatatactttg

SEQ ID NO: 970170 - DNA, 21 bp, Homo sapiens
aaaacaggtcttcatcgaatc

SEQ ID NO: 970171 - DNA, 14 bp, Homo sapiens
aaaacagtacagaa

SEQ ID NO: 970172 - DNA, 17 bp, Homo sapiens
aaaacataatcttctgc

SEQ ID NO: 970173 - DNA, 18 bp, Homo sapiens
aaaacatacttacatttc

SEQ ID NO: 970174 - DNA, 19 bp, Homo sapiens
aaaacatacttacatttca

SEQ ID NO: 970175 - DNA, 21 bp, Homo sapiens
aaaacatacttacatttcaga

SEQ ID NO: 970176 - DNA, 15 bp, Homo sapiens
aaaacatacttcaaa

SEQ ID NO: 970177 - DNA, 18 bp, Homo sapiens
aaaacatattcaaagcag

SEQ ID NO: 970178 - DNA, 14 bp, Homo sapiens
aaaacatatttcat

SEQ ID NO: 970179 - DNA, 15 bp, Homo sapiens
aaaacatatttcatt

SEQ ID NO: 970180 - DNA, 21 bp, Homo sapiens
aaaacatatttcattttaaca

SEQ ID NO: 970181 - DNA, 18 bp, Homo sapiens
aaaacatcaaaatgaata

SEQ ID NO: 970182 - DNA, 16 bp, Homo sapiens
aaaacatccagataca

SEQ ID NO: 970183 - DNA, 21 bp, Homo sapiens
aaaacatccagatacacccaa

SEQ ID NO: 970184 - DNA, 11 bp, Homo sapiens
aaaacatctgg

SEQ ID NO: 970185 - DNA, 13 bp, Homo sapiens
aaaacatgctaca

SEQ ID NO: 970186 - DNA, 15 bp, Homo sapiens
aaaacatgctacaca

SEQ ID NO: 970187 - DNA, 16 bp, Homo sapiens
aaaacatgtaatattt

SEQ ID NO: 970188 - DNA, 14 bp, Homo sapiens
aaaacattaagaaa

SEQ ID NO: 970189 - DNA, 19 bp, Homo sapiens
aaaacattaagaaaatcat

SEQ ID NO: 970190 - DNA, 23 bp, Homo sapiens
aaaacattaagaaaatcatattg

SEQ ID NO: 970191 - DNA, 16 bp, Homo sapiens
aaaacattgcttttga

SEQ ID NO: 970192 - DNA, 22 bp, Homo sapiens
aaaacattgtccccaatgaata

SEQ ID NO: 970193 - DNA, 15 bp, Homo sapiens
aaaacatttaacata

SEQ ID NO: 970194 - DNA, 12 bp, Homo sapiens
aaaacatttatt

SEQ ID NO: 970195 - DNA, 15 bp, Homo sapiens
aaaacatttcaaagc

SEQ ID NO: 970196 - DNA, 19 bp, Homo sapiens
aaaacatttcttaaaacag

SEQ ID NO: 970197 - DNA, 17 bp, Homo sapiens
aaaacattttaaatgaa

SEQ ID NO: 970198 - DNA, 15 bp, Homo sapiens
aaaacattttgaagt

SEQ ID NO: 970199 - DNA, 13 bp, Homo sapiens
aaaaccaaagagg

SEQ ID NO: 970200 - DNA, 21 bp, Homo sapiens
aaaaccaacaggtttatctga

SEQ ID NO: 970201 - DNA, 15 bp, Homo sapiens
aaaaccaatgttctc

SEQ ID NO: 970202 - DNA, 12 bp, Homo sapiens
aaaaccacacaa

SEQ ID NO: 970203 - DNA, 19 bp, Homo sapiens
aaaaccacagccctgtcag

SEQ ID NO: 970204 - DNA, 20 bp, Homo sapiens
aaaaccacagccctgtcagt

SEQ ID NO: 970205 - DNA, 16 bp, Homo sapiens
aaaaccacagctgggc

SEQ ID NO: 970206 - DNA, 12 bp, Homo sapiens
aaaaccacatgg

SEQ ID NO: 970207 - DNA, 14 bp, Homo sapiens
aaaaccacatgggc

SEQ ID NO: 970208 - DNA, 17 bp, Homo sapiens
aaaaccacccaagatga

SEQ ID NO: 970209 - DNA, 11 bp, Homo sapiens
aaaaccaggcc

SEQ ID NO: 970210 - DNA, 20 bp, Homo sapiens
aaaaccatcaaaaatattcc

SEQ ID NO: 970211 - DNA, 19 bp, Homo sapiens
aaaaccatcagatatttct

SEQ ID NO: 970212 - DNA, 21 bp, Homo sapiens
aaaaccatcagatatttctta

SEQ ID NO: 970213 - DNA, 20 bp, Homo sapiens
aaaacccaatacttttgtcc

SEQ ID NO: 970214 - DNA, 21 bp, Homo sapiens
aaaaccctaattttgtacata

SEQ ID NO: 970215 - DNA, 20 bp, Homo sapiens
aaaacccttgggccagaagt

SEQ ID NO: 970216 - DNA, 14 bp, Homo sapiens
aaaaccgaataaat

SEQ ID NO: 970217 - DNA, 15 bp, Homo sapiens
aaaaccgaataaatg

SEQ ID NO: 970218 - DNA, 18 bp, Homo sapiens
aaaaccgagataggggag

SEQ ID NO: 970219 - DNA, 21 bp, Homo sapiens
aaaacctaagtcctttatgtg

SEQ ID NO: 970220 - DNA, 12 bp, Homo sapiens
aaaacctaccag

SEQ ID NO: 970221 - DNA, 13 bp, Homo sapiens
aaaacctgacaaa

SEQ ID NO: 970222 - DNA, 19 bp, Homo sapiens
aaaacctgcttccttcagt

SEQ ID NO: 970223 - DNA, 14 bp, Homo sapiens
aaaacctgtcaatg

SEQ ID NO: 970224 - DNA, 19 bp, Homo sapiens
aaaacctgtgccaggctga

SEQ ID NO: 970225 - DNA, 22 bp, Homo sapiens
aaaaccttgtaaaaaaagcaaa

SEQ ID NO: 970226 - DNA, 13 bp, Homo sapiens
aaaacctttcaaa

SEQ ID NO: 970227 - DNA, 21 bp, Homo sapiens
aaaacgaagtctttttcattt

SEQ ID NO: 970228 - DNA, 14 bp, Homo sapiens
aaaacgcatggagt

SEQ ID NO: 970229 - DNA, 15 bp, Homo sapiens
aaaagctaacatctt

SEQ ID NO: 970230 - DNA, 16 bp, Homo sapiens
aaaagctaacatcttt

SEQ ID NO: 970231 - DNA, 21 bp, Homo sapiens
aaaagctagtgtacctcctct

SEQ ID NO: 970232 - DNA, 21 bp, Homo sapiens
aaaagctataaagcagtattt

SEQ ID NO: 970233 - DNA, 21 bp, Homo sapiens
aaaagctataaagtatatatt

SEQ ID NO: 970234 - DNA, 20 bp, Homo sapiens
aaaagctatggtgagatgca

SEQ ID NO: 970235 - DNA, 15 bp, Homo sapiens
aaaagctattaaagt

SEQ ID NO: 970236 - DNA, 17 bp, Homo sapiens
aaaagctcactgctgat

SEQ ID NO: 970237 - DNA, 13 bp, Homo sapiens
aaaagctcctgtc

SEQ ID NO: 970238 - DNA, 14 bp, Homo sapiens
aaaagctcttttaa

SEQ ID NO: 970239 - DNA, 13 bp, Homo sapiens
aaaagctgctcag

SEQ ID NO: 970240 - DNA, 18 bp, Homo sapiens
aaaagcttaatgattctg

SEQ ID NO: 970241 - DNA, 14 bp, Homo sapiens
aaaagcttcaaatt

SEQ ID NO: 970242 - DNA, 13 bp, Homo sapiens
aaaagcttgtcca

SEQ ID NO: 970243 - DNA, 14 bp, Homo sapiens
aaaagctttttatt

SEQ ID NO: 970244 - DNA, 10 bp, Homo sapiens
aaaaggaaaa

SEQ ID NO: 970245 - DNA, 14 bp, Homo sapiens
aaaaggaaaagcaa

SEQ ID NO: 970246 - DNA, 16 bp, Homo sapiens
aaaaggaaaagttaaa

SEQ ID NO: 970247 - DNA, 13 bp, Homo sapiens
aaaaggaaagaaa

SEQ ID NO: 970248 - DNA, 11 bp, Homo sapiens
aaaaggaaagc

SEQ ID NO: 970249 - DNA, 17 bp, Homo sapiens
aaaaggaaattagtctt

SEQ ID NO: 970250 - DNA, 19 bp, Homo sapiens
aaaaggaaattagtctttt

SEQ ID NO: 970251 - DNA, 12 bp, Homo sapiens
aaaaggaaattt

SEQ ID NO: 970252 - DNA, 13 bp, Homo sapiens
aaaaggaagacta

SEQ ID NO: 970253 - DNA, 15 bp, Homo sapiens
aaaaggaagactaga

SEQ ID NO: 970254 - DNA, 13 bp, Homo sapiens
aaaaggaaggaga

SEQ ID NO: 970255 - DNA, 13 bp, Homo sapiens
aaaaggaggaaat

SEQ ID NO: 970256 - DNA, 15 bp, Homo sapiens
aaaaggatacataat

SEQ ID NO: 970257 - DNA, 21 bp, Homo sapiens
aaaaggatattatctacctgt

SEQ ID NO: 970258 - DNA, 23 bp, Homo sapiens
aaaaggatctttgtggccaagga

SEQ ID NO: 970259 - DNA, 14 bp, Homo sapiens
aaaaggatgcacag

SEQ ID NO: 970260 - DNA, 17 bp, Homo sapiens
aaaaggatgtataaatt

SEQ ID NO: 970261 - DNA, 17 bp, Homo sapiens
aaaaggatgttacaagt

SEQ ID NO: 970262 - DNA, 19 bp, Homo sapiens
aaaaggatgttacaagttt

SEQ ID NO: 970263 - DNA, 21 bp, Homo sapiens
aaaaggatgttacaagtttgc

SEQ ID NO: 970264 - DNA, 17 bp, Homo sapiens
aaaaggcaaatattgaa

SEQ ID NO: 970265 - DNA, 23 bp, Homo sapiens
aaaaggcaaatattgaagttgtt

SEQ ID NO: 970266 - DNA, 20 bp, Homo sapiens
aaaaggcaactcaaagatga

SEQ ID NO: 970267 - DNA, 22 bp, Homo sapiens
aaaaggcctcttgtaaagactg

SEQ ID NO: 970268 - DNA, 16 bp, Homo sapiens
aaaagggaagaaactg

SEQ ID NO: 970269 - DNA, 12 bp, Homo sapiens
aaaagggaagga

SEQ ID NO: 970270 - DNA, 12 bp, Homo sapiens
aaaagggaagta

SEQ ID NO: 970271 - DNA, 22 bp, Homo sapiens
aaaagggagaataaaattccta

SEQ ID NO: 970272 - DNA, 17 bp, Homo sapiens
aaaagggcagctgtgat

SEQ ID NO: 970273 - DNA, 22 bp, Homo sapiens
aaaagggccaaagaaccaaaga

SEQ ID NO: 970274 - DNA, 23 bp, Homo sapiens
aaaaggtagatcctgagatgatt

SEQ ID NO: 970275 - DNA, 21 bp, Homo sapiens
aaaaggtgaaaatgttttatt

SEQ ID NO: 970276 - DNA, 22 bp, Homo sapiens
aaaaggtgcctgtgaggcaggg

SEQ ID NO: 970277 - DNA, 19 bp, Homo sapiens
aaaaggtggagtttctctg

SEQ ID NO: 970278 - DNA, 14 bp, Homo sapiens
aaaaggtgtccttt

SEQ ID NO: 970279 - DNA, 20 bp, Homo sapiens
aaaaggtgtccttttccttt

SEQ ID NO: 970280 - DNA, 15 bp, Homo sapiens
aaaagtaaatgtaca

SEQ ID NO: 970281 - DNA, 20 bp, Homo sapiens
aaaagtaacaaggtgtcttt

SEQ ID NO: 970282 - DNA, 23 bp, Homo sapiens
aaaagtaagtaccactcaggcca

SEQ ID NO: 970283 - DNA, 23 bp, Homo sapiens
aaaagtacattgcttaaaatata

SEQ ID NO: 970284 - DNA, 21 bp, Homo sapiens
aaaagtacatttaatacagca

SEQ ID NO: 970285 - DNA, 14 bp, Homo sapiens
aaaagtactttaaa

SEQ ID NO: 970286 - DNA, 17 bp, Homo sapiens
aaaagtactttaaaaag

SEQ ID NO: 970287 - DNA, 16 bp, Homo sapiens
aaaagtataaaatagt

SEQ ID NO: 970288 - DNA, 17 bp, Homo sapiens
aaaagtatattaaacaa

SEQ ID NO: 970289 - DNA, 22 bp, Homo sapiens
aaaagtatattaaacaaagttt

SEQ ID NO: 970290 - DNA, 14 bp, Homo sapiens
aaaagtatctttaa

SEQ ID NO: 970291 - DNA, 16 bp, Homo sapiens
aaaagtatctttaaca

SEQ ID NO: 970292 - DNA, 20 bp, Homo sapiens
aaaagtattcgttacatctt

SEQ ID NO: 970293 - DNA, 18 bp, Homo sapiens
aaaagtattctcaaagat

SEQ ID NO: 970294 - DNA, 22 bp, Homo sapiens
aaaagtattggttactggtgat

SEQ ID NO: 970295 - DNA, 16 bp, Homo sapiens
aaaagtcaacaaactg

SEQ ID NO: 970296 - DNA, 19 bp, Homo sapiens
aaaagtcagactgctggga

SEQ ID NO: 970297 - DNA, 20 bp, Homo sapiens
aaaagtccataccttatata

SEQ ID NO: 970298 - DNA, 21 bp, Homo sapiens
aaaagtccctccctgcctgag

SEQ ID NO: 970299 - DNA, 18 bp, Homo sapiens
aaaagtctacctgtgttt

SEQ ID NO: 970300 - DNA, 14 bp, Homo sapiens
aaaagtctattttt

SEQ ID NO: 970301 - DNA, 18 bp, Homo sapiens
aaaagtctgtctttcctg

SEQ ID NO: 970302 - DNA, 17 bp, Homo sapiens
aaaagtgaacttttgta

SEQ ID NO: 970303 - DNA, 21 bp, Homo sapiens
aaaagtgaacttttgtaattt

SEQ ID NO: 970304 - DNA, 19 bp, Homo sapiens
aaaagtgaagtgaatctga

SEQ ID NO: 970305 - DNA, 17 bp, Homo sapiens
aaaagtgacacagcagc

SEQ ID NO: 970306 - DNA, 21 bp, Homo sapiens
aaaagtgatcaataaaatgtg

SEQ ID NO: 970307 - DNA, 18 bp, Homo sapiens
aaaagtgatgtattttca

SEQ ID NO: 970308 - DNA, 19 bp, Homo sapiens
aaaagtggcaagaccaaaa

SEQ ID NO: 970309 - DNA, 17 bp, Homo sapiens
aaaagtgggcttgattc

SEQ ID NO: 970310 - DNA, 15 bp, Homo sapiens
aaaagtgtctcaaag

SEQ ID NO: 970311 - DNA, 17 bp, Homo sapiens
aaaagtgtctcaaagga

SEQ ID NO: 970312 - DNA, 21 bp, Homo sapiens
aaaagtgtctcaaaggagctt

SEQ ID NO: 970313 - DNA, 21 bp, Homo sapiens
aaaagtgtttatttttcatat

SEQ ID NO: 970314 - DNA, 19 bp, Homo sapiens
aaaagttaataacagctcc

SEQ ID NO: 970315 - DNA, 18 bp, Homo sapiens
aaaagttacatgtttgca

SEQ ID NO: 970316 - DNA, 22 bp, Homo sapiens
aaaagttataataactgaactg

SEQ ID NO: 970317 - DNA, 21 bp, Homo sapiens
aaaagttcctctcccttccct

SEQ ID NO: 970318 - DNA, 11 bp, Homo sapiens
aaaagttcttt

SEQ ID NO: 970319 - DNA, 14 bp, Homo sapiens
aaaagttgcagctg

SEQ ID NO: 970320 - DNA, 13 bp, Homo sapiens
aaaagttggaagg

SEQ ID NO: 970321 - DNA, 17 bp, Homo sapiens
aaaagtttacaacataa

SEQ ID NO: 970322 - DNA, 23 bp, Homo sapiens
aaaagtttacaacataatctagt

SEQ ID NO: 970323 - DNA, 16 bp, Homo sapiens
aaaagtttacaagtgt

SEQ ID NO: 970324 - DNA, 22 bp, Homo sapiens
aaaagtttattgtttgatgttt

SEQ ID NO: 970325 - DNA, 12 bp, Homo sapiens
aaaagtttcaat

SEQ ID NO: 970326 - DNA, 13 bp, Homo sapiens
aaaagtttcaatg

SEQ ID NO: 970327 - DNA, 20 bp, Homo sapiens
aaaagtttcacgtcttggtg

SEQ ID NO: 970328 - DNA, 23 bp, Homo sapiens
aaaagtttgaaaagcaatattgt

SEQ ID NO: 970329 - DNA, 16 bp, Homo sapiens
aaaagtttgccagaag

SEQ ID NO: 970330 - DNA, 13 bp, Homo sapiens
aaaagttttctaa

SEQ ID NO: 970331 - DNA, 19 bp, Homo sapiens
aaaagttttgatatttatt

SEQ ID NO: 970332 - DNA, 20 bp, Homo sapiens
aaaagttttgatatttattt

SEQ ID NO: 970333 - DNA, 13 bp, Homo sapiens
aaaataaaacaag

SEQ ID NO: 970334 - DNA, 14 bp, Homo sapiens
aaaataaaacacac

SEQ ID NO: 970335 - DNA, 16 bp, Homo sapiens
aaaataaaacatagca

SEQ ID NO: 970336 - DNA, 14 bp, Homo sapiens
aaaataaaactttt

SEQ ID NO: 970337 - DNA, 17 bp, Homo sapiens
aaaataaaactttttaa

SEQ ID NO: 970338 - DNA, 21 bp, Homo sapiens
aaaataaaatgaaaattgtat

SEQ ID NO: 970339 - DNA, 14 bp, Homo sapiens
aaaataaaatgcct

SEQ ID NO: 970340 - DNA, 12 bp, Homo sapiens
aaaataaaatgt

SEQ ID NO: 970341 - DNA, 16 bp, Homo sapiens
aaaataaaatgtttca

SEQ ID NO: 970342 - DNA, 21 bp, Homo sapiens
aaaataaacgtggattttaaa

SEQ ID NO: 970343 - DNA, 13 bp, Homo sapiens
aaaataaacttct

SEQ ID NO: 970344 - DNA, 22 bp, Homo sapiens
aaaataaagctaccattttaca

SEQ ID NO: 970345 - DNA, 18 bp, Homo sapiens
aaaataaaggataactct

SEQ ID NO: 970346 - DNA, 22 bp, Homo sapiens
aaaataaaggataactctgtat

SEQ ID NO: 970347 - DNA, 16 bp, Homo sapiens
aaaataaataatttta

SEQ ID NO: 970348 - DNA, 12 bp, Homo sapiens
aaaataaatata

SEQ ID NO: 970349 - DNA, 15 bp, Homo sapiens
aaaataaatatatat

SEQ ID NO: 970350 - DNA, 14 bp, Homo sapiens
aaaataaatatatc

SEQ ID NO: 970351 - DNA, 14 bp, Homo sapiens
aaaataaattagaa

SEQ ID NO: 970352 - DNA, 12 bp, Homo sapiens
aaaataaattat

SEQ ID NO: 970353 - DNA, 12 bp, Homo sapiens
aaaataaattta

SEQ ID NO: 970354 - DNA, 20 bp, Homo sapiens
aaaataaatttatatgaaaa

SEQ ID NO: 970355 - DNA, 13 bp, Homo sapiens
aaaataacatgct

SEQ ID NO: 970356 - DNA, 20 bp, Homo sapiens
aaaataaccctttggttttt

SEQ ID NO: 970357 - DNA, 15 bp, Homo sapiens
aaaataactgaattt

SEQ ID NO: 970358 - DNA, 16 bp, Homo sapiens
aaaataacttcaagca

SEQ ID NO: 970359 - DNA, 22 bp, Homo sapiens
aaaataagaaaagatgtagatt

SEQ ID NO: 970360 - DNA, 14 bp, Homo sapiens
aaaataagctttct

SEQ ID NO: 970361 - DNA, 18 bp, Homo sapiens
aaaataagtcaacagtaa

SEQ ID NO: 970362 - DNA, 13 bp, Homo sapiens
aaaataagtctga

SEQ ID NO: 970363 - DNA, 16 bp, Homo sapiens
aaaataagttaaaggc

SEQ ID NO: 970364 - DNA, 12 bp, Homo sapiens
aaaataagtttt

SEQ ID NO: 970365 - DNA, 13 bp, Homo sapiens
aaaataataataa

SEQ ID NO: 970366 - DNA, 17 bp, Homo sapiens
aaaataataataaagtg

SEQ ID NO: 970367 - DNA, 23 bp, Homo sapiens
aaaataatcaaaagctatttaaa

SEQ ID NO: 970368 - DNA, 21 bp, Homo sapiens
aaaataatctatattaaatga

SEQ ID NO: 970369 - DNA, 22 bp, Homo sapiens
aaaataatctatattaaatgag

SEQ ID NO: 970370 - DNA, 21 bp, Homo sapiens
aaaataatctatttctatgag

SEQ ID NO: 970371 - DNA, 17 bp, Homo sapiens
aaaataatttctctaca

SEQ ID NO: 970372 - DNA, 15 bp, Homo sapiens
aaaataattttccaa

SEQ ID NO: 970373 - DNA, 13 bp, Homo sapiens
aaaataattttgt

SEQ ID NO: 970374 - DNA, 15 bp, Homo sapiens
aaaatacaagactgc

SEQ ID NO: 970375 - DNA, 14 bp, Homo sapiens
aaaatacaataaac

SEQ ID NO: 970376 - DNA, 15 bp, Homo sapiens
aaaatacaataaact

SEQ ID NO: 970377 - DNA, 22 bp, Homo sapiens
aaaatacaatgttatcaaccaa

SEQ ID NO: 970378 - DNA, 16 bp, Homo sapiens
aaaatacaatttttat

SEQ ID NO: 970379 - DNA, 17 bp, Homo sapiens
aaaatacacgtttatct

SEQ ID NO: 970380 - DNA, 12 bp, Homo sapiens
aaaatacatgaa

SEQ ID NO: 970381 - DNA, 15 bp, Homo sapiens
aaaatacatgaagct

SEQ ID NO: 970382 - DNA, 17 bp, Homo sapiens
aaaatacatttgtaagt

SEQ ID NO: 970383 - DNA, 21 bp, Homo sapiens
aaaataccataggaagacata

SEQ ID NO: 970384 - DNA, 23 bp, Homo sapiens
aaaataccataggaagacataaa

SEQ ID NO: 970385 - DNA, 20 bp, Homo sapiens
aaaatacctattttatatga

SEQ ID NO: 970386 - DNA, 22 bp, Homo sapiens
aaaatactctttcaataaatgt

SEQ ID NO: 970387 - DNA, 23 bp, Homo sapiens
aaaatactctttcaataaatgta

SEQ ID NO: 970388 - DNA, 22 bp, Homo sapiens
aaaatactgactccaaccattc

SEQ ID NO: 970389 - DNA, 21 bp, Homo sapiens
aaaatactgggattacaggct

SEQ ID NO: 970390 - DNA, 21 bp, Homo sapiens
aaaatacttgtcaatatttaa

SEQ ID NO: 970391 - DNA, 16 bp, Homo sapiens
aaaatacttttactct

SEQ ID NO: 970392 - DNA, 16 bp, Homo sapiens
aaaatagaaaagttat

SEQ ID NO: 970393 - DNA, 15 bp, Homo sapiens
aaaatagacaaatag

SEQ ID NO: 970394 - DNA, 19 bp, Homo sapiens
aaaatagacaaatagaaaa

SEQ ID NO: 970395 - DNA, 13 bp, Homo sapiens
aaaatagacactc

SEQ ID NO: 970396 - DNA, 15 bp, Homo sapiens
aaaatagagagagag

SEQ ID NO: 970397 - DNA, 22 bp, Homo sapiens
aaaatagagagagaggtattta

SEQ ID NO: 970398 - DNA, 23 bp, Homo sapiens
aaaatagagagagaggtatttaa

SEQ ID NO: 970399 - DNA, 21 bp, Homo sapiens
aaaatagagcaaaatcaacat

SEQ ID NO: 970400 - DNA, 21 bp, Homo sapiens
aaaatagagcttttaaaaatg

SEQ ID NO: 970401 - DNA, 22 bp, Homo sapiens
aaaatagcaacactctatattt

SEQ ID NO: 970402 - DNA, 17 bp, Homo sapiens
aaaatagcatactgtgt

SEQ ID NO: 970403 - DNA, 23 bp, Homo sapiens
aaaatagcatactgtgtatgttt

SEQ ID NO: 970404 - DNA, 15 bp, Homo sapiens
aaaatagcgttcttg

SEQ ID NO: 970405 - DNA, 17 bp, Homo sapiens
aaaatagcgttcttgta

SEQ ID NO: 970406 - DNA, 16 bp, Homo sapiens
aaaatagctctgtgtg

SEQ ID NO: 970407 - DNA, 19 bp, Homo sapiens
aaaatagcttgtatagtgt

SEQ ID NO: 970408 - DNA, 15 bp, Homo sapiens
aaaataggcttttta

SEQ ID NO: 970409 - DNA, 20 bp, Homo sapiens
aaaatagggtatattttcct

SEQ ID NO: 970410 - DNA, 21 bp, Homo sapiens
aaaatagggtatattttccta

SEQ ID NO: 970411 - DNA, 19 bp, Homo sapiens
aaaatagtaaatgctttgt

SEQ ID NO: 970412 - DNA, 13 bp, Homo sapiens
aaaatagtctttt

SEQ ID NO: 970413 - DNA, 15 bp, Homo sapiens
aaaatagtgtaagaa

SEQ ID NO: 970414 - DNA, 17 bp, Homo sapiens
aaaatagtgtaagaact

SEQ ID NO: 970415 - DNA, 15 bp, Homo sapiens
aaaatagttcccttt

SEQ ID NO: 970416 - DNA, 16 bp, Homo sapiens
aaaatagtttggatat

SEQ ID NO: 970417 - DNA, 10 bp, Homo sapiens
aaaatataaa

SEQ ID NO: 970418 - DNA, 17 bp, Homo sapiens
aaaatataaaactgcgt

SEQ ID NO: 970419 - DNA, 13 bp, Homo sapiens
aaaatataaattg

SEQ ID NO: 970420 - DNA, 19 bp, Homo sapiens
aaaatataaattgtacatt

SEQ ID NO: 970421 - DNA, 20 bp, Homo sapiens
aaaatataaattgtacattt

SEQ ID NO: 970422 - DNA, 16 bp, Homo sapiens
aaaatataagtaaagt

SEQ ID NO: 970423 - DNA, 13 bp, Homo sapiens
aaaatataattct

SEQ ID NO: 970424 - DNA, 13 bp, Homo sapiens
aaaatatacaaaa

SEQ ID NO: 970425 - DNA, 18 bp, Homo sapiens
aaaatatagcctttaaat

SEQ ID NO: 970426 - DNA, 12 bp, Homo sapiens
aaaatatatgta

SEQ ID NO: 970427 - DNA, 14 bp, Homo sapiens
aaaatatatgtatt

SEQ ID NO: 970428 - DNA, 16 bp, Homo sapiens
aaaatatatgtatttt

SEQ ID NO: 970429 - DNA, 18 bp, Homo sapiens
aaaatatatttaatatgt

SEQ ID NO: 970430 - DNA, 13 bp, Homo sapiens
aaaatatattttg

SEQ ID NO: 970431 - DNA, 16 bp, Homo sapiens
aaaatatattttgtat

SEQ ID NO: 970432 - DNA, 14 bp, Homo sapiens
aaaatatcctcagg

SEQ ID NO: 970433 - DNA, 15 bp, Homo sapiens
aaaatatcttccttt

SEQ ID NO: 970434 - DNA, 16 bp, Homo sapiens
aaaatatgaacctatt

SEQ ID NO: 970435 - DNA, 20 bp, Homo sapiens
aaaatatggaacttctaata

SEQ ID NO: 970436 - DNA, 15 bp, Homo sapiens
aaaatatgtaaaact

SEQ ID NO: 970437 - DNA, 16 bp, Homo sapiens
aaaatatgtaatttca

SEQ ID NO: 970438 - DNA, 18 bp, Homo sapiens
aaaatatgtgaagttttc

SEQ ID NO: 970439 - DNA, 23 bp, Homo sapiens
aaaatattactctagtttattct

SEQ ID NO: 970440 - DNA, 16 bp, Homo sapiens
aaaatattgctaaaag

SEQ ID NO: 970441 - DNA, 15 bp, Homo sapiens
aaaatattgtttctg

SEQ ID NO: 970442 - DNA, 19 bp, Homo sapiens
aaaatattgttttacaata

SEQ ID NO: 970443 - DNA, 12 bp, Homo sapiens
aaaatatttaaa

SEQ ID NO: 970444 - DNA, 19 bp, Homo sapiens
aaaatatttaaaaatgtct

SEQ ID NO: 970445 - DNA, 11 bp, Homo sapiens
aaaatatttca

SEQ ID NO: 970446 - DNA, 19 bp, Homo sapiens
aaaatatttcagatatcaa

SEQ ID NO: 970447 - DNA, 21 bp, Homo sapiens
aaaatatttctatgtaaatta

SEQ ID NO: 970448 - DNA, 14 bp, Homo sapiens
aaaatattttaaga

SEQ ID NO: 970449 - DNA, 23 bp, Homo sapiens
aaaatattttaagaaagagaatg

SEQ ID NO: 970450 - DNA, 13 bp, Homo sapiens
aaaatattttctc

SEQ ID NO: 970451 - DNA, 12 bp, Homo sapiens
aaaatattttgg

SEQ ID NO: 970452 - DNA, 20 bp, Homo sapiens
aaaatattttgttgccttca

SEQ ID NO: 970453 - DNA, 20 bp, Homo sapiens
aaaatattttttatatatac

SEQ ID NO: 970454 - DNA, 15 bp, Homo sapiens
aaaatattttttgca

SEQ ID NO: 970455 - DNA, 16 bp, Homo sapiens
aaaatattttttgcaa

SEQ ID NO: 970456 - DNA, 15 bp, Homo sapiens
aaaatcaaaacaaaa

SEQ ID NO: 970457 - DNA, 18 bp, Homo sapiens
aaaatcaaaacaaaaaaa

SEQ ID NO: 970458 - DNA, 13 bp, Homo sapiens
aaaatcaaatggt

SEQ ID NO: 970459 - DNA, 18 bp, Homo sapiens
aaaatcaactcatcattt

SEQ ID NO: 970460 - DNA, 11 bp, Homo sapiens
aaaatcaactt

SEQ ID NO: 970461 - DNA, 14 bp, Homo sapiens
aaaatcaatcaatg

SEQ ID NO: 970462 - DNA, 13 bp, Homo sapiens
aaaatcacaaaaa

SEQ ID NO: 970463 - DNA, 16 bp, Homo sapiens
aaaatcacatcactac

SEQ ID NO: 970464 - DNA, 15 bp, Homo sapiens
aaaatcactgtttgt

SEQ ID NO: 970465 - DNA, 13 bp, Homo sapiens
aaaatcagcctgc

SEQ ID NO: 970466 - DNA, 13 bp, Homo sapiens
aaaatcatattgc

SEQ ID NO: 970467 - DNA, 14 bp, Homo sapiens
aaaatcatcactca

SEQ ID NO: 970468 - DNA, 19 bp, Homo sapiens
aaaatcatgccagtatttt

SEQ ID NO: 970469 - DNA, 12 bp, Homo sapiens
aaaatcatgttt

SEQ ID NO: 970470 - DNA, 17 bp, Homo sapiens
aaaatccaaaaagctct

SEQ ID NO: 970471 - DNA, 21 bp, Homo sapiens
aaaatccaaaaagctctgaaa

SEQ ID NO: 970472 - DNA, 16 bp, Homo sapiens
aaaatccaaaacttct

SEQ ID NO: 970473 - DNA, 18 bp, Homo sapiens
aaaatccagtattatatt

SEQ ID NO: 970474 - DNA, 15 bp, Homo sapiens
aaaatccatccaaat

SEQ ID NO: 970475 - DNA, 14 bp, Homo sapiens
aaaatccatgaaca

SEQ ID NO: 970476 - DNA, 22 bp, Homo sapiens
aaaatccatgtgaccattctgc

SEQ ID NO: 970477 - DNA, 21 bp, Homo sapiens
aaaatccccttcgctgaaatt

SEQ ID NO: 970478 - DNA, 18 bp, Homo sapiens
aaaatcctgaataaacca

SEQ ID NO: 970479 - DNA, 21 bp, Homo sapiens
aaaatccttgtgacttacaat

SEQ ID NO: 970480 - DNA, 15 bp, Homo sapiens
aaaatttttgacact

SEQ ID NO: 970481 - DNA, 18 bp, Homo sapiens
aaaatttttttttaacca

SEQ ID NO: 970482 - DNA, 18 bp, Homo sapiens
aaaatttttttttctctt

SEQ ID NO: 970483 - DNA, 18 bp, Homo sapiens
aaacaaaaaaactacaaa

SEQ ID NO: 970484 - DNA, 13 bp, Homo sapiens
aaacaaaaaaaga

SEQ ID NO: 970485 - DNA, 16 bp, Homo sapiens
aaacaaaaagaacaaa

SEQ ID NO: 970486 - DNA, 13 bp, Homo sapiens
aaacaaaaagcta

SEQ ID NO: 970487 - DNA, 21 bp, Homo sapiens
aaacaaaaattaggtattttg

SEQ ID NO: 970488 - DNA, 14 bp, Homo sapiens
aaacaaaacaaact

SEQ ID NO: 970489 - DNA, 16 bp, Homo sapiens
aaacaaaacaaacttc

SEQ ID NO: 970490 - DNA, 18 bp, Homo sapiens
aaacaaaacaaacttcca

SEQ ID NO: 970491 - DNA, 13 bp, Homo sapiens
aaacaaaacttaa

SEQ ID NO: 970492 - DNA, 19 bp, Homo sapiens
aaacaaaagggtgtatagt

SEQ ID NO: 970493 - DNA, 17 bp, Homo sapiens
aaacaaaagttttaatt

SEQ ID NO: 970494 - DNA, 16 bp, Homo sapiens
aaacaaaatagaaagt

SEQ ID NO: 970495 - DNA, 15 bp, Homo sapiens
aaacaaaatctaaaa

SEQ ID NO: 970496 - DNA, 16 bp, Homo sapiens
aaacaaaatctgaact

SEQ ID NO: 970497 - DNA, 17 bp, Homo sapiens
aaacaaaatttcacagt

SEQ ID NO: 970498 - DNA, 13 bp, Homo sapiens
aaacaaacaaaaa

SEQ ID NO: 970499 - DNA, 14 bp, Homo sapiens
aaacaaagccatgc

SEQ ID NO: 970500 - DNA, 15 bp, Homo sapiens
aaacaaagctgatag

SEQ ID NO: 970501 - DNA, 16 bp, Homo sapiens
aaacaaaggaactaac

SEQ ID NO: 970502 - DNA, 16 bp, Homo sapiens
aaacaaagtactcttt

SEQ ID NO: 970503 - DNA, 17 bp, Homo sapiens
aaacaaagttactaggt

SEQ ID NO: 970504 - DNA, 23 bp, Homo sapiens
aaacaaagtttacattgtcctgt

SEQ ID NO: 970505 - DNA, 19 bp, Homo sapiens
aaacaaagtttcagagtat

SEQ ID NO: 970506 - DNA, 13 bp, Homo sapiens
aaacaaataaaat

SEQ ID NO: 970507 - DNA, 16 bp, Homo sapiens
aaacaaataatcacat

SEQ ID NO: 970508 - DNA, 17 bp, Homo sapiens
aaacaaataatcacatt

SEQ ID NO: 970509 - DNA, 12 bp, Homo sapiens
aaacaaatatgc

SEQ ID NO: 970510 - DNA, 14 bp, Homo sapiens
aaacaaatatgcaa

SEQ ID NO: 970511 - DNA, 18 bp, Homo sapiens
aaacaaatttagaagaaa

SEQ ID NO: 970512 - DNA, 13 bp, Homo sapiens
aaacaacaaaaga

SEQ ID NO: 970513 - DNA, 22 bp, Homo sapiens
aaacaacaatttctactttgaa

SEQ ID NO: 970514 - DNA, 19 bp, Homo sapiens
aaacaacagtcttcatttt

SEQ ID NO: 970515 - DNA, 18 bp, Homo sapiens
aaacaacatttatatgta

SEQ ID NO: 970516 - DNA, 17 bp, Homo sapiens
aaacaacctgaatcttt

SEQ ID NO: 970517 - DNA, 17 bp, Homo sapiens
aaacaacgtgtatagtg

SEQ ID NO: 970518 - DNA, 19 bp, Homo sapiens
aaacaacttggcatttcta

SEQ ID NO: 970519 - DNA, 17 bp, Homo sapiens
aaacaagactgcctccc

SEQ ID NO: 970520 - DNA, 12 bp, Homo sapiens
aaacaagcctta

SEQ ID NO: 970521 - DNA, 20 bp, Homo sapiens
aaacaagctgtgcaggcatg

SEQ ID NO: 970522 - DNA, 16 bp, Homo sapiens
aaacaaggaagccaaa

SEQ ID NO: 970523 - DNA, 12 bp, Homo sapiens
aaacaagggaga

SEQ ID NO: 970524 - DNA, 15 bp, Homo sapiens
aaacaagtatataat

SEQ ID NO: 970525 - DNA, 17 bp, Homo sapiens
aaacaagtttagaaagc

SEQ ID NO: 970526 - DNA, 15 bp, Homo sapiens
aaacaataaatgtgc

SEQ ID NO: 970527 - DNA, 16 bp, Homo sapiens
aaacaataaatgtgca

SEQ ID NO: 970528 - DNA, 16 bp, Homo sapiens
aaagaaaaaaaaagaa

SEQ ID NO: 970529 - DNA, 22 bp, Homo sapiens
aaagaaaaaaattgaaatgtaa

SEQ ID NO: 970530 - DNA, 14 bp, Homo sapiens
aaagaaaaaacaac

SEQ ID NO: 970531 - DNA, 15 bp, Homo sapiens
aaagaaaaaacaact

SEQ ID NO: 970532 - DNA, 18 bp, Homo sapiens
aaagaaaaaagagaaaag

SEQ ID NO: 970533 - DNA, 11 bp, Homo sapiens
aaagaaaaaat

SEQ ID NO: 970534 - DNA, 16 bp, Homo sapiens
aaagaaaaagaagtac

SEQ ID NO: 970535 - DNA, 21 bp, Homo sapiens
aaagaaaaatgcctgtctcta

SEQ ID NO: 970536 - DNA, 14 bp, Homo sapiens
aaagaaaaccataa

SEQ ID NO: 970537 - DNA, 13 bp, Homo sapiens
aaagaaaaccttt

SEQ ID NO: 970538 - DNA, 21 bp, Homo sapiens
aaagaaaataaaaaaaagaaa

SEQ ID NO: 970539 - DNA, 13 bp, Homo sapiens
aaagaaaatgaaa

SEQ ID NO: 970540 - DNA, 16 bp, Homo sapiens
aaagaaacaagctgtg

SEQ ID NO: 970541 - DNA, 12 bp, Homo sapiens
aaagaaacacaa

SEQ ID NO: 970542 - DNA, 15 bp, Homo sapiens
aaagaaacatttcct

SEQ ID NO: 970543 - DNA, 15 bp, Homo sapiens
aaagaaactgacatg

SEQ ID NO: 970544 - DNA, 19 bp, Homo sapiens
aaagaaacttggctggaat

SEQ ID NO: 970545 - DNA, 12 bp, Homo sapiens
aaagaaactttc

SEQ ID NO: 970546 - DNA, 14 bp, Homo sapiens
aaagaaagaaggaa

SEQ ID NO: 970547 - DNA, 21 bp, Homo sapiens
aaagaaagggaaactggctga

SEQ ID NO: 970548 - DNA, 10 bp, Homo sapiens
aaagaaagtg

SEQ ID NO: 970549 - DNA, 13 bp, Homo sapiens
aaagaaataaacc

SEQ ID NO: 970550 - DNA, 12 bp, Homo sapiens
aaagaaatattt

SEQ ID NO: 970551 - DNA, 18 bp, Homo sapiens
aaagaaatcatgtccata

SEQ ID NO: 970552 - DNA, 22 bp, Homo sapiens
aaagaaatctgtttcaacagat

SEQ ID NO: 970553 - DNA, 11 bp, Homo sapiens
aaagaaatctt

SEQ ID NO: 970554 - DNA, 20 bp, Homo sapiens
aaagaaatttagagtcaatt

SEQ ID NO: 970555 - DNA, 16 bp, Homo sapiens
aaagaacagtgagaaa

SEQ ID NO: 970556 - DNA, 15 bp, Homo sapiens
aaagaacatacatga

SEQ ID NO: 970557 - DNA, 16 bp, Homo sapiens
aaagaacatacatgat

SEQ ID NO: 970558 - DNA, 13 bp, Homo sapiens
aaagaacatgctt

SEQ ID NO: 970559 - DNA, 15 bp, Homo sapiens
aaagaacattttgcc

SEQ ID NO: 970560 - DNA, 15 bp, Homo sapiens
aaagaacgctgattt

SEQ ID NO: 970561 - DNA, 16 bp, Homo sapiens
aaagaactccttattt

SEQ ID NO: 970562 - DNA, 20 bp, Homo sapiens
aaagaactccttattttgta

SEQ ID NO: 970563 - DNA, 21 bp, Homo sapiens
aaagaactccttattttgtat

SEQ ID NO: 970564 - DNA, 12 bp, Homo sapiens
aaagaacttact

SEQ ID NO: 970565 - DNA, 17 bp, Homo sapiens
aaagaagaaacgtctat

SEQ ID NO: 970566 - DNA, 12 bp, Homo sapiens
aaagaagaacag

SEQ ID NO: 970567 - DNA, 18 bp, Homo sapiens
aaagaagacctgagaatg

SEQ ID NO: 970568 - DNA, 20 bp, Homo sapiens
aaagaagacctgagaatgta

SEQ ID NO: 970569 - DNA, 20 bp, Homo sapiens
aaagaagcccaatattataa

SEQ ID NO: 970570 - DNA, 13 bp, Homo sapiens
aaagaagctgcat

SEQ ID NO: 970571 - DNA, 12 bp, Homo sapiens
aaagaaggagct

SEQ ID NO: 970572 - DNA, 23 bp, Homo sapiens
aaagaaggcatggacttctggat

SEQ ID NO: 970573 - DNA, 21 bp, Homo sapiens
aaagaagggctggtattgttc

SEQ ID NO: 970574 - DNA, 19 bp, Homo sapiens
aaagaaggtgctgatccta

SEQ ID NO: 970575 - DNA, 15 bp, Homo sapiens
aaagaagtaaaagca

SEQ ID NO: 970576 - DNA, 13 bp, Homo sapiens
aaagaagtggaga

SEQ ID NO: 970577 - DNA, 24 bp, Homo sapiens
aaagaagtgtggggattttcactg

SEQ ID NO: 970578 - DNA, 17 bp, Homo sapiens
aaagaagtttgaacatt

SEQ ID NO: 970579 - DNA, 16 bp, Homo sapiens
aaagaatagaagctaa

SEQ ID NO: 970580 - DNA, 15 bp, Homo sapiens
aaagaatatgacttt

SEQ ID NO: 970581 - DNA, 20 bp, Homo sapiens
aaagaatatgactttttata

SEQ ID NO: 970582 - DNA, 13 bp, Homo sapiens
aaagaatattttg

SEQ ID NO: 970583 - DNA, 15 bp, Homo sapiens
aaagaatgagaaaca

SEQ ID NO: 970584 - DNA, 22 bp, Homo sapiens
aaagaatgagaaggagtcagaa

SEQ ID NO: 970585 - DNA, 18 bp, Homo sapiens
aaagaatgttactgcctt

SEQ ID NO: 970586 - DNA, 12 bp, Homo sapiens
aaagaatgttag

SEQ ID NO: 970587 - DNA, 20 bp, Homo sapiens
aaagaattacttgtgttact

SEQ ID NO: 970588 - DNA, 22 bp, Homo sapiens
aaagaattatttttgtgtttct

SEQ ID NO: 970589 - DNA, 23 bp, Homo sapiens
aaagaattatttttgtgtttcta

SEQ ID NO: 970590 - DNA, 23 bp, Homo sapiens
aaagaattgatcagaatcccaaa

SEQ ID NO: 970591 - DNA, 20 bp, Homo sapiens
aaagaatttttgtttggact

SEQ ID NO: 970592 - DNA, 15 bp, Homo sapiens
aaagacaaaaatcaa

SEQ ID NO: 970593 - DNA, 19 bp, Homo sapiens
aaagacaaaagaaacttac

SEQ ID NO: 970594 - DNA, 13 bp, Homo sapiens
aaagacaagactt

SEQ ID NO: 970595 - DNA, 17 bp, Homo sapiens
aaagacaagacttcagt

SEQ ID NO: 970596 - DNA, 19 bp, Homo sapiens
aaagacacctactgagtgg

SEQ ID NO: 970597 - DNA, 14 bp, Homo sapiens
aaagacagaatggt

SEQ ID NO: 970598 - DNA, 21 bp, Homo sapiens
aaagacagaatggtggagtgt

SEQ ID NO: 970599 - DNA, 16 bp, Homo sapiens
aaagacagaatgtcac

SEQ ID NO: 970600 - DNA, 17 bp, Homo sapiens
aaagacagagtgaattt

SEQ ID NO: 970601 - DNA, 13 bp, Homo sapiens
aaagacaggaaga

SEQ ID NO: 970602 - DNA, 20 bp, Homo sapiens
aaagacattttaagtttgta

SEQ ID NO: 970603 - DNA, 23 bp, Homo sapiens
aaagaccacctccaacccaaccc

SEQ ID NO: 970604 - DNA, 17 bp, Homo sapiens
aaagacccaacttgcca

SEQ ID NO: 970605 - DNA, 14 bp, Homo sapiens
aaagacctggcctt

SEQ ID NO: 970606 - DNA, 19 bp, Homo sapiens
aaagacgatttgtcagtta

SEQ ID NO: 970607 - DNA, 22 bp, Homo sapiens
aaagacgtctctttttggtaat

SEQ ID NO: 970608 - DNA, 20 bp, Homo sapiens
aaagactaatttaaaaaata

SEQ ID NO: 970609 - DNA, 18 bp, Homo sapiens
aaagactatttcaaaatg

SEQ ID NO: 970610 - DNA, 10 bp, Homo sapiens
aaagactcca

SEQ ID NO: 970611 - DNA, 12 bp, Homo sapiens
aaagactctgag

SEQ ID NO: 970612 - DNA, 23 bp, Homo sapiens
aaagactgagtacgttgtgcatt

SEQ ID NO: 970613 - DNA, 13 bp, Homo sapiens
aaagactggcttt

SEQ ID NO: 970614 - DNA, 23 bp, Homo sapiens
aaagactggcttttattaatgca

SEQ ID NO: 970615 - DNA, 19 bp, Homo sapiens
aaagactggtttgtttgct

SEQ ID NO: 970616 - DNA, 20 bp, Homo sapiens
aaagactggtttgtttgctt

SEQ ID NO: 970617 - DNA, 16 bp, Homo sapiens
aaagactggttttctg

SEQ ID NO: 970618 - DNA, 13 bp, Homo sapiens
aaagactgtacaa

SEQ ID NO: 970619 - DNA, 13 bp, Homo sapiens
aaagactgtactg

SEQ ID NO: 970620 - DNA, 17 bp, Homo sapiens
aaagactgtcaaatgaa

SEQ ID NO: 970621 - DNA, 18 bp, Homo sapiens
aaagactgtcaaatgaac

SEQ ID NO: 970622 - DNA, 21 bp, Homo sapiens
aaagactgtcaaatgaacttt

SEQ ID NO: 970623 - DNA, 22 bp, Homo sapiens
aaagactgtcaaatgaactttt

SEQ ID NO: 970624 - DNA, 14 bp, Homo sapiens
aaagactgtgggtg

SEQ ID NO: 970625 - DNA, 13 bp, Homo sapiens
aaagacttaaagg

SEQ ID NO: 970626 - DNA, 23 bp, Homo sapiens
aaagacttctctacccatcttaa

SEQ ID NO: 970627 - DNA, 13 bp, Homo sapiens
aaagacttgagaa

SEQ ID NO: 970628 - DNA, 23 bp, Homo sapiens
aaagacttgagacaatgttttct

SEQ ID NO: 970629 - DNA, 18 bp, Homo sapiens
aaagacttttatgtgaga

SEQ ID NO: 970630 - DNA, 17 bp, Homo sapiens
aaagagaaaaagaaatg

SEQ ID NO: 970631 - DNA, 13 bp, Homo sapiens
aaagagaaaagaa

SEQ ID NO: 970632 - DNA, 15 bp, Homo sapiens
aaagagaagatgcct

SEQ ID NO: 970633 - DNA, 18 bp, Homo sapiens
aaagagaatgaactgtgg

SEQ ID NO: 970634 - DNA, 22 bp, Homo sapiens
aaagagaatgaactgtggaatt

SEQ ID NO: 970635 - DNA, 10 bp, Homo sapiens
aaagagacca

SEQ ID NO: 970636 - DNA, 23 bp, Homo sapiens
aaagagactgatcatccaggcct

SEQ ID NO: 970637 - DNA, 11 bp, Homo sapiens
aaagagagaga

SEQ ID NO: 970638 - DNA, 12 bp, Homo sapiens
aaagagagctct

SEQ ID NO: 970639 - DNA, 14 bp, Homo sapiens
aaagagatacagag

SEQ ID NO: 970640 - DNA, 16 bp, Homo sapiens
aaagagatagttctaa

SEQ ID NO: 970641 - DNA, 12 bp, Homo sapiens
aaagagcactta

SEQ ID NO: 970642 - DNA, 18 bp, Homo sapiens
aaagagcacttaagagaa

SEQ ID NO: 970643 - DNA, 22 bp, Homo sapiens
aaagagccctggctctgcccct

SEQ ID NO: 970644 - DNA, 15 bp, Homo sapiens
aaagagcccttgcct

SEQ ID NO: 970645 - DNA, 18 bp, Homo sapiens
aaagagcccttgcctccc

SEQ ID NO: 970646 - DNA, 20 bp, Homo sapiens
aaagagctcaggcttttcca

SEQ ID NO: 970647 - DNA, 16 bp, Homo sapiens
aaagagctgtctgact

SEQ ID NO: 970648 - DNA, 20 bp, Homo sapiens
aaagaggaggacccctgcct

SEQ ID NO: 970649 - DNA, 19 bp, Homo sapiens
aaagaggatgatttcagaa

SEQ ID NO: 970650 - DNA, 18 bp, Homo sapiens
aaagaggcgtctgtatat

SEQ ID NO: 970651 - DNA, 12 bp, Homo sapiens
aaagaggctgag

SEQ ID NO: 970652 - DNA, 20 bp, Homo sapiens
aaagaggctgaggcctggac

SEQ ID NO: 970653 - DNA, 18 bp, Homo sapiens
aaagaggctgcccctctc

SEQ ID NO: 970654 - DNA, 23 bp, Homo sapiens
aaagaggctgcccctctcaccaa

SEQ ID NO: 970655 - DNA, 19 bp, Homo sapiens
aaagagggtttattttcag

SEQ ID NO: 970656 - DNA, 16 bp, Homo sapiens
aaagagttattcaaat

SEQ ID NO: 970657 - DNA, 14 bp, Homo sapiens
aaagagttcaagaa

SEQ ID NO: 970658 - DNA, 15 bp, Homo sapiens
aaagataaagatgat

SEQ ID NO: 970659 - DNA, 20 bp, Homo sapiens
aaagataacaagatctttca

SEQ ID NO: 970660 - DNA, 21 bp, Homo sapiens
aaagataatattttacataca

SEQ ID NO: 970661 - DNA, 19 bp, Homo sapiens
aaagataatctcagtgctt

SEQ ID NO: 970662 - DNA, 23 bp, Homo sapiens
aaagataatctcagtgctttcct

SEQ ID NO: 970663 - DNA, 16 bp, Homo sapiens
aaagatacgactttat

SEQ ID NO: 970664 - DNA, 12 bp, Homo sapiens
aaagatatatta

SEQ ID NO: 970665 - DNA, 20 bp, Homo sapiens
aaagatattttgctttgtga

SEQ ID NO: 970666 - DNA, 14 bp, Homo sapiens
aaagatcaaaataa

SEQ ID NO: 970667 - DNA, 15 bp, Homo sapiens
aaagatcaaaataaa

SEQ ID NO: 970668 - DNA, 18 bp, Homo sapiens
aaagatcaccttgtattc

SEQ ID NO: 970669 - DNA, 22 bp, Homo sapiens
aaagatcacttgttgttttact

SEQ ID NO: 970670 - DNA, 21 bp, Homo sapiens
aaagatccaccctcaaatgtc

SEQ ID NO: 970671 - DNA, 20 bp, Homo sapiens
aaagatccagggatggagat

SEQ ID NO: 970672 - DNA, 23 bp, Homo sapiens
aaagatctctgtcacatccaact

SEQ ID NO: 970673 - DNA, 13 bp, Homo sapiens
aaagatctgtttt

SEQ ID NO: 970674 - DNA, 16 bp, Homo sapiens
aaagatctgttttgaa

SEQ ID NO: 970675 - DNA, 15 bp, Homo sapiens
aaagatgaaaggcag

SEQ ID NO: 970676 - DNA, 20 bp, Homo sapiens
aaagatgaaggctgtatcta

SEQ ID NO: 970677 - DNA, 20 bp, Homo sapiens
aaagatgagctttgtctact

SEQ ID NO: 970678 - DNA, 12 bp, Homo sapiens
aaagatgatgat

SEQ ID NO: 970679 - DNA, 13 bp, Homo sapiens
aaagatgatggaa

SEQ ID NO: 970680 - DNA, 18 bp, Homo sapiens
aaagatgatggaaacgca

SEQ ID NO: 970681 - DNA, 20 bp, Homo sapiens
aaagatgatggaaacgcact

SEQ ID NO: 970682 - DNA, 14 bp, Homo sapiens
aaagatgcattttt

SEQ ID NO: 970683 - DNA, 18 bp, Homo sapiens
aaagatgccatagcataa

SEQ ID NO: 970684 - DNA, 16 bp, Homo sapiens
aaagatgcgtttgcct

SEQ ID NO: 970685 - DNA, 18 bp, Homo sapiens
aaagatgcgtttgcctcc

SEQ ID NO: 970686 - DNA, 14 bp, Homo sapiens
aaagatggataaac

SEQ ID NO: 970687 - DNA, 12 bp, Homo sapiens
aaagatggcctt

SEQ ID NO: 970688 - DNA, 21 bp, Homo sapiens
aaagatggctgtgcctctgcc

SEQ ID NO: 970689 - DNA, 23 bp, Homo sapiens
aaagatggctgtgcctctgcctg

SEQ ID NO: 970690 - DNA, 13 bp, Homo sapiens
aaagatgggagga

SEQ ID NO: 970691 - DNA, 15 bp, Homo sapiens
aaagatgggaggaga

SEQ ID NO: 970692 - DNA, 23 bp, Homo sapiens
aaagatgggaggagaccagcggt

SEQ ID NO: 970693 - DNA, 13 bp, Homo sapiens
aaagatggtggct

SEQ ID NO: 970694 - DNA, 16 bp, Homo sapiens
aaagatggtggctgtg

SEQ ID NO: 970695 - DNA, 23 bp, Homo sapiens
aaagatggtgtgggtgtcctgcc

SEQ ID NO: 970696 - DNA, 19 bp, Homo sapiens
aaagatggttaaacatttt

SEQ ID NO: 970697 - DNA, 22 bp, Homo sapiens
aaagatgtaatgtccctttcag

SEQ ID NO: 970698 - DNA, 22 bp, Homo sapiens
aaagatgtatatttgcatattt

SEQ ID NO: 970699 - DNA, 13 bp, Homo sapiens
aaagatgttaaat

SEQ ID NO: 970700 - DNA, 18 bp, Homo sapiens
aaagatgttaagcattta

SEQ ID NO: 970701 - DNA, 19 bp, Homo sapiens
aaagatgtttgaaaatgct

SEQ ID NO: 970702 - DNA, 21 bp, Homo sapiens
aaagattaggtcgttttccaa

SEQ ID NO: 970703 - DNA, 19 bp, Homo sapiens
aaagattcaggtatgttgc

SEQ ID NO: 970704 - DNA, 14 bp, Homo sapiens
aaagattctactaa

SEQ ID NO: 970705 - DNA, 15 bp, Homo sapiens
aaagattctactaac

SEQ ID NO: 970706 - DNA, 21 bp, Homo sapiens
aaagattctttatatctgaac

SEQ ID NO: 970707 - DNA, 18 bp, Homo sapiens
aaagattgaacttaaatg

SEQ ID NO: 970708 - DNA, 16 bp, Homo sapiens
aaagattggagctgaa

SEQ ID NO: 970709 - DNA, 13 bp, Homo sapiens
aaagattgtactt

SEQ ID NO: 970710 - DNA, 14 bp, Homo sapiens
aaagattgtactta

SEQ ID NO: 970711 - DNA, 18 bp, Homo sapiens
aaagattgtacttagcca

SEQ ID NO: 970712 - DNA, 14 bp, Homo sapiens
aaagatttcttgag

SEQ ID NO: 970713 - DNA, 15 bp, Homo sapiens
aaagattttaatcaa

SEQ ID NO: 970714 - DNA, 15 bp, Homo sapiens
aaagattttattgta

SEQ ID NO: 970715 - DNA, 21 bp, Homo sapiens
aaagattttattgtataaaaa

SEQ ID NO: 970716 - DNA, 20 bp, Homo sapiens
aaagattttttaataattta

SEQ ID NO: 970717 - DNA, 12 bp, Homo sapiens
aaagcaaaacat

SEQ ID NO: 970718 - DNA, 12 bp, Homo sapiens
aaagcaaaatag

SEQ ID NO: 970719 - DNA, 14 bp, Homo sapiens
aaagcaaaatagta

SEQ ID NO: 970720 - DNA, 17 bp, Homo sapiens
aaagcaaaatagtattg

SEQ ID NO: 970721 - DNA, 19 bp, Homo sapiens
aaagcaaacacaagaaatc

SEQ ID NO: 970722 - DNA, 21 bp, Homo sapiens
aaagcaaacttaagaaacact

SEQ ID NO: 970723 - DNA, 23 bp, Homo sapiens
aaagcaaacttaagaaacactga

SEQ ID NO: 970724 - DNA, 15 bp, Homo sapiens
aaagcaaagaaaata

SEQ ID NO: 970725 - DNA, 15 bp, Homo sapiens
aaagcaaaggaagca

SEQ ID NO: 970726 - DNA, 18 bp, Homo sapiens
aaagcaaatggaaaatgt

SEQ ID NO: 970727 - DNA, 23 bp, Homo sapiens
aaagcaaattactccaaggttta

SEQ ID NO: 970728 - DNA, 14 bp, Homo sapiens
aaagcaaattgttt

SEQ ID NO: 970729 - DNA, 21 bp, Homo sapiens
aaagcaactgttatgaaataa

SEQ ID NO: 970730 - DNA, 15 bp, Homo sapiens
aaagcaagaaacagt

SEQ ID NO: 970731 - DNA, 14 bp, Homo sapiens
aaagcaaggaaact

SEQ ID NO: 970732 - DNA, 22 bp, Homo sapiens
aaagcaagggctccagcatcca

SEQ ID NO: 970733 - DNA, 18 bp, Homo sapiens
aaagcaatattttggagt

SEQ ID NO: 970734 - DNA, 22 bp, Homo sapiens
aaagcaatcaagcaccaggaag

SEQ ID NO: 970735 - DNA, 19 bp, Homo sapiens
aaagcaattgccctgtaac

SEQ ID NO: 970736 - DNA, 18 bp, Homo sapiens
aaagcacaagtacttttg

SEQ ID NO: 970737 - DNA, 14 bp, Homo sapiens
aaagcacagtgtta

SEQ ID NO: 970738 - DNA, 20 bp, Homo sapiens
aaagcacagtgttaaatgaa

SEQ ID NO: 970739 - DNA, 16 bp, Homo sapiens
aaagcacagtttgaac

SEQ ID NO: 970740 - DNA, 17 bp, Homo sapiens
aaagcacagtttgaaca

SEQ ID NO: 970741 - DNA, 18 bp, Homo sapiens
aaagcacatgcttagctt

SEQ ID NO: 970742 - DNA, 16 bp, Homo sapiens
aaagcacattgaaaga

SEQ ID NO: 970743 - DNA, 16 bp, Homo sapiens
aaagcaccaaaataag

SEQ ID NO: 970744 - DNA, 22 bp, Homo sapiens
aaagcaccaaaataagaaaaga

SEQ ID NO: 970745 - DNA, 12 bp, Homo sapiens
aaagcacctgcc

SEQ ID NO: 970746 - DNA, 20 bp, Homo sapiens
aaagcactacaatcatggtc

SEQ ID NO: 970747 - DNA, 16 bp, Homo sapiens
aaagcactctctgcag

SEQ ID NO: 970748 - DNA, 22 bp, Homo sapiens
aaagcactgacctgtcatgccc

SEQ ID NO: 970749 - DNA, 17 bp, Homo sapiens
aaagcactggtttcaag

SEQ ID NO: 970750 - DNA, 20 bp, Homo sapiens
aaagcactggtttcaagaat

SEQ ID NO: 970751 - DNA, 23 bp, Homo sapiens
aaagcactggtttcaagaatatg

SEQ ID NO: 970752 - DNA, 22 bp, Homo sapiens
aaagcacttggactcttgctct

SEQ ID NO: 970753 - DNA, 16 bp, Homo sapiens
aaagcactttgcactt

SEQ ID NO: 970754 - DNA, 14 bp, Homo sapiens
aaagcagaactgaa

SEQ ID NO: 970755 - DNA, 14 bp, Homo sapiens
aaagcagaatttta

SEQ ID NO: 970756 - DNA, 15 bp, Homo sapiens
aaagcagagccaagg

SEQ ID NO: 970757 - DNA, 18 bp, Homo sapiens
aaagcagagccaaggcca

SEQ ID NO: 970758 - DNA, 22 bp, Homo sapiens
aaagcagagtggactgcattta

SEQ ID NO: 970759 - DNA, 19 bp, Homo sapiens
aaagcagcagaggtgagaa

SEQ ID NO: 970760 - DNA, 20 bp, Homo sapiens
aaagcagcattctggagggg

SEQ ID NO: 970761 - DNA, 15 bp, Homo sapiens
aaagcagccacgagg

SEQ ID NO: 970762 - DNA, 15 bp, Homo sapiens
aaagcagcgtttcta

SEQ ID NO: 970763 - DNA, 20 bp, Homo sapiens
aaagcagctaaatgtaactt

SEQ ID NO: 970764 - DNA, 14 bp, Homo sapiens
aaagcaggttcttg

SEQ ID NO: 970765 - DNA, 19 bp, Homo sapiens
aaagcaggttcttgttggt

SEQ ID NO: 970766 - DNA, 20 bp, Homo sapiens
aaagcagtatataataactt

SEQ ID NO: 970767 - DNA, 22 bp, Homo sapiens
aaagcagtcccattcatattaa

SEQ ID NO: 970768 - DNA, 17 bp, Homo sapiens
aaagcagtcctgttcaa

SEQ ID NO: 970769 - DNA, 18 bp, Homo sapiens
aaagcataaaaacatttt

SEQ ID NO: 970770 - DNA, 22 bp, Homo sapiens
aaagcataaagctcaaatgaaa

SEQ ID NO: 970771 - DNA, 18 bp, Homo sapiens
aaagcatcacctcaggcc

SEQ ID NO: 970772 - DNA, 19 bp, Homo sapiens
aaagcatcactgccttggc

SEQ ID NO: 970773 - DNA, 13 bp, Homo sapiens
aaagcatccatgt

SEQ ID NO: 970774 - DNA, 14 bp, Homo sapiens
aaagcatgaatggt

SEQ ID NO: 970775 - DNA, 22 bp, Homo sapiens
aaagcatgcatatcattaaaca

SEQ ID NO: 970776 - DNA, 18 bp, Homo sapiens
aaagcatggacatttaga

SEQ ID NO: 970777 - DNA, 12 bp, Homo sapiens
aaagcattttca

SEQ ID NO: 970778 - DNA, 19 bp, Homo sapiens
aaagcattttcagtcttgt

SEQ ID NO: 970779 - DNA, 21 bp, Homo sapiens
aaagcattttcagtcttgtag

SEQ ID NO: 970780 - DNA, 21 bp, Homo sapiens
aaagcattttgtaataataaa

SEQ ID NO: 970781 - DNA, 19 bp, Homo sapiens
aaagccaacaactctgcct

SEQ ID NO: 970782 - DNA, 22 bp, Homo sapiens
aaagccaaggagtcactgagac

SEQ ID NO: 970783 - DNA, 23 bp, Homo sapiens
aaagccaaggagtcactgagacc

SEQ ID NO: 970784 - DNA, 19 bp, Homo sapiens
aaagccacaaggctggcca

SEQ ID NO: 970785 - DNA, 17 bp, Homo sapiens
aaagccacattatttct

SEQ ID NO: 970786 - DNA, 18 bp, Homo sapiens
aaagccacattatttcta

SEQ ID NO: 970787 - DNA, 20 bp, Homo sapiens
aaagccacattatttctagt

SEQ ID NO: 970788 - DNA, 12 bp, Homo sapiens
aaagccacccca

SEQ ID NO: 970789 - DNA, 20 bp, Homo sapiens
aaagccagaaccagatgagt

SEQ ID NO: 970790 - DNA, 22 bp, Homo sapiens
aaagccagacaacttctgtttc

SEQ ID NO: 970791 - DNA, 19 bp, Homo sapiens
aaagccagggtctctccct

SEQ ID NO: 970792 - DNA, 22 bp, Homo sapiens
aaagccagggtctctccctcag

SEQ ID NO: 970793 - DNA, 17 bp, Homo sapiens
aaagccataacttgaaa

SEQ ID NO: 970794 - DNA, 19 bp, Homo sapiens
aaagccatattccagcagt

SEQ ID NO: 970795 - DNA, 19 bp, Homo sapiens
aaagccatcatgccttgat

SEQ ID NO: 970796 - DNA, 20 bp, Homo sapiens
aaagccatgttaaatgactt

SEQ ID NO: 970797 - DNA, 16 bp, Homo sapiens
aaaggatatttaagaa

SEQ ID NO: 970798 - DNA, 23 bp, Homo sapiens
aaaggatatttaagaaaatacaa

SEQ ID NO: 970799 - DNA, 15 bp, Homo sapiens
aaaggatattttctt

SEQ ID NO: 970800 - DNA, 14 bp, Homo sapiens
aaaggatgcacaga

SEQ ID NO: 970801 - DNA, 20 bp, Homo sapiens
aaaggatggtggttatttta

SEQ ID NO: 970802 - DNA, 19 bp, Homo sapiens
aaaggatgtaaacagtgcc

SEQ ID NO: 970803 - DNA, 12 bp, Homo sapiens
aaaggatgtgat

SEQ ID NO: 970804 - DNA, 14 bp, Homo sapiens
aaaggatgttacaa

SEQ ID NO: 970805 - DNA, 16 bp, Homo sapiens
aaaggatgttacaagt

SEQ ID NO: 970806 - DNA, 15 bp, Homo sapiens
aaaggcaaaagactg

SEQ ID NO: 970807 - DNA, 17 bp, Homo sapiens
aaaggcaaaagactggt

SEQ ID NO: 970808 - DNA, 13 bp, Homo sapiens
aaaggcaaataat

SEQ ID NO: 970809 - DNA, 23 bp, Homo sapiens
aaaggcaaatattgaagttgttt

SEQ ID NO: 970810 - DNA, 13 bp, Homo sapiens
aaaggcaactcaa

SEQ ID NO: 970811 - DNA, 18 bp, Homo sapiens
aaaggcaactcaaagatg

SEQ ID NO: 970812 - DNA, 20 bp, Homo sapiens
aaaggcaactcaaagatgat

SEQ ID NO: 970813 - DNA, 20 bp, Homo sapiens
aaaggcaatggtttgtgtca

SEQ ID NO: 970814 - DNA, 17 bp, Homo sapiens
aaaggcaattatatcta

SEQ ID NO: 970815 - DNA, 22 bp, Homo sapiens
aaaggcaattatatctattatg

SEQ ID NO: 970816 - DNA, 17 bp, Homo sapiens
aaaggcaccatctaata

SEQ ID NO: 970817 - DNA, 18 bp, Homo sapiens
aaaggcagagaagttctc

SEQ ID NO: 970818 - DNA, 13 bp, Homo sapiens
aaaggcagctgcc

SEQ ID NO: 970819 - DNA, 15 bp, Homo sapiens
aaaggcagctgcctc

SEQ ID NO: 970820 - DNA, 19 bp, Homo sapiens
aaaggcaggaagggaagcg

SEQ ID NO: 970821 - DNA, 21 bp, Homo sapiens
aaaggcaggcctatttcatca

SEQ ID NO: 970822 - DNA, 22 bp, Homo sapiens
aaaggcaggtttcatttcttat

SEQ ID NO: 970823 - DNA, 16 bp, Homo sapiens
aaaggcagtattttgt

SEQ ID NO: 970824 - DNA, 19 bp, Homo sapiens
aaaggcagtattttgtgtc

SEQ ID NO: 970825 - DNA, 15 bp, Homo sapiens
aaaggcatctccctt

SEQ ID NO: 970826 - DNA, 15 bp, Homo sapiens
aaaggcattagagtc

SEQ ID NO: 970827 - DNA, 18 bp, Homo sapiens
aaaggccaaagataaaag

SEQ ID NO: 970828 - DNA, 18 bp, Homo sapiens
aaaggccagtggaagaaa

SEQ ID NO: 970829 - DNA, 13 bp, Homo sapiens
aaaggcccagccc

SEQ ID NO: 970830 - DNA, 14 bp, Homo sapiens
aaaggcccatgccc

SEQ ID NO: 970831 - DNA, 18 bp, Homo sapiens
aaaggccgccgtgaccta

SEQ ID NO: 970832 - DNA, 13 bp, Homo sapiens
aaaggcctcttgt

SEQ ID NO: 970833 - DNA, 11 bp, Homo sapiens
aaaggcctgga

SEQ ID NO: 970834 - DNA, 20 bp, Homo sapiens
aaaggcctggaaccagggag

SEQ ID NO: 970835 - DNA, 17 bp, Homo sapiens
aaaggccttcagacaca

SEQ ID NO: 970836 - DNA, 14 bp, Homo sapiens
aaaggctacctttg

SEQ ID NO: 970837 - DNA, 17 bp, Homo sapiens
aaaggctacctttgtat

SEQ ID NO: 970838 - DNA, 19 bp, Homo sapiens
aaaggctaggtacacagct

SEQ ID NO: 970839 - DNA, 16 bp, Homo sapiens
aaaggctcatttaaaa

SEQ ID NO: 970840 - DNA, 19 bp, Homo sapiens
aaaggctcatttaaaacag

SEQ ID NO: 970841 - DNA, 16 bp, Homo sapiens
aaaggctcgattttgt

SEQ ID NO: 970842 - DNA, 18 bp, Homo sapiens
aaaggctcgattttgtat

SEQ ID NO: 970843 - DNA, 13 bp, Homo sapiens
aaaggctgtggta

SEQ ID NO: 970844 - DNA, 15 bp, Homo sapiens
aaaggctgttaaata

SEQ ID NO: 970845 - DNA, 19 bp, Homo sapiens
aaaggctgttaaatacagg

SEQ ID NO: 970846 - DNA, 20 bp, Homo sapiens
aaaggctgttaaatacagga

SEQ ID NO: 970847 - DNA, 12 bp, Homo sapiens
aaagggaaaaaa

SEQ ID NO: 970848 - DNA, 13 bp, Homo sapiens
aaagggaaaaaag

SEQ ID NO: 970849 - DNA, 15 bp, Homo sapiens
aaagggaaaaaagaa

SEQ ID NO: 970850 - DNA, 16 bp, Homo sapiens
aaagggaaaaaagaaa

SEQ ID NO: 970851 - DNA, 14 bp, Homo sapiens
aaagggaaactatt

SEQ ID NO: 970852 - DNA, 18 bp, Homo sapiens
aaagggaagtgaggccca

SEQ ID NO: 970853 - DNA, 20 bp, Homo sapiens
aaagggaatactcacatttt

SEQ ID NO: 970854 - DNA, 14 bp, Homo sapiens
aaagggacagcatg

SEQ ID NO: 970855 - DNA, 16 bp, Homo sapiens
aaagggacagcatgcc

SEQ ID NO: 970856 - DNA, 16 bp, Homo sapiens
aaagggagaggaagag

SEQ ID NO: 970857 - DNA, 13 bp, Homo sapiens
aaagggagcgagg

SEQ ID NO: 970858 - DNA, 14 bp, Homo sapiens
aaagggatactttt

SEQ ID NO: 970859 - DNA, 20 bp, Homo sapiens
aaagggcactcccaaccctg

SEQ ID NO: 970860 - DNA, 12 bp, Homo sapiens
aaagggcactta

SEQ ID NO: 970861 - DNA, 19 bp, Homo sapiens
aaagggcacttaatttgta

SEQ ID NO: 970862 - DNA, 17 bp, Homo sapiens
aaagggcagaggaagag

SEQ ID NO: 970863 - DNA, 15 bp, Homo sapiens
aaagggcagttttga

SEQ ID NO: 970864 - DNA, 12 bp, Homo sapiens
aaagggccaggt

SEQ ID NO: 970865 - DNA, 14 bp, Homo sapiens
aaagggcctggcca

SEQ ID NO: 970866 - DNA, 18 bp, Homo sapiens
aaagggctggctccccct

SEQ ID NO: 970867 - DNA, 17 bp, Homo sapiens
aaaggggagaaactgaa

SEQ ID NO: 970868 - DNA, 22 bp, Homo sapiens
aaaggggagaaactgaaagtgt

SEQ ID NO: 970869 - DNA, 19 bp, Homo sapiens
aaaggggagagcctgctgg

SEQ ID NO: 970870 - DNA, 18 bp, Homo sapiens
aaaggggcagaaaaactc

SEQ ID NO: 970871 - DNA, 13 bp, Homo sapiens
aaaggggctgctg

SEQ ID NO: 970872 - DNA, 14 bp, Homo sapiens
aaaggggggagggg

SEQ ID NO: 970873 - DNA, 14 bp, Homo sapiens
aaaggggggaggtc

SEQ ID NO: 970874 - DNA, 20 bp, Homo sapiens
aaagggggtcccagtgggag

SEQ ID NO: 970875 - DNA, 23 bp, Homo sapiens
aaagggggtcccagtgggagggg

SEQ ID NO: 970876 - DNA, 17 bp, Homo sapiens
aaagggggtccgtggaa

SEQ ID NO: 970877 - DNA, 15 bp, Homo sapiens
aaaggggtgctttta

SEQ ID NO: 970878 - DNA, 10 bp, Homo sapiens
aaagggtgaa

SEQ ID NO: 970879 - DNA, 18 bp, Homo sapiens
aaagggtgctgcttccct

SEQ ID NO: 970880 - DNA, 17 bp, Homo sapiens
aaagggtgtaggggcca

SEQ ID NO: 970881 - DNA, 23 bp, Homo sapiens
aaagggtgtaggggccacctcct

SEQ ID NO: 970882 - DNA, 14 bp, Homo sapiens
aaagggtgtatagt

SEQ ID NO: 970883 - DNA, 17 bp, Homo sapiens
aaagggtgtatagtgtt

SEQ ID NO: 970884 - DNA, 13 bp, Homo sapiens
aaagggtttgata

SEQ ID NO: 970885 - DNA, 19 bp, Homo sapiens
aaagggtttgtaatacttt

SEQ ID NO: 970886 - DNA, 21 bp, Homo sapiens
aaaggtaaatggttaaatttt

SEQ ID NO: 970887 - DNA, 15 bp, Homo sapiens
aaaggtaactaactg

SEQ ID NO: 970888 - DNA, 17 bp, Homo sapiens
aaaggtaactaactgct

SEQ ID NO: 970889 - DNA, 23 bp, Homo sapiens
aaaggtacactggtatttatatt

SEQ ID NO: 970890 - DNA, 19 bp, Homo sapiens
aaaggtaccaaacaaggaa

SEQ ID NO: 970891 - DNA, 14 bp, Homo sapiens
aaaggtagagtctt

SEQ ID NO: 970892 - DNA, 23 bp, Homo sapiens
aaaggtcagcccgtttcagaagg

SEQ ID NO: 970893 - DNA, 14 bp, Homo sapiens
aaaggtcctgccct

SEQ ID NO: 970894 - DNA, 21 bp, Homo sapiens
aaaggtcgcagcagtagcttt

SEQ ID NO: 970895 - DNA, 19 bp, Homo sapiens
aaaggtctaagcaagtgag

SEQ ID NO: 970896 - DNA, 14 bp, Homo sapiens
aaaggtgaaggaat

SEQ ID NO: 970897 - DNA, 15 bp, Homo sapiens
aaaggtgattgtcac

SEQ ID NO: 970898 - DNA, 19 bp, Homo sapiens
aaaggtggaataaacatta

SEQ ID NO: 970899 - DNA, 19 bp, Homo sapiens
aaaggtggagtttctctgt

SEQ ID NO: 970900 - DNA, 18 bp, Homo sapiens
aaaggtggcaatgcttaa

SEQ ID NO: 970901 - DNA, 23 bp, Homo sapiens
aaaggtggtatgtaatttatgca

SEQ ID NO: 970902 - DNA, 14 bp, Homo sapiens
aaaggtgtatttaa

SEQ ID NO: 970903 - DNA, 19 bp, Homo sapiens
aaaggtgtccttttccttt

SEQ ID NO: 970904 - DNA, 17 bp, Homo sapiens
aaaggtgtgagactggg

SEQ ID NO: 970905 - DNA, 14 bp, Homo sapiens
aaaggtgttgtccc

SEQ ID NO: 970906 - DNA, 18 bp, Homo sapiens
aaaggtgttgtcccttct

SEQ ID NO: 970907 - DNA, 17 bp, Homo sapiens
aaaggttgagttttcca

SEQ ID NO: 970908 - DNA, 14 bp, Homo sapiens
aaaggttggcctta

SEQ ID NO: 970909 - DNA, 20 bp, Homo sapiens
aaaggtttaagaaatagaat

SEQ ID NO: 970910 - DNA, 16 bp, Homo sapiens
aaaggtttatgaaaaa

SEQ ID NO: 970911 - DNA, 23 bp, Homo sapiens
aaaggtttttgaaatccaggaat

SEQ ID NO: 970912 - DNA, 18 bp, Homo sapiens
aaaggttttttttcagtt

SEQ ID NO: 970913 - DNA, 14 bp, Homo sapiens
aaagtaaaatgtct

SEQ ID NO: 970914 - DNA, 16 bp, Homo sapiens
aaagtaaaattgaagc

SEQ ID NO: 970915 - DNA, 15 bp, Homo sapiens
aaagtaacaaggtgt

SEQ ID NO: 970916 - DNA, 14 bp, Homo sapiens
aaagtaacaatcta

SEQ ID NO: 970917 - DNA, 15 bp, Homo sapiens
aaagtaacaatctat

SEQ ID NO: 970918 - DNA, 14 bp, Homo sapiens
aaagtaactcattt

SEQ ID NO: 970919 - DNA, 15 bp, Homo sapiens
aaagtaactcatttg

SEQ ID NO: 970920 - DNA, 20 bp, Homo sapiens
aaagtaactcatttgttaaa

SEQ ID NO: 970921 - DNA, 21 bp, Homo sapiens
aaagtaaggtgcttggagttt

SEQ ID NO: 970922 - DNA, 19 bp, Homo sapiens
aaagtaagtaccactcagg

SEQ ID NO: 970923 - DNA, 12 bp, Homo sapiens
aaagtaagttaa

SEQ ID NO: 970924 - DNA, 14 bp, Homo sapiens
aaagtaatttcttt

SEQ ID NO: 970925 - DNA, 15 bp, Homo sapiens
aaagtaattttgtca

SEQ ID NO: 970926 - DNA, 16 bp, Homo sapiens
aaagtaattttgtcac

SEQ ID NO: 970927 - DNA, 21 bp, Homo sapiens
aaagtacagaaaaatactttg

SEQ ID NO: 970928 - DNA, 21 bp, Homo sapiens
aaagtacagaatttgaattat

SEQ ID NO: 970929 - DNA, 22 bp, Homo sapiens
aaagtacattctggggaaacaa

SEQ ID NO: 970930 - DNA, 15 bp, Homo sapiens
aaagtacatttaata

SEQ ID NO: 970931 - DNA, 17 bp, Homo sapiens
aaagtaccacactgagt

SEQ ID NO: 970932 - DNA, 13 bp, Homo sapiens
aaagtactcttta

SEQ ID NO: 970933 - DNA, 13 bp, Homo sapiens
aaagtagacttgg

SEQ ID NO: 970934 - DNA, 18 bp, Homo sapiens
aaagtagcaaaacaaatt

SEQ ID NO: 970935 - DNA, 21 bp, Homo sapiens
aaagtagtacttcttctgtaa

SEQ ID NO: 970936 - DNA, 22 bp, Homo sapiens
aaagtagtcccccaaattaaca

SEQ ID NO: 970937 - DNA, 11 bp, Homo sapiens
aaagtataatc

SEQ ID NO: 970938 - DNA, 14 bp, Homo sapiens
aaagtatcaaagaa

SEQ ID NO: 970939 - DNA, 12 bp, Homo sapiens
aaagtatcatgc

SEQ ID NO: 970940 - DNA, 15 bp, Homo sapiens
aaagtatcatgcatt

SEQ ID NO: 970941 - DNA, 16 bp, Homo sapiens
aaagtatcatgcattc

SEQ ID NO: 970942 - DNA, 21 bp, Homo sapiens
aaagtatccctactgtaattt

SEQ ID NO: 970943 - DNA, 18 bp, Homo sapiens
aaagtatctttaacaatt

SEQ ID NO: 970944 - DNA, 12 bp, Homo sapiens
aaagtatgaatc

SEQ ID NO: 970945 - DNA, 15 bp, Homo sapiens
aaagtatgcaaaata

SEQ ID NO: 970946 - DNA, 14 bp, Homo sapiens
aaagtatgcattat

SEQ ID NO: 970947 - DNA, 20 bp, Homo sapiens
aaagtatgcattattaaatt

SEQ ID NO: 970948 - DNA, 20 bp, Homo sapiens
aaagtatgtaaagtatgtaa

SEQ ID NO: 970949 - DNA, 12 bp, Homo sapiens
aaagtatgtttt

SEQ ID NO: 970950 - DNA, 20 bp, Homo sapiens
aaagtatgtttttaaatttt

SEQ ID NO: 970951 - DNA, 17 bp, Homo sapiens
aaagtatgtttttacat

SEQ ID NO: 970952 - DNA, 16 bp, Homo sapiens
aaagtattcagaaatt

SEQ ID NO: 970953 - DNA, 16 bp, Homo sapiens
aaagtattccacctta

SEQ ID NO: 970954 - DNA, 20 bp, Homo sapiens
aaagtattctcaaagatgca

SEQ ID NO: 970955 - DNA, 16 bp, Homo sapiens
aaagtattctttttct

SEQ ID NO: 970956 - DNA, 15 bp, Homo sapiens
aaagtattggttact

SEQ ID NO: 970957 - DNA, 14 bp, Homo sapiens
aaagtattgtaaat

SEQ ID NO: 970958 - DNA, 20 bp, Homo sapiens
aaagtattgtaatgagtgaa

SEQ ID NO: 970959 - DNA, 21 bp, Homo sapiens
aaagtatttataaaaatataa

SEQ ID NO: 970960 - DNA, 18 bp, Homo sapiens
aaagtcaaaaggtgcctg

SEQ ID NO: 970961 - DNA, 20 bp, Homo sapiens
aaagtcaaaaggtgcctgtg

SEQ ID NO: 970962 - DNA, 21 bp, Homo sapiens
aaagtcaaatgccaaacacta

SEQ ID NO: 970963 - DNA, 19 bp, Homo sapiens
aaagtcacccaaacacttc

SEQ ID NO: 970964 - DNA, 14 bp, Homo sapiens
aaagtcagaatcag

SEQ ID NO: 970965 - DNA, 13 bp, Homo sapiens
aaagtcagagaca

SEQ ID NO: 970966 - DNA, 14 bp, Homo sapiens
aaagtcagatgttt

SEQ ID NO: 970967 - DNA, 19 bp, Homo sapiens
aaagtcatcccctctcagg

SEQ ID NO: 970968 - DNA, 22 bp, Homo sapiens
aaagtcatcccctctcaggaga

SEQ ID NO: 970969 - DNA, 15 bp, Homo sapiens
aaagtcattattcct

SEQ ID NO: 970970 - DNA, 16 bp, Homo sapiens
aaagtcatttgtgaaa

SEQ ID NO: 970971 - DNA, 21 bp, Homo sapiens
aaagtccataccttatatatg

SEQ ID NO: 970972 - DNA, 13 bp, Homo sapiens
aaagtccctccct

SEQ ID NO: 970973 - DNA, 23 bp, Homo sapiens
aaagtccctccctgcctgagggc

SEQ ID NO: 970974 - DNA, 17 bp, Homo sapiens
aaagtcccttgagactc

SEQ ID NO: 970975 - DNA, 18 bp, Homo sapiens
aaagtcccttgagactcc

SEQ ID NO: 970976 - DNA, 15 bp, Homo sapiens
aaagtcctctgctcc

SEQ ID NO: 970977 - DNA, 18 bp, Homo sapiens
aaagtcctttttttccat

SEQ ID NO: 970978 - DNA, 17 bp, Homo sapiens
aaagtctaaactgagct

SEQ ID NO: 970979 - DNA, 13 bp, Homo sapiens
aaagtctattttt

SEQ ID NO: 970980 - DNA, 22 bp, Homo sapiens
aaagtctatttttttaactgaa

SEQ ID NO: 970981 - DNA, 23 bp, Homo sapiens
aaagtctatttttttaactgaaa

SEQ ID NO: 970982 - DNA, 23 bp, Homo sapiens
aaagtctgccgcccacctcgctc

SEQ ID NO: 970983 - DNA, 23 bp, Homo sapiens
aaagtctgctctcatataagaca

SEQ ID NO: 970984 - DNA, 14 bp, Homo sapiens
aaagtctgtccttg

SEQ ID NO: 970985 - DNA, 19 bp, Homo sapiens
aaagtctgtccttgaagga

SEQ ID NO: 970986 - DNA, 16 bp, Homo sapiens
aaagtgaaaaaaagaa

SEQ ID NO: 970987 - DNA, 13 bp, Homo sapiens
aaagtgaactttt

SEQ ID NO: 970988 - DNA, 16 bp, Homo sapiens
aaagtgaacttttgta

SEQ ID NO: 970989 - DNA, 17 bp, Homo sapiens
aaagtgaacttttgtaa

SEQ ID NO: 970990 - DNA, 12 bp, Homo sapiens
aaagtgaaggaa

SEQ ID NO: 970991 - DNA, 22 bp, Homo sapiens
aaagtgaatttgaatgaaaaat

SEQ ID NO: 970992 - DNA, 22 bp, Homo sapiens
aaagtgacatttgctttcggta

SEQ ID NO: 970993 - DNA, 19 bp, Homo sapiens
aaagtgagaaaactgtgac

SEQ ID NO: 970994 - DNA, 19 bp, Homo sapiens
aaagtgagagccagcagca

SEQ ID NO: 970995 - DNA, 16 bp, Homo sapiens
aaagtgattatctctt

SEQ ID NO: 970996 - DNA, 23 bp, Homo sapiens
aaagtgattttatttttgcaaaa

SEQ ID NO: 970997 - DNA, 14 bp, Homo sapiens
aaagtgcaagtcca

SEQ ID NO: 970998 - DNA, 15 bp, Homo sapiens
aaagtgcagcccttc

SEQ ID NO: 970999 - DNA, 15 bp, Homo sapiens
aaagtgccagtattt

SEQ ID NO: 971000 - DNA, 21 bp, Homo sapiens
aaagtgccccttaagggttga

SEQ ID NO: 971001 - DNA, 21 bp, Homo sapiens
aaagtgccgtgataatttttg

SEQ ID NO: 971002 - DNA, 20 bp, Homo sapiens
aaagtgcctgacacactaac

SEQ ID NO: 971003 - DNA, 23 bp, Homo sapiens
aaagtgcctttatctcagccatc

SEQ ID NO: 971004 - DNA, 15 bp, Homo sapiens
aaagtgctggaactt

SEQ ID NO: 971005 - DNA, 18 bp, Homo sapiens
aaagtgctgggattacag

SEQ ID NO: 971006 - DNA, 19 bp, Homo sapiens
aaagtgctgggattacagg

SEQ ID NO: 971007 - DNA, 22 bp, Homo sapiens
aaagtgcttcattctttgcagg

SEQ ID NO: 971008 - DNA, 18 bp, Homo sapiens
aaagtgctttgacttctt

SEQ ID NO: 971009 - DNA, 19 bp, Homo sapiens
aaagtggaaaacaaggaag

SEQ ID NO: 971010 - DNA, 17 bp, Homo sapiens
aaagtggcaagaccaaa

SEQ ID NO: 971011 - DNA, 17 bp, Homo sapiens
aaagtggccatgccacc

SEQ ID NO: 971012 - DNA, 21 bp, Homo sapiens
aaagtgggaggtcaggaaact

SEQ ID NO: 971013 - DNA, 19 bp, Homo sapiens
aaagtggtaaatactgtga

SEQ ID NO: 971014 - DNA, 17 bp, Homo sapiens
aaagtggtatagaaatg

SEQ ID NO: 971015 - DNA, 17 bp, Homo sapiens
aaagtggtctctgctgg

SEQ ID NO: 971016 - DNA, 22 bp, Homo sapiens
aaagtgtatttttttactaata

SEQ ID NO: 971017 - DNA, 21 bp, Homo sapiens
aaagtgtctcaaaggagcttt

SEQ ID NO: 971018 - DNA, 14 bp, Homo sapiens
aaagtgtctgcagt

SEQ ID NO: 971019 - DNA, 12 bp, Homo sapiens
aaagtgtgtatt

SEQ ID NO: 971020 - DNA, 15 bp, Homo sapiens
aaagtgtgtattaaa

SEQ ID NO: 971021 - DNA, 23 bp, Homo sapiens
aaagtgtgtattaaaaaaaacaa

SEQ ID NO: 971022 - DNA, 15 bp, Homo sapiens
aaagtgtgtgtgttc

SEQ ID NO: 971023 - DNA, 12 bp, Homo sapiens
aaagtgttggtc

SEQ ID NO: 971024 - DNA, 18 bp, Homo sapiens
aaagtgttgtgttcctgg

SEQ ID NO: 971025 - DNA, 13 bp, Homo sapiens
aaagtgtttagct

SEQ ID NO: 971026 - DNA, 15 bp, Homo sapiens
aaagtgtttagctgt

SEQ ID NO: 971027 - DNA, 20 bp, Homo sapiens
aaagtgtttatttttcatat

SEQ ID NO: 971028 - DNA, 21 bp, Homo sapiens
aaagtgtttatttttcatatt

SEQ ID NO: 971029 - DNA, 14 bp, Homo sapiens
aaagtgttttctct

SEQ ID NO: 971030 - DNA, 23 bp, Homo sapiens
aaagtgttttctctgaacacatt

SEQ ID NO: 971031 - DNA, 18 bp, Homo sapiens
aaatcccttacctcggtg

SEQ ID NO: 971032 - DNA, 18 bp, Homo sapiens
aaatccgctctcttcctg

SEQ ID NO: 971033 - DNA, 19 bp, Homo sapiens
aaatcctcaacactattgt

SEQ ID NO: 971034 - DNA, 17 bp, Homo sapiens
aaatcctcatgttactc

SEQ ID NO: 971035 - DNA, 11 bp, Homo sapiens
aaatcctctgg

SEQ ID NO: 971036 - DNA, 17 bp, Homo sapiens
aaatcctcttcctctga

SEQ ID NO: 971037 - DNA, 17 bp, Homo sapiens
aaatcctgaagagcatt

SEQ ID NO: 971038 - DNA, 13 bp, Homo sapiens
aaatcctgaataa

SEQ ID NO: 971039 - DNA, 18 bp, Homo sapiens
aaatcctgccatttaaaa

SEQ ID NO: 971040 - DNA, 21 bp, Homo sapiens
aaatcctggaagattttggta

SEQ ID NO: 971041 - DNA, 16 bp, Homo sapiens
aaatccttattgttca

SEQ ID NO: 971042 - DNA, 23 bp, Homo sapiens
aaatccttgtgacttacaatttg

SEQ ID NO: 971043 - DNA, 16 bp, Homo sapiens
aaatcctttctgcccc

SEQ ID NO: 971044 - DNA, 21 bp, Homo sapiens
aaatccttttaaccattttaa

SEQ ID NO: 971045 - DNA, 20 bp, Homo sapiens
aaatcgaatgaaattaactg

SEQ ID NO: 971046 - DNA, 21 bp, Homo sapiens
aaatcgggttcagaacacttt

SEQ ID NO: 971047 - DNA, 21 bp, Homo sapiens
aaatcgtggcacgtattgctg

SEQ ID NO: 971048 - DNA, 22 bp, Homo sapiens
aaatcgtggcacgtattgctgt

SEQ ID NO: 971049 - DNA, 22 bp, Homo sapiens
aaatcgttggaaaataaattca

SEQ ID NO: 971050 - DNA, 15 bp, Homo sapiens
aaatctaacattatt

SEQ ID NO: 971051 - DNA, 18 bp, Homo sapiens
aaatctaatattaaaaat

SEQ ID NO: 971052 - DNA, 19 bp, Homo sapiens
aaatctaatattaaaaata

SEQ ID NO: 971053 - DNA, 19 bp, Homo sapiens
aaatctaatctcttattct

SEQ ID NO: 971054 - DNA, 20 bp, Homo sapiens
aaatctagacattcttttaa

SEQ ID NO: 971055 - DNA, 17 bp, Homo sapiens
aaatctaggaaaattat

SEQ ID NO: 971056 - DNA, 19 bp, Homo sapiens
aaatctagttttttttgta

SEQ ID NO: 971057 - DNA, 20 bp, Homo sapiens
aaatctagttttttttgtaa

SEQ ID NO: 971058 - DNA, 21 bp, Homo sapiens
aaatctagttttttttgtaaa

SEQ ID NO: 971059 - DNA, 22 bp, Homo sapiens
aaatctatttattaatatttaa

SEQ ID NO: 971060 - DNA, 19 bp, Homo sapiens
aaatctcaaatttctaaat

SEQ ID NO: 971061 - DNA, 15 bp, Homo sapiens
aaatctcaatgaatt

SEQ ID NO: 971062 - DNA, 22 bp, Homo sapiens
aaatctcagaattccttttcta

SEQ ID NO: 971063 - DNA, 21 bp, Homo sapiens
aaatgcatgtcttaaatgctc

SEQ ID NO: 971064 - DNA, 20 bp, Homo sapiens
aaatgcattataggatcatt

SEQ ID NO: 971065 - DNA, 18 bp, Homo sapiens
aaatgcattgaaagaatt

SEQ ID NO: 971066 - DNA, 20 bp, Homo sapiens
aaatgcattttcttcagaat

SEQ ID NO: 971067 - DNA, 21 bp, Homo sapiens
aaatgccaaaatgtacttaaa

SEQ ID NO: 971068 - DNA, 23 bp, Homo sapiens
aaatgccaagggggtgactggaa

SEQ ID NO: 971069 - DNA, 22 bp, Homo sapiens
aaatgccaagtgcctgcttagt

SEQ ID NO: 971070 - DNA, 17 bp, Homo sapiens
aaatgccactccctacc

SEQ ID NO: 971071 - DNA, 17 bp, Homo sapiens
aaatgccatgtttatca

SEQ ID NO: 971072 - DNA, 18 bp, Homo sapiens
aaatgcccaaggatgcct

SEQ ID NO: 971073 - DNA, 13 bp, Homo sapiens
aaatgcccagctt

SEQ ID NO: 971074 - DNA, 12 bp, Homo sapiens
aaatgcccagtt

SEQ ID NO: 971075 - DNA, 20 bp, Homo sapiens
aaatgcccatttttgctaat

SEQ ID NO: 971076 - DNA, 19 bp, Homo sapiens
aaatgccctcctaaatgtc

SEQ ID NO: 971077 - DNA, 23 bp, Homo sapiens
aaatgccctcctaaatgtcagct

SEQ ID NO: 971078 - DNA, 13 bp, Homo sapiens
aaatgccctcttc

SEQ ID NO: 971079 - DNA, 16 bp, Homo sapiens
aaatgcctcagtgtat

SEQ ID NO: 971080 - DNA, 17 bp, Homo sapiens
aaatgccttagaaatgt

SEQ ID NO: 971081 - DNA, 16 bp, Homo sapiens
aaatgcgagactctga

SEQ ID NO: 971082 - DNA, 15 bp, Homo sapiens
aaatgctataatttg

SEQ ID NO: 971083 - DNA, 14 bp, Homo sapiens
aaatgctatttttt

SEQ ID NO: 971084 - DNA, 22 bp, Homo sapiens
aaatgctcataaagatgttaaa

SEQ ID NO: 971085 - DNA, 23 bp, Homo sapiens
aaatgctcataaagatgttaaat

SEQ ID NO: 971086 - DNA, 21 bp, Homo sapiens
aaatgctcattttctggtttg

SEQ ID NO: 971087 - DNA, 17 bp, Homo sapiens
aaatgctcattttcttt

SEQ ID NO: 971088 - DNA, 19 bp, Homo sapiens
aaatgctcgtgtgatttcc

SEQ ID NO: 971089 - DNA, 18 bp, Homo sapiens
aaatgctcttaaaatatc

SEQ ID NO: 971090 - DNA, 18 bp, Homo sapiens
aaatgctgctctcagcct

SEQ ID NO: 971091 - DNA, 14 bp, Homo sapiens
aaatgctggctgag

SEQ ID NO: 971092 - DNA, 22 bp, Homo sapiens
aaatgctggtatttgatttcct

SEQ ID NO: 971093 - DNA, 19 bp, Homo sapiens
aaatgcttcatttgtatgt

SEQ ID NO: 971094 - DNA, 23 bp, Homo sapiens
aaatgcttcatttgtatgtcaaa

SEQ ID NO: 971095 - DNA, 24 bp, Homo sapiens
aaatgcttgggaccagaagtgttt

SEQ ID NO: 971096 - DNA, 18 bp, Homo sapiens
aaatgctttatgcaaacc

SEQ ID NO: 971097 - DNA, 19 bp, Homo sapiens
aaatgctttgtgtgattga

SEQ ID NO: 971098 - DNA, 13 bp, Homo sapiens
aaatgcttttaaa

SEQ ID NO: 971099 - DNA, 19 bp, Homo sapiens
aaatgcttttaaatgctct

SEQ ID NO: 971100 - DNA, 19 bp, Homo sapiens
aaatgcttttatattctaa

SEQ ID NO: 971101 - DNA, 21 bp, Homo sapiens
aaatgcttttcactttctgtc

SEQ ID NO: 971102 - DNA, 16 bp, Homo sapiens
aaatggaaaagagaga

SEQ ID NO: 971103 - DNA, 14 bp, Homo sapiens
aaatggaaaatgta

SEQ ID NO: 971104 - DNA, 14 bp, Homo sapiens
aaatggaaattttg

SEQ ID NO: 971105 - DNA, 22 bp, Homo sapiens
aaatggaattgcttctgtgtag

SEQ ID NO: 971106 - DNA, 14 bp, Homo sapiens
aaatggacaaagaa

SEQ ID NO: 971107 - DNA, 22 bp, Homo sapiens
aaatggacaaggcctaattttt

SEQ ID NO: 971108 - DNA, 20 bp, Homo sapiens
aaatggacacaaattttcaa

SEQ ID NO: 971109 - DNA, 16 bp, Homo sapiens
aaatggacactgtgcc

SEQ ID NO: 971110 - DNA, 18 bp, Homo sapiens
aaatggagctcagtaaca

SEQ ID NO: 971111 - DNA, 23 bp, Homo sapiens
aaatggaggatctctaaagagca

SEQ ID NO: 971112 - DNA, 18 bp, Homo sapiens
aaatggaggcttttcact

SEQ ID NO: 971113 - DNA, 23 bp, Homo sapiens
aaatggagtcatttgagtctctt

SEQ ID NO: 971114 - DNA, 16 bp, Homo sapiens
aaatggatacataaag

SEQ ID NO: 971115 - DNA, 22 bp, Homo sapiens
aaatggatgccttgaataataa

SEQ ID NO: 971116 - DNA, 23 bp, Homo sapiens
aaatggatgccttgaataataag

SEQ ID NO: 971117 - DNA, 12 bp, Homo sapiens
aaatggcacctt

SEQ ID NO: 971118 - DNA, 18 bp, Homo sapiens
aaatggccagtgctgctt

SEQ ID NO: 971119 - DNA, 21 bp, Homo sapiens
aaatggccagtgctgcttctt

SEQ ID NO: 971120 - DNA, 11 bp, Homo sapiens
aaatggccatt

SEQ ID NO: 971121 - DNA, 11 bp, Homo sapiens
aaatggcctca

SEQ ID NO: 971122 - DNA, 16 bp, Homo sapiens
aaatggcgaacatgtg

SEQ ID NO: 971123 - DNA, 15 bp, Homo sapiens
aaatggcgaatgtca

SEQ ID NO: 971124 - DNA, 14 bp, Homo sapiens
aaatggcgtctgct

SEQ ID NO: 971125 - DNA, 17 bp, Homo sapiens
aaatggcgtctgctctg

SEQ ID NO: 971126 - DNA, 21 bp, Homo sapiens
aaatggcgtctgctctggtgg

SEQ ID NO: 971127 - DNA, 18 bp, Homo sapiens
aaatggctcaagtagaaa

SEQ ID NO: 971128 - DNA, 22 bp, Homo sapiens
aaatggcttcagaattaaaact

SEQ ID NO: 971129 - DNA, 17 bp, Homo sapiens
aaatgggaaaaaaacaa

SEQ ID NO: 971130 - DNA, 18 bp, Homo sapiens
aaatgggaaaaaaacaaa

SEQ ID NO: 971131 - DNA, 16 bp, Homo sapiens
aaatgggacttaactc

SEQ ID NO: 971132 - DNA, 23 bp, Homo sapiens
aaatgggagactctttgaaatga

SEQ ID NO: 971133 - DNA, 15 bp, Homo sapiens
aaatgggaggaggaa

SEQ ID NO: 971134 - DNA, 18 bp, Homo sapiens
aaatttctgtaaaacagg

SEQ ID NO: 971135 - DNA, 17 bp, Homo sapiens
aaatttcttatgtgaca

SEQ ID NO: 971136 - DNA, 20 bp, Homo sapiens
aaatttcttatgtgacatta

SEQ ID NO: 971137 - DNA, 23 bp, Homo sapiens
aaatttcttggcaaattttaaaa

SEQ ID NO: 971138 - DNA, 17 bp, Homo sapiens
aaatttgactaatttta

SEQ ID NO: 971139 - DNA, 18 bp, Homo sapiens
aaatttgacttttctgta

SEQ ID NO: 971140 - DNA, 15 bp, Homo sapiens
aaatttgattgattt

SEQ ID NO: 971141 - DNA, 13 bp, Homo sapiens
aaatttgatttcc

SEQ ID NO: 971142 - DNA, 18 bp, Homo sapiens
aaatttgatttccatctt

SEQ ID NO: 971143 - DNA, 18 bp, Homo sapiens
aaatttgcaactcactga

SEQ ID NO: 971144 - DNA, 22 bp, Homo sapiens
aaatttgccaccactagagctg

SEQ ID NO: 971145 - DNA, 20 bp, Homo sapiens
aaatttgccatgacatttca

SEQ ID NO: 971146 - DNA, 20 bp, Homo sapiens
aaatttggccttaagaactg

SEQ ID NO: 971147 - DNA, 15 bp, Homo sapiens
aaatttggttctaat

SEQ ID NO: 971148 - DNA, 16 bp, Homo sapiens
aaatttggttctaata

SEQ ID NO: 971149 - DNA, 12 bp, Homo sapiens
aaatttgtacag

SEQ ID NO: 971150 - DNA, 24 bp, Homo sapiens
aaatttgtacaggactgtaaagat

SEQ ID NO: 971151 - DNA, 21 bp, Homo sapiens
aaatttgtctggttaaaaaat

SEQ ID NO: 971152 - DNA, 22 bp, Homo sapiens
aaatttgtcttaaaaatttata

SEQ ID NO: 971153 - DNA, 14 bp, Homo sapiens
aaatttgtgtaaat

SEQ ID NO: 971154 - DNA, 15 bp, Homo sapiens
aaatttgttcttgta

SEQ ID NO: 971155 - DNA, 14 bp, Homo sapiens
aaatttgttgcata

SEQ ID NO: 971156 - DNA, 16 bp, Homo sapiens
aaatttgttgtttgtt

SEQ ID NO: 971157 - DNA, 12 bp, Homo sapiens
aaatttgtttaa

SEQ ID NO: 971158 - DNA, 17 bp, Homo sapiens
aaatttgtttaattaaa

SEQ ID NO: 971159 - DNA, 18 bp, Homo sapiens
aaatttgtttgaaatctt

SEQ ID NO: 971160 - DNA, 13 bp, Homo sapiens
aaattttaaaaaa

SEQ ID NO: 971161 - DNA, 16 bp, Homo sapiens
aaattttaaaaagcag

SEQ ID NO: 971162 - DNA, 20 bp, Homo sapiens
aaattttacctctctctggg

SEQ ID NO: 971163 - DNA, 14 bp, Homo sapiens
aaattttagaaata

SEQ ID NO: 971164 - DNA, 16 bp, Homo sapiens
aaattttagagcatac

SEQ ID NO: 971165 - DNA, 12 bp, Homo sapiens
aaattttatctg

SEQ ID NO: 971166 - DNA, 14 bp, Homo sapiens
aaattttattatta

SEQ ID NO: 971167 - DNA, 13 bp, Homo sapiens
aaattttattcct

SEQ ID NO: 971168 - DNA, 18 bp, Homo sapiens
aaattttatttcctggac

SEQ ID NO: 971169 - DNA, 16 bp, Homo sapiens
aaattttattttgtgc

SEQ ID NO: 971170 - DNA, 14 bp, Homo sapiens
aaattttctagact

SEQ ID NO: 971171 - DNA, 20 bp, Homo sapiens
aaattttctagactttctgt

SEQ ID NO: 971172 - DNA, 15 bp, Homo sapiens
aaattttctccttgg

SEQ ID NO: 971173 - DNA, 12 bp, Homo sapiens
aaattttctttt

SEQ ID NO: 971174 - DNA, 22 bp, Homo sapiens
aaattttcttttaagcatttgt

SEQ ID NO: 971175 - DNA, 18 bp, Homo sapiens
aaattttgatgttttaag

SEQ ID NO: 971176 - DNA, 19 bp, Homo sapiens
aaattttggaatatttgct

SEQ ID NO: 971177 - DNA, 11 bp, Homo sapiens
aaattttgtcc

SEQ ID NO: 971178 - DNA, 17 bp, Homo sapiens
aaattttgtttcagaat

SEQ ID NO: 971179 - DNA, 23 bp, Homo sapiens
aaattttgtttcagaattttgta

SEQ ID NO: 971180 - DNA, 20 bp, Homo sapiens
aaattttgttttctttttct

SEQ ID NO: 971181 - DNA, 13 bp, Homo sapiens
aaatttttaatgt

SEQ ID NO: 971182 - DNA, 13 bp, Homo sapiens
aaatttttataaa

SEQ ID NO: 971183 - DNA, 20 bp, Homo sapiens
aaatttttcagatgcttctg

SEQ ID NO: 971184 - DNA, 21 bp, Homo sapiens
aaatttttcagatgcttctgg

SEQ ID NO: 971185 - DNA, 17 bp, Homo sapiens
aaatttttcttcttgag

SEQ ID NO: 971186 - DNA, 10 bp, Homo sapiens
aaatttttga

SEQ ID NO: 971187 - DNA, 16 bp, Homo sapiens
aaatttttgaaaaata

SEQ ID NO: 971188 - DNA, 21 bp, Homo sapiens
aaatttttgaaaaatattgct

SEQ ID NO: 971189 - DNA, 22 bp, Homo sapiens
aaatttttgaaaaatattgcta

SEQ ID NO: 971190 - DNA, 16 bp, Homo sapiens
aaatttttgacacttt

SEQ ID NO: 971191 - DNA, 20 bp, Homo sapiens
aaatttttgtagtagcgttt

SEQ ID NO: 971192 - DNA, 23 bp, Homo sapiens
aaatttttgtcattttaaaatct

SEQ ID NO: 971193 - DNA, 16 bp, Homo sapiens
aaattttttagtatgt

SEQ ID NO: 971194 - DNA, 12 bp, Homo sapiens
aaattttttgac

SEQ ID NO: 971195 - DNA, 14 bp, Homo sapiens
aaattttttgttga

SEQ ID NO: 971196 - DNA, 15 bp, Homo sapiens
aaattttttttacat

SEQ ID NO: 971197 - DNA, 16 bp, Homo sapiens
aaattttttttacatt

SEQ ID NO: 971198 - DNA, 18 bp, Homo sapiens
aaattttttttacatttt

SEQ ID NO: 971199 - DNA, 17 bp, Homo sapiens
aaattttttttgtttca

SEQ ID NO: 971200 - DNA, 18 bp, Homo sapiens
aaattttttttgtttcat

SEQ ID NO: 971201 - DNA, 19 bp, Homo sapiens
aaatttttttttaaagcag

SEQ ID NO: 971202 - DNA, 23 bp, Homo sapiens
aaatttttttttctctttttggt

SEQ ID NO: 971203 - DNA, 13 bp, Homo sapiens
aacaaaaaaacta

SEQ ID NO: 971204 - DNA, 14 bp, Homo sapiens
aacaaaaaaactat

SEQ ID NO: 971205 - DNA, 19 bp, Homo sapiens
aacaaaaaaagacaagaga

SEQ ID NO: 971206 - DNA, 21 bp, Homo sapiens
aacaaaaaaagacaagagaga

SEQ ID NO: 971207 - DNA, 13 bp, Homo sapiens
aacaaaaaaatct

SEQ ID NO: 971208 - DNA, 14 bp, Homo sapiens
aacaaaaaccaaaa

SEQ ID NO: 971209 - DNA, 11 bp, Homo sapiens
aacaaaaagaa

SEQ ID NO: 971210 - DNA, 14 bp, Homo sapiens
aacaaaaattaggt

SEQ ID NO: 971211 - DNA, 13 bp, Homo sapiens
aacaaaaattgtc

SEQ ID NO: 971212 - DNA, 14 bp, Homo sapiens
aacaaaaccaagcc

SEQ ID NO: 971213 - DNA, 12 bp, Homo sapiens
aacaaaactgtt

SEQ ID NO: 971214 - DNA, 14 bp, Homo sapiens
aacaaaactgttct

SEQ ID NO: 971215 - DNA, 18 bp, Homo sapiens
aacaaaactgttcttttg

SEQ ID NO: 971216 - DNA, 21 bp, Homo sapiens
aacaaaactgttcttttgcat

SEQ ID NO: 971217 - DNA, 15 bp, Homo sapiens
aacaaaagcaagact

SEQ ID NO: 971218 - DNA, 20 bp, Homo sapiens
aacaaaagggtgtatagtgt

SEQ ID NO: 971219 - DNA, 23 bp, Homo sapiens
aacaaaagggtgtatagtgttca

SEQ ID NO: 971220 - DNA, 16 bp, Homo sapiens
aacaaaagtacattgc

SEQ ID NO: 971221 - DNA, 13 bp, Homo sapiens
aacaaaagttccc

SEQ ID NO: 971222 - DNA, 20 bp, Homo sapiens
aacaaaatgtaatgtcagac

SEQ ID NO: 971223 - DNA, 13 bp, Homo sapiens
aacaaaatttcac

SEQ ID NO: 971224 - DNA, 19 bp, Homo sapiens
aacaaaatttgtttgaaat

SEQ ID NO: 971225 - DNA, 21 bp, Homo sapiens
aacaaaattttattttgtgct

SEQ ID NO: 971226 - DNA, 21 bp, Homo sapiens
aacaaacactgaatcatgtta

SEQ ID NO: 971227 - DNA, 22 bp, Homo sapiens
aacaaatatacattttctaaat

SEQ ID NO: 971228 - DNA, 14 bp, Homo sapiens
aacaaatatgaaaa

SEQ ID NO: 971229 - DNA, 13 bp, Homo sapiens
aacaaatatgcaa

SEQ ID NO: 971230 - DNA, 18 bp, Homo sapiens
aacaaatcagatcagatg

SEQ ID NO: 971231 - DNA, 23 bp, Homo sapiens
aacaaatctaatctcttattcta

SEQ ID NO: 971232 - DNA, 19 bp, Homo sapiens
aacaaatgaacgatatgta

SEQ ID NO: 971233 - DNA, 20 bp, Homo sapiens
aacaaattatgttacatctg

SEQ ID NO: 971234 - DNA, 18 bp, Homo sapiens
aacaaattcatattctgt

SEQ ID NO: 971235 - DNA, 18 bp, Homo sapiens
aacaaattgtttacataa

SEQ ID NO: 971236 - DNA, 15 bp, Homo sapiens
aacaaatttagaaga

SEQ ID NO: 971237 - DNA, 12 bp, Homo sapiens
aacaaatttttc

SEQ ID NO: 971238 - DNA, 11 bp, Homo sapiens
aacaacaaaaa

SEQ ID NO: 971239 - DNA, 13 bp, Homo sapiens
aacaacaattggt

SEQ ID NO: 971240 - DNA, 14 bp, Homo sapiens
aacaacaattggta

SEQ ID NO: 971241 - DNA, 16 bp, Homo sapiens
aacaacacccaagatg

SEQ ID NO: 971242 - DNA, 14 bp, Homo sapiens
aacaacagtagttt

SEQ ID NO: 971243 - DNA, 20 bp, Homo sapiens
aacaacagtcttcatttttt

SEQ ID NO: 971244 - DNA, 21 bp, Homo sapiens
aacaacccacaccgtcttcct

SEQ ID NO: 971245 - DNA, 18 bp, Homo sapiens
aacaaccgtcctgctgtc

SEQ ID NO: 971246 - DNA, 21 bp, Homo sapiens
aacaaccgtcctgctgtccct

SEQ ID NO: 971247 - DNA, 14 bp, Homo sapiens
aacaacctgcccaa

SEQ ID NO: 971248 - DNA, 19 bp, Homo sapiens
aacaacgtgtatagtgcct

SEQ ID NO: 971249 - DNA, 14 bp, Homo sapiens
aacaactaaaaaaa

SEQ ID NO: 971250 - DNA, 21 bp, Homo sapiens
aacaactaaaaaaatttttga

SEQ ID NO: 971251 - DNA, 22 bp, Homo sapiens
aacaactaaaaaaatttttgac

SEQ ID NO: 971252 - DNA, 22 bp, Homo sapiens
aacaactctgatgtggaatgca

SEQ ID NO: 971253 - DNA, 13 bp, Homo sapiens
aacaactctgcct

SEQ ID NO: 971254 - DNA, 14 bp, Homo sapiens
aacaactgctctta

SEQ ID NO: 971255 - DNA, 19 bp, Homo sapiens
aacaacttgctacttatca

SEQ ID NO: 971256 - DNA, 14 bp, Homo sapiens
aacaacttggcatt

SEQ ID NO: 971257 - DNA, 15 bp, Homo sapiens
aacaacttggcattt

SEQ ID NO: 971258 - DNA, 17 bp, Homo sapiens
aacaacttggcatttct

SEQ ID NO: 971259 - DNA, 18 bp, Homo sapiens
aacaacttggcatttcta

SEQ ID NO: 971260 - DNA, 15 bp, Homo sapiens
aacaactttcacttc

SEQ ID NO: 971261 - DNA, 13 bp, Homo sapiens
aacaagaaaccaa

SEQ ID NO: 971262 - DNA, 17 bp, Homo sapiens
aacaagaagaaatatga

SEQ ID NO: 971263 - DNA, 18 bp, Homo sapiens
aacaagaagaaatatgaa

SEQ ID NO: 971264 - DNA, 18 bp, Homo sapiens
aacaagaatattgtatgt

SEQ ID NO: 971265 - DNA, 12 bp, Homo sapiens
aacaagaatgca

SEQ ID NO: 971266 - DNA, 17 bp, Homo sapiens
aacaagaccacgtttct

SEQ ID NO: 971267 - DNA, 19 bp, Homo sapiens
aacaagaccacgtttctaa

SEQ ID NO: 971268 - DNA, 19 bp, Homo sapiens
aacaagaccccgtctcaaa

SEQ ID NO: 971269 - DNA, 22 bp, Homo sapiens
aacaagacctcagtgccttcct

SEQ ID NO: 971270 - DNA, 19 bp, Homo sapiens
aacaagactgccaggtggt

SEQ ID NO: 971271 - DNA, 19 bp, Homo sapiens
aacaagagcactacattca

SEQ ID NO: 971272 - DNA, 23 bp, Homo sapiens
aacaagcatgatcttgttactgt

SEQ ID NO: 971273 - DNA, 22 bp, Homo sapiens
aacaagccaaagagcctcccac

SEQ ID NO: 971274 - DNA, 14 bp, Homo sapiens
aacaagcttcagta

SEQ ID NO: 971275 - DNA, 20 bp, Homo sapiens
aacaaggaatgcctgtgcca

SEQ ID NO: 971276 - DNA, 20 bp, Homo sapiens
aacaaggatcaggctgctgg

SEQ ID NO: 971277 - DNA, 23 bp, Homo sapiens
aacaaggcctgtcagctaaagaa

SEQ ID NO: 971278 - DNA, 23 bp, Homo sapiens
aacaagggaaggggcctccctcc

SEQ ID NO: 971279 - DNA, 19 bp, Homo sapiens
aacaagtctagtcttctgg

SEQ ID NO: 971280 - DNA, 20 bp, Homo sapiens
aacaagtgcctcctggactg

SEQ ID NO: 971281 - DNA, 17 bp, Homo sapiens
aacaagtttagaaagct

SEQ ID NO: 971282 - DNA, 17 bp, Homo sapiens
aacaagtttttctgtca

SEQ ID NO: 971283 - DNA, 16 bp, Homo sapiens
aacaataaacaggaat

SEQ ID NO: 971284 - DNA, 15 bp, Homo sapiens
aacaataaagggaga

SEQ ID NO: 971285 - DNA, 17 bp, Homo sapiens
aacaatacaaatggatt

SEQ ID NO: 971286 - DNA, 15 bp, Homo sapiens
aacaatacatgagaa

SEQ ID NO: 971287 - DNA, 18 bp, Homo sapiens
aacaataggctgttccca

SEQ ID NO: 971288 - DNA, 22 bp, Homo sapiens
aacaatagttcttagctttgaa

SEQ ID NO: 971289 - DNA, 21 bp, Homo sapiens
aacaatatgtaatcaaacttc

SEQ ID NO: 971290 - DNA, 16 bp, Homo sapiens
aacaatattgtttcta

SEQ ID NO: 971291 - DNA, 17 bp, Homo sapiens
aacaatcactattctta

SEQ ID NO: 971292 - DNA, 18 bp, Homo sapiens
aacaatcactattcttaa

SEQ ID NO: 971293 - DNA, 20 bp, Homo sapiens
aacaatcagtcatcatgggt

SEQ ID NO: 971294 - DNA, 16 bp, Homo sapiens
aacaatccattcacaa

SEQ ID NO: 971295 - DNA, 20 bp, Homo sapiens
aacaatccattcacaagcct

SEQ ID NO: 971296 - DNA, 18 bp, Homo sapiens
aacaatcccaatctttct

SEQ ID NO: 971297 - DNA, 17 bp, Homo sapiens
aacaatctggaagaaaa

SEQ ID NO: 971298 - DNA, 16 bp, Homo sapiens
aacaatcttattccga

SEQ ID NO: 971299 - DNA, 24 bp, Homo sapiens
aacaatcttattccgagcattcca

SEQ ID NO: 971300 - DNA, 13 bp, Homo sapiens
aacaatggtaaca

SEQ ID NO: 971301 - DNA, 22 bp, Homo sapiens
aacaatggtgtctcttttatgt

SEQ ID NO: 971302 - DNA, 14 bp, Homo sapiens
aacaatgtaaagta

SEQ ID NO: 971303 - DNA, 13 bp, Homo sapiens
aacaatgtataaa

SEQ ID NO: 971304 - DNA, 11 bp, Homo sapiens
aacaattcagt

SEQ ID NO: 971305 - DNA, 14 bp, Homo sapiens
aacaattctaaaat

SEQ ID NO: 971306 - DNA, 19 bp, Homo sapiens
aacaattctaaaatgattg

SEQ ID NO: 971307 - DNA, 16 bp, Homo sapiens
aacaattgaagtaaac

SEQ ID NO: 971308 - DNA, 17 bp, Homo sapiens
aacaattggtaaaactc

SEQ ID NO: 971309 - DNA, 17 bp, Homo sapiens
aacaattgtcttaaaac

SEQ ID NO: 971310 - DNA, 22 bp, Homo sapiens
aacaattgtgtagcctttttgt

SEQ ID NO: 971311 - DNA, 16 bp, Homo sapiens
aacaatttatgaattg

SEQ ID NO: 971312 - DNA, 14 bp, Homo sapiens
aacaatttggcaat

SEQ ID NO: 971313 - DNA, 17 bp, Homo sapiens
aacaattttttttaatt

SEQ ID NO: 971314 - DNA, 22 bp, Homo sapiens
aacacaaaacattcatgtaact

SEQ ID NO: 971315 - DNA, 15 bp, Homo sapiens
aacacaaaacattta

SEQ ID NO: 971316 - DNA, 13 bp, Homo sapiens
aacacaaactgta

SEQ ID NO: 971317 - DNA, 16 bp, Homo sapiens
aacacaaactgtaaat

SEQ ID NO: 971318 - DNA, 20 bp, Homo sapiens
aacacaaagagaaaaagaaa

SEQ ID NO: 971319 - DNA, 19 bp, Homo sapiens
aacacaaagcggggggagg

SEQ ID NO: 971320 - DNA, 20 bp, Homo sapiens
aacacaaatgtctagtttct

SEQ ID NO: 971321 - DNA, 23 bp, Homo sapiens
aacacaaatgtctagtttctagt

SEQ ID NO: 971322 - DNA, 17 bp, Homo sapiens
aacacaacaataacttt

SEQ ID NO: 971323 - DNA, 18 bp, Homo sapiens
aacacaagctggaagcac

SEQ ID NO: 971324 - DNA, 20 bp, Homo sapiens
aacacaattgatacttcagg

SEQ ID NO: 971325 - DNA, 15 bp, Homo sapiens
aacacacacatatac

SEQ ID NO: 971326 - DNA, 17 bp, Homo sapiens
aacacacacatatacac

SEQ ID NO: 971327 - DNA, 21 bp, Homo sapiens
aacacacaggtgcaacagact

SEQ ID NO: 971328 - DNA, 17 bp, Homo sapiens
aacacactaccgaatgt

SEQ ID NO: 971329 - DNA, 19 bp, Homo sapiens
aacacactgtgtcctggtg

SEQ ID NO: 971330 - DNA, 22 bp, Homo sapiens
aacacagagaagcggatttcca

SEQ ID NO: 971331 - DNA, 20 bp, Homo sapiens
aaatattctacacatgtaaa

SEQ ID NO: 971332 - DNA, 23 bp, Homo sapiens
aaatattctacacatgtaaaata

SEQ ID NO: 971333 - DNA, 13 bp, Homo sapiens
aaatattcttagg

SEQ ID NO: 971334 - DNA, 20 bp, Homo sapiens
aaatattcttgtccacattc

SEQ ID NO: 971335 - DNA, 22 bp, Homo sapiens
aaatattcttgtccacattcta

SEQ ID NO: 971336 - DNA, 22 bp, Homo sapiens
aaatattctttctcataaaact

SEQ ID NO: 971337 - DNA, 16 bp, Homo sapiens
aaatattgaagttgtt

SEQ ID NO: 971338 - DNA, 19 bp, Homo sapiens
aaatattgaagttgtttat

SEQ ID NO: 971339 - DNA, 23 bp, Homo sapiens
aaatattgaagttgtttatcaac

SEQ ID NO: 971340 - DNA, 21 bp, Homo sapiens
aaatattgagcagaattcatt

SEQ ID NO: 971341 - DNA, 16 bp, Homo sapiens
aaatattgctaaaagt

SEQ ID NO: 971342 - DNA, 15 bp, Homo sapiens
aaatattgctgtata

SEQ ID NO: 971343 - DNA, 12 bp, Homo sapiens
aaatattggtta

SEQ ID NO: 971344 - DNA, 16 bp, Homo sapiens
aaatattgtttctgca

SEQ ID NO: 971345 - DNA, 12 bp, Homo sapiens
aaatatttaagt

SEQ ID NO: 971346 - DNA, 14 bp, Homo sapiens
aaatatttaagtga

SEQ ID NO: 971347 - DNA, 15 bp, Homo sapiens
aaatatttactcttt

SEQ ID NO: 971348 - DNA, 21 bp, Homo sapiens
aaatatttactctttgcaaac

SEQ ID NO: 971349 - DNA, 10 bp, Homo sapiens
aaatatttat

SEQ ID NO: 971350 - DNA, 15 bp, Homo sapiens
aaatatttattcatt

SEQ ID NO: 971351 - DNA, 23 bp, Homo sapiens
aaatatttattcattatttgtca

SEQ ID NO: 971352 - DNA, 13 bp, Homo sapiens
aaatatttatttt

SEQ ID NO: 971353 - DNA, 17 bp, Homo sapiens
aaatatttcagatatca

SEQ ID NO: 971354 - DNA, 21 bp, Homo sapiens
aaatatttccattaacagcaa

SEQ ID NO: 971355 - DNA, 23 bp, Homo sapiens
aacacagagaagcggatttccag

SEQ ID NO: 971356 - DNA, 16 bp, Homo sapiens
aacacagattattcat

SEQ ID NO: 971357 - DNA, 16 bp, Homo sapiens
aacacagcatgtgcca

SEQ ID NO: 971358 - DNA, 18 bp, Homo sapiens
aacacagcatgtgtattt

SEQ ID NO: 971359 - DNA, 13 bp, Homo sapiens
aacatattcatga

SEQ ID NO: 971360 - DNA, 23 bp, Homo sapiens
aacatattcttttgatcacattg

SEQ ID NO: 971361 - DNA, 15 bp, Homo sapiens
aacatatttcatttt

SEQ ID NO: 971362 - DNA, 22 bp, Homo sapiens
aacatatttcattttaacatga

SEQ ID NO: 971363 - DNA, 16 bp, Homo sapiens
aacatatttttatact

SEQ ID NO: 971364 - DNA, 19 bp, Homo sapiens
aacatatttttatacttta

SEQ ID NO: 971365 - DNA, 21 bp, Homo sapiens
aacatatttttatactttatt

SEQ ID NO: 971366 - DNA, 15 bp, Homo sapiens
aacatcaaataaatt

SEQ ID NO: 971367 - DNA, 16 bp, Homo sapiens
aacatcaaataaattt

SEQ ID NO: 971368 - DNA, 12 bp, Homo sapiens
aacatcaatgtt

SEQ ID NO: 971369 - DNA, 14 bp, Homo sapiens
aacatcaatgttca

SEQ ID NO: 971370 - DNA, 15 bp, Homo sapiens
aacatcagtgtctgt

SEQ ID NO: 971371 - DNA, 15 bp, Homo sapiens
aacatcataattaca

SEQ ID NO: 971372 - DNA, 15 bp, Homo sapiens
aacatcattagaaca

SEQ ID NO: 971373 - DNA, 21 bp, Homo sapiens
aacatcattttactcttatga

SEQ ID NO: 971374 - DNA, 15 bp, Homo sapiens
aacatccaaaatctt

SEQ ID NO: 971375 - DNA, 17 bp, Homo sapiens
aacatccaaccttccca

SEQ ID NO: 971376 - DNA, 19 bp, Homo sapiens
aacatccaaggagaaacag

SEQ ID NO: 971377 - DNA, 22 bp, Homo sapiens
aacatccaaggagaaacagaga

SEQ ID NO: 971378 - DNA, 15 bp, Homo sapiens
aacatccaagtcttt

SEQ ID NO: 971379 - DNA, 18 bp, Homo sapiens
aacatccacttaagttct

SEQ ID NO: 971380 - DNA, 12 bp, Homo sapiens
aacatccagaag

SEQ ID NO: 971381 - DNA, 18 bp, Homo sapiens
aacatcccaaactttaaa

SEQ ID NO: 971382 - DNA, 16 bp, Homo sapiens
aacatcccattgccct

SEQ ID NO: 971383 - DNA, 16 bp, Homo sapiens
aacatccctgggcaag

SEQ ID NO: 971384 - DNA, 15 bp, Homo sapiens
aacatccttccttcc

SEQ ID NO: 971385 - DNA, 16 bp, Homo sapiens
aacatcgttgttttgc

SEQ ID NO: 971386 - DNA, 18 bp, Homo sapiens
aacatctcatcatgtcta

SEQ ID NO: 971387 - DNA, 23 bp, Homo sapiens
aacatctctgcagtttttcccaa

SEQ ID NO: 971388 - DNA, 12 bp, Homo sapiens
aacatctctggc

SEQ ID NO: 971389 - DNA, 15 bp, Homo sapiens
aacatctcttgaaac

SEQ ID NO: 971390 - DNA, 22 bp, Homo sapiens
aacatctttacgtactgtaact

SEQ ID NO: 971391 - DNA, 23 bp, Homo sapiens
aacatctttacgtactgtaactg

SEQ ID NO: 971392 - DNA, 11 bp, Homo sapiens
aacatctttgt

SEQ ID NO: 971393 - DNA, 16 bp, Homo sapiens
aacatctttgttttta

SEQ ID NO: 971394 - DNA, 21 bp, Homo sapiens
aacatctttttaacctgcaaa

SEQ ID NO: 971395 - DNA, 23 bp, Homo sapiens
aacatgaaaaacacggcagctgt

SEQ ID NO: 971396 - DNA, 22 bp, Homo sapiens
aacatgaacacccttagaaaat

SEQ ID NO: 971397 - DNA, 16 bp, Homo sapiens
aacatgaagcataatt

SEQ ID NO: 971398 - DNA, 22 bp, Homo sapiens
aacatgaatttagaaatattca

SEQ ID NO: 971399 - DNA, 20 bp, Homo sapiens
aacatgactctttattgtct

SEQ ID NO: 971400 - DNA, 24 bp, Homo sapiens
aacatgattttacaagtataacag

SEQ ID NO: 971401 - DNA, 22 bp, Homo sapiens
aacatgcaagatacaggaaaaa

SEQ ID NO: 971402 - DNA, 13 bp, Homo sapiens
aacatgccccctg

SEQ ID NO: 971403 - DNA, 22 bp, Homo sapiens
aacatgccccctgcagacacgt

SEQ ID NO: 971404 - DNA, 14 bp, Homo sapiens
aacatgccctgttc

SEQ ID NO: 971405 - DNA, 21 bp, Homo sapiens
aacatgcctgccaaagacgtg

SEQ ID NO: 971406 - DNA, 21 bp, Homo sapiens
aacatgcctgccccaaacaaa

SEQ ID NO: 971407 - DNA, 22 bp, Homo sapiens
aacatgcctgccccaaacaaat

SEQ ID NO: 971408 - DNA, 14 bp, Homo sapiens
aacatggacttgta

SEQ ID NO: 971409 - DNA, 18 bp, Homo sapiens
aacatggacttgtatatt

SEQ ID NO: 971410 - DNA, 23 bp, Homo sapiens
aacatggacttgtatatttgtac

SEQ ID NO: 971411 - DNA, 17 bp, Homo sapiens
aacatgggagggatcag

SEQ ID NO: 971412 - DNA, 20 bp, Homo sapiens
aacatgggagggatcagccc

SEQ ID NO: 971413 - DNA, 22 bp, Homo sapiens
aacatgggcattgggttctaaa

SEQ ID NO: 971414 - DNA, 20 bp, Homo sapiens
aacatgtaaccggcatgttt

SEQ ID NO: 971415 - DNA, 21 bp, Homo sapiens
aacatgtaattaagtactatg

SEQ ID NO: 971416 - DNA, 15 bp, Homo sapiens
aacatgtaggaagta

SEQ ID NO: 971417 - DNA, 19 bp, Homo sapiens
aacatgtcacaatacagta

SEQ ID NO: 971418 - DNA, 19 bp, Homo sapiens
aacatgtcctgcctattat

SEQ ID NO: 971419 - DNA, 17 bp, Homo sapiens
aacatgtgaaaagaata

SEQ ID NO: 971420 - DNA, 20 bp, Homo sapiens
aacatgtggctcctcccagc

SEQ ID NO: 971421 - DNA, 13 bp, Homo sapiens
aacatgtgtttct

SEQ ID NO: 971422 - DNA, 16 bp, Homo sapiens
aacatgtgtttctgac

SEQ ID NO: 971423 - DNA, 17 bp, Homo sapiens
aacatgttactgaccag

SEQ ID NO: 971424 - DNA, 22 bp, Homo sapiens
aacatgtttacaggtttgaatt

SEQ ID NO: 971425 - DNA, 14 bp, Homo sapiens
aacatgtttctgtt

SEQ ID NO: 971426 - DNA, 23 bp, Homo sapiens
aacattaaaacaatattgtttct

SEQ ID NO: 971427 - DNA, 13 bp, Homo sapiens
aacattaaaatat

SEQ ID NO: 971428 - DNA, 16 bp, Homo sapiens
aacattaaacactgta

SEQ ID NO: 971429 - DNA, 18 bp, Homo sapiens
aacattaagaaaatcata

SEQ ID NO: 971430 - DNA, 17 bp, Homo sapiens
aacattaagtaaatgct

SEQ ID NO: 971431 - DNA, 18 bp, Homo sapiens
aacattaagtaaatgctg

SEQ ID NO: 971432 - DNA, 18 bp, Homo sapiens
aacattaatgcctgcttt

SEQ ID NO: 971433 - DNA, 20 bp, Homo sapiens
aacattaattttgtgcattc

SEQ ID NO: 971434 - DNA, 21 bp, Homo sapiens
aacattaattttgtgcattct

SEQ ID NO: 971435 - DNA, 18 bp, Homo sapiens
aacattacagttcataat

SEQ ID NO: 971436 - DNA, 17 bp, Homo sapiens
aacattagatgtcatga

SEQ ID NO: 971437 - DNA, 16 bp, Homo sapiens
aacattaggaattgtt

SEQ ID NO: 971438 - DNA, 18 bp, Homo sapiens
aacattaggaattgttta

SEQ ID NO: 971439 - DNA, 20 bp, Homo sapiens
aacattaggaccttagaatt

SEQ ID NO: 971440 - DNA, 21 bp, Homo sapiens
aacattattttttatttctga

SEQ ID NO: 971441 - DNA, 22 bp, Homo sapiens
aacattcacacagggctctttg

SEQ ID NO: 971442 - DNA, 18 bp, Homo sapiens
aacattcacttttgttaa

SEQ ID NO: 971443 - DNA, 16 bp, Homo sapiens
aacattcagaggaaga

SEQ ID NO: 971444 - DNA, 19 bp, Homo sapiens
aacattcgtgagctgggga

SEQ ID NO: 971445 - DNA, 19 bp, Homo sapiens
aacattctatctactgatt

SEQ ID NO: 971446 - DNA, 21 bp, Homo sapiens
aacattctattgactttctta

SEQ ID NO: 971447 - DNA, 18 bp, Homo sapiens
aacattctcctgtggaag

SEQ ID NO: 971448 - DNA, 17 bp, Homo sapiens
aacattctgatttggaa

SEQ ID NO: 971449 - DNA, 12 bp, Homo sapiens
aacattctgcaa

SEQ ID NO: 971450 - DNA, 15 bp, Homo sapiens
aacattctgcaatgg

SEQ ID NO: 971451 - DNA, 20 bp, Homo sapiens
aacattctggatctgaccct

SEQ ID NO: 971452 - DNA, 23 bp, Homo sapiens
aacattctttttctgttgaaact

SEQ ID NO: 971453 - DNA, 16 bp, Homo sapiens
aacattgaagtaatga

SEQ ID NO: 971454 - DNA, 22 bp, Homo sapiens
aacattgaccaagaactgcatg

SEQ ID NO: 971455 - DNA, 22 bp, Homo sapiens
aacattgcactttataaacact

SEQ ID NO: 971456 - DNA, 18 bp, Homo sapiens
aacattgcctttgaatgt

SEQ ID NO: 971457 - DNA, 13 bp, Homo sapiens
aacattgtaaagt

SEQ ID NO: 971458 - DNA, 13 bp, Homo sapiens
aacattgtactgt

SEQ ID NO: 971459 - DNA, 22 bp, Homo sapiens
aacattgtactgttgctttaat

SEQ ID NO: 971460 - DNA, 16 bp, Homo sapiens
aacattgtagcctcaa

SEQ ID NO: 971461 - DNA, 12 bp, Homo sapiens
aacattgtatta

SEQ ID NO: 971462 - DNA, 22 bp, Homo sapiens
aacattgtccccaatgaatata

SEQ ID NO: 971463 - DNA, 22 bp, Homo sapiens
aacattgtgatgtatattcctt

SEQ ID NO: 971464 - DNA, 22 bp, Homo sapiens
aacatttaaactttttaaaata

SEQ ID NO: 971465 - DNA, 13 bp, Homo sapiens
aacatttaaagag

SEQ ID NO: 971466 - DNA, 14 bp, Homo sapiens
aacattttaattca

SEQ ID NO: 971467 - DNA, 16 bp, Homo sapiens
aacattttatactgta

SEQ ID NO: 971468 - DNA, 17 bp, Homo sapiens
aacattttatactgtac

SEQ ID NO: 971469 - DNA, 22 bp, Homo sapiens
aacattttatttttaaaatatt

SEQ ID NO: 971470 - DNA, 12 bp, Homo sapiens
aacattttctgg

SEQ ID NO: 971471 - DNA, 23 bp, Homo sapiens
aacattttgaaagtctgtccttg

SEQ ID NO: 971472 - DNA, 15 bp, Homo sapiens
aacattttgaagtgt

SEQ ID NO: 971473 - DNA, 16 bp, Homo sapiens
aacattttgtcatata

SEQ ID NO: 971474 - DNA, 23 bp, Homo sapiens
aacattttgtggagtttgtattt

SEQ ID NO: 971475 - DNA, 22 bp, Homo sapiens
aacattttgtggtcattaagca

SEQ ID NO: 971476 - DNA, 14 bp, Homo sapiens
aaccaaaacttcca

SEQ ID NO: 971477 - DNA, 15 bp, Homo sapiens
aaccaaaacttccaa

SEQ ID NO: 971478 - DNA, 17 bp, Homo sapiens
aaccaaaacttccaagg

SEQ ID NO: 971479 - DNA, 14 bp, Homo sapiens
aaccaaaatgatac

SEQ ID NO: 971480 - DNA, 14 bp, Homo sapiens
aaccaaactagtat

SEQ ID NO: 971481 - DNA, 16 bp, Homo sapiens
aaccaaagaagaaagt

SEQ ID NO: 971482 - DNA, 16 bp, Homo sapiens
aaccaaagagactgga

SEQ ID NO: 971483 - DNA, 19 bp, Homo sapiens
aaccaaagagactggagca

SEQ ID NO: 971484 - DNA, 19 bp, Homo sapiens
aaccaaagagggcttcctc

SEQ ID NO: 971485 - DNA, 20 bp, Homo sapiens
aaccaaagctgcctgtgcca

SEQ ID NO: 971486 - DNA, 14 bp, Homo sapiens
aaccaaaggtgaag

SEQ ID NO: 971487 - DNA, 21 bp, Homo sapiens
aaccaaaggtgaaggaatata

SEQ ID NO: 971488 - DNA, 16 bp, Homo sapiens
aaccaaagtctaaact

SEQ ID NO: 971489 - DNA, 13 bp, Homo sapiens
aaccaaatacctc

SEQ ID NO: 971490 - DNA, 23 bp, Homo sapiens
aaccaaatacctcaatttttgtt

SEQ ID NO: 971491 - DNA, 14 bp, Homo sapiens
aaccaaatggttct

SEQ ID NO: 971492 - DNA, 22 bp, Homo sapiens
aaccaaatggttcttacttttc

SEQ ID NO: 971493 - DNA, 15 bp, Homo sapiens
aaccaaattttaaaa

SEQ ID NO: 971494 - DNA, 16 bp, Homo sapiens
aaccaaattttaaaag

SEQ ID NO: 971495 - DNA, 14 bp, Homo sapiens
aaccaacagaagca

SEQ ID NO: 971496 - DNA, 14 bp, Homo sapiens
aaccaacaggttta

SEQ ID NO: 971497 - DNA, 23 bp, Homo sapiens
aaccaacaggtttatctgaagga

SEQ ID NO: 971498 - DNA, 13 bp, Homo sapiens
aaccaaccagcag

SEQ ID NO: 971499 - DNA, 14 bp, Homo sapiens
aaccaaccagcagg

SEQ ID NO: 971500 - DNA, 13 bp, Homo sapiens
aaccaactgcccc

SEQ ID NO: 971501 - DNA, 14 bp, Homo sapiens
aaccaagaggctgg

SEQ ID NO: 971502 - DNA, 15 bp, Homo sapiens
aaccaagaggctggt

SEQ ID NO: 971503 - DNA, 20 bp, Homo sapiens
aaccaagctgagtttcctat

SEQ ID NO: 971504 - DNA, 14 bp, Homo sapiens
aaccaaggaaggag

SEQ ID NO: 971505 - DNA, 14 bp, Homo sapiens
aaccaaggaggggc

SEQ ID NO: 971506 - DNA, 15 bp, Homo sapiens
aaccaaggcagcctc

SEQ ID NO: 971507 - DNA, 23 bp, Homo sapiens
aaccaagtgtgctctttttttaa

SEQ ID NO: 971508 - DNA, 19 bp, Homo sapiens
aaccaataatggtcagtcc

SEQ ID NO: 971509 - DNA, 23 bp, Homo sapiens
aaccaatcccgtgaaagaattat

SEQ ID NO: 971510 - DNA, 13 bp, Homo sapiens
aaccaatcctgga

SEQ ID NO: 971511 - DNA, 14 bp, Homo sapiens
aaccaatgagctgt

SEQ ID NO: 971512 - DNA, 23 bp, Homo sapiens
aaccaatgcctttttagatgtat

SEQ ID NO: 971513 - DNA, 19 bp, Homo sapiens
aaccaatttcttccttcca

SEQ ID NO: 971514 - DNA, 17 bp, Homo sapiens
aaccacaactttgtcgt

SEQ ID NO: 971515 - DNA, 13 bp, Homo sapiens
aaccacaagtgaa

SEQ ID NO: 971516 - DNA, 20 bp, Homo sapiens
aaccacaatgtttcttcatt

SEQ ID NO: 971517 - DNA, 20 bp, Homo sapiens
aaccacactcaccccagcct

SEQ ID NO: 971518 - DNA, 21 bp, Homo sapiens
aaccacagaaatcacagtcaa

SEQ ID NO: 971519 - DNA, 13 bp, Homo sapiens
aaccacagcagga

SEQ ID NO: 971520 - DNA, 12 bp, Homo sapiens
aaccacagccct

SEQ ID NO: 971521 - DNA, 15 bp, Homo sapiens
aaccacagccctgtc

SEQ ID NO: 971522 - DNA, 16 bp, Homo sapiens
aaccacagccctgtca

SEQ ID NO: 971523 - DNA, 22 bp, Homo sapiens
aaccacataatttttgtacatc

SEQ ID NO: 971524 - DNA, 22 bp, Homo sapiens
aaccacatacaacacaaagaga

SEQ ID NO: 971525 - DNA, 23 bp, Homo sapiens
aaccacatgaactacgtgacctc

SEQ ID NO: 971526 - DNA, 18 bp, Homo sapiens
aaccacatgggctggggg

SEQ ID NO: 971527 - DNA, 19 bp, Homo sapiens
aaccacatgggctgggggc

SEQ ID NO: 971528 - DNA, 21 bp, Homo sapiens
aaccacatttcctctgttctt

SEQ ID NO: 971529 - DNA, 17 bp, Homo sapiens
aaccaccgcatatgcat

SEQ ID NO: 971530 - DNA, 23 bp, Homo sapiens
aaccaccgcatatgcatgccagg

SEQ ID NO: 971531 - DNA, 16 bp, Homo sapiens
aaccaccgctccccag

SEQ ID NO: 971532 - DNA, 18 bp, Homo sapiens
aaccaccgctccccagcc

SEQ ID NO: 971533 - DNA, 19 bp, Homo sapiens
aaccaccgctccccagccc

SEQ ID NO: 971534 - DNA, 19 bp, Homo sapiens
aaccacctaatcaggctga

SEQ ID NO: 971535 - DNA, 15 bp, Homo sapiens
aaccacgaggctgcc

SEQ ID NO: 971536 - DNA, 16 bp, Homo sapiens
aaccacgaggctgccc

SEQ ID NO: 971537 - DNA, 15 bp, Homo sapiens
aaccacgcctcttga

SEQ ID NO: 971538 - DNA, 16 bp, Homo sapiens
aaccacggccacattt

SEQ ID NO: 971539 - DNA, 13 bp, Homo sapiens
aaccactgaaaaa

SEQ ID NO: 971540 - DNA, 13 bp, Homo sapiens
aaccactgaatct

SEQ ID NO: 971541 - DNA, 17 bp, Homo sapiens
aaccactgaatctggac

SEQ ID NO: 971542 - DNA, 14 bp, Homo sapiens
aaccactgcaacgg

SEQ ID NO: 971543 - DNA, 20 bp, Homo sapiens
aaccactgcttctcttttga

SEQ ID NO: 971544 - DNA, 20 bp, Homo sapiens
aaccactgtaaaatgaaatt

SEQ ID NO: 971545 - DNA, 18 bp, Homo sapiens
aaccactgtgccactgac

SEQ ID NO: 971546 - DNA, 19 bp, Homo sapiens
aaccacttaaaaaatgtcc

SEQ ID NO: 971547 - DNA, 15 bp, Homo sapiens
aaccacttcagctga

SEQ ID NO: 971548 - DNA, 12 bp, Homo sapiens
aaccacttccct

SEQ ID NO: 971549 - DNA, 13 bp, Homo sapiens
aaccacttccctc

SEQ ID NO: 971550 - DNA, 13 bp, Homo sapiens
aaccacttctctg

SEQ ID NO: 971551 - DNA, 15 bp, Homo sapiens
aaccacttctctgct

SEQ ID NO: 971552 - DNA, 14 bp, Homo sapiens
aaccacttgcctgg

SEQ ID NO: 971553 - DNA, 21 bp, Homo sapiens
aaccactttcttatttttttc

SEQ ID NO: 971554 - DNA, 22 bp, Homo sapiens
aaccactttcttatttttttct

SEQ ID NO: 971555 - DNA, 22 bp, Homo sapiens
aaccagaaacacccctctgtct

SEQ ID NO: 971556 - DNA, 16 bp, Homo sapiens
aaccagaattgtcctc

SEQ ID NO: 971557 - DNA, 23 bp, Homo sapiens
aaccagactttgaaaaattgttc

SEQ ID NO: 971558 - DNA, 15 bp, Homo sapiens
aaccagagaatctta

SEQ ID NO: 971559 - DNA, 23 bp, Homo sapiens
aaccagcacagcttagatttcat

SEQ ID NO: 971560 - DNA, 20 bp, Homo sapiens
aaccagcagaaatgccccca

SEQ ID NO: 971561 - DNA, 11 bp, Homo sapiens
aaccagcaggt

SEQ ID NO: 971562 - DNA, 15 bp, Homo sapiens
aaccagcattcccta

SEQ ID NO: 971563 - DNA, 16 bp, Homo sapiens
aaccagccaggcagag

SEQ ID NO: 971564 - DNA, 11 bp, Homo sapiens
aaccagcccag

SEQ ID NO: 971565 - DNA, 21 bp, Homo sapiens
aaccagcccgacagtgccatc

SEQ ID NO: 971566 - DNA, 16 bp, Homo sapiens
aaccagctaagaaaag

SEQ ID NO: 971567 - DNA, 22 bp, Homo sapiens
aaccagctgtaacacagctgag

SEQ ID NO: 971568 - DNA, 14 bp, Homo sapiens
aaccaggacccagg

SEQ ID NO: 971569 - DNA, 15 bp, Homo sapiens
aaccaggacccaggg

SEQ ID NO: 971570 - DNA, 16 bp, Homo sapiens
aaccaggacccagggt

SEQ ID NO: 971571 - DNA, 19 bp, Homo sapiens
aaccaggacccagggtccc

SEQ ID NO: 971572 - DNA, 18 bp, Homo sapiens
aaccaggccccagcctcc

SEQ ID NO: 971573 - DNA, 18 bp, Homo sapiens
aaccagggaagctgtccc

SEQ ID NO: 971574 - DNA, 19 bp, Homo sapiens
aaccagggaagctgtccct

SEQ ID NO: 971575 - DNA, 13 bp, Homo sapiens
aaccagggaggag

SEQ ID NO: 971576 - DNA, 12 bp, Homo sapiens
aaccagggcctc

SEQ ID NO: 971577 - DNA, 23 bp, Homo sapiens
aaccagtatttttgctgcttctg

SEQ ID NO: 971578 - DNA, 15 bp, Homo sapiens
aaccagtctcctcac

SEQ ID NO: 971579 - DNA, 15 bp, Homo sapiens
aaccagtctgaagtt

SEQ ID NO: 971580 - DNA, 21 bp, Homo sapiens
aaccagtctgaagtttcattt

SEQ ID NO: 971581 - DNA, 19 bp, Homo sapiens
aaccagtgttgtggattta

SEQ ID NO: 971582 - DNA, 14 bp, Homo sapiens
aaccataaatcaat

SEQ ID NO: 971583 - DNA, 21 bp, Homo sapiens
aaccataaatcaattcatgtt

SEQ ID NO: 971584 - DNA, 18 bp, Homo sapiens
aaccataacaacttcata

SEQ ID NO: 971585 - DNA, 21 bp, Homo sapiens
aaccataccttccttccctgg

SEQ ID NO: 971586 - DNA, 14 bp, Homo sapiens
aaccatatgatact

SEQ ID NO: 971587 - DNA, 16 bp, Homo sapiens
aaccatcattataaac

SEQ ID NO: 971588 - DNA, 20 bp, Homo sapiens
aaccatccagtgacaaacca

SEQ ID NO: 971589 - DNA, 13 bp, Homo sapiens
aaccatccatccc

SEQ ID NO: 971590 - DNA, 16 bp, Homo sapiens
aaccatccccaactcc

SEQ ID NO: 971591 - DNA, 17 bp, Homo sapiens
aaccctgcaatcacttt

SEQ ID NO: 971592 - DNA, 19 bp, Homo sapiens
aaccctgcccctgccccgt

SEQ ID NO: 971593 - DNA, 15 bp, Homo sapiens
aaccctgccgtcacc

SEQ ID NO: 971594 - DNA, 10 bp, Homo sapiens
aaccctgcct

SEQ ID NO: 971595 - DNA, 12 bp, Homo sapiens
aaccctgcctgt

SEQ ID NO: 971596 - DNA, 13 bp, Homo sapiens
aaccctgctccgt

SEQ ID NO: 971597 - DNA, 23 bp, Homo sapiens
aaccctgctgaacacagtgtctg

SEQ ID NO: 971598 - DNA, 12 bp, Homo sapiens
aaccctggcctc

SEQ ID NO: 971599 - DNA, 22 bp, Homo sapiens
aaccctggcttgcttgccgagc

SEQ ID NO: 971600 - DNA, 21 bp, Homo sapiens
aaccctgggagtagctagttt

SEQ ID NO: 971601 - DNA, 22 bp, Homo sapiens
aaccctgggctgtccagcctta

SEQ ID NO: 971602 - DNA, 23 bp, Homo sapiens
aaccctgggctgtccagccttaa

SEQ ID NO: 971603 - DNA, 16 bp, Homo sapiens
aaccctggggaaggag

SEQ ID NO: 971604 - DNA, 19 bp, Homo sapiens
aaccctggggaaggagcca

SEQ ID NO: 971605 - DNA, 21 bp, Homo sapiens
aaccctggggaaggagccagt

SEQ ID NO: 971606 - DNA, 12 bp, Homo sapiens
aaccctgtgctg

SEQ ID NO: 971607 - DNA, 21 bp, Homo sapiens
aaccctgtgctggtgtcctga

SEQ ID NO: 971608 - DNA, 21 bp, Homo sapiens
aacccttaccccttagcctcc

SEQ ID NO: 971609 - DNA, 23 bp, Homo sapiens
aacccttaccccttagcctccct

SEQ ID NO: 971610 - DNA, 15 bp, Homo sapiens
aacccttcaactcct

SEQ ID NO: 971611 - DNA, 23 bp, Homo sapiens
aacccttctcctcttgtaaataa

SEQ ID NO: 971612 - DNA, 14 bp, Homo sapiens
aacccttcttttaa

SEQ ID NO: 971613 - DNA, 16 bp, Homo sapiens
aacccttgaatttcta

SEQ ID NO: 971614 - DNA, 23 bp, Homo sapiens
aaccgaacatatcatttgtgaag

SEQ ID NO: 971615 - DNA, 13 bp, Homo sapiens
aaccgaataaatg

SEQ ID NO: 971616 - DNA, 19 bp, Homo sapiens
aaccgagataggggagggg

SEQ ID NO: 971617 - DNA, 23 bp, Homo sapiens
aaccgagccagcagctgaagtct

SEQ ID NO: 971618 - DNA, 13 bp, Homo sapiens
aaccgatgctcca

SEQ ID NO: 971619 - DNA, 15 bp, Homo sapiens
aaccgatgctccagc

SEQ ID NO: 971620 - DNA, 17 bp, Homo sapiens
aaccgatgctccagcca

SEQ ID NO: 971621 - DNA, 12 bp, Homo sapiens
aaccgcacagct

SEQ ID NO: 971622 - DNA, 20 bp, Homo sapiens
aactcgggggtgctggggcc

SEQ ID NO: 971623 - DNA, 20 bp, Homo sapiens
aactcggtttggtagacttg

SEQ ID NO: 971624 - DNA, 22 bp, Homo sapiens
aactctaattcccattttgcaa

SEQ ID NO: 971625 - DNA, 22 bp, Homo sapiens
aactctacatgtaactatttct

SEQ ID NO: 971626 - DNA, 13 bp, Homo sapiens
aactctaccctga

SEQ ID NO: 971627 - DNA, 19 bp, Homo sapiens
aactctactcaacccattg

SEQ ID NO: 971628 - DNA, 14 bp, Homo sapiens
aactctagaaatgc

SEQ ID NO: 971629 - DNA, 12 bp, Homo sapiens
aactctagctgg

SEQ ID NO: 971630 - DNA, 14 bp, Homo sapiens
aactctattaatga

SEQ ID NO: 971631 - DNA, 15 bp, Homo sapiens
aactctcaaaagtct

SEQ ID NO: 971632 - DNA, 20 bp, Homo sapiens
aactctcaaaagtctatttt

SEQ ID NO: 971633 - DNA, 18 bp, Homo sapiens
aactctcattatttgtgt

SEQ ID NO: 971634 - DNA, 12 bp, Homo sapiens
aactctccactc

SEQ ID NO: 971635 - DNA, 17 bp, Homo sapiens
aactctccagccattgt

SEQ ID NO: 971636 - DNA, 13 bp, Homo sapiens
aactctctagctt

SEQ ID NO: 971637 - DNA, 10 bp, Homo sapiens
aactctctgc

SEQ ID NO: 971638 - DNA, 15 bp, Homo sapiens
aactctctgcctgta

SEQ ID NO: 971639 - DNA, 10 bp, Homo sapiens
aactctctgt

SEQ ID NO: 971640 - DNA, 14 bp, Homo sapiens
aactctctttcctt

SEQ ID NO: 971641 - DNA, 12 bp, Homo sapiens
aactctgagccc

SEQ ID NO: 971642 - DNA, 14 bp, Homo sapiens
aactctgagcccat

SEQ ID NO: 971643 - DNA, 19 bp, Homo sapiens
aactctgatccctgggcct

SEQ ID NO: 971644 - DNA, 13 bp, Homo sapiens
aactctgatgtgg

SEQ ID NO: 971645 - DNA, 17 bp, Homo sapiens
aactctgcaaaggcctg

SEQ ID NO: 971646 - DNA, 21 bp, Homo sapiens
aactctgcactccatggccac

SEQ ID NO: 971647 - DNA, 23 bp, Homo sapiens
aactctgccagaaaaaaataact

SEQ ID NO: 971648 - DNA, 14 bp, Homo sapiens
aactctgccagcca

SEQ ID NO: 971649 - DNA, 21 bp, Homo sapiens
aactctgcctttatgatgcta

SEQ ID NO: 971650 - DNA, 13 bp, Homo sapiens
aactctggtggca

SEQ ID NO: 971651 - DNA, 23 bp, Homo sapiens
aactctgtataatagagataagt

SEQ ID NO: 971652 - DNA, 16 bp, Homo sapiens
aactctgttacacttt

SEQ ID NO: 971653 - DNA, 17 bp, Homo sapiens
aactcttagaaatgaag

SEQ ID NO: 971654 - DNA, 15 bp, Homo sapiens
aactcttataaattt

SEQ ID NO: 971655 - DNA, 12 bp, Homo sapiens
aactcttcagaa

SEQ ID NO: 971656 - DNA, 11 bp, Homo sapiens
aactcttcagt

SEQ ID NO: 971657 - DNA, 22 bp, Homo sapiens
aactcttcagtgcaaattgtat

SEQ ID NO: 971658 - DNA, 23 bp, Homo sapiens
aactcttcagttaattcttagat

SEQ ID NO: 971659 - DNA, 21 bp, Homo sapiens
aactcttctttgctgcattcc

SEQ ID NO: 971660 - DNA, 17 bp, Homo sapiens
aactcttgtgaattatt

SEQ ID NO: 971661 - DNA, 12 bp, Homo sapiens
aactctttcaaa

SEQ ID NO: 971662 - DNA, 13 bp, Homo sapiens
aactctttgctgc

SEQ ID NO: 971663 - DNA, 23 bp, Homo sapiens
aactctttgctgctgcccatgtt

SEQ ID NO: 971664 - DNA, 17 bp, Homo sapiens
aactctttttgggctcc

SEQ ID NO: 971665 - DNA, 17 bp, Homo sapiens
aactgaaaatgtaaatt

SEQ ID NO: 971666 - DNA, 16 bp, Homo sapiens
aactgaaacttttcta

SEQ ID NO: 971667 - DNA, 17 bp, Homo sapiens
aactgaaacttttctaa

SEQ ID NO: 971668 - DNA, 17 bp, Homo sapiens
aactgaaagtgttttac

SEQ ID NO: 971669 - DNA, 16 bp, Homo sapiens
aactgaaccacaaaaa

SEQ ID NO: 971670 - DNA, 20 bp, Homo sapiens
aactgaacgaccttacaaat

SEQ ID NO: 971671 - DNA, 20 bp, Homo sapiens
aactgaagacctccacatta

SEQ ID NO: 971672 - DNA, 18 bp, Homo sapiens
aactgaagcagcctctcc

SEQ ID NO: 971673 - DNA, 13 bp, Homo sapiens
aactgaaggagaa

SEQ ID NO: 971674 - DNA, 21 bp, Homo sapiens
aactgaaggctaaaaagcaac

SEQ ID NO: 971675 - DNA, 21 bp, Homo sapiens
aactgaaggggtgcacccacc

SEQ ID NO: 971676 - DNA, 16 bp, Homo sapiens
aactgaagtttcacat

SEQ ID NO: 971677 - DNA, 18 bp, Homo sapiens
aactgaatattttggaaa

SEQ ID NO: 971678 - DNA, 19 bp, Homo sapiens
aactgaatattttggaaac

SEQ ID NO: 971679 - DNA, 20 bp, Homo sapiens
aactgaatattttggaaact

SEQ ID NO: 971680 - DNA, 20 bp, Homo sapiens
aactgaatcaggaaactcaa

SEQ ID NO: 971681 - DNA, 15 bp, Homo sapiens
aactgaatgaatcca

SEQ ID NO: 971682 - DNA, 23 bp, Homo sapiens
aactgaatgaatccattggagaa

SEQ ID NO: 971683 - DNA, 20 bp, Homo sapiens
aactgaatgtttattccttg

SEQ ID NO: 971684 - DNA, 10 bp, Homo sapiens
aactgacaag

SEQ ID NO: 971685 - DNA, 18 bp, Homo sapiens
aactgacatgccctccct

SEQ ID NO: 971686 - DNA, 14 bp, Homo sapiens
aactgacgctggag

SEQ ID NO: 971687 - DNA, 20 bp, Homo sapiens
aactgacgctggagatgcaa

SEQ ID NO: 971688 - DNA, 14 bp, Homo sapiens
aactgactttctcc

SEQ ID NO: 971689 - DNA, 21 bp, Homo sapiens
aactgagaaggcaggcctccg

SEQ ID NO: 971690 - DNA, 15 bp, Homo sapiens
aactgagagaaagat

SEQ ID NO: 971691 - DNA, 14 bp, Homo sapiens
aactgagctcctct

SEQ ID NO: 971692 - DNA, 12 bp, Homo sapiens
aactgaggaatt

SEQ ID NO: 971693 - DNA, 18 bp, Homo sapiens
aactgaggaatttcacct

SEQ ID NO: 971694 - DNA, 18 bp, Homo sapiens
aactgaggaattttcttt

SEQ ID NO: 971695 - DNA, 13 bp, Homo sapiens
aactgaggccctg

SEQ ID NO: 971696 - DNA, 15 bp, Homo sapiens
aactgaggccctgtg

SEQ ID NO: 971697 - DNA, 19 bp, Homo sapiens
aactgagggctctgtttgt

SEQ ID NO: 971698 - DNA, 18 bp, Homo sapiens
aactgaggtatggccatg

SEQ ID NO: 971699 - DNA, 21 bp, Homo sapiens
aactgagtcatcttgtgagtg

SEQ ID NO: 971700 - DNA, 23 bp, Homo sapiens
aactgagtccatgaaaataccat

SEQ ID NO: 971701 - DNA, 23 bp, Homo sapiens
aactgatggaccgggtgggcctg

SEQ ID NO: 971702 - DNA, 21 bp, Homo sapiens
aactgatgttactagcctctc

SEQ ID NO: 971703 - DNA, 13 bp, Homo sapiens
aactgattaaaaa

SEQ ID NO: 971704 - DNA, 17 bp, Homo sapiens
aactgattagtattcag

SEQ ID NO: 971705 - DNA, 15 bp, Homo sapiens
aactgatttaacact

SEQ ID NO: 971706 - DNA, 16 bp, Homo sapiens
aactgattttgtatgt

SEQ ID NO: 971707 - DNA, 13 bp, Homo sapiens
aactgcaaagctt

SEQ ID NO: 971708 - DNA, 22 bp, Homo sapiens
aactgcaaagctttggctgaga

SEQ ID NO: 971709 - DNA, 17 bp, Homo sapiens
aactgcacacacagctc

SEQ ID NO: 971710 - DNA, 19 bp, Homo sapiens
aactgcacacacagctcct

SEQ ID NO: 971711 - DNA, 15 bp, Homo sapiens
aactgcacagtgctg

SEQ ID NO: 971712 - DNA, 21 bp, Homo sapiens
aactgcactcatagggtgctc

SEQ ID NO: 971713 - DNA, 22 bp, Homo sapiens
aactgcactcatagggtgctct

SEQ ID NO: 971714 - DNA, 12 bp, Homo sapiens
aactgcactttt

SEQ ID NO: 971715 - DNA, 17 bp, Homo sapiens
aactgcactttttttac

SEQ ID NO: 971716 - DNA, 22 bp, Homo sapiens
aactgcagaccatgaagtaaat

SEQ ID NO: 971717 - DNA, 19 bp, Homo sapiens
aactgcagatagcccagga

SEQ ID NO: 971718 - DNA, 21 bp, Homo sapiens
aactgcagatagcccaggagc

SEQ ID NO: 971719 - DNA, 21 bp, Homo sapiens
aactgcagcctctctggctgg

SEQ ID NO: 971720 - DNA, 14 bp, Homo sapiens
aactgcagctgtga

SEQ ID NO: 971721 - DNA, 13 bp, Homo sapiens
aactgcaggccct

SEQ ID NO: 971722 - DNA, 21 bp, Homo sapiens
aactgcaggccctggcctccc

SEQ ID NO: 971723 - DNA, 23 bp, Homo sapiens
aactgcaggccctggcctcccct

SEQ ID NO: 971724 - DNA, 18 bp, Homo sapiens
aactgcatacgttttggt

SEQ ID NO: 971725 - DNA, 14 bp, Homo sapiens
aactgcattagaaa

SEQ ID NO: 971726 - DNA, 16 bp, Homo sapiens
aactgcattagaaatt

SEQ ID NO: 971727 - DNA, 14 bp, Homo sapiens
aactgcattgagaa

SEQ ID NO: 971728 - DNA, 20 bp, Homo sapiens
aactgcattgagaactgcat

SEQ ID NO: 971729 - DNA, 22 bp, Homo sapiens
aactgcattttaccagatgttt

SEQ ID NO: 971730 - DNA, 20 bp, Homo sapiens
aactgccaaaaatataattc

SEQ ID NO: 971731 - DNA, 16 bp, Homo sapiens
aactgccaagcttgga

SEQ ID NO: 971732 - DNA, 21 bp, Homo sapiens
aactgccattattttctgtca

SEQ ID NO: 971733 - DNA, 22 bp, Homo sapiens
aactgccattattttctgtcag

SEQ ID NO: 971734 - DNA, 14 bp, Homo sapiens
aactgccctaagcc

SEQ ID NO: 971735 - DNA, 12 bp, Homo sapiens
aactgcccttcc

SEQ ID NO: 971736 - DNA, 14 bp, Homo sapiens
aactgcccttccag

SEQ ID NO: 971737 - DNA, 18 bp, Homo sapiens
aactgcccttccaggtgg

SEQ ID NO: 971738 - DNA, 16 bp, Homo sapiens
aactgcctactccaaa

SEQ ID NO: 971739 - DNA, 20 bp, Homo sapiens
aactgcctcgaaacacagaa

SEQ ID NO: 971740 - DNA, 14 bp, Homo sapiens
aactgcctgggcca

SEQ ID NO: 971741 - DNA, 14 bp, Homo sapiens
aactgcgaggacat

SEQ ID NO: 971742 - DNA, 20 bp, Homo sapiens
aactgcgaggacatcaaagt

SEQ ID NO: 971743 - DNA, 18 bp, Homo sapiens
aactgcggtcagatgtgg

SEQ ID NO: 971744 - DNA, 19 bp, Homo sapiens
aactgctaatgcaaattaa

SEQ ID NO: 971745 - DNA, 15 bp, Homo sapiens
aactgctgagccact

SEQ ID NO: 971746 - DNA, 21 bp, Homo sapiens
aactgctgtggccccctgtcc

SEQ ID NO: 971747 - DNA, 20 bp, Homo sapiens
aactgcttcatctccttttg

SEQ ID NO: 971748 - DNA, 13 bp, Homo sapiens
aactgctttcaag

SEQ ID NO: 971749 - DNA, 15 bp, Homo sapiens
aactgctttcaagtc

SEQ ID NO: 971750 - DNA, 18 bp, Homo sapiens
aactgctttctgttccaa

SEQ ID NO: 971751 - DNA, 15 bp, Homo sapiens
aactgctttgtgcat

SEQ ID NO: 971752 - DNA, 16 bp, Homo sapiens
aactgctttgtgcata

SEQ ID NO: 971753 - DNA, 16 bp, Homo sapiens
aactgcttttcctcaa

SEQ ID NO: 971754 - DNA, 22 bp, Homo sapiens
aactgcttttcctcaagcaata

SEQ ID NO: 971755 - DNA, 22 bp, Homo sapiens
aactgcttttttttttccagca

SEQ ID NO: 971756 - DNA, 15 bp, Homo sapiens
aactggaaaacagaa

SEQ ID NO: 971757 - DNA, 21 bp, Homo sapiens
aactggaaaacagaacactta

SEQ ID NO: 971758 - DNA, 17 bp, Homo sapiens
aactggaaaatcttcta

SEQ ID NO: 971759 - DNA, 17 bp, Homo sapiens
aactggaagctgttcag

SEQ ID NO: 971760 - DNA, 16 bp, Homo sapiens
aactggaatcagctca

SEQ ID NO: 971761 - DNA, 19 bp, Homo sapiens
aactggaatcagctcagga

SEQ ID NO: 971762 - DNA, 21 bp, Homo sapiens
aactggacacaataggtcttt

SEQ ID NO: 971763 - DNA, 14 bp, Homo sapiens
aactggattttgaa

SEQ ID NO: 971764 - DNA, 15 bp, Homo sapiens
aactggcctaaattt

SEQ ID NO: 971765 - DNA, 15 bp, Homo sapiens
aactggcttctgtgc

SEQ ID NO: 971766 - DNA, 14 bp, Homo sapiens
aactggggggccac

SEQ ID NO: 971767 - DNA, 22 bp, Homo sapiens
aactggtaagcgatttgaaaca

SEQ ID NO: 971768 - DNA, 19 bp, Homo sapiens
aactggtcaccatgaaact

SEQ ID NO: 971769 - DNA, 23 bp, Homo sapiens
aactggttaaaaaacaaatgttc

SEQ ID NO: 971770 - DNA, 16 bp, Homo sapiens
aactggttagtgtgaa

SEQ ID NO: 971771 - DNA, 22 bp, Homo sapiens
aactgtaaactctatcagcatt

SEQ ID NO: 971772 - DNA, 20 bp, Homo sapiens
aagagaagatgcctgttaat

SEQ ID NO: 971773 - DNA, 23 bp, Homo sapiens
aagagaagatgcctgttaattta

SEQ ID NO: 971774 - DNA, 21 bp, Homo sapiens
aagagaagcaaacaatggtgt

SEQ ID NO: 971775 - DNA, 14 bp, Homo sapiens
aagagaagcaattt

SEQ ID NO: 971776 - DNA, 17 bp, Homo sapiens
aagagaagctgctgacc

SEQ ID NO: 971777 - DNA, 18 bp, Homo sapiens
aagagaagctgctgacca

SEQ ID NO: 971778 - DNA, 23 bp, Homo sapiens
aagagaatatttacaatatatga

SEQ ID NO: 971779 - DNA, 13 bp, Homo sapiens
aagagaatatttt

SEQ ID NO: 971780 - DNA, 18 bp, Homo sapiens
aagagaatattttaagta

SEQ ID NO: 971781 - DNA, 20 bp, Homo sapiens
aagagaatattttaagtatt

SEQ ID NO: 971782 - DNA, 13 bp, Homo sapiens
aagagaatgaact

SEQ ID NO: 971783 - DNA, 17 bp, Homo sapiens
aagagaatgaactgtgg

SEQ ID NO: 971784 - DNA, 20 bp, Homo sapiens
aagagaatgatgctcaaaat

SEQ ID NO: 971785 - DNA, 19 bp, Homo sapiens
aagagacaaacacctccca

SEQ ID NO: 971786 - DNA, 14 bp, Homo sapiens
aagagacagaatgt

SEQ ID NO: 971787 - DNA, 16 bp, Homo sapiens
aagagacagaatgtat

SEQ ID NO: 971788 - DNA, 18 bp, Homo sapiens
aagagacagagacaagta

SEQ ID NO: 971789 - DNA, 19 bp, Homo sapiens
aagagacagagtgctgagg

SEQ ID NO: 971790 - DNA, 16 bp, Homo sapiens
aagagacagcccagga

SEQ ID NO: 971791 - DNA, 17 bp, Homo sapiens
aagagacagttctctgt

SEQ ID NO: 971792 - DNA, 15 bp, Homo sapiens
aagagacatccaaat

SEQ ID NO: 971793 - DNA, 17 bp, Homo sapiens
aagagacatgagaaagg

SEQ ID NO: 971794 - DNA, 19 bp, Homo sapiens
aagagacttaaaggacagg

SEQ ID NO: 971795 - DNA, 13 bp, Homo sapiens
aagagagaatgta

SEQ ID NO: 971796 - DNA, 15 bp, Homo sapiens
aagagagatgagaaa

SEQ ID NO: 971797 - DNA, 15 bp, Homo sapiens
aagagagatgttttg

SEQ ID NO: 971798 - DNA, 21 bp, Homo sapiens
aagagagcagcgcccaggcct

SEQ ID NO: 971799 - DNA, 16 bp, Homo sapiens
aagagagccttggttc

SEQ ID NO: 971800 - DNA, 22 bp, Homo sapiens
aagagagccttggttcatcagt

SEQ ID NO: 971801 - DNA, 20 bp, Homo sapiens
aagagagctctaaccagatg

SEQ ID NO: 971802 - DNA, 19 bp, Homo sapiens
aagagaggaaggacccctc

SEQ ID NO: 971803 - DNA, 21 bp, Homo sapiens
aagagaggaaggacccctcac

SEQ ID NO: 971804 - DNA, 20 bp, Homo sapiens
aagagaggatgtgcaagcga

SEQ ID NO: 971805 - DNA, 19 bp, Homo sapiens
aagagaggcacctgctgga

SEQ ID NO: 971806 - DNA, 18 bp, Homo sapiens
aagagaggggaagaattt

SEQ ID NO: 971807 - DNA, 11 bp, Homo sapiens
aagagaggtta

SEQ ID NO: 971808 - DNA, 20 bp, Homo sapiens
aagagagtaaacagacagct

SEQ ID NO: 971809 - DNA, 22 bp, Homo sapiens
aagagagtatttttatacaaac

SEQ ID NO: 971810 - DNA, 14 bp, Homo sapiens
aagagagtttgcca

SEQ ID NO: 971811 - DNA, 20 bp, Homo sapiens
aagagataataagattagtt

SEQ ID NO: 971812 - DNA, 20 bp, Homo sapiens
aagagatattttaaaatgag

SEQ ID NO: 971813 - DNA, 21 bp, Homo sapiens
aagagatcacccactcctatg

SEQ ID NO: 971814 - DNA, 18 bp, Homo sapiens
aagagatcgagaccatcc

SEQ ID NO: 971815 - DNA, 16 bp, Homo sapiens
aagagatctgggcatt

SEQ ID NO: 971816 - DNA, 13 bp, Homo sapiens
aagagatgaagag

SEQ ID NO: 971817 - DNA, 17 bp, Homo sapiens
aagagatgagaaatgat

SEQ ID NO: 971818 - DNA, 21 bp, Homo sapiens
aagagatgggccttttcttga

SEQ ID NO: 971819 - DNA, 17 bp, Homo sapiens
aagagatgggcttgttt

SEQ ID NO: 971820 - DNA, 14 bp, Homo sapiens
aagagatgtggcaa

SEQ ID NO: 971821 - DNA, 21 bp, Homo sapiens
aagagattcgaatgacggtaa

SEQ ID NO: 971822 - DNA, 14 bp, Homo sapiens
aagagatttatctt

SEQ ID NO: 971823 - DNA, 22 bp, Homo sapiens
aagagatttatctttatacaga

SEQ ID NO: 971824 - DNA, 13 bp, Homo sapiens
aagagcaaagtag

SEQ ID NO: 971825 - DNA, 23 bp, Homo sapiens
aagagcaaggtttcgtggcagca

SEQ ID NO: 971826 - DNA, 19 bp, Homo sapiens
aagagcaccttcctcactt

SEQ ID NO: 971827 - DNA, 21 bp, Homo sapiens
aagagcacttaagagaatatt

SEQ ID NO: 971828 - DNA, 13 bp, Homo sapiens
aagagcagagtct

SEQ ID NO: 971829 - DNA, 12 bp, Homo sapiens
aagagcagcctg

SEQ ID NO: 971830 - DNA, 13 bp, Homo sapiens
aagagcagcctgt

SEQ ID NO: 971831 - DNA, 19 bp, Homo sapiens
aagagcagcctgtggcatc

SEQ ID NO: 971832 - DNA, 21 bp, Homo sapiens
aagagcagcttcggtgtgcag

SEQ ID NO: 971833 - DNA, 22 bp, Homo sapiens
aagagcagcttcggtgtgcaga

SEQ ID NO: 971834 - DNA, 20 bp, Homo sapiens
aagagcagtcagagtccagt

SEQ ID NO: 971835 - DNA, 17 bp, Homo sapiens
aagagcatgatttgaaa

SEQ ID NO: 971836 - DNA, 11 bp, Homo sapiens
aagagccacct

SEQ ID NO: 971837 - DNA, 15 bp, Homo sapiens
aagagccacctgcaa

SEQ ID NO: 971838 - DNA, 16 bp, Homo sapiens
aagagccacctgcaag

SEQ ID NO: 971839 - DNA, 19 bp, Homo sapiens
aagagccacctgcaagatg

SEQ ID NO: 971840 - DNA, 20 bp, Homo sapiens
aagagccatataagtttgaa

SEQ ID NO: 971841 - DNA, 14 bp, Homo sapiens
aagagcccagtctg

SEQ ID NO: 971842 - DNA, 22 bp, Homo sapiens
aagagcccgcagggccatgcag

SEQ ID NO: 971843 - DNA, 22 bp, Homo sapiens
aagagccctggacacccctgct

SEQ ID NO: 971844 - DNA, 17 bp, Homo sapiens
aagagccggtggtgccc

SEQ ID NO: 971845 - DNA, 19 bp, Homo sapiens
aagagcctgaagctggcct

SEQ ID NO: 971846 - DNA, 20 bp, Homo sapiens
aagagcctgaagctggcctg

SEQ ID NO: 971847 - DNA, 14 bp, Homo sapiens
aagagcctttccaa

SEQ ID NO: 971848 - DNA, 15 bp, Homo sapiens
aagagcctttccaaa

SEQ ID NO: 971849 - DNA, 18 bp, Homo sapiens
aagagcgagagatcaaag

SEQ ID NO: 971850 - DNA, 21 bp, Homo sapiens
aagagcgagagatcaaagatg

SEQ ID NO: 971851 - DNA, 20 bp, Homo sapiens
aagagctacgtatttaatag

SEQ ID NO: 971852 - DNA, 19 bp, Homo sapiens
aagagctcccctccacagc

SEQ ID NO: 971853 - DNA, 19 bp, Homo sapiens
aagagctcccgaggaagca

SEQ ID NO: 971854 - DNA, 17 bp, Homo sapiens
aagagctggtggtttga

SEQ ID NO: 971855 - DNA, 19 bp, Homo sapiens
aagagctgtcttcccctga

SEQ ID NO: 971856 - DNA, 16 bp, Homo sapiens
aagagcttgctttgat

SEQ ID NO: 971857 - DNA, 22 bp, Homo sapiens
aagaggaaaggcgcccccgccc

SEQ ID NO: 971858 - DNA, 16 bp, Homo sapiens
aagaggaagaaattca

SEQ ID NO: 971859 - DNA, 16 bp, Homo sapiens
aagaggaagttcagat

SEQ ID NO: 971860 - DNA, 17 bp, Homo sapiens
aagaggaagttcagatc

SEQ ID NO: 971861 - DNA, 14 bp, Homo sapiens
aagaggaatctgtt

SEQ ID NO: 971862 - DNA, 19 bp, Homo sapiens
aagaggaattacgtgctct

SEQ ID NO: 971863 - DNA, 15 bp, Homo sapiens
aagaggacacaatgg

SEQ ID NO: 971864 - DNA, 16 bp, Homo sapiens
aagaggacacaatggc

SEQ ID NO: 971865 - DNA, 21 bp, Homo sapiens
aagaggacacaatggcacctc

SEQ ID NO: 971866 - DNA, 22 bp, Homo sapiens
aagaggacataatggggtcctg

SEQ ID NO: 971867 - DNA, 15 bp, Homo sapiens
aagaggactgagact

SEQ ID NO: 971868 - DNA, 16 bp, Homo sapiens
aagaggagaccctgga

SEQ ID NO: 971869 - DNA, 19 bp, Homo sapiens
aagaggaggacccctgcct

SEQ ID NO: 971870 - DNA, 22 bp, Homo sapiens
aagaggaggggaagaggcctgt

SEQ ID NO: 971871 - DNA, 19 bp, Homo sapiens
aagaggatctcctgtccat

SEQ ID NO: 971872 - DNA, 17 bp, Homo sapiens
aagaggatgatttcaga

SEQ ID NO: 971873 - DNA, 21 bp, Homo sapiens
aagaggatgatttcagaagga

SEQ ID NO: 971874 - DNA, 17 bp, Homo sapiens
aagaggcaagtggtagg

SEQ ID NO: 971875 - DNA, 17 bp, Homo sapiens
aagaggcccactagagg

SEQ ID NO: 971876 - DNA, 21 bp, Homo sapiens
aagaggccttcccatggccat

SEQ ID NO: 971877 - DNA, 11 bp, Homo sapiens
aagatgctggg

SEQ ID NO: 971878 - DNA, 17 bp, Homo sapiens
aagatgcttctcactgc

SEQ ID NO: 971879 - DNA, 12 bp, Homo sapiens
aagatgcttggt

SEQ ID NO: 971880 - DNA, 22 bp, Homo sapiens
aagatggactctgaaaaacatt

SEQ ID NO: 971881 - DNA, 21 bp, Homo sapiens
aagatggataaactgagcctc

SEQ ID NO: 971882 - DNA, 14 bp, Homo sapiens
aagatggattctca

SEQ ID NO: 971883 - DNA, 18 bp, Homo sapiens
aagatggcatcctgtgaa

SEQ ID NO: 971884 - DNA, 21 bp, Homo sapiens
aagatggcccagctccccaag

SEQ ID NO: 971885 - DNA, 19 bp, Homo sapiens
aagatggctcagaggggga

SEQ ID NO: 971886 - DNA, 21 bp, Homo sapiens
aagatggctcagagggggact

SEQ ID NO: 971887 - DNA, 20 bp, Homo sapiens
aagatggctcccaaggttcc

SEQ ID NO: 971888 - DNA, 12 bp, Homo sapiens
aagatgggagga

SEQ ID NO: 971889 - DNA, 19 bp, Homo sapiens
aagatgggcatcttttgta

SEQ ID NO: 971890 - DNA, 19 bp, Homo sapiens
aagatgggggcagggctgt

SEQ ID NO: 971891 - DNA, 16 bp, Homo sapiens
aagatggtatatttgg

SEQ ID NO: 971892 - DNA, 20 bp, Homo sapiens
aagatggtccatttgttcct

SEQ ID NO: 971893 - DNA, 22 bp, Homo sapiens
aagatggtccatttgttcctgc

SEQ ID NO: 971894 - DNA, 21 bp, Homo sapiens
aagatggtccgtgcccaggcc

SEQ ID NO: 971895 - DNA, 17 bp, Homo sapiens
aagatggtcgtgtgtgt

SEQ ID NO: 971896 - DNA, 13 bp, Homo sapiens
aagatggtgaaga

SEQ ID NO: 971897 - DNA, 19 bp, Homo sapiens
aagatggtgaagacagaaa

SEQ ID NO: 971898 - DNA, 14 bp, Homo sapiens
aagatggtttcaat

SEQ ID NO: 971899 - DNA, 14 bp, Homo sapiens
aagatgtacattta

SEQ ID NO: 971900 - DNA, 19 bp, Homo sapiens
aagatgtagatttatttca

SEQ ID NO: 971901 - DNA, 13 bp, Homo sapiens
aagatgtatgctt

SEQ ID NO: 971902 - DNA, 18 bp, Homo sapiens
aagatgtatgctttgaat

SEQ ID NO: 971903 - DNA, 16 bp, Homo sapiens
aagatgtctcctcaag

SEQ ID NO: 971904 - DNA, 17 bp, Homo sapiens
aagatgtctcctcaagc

SEQ ID NO: 971905 - DNA, 20 bp, Homo sapiens
aagatgtctcctcaagcctg

SEQ ID NO: 971906 - DNA, 11 bp, Homo sapiens
aagatgtgaat

SEQ ID NO: 971907 - DNA, 16 bp, Homo sapiens
aagatgtgaattattg

SEQ ID NO: 971908 - DNA, 21 bp, Homo sapiens
aagatgtgaattattgacact

SEQ ID NO: 971909 - DNA, 21 bp, Homo sapiens
aagatgtgtcatgaaaacagc

SEQ ID NO: 971910 - DNA, 19 bp, Homo sapiens
aagatgtgtcttcaatttg

SEQ ID NO: 971911 - DNA, 18 bp, Homo sapiens
aagatgtgttcttatttt

SEQ ID NO: 971912 - DNA, 23 bp, Homo sapiens
aagatgttaaaatcggtttttaa

SEQ ID NO: 971913 - DNA, 11 bp, Homo sapiens
aagatgttaag

SEQ ID NO: 971914 - DNA, 18 bp, Homo sapiens
aagatgttaatctcccag

SEQ ID NO: 971915 - DNA, 21 bp, Homo sapiens
aagatgttaatctcccagccc

SEQ ID NO: 971916 - DNA, 23 bp, Homo sapiens
aagatgttaatctcccagcccac

SEQ ID NO: 971917 - DNA, 13 bp, Homo sapiens
aagatgttccagt

SEQ ID NO: 971918 - DNA, 12 bp, Homo sapiens
aagatgttgttt

SEQ ID NO: 971919 - DNA, 17 bp, Homo sapiens
aagatgtttacattttt

SEQ ID NO: 971920 - DNA, 15 bp, Homo sapiens
aagatgtttcttata

SEQ ID NO: 971921 - DNA, 23 bp, Homo sapiens
aagatgtttcttatattattcca

SEQ ID NO: 971922 - DNA, 17 bp, Homo sapiens
aagattaaaggaaggaa

SEQ ID NO: 971923 - DNA, 19 bp, Homo sapiens
aagattaatctttaaacca

SEQ ID NO: 971924 - DNA, 12 bp, Homo sapiens
aagattaatttt

SEQ ID NO: 971925 - DNA, 20 bp, Homo sapiens
aagattacaaatcagaagtc

SEQ ID NO: 971926 - DNA, 19 bp, Homo sapiens
aagattagttggacagttt

SEQ ID NO: 971927 - DNA, 13 bp, Homo sapiens
aagattagtttca

SEQ ID NO: 971928 - DNA, 22 bp, Homo sapiens
aagattattgtgacttcactgt

SEQ ID NO: 971929 - DNA, 23 bp, Homo sapiens
aagattattgtgacttcactgta

SEQ ID NO: 971930 - DNA, 18 bp, Homo sapiens
aagattatttgtgcattt

SEQ ID NO: 971931 - DNA, 21 bp, Homo sapiens
aagattatttgtgcattttat

SEQ ID NO: 971932 - DNA, 16 bp, Homo sapiens
aagattattttttaaa

SEQ ID NO: 971933 - DNA, 18 bp, Homo sapiens
aagattattttttaaaaa

SEQ ID NO: 971934 - DNA, 23 bp, Homo sapiens
aagattcacacctgactctgaaa

SEQ ID NO: 971935 - DNA, 17 bp, Homo sapiens
aagattccaaaaagcac

SEQ ID NO: 971936 - DNA, 18 bp, Homo sapiens
aagattcccagagacagg

SEQ ID NO: 971937 - DNA, 20 bp, Homo sapiens
aagattcccagagacaggaa

SEQ ID NO: 971938 - DNA, 17 bp, Homo sapiens
aagattctaaagctcaa

SEQ ID NO: 971939 - DNA, 14 bp, Homo sapiens
aagattctactaac

SEQ ID NO: 971940 - DNA, 21 bp, Homo sapiens
aagattctactcttgtcattt

SEQ ID NO: 971941 - DNA, 17 bp, Homo sapiens
aagattctcctgtgcta

SEQ ID NO: 971942 - DNA, 13 bp, Homo sapiens
aagattctttccc

SEQ ID NO: 971943 - DNA, 16 bp, Homo sapiens
aagattctttcccaat

SEQ ID NO: 971944 - DNA, 16 bp, Homo sapiens
aagattgctgaaattt

SEQ ID NO: 971945 - DNA, 16 bp, Homo sapiens
aagattgcttaaaata

SEQ ID NO: 971946 - DNA, 13 bp, Homo sapiens
aagattggaaatg

SEQ ID NO: 971947 - DNA, 23 bp, Homo sapiens
aagattgttgataggaactgtct

SEQ ID NO: 971948 - DNA, 22 bp, Homo sapiens
aagattgttggtgaattttcaa

SEQ ID NO: 971949 - DNA, 23 bp, Homo sapiens
aagatttaccttttctgttgtac

SEQ ID NO: 971950 - DNA, 13 bp, Homo sapiens
aagatttagaaaa

SEQ ID NO: 971951 - DNA, 18 bp, Homo sapiens
aagatttatacagttgaa

SEQ ID NO: 971952 - DNA, 18 bp, Homo sapiens
aagatttcatgacgaaga

SEQ ID NO: 971953 - DNA, 17 bp, Homo sapiens
aagatttccaagtgcca

SEQ ID NO: 971954 - DNA, 16 bp, Homo sapiens
aagatttcctactttc

SEQ ID NO: 971955 - DNA, 22 bp, Homo sapiens
aagatttctgtctactaagtga

SEQ ID NO: 971956 - DNA, 21 bp, Homo sapiens
aagatttcttttcattattct

SEQ ID NO: 971957 - DNA, 16 bp, Homo sapiens
aagatttgaccaaatc

SEQ ID NO: 971958 - DNA, 18 bp, Homo sapiens
aagatttgttactgtatt

SEQ ID NO: 971959 - DNA, 17 bp, Homo sapiens
aagatttgtttttaaac

SEQ ID NO: 971960 - DNA, 22 bp, Homo sapiens
aagatttgtttttaaactgtac

SEQ ID NO: 971961 - DNA, 23 bp, Homo sapiens
aagatttgtttttaaactgtaca

SEQ ID NO: 971962 - DNA, 13 bp, Homo sapiens
aagattttaaatt

SEQ ID NO: 971963 - DNA, 17 bp, Homo sapiens
aagattttatgcacagc

SEQ ID NO: 971964 - DNA, 22 bp, Homo sapiens
aagattttatttatggaattaa

SEQ ID NO: 971965 - DNA, 16 bp, Homo sapiens
aagattttcctcttgt

SEQ ID NO: 971966 - DNA, 15 bp, Homo sapiens
aagattttgaatgct

SEQ ID NO: 971967 - DNA, 17 bp, Homo sapiens
aagattttgaatgcttc

SEQ ID NO: 971968 - DNA, 16 bp, Homo sapiens
aagattttttaataat

SEQ ID NO: 971969 - DNA, 18 bp, Homo sapiens
aagattttttaattgttt

SEQ ID NO: 971970 - DNA, 19 bp, Homo sapiens
aagattttttaattgttta

SEQ ID NO: 971971 - DNA, 18 bp, Homo sapiens
aagcaaaaagatgtatat

SEQ ID NO: 971972 - DNA, 19 bp, Homo sapiens
aagcaaaacatcacattcc

SEQ ID NO: 971973 - DNA, 11 bp, Homo sapiens
aagcaaaagaa

SEQ ID NO: 971974 - DNA, 15 bp, Homo sapiens
aagcaaaatagtatt

SEQ ID NO: 971975 - DNA, 16 bp, Homo sapiens
aagcaaacatcaaata

SEQ ID NO: 971976 - DNA, 17 bp, Homo sapiens
aagcaaacatcaaataa

SEQ ID NO: 971977 - DNA, 18 bp, Homo sapiens
aagcaaacatcaaataaa

SEQ ID NO: 971978 - DNA, 20 bp, Homo sapiens
aagcaaagacaaaagaaact

SEQ ID NO: 971979 - DNA, 21 bp, Homo sapiens
aagcaaagatttcagtagaat

SEQ ID NO: 971980 - DNA, 13 bp, Homo sapiens
aagcaaaggcagt

SEQ ID NO: 971981 - DNA, 14 bp, Homo sapiens
aagcaaagggggga

SEQ ID NO: 971982 - DNA, 19 bp, Homo sapiens
aagcaaagtgctttgactt

SEQ ID NO: 971983 - DNA, 15 bp, Homo sapiens
aagcaaatatagaaa

SEQ ID NO: 971984 - DNA, 19 bp, Homo sapiens
aagcaaatcccatttcttg

SEQ ID NO: 971985 - DNA, 23 bp, Homo sapiens
aagcaaatctttctgtaaacaga

SEQ ID NO: 971986 - DNA, 19 bp, Homo sapiens
aagcaaatggaaaatgtat

SEQ ID NO: 971987 - DNA, 12 bp, Homo sapiens
aagcaaatgtgt

SEQ ID NO: 971988 - DNA, 17 bp, Homo sapiens
aagcaaattgctttttt

SEQ ID NO: 971989 - DNA, 12 bp, Homo sapiens
aagcaaattttg

SEQ ID NO: 971990 - DNA, 19 bp, Homo sapiens
aagcaacaaagagcgagtc

SEQ ID NO: 971991 - DNA, 17 bp, Homo sapiens
aagccatagaccctgag

SEQ ID NO: 971992 - DNA, 22 bp, Homo sapiens
aagccatatatgaccagaagcc

SEQ ID NO: 971993 - DNA, 13 bp, Homo sapiens
aagccatcacttc

SEQ ID NO: 971994 - DNA, 14 bp, Homo sapiens
aagccatcacttct

SEQ ID NO: 971995 - DNA, 20 bp, Homo sapiens
aagccatctcagattctgtc

SEQ ID NO: 971996 - DNA, 17 bp, Homo sapiens
aagccatctgacagcag

SEQ ID NO: 971997 - DNA, 21 bp, Homo sapiens
aagccatggtcccgaagtgta

SEQ ID NO: 971998 - DNA, 21 bp, Homo sapiens
aagccatgtggggttgctgaa

SEQ ID NO: 971999 - DNA, 20 bp, Homo sapiens
aagccattctaaggaaatta

SEQ ID NO: 972000 - DNA, 20 bp, Homo sapiens
aagccattttttgaggagag

SEQ ID NO: 972001 - DNA, 16 bp, Homo sapiens
aagcccaacctcctga

SEQ ID NO: 972002 - DNA, 18 bp, Homo sapiens
aagcccaatattataatt

SEQ ID NO: 972003 - DNA, 11 bp, Homo sapiens
aagcccacctg

SEQ ID NO: 972004 - DNA, 12 bp, Homo sapiens
aagcccacctga

SEQ ID NO: 972005 - DNA, 15 bp, Homo sapiens
aagcccaggggccgg

SEQ ID NO: 972006 - DNA, 18 bp, Homo sapiens
aagcccagtgctgctgta

SEQ ID NO: 972007 - DNA, 23 bp, Homo sapiens
aagcccagtgctgctgtaaatac

SEQ ID NO: 972008 - DNA, 15 bp, Homo sapiens
aagcccatcctgacc

SEQ ID NO: 972009 - DNA, 18 bp, Homo sapiens
aagcccatcctgaccagc

SEQ ID NO: 972010 - DNA, 21 bp, Homo sapiens
aagcccattttcaactgcttt

SEQ ID NO: 972011 - DNA, 12 bp, Homo sapiens
aagccccaggca

SEQ ID NO: 972012 - DNA, 17 bp, Homo sapiens
aagccccaggcaggctg

SEQ ID NO: 972013 - DNA, 21 bp, Homo sapiens
aagccccaggcaggctgtgcg

SEQ ID NO: 972014 - DNA, 15 bp, Homo sapiens
aagccccagggcctg

SEQ ID NO: 972015 - DNA, 16 bp, Homo sapiens
aagccccagggcctgg

SEQ ID NO: 972016 - DNA, 18 bp, Homo sapiens
aagccccatgtgccttgt

SEQ ID NO: 972017 - DNA, 23 bp, Homo sapiens
aagccccatgtgccttgtccagg

SEQ ID NO: 972018 - DNA, 13 bp, Homo sapiens
aagcccccagggc

SEQ ID NO: 972019 - DNA, 18 bp, Homo sapiens
aagcccccagggcctcca

SEQ ID NO: 972020 - DNA, 20 bp, Homo sapiens
aagcccccagggcctccagg

SEQ ID NO: 972021 - DNA, 22 bp, Homo sapiens
aagccccctggcagctgcccct

SEQ ID NO: 972022 - DNA, 18 bp, Homo sapiens
aagcccccttctccatgg

SEQ ID NO: 972023 - DNA, 15 bp, Homo sapiens
aagcccctcagccct

SEQ ID NO: 972024 - DNA, 16 bp, Homo sapiens
aagcccctcagccctt

SEQ ID NO: 972025 - DNA, 15 bp, Homo sapiens
aagcccctgccctgg

SEQ ID NO: 972026 - DNA, 18 bp, Homo sapiens
aagcccctgccctgggga

SEQ ID NO: 972027 - DNA, 23 bp, Homo sapiens
aagcccctgccctggggagaaag

SEQ ID NO: 972028 - DNA, 20 bp, Homo sapiens
aagcccctgtcgcccaccca

SEQ ID NO: 972029 - DNA, 20 bp, Homo sapiens
aagcccctgtgaccctctca

SEQ ID NO: 972030 - DNA, 18 bp, Homo sapiens
aagccccttatttttagc

SEQ ID NO: 972031 - DNA, 13 bp, Homo sapiens
aagccccttggag

SEQ ID NO: 972032 - DNA, 19 bp, Homo sapiens
aagcccgcctccagcacca

SEQ ID NO: 972033 - DNA, 19 bp, Homo sapiens
aagccctaagcctgtcccc

SEQ ID NO: 972034 - DNA, 13 bp, Homo sapiens
aagcctttaaaac

SEQ ID NO: 972035 - DNA, 15 bp, Homo sapiens
aagccttttaaatca

SEQ ID NO: 972036 - DNA, 21 bp, Homo sapiens
aagcgaaggaacctctcgcca

SEQ ID NO: 972037 - DNA, 12 bp, Homo sapiens
aagcgacagatt

SEQ ID NO: 972038 - DNA, 15 bp, Homo sapiens
aagcgactctcctgt

SEQ ID NO: 972039 - DNA, 18 bp, Homo sapiens
aagcgacttttgttctct

SEQ ID NO: 972040 - DNA, 15 bp, Homo sapiens
aagcgagcacagtat

SEQ ID NO: 972041 - DNA, 18 bp, Homo sapiens
aagcgagcacagtattat

SEQ ID NO: 972042 - DNA, 14 bp, Homo sapiens
aagcgcccacccag

SEQ ID NO: 972043 - DNA, 18 bp, Homo sapiens
aagcgcccacccaggtcc

SEQ ID NO: 972044 - DNA, 15 bp, Homo sapiens
aagcgcctattgttt

SEQ ID NO: 972045 - DNA, 16 bp, Homo sapiens
aagcgcctccaaccct

SEQ ID NO: 972046 - DNA, 20 bp, Homo sapiens
aagcgcctccaaccctagca

SEQ ID NO: 972047 - DNA, 15 bp, Homo sapiens
aagcgcggctaactt

SEQ ID NO: 972048 - DNA, 15 bp, Homo sapiens
aagcgctccagggcc

SEQ ID NO: 972049 - DNA, 24 bp, Homo sapiens
aagcggctcaagaataaaatatga

SEQ ID NO: 972050 - DNA, 14 bp, Homo sapiens
aagcgggaaacatg

SEQ ID NO: 972051 - DNA, 22 bp, Homo sapiens
aagcgggctgggggtagcctgg

SEQ ID NO: 972052 - DNA, 23 bp, Homo sapiens
aagcgggctgggggtagcctgga

SEQ ID NO: 972053 - DNA, 14 bp, Homo sapiens
aagcgggggcgtgg

SEQ ID NO: 972054 - DNA, 13 bp, Homo sapiens
aagcggggggagg

SEQ ID NO: 972055 - DNA, 17 bp, Homo sapiens
aagcgtgctgacatcag

SEQ ID NO: 972056 - DNA, 16 bp, Homo sapiens
aagcgttcctggcctt

SEQ ID NO: 972057 - DNA, 20 bp, Homo sapiens
aagcgttcctggccttctga

SEQ ID NO: 972058 - DNA, 15 bp, Homo sapiens
aagcgtttttaacct

SEQ ID NO: 972059 - DNA, 15 bp, Homo sapiens
aagctaaaaatatta

SEQ ID NO: 972060 - DNA, 23 bp, Homo sapiens
aagctaaattttgttactgattc

SEQ ID NO: 972061 - DNA, 19 bp, Homo sapiens
aagctaagtaaaaatatgt

SEQ ID NO: 972062 - DNA, 14 bp, Homo sapiens
aagctaatctgcct

SEQ ID NO: 972063 - DNA, 22 bp, Homo sapiens
aagctaatttgcattaaattca

SEQ ID NO: 972064 - DNA, 20 bp, Homo sapiens
aagctacccctcaaactgca

SEQ ID NO: 972065 - DNA, 22 bp, Homo sapiens
aagctacccctcaaactgcaca

SEQ ID NO: 972066 - DNA, 13 bp, Homo sapiens
aagctagaaatga

SEQ ID NO: 972067 - DNA, 19 bp, Homo sapiens
aagctagaaggccacatgt

SEQ ID NO: 972068 - DNA, 15 bp, Homo sapiens
aagctagggtggccc

SEQ ID NO: 972069 - DNA, 21 bp, Homo sapiens
aagctaggtgctatttgtcat

SEQ ID NO: 972070 - DNA, 12 bp, Homo sapiens
aagctagtcttt

SEQ ID NO: 972071 - DNA, 14 bp, Homo sapiens
aagctagtcttttg

SEQ ID NO: 972072 - DNA, 16 bp, Homo sapiens
aagctagtcttttgct

SEQ ID NO: 972073 - DNA, 17 bp, Homo sapiens
aagctagtcttttgctt

SEQ ID NO: 972074 - DNA, 20 bp, Homo sapiens
aagctagtcttttgcttttg

SEQ ID NO: 972075 - DNA, 21 bp, Homo sapiens
aagctagtcttttgcttttgc

SEQ ID NO: 972076 - DNA, 19 bp, Homo sapiens
aagctagtggcttcaaaat

SEQ ID NO: 972077 - DNA, 20 bp, Homo sapiens
aagctagtgtacctcctctc

SEQ ID NO: 972078 - DNA, 14 bp, Homo sapiens
aagctagtgtttct

SEQ ID NO: 972079 - DNA, 20 bp, Homo sapiens
aagctagtgtttctagctaa

SEQ ID NO: 972080 - DNA, 21 bp, Homo sapiens
aagctagttaatgtcagtgac

SEQ ID NO: 972081 - DNA, 19 bp, Homo sapiens
aagctataaagtatatatt

SEQ ID NO: 972082 - DNA, 17 bp, Homo sapiens
aagctatccaaataact

SEQ ID NO: 972083 - DNA, 22 bp, Homo sapiens
aagctatcttcatgtaaattga

SEQ ID NO: 972084 - DNA, 18 bp, Homo sapiens
aagctatggtgagatgca

SEQ ID NO: 972085 - DNA, 23 bp, Homo sapiens
aagctatggtgagatgcagctgg

SEQ ID NO: 972086 - DNA, 20 bp, Homo sapiens
aagctattcctttcccttcc

SEQ ID NO: 972087 - DNA, 13 bp, Homo sapiens
aagctatttaaag

SEQ ID NO: 972088 - DNA, 17 bp, Homo sapiens
aagctatttatctgtag

SEQ ID NO: 972089 - DNA, 15 bp, Homo sapiens
aagctatttgatatg

SEQ ID NO: 972090 - DNA, 18 bp, Homo sapiens
aagctcaaataaaaataa

SEQ ID NO: 972091 - DNA, 18 bp, Homo sapiens
aagctcacactgatgggc

SEQ ID NO: 972092 - DNA, 19 bp, Homo sapiens
aagctcacagttcctcgcc

SEQ ID NO: 972093 - DNA, 13 bp, Homo sapiens
aagctcactgctg

SEQ ID NO: 972094 - DNA, 15 bp, Homo sapiens
aagctcactgctgat

SEQ ID NO: 972095 - DNA, 14 bp, Homo sapiens
aagctcacttctgg

SEQ ID NO: 972096 - DNA, 14 bp, Homo sapiens
aagctcagaatcca

SEQ ID NO: 972097 - DNA, 15 bp, Homo sapiens
aagctcagaatccaa

SEQ ID NO: 972098 - DNA, 22 bp, Homo sapiens
aagctcagaggcgcactgtgac

SEQ ID NO: 972099 - DNA, 14 bp, Homo sapiens
aagctcagcccacc

SEQ ID NO: 972100 - DNA, 13 bp, Homo sapiens
aagctcaggaggg

SEQ ID NO: 972101 - DNA, 20 bp, Homo sapiens
aagctcatagaggtgagaaa

SEQ ID NO: 972102 - DNA, 12 bp, Homo sapiens
aagctcatattt

SEQ ID NO: 972103 - DNA, 21 bp, Homo sapiens
aagctcatattttgtatatat

SEQ ID NO: 972104 - DNA, 23 bp, Homo sapiens
aagctccacggtgcgtggctgtg

SEQ ID NO: 972105 - DNA, 19 bp, Homo sapiens
aagctccactgtcaccctc

SEQ ID NO: 972106 - DNA, 14 bp, Homo sapiens
aagctccatctcca

SEQ ID NO: 972107 - DNA, 20 bp, Homo sapiens
aagctccatctccactccag

SEQ ID NO: 972108 - DNA, 18 bp, Homo sapiens
aagctccatgtgcatata

SEQ ID NO: 972109 - DNA, 13 bp, Homo sapiens
aagctcccacccc

SEQ ID NO: 972110 - DNA, 12 bp, Homo sapiens
aagctccctgga

SEQ ID NO: 972111 - DNA, 13 bp, Homo sapiens
aagctccctggag

SEQ ID NO: 972112 - DNA, 19 bp, Homo sapiens
aagctcccttgaagcaaga

SEQ ID NO: 972113 - DNA, 14 bp, Homo sapiens
aagctcctgtcctc

SEQ ID NO: 972114 - DNA, 15 bp, Homo sapiens
aagctcctgtcctcc

SEQ ID NO: 972115 - DNA, 22 bp, Homo sapiens
aagctcctgtcctcccatcccc

SEQ ID NO: 972116 - DNA, 18 bp, Homo sapiens
aagctccttcctgtttgt

SEQ ID NO: 972117 - DNA, 22 bp, Homo sapiens
aagctccttgagtaaaaaggtg

SEQ ID NO: 972118 - DNA, 16 bp, Homo sapiens
aagctctagtgggaag

SEQ ID NO: 972119 - DNA, 22 bp, Homo sapiens
aagctctcgggactagctgcct

SEQ ID NO: 972120 - DNA, 12 bp, Homo sapiens
aagctctgaagt

SEQ ID NO: 972121 - DNA, 11 bp, Homo sapiens
aagctctggct

SEQ ID NO: 972122 - DNA, 23 bp, Homo sapiens
aagctctggggatgggtggggag

SEQ ID NO: 972123 - DNA, 22 bp, Homo sapiens
aagctcttacactacattagaa

SEQ ID NO: 972124 - DNA, 11 bp, Homo sapiens
aagctcttcat

SEQ ID NO: 972125 - DNA, 15 bp, Homo sapiens
aagctcttcatttct

SEQ ID NO: 972126 - DNA, 11 bp, Homo sapiens
aagctgaaatt

SEQ ID NO: 972127 - DNA, 23 bp, Homo sapiens
aagctgaagaggttgaagctaaa

SEQ ID NO: 972128 - DNA, 14 bp, Homo sapiens
aagctgaagtgcat

SEQ ID NO: 972129 - DNA, 21 bp, Homo sapiens
aagctgaagtgcatccaaagg

SEQ ID NO: 972130 - DNA, 14 bp, Homo sapiens
aagctgaataaagt

SEQ ID NO: 972131 - DNA, 13 bp, Homo sapiens
aagctgaatacat

SEQ ID NO: 972132 - DNA, 17 bp, Homo sapiens
aagctgacattgccaaa

SEQ ID NO: 972133 - DNA, 14 bp, Homo sapiens
aagctgactgtttt

SEQ ID NO: 972134 - DNA, 16 bp, Homo sapiens
aagctgacttggcact

SEQ ID NO: 972135 - DNA, 20 bp, Homo sapiens
aagctgagaagaatgaaaat

SEQ ID NO: 972136 - DNA, 21 bp, Homo sapiens
aagctgagcaggacagccagc

SEQ ID NO: 972137 - DNA, 23 bp, Homo sapiens
aagctgaggaacaggttcctgtg

SEQ ID NO: 972138 - DNA, 12 bp, Homo sapiens
aaggcccctccc

SEQ ID NO: 972139 - DNA, 19 bp, Homo sapiens
aaggcccctctgtggagcg

SEQ ID NO: 972140 - DNA, 15 bp, Homo sapiens
aaggcccctgcaatg

SEQ ID NO: 972141 - DNA, 20 bp, Homo sapiens
aaggccctcggagctggctg

SEQ ID NO: 972142 - DNA, 13 bp, Homo sapiens
aaggccctgtggt

SEQ ID NO: 972143 - DNA, 18 bp, Homo sapiens
aaggccgaagctctggct

SEQ ID NO: 972144 - DNA, 15 bp, Homo sapiens
aaggccgagggccag

SEQ ID NO: 972145 - DNA, 18 bp, Homo sapiens
aaggccgagggccaggca

SEQ ID NO: 972146 - DNA, 19 bp, Homo sapiens
aaggccgagggccaggcag

SEQ ID NO: 972147 - DNA, 15 bp, Homo sapiens
aaggccgccagcgtg

SEQ ID NO: 972148 - DNA, 16 bp, Homo sapiens
aaggccgtgtctctga

SEQ ID NO: 972149 - DNA, 18 bp, Homo sapiens
aaggcctcatctccttta

SEQ ID NO: 972150 - DNA, 15 bp, Homo sapiens
aaggcctcggcagaa

SEQ ID NO: 972151 - DNA, 15 bp, Homo sapiens
aaggggaggagggga

SEQ ID NO: 972152 - DNA, 21 bp, Homo sapiens
aaggggagtcaccttcccttg

SEQ ID NO: 972153 - DNA, 16 bp, Homo sapiens
aaggttctcatttctc

SEQ ID NO: 972154 - DNA, 17 bp, Homo sapiens
aaggttgaataatatat

SEQ ID NO: 972155 - DNA, 13 bp, Homo sapiens
aaggttgcagtgc

SEQ ID NO: 972156 - DNA, 17 bp, Homo sapiens
aaggttggaatctttta

SEQ ID NO: 972157 - DNA, 16 bp, Homo sapiens
aaggttggagcccagg

SEQ ID NO: 972158 - DNA, 17 bp, Homo sapiens
aaggttggagcccaggg

SEQ ID NO: 972159 - DNA, 19 bp, Homo sapiens
aaggttggcgtgccctgga

SEQ ID NO: 972160 - DNA, 21 bp, Homo sapiens
aaggttggcgtgccctggagg

SEQ ID NO: 972161 - DNA, 14 bp, Homo sapiens
aaggttgtgcaggg

SEQ ID NO: 972162 - DNA, 18 bp, Homo sapiens
aaggttgttttgaaactg

SEQ ID NO: 972163 - DNA, 16 bp, Homo sapiens
aaggtttaaagtttga

SEQ ID NO: 972164 - DNA, 17 bp, Homo sapiens
aaggtttatgaaaaaga

SEQ ID NO: 972165 - DNA, 17 bp, Homo sapiens
aaggtttcagatgaggt

SEQ ID NO: 972166 - DNA, 17 bp, Homo sapiens
aaggtttgtatattgtc

SEQ ID NO: 972167 - DNA, 20 bp, Homo sapiens
aaggttttataaggctgatg

SEQ ID NO: 972168 - DNA, 20 bp, Homo sapiens
aaggttttcctcttctattt

SEQ ID NO: 972169 - DNA, 14 bp, Homo sapiens
aaggttttctccac

SEQ ID NO: 972170 - DNA, 22 bp, Homo sapiens
aaggttttggatcttgaatgtg

SEQ ID NO: 972171 - DNA, 23 bp, Homo sapiens
aaggttttggttatggagtcttg

SEQ ID NO: 972172 - DNA, 12 bp, Homo sapiens
aaggttttgtat

SEQ ID NO: 972173 - DNA, 20 bp, Homo sapiens
aaggtttttaaattgtttca

SEQ ID NO: 972174 - DNA, 19 bp, Homo sapiens
aaggttttttttttaagtg

SEQ ID NO: 972175 - DNA, 21 bp, Homo sapiens
aaggttttttttttaagtgca

SEQ ID NO: 972176 - DNA, 22 bp, Homo sapiens
aaggttttttttttaagtgcaa

SEQ ID NO: 972177 - DNA, 15 bp, Homo sapiens
aagtaaaaaaatatg

SEQ ID NO: 972178 - DNA, 13 bp, Homo sapiens
aagtaaaaattaa

SEQ ID NO: 972179 - DNA, 18 bp, Homo sapiens
aagtaaaaattaaaaaat

SEQ ID NO: 972180 - DNA, 12 bp, Homo sapiens
aagtaaaacttg

SEQ ID NO: 972181 - DNA, 13 bp, Homo sapiens
aagtaaaattgct

SEQ ID NO: 972182 - DNA, 19 bp, Homo sapiens
aagtaaagactattctgtt

SEQ ID NO: 972183 - DNA, 12 bp, Homo sapiens
aagtaaatgctg

SEQ ID NO: 972184 - DNA, 16 bp, Homo sapiens
aagtaacaaaaataaa

SEQ ID NO: 972185 - DNA, 13 bp, Homo sapiens
aagtaacacttta

SEQ ID NO: 972186 - DNA, 15 bp, Homo sapiens
aagtaacataactag

SEQ ID NO: 972187 - DNA, 21 bp, Homo sapiens
aagtaacatgcatactttatt

SEQ ID NO: 972188 - DNA, 22 bp, Homo sapiens
aagtaacatgcatactttattg

SEQ ID NO: 972189 - DNA, 14 bp, Homo sapiens
aagtaactcatttg

SEQ ID NO: 972190 - DNA, 21 bp, Homo sapiens
aagtaactcatttgttaaaat

SEQ ID NO: 972191 - DNA, 18 bp, Homo sapiens
aagtaactcttacctaaa

SEQ ID NO: 972192 - DNA, 14 bp, Homo sapiens
aagtaacttctgac

SEQ ID NO: 972193 - DNA, 18 bp, Homo sapiens
aagtaacttttaaaattt

SEQ ID NO: 972194 - DNA, 15 bp, Homo sapiens
aagtaagaaaatatt

SEQ ID NO: 972195 - DNA, 21 bp, Homo sapiens
aagtaagaaagtgaagcaaat

SEQ ID NO: 972196 - DNA, 12 bp, Homo sapiens
aagtaagaaatt

SEQ ID NO: 972197 - DNA, 18 bp, Homo sapiens
aagtaagaaatttctagt

SEQ ID NO: 972198 - DNA, 13 bp, Homo sapiens
aagtaagaagaca

SEQ ID NO: 972199 - DNA, 14 bp, Homo sapiens
aagtaagaagacat

SEQ ID NO: 972200 - DNA, 23 bp, Homo sapiens
aagtaagagtactgggagaatca

SEQ ID NO: 972201 - DNA, 21 bp, Homo sapiens
aagtaagtaccactcaggcca

SEQ ID NO: 972202 - DNA, 14 bp, Homo sapiens
aagtaagtcttttt

SEQ ID NO: 972203 - DNA, 15 bp, Homo sapiens
aagtaatatgcacac

SEQ ID NO: 972204 - DNA, 18 bp, Homo sapiens
aagtaatcccgccaccta

SEQ ID NO: 972205 - DNA, 18 bp, Homo sapiens
aagtaatctttaaactgg

SEQ ID NO: 972206 - DNA, 13 bp, Homo sapiens
aagtaatgaagaa

SEQ ID NO: 972207 - DNA, 16 bp, Homo sapiens
aagtaatgaagaatca

SEQ ID NO: 972208 - DNA, 17 bp, Homo sapiens
aagtaatgaagaatcac

SEQ ID NO: 972209 - DNA, 20 bp, Homo sapiens
aagtaatgacttagaaactg

SEQ ID NO: 972210 - DNA, 21 bp, Homo sapiens
aagtaatgatactgtgtgttt

SEQ ID NO: 972211 - DNA, 23 bp, Homo sapiens
aagtaatgtattagtatggttca

SEQ ID NO: 972212 - DNA, 11 bp, Homo sapiens
aagtaattatc

SEQ ID NO: 972213 - DNA, 18 bp, Homo sapiens
aagtaattgcatttctgc

SEQ ID NO: 972214 - DNA, 16 bp, Homo sapiens
aagtaattgtgaaaaa

SEQ ID NO: 972215 - DNA, 13 bp, Homo sapiens
aagtaatttcagt

SEQ ID NO: 972216 - DNA, 14 bp, Homo sapiens
aagtaatttcagtg

SEQ ID NO: 972217 - DNA, 14 bp, Homo sapiens
aagtaattttgtca

SEQ ID NO: 972218 - DNA, 21 bp, Homo sapiens
aagtaattttgtcacattatt

SEQ ID NO: 972219 - DNA, 14 bp, Homo sapiens
aagtacaaacatga

SEQ ID NO: 972220 - DNA, 13 bp, Homo sapiens
aagtacaaatgaa

SEQ ID NO: 972221 - DNA, 18 bp, Homo sapiens
aagtacaatgaactgctt

SEQ ID NO: 972222 - DNA, 23 bp, Homo sapiens
aagtacaatgaactgcttttcct

SEQ ID NO: 972223 - DNA, 19 bp, Homo sapiens
aagtacacaataagcaaaa

SEQ ID NO: 972224 - DNA, 19 bp, Homo sapiens
aagtacactgtttcaaact

SEQ ID NO: 972225 - DNA, 23 bp, Homo sapiens
aagtacactgtttcaaactttac

SEQ ID NO: 972226 - DNA, 21 bp, Homo sapiens
aagtacagaaaaatactttga

SEQ ID NO: 972227 - DNA, 20 bp, Homo sapiens
aagtacatattaggaaaata

SEQ ID NO: 972228 - DNA, 14 bp, Homo sapiens
aagtacattgctta

SEQ ID NO: 972229 - DNA, 16 bp, Homo sapiens
aagtaccacactgagt

SEQ ID NO: 972230 - DNA, 13 bp, Homo sapiens
aagtaccagacta

SEQ ID NO: 972231 - DNA, 23 bp, Homo sapiens
aagtaccctcttttaccaacttc

SEQ ID NO: 972232 - DNA, 22 bp, Homo sapiens
aagtacctatattgatttaaaa

SEQ ID NO: 972233 - DNA, 12 bp, Homo sapiens
aagtacctgtag

SEQ ID NO: 972234 - DNA, 22 bp, Homo sapiens
aagtaccttgaactcttagtga

SEQ ID NO: 972235 - DNA, 15 bp, Homo sapiens
aagtacgttattgtt

SEQ ID NO: 972236 - DNA, 16 bp, Homo sapiens
aagtacgttattgttg

SEQ ID NO: 972237 - DNA, 19 bp, Homo sapiens
aagtactcctcacttttca

SEQ ID NO: 972238 - DNA, 23 bp, Homo sapiens
aagtactcctcacttttcaattt

SEQ ID NO: 972239 - DNA, 24 bp, Homo sapiens
aagtactctttaacatacaagaaa

SEQ ID NO: 972240 - DNA, 17 bp, Homo sapiens
aagtactggctctttat

SEQ ID NO: 972241 - DNA, 20 bp, Homo sapiens
aagtactggtaagattgtta

SEQ ID NO: 972242 - DNA, 21 bp, Homo sapiens
aagtactggtaagattgttat

SEQ ID NO: 972243 - DNA, 18 bp, Homo sapiens
aagtactgtcctcaaata

SEQ ID NO: 972244 - DNA, 22 bp, Homo sapiens
aagtacttgtcatagactcctt

SEQ ID NO: 972245 - DNA, 19 bp, Homo sapiens
aagtactttaaaaaggaaa

SEQ ID NO: 972246 - DNA, 18 bp, Homo sapiens
aagtagaaaagttgcaga

SEQ ID NO: 972247 - DNA, 13 bp, Homo sapiens
aagtagaaatggt

SEQ ID NO: 972248 - DNA, 19 bp, Homo sapiens
aagtagaagtcttagatgt

SEQ ID NO: 972249 - DNA, 21 bp, Homo sapiens
aagtagaagtcttagatgtat

SEQ ID NO: 972250 - DNA, 14 bp, Homo sapiens
aagtagcctctcct

SEQ ID NO: 972251 - DNA, 18 bp, Homo sapiens
aagtagctgggattacag

SEQ ID NO: 972252 - DNA, 19 bp, Homo sapiens
aagtagctgggattacagg

SEQ ID NO: 972253 - DNA, 23 bp, Homo sapiens
aagtaggactttcctaaatgttt

SEQ ID NO: 972254 - DNA, 18 bp, Homo sapiens
aagtaggaggaaacagtt

SEQ ID NO: 972255 - DNA, 14 bp, Homo sapiens
aagtaggcaggacc

SEQ ID NO: 972256 - DNA, 15 bp, Homo sapiens
aagtaggcaggacca

SEQ ID NO: 972257 - DNA, 16 bp, Homo sapiens
aagtaggcatatatca

SEQ ID NO: 972258 - DNA, 15 bp, Homo sapiens
aagtaggtggcttga

SEQ ID NO: 972259 - DNA, 21 bp, Homo sapiens
aagtaggtggcttgagctaga

SEQ ID NO: 972260 - DNA, 20 bp, Homo sapiens
aagtagtacttcttctgtaa

SEQ ID NO: 972261 - DNA, 13 bp, Homo sapiens
aagtagtcctggc

SEQ ID NO: 972262 - DNA, 14 bp, Homo sapiens
aagtagtcctgtga

SEQ ID NO: 972263 - DNA, 17 bp, Homo sapiens
aagtagtccttggcata

SEQ ID NO: 972264 - DNA, 14 bp, Homo sapiens
aagtagtgatgaaa

SEQ ID NO: 972265 - DNA, 17 bp, Homo sapiens
aagtagtgtatcacagt

SEQ ID NO: 972266 - DNA, 13 bp, Homo sapiens
aagtgatgtcatt

SEQ ID NO: 972267 - DNA, 14 bp, Homo sapiens
aagtgattgaaaat

SEQ ID NO: 972268 - DNA, 21 bp, Homo sapiens
aagtgattttatttttgcaaa

SEQ ID NO: 972269 - DNA, 17 bp, Homo sapiens
aagtgatttttttgtcc

SEQ ID NO: 972270 - DNA, 18 bp, Homo sapiens
aagtgcaacatttctgta

SEQ ID NO: 972271 - DNA, 16 bp, Homo sapiens
aagtgcaatagattac

SEQ ID NO: 972272 - DNA, 17 bp, Homo sapiens
aagtgcagatgagtgtg

SEQ ID NO: 972273 - DNA, 21 bp, Homo sapiens
aagtgcaggctggcaccgcct

SEQ ID NO: 972274 - DNA, 15 bp, Homo sapiens
aagtgcagtcatttg

SEQ ID NO: 972275 - DNA, 16 bp, Homo sapiens
aagtgcagtcatttgt

SEQ ID NO: 972276 - DNA, 15 bp, Homo sapiens
aagtgcatccaaagg

SEQ ID NO: 972277 - DNA, 16 bp, Homo sapiens
aagtgcatccaaaggt

SEQ ID NO: 972278 - DNA, 16 bp, Homo sapiens
aagtgcatttttctta

SEQ ID NO: 972279 - DNA, 23 bp, Homo sapiens
aagtgccactgcccgagctggtg

SEQ ID NO: 972280 - DNA, 12 bp, Homo sapiens
aagtgccagaaa

SEQ ID NO: 972281 - DNA, 15 bp, Homo sapiens
aagtgccagaggtgg

SEQ ID NO: 972282 - DNA, 19 bp, Homo sapiens
aagtgccagaggtgggcag

SEQ ID NO: 972283 - DNA, 15 bp, Homo sapiens
aagtgccagtatttt

SEQ ID NO: 972284 - DNA, 18 bp, Homo sapiens
aagtgccattactactgt

SEQ ID NO: 972285 - DNA, 16 bp, Homo sapiens
aagtgccgcaaattgt

SEQ ID NO: 972286 - DNA, 18 bp, Homo sapiens
aagtgcctcacatttttt

SEQ ID NO: 972287 - DNA, 13 bp, Homo sapiens
aagtgcctgagct

SEQ ID NO: 972288 - DNA, 14 bp, Homo sapiens
aagtgcctgccttg

SEQ ID NO: 972289 - DNA, 12 bp, Homo sapiens
aagtgccttaat

SEQ ID NO: 972290 - DNA, 19 bp, Homo sapiens
aagtgccttggatgagaag

SEQ ID NO: 972291 - DNA, 19 bp, Homo sapiens
aagtgcctttatctcagcc

SEQ ID NO: 972292 - DNA, 22 bp, Homo sapiens
aagtgcggggtaggggaagaag

SEQ ID NO: 972293 - DNA, 22 bp, Homo sapiens
aagtgcgtccacgagctgttta

SEQ ID NO: 972294 - DNA, 19 bp, Homo sapiens
aagtgctcttggctgaccc

SEQ ID NO: 972295 - DNA, 13 bp, Homo sapiens
aagtgctgcattt

SEQ ID NO: 972296 - DNA, 18 bp, Homo sapiens
aagtatatagtatattta

SEQ ID NO: 972297 - DNA, 15 bp, Homo sapiens
aagtatatgtgagaa

SEQ ID NO: 972298 - DNA, 12 bp, Homo sapiens
aagtatattaaa

SEQ ID NO: 972299 - DNA, 16 bp, Homo sapiens
aagtatattcttattg

SEQ ID NO: 972300 - DNA, 20 bp, Homo sapiens
aagtatattgtgagttttct

SEQ ID NO: 972301 - DNA, 14 bp, Homo sapiens
aagtatattttcct

SEQ ID NO: 972302 - DNA, 19 bp, Homo sapiens
aagtatcaagtatagaaaa

SEQ ID NO: 972303 - DNA, 14 bp, Homo sapiens
aagtatcacttttc

SEQ ID NO: 972304 - DNA, 12 bp, Homo sapiens
aagtatcatgca

SEQ ID NO: 972305 - DNA, 16 bp, Homo sapiens
aagtatccctactgta

SEQ ID NO: 972306 - DNA, 18 bp, Homo sapiens
aagtatccctactgtaat

SEQ ID NO: 972307 - DNA, 23 bp, Homo sapiens
aagtatcctgacaagttcctagg

SEQ ID NO: 972308 - DNA, 15 bp, Homo sapiens
aagtatctttaacaa

SEQ ID NO: 972309 - DNA, 23 bp, Homo sapiens
aagtatgaatctatgccaaagat

SEQ ID NO: 972310 - DNA, 17 bp, Homo sapiens
aagtatgagggaaaatg

SEQ ID NO: 972311 - DNA, 14 bp, Homo sapiens
aagtatgcaaaata

SEQ ID NO: 972312 - DNA, 21 bp, Homo sapiens
aagtatgcaatgcttcattat

SEQ ID NO: 972313 - DNA, 18 bp, Homo sapiens
aagtatgcatgcaggcct

SEQ ID NO: 972314 - DNA, 20 bp, Homo sapiens
aagtatgcattattaaattg

SEQ ID NO: 972315 - DNA, 14 bp, Homo sapiens
aagtatgccttaag

SEQ ID NO: 972316 - DNA, 18 bp, Homo sapiens
aagtatgccttaagcaga

SEQ ID NO: 972317 - DNA, 19 bp, Homo sapiens
aagtatgccttaagcagaa

SEQ ID NO: 972318 - DNA, 16 bp, Homo sapiens
aagtatggaatattca

SEQ ID NO: 972319 - DNA, 17 bp, Homo sapiens
aagtatggaatattcat

SEQ ID NO: 972320 - DNA, 21 bp, Homo sapiens
aagtatggaatattcatttta

SEQ ID NO: 972321 - DNA, 22 bp, Homo sapiens
aagtatggaatattcattttac

SEQ ID NO: 972322 - DNA, 13 bp, Homo sapiens
aagtatgtaaaca

SEQ ID NO: 972323 - DNA, 21 bp, Homo sapiens
aagtatgtaaacaggagacag

SEQ ID NO: 972324 - DNA, 22 bp, Homo sapiens
aagtatgtaaagtatgtaaaca

SEQ ID NO: 972325 - DNA, 20 bp, Homo sapiens
aagtatgtatattaaaaaag

SEQ ID NO: 972326 - DNA, 21 bp, Homo sapiens
aagtatgtatattaaaaaaga

SEQ ID NO: 972327 - DNA, 14 bp, Homo sapiens
aagtatgtattatt

SEQ ID NO: 972328 - DNA, 21 bp, Homo sapiens
aagtatgtattatttacattt

SEQ ID NO: 972329 - DNA, 12 bp, Homo sapiens
aagtatgttgta

SEQ ID NO: 972330 - DNA, 13 bp, Homo sapiens
aagtatgttgtac

SEQ ID NO: 972331 - DNA, 19 bp, Homo sapiens
aagtattacaaccatatat

SEQ ID NO: 972332 - DNA, 16 bp, Homo sapiens
aagtattattcaaacc

SEQ ID NO: 972333 - DNA, 13 bp, Homo sapiens
aagtattcagaaa

SEQ ID NO: 972334 - DNA, 17 bp, Homo sapiens
aagtattcagaaattaa

SEQ ID NO: 972335 - DNA, 20 bp, Homo sapiens
aagtattccaccttaaatta

SEQ ID NO: 972336 - DNA, 21 bp, Homo sapiens
aagtattccaccttaaattaa

SEQ ID NO: 972337 - DNA, 21 bp, Homo sapiens
aagtattcttatttaatgaaa

SEQ ID NO: 972338 - DNA, 18 bp, Homo sapiens
aagtattgcatctgtata

SEQ ID NO: 972339 - DNA, 19 bp, Homo sapiens
aagtattgcatctgtataa

SEQ ID NO: 972340 - DNA, 19 bp, Homo sapiens
aagtattgcgaatgtgcag

SEQ ID NO: 972341 - DNA, 12 bp, Homo sapiens
aagtattgtaaa

SEQ ID NO: 972342 - DNA, 13 bp, Homo sapiens
aagtatttaaatg

SEQ ID NO: 972343 - DNA, 14 bp, Homo sapiens
aagtatttaaatgt

SEQ ID NO: 972344 - DNA, 10 bp, Homo sapiens
aagtatttag

SEQ ID NO: 972345 - DNA, 21 bp, Homo sapiens
aagtatttataaaaatataaa

SEQ ID NO: 972346 - DNA, 13 bp, Homo sapiens
aagtatttatata

SEQ ID NO: 972347 - DNA, 18 bp, Homo sapiens
aagtatttatatatttat

SEQ ID NO: 972348 - DNA, 23 bp, Homo sapiens
aagtatttatatatttataactc

SEQ ID NO: 972349 - DNA, 11 bp, Homo sapiens
aagtatttctg

SEQ ID NO: 972350 - DNA, 17 bp, Homo sapiens
aagtattttcataagta

SEQ ID NO: 972351 - DNA, 17 bp, Homo sapiens
aagtatttttagaataa

SEQ ID NO: 972352 - DNA, 14 bp, Homo sapiens
aagtatttttgtct

SEQ ID NO: 972353 - DNA, 14 bp, Homo sapiens
aagtattttttcaa

SEQ ID NO: 972354 - DNA, 13 bp, Homo sapiens
aagtcaaaaaatt

SEQ ID NO: 972355 - DNA, 14 bp, Homo sapiens
aagtcaaaaaatta

SEQ ID NO: 972356 - DNA, 18 bp, Homo sapiens
aagtcaaacgactaacct

SEQ ID NO: 972357 - DNA, 15 bp, Homo sapiens
aagtcaaacttggat

SEQ ID NO: 972358 - DNA, 22 bp, Homo sapiens
aagtcaaagtaaaacttgctgc

SEQ ID NO: 972359 - DNA, 15 bp, Homo sapiens
aagtcaaatgccaaa

SEQ ID NO: 972360 - DNA, 16 bp, Homo sapiens
aagtcaacctgcctga

SEQ ID NO: 972361 - DNA, 12 bp, Homo sapiens
aagtcaagcaca

SEQ ID NO: 972362 - DNA, 22 bp, Homo sapiens
aagtcaagcacatgtaataaat

SEQ ID NO: 972363 - DNA, 18 bp, Homo sapiens
aagtcaatgtacttgttt

SEQ ID NO: 972364 - DNA, 17 bp, Homo sapiens
aagtcaattcagttcta

SEQ ID NO: 972365 - DNA, 12 bp, Homo sapiens
aagtcacagctg

SEQ ID NO: 972366 - DNA, 16 bp, Homo sapiens
aagtcacagctgcagc

SEQ ID NO: 972367 - DNA, 17 bp, Homo sapiens
aagtcacagctgcagct

SEQ ID NO: 972368 - DNA, 22 bp, Homo sapiens
aagtcacagtcgtatctctaga

SEQ ID NO: 972369 - DNA, 14 bp, Homo sapiens
aagtcacatccctg

SEQ ID NO: 972370 - DNA, 16 bp, Homo sapiens
aagtcacccaaacact

SEQ ID NO: 972371 - DNA, 18 bp, Homo sapiens
aagtcacccaaacacttc

SEQ ID NO: 972372 - DNA, 22 bp, Homo sapiens
aagtcacccaaacacttctgct

SEQ ID NO: 972373 - DNA, 23 bp, Homo sapiens
aagtcacccaaacacttctgctt

SEQ ID NO: 972374 - DNA, 19 bp, Homo sapiens
aagtcacccagagcacagg

SEQ ID NO: 972375 - DNA, 14 bp, Homo sapiens
aagtcaccggagct

SEQ ID NO: 972376 - DNA, 18 bp, Homo sapiens
aagtcacctttctgggct

SEQ ID NO: 972377 - DNA, 21 bp, Homo sapiens
aagtcacggctgcgcactgtg

SEQ ID NO: 972378 - DNA, 18 bp, Homo sapiens
aagtcactagtgaacaat

SEQ ID NO: 972379 - DNA, 15 bp, Homo sapiens
aagtcactgaacaaa

SEQ ID NO: 972380 - DNA, 16 bp, Homo sapiens
aagtcactgaacaaaa

SEQ ID NO: 972381 - DNA, 12 bp, Homo sapiens
aagtcactgcac

SEQ ID NO: 972382 - DNA, 14 bp, Homo sapiens
aagtcactgcacag

SEQ ID NO: 972383 - DNA, 17 bp, Homo sapiens
aagtcacttaactataa

SEQ ID NO: 972384 - DNA, 12 bp, Homo sapiens
aagtcagaagtt

SEQ ID NO: 972385 - DNA, 20 bp, Homo sapiens
aagtcagactgctgggactg

SEQ ID NO: 972386 - DNA, 15 bp, Homo sapiens
aagtcagagacagat

SEQ ID NO: 972387 - DNA, 13 bp, Homo sapiens
aagtcagatgttt

SEQ ID NO: 972388 - DNA, 14 bp, Homo sapiens
aagtcagatgtttg

SEQ ID NO: 972389 - DNA, 18 bp, Homo sapiens
aagtcagatgtttgagca

SEQ ID NO: 972390 - DNA, 21 bp, Homo sapiens
aagtcagccacactgggcctg

SEQ ID NO: 972391 - DNA, 22 bp, Homo sapiens
aagtcagctccagctttctgcc

SEQ ID NO: 972392 - DNA, 19 bp, Homo sapiens
aagtcagctttgccttcca

SEQ ID NO: 972393 - DNA, 16 bp, Homo sapiens
aagtcaggtccaattt

SEQ ID NO: 972394 - DNA, 18 bp, Homo sapiens
aagtcagtatcatattat

SEQ ID NO: 972395 - DNA, 12 bp, Homo sapiens
aagtcagtcacg

SEQ ID NO: 972396 - DNA, 21 bp, Homo sapiens
aagtcagtgcccaactgttat

SEQ ID NO: 972397 - DNA, 18 bp, Homo sapiens
aagtcagtgggaacgtga

SEQ ID NO: 972398 - DNA, 21 bp, Homo sapiens
aagtcagtgtagacctgagct

SEQ ID NO: 972399 - DNA, 20 bp, Homo sapiens
aagtcagttgctcaaaaaga

SEQ ID NO: 972400 - DNA, 20 bp, Homo sapiens
aagtcatcccctctcaggag

SEQ ID NO: 972401 - DNA, 18 bp, Homo sapiens
aagtgtgccaaatcagtt

SEQ ID NO: 972402 - DNA, 23 bp, Homo sapiens
aagtgtgctctttttttaaaagg

SEQ ID NO: 972403 - DNA, 19 bp, Homo sapiens
aagtgtggctggtgtcccc

SEQ ID NO: 972404 - DNA, 23 bp, Homo sapiens
aagtgtggctggtgtccccttcc

SEQ ID NO: 972405 - DNA, 21 bp, Homo sapiens
aagtgtggttttgtaatttaa

SEQ ID NO: 972406 - DNA, 13 bp, Homo sapiens
aagtgtgtattaa

SEQ ID NO: 972407 - DNA, 16 bp, Homo sapiens
aagtgtgtccatcctg

SEQ ID NO: 972408 - DNA, 17 bp, Homo sapiens
aagtgtgtggctgggcg

SEQ ID NO: 972409 - DNA, 18 bp, Homo sapiens
aagtgtgtgtgttctgta

SEQ ID NO: 972410 - DNA, 21 bp, Homo sapiens
aagtgtgttcattaatgttta

SEQ ID NO: 972411 - DNA, 16 bp, Homo sapiens
aagtgtgttgttgctt

SEQ ID NO: 972412 - DNA, 12 bp, Homo sapiens
aagtgtgtttgc

SEQ ID NO: 972413 - DNA, 23 bp, Homo sapiens
aagtgttaaattattttttctat

SEQ ID NO: 972414 - DNA, 22 bp, Homo sapiens
aagtgttatttttcaaggaagg

SEQ ID NO: 972415 - DNA, 21 bp, Homo sapiens
aagtgttcaagaaataaaaat

SEQ ID NO: 972416 - DNA, 15 bp, Homo sapiens
aagtgttcagacagt

SEQ ID NO: 972417 - DNA, 12 bp, Homo sapiens
aagtgttctcat

SEQ ID NO: 972418 - DNA, 23 bp, Homo sapiens
aagtgttctcatgaagcaggagg

SEQ ID NO: 972419 - DNA, 16 bp, Homo sapiens
aagtgttgaaaatgta

SEQ ID NO: 972420 - DNA, 22 bp, Homo sapiens
aagtgttgaaaatgtatttcct

SEQ ID NO: 972421 - DNA, 20 bp, Homo sapiens
aagtgttggaaaaaatttgt

SEQ ID NO: 972422 - DNA, 23 bp, Homo sapiens
aagtgttggctaatgaagggaaa

SEQ ID NO: 972423 - DNA, 16 bp, Homo sapiens
aagtgttggtctttct

SEQ ID NO: 972424 - DNA, 17 bp, Homo sapiens
aagtgttggtctttcta

SEQ ID NO: 972425 - DNA, 17 bp, Homo sapiens
aagtgttgtaaatattt

SEQ ID NO: 972426 - DNA, 22 bp, Homo sapiens
aagtgttgtaaatatttatgta

SEQ ID NO: 972427 - DNA, 21 bp, Homo sapiens
aagtgttgtgttcctggctga

SEQ ID NO: 972428 - DNA, 23 bp, Homo sapiens
aagtgtttaacttgtcaaaaaac

SEQ ID NO: 972429 - DNA, 19 bp, Homo sapiens
aagtgtttatgttgtttat

SEQ ID NO: 972430 - DNA, 20 bp, Homo sapiens
aagtgtttcttctggcttag

SEQ ID NO: 972431 - DNA, 20 bp, Homo sapiens
aagtgttttactctttttct

SEQ ID NO: 972432 - DNA, 16 bp, Homo sapiens
aagtgttttagatgtt

SEQ ID NO: 972433 - DNA, 16 bp, Homo sapiens
aagtgttttggagaaa

SEQ ID NO: 972434 - DNA, 13 bp, Homo sapiens
aagttaaaattgt

SEQ ID NO: 972435 - DNA, 14 bp, Homo sapiens
aagttaaaggcagt

SEQ ID NO: 972436 - DNA, 17 bp, Homo sapiens
aagttaacaaggaatgc

SEQ ID NO: 972437 - DNA, 13 bp, Homo sapiens
aagttaacagaga

SEQ ID NO: 972438 - DNA, 17 bp, Homo sapiens
aagttaactcttcaaat

SEQ ID NO: 972439 - DNA, 19 bp, Homo sapiens
aagttaataacagctcctt

SEQ ID NO: 972440 - DNA, 19 bp, Homo sapiens
aagttaatgtatataaaaa

SEQ ID NO: 972441 - DNA, 13 bp, Homo sapiens
aagttaattcacc

SEQ ID NO: 972442 - DNA, 12 bp, Homo sapiens
aagttaatttaa

SEQ ID NO: 972443 - DNA, 15 bp, Homo sapiens
aagttaatttaaagt

SEQ ID NO: 972444 - DNA, 15 bp, Homo sapiens
aagttacaatgtttt

SEQ ID NO: 972445 - DNA, 19 bp, Homo sapiens
aagttacacagaaatgctg

SEQ ID NO: 972446 - DNA, 17 bp, Homo sapiens
aagttacacatttttca

SEQ ID NO: 972447 - DNA, 22 bp, Homo sapiens
aagttacctgttatatatctct

SEQ ID NO: 972448 - DNA, 19 bp, Homo sapiens
aagttactaggtaacttca

SEQ ID NO: 972449 - DNA, 21 bp, Homo sapiens
aagttactaggtaacttcata

SEQ ID NO: 972450 - DNA, 23 bp, Homo sapiens
aagttacttaattgccagcaaat

SEQ ID NO: 972451 - DNA, 15 bp, Homo sapiens
aagttacttattcta

SEQ ID NO: 972452 - DNA, 12 bp, Homo sapiens
aagttacttttt

SEQ ID NO: 972453 - DNA, 23 bp, Homo sapiens
aagttagaaggcttaagaactgc

SEQ ID NO: 972454 - DNA, 24 bp, Homo sapiens
aagttagaaggcttaagaactgct

SEQ ID NO: 972455 - DNA, 15 bp, Homo sapiens
aagttagctcaggag

SEQ ID NO: 972456 - DNA, 16 bp, Homo sapiens
aagttagtatcttttg

SEQ ID NO: 972457 - DNA, 23 bp, Homo sapiens
aagttagtttgtatatattatta

SEQ ID NO: 972458 - DNA, 11 bp, Homo sapiens
aagttataata

SEQ ID NO: 972459 - DNA, 12 bp, Homo sapiens
aagttataataa

SEQ ID NO: 972460 - DNA, 14 bp, Homo sapiens
aagttataataact

SEQ ID NO: 972461 - DNA, 13 bp, Homo sapiens
aagttatagtact

SEQ ID NO: 972462 - DNA, 15 bp, Homo sapiens
aagttatagtgaata

SEQ ID NO: 972463 - DNA, 18 bp, Homo sapiens
aagttatattagtgaaga

SEQ ID NO: 972464 - DNA, 16 bp, Homo sapiens
aagttatattgaatat

SEQ ID NO: 972465 - DNA, 17 bp, Homo sapiens
aagttatatttcagatg

SEQ ID NO: 972466 - DNA, 14 bp, Homo sapiens
aagttatctttgaa

SEQ ID NO: 972467 - DNA, 20 bp, Homo sapiens
aagttattaacgggcatgta

SEQ ID NO: 972468 - DNA, 22 bp, Homo sapiens
aagttattaacgggcatgtatt

SEQ ID NO: 972469 - DNA, 17 bp, Homo sapiens
aagttattaactttaat

SEQ ID NO: 972470 - DNA, 19 bp, Homo sapiens
aagttattcaaatttgtac

SEQ ID NO: 972471 - DNA, 14 bp, Homo sapiens
aagttatttacttt

SEQ ID NO: 972472 - DNA, 15 bp, Homo sapiens
aagttatttactttt

SEQ ID NO: 972473 - DNA, 21 bp, Homo sapiens
aagttatttccaagtttgtgt

SEQ ID NO: 972474 - DNA, 15 bp, Homo sapiens
aagttatttcttgtt

SEQ ID NO: 972475 - DNA, 23 bp, Homo sapiens
aagttattttatttgcttatttt

SEQ ID NO: 972476 - DNA, 18 bp, Homo sapiens
aagttattttctacagtg

SEQ ID NO: 972477 - DNA, 23 bp, Homo sapiens
aagttcaaattcttctgaactca

SEQ ID NO: 972478 - DNA, 20 bp, Homo sapiens
aagttcattgcaattaaact

SEQ ID NO: 972479 - DNA, 20 bp, Homo sapiens
aagttcccccatcagttccc

SEQ ID NO: 972480 - DNA, 17 bp, Homo sapiens
aagttcctctcccttcc

SEQ ID NO: 972481 - DNA, 19 bp, Homo sapiens
aagttcctctcccttccct

SEQ ID NO: 972482 - DNA, 11 bp, Homo sapiens
aagttccttaa

SEQ ID NO: 972483 - DNA, 17 bp, Homo sapiens
aagttctagagaagagg

SEQ ID NO: 972484 - DNA, 20 bp, Homo sapiens
aagttctaggaaattcttga

SEQ ID NO: 972485 - DNA, 22 bp, Homo sapiens
aagttctagtgttttcaatttt

SEQ ID NO: 972486 - DNA, 18 bp, Homo sapiens
aagttctatttcttgaag

SEQ ID NO: 972487 - DNA, 13 bp, Homo sapiens
aagttctcagagc

SEQ ID NO: 972488 - DNA, 14 bp, Homo sapiens
aagttctcagagct

SEQ ID NO: 972489 - DNA, 16 bp, Homo sapiens
aagttctccagcttca

SEQ ID NO: 972490 - DNA, 17 bp, Homo sapiens
aagttctccagcttcag

SEQ ID NO: 972491 - DNA, 17 bp, Homo sapiens
aagttctgcaaaataca

SEQ ID NO: 972492 - DNA, 19 bp, Homo sapiens
aagttctggcaagagcaga

SEQ ID NO: 972493 - DNA, 14 bp, Homo sapiens
aagttctgttttct

SEQ ID NO: 972494 - DNA, 9 bp, Homo sapiens
aagttctta

SEQ ID NO: 972495 - DNA, 22 bp, Homo sapiens
aagttcttatgaggaggggagg

SEQ ID NO: 972496 - DNA, 17 bp, Homo sapiens
aagttcttattttagta

SEQ ID NO: 972497 - DNA, 12 bp, Homo sapiens
aagttcttcaag

SEQ ID NO: 972498 - DNA, 17 bp, Homo sapiens
aagttcttcaagaggaa

SEQ ID NO: 972499 - DNA, 15 bp, Homo sapiens
aagttcttcacctct

SEQ ID NO: 972500 - DNA, 16 bp, Homo sapiens
aagttcttcacctcta

SEQ ID NO: 972501 - DNA, 20 bp, Homo sapiens
aagttcttggaccagtttgc

SEQ ID NO: 972502 - DNA, 14 bp, Homo sapiens
aagttgaactatga

SEQ ID NO: 972503 - DNA, 21 bp, Homo sapiens
aagttgaatggcctgccttga

SEQ ID NO: 972504 - DNA, 23 bp, Homo sapiens
aagttgaattgaggggattaata

SEQ ID NO: 972505 - DNA, 19 bp, Homo sapiens
aagttgacttatagtacat

SEQ ID NO: 972506 - DNA, 16 bp, Homo sapiens
aagttgagatagtttt

SEQ ID NO: 972507 - DNA, 23 bp, Homo sapiens
aagttgagatagttttcatccat

SEQ ID NO: 972508 - DNA, 19 bp, Homo sapiens
aagttgagatgttgtgtgg

SEQ ID NO: 972509 - DNA, 19 bp, Homo sapiens
aagttgagatttttaagaa

SEQ ID NO: 972510 - DNA, 14 bp, Homo sapiens
aagttgattagaaa

SEQ ID NO: 972511 - DNA, 21 bp, Homo sapiens
aagttgattttgaacttttta

SEQ ID NO: 972512 - DNA, 16 bp, Homo sapiens
aagttgcagatgtatt

SEQ ID NO: 972513 - DNA, 19 bp, Homo sapiens
aagttgcagctgttttgtt

SEQ ID NO: 972514 - DNA, 21 bp, Homo sapiens
aagttgcagtgagcagggtgg

SEQ ID NO: 972515 - DNA, 22 bp, Homo sapiens
aagttgcagtgagcagggtggg

SEQ ID NO: 972516 - DNA, 16 bp, Homo sapiens
aagttgcagtgagctg

SEQ ID NO: 972517 - DNA, 14 bp, Homo sapiens
aagttgcgacggag

SEQ ID NO: 972518 - DNA, 13 bp, Homo sapiens
aagtttttttgct

SEQ ID NO: 972519 - DNA, 19 bp, Homo sapiens
aataaaaaaaaaaggatga

SEQ ID NO: 972520 - DNA, 15 bp, Homo sapiens
aataaaaaaaagaaa

SEQ ID NO: 972521 - DNA, 17 bp, Homo sapiens
aataaaaaaaagaaaaa

SEQ ID NO: 972522 - DNA, 15 bp, Homo sapiens
aataaaaaacaagaa

SEQ ID NO: 972523 - DNA, 19 bp, Homo sapiens
aataaaaaacaagaaacca

SEQ ID NO: 972524 - DNA, 16 bp, Homo sapiens
aataaaaaagattcta

SEQ ID NO: 972525 - DNA, 21 bp, Homo sapiens
aataaaaaagattctactaac

SEQ ID NO: 972526 - DNA, 15 bp, Homo sapiens
aataaaaaagcaaaa

SEQ ID NO: 972527 - DNA, 23 bp, Homo sapiens
aataaaaacattgcctttgaatg

SEQ ID NO: 972528 - DNA, 19 bp, Homo sapiens
aataaaaactgactcctta

SEQ ID NO: 972529 - DNA, 17 bp, Homo sapiens
aataaaaagatcacttt

SEQ ID NO: 972530 - DNA, 19 bp, Homo sapiens
aataaaaagatcactttct

SEQ ID NO: 972531 - DNA, 11 bp, Homo sapiens
aataaaaagga

SEQ ID NO: 972532 - DNA, 12 bp, Homo sapiens
aataaaaaggaa

SEQ ID NO: 972533 - DNA, 13 bp, Homo sapiens
aataaaaagtgac

SEQ ID NO: 972534 - DNA, 13 bp, Homo sapiens
aataaaaatatat

SEQ ID NO: 972535 - DNA, 17 bp, Homo sapiens
aataaaaatatgtaatt

SEQ ID NO: 972536 - DNA, 21 bp, Homo sapiens
aataaaaatcaacttgtgtac

SEQ ID NO: 972537 - DNA, 16 bp, Homo sapiens
aataaaaatgctataa

SEQ ID NO: 972538 - DNA, 14 bp, Homo sapiens
aataaaaatgttta

SEQ ID NO: 972539 - DNA, 15 bp, Homo sapiens
aataaaaatgtttaa

SEQ ID NO: 972540 - DNA, 13 bp, Homo sapiens
aataaaaattcta

SEQ ID NO: 972541 - DNA, 14 bp, Homo sapiens
aataaaacaagcct

SEQ ID NO: 972542 - DNA, 16 bp, Homo sapiens
aatattttgttcttat

SEQ ID NO: 972543 - DNA, 20 bp, Homo sapiens
aatatttttatatttccttt

SEQ ID NO: 972544 - DNA, 15 bp, Homo sapiens
aatatttttccctcc

SEQ ID NO: 972545 - DNA, 23 bp, Homo sapiens
aatatttttccctccgggcaggg

SEQ ID NO: 972546 - DNA, 21 bp, Homo sapiens
aatattttttatatatacagt

SEQ ID NO: 972547 - DNA, 17 bp, Homo sapiens
aatattttttatttcta

SEQ ID NO: 972548 - DNA, 23 bp, Homo sapiens
aatattttttatttctaagtatt

SEQ ID NO: 972549 - DNA, 12 bp, Homo sapiens
aatattttttga

SEQ ID NO: 972550 - DNA, 20 bp, Homo sapiens
aatattttttgaaggtttca

SEQ ID NO: 972551 - DNA, 15 bp, Homo sapiens
aatattttttgcaag

SEQ ID NO: 972552 - DNA, 10 bp, Homo sapiens
aatcaaaact

SEQ ID NO: 972553 - DNA, 20 bp, Homo sapiens
aatcaaaagggccaaagaac

SEQ ID NO: 972554 - DNA, 15 bp, Homo sapiens
aatcaaaatccaaaa

SEQ ID NO: 972555 - DNA, 14 bp, Homo sapiens
aatcaaaattgtct

SEQ ID NO: 972556 - DNA, 14 bp, Homo sapiens
aatcaaacagtaat

SEQ ID NO: 972557 - DNA, 16 bp, Homo sapiens
aatcaaacattttctg

SEQ ID NO: 972558 - DNA, 17 bp, Homo sapiens
aatcaaacattttctgg

SEQ ID NO: 972559 - DNA, 14 bp, Homo sapiens
aatcaaagaaaaga

SEQ ID NO: 972560 - DNA, 17 bp, Homo sapiens
aatcaaagaaaagactt

SEQ ID NO: 972561 - DNA, 24 bp, Homo sapiens
aatcaaagaaaagacttttgttga

SEQ ID NO: 972562 - DNA, 14 bp, Homo sapiens
aatcaaagaattac

SEQ ID NO: 972563 - DNA, 17 bp, Homo sapiens
aatcaaagaattacagt

SEQ ID NO: 972564 - DNA, 18 bp, Homo sapiens
aatcaaagtgtctagaca

SEQ ID NO: 972565 - DNA, 14 bp, Homo sapiens
aatcaaatcttaca

SEQ ID NO: 972566 - DNA, 18 bp, Homo sapiens
aatcaaatcttacaaaat

SEQ ID NO: 972567 - DNA, 13 bp, Homo sapiens
aatcaacagatga

SEQ ID NO: 972568 - DNA, 15 bp, Homo sapiens
aatcaacagatgata

SEQ ID NO: 972569 - DNA, 17 bp, Homo sapiens
aatcaaccctgcaatca

SEQ ID NO: 972570 - DNA, 23 bp, Homo sapiens
aatcaactaggtatttaagactg

SEQ ID NO: 972571 - DNA, 22 bp, Homo sapiens
aatcaactggagtctatgctta

SEQ ID NO: 972572 - DNA, 13 bp, Homo sapiens
aatcaactttact

SEQ ID NO: 972573 - DNA, 10 bp, Homo sapiens
aatcaagaga

SEQ ID NO: 972574 - DNA, 10 bp, Homo sapiens
aatcaagagt

SEQ ID NO: 972575 - DNA, 18 bp, Homo sapiens
aatcaaggcaaaaggaat

SEQ ID NO: 972576 - DNA, 22 bp, Homo sapiens
aatcaagttgtaacttatattg

SEQ ID NO: 972577 - DNA, 12 bp, Homo sapiens
aatcaataatat

SEQ ID NO: 972578 - DNA, 14 bp, Homo sapiens
aatcaatacactag

SEQ ID NO: 972579 - DNA, 12 bp, Homo sapiens
aatcaatagttg

SEQ ID NO: 972580 - DNA, 15 bp, Homo sapiens
aatcaatatcccaac

SEQ ID NO: 972581 - DNA, 16 bp, Homo sapiens
aatcaatatcccaaca

SEQ ID NO: 972582 - DNA, 17 bp, Homo sapiens
aatcaatatcccaacat

SEQ ID NO: 972583 - DNA, 21 bp, Homo sapiens
aatcaatatcccaacattctg

SEQ ID NO: 972584 - DNA, 16 bp, Homo sapiens
aatcaatcaatggtgc

SEQ ID NO: 972585 - DNA, 15 bp, Homo sapiens
aatcaatggtgcaaa

SEQ ID NO: 972586 - DNA, 17 bp, Homo sapiens
aatcaatggtgcaaaaa

SEQ ID NO: 972587 - DNA, 19 bp, Homo sapiens
aatcaatggtgcaaaaaaa

SEQ ID NO: 972588 - DNA, 15 bp, Homo sapiens
aatcacaaaaacaaa

SEQ ID NO: 972589 - DNA, 22 bp, Homo sapiens
aatcacaaaaacaaaaaaacta

SEQ ID NO: 972590 - DNA, 16 bp, Homo sapiens
aatcacacctctgggc

SEQ ID NO: 972591 - DNA, 15 bp, Homo sapiens
aatcacagaaaattt

SEQ ID NO: 972592 - DNA, 17 bp, Homo sapiens
aatcacagaaaatttaa

SEQ ID NO: 972593 - DNA, 13 bp, Homo sapiens
aatcacagaatca

SEQ ID NO: 972594 - DNA, 22 bp, Homo sapiens
aatcacagatgggtattaaact

SEQ ID NO: 972595 - DNA, 13 bp, Homo sapiens
aatcacagctcac

SEQ ID NO: 972596 - DNA, 20 bp, Homo sapiens
aatcatcctgaatctgatct

SEQ ID NO: 972597 - DNA, 23 bp, Homo sapiens
aatcatcctgttttctctgtgac

SEQ ID NO: 972598 - DNA, 24 bp, Homo sapiens
aatcatcggagtcagccaggagct

SEQ ID NO: 972599 - DNA, 18 bp, Homo sapiens
aatcatctataaagaaga

SEQ ID NO: 972600 - DNA, 16 bp, Homo sapiens
aatcatctgcattcct

SEQ ID NO: 972601 - DNA, 20 bp, Homo sapiens
aatcatgaacagctctgaga

SEQ ID NO: 972602 - DNA, 22 bp, Homo sapiens
aatcatgaacagctctgagatc

SEQ ID NO: 972603 - DNA, 23 bp, Homo sapiens
aatcatgaacagctctgagatcc

SEQ ID NO: 972604 - DNA, 23 bp, Homo sapiens
aatcatgacttatcccattttca

SEQ ID NO: 972605 - DNA, 17 bp, Homo sapiens
aatcatgagcctgctgg

SEQ ID NO: 972606 - DNA, 18 bp, Homo sapiens
aatcatgagcctgctgga

SEQ ID NO: 972607 - DNA, 18 bp, Homo sapiens
aatcatggtcaagttccc

SEQ ID NO: 972608 - DNA, 13 bp, Homo sapiens
aatcatgtaaatg

SEQ ID NO: 972609 - DNA, 16 bp, Homo sapiens
aatcatgtcaggcctg

SEQ ID NO: 972610 - DNA, 22 bp, Homo sapiens
aatcatgtcagtctgcttagaa

SEQ ID NO: 972611 - DNA, 23 bp, Homo sapiens
aatcatgtcagtctgcttagaaa

SEQ ID NO: 972612 - DNA, 17 bp, Homo sapiens
aatcatgtccatacact

SEQ ID NO: 972613 - DNA, 23 bp, Homo sapiens
aatcatgtgggtgagccagtgga

SEQ ID NO: 972614 - DNA, 22 bp, Homo sapiens
aatcatgttgatcatgtacttt

SEQ ID NO: 972615 - DNA, 22 bp, Homo sapiens
aatcatgttgttgtgtgtatat

SEQ ID NO: 972616 - DNA, 21 bp, Homo sapiens
aatcattaatttcaaaattta

SEQ ID NO: 972617 - DNA, 14 bp, Homo sapiens
aatcattagagctt

SEQ ID NO: 972618 - DNA, 16 bp, Homo sapiens
aatcattccagtgcta

SEQ ID NO: 972619 - DNA, 15 bp, Homo sapiens
aatcattctcgattt

SEQ ID NO: 972620 - DNA, 14 bp, Homo sapiens
aatcattgaagtat

SEQ ID NO: 972621 - DNA, 20 bp, Homo sapiens
aatcattgctgaaaatggta

SEQ ID NO: 972622 - DNA, 22 bp, Homo sapiens
aatcattgctttgaagcagttg

SEQ ID NO: 972623 - DNA, 13 bp, Homo sapiens
aatcatttattca

SEQ ID NO: 972624 - DNA, 12 bp, Homo sapiens
aatcatttcagt

SEQ ID NO: 972625 - DNA, 20 bp, Homo sapiens
aatcatttccccataactca

SEQ ID NO: 972626 - DNA, 19 bp, Homo sapiens
aatcatttctatttctcct

SEQ ID NO: 972627 - DNA, 20 bp, Homo sapiens
aatcatttctatttctcctc

SEQ ID NO: 972628 - DNA, 21 bp, Homo sapiens
aatcatttcttgggccctcct

SEQ ID NO: 972629 - DNA, 13 bp, Homo sapiens
aatcatttggtta

SEQ ID NO: 972630 - DNA, 15 bp, Homo sapiens
aatcatttgtttaaa

SEQ ID NO: 972631 - DNA, 17 bp, Homo sapiens
aatcattttaattatta

SEQ ID NO: 972632 - DNA, 22 bp, Homo sapiens
aatcattttaattattattctt

SEQ ID NO: 972633 - DNA, 19 bp, Homo sapiens
aatcattttgcctcttttc

SEQ ID NO: 972634 - DNA, 20 bp, Homo sapiens
aatcatttttatattataac

SEQ ID NO: 972635 - DNA, 16 bp, Homo sapiens
aatccaaatctgtcct

SEQ ID NO: 972636 - DNA, 17 bp, Homo sapiens
aatccaaatctgtcctc

SEQ ID NO: 972637 - DNA, 20 bp, Homo sapiens
aatccaaatggcgtctggaa

SEQ ID NO: 972638 - DNA, 22 bp, Homo sapiens
aatccaagatattttaaaatct

SEQ ID NO: 972639 - DNA, 18 bp, Homo sapiens
aatccaagcctccacagc

SEQ ID NO: 972640 - DNA, 22 bp, Homo sapiens
aatccaagcctccacagcgagg

SEQ ID NO: 972641 - DNA, 13 bp, Homo sapiens
aatccaagctccc

SEQ ID NO: 972642 - DNA, 23 bp, Homo sapiens
aatcttaaacaatgtataaagat

SEQ ID NO: 972643 - DNA, 20 bp, Homo sapiens
aatcttaatcgatgaatgta

SEQ ID NO: 972644 - DNA, 13 bp, Homo sapiens
aatcttaatgttc

SEQ ID NO: 972645 - DNA, 20 bp, Homo sapiens
aatcttaccagatgctactg

SEQ ID NO: 972646 - DNA, 14 bp, Homo sapiens
aatcttagataact

SEQ ID NO: 972647 - DNA, 18 bp, Homo sapiens
aatcttagtgtatgatta

SEQ ID NO: 972648 - DNA, 23 bp, Homo sapiens
aatcttagtgtatgattactggc

SEQ ID NO: 972649 - DNA, 14 bp, Homo sapiens
aatcttagtgttca

SEQ ID NO: 972650 - DNA, 14 bp, Homo sapiens
aatcttatggggcc

SEQ ID NO: 972651 - DNA, 21 bp, Homo sapiens
aatcttcacgacaatgttgag

SEQ ID NO: 972652 - DNA, 14 bp, Homo sapiens
aatcttcaggtgaa

SEQ ID NO: 972653 - DNA, 17 bp, Homo sapiens
aatcttgaatgtttgtg

SEQ ID NO: 972654 - DNA, 18 bp, Homo sapiens
aatcttgcagttttgtaa

SEQ ID NO: 972655 - DNA, 19 bp, Homo sapiens
aatcttgcagttttgtaag

SEQ ID NO: 972656 - DNA, 18 bp, Homo sapiens
aatcttggcttcttaaaa

SEQ ID NO: 972657 - DNA, 20 bp, Homo sapiens
aatcttggcttcttaaaaac

SEQ ID NO: 972658 - DNA, 21 bp, Homo sapiens
aatcttggcttcttaaaaact

SEQ ID NO: 972659 - DNA, 18 bp, Homo sapiens
aatcttgtgctagaatac

SEQ ID NO: 972660 - DNA, 19 bp, Homo sapiens
aatcttgtgctagaatact

SEQ ID NO: 972661 - DNA, 20 bp, Homo sapiens
aatcttgttaatgtcattgc

SEQ ID NO: 972662 - DNA, 21 bp, Homo sapiens
aatcttgttaatgtcattgct

SEQ ID NO: 972663 - DNA, 22 bp, Homo sapiens
aatcttgttaatgtcattgcta

SEQ ID NO: 972664 - DNA, 18 bp, Homo sapiens
aatcttgttactgctgat

SEQ ID NO: 972665 - DNA, 13 bp, Homo sapiens
aatcttgttttga

SEQ ID NO: 972666 - DNA, 19 bp, Homo sapiens
aatgacaatatcaatcaca

SEQ ID NO: 972667 - DNA, 22 bp, Homo sapiens
aatgacacccatgccagagagg

SEQ ID NO: 972668 - DNA, 19 bp, Homo sapiens
aatgacagatgcaagttat

SEQ ID NO: 972669 - DNA, 18 bp, Homo sapiens
aatgacagattctgacat

SEQ ID NO: 972670 - DNA, 17 bp, Homo sapiens
aatgacagtttcagaga

SEQ ID NO: 972671 - DNA, 22 bp, Homo sapiens
aatgacatctcaggggccagag

SEQ ID NO: 972672 - DNA, 19 bp, Homo sapiens
aatgaccaagacaggttca

SEQ ID NO: 972673 - DNA, 20 bp, Homo sapiens
aatgaccagcagcagctttc

SEQ ID NO: 972674 - DNA, 19 bp, Homo sapiens
aatgaccattcaattagtg

SEQ ID NO: 972675 - DNA, 16 bp, Homo sapiens
aatgacctttttacaa

SEQ ID NO: 972676 - DNA, 12 bp, Homo sapiens
aatgacgcctga

SEQ ID NO: 972677 - DNA, 14 bp, Homo sapiens
aatgacgtttacat

SEQ ID NO: 972678 - DNA, 17 bp, Homo sapiens
aatgactaaaaaacaaa

SEQ ID NO: 972679 - DNA, 20 bp, Homo sapiens
aatgactaaaaaacaaagaa

SEQ ID NO: 972680 - DNA, 17 bp, Homo sapiens
aatgactaaaaatatta

SEQ ID NO: 972681 - DNA, 21 bp, Homo sapiens
aatgactatataatttatttc

SEQ ID NO: 972682 - DNA, 16 bp, Homo sapiens
aatgactcaaagtctg

SEQ ID NO: 972683 - DNA, 20 bp, Homo sapiens
aatgactcaggacatccccc

SEQ ID NO: 972684 - DNA, 19 bp, Homo sapiens
tggtgcactttgtaaattc

SEQ ID NO: 972685 - DNA, 19 bp, Homo sapiens
tggtgcagaggtttcttga

SEQ ID NO: 972686 - DNA, 15 bp, Homo sapiens
tggtgcagccttccc

SEQ ID NO: 972687 - DNA, 20 bp, Homo sapiens
tgttctttggaaatacacag

SEQ ID NO: 972688 - DNA, 13 bp, Homo sapiens
tgttctttgggga

SEQ ID NO: 972689 - DNA, 16 bp, Homo sapiens
tgttcttttaccactg

SEQ ID NO: 972690 - DNA, 21 bp, Homo sapiens
tgttcttttctcctttaccag

SEQ ID NO: 972691 - DNA, 13 bp, Homo sapiens
tgttctttttaga

SEQ ID NO: 972692 - DNA, 23 bp, Homo sapiens
tgttgaaaaaaaagtttcagaga

SEQ ID NO: 972693 - DNA, 21 bp, Homo sapiens
tgttgaaaaaatttaaaagta

SEQ ID NO: 972694 - DNA, 21 bp, Homo sapiens
tgttgaaaatgtatttcctga

SEQ ID NO: 972695 - DNA, 21 bp, Homo sapiens
ttgaatgtggataaaactgtg

SEQ ID NO: 972696 - DNA, 19 bp, Homo sapiens
ttgaatgtggcttgagaaa

SEQ ID NO: 972697 - DNA, 22 bp, Homo sapiens
ttgaatgtggcttgagaaatat

SEQ ID NO: 972698 - DNA, 23 bp, Homo sapiens
ttgaatgttatttgttattttca

SEQ ID NO: 972699 - DNA, 17 bp, Homo sapiens
ttgaattaaattaggaa

SEQ ID NO: 972700 - DNA, 14 bp, Homo sapiens
ttgaattagaaaat

SEQ ID NO: 972701 - DNA, 15 bp, Homo sapiens
ttgaattagattatt

SEQ ID NO: 972702 - DNA, 20 bp, Homo sapiens
ttgaattatcttggttgaaa

SEQ ID NO: 972703 - DNA, 22 bp, Homo sapiens
ttgaattatcttggttgaaaat

SEQ ID NO: 972704 - DNA, 13 bp, Homo sapiens
ttgaattcattat

SEQ ID NO: 972705 - DNA, 22 bp, Homo sapiens
ttgaattcctaaaattatggaa

SEQ ID NO: 972706 - DNA, 19 bp, Homo sapiens
ttgaattcttgatctctaa

SEQ ID NO: 972707 - DNA, 14 bp, Homo sapiens
agccttagggaagc

SEQ ID NO: 972708 - DNA, 18 bp, Homo sapiens
agccttatcaagtgtctt

SEQ ID NO: 972709 - DNA, 14 bp, Homo sapiens
agccttatcctctg

SEQ ID NO: 972710 - DNA, 17 bp, Homo sapiens
agccttatcctctgatc

SEQ ID NO: 972711 - DNA, 18 bp, Homo sapiens
agccttatcctctgatct

SEQ ID NO: 972712 - DNA, 16 bp, Homo sapiens
agccttatgtgttaca

SEQ ID NO: 972713 - DNA, 16 bp, Homo sapiens
agccttattctaaggt

SEQ ID NO: 972714 - DNA, 14 bp, Homo sapiens
agccttatttctag

SEQ ID NO: 972715 - DNA, 22 bp, Homo sapiens
agccttatttctagaagcacat

SEQ ID NO: 972716 - DNA, 21 bp, Homo sapiens
agccttatttttgtatgcctt

SEQ ID NO: 972717 - DNA, 22 bp, Homo sapiens
agccttatttttgtatgccttt

SEQ ID NO: 972718 - DNA, 20 bp, Homo sapiens
agccttcactggttctgcat

SEQ ID NO: 972719 - DNA, 17 bp, Homo sapiens
agccttcatttgcaatt

SEQ ID NO: 972720 - DNA, 22 bp, Homo sapiens
agccttcatttgcaattcatgt

SEQ ID NO: 972721 - DNA, 18 bp, Homo sapiens
agccttccaactagctgg

SEQ ID NO: 972722 - DNA, 13 bp, Homo sapiens
agccttcccctcc

SEQ ID NO: 972723 - DNA, 17 bp, Homo sapiens
agccttcccctccctgt

SEQ ID NO: 972724 - DNA, 22 bp, Homo sapiens
agccttccccttgcccagggct

SEQ ID NO: 972725 - DNA, 12 bp, Homo sapiens
agccttcctcca

SEQ ID NO: 972726 - DNA, 23 bp, Homo sapiens
agccttcctccacatcctttcta

SEQ ID NO: 972727 - DNA, 17 bp, Homo sapiens
agccttcctctgcagct

SEQ ID NO: 972728 - DNA, 19 bp, Homo sapiens
agccttcctctgcagctga

SEQ ID NO: 972729 - DNA, 23 bp, Homo sapiens
agccttcctctgcagctgacctc

SEQ ID NO: 972730 - DNA, 14 bp, Homo sapiens
agccttccttctgc

SEQ ID NO: 972731 - DNA, 18 bp, Homo sapiens
agccttccttctgctccc

SEQ ID NO: 972732 - DNA, 23 bp, Homo sapiens
agccttccttctgctcccacccc

SEQ ID NO: 972733 - DNA, 17 bp, Homo sapiens
agccttcgtgtggctcc

SEQ ID NO: 972734 - DNA, 11 bp, Homo sapiens
agccttctccc

SEQ ID NO: 972735 - DNA, 15 bp, Homo sapiens
agccttcttctgcca

SEQ ID NO: 972736 - DNA, 16 bp, Homo sapiens
agccttcttctgccac

SEQ ID NO: 972737 - DNA, 20 bp, Homo sapiens
agccttctttttctggactc

SEQ ID NO: 972738 - DNA, 20 bp, Homo sapiens
agccttgaactcctggcctc

SEQ ID NO: 972739 - DNA, 22 bp, Homo sapiens
agccttgaagaaaatgacttta

SEQ ID NO: 972740 - DNA, 16 bp, Homo sapiens
agccttgagccctggc

SEQ ID NO: 972741 - DNA, 18 bp, Homo sapiens
agccttgataatacttga

SEQ ID NO: 972742 - DNA, 19 bp, Homo sapiens
agccttgataatacttgac

SEQ ID NO: 972743 - DNA, 13 bp, Homo sapiens
agccttgcacacc

SEQ ID NO: 972744 - DNA, 22 bp, Homo sapiens
agccttgcacacccactgcccc

SEQ ID NO: 972745 - DNA, 20 bp, Homo sapiens
agccttgcagatatctgcat

SEQ ID NO: 972746 - DNA, 18 bp, Homo sapiens
agccttgcatcaagggct

SEQ ID NO: 972747 - DNA, 15 bp, Homo sapiens
agccttgctgggcca

SEQ ID NO: 972748 - DNA, 18 bp, Homo sapiens
agccttgctgggccaggg

SEQ ID NO: 972749 - DNA, 12 bp, Homo sapiens
agccttgcttgt

SEQ ID NO: 972750 - DNA, 20 bp, Homo sapiens
agccttggaaccagccccat

SEQ ID NO: 972751 - DNA, 23 bp, Homo sapiens
agccttggaaccagccccatcag

SEQ ID NO: 972752 - DNA, 22 bp, Homo sapiens
agccttggataatgctgttgcc

SEQ ID NO: 972753 - DNA, 22 bp, Homo sapiens
agccttggccgcataggcccag

SEQ ID NO: 972754 - DNA, 19 bp, Homo sapiens
agccttggctcgttctctt

SEQ ID NO: 972755 - DNA, 22 bp, Homo sapiens
agccttgggttccaaccaggca

SEQ ID NO: 972756 - DNA, 18 bp, Homo sapiens
agccttggtgtccacctg

SEQ ID NO: 972757 - DNA, 19 bp, Homo sapiens
agccttggtgtccacctgg

SEQ ID NO: 972758 - DNA, 22 bp, Homo sapiens
agccttggtgtccacctggccc

SEQ ID NO: 972759 - DNA, 18 bp, Homo sapiens
agccttgtaattctaaat

SEQ ID NO: 972760 - DNA, 21 bp, Homo sapiens
agccttgtgagatccttcaca

SEQ ID NO: 972761 - DNA, 15 bp, Homo sapiens
agccttgtgccctgc

SEQ ID NO: 972762 - DNA, 16 bp, Homo sapiens
agccttgtgccctgcc

SEQ ID NO: 972763 - DNA, 17 bp, Homo sapiens
agcctttaaaaccagta

SEQ ID NO: 972764 - DNA, 22 bp, Homo sapiens
agcctttaaatcatttttatat

SEQ ID NO: 972765 - DNA, 13 bp, Homo sapiens
agcctttaatgca

SEQ ID NO: 972766 - DNA, 16 bp, Homo sapiens
agcctttactgtttga

SEQ ID NO: 972767 - DNA, 16 bp, Homo sapiens
agcctttccaagtcac

SEQ ID NO: 972768 - DNA, 14 bp, Homo sapiens
agcctttccagcct

SEQ ID NO: 972769 - DNA, 14 bp, Homo sapiens
agcctttccataag

SEQ ID NO: 972770 - DNA, 19 bp, Homo sapiens
agcctttcctcggtctccc

SEQ ID NO: 972771 - DNA, 15 bp, Homo sapiens
agcctttctctcttt

SEQ ID NO: 972772 - DNA, 13 bp, Homo sapiens
agcctttcttgta

SEQ ID NO: 972773 - DNA, 23 bp, Homo sapiens
agcctttcttgtagccatggctg

SEQ ID NO: 972774 - DNA, 11 bp, Homo sapiens
agcctttgaat

SEQ ID NO: 972775 - DNA, 16 bp, Homo sapiens
agcctttgcctccccg

SEQ ID NO: 972776 - DNA, 21 bp, Homo sapiens
agcctttgggtcctgggcagg

SEQ ID NO: 972777 - DNA, 23 bp, Homo sapiens
agccttttccctctttggctccc

SEQ ID NO: 972778 - DNA, 23 bp, Homo sapiens
agccttttgtttcccttgctttg

SEQ ID NO: 972779 - DNA, 16 bp, Homo sapiens
agcctttttctaggcc

SEQ ID NO: 972780 - DNA, 23 bp, Homo sapiens
agcgaaaaaatcaggtggctttt

SEQ ID NO: 972781 - DNA, 12 bp, Homo sapiens
agcgaaactccg

SEQ ID NO: 972782 - DNA, 15 bp, Homo sapiens
agcgaaattgtcttt

SEQ ID NO: 972783 - DNA, 19 bp, Homo sapiens
agcgaacgtatttctccag

SEQ ID NO: 972784 - DNA, 22 bp, Homo sapiens
agcgaacgtatttctccagacc

SEQ ID NO: 972785 - DNA, 20 bp, Homo sapiens
agcgaagggggtcaaaggaa

SEQ ID NO: 972786 - DNA, 13 bp, Homo sapiens
agcgaagtagctt

SEQ ID NO: 972787 - DNA, 20 bp, Homo sapiens
agcgaagtctcatgggaagc

SEQ ID NO: 972788 - DNA, 11 bp, Homo sapiens
agcgacagatt

SEQ ID NO: 972789 - DNA, 13 bp, Homo sapiens
agcgaccaaggat

SEQ ID NO: 972790 - DNA, 17 bp, Homo sapiens
agcgacccattcagaga

SEQ ID NO: 972791 - DNA, 15 bp, Homo sapiens
agcgaccccagactg

SEQ ID NO: 972792 - DNA, 16 bp, Homo sapiens
agcgacctctctgcct

SEQ ID NO: 972793 - DNA, 19 bp, Homo sapiens
agcgactccgttggccact

SEQ ID NO: 972794 - DNA, 15 bp, Homo sapiens
agcgactggatgctc

SEQ ID NO: 972795 - DNA, 13 bp, Homo sapiens
agcgagaggcagc

SEQ ID NO: 972796 - DNA, 15 bp, Homo sapiens
agcgagaggcagcaa

SEQ ID NO: 972797 - DNA, 17 bp, Homo sapiens
agcgagaggcagcaagg

SEQ ID NO: 972798 - DNA, 16 bp, Homo sapiens
agcgagagtctgtctc

SEQ ID NO: 972799 - DNA, 14 bp, Homo sapiens
agcgagccacagga

SEQ ID NO: 972800 - DNA, 22 bp, Homo sapiens
agcgagcccctcggctctggag

SEQ ID NO: 972801 - DNA, 17 bp, Homo sapiens
agcgagctgctctgcta

SEQ ID NO: 972802 - DNA, 20 bp, Homo sapiens
agcgaggagatgctccttgg

SEQ ID NO: 972803 - DNA, 15 bp, Homo sapiens
agcgagggcagctgc

SEQ ID NO: 972804 - DNA, 22 bp, Homo sapiens
agcgaggtcaacagagaaggca

SEQ ID NO: 972805 - DNA, 21 bp, Homo sapiens
agcgaggtgggagaggcctca

SEQ ID NO: 972806 - DNA, 16 bp, Homo sapiens
agcgataatacactat

SEQ ID NO: 972807 - DNA, 16 bp, Homo sapiens
agcgatccaggggaag

SEQ ID NO: 972808 - DNA, 17 bp, Homo sapiens
agcgatctctcctggcc

SEQ ID NO: 972809 - DNA, 19 bp, Homo sapiens
agcgatgaatttggagact

SEQ ID NO: 972810 - DNA, 13 bp, Homo sapiens
agcgatggcaggc

SEQ ID NO: 972811 - DNA, 16 bp, Homo sapiens
agcgatggcaggcctg

SEQ ID NO: 972812 - DNA, 18 bp, Homo sapiens
agcgatggcaggcctgac

SEQ ID NO: 972813 - DNA, 19 bp, Homo sapiens
agcgatggcaggcctgacc

SEQ ID NO: 972814 - DNA, 18 bp, Homo sapiens
agcgatgggcccctggcc

SEQ ID NO: 972815 - DNA, 18 bp, Homo sapiens
agcgatggtctcagaaac

SEQ ID NO: 972816 - DNA, 14 bp, Homo sapiens
agcgatttgaaaca

SEQ ID NO: 972817 - DNA, 14 bp, Homo sapiens
agcgcacctgcccc

SEQ ID NO: 972818 - DNA, 21 bp, Homo sapiens
agcgcagctggactctgcatc

SEQ ID NO: 972819 - DNA, 16 bp, Homo sapiens
agcgcaggcagcgcag

SEQ ID NO: 972820 - DNA, 13 bp, Homo sapiens
agcgcaggctgca

SEQ ID NO: 972821 - DNA, 20 bp, Homo sapiens
agcgcaggctgcagagcccg

SEQ ID NO: 972822 - DNA, 12 bp, Homo sapiens
agcgcagggctg

SEQ ID NO: 972823 - DNA, 17 bp, Homo sapiens
agcgccaggaagccaga

SEQ ID NO: 972824 - DNA, 21 bp, Homo sapiens
agcgccaggaagccagagccc

SEQ ID NO: 972825 - DNA, 21 bp, Homo sapiens
agcgccaggctgaccacagca

SEQ ID NO: 972826 - DNA, 17 bp, Homo sapiens
agcgccaggctggagat

SEQ ID NO: 972827 - DNA, 12 bp, Homo sapiens
agcgccagggcc

SEQ ID NO: 972828 - DNA, 14 bp, Homo sapiens
agcgcccacccagg

SEQ ID NO: 972829 - DNA, 16 bp, Homo sapiens
agcgcccacccaggtc

SEQ ID NO: 972830 - DNA, 17 bp, Homo sapiens
agcgcccacccaggtcc

SEQ ID NO: 972831 - DNA, 12 bp, Homo sapiens
agcctccagagc

SEQ ID NO: 972832 - DNA, 13 bp, Homo sapiens
agcctccagagcc

SEQ ID NO: 972833 - DNA, 14 bp, Homo sapiens
agcctccagagcca

SEQ ID NO: 972834 - DNA, 19 bp, Homo sapiens
agcctccagagccagcctg

SEQ ID NO: 972835 - DNA, 24 bp, Homo sapiens
agcctccagagccagcctgggact

SEQ ID NO: 972836 - DNA, 12 bp, Homo sapiens
agcctccagggc

SEQ ID NO: 972837 - DNA, 17 bp, Homo sapiens
agcctccatttagttct

SEQ ID NO: 972838 - DNA, 19 bp, Homo sapiens
agcctcccaaagtgctggg

SEQ ID NO: 972839 - DNA, 20 bp, Homo sapiens
agcctcccaaagtgctggga

SEQ ID NO: 972840 - DNA, 21 bp, Homo sapiens
agcctcccaaagtgctgggat

SEQ ID NO: 972841 - DNA, 17 bp, Homo sapiens
agcctcccaagtagctg

SEQ ID NO: 972842 - DNA, 18 bp, Homo sapiens
agcctcccaagtagctgg

SEQ ID NO: 972843 - DNA, 19 bp, Homo sapiens
agcctcccaagtagctggg

SEQ ID NO: 972844 - DNA, 21 bp, Homo sapiens
agcctcccaagtagctgggat

SEQ ID NO: 972845 - DNA, 11 bp, Homo sapiens
agcctcccaca

SEQ ID NO: 972846 - DNA, 17 bp, Homo sapiens
agcctcccaccagagcc

SEQ ID NO: 972847 - DNA, 21 bp, Homo sapiens
agcctcccaccagagccggga

SEQ ID NO: 972848 - DNA, 22 bp, Homo sapiens
agcctcccacgactgcccggca

SEQ ID NO: 972849 - DNA, 21 bp, Homo sapiens
agcctcccaggtagctgggat

SEQ ID NO: 972850 - DNA, 19 bp, Homo sapiens
agcctcccccgccagcccc

SEQ ID NO: 972851 - DNA, 14 bp, Homo sapiens
agcctccccctcag

SEQ ID NO: 972852 - DNA, 20 bp, Homo sapiens
agcctcccctcccctgggga

SEQ ID NO: 972853 - DNA, 19 bp, Homo sapiens
agcctcccgagtagctggg

SEQ ID NO: 972854 - DNA, 11 bp, Homo sapiens
agcctccctca

SEQ ID NO: 972855 - DNA, 21 bp, Homo sapiens
agcctccctcagcccccagga

SEQ ID NO: 972856 - DNA, 12 bp, Homo sapiens
agcctccctgaa

SEQ ID NO: 972857 - DNA, 18 bp, Homo sapiens
agcctccctgagcctgca

SEQ ID NO: 972858 - DNA, 16 bp, Homo sapiens
agcctccctgcagcca

SEQ ID NO: 972859 - DNA, 18 bp, Homo sapiens
agcctccctgtctccagc

SEQ ID NO: 972860 - DNA, 19 bp, Homo sapiens
agcctgcatcttcttgcat

SEQ ID NO: 972861 - DNA, 18 bp, Homo sapiens
agcctgcattctgcacgc

SEQ ID NO: 972862 - DNA, 21 bp, Homo sapiens
agcctgcattctgcacgctgc

SEQ ID NO: 972863 - DNA, 15 bp, Homo sapiens
agcctgcattgagct

SEQ ID NO: 972864 - DNA, 22 bp, Homo sapiens
agcctgcattgagcttgcatgc

SEQ ID NO: 972865 - DNA, 23 bp, Homo sapiens
agcctgcattgagcttgcatgct

SEQ ID NO: 972866 - DNA, 20 bp, Homo sapiens
agcctgccaaagtgcctggg

SEQ ID NO: 972867 - DNA, 14 bp, Homo sapiens
agcctgcccacctc

SEQ ID NO: 972868 - DNA, 15 bp, Homo sapiens
agcctgcccacctct

SEQ ID NO: 972869 - DNA, 22 bp, Homo sapiens
agcctgccccctatcttgtcct

SEQ ID NO: 972870 - DNA, 20 bp, Homo sapiens
agcctgccctcactccctct

SEQ ID NO: 972871 - DNA, 19 bp, Homo sapiens
agcctgccgccgtctctgt

SEQ ID NO: 972872 - DNA, 14 bp, Homo sapiens
agcctgcctggcag

SEQ ID NO: 972873 - DNA, 21 bp, Homo sapiens
agcctgcgccaccgcccagag

SEQ ID NO: 972874 - DNA, 18 bp, Homo sapiens
agcctgcggcctgctgga

SEQ ID NO: 972875 - DNA, 18 bp, Homo sapiens
agcctgcggcgccagcct

SEQ ID NO: 972876 - DNA, 15 bp, Homo sapiens
agcctgctccagctg

SEQ ID NO: 972877 - DNA, 17 bp, Homo sapiens
agcctgctccagctgtt

SEQ ID NO: 972878 - DNA, 14 bp, Homo sapiens
agcctgctccccca

SEQ ID NO: 972879 - DNA, 13 bp, Homo sapiens
agcctgctctgga

SEQ ID NO: 972880 - DNA, 11 bp, Homo sapiens
agcctgctgac

SEQ ID NO: 972881 - DNA, 17 bp, Homo sapiens
agcctgctgagagcccc

SEQ ID NO: 972882 - DNA, 19 bp, Homo sapiens
agcctgctgagagccccca

SEQ ID NO: 972883 - DNA, 13 bp, Homo sapiens
agcctgctgccca

SEQ ID NO: 972884 - DNA, 20 bp, Homo sapiens
agcctgctgcccaggctgtg

SEQ ID NO: 972885 - DNA, 14 bp, Homo sapiens
agcctgctggaagc

SEQ ID NO: 972886 - DNA, 11 bp, Homo sapiens
agcctgctggc

SEQ ID NO: 972887 - DNA, 14 bp, Homo sapiens
agcctgctggcagg

SEQ ID NO: 972888 - DNA, 15 bp, Homo sapiens
agcctgctggcaggg

SEQ ID NO: 972889 - DNA, 20 bp, Homo sapiens
agcctgctggcagggccagg

SEQ ID NO: 972890 - DNA, 14 bp, Homo sapiens
agcctgctggggct

SEQ ID NO: 972891 - DNA, 20 bp, Homo sapiens
agcctgctgtgtccttcctc

SEQ ID NO: 972892 - DNA, 21 bp, Homo sapiens
agcctgctgtgtccttcctcc

SEQ ID NO: 972893 - DNA, 17 bp, Homo sapiens
agcctgctttggccttt

SEQ ID NO: 972894 - DNA, 19 bp, Homo sapiens
agcctgctttggcctttcc

SEQ ID NO: 972895 - DNA, 13 bp, Homo sapiens
agcctggaagcca

SEQ ID NO: 972896 - DNA, 14 bp, Homo sapiens
agcctggaccctgt

SEQ ID NO: 972897 - DNA, 22 bp, Homo sapiens
agcctggactctaagctggagc

SEQ ID NO: 972898 - DNA, 16 bp, Homo sapiens
agcctggactctgccc

SEQ ID NO: 972899 - DNA, 11 bp, Homo sapiens
agcctggagaa

SEQ ID NO: 972900 - DNA, 18 bp, Homo sapiens
agcctggagaggcctggg

SEQ ID NO: 972901 - DNA, 20 bp, Homo sapiens
agcctggagaggcctggggt

SEQ ID NO: 972902 - DNA, 14 bp, Homo sapiens
agcctggatggccc

SEQ ID NO: 972903 - DNA, 15 bp, Homo sapiens
agcctggatggcccc

SEQ ID NO: 972904 - DNA, 14 bp, Homo sapiens
agcctggcacccac

SEQ ID NO: 972905 - DNA, 16 bp, Homo sapiens
agcctggcatctgtgc

SEQ ID NO: 972906 - DNA, 19 bp, Homo sapiens
agcctggccagacaagaag

SEQ ID NO: 972907 - DNA, 16 bp, Homo sapiens
agcctggccatcatgg

SEQ ID NO: 972908 - DNA, 20 bp, Homo sapiens
agcctggccatcatggcgaa

SEQ ID NO: 972909 - DNA, 23 bp, Homo sapiens
agcctggctctgccccctccccc

SEQ ID NO: 972910 - DNA, 17 bp, Homo sapiens
agcctggctgcccatca

SEQ ID NO: 972911 - DNA, 23 bp, Homo sapiens
agcctggctgtccaaccagactt

SEQ ID NO: 972912 - DNA, 12 bp, Homo sapiens
agcctggcttct

SEQ ID NO: 972913 - DNA, 14 bp, Homo sapiens
agcctggcttctgg

SEQ ID NO: 972914 - DNA, 15 bp, Homo sapiens
agcctggcttctgga

SEQ ID NO: 972915 - DNA, 19 bp, Homo sapiens
agcctggcttctggagccc

SEQ ID NO: 972916 - DNA, 20 bp, Homo sapiens
agcctggcttctggagccct

SEQ ID NO: 972917 - DNA, 21 bp, Homo sapiens
agcctggcttctggagccctt

SEQ ID NO: 972918 - DNA, 16 bp, Homo sapiens
agcctgggacacacac

SEQ ID NO: 972919 - DNA, 16 bp, Homo sapiens
agcctgggactcccag

SEQ ID NO: 972920 - DNA, 17 bp, Homo sapiens
agcctgggactcccagt

SEQ ID NO: 972921 - DNA, 11 bp, Homo sapiens
agcctgggcca

SEQ ID NO: 972922 - DNA, 12 bp, Homo sapiens
agcctgggccag

SEQ ID NO: 972923 - DNA, 13 bp, Homo sapiens
agcctgggccaga

SEQ ID NO: 972924 - DNA, 16 bp, Homo sapiens
agcctgggccagagaa

SEQ ID NO: 972925 - DNA, 19 bp, Homo sapiens
agcctgggcccatctccct

SEQ ID NO: 972926 - DNA, 15 bp, Homo sapiens
agcctgggcgacaga

SEQ ID NO: 972927 - DNA, 11 bp, Homo sapiens
agcctgggctc

SEQ ID NO: 972928 - DNA, 19 bp, Homo sapiens
agcctgggctcactgtgct

SEQ ID NO: 972929 - DNA, 22 bp, Homo sapiens
agcctgggctcactgtgctggg

SEQ ID NO: 972930 - DNA, 17 bp, Homo sapiens
agcctgggctccctctt

SEQ ID NO: 972931 - DNA, 21 bp, Homo sapiens
agcctggggcctggggatgta

SEQ ID NO: 972932 - DNA, 14 bp, Homo sapiens
agcctggggctccc

SEQ ID NO: 972933 - DNA, 17 bp, Homo sapiens
agcctggggctctctga

SEQ ID NO: 972934 - DNA, 21 bp, Homo sapiens
agcctggggctctctgacccg

SEQ ID NO: 972935 - DNA, 17 bp, Homo sapiens
agcctggggctgaggct

SEQ ID NO: 972936 - DNA, 16 bp, Homo sapiens
agcctggggtgttctc

SEQ ID NO: 972937 - DNA, 18 bp, Homo sapiens
agcctggggttgtccccg

SEQ ID NO: 972938 - DNA, 19 bp, Homo sapiens
agcctgggtctggatggga

SEQ ID NO: 972939 - DNA, 23 bp, Homo sapiens
agcctgggtctggatgggaggag

SEQ ID NO: 972940 - DNA, 20 bp, Homo sapiens
agcctgggtgacagagcgag

SEQ ID NO: 972941 - DNA, 21 bp, Homo sapiens
agcctgggtgacagagcgaga

SEQ ID NO: 972942 - DNA, 13 bp, Homo sapiens
agcctgggtgaga

SEQ ID NO: 972943 - DNA, 23 bp, Homo sapiens
agcctgggtgagaatcctgcctc

SEQ ID NO: 972944 - DNA, 22 bp, Homo sapiens
agcctggtcccacgagggtgcc

SEQ ID NO: 972945 - DNA, 15 bp, Homo sapiens
agcctggtccttccc

SEQ ID NO: 972946 - DNA, 18 bp, Homo sapiens
agcctggtccttccctga

SEQ ID NO: 972947 - DNA, 22 bp, Homo sapiens
agcctggtccttccctgatggc

SEQ ID NO: 972948 - DNA, 14 bp, Homo sapiens
agcctggtgggcct

SEQ ID NO: 972949 - DNA, 21 bp, Homo sapiens
agcctggtgggcctcctctgt

SEQ ID NO: 972950 - DNA, 14 bp, Homo sapiens
agcctggttcagaa

SEQ ID NO: 972951 - DNA, 24 bp, Homo sapiens
agcctggttcagaataaattgatc

SEQ ID NO: 972952 - DNA, 16 bp, Homo sapiens
agcctggttcagacac

SEQ ID NO: 972953 - DNA, 18 bp, Homo sapiens
agcctggtttttctcaat

SEQ ID NO: 972954 - DNA, 13 bp, Homo sapiens
agcctgtcccagg

SEQ ID NO: 972955 - DNA, 19 bp, Homo sapiens
agcctgtcccatggacact

SEQ ID NO: 972956 - DNA, 14 bp, Homo sapiens
agcctgtccccaga

SEQ ID NO: 972957 - DNA, 15 bp, Homo sapiens
agcctgtccccagac

SEQ ID NO: 972958 - DNA, 16 bp, Homo sapiens
agcctgtccccagacc

SEQ ID NO: 972959 - DNA, 15 bp, Homo sapiens
agcctgtccccgcct

SEQ ID NO: 972960 - DNA, 13 bp, Homo sapiens
agcctgtcctcac

SEQ ID NO: 972961 - DNA, 12 bp, Homo sapiens
agcctgtcctgg

SEQ ID NO: 972962 - DNA, 13 bp, Homo sapiens
agcctgtcctggt

SEQ ID NO: 972963 - DNA, 16 bp, Homo sapiens
agcctgtgaccttggg

SEQ ID NO: 972964 - DNA, 17 bp, Homo sapiens
agcctgtgaccttggga

SEQ ID NO: 972965 - DNA, 13 bp, Homo sapiens
agcctgtgaggga

SEQ ID NO: 972966 - DNA, 12 bp, Homo sapiens
agcctgtgcctc

SEQ ID NO: 972967 - DNA, 21 bp, Homo sapiens
agcctgtgcctctgggactgg

SEQ ID NO: 972968 - DNA, 22 bp, Homo sapiens
agcctgtgctggaccagctggc

SEQ ID NO: 972969 - DNA, 18 bp, Homo sapiens
agcctgtgggagtagaaa

SEQ ID NO: 972970 - DNA, 19 bp, Homo sapiens
agcctgtgttagtgtctgt

SEQ ID NO: 972971 - DNA, 17 bp, Homo sapiens
agcctgttcccctcact

SEQ ID NO: 972972 - DNA, 22 bp, Homo sapiens
agcctgttcccctcactggatg

SEQ ID NO: 972973 - DNA, 15 bp, Homo sapiens
agcctgttgctgaag

SEQ ID NO: 972974 - DNA, 22 bp, Homo sapiens
agcctgttggacccgctctgga

SEQ ID NO: 972975 - DNA, 15 bp, Homo sapiens
agcctgttttcactc

SEQ ID NO: 972976 - DNA, 19 bp, Homo sapiens
agccttaaaatgcattgaa

SEQ ID NO: 972977 - DNA, 14 bp, Homo sapiens
agccttaactaaga

SEQ ID NO: 972978 - DNA, 15 bp, Homo sapiens
agccttaactaagac

SEQ ID NO: 972979 - DNA, 13 bp, Homo sapiens
agccttaagctta

SEQ ID NO: 972980 - DNA, 17 bp, Homo sapiens
agccttaatttgcacag

SEQ ID NO: 972981 - DNA, 18 bp, Homo sapiens
agccttaatttgcacagt

SEQ ID NO: 972982 - DNA, 12 bp, Homo sapiens
agccttaatttt

SEQ ID NO: 972983 - DNA, 20 bp, Homo sapiens
agccttaatttttttttcat

SEQ ID NO: 972984 - DNA, 16 bp, Homo sapiens
agccttagaggtcttt

SEQ ID NO: 972985 - DNA, 23 bp, Homo sapiens
agccccctggatgtcccctgtcc

SEQ ID NO: 972986 - DNA, 18 bp, Homo sapiens
agccccctggcagctgcc

SEQ ID NO: 972987 - DNA, 22 bp, Homo sapiens
agccccctggcagctgcccctc

SEQ ID NO: 972988 - DNA, 23 bp, Homo sapiens
agccccctggcagctgcccctcc

SEQ ID NO: 972989 - DNA, 19 bp, Homo sapiens
agccccgactccagccagc

SEQ ID NO: 972990 - DNA, 14 bp, Homo sapiens
agccccgacttcct

SEQ ID NO: 972991 - DNA, 21 bp, Homo sapiens
agccccgatgattcttaacac

SEQ ID NO: 972992 - DNA, 13 bp, Homo sapiens
agccccgcacggg

SEQ ID NO: 972993 - DNA, 18 bp, Homo sapiens
agccccgcacgggctgtc

SEQ ID NO: 972994 - DNA, 17 bp, Homo sapiens
agccccgccccagccct

SEQ ID NO: 972995 - DNA, 18 bp, Homo sapiens
agccccgccccagccctc

SEQ ID NO: 972996 - DNA, 23 bp, Homo sapiens
agccccgccccgttgtgagctgg

SEQ ID NO: 972997 - DNA, 23 bp, Homo sapiens
agccccgcgaccatgtggccaca

SEQ ID NO: 972998 - DNA, 17 bp, Homo sapiens
agccccgctcccaccta

SEQ ID NO: 972999 - DNA, 22 bp, Homo sapiens
agccccgctcccacctagtgcc

SEQ ID NO: 973000 - DNA, 21 bp, Homo sapiens
agccccgctcctcccctcttg

SEQ ID NO: 973001 - DNA, 18 bp, Homo sapiens
agccccgctgagcttgga

SEQ ID NO: 973002 - DNA, 16 bp, Homo sapiens
agccccggcaagccac

SEQ ID NO: 973003 - DNA, 20 bp, Homo sapiens
agccccggcaagccacagga

SEQ ID NO: 973004 - DNA, 13 bp, Homo sapiens
agcccctaagccc

SEQ ID NO: 973005 - DNA, 21 bp, Homo sapiens
agcccctacccctgccctgct

SEQ ID NO: 973006 - DNA, 15 bp, Homo sapiens
agcccctactgctgt

SEQ ID NO: 973007 - DNA, 16 bp, Homo sapiens
agcccctactgctgtg

SEQ ID NO: 973008 - DNA, 16 bp, Homo sapiens
agcccctagaaaccca

SEQ ID NO: 973009 - DNA, 11 bp, Homo sapiens
agcccctagga

SEQ ID NO: 973010 - DNA, 19 bp, Homo sapiens
agcccctatagcactgagc

SEQ ID NO: 973011 - DNA, 23 bp, Homo sapiens
agcccctatagcactgagctcac

SEQ ID NO: 973012 - DNA, 15 bp, Homo sapiens
agcccctcagccctt

SEQ ID NO: 973013 - DNA, 15 bp, Homo sapiens
agcccctccacgtga

SEQ ID NO: 973014 - DNA, 16 bp, Homo sapiens
agcccctccacgtgat

SEQ ID NO: 973015 - DNA, 14 bp, Homo sapiens
agcccctcccacca

SEQ ID NO: 973016 - DNA, 17 bp, Homo sapiens
agcccctccccagccag

SEQ ID NO: 973017 - DNA, 13 bp, Homo sapiens
agcccctcctcca

SEQ ID NO: 973018 - DNA, 12 bp, Homo sapiens
agcccctcctct

SEQ ID NO: 973019 - DNA, 22 bp, Homo sapiens
agcccctcctctgccacctccc

SEQ ID NO: 973020 - DNA, 19 bp, Homo sapiens
agcccctctcccctctctg

SEQ ID NO: 973021 - DNA, 15 bp, Homo sapiens
agcccctctctcaca

SEQ ID NO: 973022 - DNA, 17 bp, Homo sapiens
agcccctctctcacaca

SEQ ID NO: 973023 - DNA, 19 bp, Homo sapiens
agcccctctggattccctt

SEQ ID NO: 973024 - DNA, 13 bp, Homo sapiens
agcccctctggtc

SEQ ID NO: 973025 - DNA, 21 bp, Homo sapiens
agcccctctggtcgctcctgc

SEQ ID NO: 973026 - DNA, 12 bp, Homo sapiens
agcccctcttcc

SEQ ID NO: 973027 - DNA, 13 bp, Homo sapiens
agcccctcttccc

SEQ ID NO: 973028 - DNA, 14 bp, Homo sapiens
agcccctcttccct

SEQ ID NO: 973029 - DNA, 20 bp, Homo sapiens
agcccctcttgccccccacc

SEQ ID NO: 973030 - DNA, 22 bp, Homo sapiens
agccctgaggtgaaagggagct

SEQ ID NO: 973031 - DNA, 15 bp, Homo sapiens
agccctgcagagcac

SEQ ID NO: 973032 - DNA, 13 bp, Homo sapiens
agccctgcagccc

SEQ ID NO: 973033 - DNA, 18 bp, Homo sapiens
agccctgcagcccaccag

SEQ ID NO: 973034 - DNA, 22 bp, Homo sapiens
agccctgcagcccaccagacgt

SEQ ID NO: 973035 - DNA, 12 bp, Homo sapiens
agccctgcccac

SEQ ID NO: 973036 - DNA, 12 bp, Homo sapiens
agccctgcccca

SEQ ID NO: 973037 - DNA, 15 bp, Homo sapiens
agccctgccccacac

SEQ ID NO: 973038 - DNA, 22 bp, Homo sapiens
agccctgccccacacctcctct

SEQ ID NO: 973039 - DNA, 13 bp, Homo sapiens
agccctgcctctg

SEQ ID NO: 973040 - DNA, 16 bp, Homo sapiens
agccctgcctctgtgt

SEQ ID NO: 973041 - DNA, 14 bp, Homo sapiens
agccctgcctgaga

SEQ ID NO: 973042 - DNA, 19 bp, Homo sapiens
agccctgctttgggctgcc

SEQ ID NO: 973043 - DNA, 23 bp, Homo sapiens
agccctgctttgggctgccctgg

SEQ ID NO: 973044 - DNA, 20 bp, Homo sapiens
agccctggacacccctgctc

SEQ ID NO: 973045 - DNA, 21 bp, Homo sapiens
agccctggacacccctgctct

SEQ ID NO: 973046 - DNA, 12 bp, Homo sapiens
agccctggagac

SEQ ID NO: 973047 - DNA, 11 bp, Homo sapiens
agccctggcag

SEQ ID NO: 973048 - DNA, 14 bp, Homo sapiens
agccctggccaagc

SEQ ID NO: 973049 - DNA, 18 bp, Homo sapiens
agccctggccaagctttg

SEQ ID NO: 973050 - DNA, 13 bp, Homo sapiens
agccctggcccac

SEQ ID NO: 973051 - DNA, 12 bp, Homo sapiens
agccctggctct

SEQ ID NO: 973052 - DNA, 14 bp, Homo sapiens
agccctggctctgc

SEQ ID NO: 973053 - DNA, 15 bp, Homo sapiens
agccctggctctgca

SEQ ID NO: 973054 - DNA, 18 bp, Homo sapiens
agccctggctctgcccct

SEQ ID NO: 973055 - DNA, 21 bp, Homo sapiens
agccctggctctgcccctcag

SEQ ID NO: 973056 - DNA, 13 bp, Homo sapiens
agccctggctggg

SEQ ID NO: 973057 - DNA, 16 bp, Homo sapiens
agccctggctgggttc

SEQ ID NO: 973058 - DNA, 24 bp, Homo sapiens
agccctggctgggttcaggtccca

SEQ ID NO: 973059 - DNA, 12 bp, Homo sapiens
agccctggctgt

SEQ ID NO: 973060 - DNA, 15 bp, Homo sapiens
agccctgggaaccac

SEQ ID NO: 973061 - DNA, 21 bp, Homo sapiens
agccctgggccccaccaccta

SEQ ID NO: 973062 - DNA, 14 bp, Homo sapiens
agccctgggcttgg

SEQ ID NO: 973063 - DNA, 19 bp, Homo sapiens
agccctgggcttggctctt

SEQ ID NO: 973064 - DNA, 12 bp, Homo sapiens
agccctgggttt

SEQ ID NO: 973065 - DNA, 18 bp, Homo sapiens
agccctggttctggctgt

SEQ ID NO: 973066 - DNA, 22 bp, Homo sapiens
agccctggttctggctgtggtc

SEQ ID NO: 973067 - DNA, 24 bp, Homo sapiens
agccctgtacccaccccagcacag

SEQ ID NO: 973068 - DNA, 14 bp, Homo sapiens
agccctgtcagtgc

SEQ ID NO: 973069 - DNA, 17 bp, Homo sapiens
agccctgtcagtgcagc

SEQ ID NO: 973070 - DNA, 19 bp, Homo sapiens
agccctgtcagtgcagccc

SEQ ID NO: 973071 - DNA, 20 bp, Homo sapiens
agccctgtcagtgcagcccg

SEQ ID NO: 973072 - DNA, 17 bp, Homo sapiens
agccctgtcctggtggt

SEQ ID NO: 973073 - DNA, 15 bp, Homo sapiens
agccctgtcctggtt

SEQ ID NO: 973074 - DNA, 17 bp, Homo sapiens
agccctgtcgagacact

SEQ ID NO: 973075 - DNA, 21 bp, Homo sapiens
agccctgtcgagacacttgcc

SEQ ID NO: 973076 - DNA, 12 bp, Homo sapiens
agccctgtggaa

SEQ ID NO: 973077 - DNA, 20 bp, Homo sapiens
agccctgtggccgccacctg

SEQ ID NO: 973078 - DNA, 17 bp, Homo sapiens
agccctgttgacacagg

SEQ ID NO: 973079 - DNA, 18 bp, Homo sapiens
agccctgttgacacaggt

SEQ ID NO: 973080 - DNA, 15 bp, Homo sapiens
agccctgttggcagc

SEQ ID NO: 973081 - DNA, 17 bp, Homo sapiens
agccctgttggcagctc

SEQ ID NO: 973082 - DNA, 20 bp, Homo sapiens
agccctgttggcagctctag

SEQ ID NO: 973083 - DNA, 18 bp, Homo sapiens
agcccttagcacagagag

SEQ ID NO: 973084 - DNA, 22 bp, Homo sapiens
agcccttatgcggttaattttg

SEQ ID NO: 973085 - DNA, 13 bp, Homo sapiens
agcccttcatttg

SEQ ID NO: 973086 - DNA, 14 bp, Homo sapiens
agcccttcatttgg

SEQ ID NO: 973087 - DNA, 13 bp, Homo sapiens
agcccttccagcc

SEQ ID NO: 973088 - DNA, 14 bp, Homo sapiens
agcccttccagcct

SEQ ID NO: 973089 - DNA, 19 bp, Homo sapiens
agcccttccatgtcgcctc

SEQ ID NO: 973090 - DNA, 11 bp, Homo sapiens
agcccttccct

SEQ ID NO: 973091 - DNA, 12 bp, Homo sapiens
agcccttccctg

SEQ ID NO: 973092 - DNA, 23 bp, Homo sapiens
agcccttccctgagtgcgggctg

SEQ ID NO: 973093 - DNA, 17 bp, Homo sapiens
agcccttccctggcccc

SEQ ID NO: 973094 - DNA, 14 bp, Homo sapiens
agcccttcctcctg

SEQ ID NO: 973095 - DNA, 20 bp, Homo sapiens
agcccttccttgggcgtctc

SEQ ID NO: 973096 - DNA, 21 bp, Homo sapiens
agcccttccttgggcgtctcc

SEQ ID NO: 973097 - DNA, 20 bp, Homo sapiens
agcccttgcccccatccctc

SEQ ID NO: 973098 - DNA, 12 bp, Homo sapiens
agcccttgggtt

SEQ ID NO: 973099 - DNA, 23 bp, Homo sapiens
agcccttgtgtgtgccctgggcc

SEQ ID NO: 973100 - DNA, 14 bp, Homo sapiens
agccctttaaaacg

SEQ ID NO: 973101 - DNA, 12 bp, Homo sapiens
agccctttctgt

SEQ ID NO: 973102 - DNA, 15 bp, Homo sapiens
agccctttgctctga

SEQ ID NO: 973103 - DNA, 22 bp, Homo sapiens
agccctttgctctgatttcctt

SEQ ID NO: 973104 - DNA, 17 bp, Homo sapiens
agccctttgctctggag

SEQ ID NO: 973105 - DNA, 21 bp, Homo sapiens
agccctttgctctggaggaag

SEQ ID NO: 973106 - DNA, 15 bp, Homo sapiens
agccctttggagaac

SEQ ID NO: 973107 - DNA, 15 bp, Homo sapiens
agccgaccctcctgg

SEQ ID NO: 973108 - DNA, 20 bp, Homo sapiens
agccgaccctcctggccttc

SEQ ID NO: 973109 - DNA, 12 bp, Homo sapiens
agccgacctcag

SEQ ID NO: 973110 - DNA, 15 bp, Homo sapiens
agccgactctggccc

SEQ ID NO: 973111 - DNA, 21 bp, Homo sapiens
agccgactctggccctggccc

SEQ ID NO: 973112 - DNA, 14 bp, Homo sapiens
agccgagagcctgc

SEQ ID NO: 973113 - DNA, 17 bp, Homo sapiens
agccgagccgggcctgg

SEQ ID NO: 973114 - DNA, 19 bp, Homo sapiens
agccgatatcagaatttgt

SEQ ID NO: 973115 - DNA, 15 bp, Homo sapiens
agccgattctctgcc

SEQ ID NO: 973116 - DNA, 17 bp, Homo sapiens
agccactgcacctgacc

SEQ ID NO: 973117 - DNA, 20 bp, Homo sapiens
agccactgcacctgcccagc

SEQ ID NO: 973118 - DNA, 15 bp, Homo sapiens
agccactgccaagct

SEQ ID NO: 973119 - DNA, 19 bp, Homo sapiens
agccactgccaagcttcct

SEQ ID NO: 973120 - DNA, 22 bp, Homo sapiens
agccactgccaagcttcctgtg

SEQ ID NO: 973121 - DNA, 23 bp, Homo sapiens
agccactgccaagcttcctgtgc

SEQ ID NO: 973122 - DNA, 18 bp, Homo sapiens
agccactgcctctccctc

SEQ ID NO: 973123 - DNA, 15 bp, Homo sapiens
agccactgcgcccag

SEQ ID NO: 973124 - DNA, 11 bp, Homo sapiens
agccactgggc

SEQ ID NO: 973125 - DNA, 17 bp, Homo sapiens
agccactgggcccctgt

SEQ ID NO: 973126 - DNA, 17 bp, Homo sapiens
agccactgtgcttggcc

SEQ ID NO: 973127 - DNA, 13 bp, Homo sapiens
agccacttctccc

SEQ ID NO: 973128 - DNA, 17 bp, Homo sapiens
agccacttctccccaga

SEQ ID NO: 973129 - DNA, 21 bp, Homo sapiens
agccacttctggcttcagccc

SEQ ID NO: 973130 - DNA, 14 bp, Homo sapiens
agccacttggccca

SEQ ID NO: 973131 - DNA, 21 bp, Homo sapiens
agccacttgtcttgaaaactg

SEQ ID NO: 973132 - DNA, 12 bp, Homo sapiens
agccacttgtga

SEQ ID NO: 973133 - DNA, 21 bp, Homo sapiens
agccagaaagcactacaatca

SEQ ID NO: 973134 - DNA, 23 bp, Homo sapiens
agccagaaataaagttggtgaca

SEQ ID NO: 973135 - DNA, 23 bp, Homo sapiens
agccagaaggggctgcttgcttt

SEQ ID NO: 973136 - DNA, 20 bp, Homo sapiens
agccagacaaaatttgagaa

SEQ ID NO: 973137 - DNA, 21 bp, Homo sapiens
agccagacagcaacggggagg

SEQ ID NO: 973138 - DNA, 22 bp, Homo sapiens
agccagacagccccaagcttct

SEQ ID NO: 973139 - DNA, 15 bp, Homo sapiens
agccagaccagcagg

SEQ ID NO: 973140 - DNA, 15 bp, Homo sapiens
agccagagaggagca

SEQ ID NO: 973141 - DNA, 18 bp, Homo sapiens
agccagagaggagcacct

SEQ ID NO: 973142 - DNA, 14 bp, Homo sapiens
agccagagccccaa

SEQ ID NO: 973143 - DNA, 15 bp, Homo sapiens
agccagagcccttca

SEQ ID NO: 973144 - DNA, 17 bp, Homo sapiens
agccagagcccttcact

SEQ ID NO: 973145 - DNA, 12 bp, Homo sapiens
agccagagctgg

SEQ ID NO: 973146 - DNA, 20 bp, Homo sapiens
agccagagctgggtggggac

SEQ ID NO: 973147 - DNA, 15 bp, Homo sapiens
agccagagctgtgcc

SEQ ID NO: 973148 - DNA, 21 bp, Homo sapiens
agccagagctgtgcctgctca

SEQ ID NO: 973149 - DNA, 21 bp, Homo sapiens
agccagaggagggcagaggga

SEQ ID NO: 973150 - DNA, 22 bp, Homo sapiens
agccagaggagggcagagggag

SEQ ID NO: 973151 - DNA, 12 bp, Homo sapiens
agccagagtgta

SEQ ID NO: 973152 - DNA, 14 bp, Homo sapiens
agccagatccaccc

SEQ ID NO: 973153 - DNA, 22 bp, Homo sapiens
agccagatggactccagcctgc

SEQ ID NO: 973154 - DNA, 22 bp, Homo sapiens
agccagattttttaaaatttat

SEQ ID NO: 973155 - DNA, 15 bp, Homo sapiens
agccagcaagtaagc

SEQ ID NO: 973156 - DNA, 18 bp, Homo sapiens
agccagcacacagggcag

SEQ ID NO: 973157 - DNA, 18 bp, Homo sapiens
agccagcagcaaaaacta

SEQ ID NO: 973158 - DNA, 21 bp, Homo sapiens
agccagcagcagcccaagctt

SEQ ID NO: 973159 - DNA, 13 bp, Homo sapiens
agccagcagcagg

SEQ ID NO: 973160 - DNA, 13 bp, Homo sapiens
agccagcagccag

SEQ ID NO: 973161 - DNA, 20 bp, Homo sapiens
agccagcattcagcacacac

SEQ ID NO: 973162 - DNA, 19 bp, Homo sapiens
agccagccaagctttaaat

SEQ ID NO: 973163 - DNA, 20 bp, Homo sapiens
agccagccaagctttaaatt

SEQ ID NO: 973164 - DNA, 15 bp, Homo sapiens
agccagccacccctg

SEQ ID NO: 973165 - DNA, 16 bp, Homo sapiens
agccagccacccctgc

SEQ ID NO: 973166 - DNA, 18 bp, Homo sapiens
agccagccacccctgcca

SEQ ID NO: 973167 - DNA, 12 bp, Homo sapiens
agccagcccagc

SEQ ID NO: 973168 - DNA, 14 bp, Homo sapiens
agccagcccagccc

SEQ ID NO: 973169 - DNA, 16 bp, Homo sapiens
agccagcccagcccag

SEQ ID NO: 973170 - DNA, 20 bp, Homo sapiens
agccagcccatggcccccaa

SEQ ID NO: 973171 - DNA, 16 bp, Homo sapiens
agccagccccctccag

SEQ ID NO: 973172 - DNA, 21 bp, Homo sapiens
agccagccccctccagctcat

SEQ ID NO: 973173 - DNA, 22 bp, Homo sapiens
agccagccccctccagctcatg

SEQ ID NO: 973174 - DNA, 15 bp, Homo sapiens
agccagccctccctg

SEQ ID NO: 973175 - DNA, 21 bp, Homo sapiens
agcccataaggccagaaactc

SEQ ID NO: 973176 - DNA, 15 bp, Homo sapiens
agcccatactcagcc

SEQ ID NO: 973177 - DNA, 17 bp, Homo sapiens
agcccatactcagcctg

SEQ ID NO: 973178 - DNA, 19 bp, Homo sapiens
agcccatagctattttcct

SEQ ID NO: 973179 - DNA, 20 bp, Homo sapiens
agcccatagctattttcctt

SEQ ID NO: 973180 - DNA, 19 bp, Homo sapiens
agcccataggccaccccct

SEQ ID NO: 973181 - DNA, 23 bp, Homo sapiens
agcccatcctgaccagctgctcc

SEQ ID NO: 973182 - DNA, 17 bp, Homo sapiens
agcccatgagtccttga

SEQ ID NO: 973183 - DNA, 11 bp, Homo sapiens
agcccatgccc

SEQ ID NO: 973184 - DNA, 20 bp, Homo sapiens
agcccatgcccacctgccca

SEQ ID NO: 973185 - DNA, 13 bp, Homo sapiens
agcccatggcccc

SEQ ID NO: 973186 - DNA, 19 bp, Homo sapiens
agcccatggcccccaataa

SEQ ID NO: 973187 - DNA, 13 bp, Homo sapiens
agcccatgtcttc

SEQ ID NO: 973188 - DNA, 17 bp, Homo sapiens
agcccatgtcttctgct

SEQ ID NO: 973189 - DNA, 22 bp, Homo sapiens
agcccatgtcttctgctgttct

SEQ ID NO: 973190 - DNA, 22 bp, Homo sapiens
agcccatgttctgcccccagcc

SEQ ID NO: 973191 - DNA, 18 bp, Homo sapiens
agcccattctctctcctg

SEQ ID NO: 973192 - DNA, 16 bp, Homo sapiens
agcccattcttctggg

SEQ ID NO: 973193 - DNA, 15 bp, Homo sapiens
agcccattgctgcca

SEQ ID NO: 973194 - DNA, 19 bp, Homo sapiens
agcccattggccgagctcc

SEQ ID NO: 973195 - DNA, 22 bp, Homo sapiens
agcccattggccgagctcctgg

SEQ ID NO: 973196 - DNA, 14 bp, Homo sapiens
agccccaagtcctg

SEQ ID NO: 973197 - DNA, 19 bp, Homo sapiens
agccccaagtcctgaagag

SEQ ID NO: 973198 - DNA, 17 bp, Homo sapiens
agccccaccctggccta

SEQ ID NO: 973199 - DNA, 23 bp, Homo sapiens
agccccacctctccaagtctctc

SEQ ID NO: 973200 - DNA, 18 bp, Homo sapiens
agccccactgccagcagc

SEQ ID NO: 973201 - DNA, 20 bp, Homo sapiens
agccccacttcacccccaac

SEQ ID NO: 973202 - DNA, 12 bp, Homo sapiens
agccccagcact

SEQ ID NO: 973203 - DNA, 21 bp, Homo sapiens
agccccagcccagccccactc

SEQ ID NO: 973204 - DNA, 20 bp, Homo sapiens
agccccaggcaggctgtgcg

SEQ ID NO: 973205 - DNA, 16 bp, Homo sapiens
agccccaggcctctgt

SEQ ID NO: 973206 - DNA, 21 bp, Homo sapiens
agccccaggcctctgtgtcct

SEQ ID NO: 973207 - DNA, 13 bp, Homo sapiens
agccccaggcctg

SEQ ID NO: 973208 - DNA, 18 bp, Homo sapiens
agccccagggatcactgg

SEQ ID NO: 973209 - DNA, 14 bp, Homo sapiens
agccccagggcctg

SEQ ID NO: 973210 - DNA, 15 bp, Homo sapiens
agccccagggcctgc

SEQ ID NO: 973211 - DNA, 17 bp, Homo sapiens
agccccagggcctgggg

SEQ ID NO: 973212 - DNA, 20 bp, Homo sapiens
agccccagggcctgggggca

SEQ ID NO: 973213 - DNA, 23 bp, Homo sapiens
agccccagggtcttccctacctc

SEQ ID NO: 973214 - DNA, 18 bp, Homo sapiens
agccccagggtgcccaga

SEQ ID NO: 973215 - DNA, 15 bp, Homo sapiens
agccccagtcttcct

SEQ ID NO: 973216 - DNA, 21 bp, Homo sapiens
agccccagtcttccttgtctc

SEQ ID NO: 973217 - DNA, 19 bp, Homo sapiens
agccccatcagaacctgag

SEQ ID NO: 973218 - DNA, 16 bp, Homo sapiens
agccccattcctggga

SEQ ID NO: 973219 - DNA, 17 bp, Homo sapiens
agcccccaacacaggca

SEQ ID NO: 973220 - DNA, 18 bp, Homo sapiens
agcccccaccacaaactt

SEQ ID NO: 973221 - DNA, 20 bp, Homo sapiens
agcccccaccagcagcacaa

SEQ ID NO: 973222 - DNA, 16 bp, Homo sapiens
agcccccaccagggga

SEQ ID NO: 973223 - DNA, 18 bp, Homo sapiens
agcccccaccaggggaag

SEQ ID NO: 973224 - DNA, 22 bp, Homo sapiens
agcccccaccggaactgggctg

SEQ ID NO: 973225 - DNA, 18 bp, Homo sapiens
agcccccagatagagctg

SEQ ID NO: 973226 - DNA, 17 bp, Homo sapiens
agcccccagcagaggca

SEQ ID NO: 973227 - DNA, 23 bp, Homo sapiens
agcccccagcagaggcaggctgg

SEQ ID NO: 973228 - DNA, 13 bp, Homo sapiens
agcccccagccct

SEQ ID NO: 973229 - DNA, 16 bp, Homo sapiens
agcccccagccctggg

SEQ ID NO: 973230 - DNA, 13 bp, Homo sapiens
agcccccagcctt

SEQ ID NO: 973231 - DNA, 12 bp, Homo sapiens
agcccccagggc

SEQ ID NO: 973232 - DNA, 15 bp, Homo sapiens
agcccccagggcccc

SEQ ID NO: 973233 - DNA, 17 bp, Homo sapiens
agcccccagggcctcca

SEQ ID NO: 973234 - DNA, 20 bp, Homo sapiens
agcccccagggcctccaggg

SEQ ID NO: 973235 - DNA, 21 bp, Homo sapiens
agcccccagggcctccagggc

SEQ ID NO: 973236 - DNA, 14 bp, Homo sapiens
agccccccagcact

SEQ ID NO: 973237 - DNA, 22 bp, Homo sapiens
agcccccccaacactgtgccct

SEQ ID NO: 973238 - DNA, 15 bp, Homo sapiens
agcccccccacccac

SEQ ID NO: 973239 - DNA, 17 bp, Homo sapiens
agcccccccacccaccc

SEQ ID NO: 973240 - DNA, 23 bp, Homo sapiens
agcccccccacccacccccaggc

SEQ ID NO: 973241 - DNA, 23 bp, Homo sapiens
agcccccccactccagcccgcag

SEQ ID NO: 973242 - DNA, 14 bp, Homo sapiens
agcccccccctcaa

SEQ ID NO: 973243 - DNA, 15 bp, Homo sapiens
agcccccctttggca

SEQ ID NO: 973244 - DNA, 21 bp, Homo sapiens
agcccccctttggcactggat

SEQ ID NO: 973245 - DNA, 17 bp, Homo sapiens
agcccccgccccagagt

SEQ ID NO: 973246 - DNA, 15 bp, Homo sapiens
agccccctccacacc

SEQ ID NO: 973247 - DNA, 22 bp, Homo sapiens
agccccctccacaccagtggcc

SEQ ID NO: 973248 - DNA, 20 bp, Homo sapiens
agccccctggatgtcccctg

SEQ ID NO: 973249 - DNA, 16 bp, Homo sapiens
agcatgccccttggct

SEQ ID NO: 973250 - DNA, 19 bp, Homo sapiens
agcatgccccttggctgga

SEQ ID NO: 973251 - DNA, 15 bp, Homo sapiens
agcatgcttcctttc

SEQ ID NO: 973252 - DNA, 21 bp, Homo sapiens
agcatgcttcctttctctcct

SEQ ID NO: 973253 - DNA, 22 bp, Homo sapiens
agcatgcttcctttctctcctg

SEQ ID NO: 973254 - DNA, 23 bp, Homo sapiens
agcatgcttcctttctctcctgg

SEQ ID NO: 973255 - DNA, 14 bp, Homo sapiens
agcatgcttgggct

SEQ ID NO: 973256 - DNA, 18 bp, Homo sapiens
agcatgcttgggctgacc

SEQ ID NO: 973257 - DNA, 16 bp, Homo sapiens
agcatggaaaaatggt

SEQ ID NO: 973258 - DNA, 19 bp, Homo sapiens
agcatggaacacttcgagt

SEQ ID NO: 973259 - DNA, 18 bp, Homo sapiens
agcatggacatttagaag

SEQ ID NO: 973260 - DNA, 18 bp, Homo sapiens
agcatggactctgggttt

SEQ ID NO: 973261 - DNA, 22 bp, Homo sapiens
agcatggagagcctcttagtga

SEQ ID NO: 973262 - DNA, 19 bp, Homo sapiens
agcatggaggaggagggag

SEQ ID NO: 973263 - DNA, 13 bp, Homo sapiens
agcatggcagctg

SEQ ID NO: 973264 - DNA, 17 bp, Homo sapiens
agcatggcatagccccg

SEQ ID NO: 973265 - DNA, 15 bp, Homo sapiens
agcatggctagattt

SEQ ID NO: 973266 - DNA, 15 bp, Homo sapiens
agcatggctatttta

SEQ ID NO: 973267 - DNA, 18 bp, Homo sapiens
agcatggctcaaagtgca

SEQ ID NO: 973268 - DNA, 14 bp, Homo sapiens
agcatggctgtctg

SEQ ID NO: 973269 - DNA, 20 bp, Homo sapiens
agcatggctgtctgcacaga

SEQ ID NO: 973270 - DNA, 16 bp, Homo sapiens
agcatggggcccctgg

SEQ ID NO: 973271 - DNA, 16 bp, Homo sapiens
agcatggggtttttat

SEQ ID NO: 973272 - DNA, 21 bp, Homo sapiens
agcatgggtccaagagacatg

SEQ ID NO: 973273 - DNA, 17 bp, Homo sapiens
agcatgggtgtgccctt

SEQ ID NO: 973274 - DNA, 20 bp, Homo sapiens
agcatgggtgtgcccttggg

SEQ ID NO: 973275 - DNA, 14 bp, Homo sapiens
agcatggtataatt

SEQ ID NO: 973276 - DNA, 16 bp, Homo sapiens
agcatggtataattga

SEQ ID NO: 973277 - DNA, 17 bp, Homo sapiens
agcatggtccctgcctt

SEQ ID NO: 973278 - DNA, 22 bp, Homo sapiens
agcatgtatgaatgtaaggatg

SEQ ID NO: 973279 - DNA, 17 bp, Homo sapiens
agcatgtcaacttttga

SEQ ID NO: 973280 - DNA, 20 bp, Homo sapiens
agcatgtcaacttttgacta

SEQ ID NO: 973281 - DNA, 22 bp, Homo sapiens
agcatgtctctctgccaagatc

SEQ ID NO: 973282 - DNA, 17 bp, Homo sapiens
agcatgtctctgcttcc

SEQ ID NO: 973283 - DNA, 22 bp, Homo sapiens
agcatgtgccaagattctactc

SEQ ID NO: 973284 - DNA, 16 bp, Homo sapiens
agcatgtgccctcctg

SEQ ID NO: 973285 - DNA, 16 bp, Homo sapiens
agcatgtgccttaatg

SEQ ID NO: 973286 - DNA, 18 bp, Homo sapiens
agcatgtgccttaatgct

SEQ ID NO: 973287 - DNA, 15 bp, Homo sapiens
agcatgtgtcagagt

SEQ ID NO: 973288 - DNA, 17 bp, Homo sapiens
agcatgtgtcagagtgt

SEQ ID NO: 973289 - DNA, 16 bp, Homo sapiens
agcatgtgtcccagga

SEQ ID NO: 973290 - DNA, 16 bp, Homo sapiens
agcatgttgagccagg

SEQ ID NO: 973291 - DNA, 20 bp, Homo sapiens
agcatgttgagccaggcctg

SEQ ID NO: 973292 - DNA, 18 bp, Homo sapiens
agcatgttgctgaggagt

SEQ ID NO: 973293 - DNA, 17 bp, Homo sapiens
agcatgttgttttttca

SEQ ID NO: 973294 - DNA, 19 bp, Homo sapiens
agcatgtttattctgttcc

SEQ ID NO: 973295 - DNA, 14 bp, Homo sapiens
agcattaaaatttt

SEQ ID NO: 973296 - DNA, 16 bp, Homo sapiens
agcattaagcccaatc

SEQ ID NO: 973297 - DNA, 20 bp, Homo sapiens
agcattaagctgttcctgtt

SEQ ID NO: 973298 - DNA, 17 bp, Homo sapiens
agcattacattattaaa

SEQ ID NO: 973299 - DNA, 13 bp, Homo sapiens
agcattactcttt

SEQ ID NO: 973300 - DNA, 17 bp, Homo sapiens
agcattattcttcagaa

SEQ ID NO: 973301 - DNA, 23 bp, Homo sapiens
agcattcaatttattcaagaaaa

SEQ ID NO: 973302 - DNA, 18 bp, Homo sapiens
agcattcacaacttgttt

SEQ ID NO: 973303 - DNA, 21 bp, Homo sapiens
agcattcagaagaaaaagaag

SEQ ID NO: 973304 - DNA, 14 bp, Homo sapiens
agcattcagagagc

SEQ ID NO: 973305 - DNA, 14 bp, Homo sapiens
agcattcagcacac

SEQ ID NO: 973306 - DNA, 19 bp, Homo sapiens
agcattcaggcagcactga

SEQ ID NO: 973307 - DNA, 12 bp, Homo sapiens
agcattccagta

SEQ ID NO: 973308 - DNA, 13 bp, Homo sapiens
agcattccagtaa

SEQ ID NO: 973309 - DNA, 22 bp, Homo sapiens
agcattccctacagcctagggc

SEQ ID NO: 973310 - DNA, 14 bp, Homo sapiens
agcattccttttga

SEQ ID NO: 973311 - DNA, 18 bp, Homo sapiens
agcattctgagctgggct

SEQ ID NO: 973312 - DNA, 20 bp, Homo sapiens
agcattcttgtcacaataaa

SEQ ID NO: 973313 - DNA, 22 bp, Homo sapiens
agcattcttgtcacaataaatg

SEQ ID NO: 973314 - DNA, 24 bp, Homo sapiens
agcattctttggagttaaaatgca

SEQ ID NO: 973315 - DNA, 13 bp, Homo sapiens
agcattgaaaaat

SEQ ID NO: 973316 - DNA, 15 bp, Homo sapiens
agcattgataatctt

SEQ ID NO: 973317 - DNA, 18 bp, Homo sapiens
agcattgataatcttcag

SEQ ID NO: 973318 - DNA, 16 bp, Homo sapiens
agcacagagcctggcc

SEQ ID NO: 973319 - DNA, 20 bp, Homo sapiens
agcacagagcctggccccag

SEQ ID NO: 973320 - DNA, 13 bp, Homo sapiens
agcacagagggct

SEQ ID NO: 973321 - DNA, 21 bp, Homo sapiens
agcacagcagcccctgcacaa

SEQ ID NO: 973322 - DNA, 15 bp, Homo sapiens
agcacagccacctcc

SEQ ID NO: 973323 - DNA, 23 bp, Homo sapiens
agcacagccacctccgccagacc

SEQ ID NO: 973324 - DNA, 23 bp, Homo sapiens
agcacagcccacggggatcacag

SEQ ID NO: 973325 - DNA, 12 bp, Homo sapiens
agcacagcccag

SEQ ID NO: 973326 - DNA, 14 bp, Homo sapiens
agcacagcccaggg

SEQ ID NO: 973327 - DNA, 13 bp, Homo sapiens
agcacagccctgg

SEQ ID NO: 973328 - DNA, 17 bp, Homo sapiens
agcacagccctgggagg

SEQ ID NO: 973329 - DNA, 17 bp, Homo sapiens
agcacagctcctgccag

SEQ ID NO: 973330 - DNA, 18 bp, Homo sapiens
agcacagctcctgccagg

SEQ ID NO: 973331 - DNA, 20 bp, Homo sapiens
agcacagcttgggtcaggtt

SEQ ID NO: 973332 - DNA, 12 bp, Homo sapiens
agcacaggcagc

SEQ ID NO: 973333 - DNA, 15 bp, Homo sapiens
agcacaggcagctgg

SEQ ID NO: 973334 - DNA, 16 bp, Homo sapiens
agcacaggctaatttt

SEQ ID NO: 973335 - DNA, 16 bp, Homo sapiens
agcacaggtcccacct

SEQ ID NO: 973336 - DNA, 20 bp, Homo sapiens
agcacaggtcccacctccag

SEQ ID NO: 973337 - DNA, 12 bp, Homo sapiens
agcacaggtgtc

SEQ ID NO: 973338 - DNA, 17 bp, Homo sapiens
agcacaggtgtctgcct

SEQ ID NO: 973339 - DNA, 21 bp, Homo sapiens
agcacatagagctttttaata

SEQ ID NO: 973340 - DNA, 16 bp, Homo sapiens
agcacatagcttgcct

SEQ ID NO: 973341 - DNA, 14 bp, Homo sapiens
agcacatctctctg

SEQ ID NO: 973342 - DNA, 19 bp, Homo sapiens
agcacatgcgtatatgtgc

SEQ ID NO: 973343 - DNA, 16 bp, Homo sapiens
agcacatgcttagctt

SEQ ID NO: 973344 - DNA, 22 bp, Homo sapiens
agcacatgcttagcttatcttt

SEQ ID NO: 973345 - DNA, 20 bp, Homo sapiens
agcacatggccatagaggcc

SEQ ID NO: 973346 - DNA, 21 bp, Homo sapiens
agcacatggccatagaggccc

SEQ ID NO: 973347 - DNA, 19 bp, Homo sapiens
agcagtctaccctgtcctt

SEQ ID NO: 973348 - DNA, 13 bp, Homo sapiens
agcagtcttgctc

SEQ ID NO: 973349 - DNA, 22 bp, Homo sapiens
agcagtgaaacttgtgctatag

SEQ ID NO: 973350 - DNA, 20 bp, Homo sapiens
agcagtgaatgctagacaga

SEQ ID NO: 973351 - DNA, 16 bp, Homo sapiens
agcagtgagaaaaagc

SEQ ID NO: 973352 - DNA, 23 bp, Homo sapiens
agcagtgagttacagcgagaggc

SEQ ID NO: 973353 - DNA, 13 bp, Homo sapiens
agcagtgatctca

SEQ ID NO: 973354 - DNA, 19 bp, Homo sapiens
agcagtgattgtcttaata

SEQ ID NO: 973355 - DNA, 20 bp, Homo sapiens
agcagtgcctcgaggcaccg

SEQ ID NO: 973356 - DNA, 22 bp, Homo sapiens
agcagtgcctcgaggcaccggc

SEQ ID NO: 973357 - DNA, 20 bp, Homo sapiens
agcagtgccttccataatta

SEQ ID NO: 973358 - DNA, 12 bp, Homo sapiens
agcagtggacac

SEQ ID NO: 973359 - DNA, 16 bp, Homo sapiens
agcagtggatgttagc

SEQ ID NO: 973360 - DNA, 12 bp, Homo sapiens
agcagtggcctt

SEQ ID NO: 973361 - DNA, 19 bp, Homo sapiens
agcagtggccttattgcat

SEQ ID NO: 973362 - DNA, 16 bp, Homo sapiens
agcagtggctggtcca

SEQ ID NO: 973363 - DNA, 17 bp, Homo sapiens
agcagtggctggtccag

SEQ ID NO: 973364 - DNA, 21 bp, Homo sapiens
agcagtgggcaggtggccgcc

SEQ ID NO: 973365 - DNA, 12 bp, Homo sapiens
agcagtggggtg

SEQ ID NO: 973366 - DNA, 15 bp, Homo sapiens
agcagtgtcatcaga

SEQ ID NO: 973367 - DNA, 15 bp, Homo sapiens
agcagtgtcttccat

SEQ ID NO: 973368 - DNA, 20 bp, Homo sapiens
agcagtgtcttccataatgt

SEQ ID NO: 973369 - DNA, 22 bp, Homo sapiens
agcagtgtcttccataatgtat

SEQ ID NO: 973370 - DNA, 21 bp, Homo sapiens
agcagtgtgaggccagggcag

SEQ ID NO: 973371 - DNA, 19 bp, Homo sapiens
agcagtgtgctttgcattt

SEQ ID NO: 973372 - DNA, 22 bp, Homo sapiens
agcagtgtggggggacagacag

SEQ ID NO: 973373 - DNA, 23 bp, Homo sapiens
agcagtgtggggggacagacagg

SEQ ID NO: 973374 - DNA, 17 bp, Homo sapiens
agcagtgttacttgcag

SEQ ID NO: 973375 - DNA, 15 bp, Homo sapiens
agcagttaactttaa

SEQ ID NO: 973376 - DNA, 14 bp, Homo sapiens
agcagttctcccac

SEQ ID NO: 973377 - DNA, 15 bp, Homo sapiens
agcagttgacatcca

SEQ ID NO: 973378 - DNA, 14 bp, Homo sapiens
agcagttggggccc

SEQ ID NO: 973379 - DNA, 21 bp, Homo sapiens
agcagttggggccctcttgcc

SEQ ID NO: 973380 - DNA, 13 bp, Homo sapiens
agcagttgtgtca

SEQ ID NO: 973381 - DNA, 16 bp, Homo sapiens
agcagtttctgtccta

SEQ ID NO: 973382 - DNA, 17 bp, Homo sapiens
agcagtttgtgatatag

SEQ ID NO: 973383 - DNA, 18 bp, Homo sapiens
agcagttttcaagtcaaa

SEQ ID NO: 973384 - DNA, 20 bp, Homo sapiens
agcagttttcccctggcctc

SEQ ID NO: 973385 - DNA, 13 bp, Homo sapiens
agcataaaaacat

SEQ ID NO: 973386 - DNA, 14 bp, Homo sapiens
agcataaaacctaa

SEQ ID NO: 973387 - DNA, 19 bp, Homo sapiens
agcataaaagatcaccttg

SEQ ID NO: 973388 - DNA, 19 bp, Homo sapiens
agcataaataaaactgaat

SEQ ID NO: 973389 - DNA, 15 bp, Homo sapiens
agcataatatgaagc

SEQ ID NO: 973390 - DNA, 19 bp, Homo sapiens
agcataatatgaagccttt

SEQ ID NO: 973391 - DNA, 20 bp, Homo sapiens
agcataatatgaagcctttg

SEQ ID NO: 973392 - DNA, 22 bp, Homo sapiens
agcataattccgaaacaaaact

SEQ ID NO: 973393 - DNA, 17 bp, Homo sapiens
agcataatttaaaaata

SEQ ID NO: 973394 - DNA, 17 bp, Homo sapiens
agcataatttgtttaaa

SEQ ID NO: 973395 - DNA, 20 bp, Homo sapiens
agcataatttgtttaaaatt

SEQ ID NO: 973396 - DNA, 20 bp, Homo sapiens
agcataccagtactcagtat

SEQ ID NO: 973397 - DNA, 19 bp, Homo sapiens
agcatacgtacacatttta

SEQ ID NO: 973398 - DNA, 13 bp, Homo sapiens
agcatactgtgta

SEQ ID NO: 973399 - DNA, 14 bp, Homo sapiens
agcatactttgtaa

SEQ ID NO: 973400 - DNA, 23 bp, Homo sapiens
agcatagccagcattcagcacac

SEQ ID NO: 973401 - DNA, 13 bp, Homo sapiens
agcatagcctgcc

SEQ ID NO: 973402 - DNA, 15 bp, Homo sapiens
agcataggggggagg

SEQ ID NO: 973403 - DNA, 18 bp, Homo sapiens
agcatagtactggcacaa

SEQ ID NO: 973404 - DNA, 15 bp, Homo sapiens
agcatatagattgtc

SEQ ID NO: 973405 - DNA, 20 bp, Homo sapiens
agcatatcgtaaagctgttc

SEQ ID NO: 973406 - DNA, 18 bp, Homo sapiens
agcatatctggtatatgt

SEQ ID NO: 973407 - DNA, 23 bp, Homo sapiens
agcatatgcagccaaccaagatg

SEQ ID NO: 973408 - DNA, 15 bp, Homo sapiens
agcatattttctcta

SEQ ID NO: 973409 - DNA, 21 bp, Homo sapiens
agcatattttctctaggcttt

SEQ ID NO: 973410 - DNA, 13 bp, Homo sapiens
agcatcaagccac

SEQ ID NO: 973411 - DNA, 16 bp, Homo sapiens
agcatcaatcttgtta

SEQ ID NO: 973412 - DNA, 13 bp, Homo sapiens
agcatcacctcag

SEQ ID NO: 973413 - DNA, 19 bp, Homo sapiens
agcatcacctcaggccagg

SEQ ID NO: 973414 - DNA, 14 bp, Homo sapiens
agcatcactgcctt

SEQ ID NO: 973415 - DNA, 16 bp, Homo sapiens
agcatcagagagtgta

SEQ ID NO: 973416 - DNA, 23 bp, Homo sapiens
agcatcagagagtgtacatcatg

SEQ ID NO: 973417 - DNA, 12 bp, Homo sapiens
agcatcagagat

SEQ ID NO: 973418 - DNA, 21 bp, Homo sapiens
agcatcagaggtttgcttcct

SEQ ID NO: 973419 - DNA, 23 bp, Homo sapiens
agcatcagaggtttgcttcctca

SEQ ID NO: 973420 - DNA, 21 bp, Homo sapiens
agcatcagccagtgaatctgt

SEQ ID NO: 973421 - DNA, 18 bp, Homo sapiens
agcaactctccactccat

SEQ ID NO: 973422 - DNA, 21 bp, Homo sapiens
agcaactctccactccatatt

SEQ ID NO: 973423 - DNA, 12 bp, Homo sapiens
agcaactgaata

SEQ ID NO: 973424 - DNA, 13 bp, Homo sapiens
agcaactgaataa

SEQ ID NO: 973425 - DNA, 15 bp, Homo sapiens
agcaactgaataaat

SEQ ID NO: 973426 - DNA, 22 bp, Homo sapiens
agcaactgaataaatacctctt

SEQ ID NO: 973427 - DNA, 15 bp, Homo sapiens
agcaacttgcttcta

SEQ ID NO: 973428 - DNA, 16 bp, Homo sapiens
agcaacttgcttctaa

SEQ ID NO: 973429 - DNA, 20 bp, Homo sapiens
agcaacttttgtgtaatgaa

SEQ ID NO: 973430 - DNA, 12 bp, Homo sapiens
agcaagaaacag

SEQ ID NO: 973431 - DNA, 14 bp, Homo sapiens
agcaagaagaaaat

SEQ ID NO: 973432 - DNA, 15 bp, Homo sapiens
agcaagaagaaaatg

SEQ ID NO: 973433 - DNA, 23 bp, Homo sapiens
agcaagacagagacgcaggaatg

SEQ ID NO: 973434 - DNA, 22 bp, Homo sapiens
agcaagacctcatctgtggagc

SEQ ID NO: 973435 - DNA, 12 bp, Homo sapiens
agcaagactctg

SEQ ID NO: 973436 - DNA, 16 bp, Homo sapiens
agcaagactgttgctc

SEQ ID NO: 973437 - DNA, 20 bp, Homo sapiens
agcaagactttataattcct

SEQ ID NO: 973438 - DNA, 23 bp, Homo sapiens
agcaagagctggcaaaggtggct

SEQ ID NO: 973439 - DNA, 18 bp, Homo sapiens
agcaagatattgatcaaa

SEQ ID NO: 973440 - DNA, 21 bp, Homo sapiens
agcaagatcctgtctttaagg

SEQ ID NO: 973441 - DNA, 17 bp, Homo sapiens
agcaagatgagctgtgc

SEQ ID NO: 973442 - DNA, 18 bp, Homo sapiens
agcaagcagtagcatttg

SEQ ID NO: 973443 - DNA, 22 bp, Homo sapiens
agcaagcagtctaccctgtcct

SEQ ID NO: 973444 - DNA, 20 bp, Homo sapiens
agcaagcatttatgtttatt

SEQ ID NO: 973445 - DNA, 21 bp, Homo sapiens
actatggaaaatcagctgctc

SEQ ID NO: 973446 - DNA, 22 bp, Homo sapiens
actatggtagccagatgataaa

SEQ ID NO: 973447 - DNA, 21 bp, Homo sapiens
actatggtatgctggccagca

SEQ ID NO: 973448 - DNA, 15 bp, Homo sapiens
actatggttcccaat

SEQ ID NO: 973449 - DNA, 14 bp, Homo sapiens
actatgtaacatgt

SEQ ID NO: 973450 - DNA, 18 bp, Homo sapiens
actatgtcgatgcacagt

SEQ ID NO: 973451 - DNA, 15 bp, Homo sapiens
actatgtctgaacat

SEQ ID NO: 973452 - DNA, 17 bp, Homo sapiens
actatgtctgaacatag

SEQ ID NO: 973453 - DNA, 19 bp, Homo sapiens
actatgtctgaacatagaa

SEQ ID NO: 973454 - DNA, 11 bp, Homo sapiens
actatgtgctg

SEQ ID NO: 973455 - DNA, 13 bp, Homo sapiens
actattaaccttt

SEQ ID NO: 973456 - DNA, 13 bp, Homo sapiens
actattacttttc

SEQ ID NO: 973457 - DNA, 21 bp, Homo sapiens
actattagagtatttcccttc

SEQ ID NO: 973458 - DNA, 22 bp, Homo sapiens
actattagagtatttcccttcc

SEQ ID NO: 973459 - DNA, 20 bp, Homo sapiens
actattccccagcagggtct

SEQ ID NO: 973460 - DNA, 21 bp, Homo sapiens
actattccccagcagggtctt

SEQ ID NO: 973461 - DNA, 22 bp, Homo sapiens
actattccctttgacttcagct

SEQ ID NO: 973462 - DNA, 19 bp, Homo sapiens
actattcttaagcactttg

SEQ ID NO: 973463 - DNA, 15 bp, Homo sapiens
actattgaactgtat

SEQ ID NO: 973464 - DNA, 18 bp, Homo sapiens
actattgagccttgcatg

SEQ ID NO: 973465 - DNA, 23 bp, Homo sapiens
actattgagccttgcatgtactt

SEQ ID NO: 973466 - DNA, 20 bp, Homo sapiens
actattgcagacctgtcacc

SEQ ID NO: 973467 - DNA, 21 bp, Homo sapiens
actattggaatctgatatact

SEQ ID NO: 973468 - DNA, 23 bp, Homo sapiens
actattgtgctcagagacactgt

SEQ ID NO: 973469 - DNA, 18 bp, Homo sapiens
actatttaaaattggcac

SEQ ID NO: 973470 - DNA, 12 bp, Homo sapiens
actatttatctg

SEQ ID NO: 973471 - DNA, 12 bp, Homo sapiens
actatttccttt

SEQ ID NO: 973472 - DNA, 11 bp, Homo sapiens
actatttctgt

SEQ ID NO: 973473 - DNA, 15 bp, Homo sapiens
actatttcttcagag

SEQ ID NO: 973474 - DNA, 23 bp, Homo sapiens
actatttgcttatttaataaaga

SEQ ID NO: 973475 - DNA, 16 bp, Homo sapiens
actatttgtctttcag

SEQ ID NO: 973476 - DNA, 13 bp, Homo sapiens
actattttcaaag

SEQ ID NO: 973477 - DNA, 14 bp, Homo sapiens
actattttcaaaga

SEQ ID NO: 973478 - DNA, 23 bp, Homo sapiens
actattttgttttaatctacttt

SEQ ID NO: 973479 - DNA, 17 bp, Homo sapiens
actcaaaacctggagat

SEQ ID NO: 973480 - DNA, 20 bp, Homo sapiens
actcaaaactcttgaaatta

SEQ ID NO: 973481 - DNA, 17 bp, Homo sapiens
actcaaaatatttgtac

SEQ ID NO: 973482 - DNA, 20 bp, Homo sapiens
actcaaaatatttgtacata

SEQ ID NO: 973483 - DNA, 16 bp, Homo sapiens
actcaaaatgacagtt

SEQ ID NO: 973484 - DNA, 16 bp, Homo sapiens
actcaaactcttaaaa

SEQ ID NO: 973485 - DNA, 14 bp, Homo sapiens
actcaaactgagga

SEQ ID NO: 973486 - DNA, 23 bp, Homo sapiens
actcaaactgaggaatttcacct

SEQ ID NO: 973487 - DNA, 15 bp, Homo sapiens
actcaaagatgatgg

SEQ ID NO: 973488 - DNA, 22 bp, Homo sapiens
actcaaagcatgggattattag

SEQ ID NO: 973489 - DNA, 22 bp, Homo sapiens
actcaaatgagccccttcatcc

SEQ ID NO: 973490 - DNA, 16 bp, Homo sapiens
actcaaatgagtaaca

SEQ ID NO: 973491 - DNA, 17 bp, Homo sapiens
actcaaatgagtaacat

SEQ ID NO: 973492 - DNA, 12 bp, Homo sapiens
actcaaatggtg

SEQ ID NO: 973493 - DNA, 19 bp, Homo sapiens
actcaaattaatctttctt

SEQ ID NO: 973494 - DNA, 14 bp, Homo sapiens
actcaaccagagtc

SEQ ID NO: 973495 - DNA, 15 bp, Homo sapiens
actcaaccagagtca

SEQ ID NO: 973496 - DNA, 12 bp, Homo sapiens
actcaagaagga

SEQ ID NO: 973497 - DNA, 17 bp, Homo sapiens
actcaagaagtgaagaa

SEQ ID NO: 973498 - DNA, 17 bp, Homo sapiens
actcaagaggaatctgt

SEQ ID NO: 973499 - DNA, 21 bp, Homo sapiens
actcaagaggaatctgtttct

SEQ ID NO: 973500 - DNA, 15 bp, Homo sapiens
actcaagaggctgag

SEQ ID NO: 973501 - DNA, 15 bp, Homo sapiens
actcaaggggctgga

SEQ ID NO: 973502 - DNA, 17 bp, Homo sapiens
actcaagggtccagaag

SEQ ID NO: 973503 - DNA, 17 bp, Homo sapiens
actcaagtacccattct

SEQ ID NO: 973504 - DNA, 14 bp, Homo sapiens
actcaagtgttaaa

SEQ ID NO: 973505 - DNA, 18 bp, Homo sapiens
actcaagtgttaaattat

SEQ ID NO: 973506 - DNA, 13 bp, Homo sapiens
actcaatattaaa

SEQ ID NO: 973507 - DNA, 17 bp, Homo sapiens
actcaatgcctggagac

SEQ ID NO: 973508 - DNA, 18 bp, Homo sapiens
actcaatgctttatttgt

SEQ ID NO: 973509 - DNA, 19 bp, Homo sapiens
actcaatgctttatttgta

SEQ ID NO: 973510 - DNA, 20 bp, Homo sapiens
actcaatgctttatttgtaa

SEQ ID NO: 973511 - DNA, 16 bp, Homo sapiens
actcaatggatttgat

SEQ ID NO: 973512 - DNA, 18 bp, Homo sapiens
actcaattcaacaatgtg

SEQ ID NO: 973513 - DNA, 18 bp, Homo sapiens
actcacaagaagaccaga

SEQ ID NO: 973514 - DNA, 20 bp, Homo sapiens
actcacaatttaaaatattt

SEQ ID NO: 973515 - DNA, 22 bp, Homo sapiens
actcacaatttaaaatatttcc

SEQ ID NO: 973516 - DNA, 22 bp, Homo sapiens
actcacacaggacccccttccc

SEQ ID NO: 973517 - DNA, 16 bp, Homo sapiens
actcacactctctgca

SEQ ID NO: 973518 - DNA, 21 bp, Homo sapiens
actcacactctctgcagccca

SEQ ID NO: 973519 - DNA, 19 bp, Homo sapiens
actcacagacctggagccc

SEQ ID NO: 973520 - DNA, 22 bp, Homo sapiens
actcacagacctggagcccctg

SEQ ID NO: 973521 - DNA, 13 bp, Homo sapiens
actcaccactgcc

SEQ ID NO: 973522 - DNA, 11 bp, Homo sapiens
actcaccagcc

SEQ ID NO: 973523 - DNA, 14 bp, Homo sapiens
actcaccagcccca

SEQ ID NO: 973524 - DNA, 21 bp, Homo sapiens
actcaccagccccactgccag

SEQ ID NO: 973525 - DNA, 13 bp, Homo sapiens
actcaccagggtc

SEQ ID NO: 973526 - DNA, 19 bp, Homo sapiens
actcaccagggtccgcacc

SEQ ID NO: 973527 - DNA, 15 bp, Homo sapiens
actcaccagtggcct

SEQ ID NO: 973528 - DNA, 17 bp, Homo sapiens
actcaccagtggccttt

SEQ ID NO: 973529 - DNA, 15 bp, Homo sapiens
actcaccccagcctc

SEQ ID NO: 973530 - DNA, 16 bp, Homo sapiens
actcaccccagcctca

SEQ ID NO: 973531 - DNA, 17 bp, Homo sapiens
actcaccccagcctcat

SEQ ID NO: 973532 - DNA, 15 bp, Homo sapiens
actcacccctcagca

SEQ ID NO: 973533 - DNA, 18 bp, Homo sapiens
actcaccctgggagccag

SEQ ID NO: 973534 - DNA, 15 bp, Homo sapiens
actcacccttcctgg

SEQ ID NO: 973535 - DNA, 23 bp, Homo sapiens
actcacctaatgtttatgagcca

SEQ ID NO: 973536 - DNA, 17 bp, Homo sapiens
actcacctctgcctcaa

SEQ ID NO: 973537 - DNA, 20 bp, Homo sapiens
actcacctgctggcccctca

SEQ ID NO: 973538 - DNA, 12 bp, Homo sapiens
actcaccttcta

SEQ ID NO: 973539 - DNA, 23 bp, Homo sapiens
actcacgataaataatcggccca

SEQ ID NO: 973540 - DNA, 17 bp, Homo sapiens
actcactaacagggaga

SEQ ID NO: 973541 - DNA, 22 bp, Homo sapiens
actcactaggcccccacttgcc

SEQ ID NO: 973542 - DNA, 14 bp, Homo sapiens
actcactcactcca

SEQ ID NO: 973543 - DNA, 15 bp, Homo sapiens
actcactcactccaa

SEQ ID NO: 973544 - DNA, 16 bp, Homo sapiens
actcactcactccaag

SEQ ID NO: 973545 - DNA, 16 bp, Homo sapiens
actcactcactcccca

SEQ ID NO: 973546 - DNA, 22 bp, Homo sapiens
actcactccaagaccaccaggg

SEQ ID NO: 973547 - DNA, 15 bp, Homo sapiens
actcactccagccca

SEQ ID NO: 973548 - DNA, 16 bp, Homo sapiens
actcactccttttaaa

SEQ ID NO: 973549 - DNA, 13 bp, Homo sapiens
actcactctgggc

SEQ ID NO: 973550 - DNA, 16 bp, Homo sapiens
agatgcttttctgtct

SEQ ID NO: 973551 - DNA, 17 bp, Homo sapiens
agatgcttttctgtctc

SEQ ID NO: 973552 - DNA, 22 bp, Homo sapiens
agatgcttttctgtctctgcct

SEQ ID NO: 973553 - DNA, 22 bp, Homo sapiens
agatggaaaattcattttttaa

SEQ ID NO: 973554 - DNA, 20 bp, Homo sapiens
agatggaagtcacctttctg

SEQ ID NO: 973555 - DNA, 22 bp, Homo sapiens
agatggaagttgcagtgagctg

SEQ ID NO: 973556 - DNA, 19 bp, Homo sapiens
agatggacacgagccacaa

SEQ ID NO: 973557 - DNA, 19 bp, Homo sapiens
agatggacgcaggccctgt

SEQ ID NO: 973558 - DNA, 14 bp, Homo sapiens
agatggagaggctg

SEQ ID NO: 973559 - DNA, 13 bp, Homo sapiens
agatggagcccat

SEQ ID NO: 973560 - DNA, 16 bp, Homo sapiens
agatggagggcttggc

SEQ ID NO: 973561 - DNA, 18 bp, Homo sapiens
agatggagggcttggccc

SEQ ID NO: 973562 - DNA, 13 bp, Homo sapiens
agatggagtccct

SEQ ID NO: 973563 - DNA, 15 bp, Homo sapiens
agatggataaactga

SEQ ID NO: 973564 - DNA, 22 bp, Homo sapiens
agatggcaagagggtgacagct

SEQ ID NO: 973565 - DNA, 17 bp, Homo sapiens
agatggcagcagtgaag

SEQ ID NO: 973566 - DNA, 17 bp, Homo sapiens
agatggcatcctgtgaa

SEQ ID NO: 973567 - DNA, 13 bp, Homo sapiens
agatggccccaac

SEQ ID NO: 973568 - DNA, 13 bp, Homo sapiens
agatggcccctcc

SEQ ID NO: 973569 - DNA, 21 bp, Homo sapiens
agatggcccctccactgggga

SEQ ID NO: 973570 - DNA, 23 bp, Homo sapiens
agatggcctttgcttatgaatat

SEQ ID NO: 973571 - DNA, 20 bp, Homo sapiens
agatggcgagcatcctggcc

SEQ ID NO: 973572 - DNA, 21 bp, Homo sapiens
agatggctcagagggggactg

SEQ ID NO: 973573 - DNA, 19 bp, Homo sapiens
agatggctgtgcctctgcc

SEQ ID NO: 973574 - DNA, 23 bp, Homo sapiens
agatggctgtgcctctgcctgtc

SEQ ID NO: 973575 - DNA, 12 bp, Homo sapiens
agatggctgtgg

SEQ ID NO: 973576 - DNA, 17 bp, Homo sapiens
agatggcttcggagggc

SEQ ID NO: 973577 - DNA, 22 bp, Homo sapiens
agatggcttcggagggccgcag

SEQ ID NO: 973578 - DNA, 23 bp, Homo sapiens
agatggcttcggagggccgcagg

SEQ ID NO: 973579 - DNA, 17 bp, Homo sapiens
agatgggaggagaccag

SEQ ID NO: 973580 - DNA, 20 bp, Homo sapiens
agatgggaggagaccagcgg

SEQ ID NO: 973581 - DNA, 16 bp, Homo sapiens
agatgggatgcttgcc

SEQ ID NO: 973582 - DNA, 18 bp, Homo sapiens
agatgggcatcttttgta

SEQ ID NO: 973583 - DNA, 22 bp, Homo sapiens
agatgggcatcttttgtattaa

SEQ ID NO: 973584 - DNA, 16 bp, Homo sapiens
agatgggcttgttttc

SEQ ID NO: 973585 - DNA, 17 bp, Homo sapiens
agatgggcttgttttct

SEQ ID NO: 973586 - DNA, 18 bp, Homo sapiens
agatgggcttgttttctt

SEQ ID NO: 973587 - DNA, 12 bp, Homo sapiens
agatggggcacc

SEQ ID NO: 973588 - DNA, 13 bp, Homo sapiens
agatggggcacca

SEQ ID NO: 973589 - DNA, 17 bp, Homo sapiens
agatgggggcagggctg

SEQ ID NO: 973590 - DNA, 14 bp, Homo sapiens
agatgggggcttct

SEQ ID NO: 973591 - DNA, 17 bp, Homo sapiens
agatgggggcttcttcc

SEQ ID NO: 973592 - DNA, 16 bp, Homo sapiens
agatgggtattaaact

SEQ ID NO: 973593 - DNA, 17 bp, Homo sapiens
agatgggtattaaactt

SEQ ID NO: 973594 - DNA, 19 bp, Homo sapiens
agatgggtctggctgagct

SEQ ID NO: 973595 - DNA, 18 bp, Homo sapiens
agatggtactgctgaggt

SEQ ID NO: 973596 - DNA, 18 bp, Homo sapiens
agatggtccatttgttcc

SEQ ID NO: 973597 - DNA, 19 bp, Homo sapiens
agatggtccgtgcccaggc

SEQ ID NO: 973598 - DNA, 15 bp, Homo sapiens
agatggtgaaattta

SEQ ID NO: 973599 - DNA, 11 bp, Homo sapiens
agatggtgctg

SEQ ID NO: 973600 - DNA, 20 bp, Homo sapiens
agatggtggccacagactga

SEQ ID NO: 973601 - DNA, 20 bp, Homo sapiens
agatggtggctgtgtctctc

SEQ ID NO: 973602 - DNA, 14 bp, Homo sapiens
agatggtgtgtcca

SEQ ID NO: 973603 - DNA, 17 bp, Homo sapiens
agatggttaaaaaggcc

SEQ ID NO: 973604 - DNA, 22 bp, Homo sapiens
agatggttaaaaaggccaaaga

SEQ ID NO: 973605 - DNA, 11 bp, Homo sapiens
agatggtttcc

SEQ ID NO: 973606 - DNA, 15 bp, Homo sapiens
agatgtaaaatgagt

SEQ ID NO: 973607 - DNA, 15 bp, Homo sapiens
agatgtaattttgtg

SEQ ID NO: 973608 - DNA, 19 bp, Homo sapiens
agatgtaattttgtgtaag

SEQ ID NO: 973609 - DNA, 17 bp, Homo sapiens
agatgtacttctctgtg

SEQ ID NO: 973610 - DNA, 15 bp, Homo sapiens
agatgtagatttatt

SEQ ID NO: 973611 - DNA, 21 bp, Homo sapiens
agatgtagcaaaacgcatgga

SEQ ID NO: 973612 - DNA, 21 bp, Homo sapiens
agatgtagcattgttccacac

SEQ ID NO: 973613 - DNA, 20 bp, Homo sapiens
agatgtaggggaagagatgt

SEQ ID NO: 973614 - DNA, 23 bp, Homo sapiens
agatgtaggggaagagatgttta

SEQ ID NO: 973615 - DNA, 17 bp, Homo sapiens
agatgtatccttccaat

SEQ ID NO: 973616 - DNA, 15 bp, Homo sapiens
agatgtatgaaggct

SEQ ID NO: 973617 - DNA, 17 bp, Homo sapiens
agatgtatgaaggcttt

SEQ ID NO: 973618 - DNA, 23 bp, Homo sapiens
agatgtatgcacacacatatatt

SEQ ID NO: 973619 - DNA, 20 bp, Homo sapiens
agatgtatgctttgaatgca

SEQ ID NO: 973620 - DNA, 18 bp, Homo sapiens
agatgtcagccgagccgg

SEQ ID NO: 973621 - DNA, 14 bp, Homo sapiens
agatgtcatgagga

SEQ ID NO: 973622 - DNA, 13 bp, Homo sapiens
agatgtccagggc

SEQ ID NO: 973623 - DNA, 16 bp, Homo sapiens
agatgtcccttgatgc

SEQ ID NO: 973624 - DNA, 19 bp, Homo sapiens
agatgtctcagagccttcc

SEQ ID NO: 973625 - DNA, 22 bp, Homo sapiens
agatgtctcctcaagcctgtgg

SEQ ID NO: 973626 - DNA, 23 bp, Homo sapiens
agatgtctcctcaagcctgtggg

SEQ ID NO: 973627 - DNA, 22 bp, Homo sapiens
agatgtctctggcgtgtgggta

SEQ ID NO: 973628 - DNA, 13 bp, Homo sapiens
agatgtctctggg

SEQ ID NO: 973629 - DNA, 15 bp, Homo sapiens
agatgtctctggggc

SEQ ID NO: 973630 - DNA, 18 bp, Homo sapiens
agatgtcttccctgggct

SEQ ID NO: 973631 - DNA, 17 bp, Homo sapiens
agatgtcttctgcctgt

SEQ ID NO: 973632 - DNA, 19 bp, Homo sapiens
agatgtcttctgcctgtta

SEQ ID NO: 973633 - DNA, 18 bp, Homo sapiens
agatgtcttttcccattt

SEQ ID NO: 973634 - DNA, 22 bp, Homo sapiens
agatgtcttttcccatttatct

SEQ ID NO: 973635 - DNA, 16 bp, Homo sapiens
agatgtgaattattga

SEQ ID NO: 973636 - DNA, 18 bp, Homo sapiens
agatgtgaattattgaca

SEQ ID NO: 973637 - DNA, 20 bp, Homo sapiens
agatgtgaattattgacact

SEQ ID NO: 973638 - DNA, 16 bp, Homo sapiens
agatgtgagtcctgtt

SEQ ID NO: 973639 - DNA, 21 bp, Homo sapiens
agatgtgagtcctgttgaaga

SEQ ID NO: 973640 - DNA, 17 bp, Homo sapiens
agatgtgataaggatca

SEQ ID NO: 973641 - DNA, 16 bp, Homo sapiens
agatgtgcaaatgcaa

SEQ ID NO: 973642 - DNA, 18 bp, Homo sapiens
agatgtgcaataatttgt

SEQ ID NO: 973643 - DNA, 19 bp, Homo sapiens
agatgtgcaataatttgta

SEQ ID NO: 973644 - DNA, 21 bp, Homo sapiens
agatgtgcctgtgggaggggg

SEQ ID NO: 973645 - DNA, 20 bp, Homo sapiens
agatgtggatccctttagaa

SEQ ID NO: 973646 - DNA, 21 bp, Homo sapiens
agatgtggccttccatttata

SEQ ID NO: 973647 - DNA, 14 bp, Homo sapiens
agatgtggggatgt

SEQ ID NO: 973648 - DNA, 13 bp, Homo sapiens
agatgtgtaaaca

SEQ ID NO: 973649 - DNA, 16 bp, Homo sapiens
agatgtgtaaacaggt

SEQ ID NO: 973650 - DNA, 18 bp, Homo sapiens
agatgtgtaaacaggtat

SEQ ID NO: 973651 - DNA, 23 bp, Homo sapiens
agatgtgtctgggagagcctggc

SEQ ID NO: 973652 - DNA, 14 bp, Homo sapiens
agatgttaagcatt

SEQ ID NO: 973653 - DNA, 14 bp, Homo sapiens
agatgttaatttac

SEQ ID NO: 973654 - DNA, 16 bp, Homo sapiens
agatgttgaggggagg

SEQ ID NO: 973655 - DNA, 15 bp, Homo sapiens
agatgttgtgtggca

SEQ ID NO: 973656 - DNA, 15 bp, Homo sapiens
agatgtttacagtat

SEQ ID NO: 973657 - DNA, 14 bp, Homo sapiens
agatgtttcacgaa

SEQ ID NO: 973658 - DNA, 22 bp, Homo sapiens
agatgtttcttttgtatgtaaa

SEQ ID NO: 973659 - DNA, 17 bp, Homo sapiens
agatgtttgatagattt

SEQ ID NO: 973660 - DNA, 14 bp, Homo sapiens
agatttctgaggaa

SEQ ID NO: 973661 - DNA, 20 bp, Homo sapiens
agatttcttctctttagtat

SEQ ID NO: 973662 - DNA, 20 bp, Homo sapiens
agatttcttttttatgtgat

SEQ ID NO: 973663 - DNA, 21 bp, Homo sapiens
agatttcttttttatgtgatg

SEQ ID NO: 973664 - DNA, 17 bp, Homo sapiens
agatttgaaaaactttt

SEQ ID NO: 973665 - DNA, 16 bp, Homo sapiens
agatttgaaaattgta

SEQ ID NO: 973666 - DNA, 18 bp, Homo sapiens
agatttgaaaattgtata

SEQ ID NO: 973667 - DNA, 17 bp, Homo sapiens
agatttgaactcttcaa

SEQ ID NO: 973668 - DNA, 15 bp, Homo sapiens
agatttgaccaaatc

SEQ ID NO: 973669 - DNA, 19 bp, Homo sapiens
agatttgacgttgttgtca

SEQ ID NO: 973670 - DNA, 21 bp, Homo sapiens
agatttgattgtgaggcttct

SEQ ID NO: 973671 - DNA, 13 bp, Homo sapiens
agatttgtccttt

SEQ ID NO: 973672 - DNA, 22 bp, Homo sapiens
agatttgttgacagcaaaatgt

SEQ ID NO: 973673 - DNA, 19 bp, Homo sapiens
agatttgtttttaaactgt

SEQ ID NO: 973674 - DNA, 20 bp, Homo sapiens
agatttgtttttaaactgta

SEQ ID NO: 973675 - DNA, 19 bp, Homo sapiens
agattttaatttatttgtt

SEQ ID NO: 973676 - DNA, 14 bp, Homo sapiens
agattttaattttg

SEQ ID NO: 973677 - DNA, 20 bp, Homo sapiens
agattttacaaaagatgtat

SEQ ID NO: 973678 - DNA, 14 bp, Homo sapiens
agattttcatgcaa

SEQ ID NO: 973679 - DNA, 23 bp, Homo sapiens
agatagcccaggagcaacagcct

SEQ ID NO: 973680 - DNA, 17 bp, Homo sapiens
agatagccctgtcctgg

SEQ ID NO: 973681 - DNA, 19 bp, Homo sapiens
agatagccctgtcctggtg

SEQ ID NO: 973682 - DNA, 20 bp, Homo sapiens
agatagctattaagatactt

SEQ ID NO: 973683 - DNA, 13 bp, Homo sapiens
agatagctgcatg

SEQ ID NO: 973684 - DNA, 12 bp, Homo sapiens
agataggcctgt

SEQ ID NO: 973685 - DNA, 15 bp, Homo sapiens
agataggggaggggg

SEQ ID NO: 973686 - DNA, 16 bp, Homo sapiens
agataggggagggggg

SEQ ID NO: 973687 - DNA, 14 bp, Homo sapiens
agatagtaactgta

SEQ ID NO: 973688 - DNA, 14 bp, Homo sapiens
agatagttaaaaga

SEQ ID NO: 973689 - DNA, 18 bp, Homo sapiens
agatagttaaaagactgc

SEQ ID NO: 973690 - DNA, 23 bp, Homo sapiens
agatagttaaaagactgcagctg

SEQ ID NO: 973691 - DNA, 14 bp, Homo sapiens
agatagttttcatc

SEQ ID NO: 973692 - DNA, 15 bp, Homo sapiens
agatataaatggctg

SEQ ID NO: 973693 - DNA, 17 bp, Homo sapiens
agatataactgtcttgt

SEQ ID NO: 973694 - DNA, 18 bp, Homo sapiens
agatataactgtcttgtt

SEQ ID NO: 973695 - DNA, 22 bp, Homo sapiens
agatatataagaaaaaattctt

SEQ ID NO: 973696 - DNA, 14 bp, Homo sapiens
agatatatgtgtat

SEQ ID NO: 973697 - DNA, 20 bp, Homo sapiens
agatatattaaaaatataaa

SEQ ID NO: 973698 - DNA, 21 bp, Homo sapiens
agatatattaaaaatataaaa

SEQ ID NO: 973699 - DNA, 15 bp, Homo sapiens
agatatattaaatgt

SEQ ID NO: 973700 - DNA, 14 bp, Homo sapiens
agatatatttcact

SEQ ID NO: 973701 - DNA, 16 bp, Homo sapiens
agatatatttcacttt

SEQ ID NO: 973702 - DNA, 18 bp, Homo sapiens
agatatcagagctcttaa

SEQ ID NO: 973703 - DNA, 19 bp, Homo sapiens
agatatcagagctcttaat

SEQ ID NO: 973704 - DNA, 19 bp, Homo sapiens
agatatccacataaatgct

SEQ ID NO: 973705 - DNA, 14 bp, Homo sapiens
agatatccatcttt

SEQ ID NO: 973706 - DNA, 13 bp, Homo sapiens
agatatcctctcc

SEQ ID NO: 973707 - DNA, 17 bp, Homo sapiens
agatatcctctccccct

SEQ ID NO: 973708 - DNA, 20 bp, Homo sapiens
agatatcctctccccctcct

SEQ ID NO: 973709 - DNA, 17 bp, Homo sapiens
agatatcttgaaatgaa

SEQ ID NO: 973710 - DNA, 16 bp, Homo sapiens
agatatgatatgtaaa

SEQ ID NO: 973711 - DNA, 13 bp, Homo sapiens
agatatgcaaaag

SEQ ID NO: 973712 - DNA, 12 bp, Homo sapiens
agatatgcctta

SEQ ID NO: 973713 - DNA, 15 bp, Homo sapiens
agatatgccttaaaa

SEQ ID NO: 973714 - DNA, 22 bp, Homo sapiens
agatatggagtgagtcacctgc

SEQ ID NO: 973715 - DNA, 16 bp, Homo sapiens
agatatggcacttctc

SEQ ID NO: 973716 - DNA, 13 bp, Homo sapiens
agatattaaaatt

SEQ ID NO: 973717 - DNA, 19 bp, Homo sapiens
agatattataagggagagc

SEQ ID NO: 973718 - DNA, 19 bp, Homo sapiens
agatattatttgtcttaaa

SEQ ID NO: 973719 - DNA, 20 bp, Homo sapiens
agatattgaggccaagaata

SEQ ID NO: 973720 - DNA, 15 bp, Homo sapiens
agatattgtacataa

SEQ ID NO: 973721 - DNA, 18 bp, Homo sapiens
agatattgtacataaaag

SEQ ID NO: 973722 - DNA, 23 bp, Homo sapiens
agatatttaagtataaaatacaa

SEQ ID NO: 973723 - DNA, 15 bp, Homo sapiens
agatattttgtaaaa

SEQ ID NO: 973724 - DNA, 21 bp, Homo sapiens
agatattttgtaaaatgtatt

SEQ ID NO: 973725 - DNA, 17 bp, Homo sapiens
agatatttttatcttta

SEQ ID NO: 973726 - DNA, 20 bp, Homo sapiens
agatatttttatctttatat

SEQ ID NO: 973727 - DNA, 21 bp, Homo sapiens
agatattttttcagaaatatg

SEQ ID NO: 973728 - DNA, 22 bp, Homo sapiens
agatattttttcagaaatatgt

SEQ ID NO: 973729 - DNA, 13 bp, Homo sapiens
agatattttttct

SEQ ID NO: 973730 - DNA, 16 bp, Homo sapiens
agatcaaaataaaaag

SEQ ID NO: 973731 - DNA, 13 bp, Homo sapiens
agatcaaagatga

SEQ ID NO: 973732 - DNA, 14 bp, Homo sapiens
agatcaaatacttt

SEQ ID NO: 973733 - DNA, 15 bp, Homo sapiens
agatcaaatacttta

SEQ ID NO: 973734 - DNA, 16 bp, Homo sapiens
agatcaaatactttaa

SEQ ID NO: 973735 - DNA, 19 bp, Homo sapiens
agatcaaatagttgcatag

SEQ ID NO: 973736 - DNA, 21 bp, Homo sapiens
agatcaagaaatgtctctgct

SEQ ID NO: 973737 - DNA, 16 bp, Homo sapiens
agatcaagtgggcctt

SEQ ID NO: 973738 - DNA, 23 bp, Homo sapiens
agatcaattacttattttaggaa

SEQ ID NO: 973739 - DNA, 14 bp, Homo sapiens
agatcaatttgtaa

SEQ ID NO: 973740 - DNA, 17 bp, Homo sapiens
agatcacagcctccagg

SEQ ID NO: 973741 - DNA, 18 bp, Homo sapiens
agatcacatcttaaattc

SEQ ID NO: 973742 - DNA, 14 bp, Homo sapiens
agatcaccagcccg

SEQ ID NO: 973743 - DNA, 16 bp, Homo sapiens
agatcaccagcccggc

SEQ ID NO: 973744 - DNA, 21 bp, Homo sapiens
agatcaccagcccggcctgct

SEQ ID NO: 973745 - DNA, 12 bp, Homo sapiens
agatcaccttgt

SEQ ID NO: 973746 - DNA, 14 bp, Homo sapiens
agatcaccttgtat

SEQ ID NO: 973747 - DNA, 22 bp, Homo sapiens
agatcacgccactgcactccag

SEQ ID NO: 973748 - DNA, 13 bp, Homo sapiens
agatcactcctgg

SEQ ID NO: 973749 - DNA, 19 bp, Homo sapiens
agatcactttctcagtttt

SEQ ID NO: 973750 - DNA, 20 bp, Homo sapiens
agatcagcaaaccggggcct

SEQ ID NO: 973751 - DNA, 12 bp, Homo sapiens
agatcagccatt

SEQ ID NO: 973752 - DNA, 16 bp, Homo sapiens
agatcagccattaaaa

SEQ ID NO: 973753 - DNA, 18 bp, Homo sapiens
agatcagccattaaaata

SEQ ID NO: 973754 - DNA, 22 bp, Homo sapiens
agatcagccattaaaataaaac

SEQ ID NO: 973755 - DNA, 15 bp, Homo sapiens
agatcagcctgggca

SEQ ID NO: 973756 - DNA, 15 bp, Homo sapiens
agatcaggaaccagg

SEQ ID NO: 973757 - DNA, 20 bp, Homo sapiens
agatcaggaattctaaataa

SEQ ID NO: 973758 - DNA, 12 bp, Homo sapiens
agatcaggtttg

SEQ ID NO: 973759 - DNA, 16 bp, Homo sapiens
agatcatatacgtgaa

SEQ ID NO: 973760 - DNA, 14 bp, Homo sapiens
agatcatccgtctg

SEQ ID NO: 973761 - DNA, 14 bp, Homo sapiens
agatcatgcataga

SEQ ID NO: 973762 - DNA, 20 bp, Homo sapiens
agatccaaggccgcggccca

SEQ ID NO: 973763 - DNA, 14 bp, Homo sapiens
agatccacacacag

SEQ ID NO: 973764 - DNA, 18 bp, Homo sapiens
agatccacgtgtggcctc

SEQ ID NO: 973765 - DNA, 15 bp, Homo sapiens
agatccagactgtaa

SEQ ID NO: 973766 - DNA, 14 bp, Homo sapiens
agatcccatgtcac

SEQ ID NO: 973767 - DNA, 18 bp, Homo sapiens
agatcccatgtcacctca

SEQ ID NO: 973768 - DNA, 19 bp, Homo sapiens
agatcccgcctcttcttct

SEQ ID NO: 973769 - DNA, 19 bp, Homo sapiens
agatccgggagactgacac

SEQ ID NO: 973770 - DNA, 21 bp, Homo sapiens
agatcctagggcacttctagt

SEQ ID NO: 973771 - DNA, 21 bp, Homo sapiens
agatcctctttactctgggca

SEQ ID NO: 973772 - DNA, 15 bp, Homo sapiens
agatcctgagctcac

SEQ ID NO: 973773 - DNA, 15 bp, Homo sapiens
agatcctgcacccca

SEQ ID NO: 973774 - DNA, 21 bp, Homo sapiens
agatcctgtctttaaggaaaa

SEQ ID NO: 973775 - DNA, 20 bp, Homo sapiens
agatcctgttacttgcttca

SEQ ID NO: 973776 - DNA, 16 bp, Homo sapiens
agatcctgtttcagct

SEQ ID NO: 973777 - DNA, 19 bp, Homo sapiens
agatccttttccagaaata

SEQ ID NO: 973778 - DNA, 20 bp, Homo sapiens
agatcgacaccatcctggct

SEQ ID NO: 973779 - DNA, 16 bp, Homo sapiens
agatcgagaccatcct

SEQ ID NO: 973780 - DNA, 18 bp, Homo sapiens
agatcgagaccatcctgg

SEQ ID NO: 973781 - DNA, 18 bp, Homo sapiens
agatcgaggctacagtga

SEQ ID NO: 973782 - DNA, 15 bp, Homo sapiens
agatcgcagtttgcc

SEQ ID NO: 973783 - DNA, 17 bp, Homo sapiens
agatcgcgccactgcac

SEQ ID NO: 973784 - DNA, 18 bp, Homo sapiens
agatcgcttgagcccagg

SEQ ID NO: 973785 - DNA, 19 bp, Homo sapiens
agatcgcttgagcccagga

SEQ ID NO: 973786 - DNA, 16 bp, Homo sapiens
agatcggccacagggc

SEQ ID NO: 973787 - DNA, 15 bp, Homo sapiens
agatcgttcattgcc

SEQ ID NO: 973788 - DNA, 18 bp, Homo sapiens
agatctaccccagggaga

SEQ ID NO: 973789 - DNA, 12 bp, Homo sapiens
agatctcccact

SEQ ID NO: 973790 - DNA, 15 bp, Homo sapiens
agatctcctgtattc

SEQ ID NO: 973791 - DNA, 18 bp, Homo sapiens
agatctcctgtattcttg

SEQ ID NO: 973792 - DNA, 16 bp, Homo sapiens
agatctcggtttgcca

SEQ ID NO: 973793 - DNA, 22 bp, Homo sapiens
agatctcggtttgccaaaattc

SEQ ID NO: 973794 - DNA, 14 bp, Homo sapiens
agatctctcctgca

SEQ ID NO: 973795 - DNA, 15 bp, Homo sapiens
agatctctcctgcaa

SEQ ID NO: 973796 - DNA, 12 bp, Homo sapiens
agatctctctct

SEQ ID NO: 973797 - DNA, 15 bp, Homo sapiens
agatctctgtcacat

SEQ ID NO: 973798 - DNA, 17 bp, Homo sapiens
agatctgaacccagctg

SEQ ID NO: 973799 - DNA, 18 bp, Homo sapiens
agatctgaaggggcgggg

SEQ ID NO: 973800 - DNA, 14 bp, Homo sapiens
agatctgactgcca

SEQ ID NO: 973801 - DNA, 20 bp, Homo sapiens
agatgctgaatatctgttca

SEQ ID NO: 973802 - DNA, 15 bp, Homo sapiens
agatgctgactggca

SEQ ID NO: 973803 - DNA, 13 bp, Homo sapiens
agatgctgggttg

SEQ ID NO: 973804 - DNA, 15 bp, Homo sapiens
agatgctggttttct

SEQ ID NO: 973805 - DNA, 20 bp, Homo sapiens
agatgctgtaacttaaaata

SEQ ID NO: 973806 - DNA, 22 bp, Homo sapiens
agatgctgtcactggcagagca

SEQ ID NO: 973807 - DNA, 23 bp, Homo sapiens
agatgctgtcattagtctatatg

SEQ ID NO: 973808 - DNA, 22 bp, Homo sapiens
agatgcttgcggcaaaaggaaa

SEQ ID NO: 973809 - DNA, 21 bp, Homo sapiens
agagctgaggatttcctggag

SEQ ID NO: 973810 - DNA, 17 bp, Homo sapiens
agagctgagggccctgt

SEQ ID NO: 973811 - DNA, 14 bp, Homo sapiens
agagctgatccaga

SEQ ID NO: 973812 - DNA, 14 bp, Homo sapiens
agagctgctctgga

SEQ ID NO: 973813 - DNA, 14 bp, Homo sapiens
agagctggaaggca

SEQ ID NO: 973814 - DNA, 22 bp, Homo sapiens
agagctggaaggcagggcagag

SEQ ID NO: 973815 - DNA, 17 bp, Homo sapiens
agagctggagcccccag

SEQ ID NO: 973816 - DNA, 22 bp, Homo sapiens
agagctggagcccccagcagag

SEQ ID NO: 973817 - DNA, 23 bp, Homo sapiens
agagctggagcccccagcagagg

SEQ ID NO: 973818 - DNA, 12 bp, Homo sapiens
agagctggcctc

SEQ ID NO: 973819 - DNA, 13 bp, Homo sapiens
agagctggcctcc

SEQ ID NO: 973820 - DNA, 17 bp, Homo sapiens
agagctggcctccccca

SEQ ID NO: 973821 - DNA, 13 bp, Homo sapiens
agagctggctctg

SEQ ID NO: 973822 - DNA, 16 bp, Homo sapiens
agagctggctctgagc

SEQ ID NO: 973823 - DNA, 18 bp, Homo sapiens
agagctgggaaattcatg

SEQ ID NO: 973824 - DNA, 20 bp, Homo sapiens
agagctggggctgccagcct

SEQ ID NO: 973825 - DNA, 15 bp, Homo sapiens
agagctggtgcccgg

SEQ ID NO: 973826 - DNA, 15 bp, Homo sapiens
agagctggtgtctga

SEQ ID NO: 973827 - DNA, 18 bp, Homo sapiens
agagctgtattaagtgac

SEQ ID NO: 973828 - DNA, 22 bp, Homo sapiens
agagctgtattaagtgactgac

SEQ ID NO: 973829 - DNA, 11 bp, Homo sapiens
agagctgtgcc

SEQ ID NO: 973830 - DNA, 17 bp, Homo sapiens
agagctgtgcctgctca

SEQ ID NO: 973831 - DNA, 21 bp, Homo sapiens
agagctgtgcctgctcagcag

SEQ ID NO: 973832 - DNA, 14 bp, Homo sapiens
agagctgtggagga

SEQ ID NO: 973833 - DNA, 13 bp, Homo sapiens
agagctgttcatg

SEQ ID NO: 973834 - DNA, 16 bp, Homo sapiens
agagcttattggccac

SEQ ID NO: 973835 - DNA, 17 bp, Homo sapiens
agagcttccctgactca

SEQ ID NO: 973836 - DNA, 13 bp, Homo sapiens
agagcttgctcca

SEQ ID NO: 973837 - DNA, 22 bp, Homo sapiens
agagcttgctccagattctgat

SEQ ID NO: 973838 - DNA, 11 bp, Homo sapiens
agagctttccg

SEQ ID NO: 973839 - DNA, 20 bp, Homo sapiens
agagctttctgccttagcct

SEQ ID NO: 973840 - DNA, 22 bp, Homo sapiens
agagctttctgtccttttggca

SEQ ID NO: 973841 - DNA, 15 bp, Homo sapiens
agagctttgtcactt

SEQ ID NO: 973842 - DNA, 20 bp, Homo sapiens
agagctttgtcacttgccac

SEQ ID NO: 973843 - DNA, 21 bp, Homo sapiens
agagctttgtcacttgccaca

SEQ ID NO: 973844 - DNA, 16 bp, Homo sapiens
agagcttttcactgtg

SEQ ID NO: 973845 - DNA, 22 bp, Homo sapiens
agagcttttgcatttcctgtgt

SEQ ID NO: 973846 - DNA, 17 bp, Homo sapiens
agagctttttaatagca

SEQ ID NO: 973847 - DNA, 13 bp, Homo sapiens
agaggaaaaatat

SEQ ID NO: 973848 - DNA, 20 bp, Homo sapiens
agaggaaaagactcctcctg

SEQ ID NO: 973849 - DNA, 17 bp, Homo sapiens
agaggaaataacagaga

SEQ ID NO: 973850 - DNA, 15 bp, Homo sapiens
agaggaacagtgtgg

SEQ ID NO: 973851 - DNA, 19 bp, Homo sapiens
agaggaactgtccagagag

SEQ ID NO: 973852 - DNA, 21 bp, Homo sapiens
agaggaactgtccagagagca

SEQ ID NO: 973853 - DNA, 11 bp, Homo sapiens
agaggaagaaa

SEQ ID NO: 973854 - DNA, 19 bp, Homo sapiens
agaggaagagagagaccct

SEQ ID NO: 973855 - DNA, 13 bp, Homo sapiens
agaggaagagcag

SEQ ID NO: 973856 - DNA, 15 bp, Homo sapiens
agaggaagccagtgg

SEQ ID NO: 973857 - DNA, 15 bp, Homo sapiens
agaggaaggaaaagg

SEQ ID NO: 973858 - DNA, 16 bp, Homo sapiens
agaggaaggacccctc

SEQ ID NO: 973859 - DNA, 19 bp, Homo sapiens
agaggaaggacccctcacc

SEQ ID NO: 973860 - DNA, 14 bp, Homo sapiens
agaggaaggagggt

SEQ ID NO: 973861 - DNA, 13 bp, Homo sapiens
agaggaaggctga

SEQ ID NO: 973862 - DNA, 18 bp, Homo sapiens
agaggaaggggccagagg

SEQ ID NO: 973863 - DNA, 18 bp, Homo sapiens
agaggaagttcagatctt

SEQ ID NO: 973864 - DNA, 23 bp, Homo sapiens
agaggaatcagacttcacactgc

SEQ ID NO: 973865 - DNA, 17 bp, Homo sapiens
agaggaatctgtttctc

SEQ ID NO: 973866 - DNA, 10 bp, Homo sapiens
agaggaatgt

SEQ ID NO: 973867 - DNA, 19 bp, Homo sapiens
agaggaatgtagggcctgc

SEQ ID NO: 973868 - DNA, 13 bp, Homo sapiens
agaggacagctct

SEQ ID NO: 973869 - DNA, 14 bp, Homo sapiens
agaggacagctctg

SEQ ID NO: 973870 - DNA, 14 bp, Homo sapiens
agaggaccacagtg

SEQ ID NO: 973871 - DNA, 17 bp, Homo sapiens
agaggaccccagggtgg

SEQ ID NO: 973872 - DNA, 16 bp, Homo sapiens
agaggacctgagactc

SEQ ID NO: 973873 - DNA, 22 bp, Homo sapiens
agaggacctgagtttgggagag

SEQ ID NO: 973874 - DNA, 23 bp, Homo sapiens
agaggacgcacgctcgctgccat

SEQ ID NO: 973875 - DNA, 17 bp, Homo sapiens
agaggacggccctgcct

SEQ ID NO: 973876 - DNA, 18 bp, Homo sapiens
agaggactcccaaccctg

SEQ ID NO: 973877 - DNA, 13 bp, Homo sapiens
agaggagaaaaaa

SEQ ID NO: 973878 - DNA, 14 bp, Homo sapiens
agaggagaaaaaaa

SEQ ID NO: 973879 - DNA, 18 bp, Homo sapiens
agaggagaaaaaaaaagt

SEQ ID NO: 973880 - DNA, 23 bp, Homo sapiens
agaggagaaaaaaaaagtgaaaa

SEQ ID NO: 973881 - DNA, 15 bp, Homo sapiens
agaggagaagagaca

SEQ ID NO: 973882 - DNA, 15 bp, Homo sapiens
agaggagaccctgga

SEQ ID NO: 973883 - DNA, 19 bp, Homo sapiens
agaggagagtggcaggtgg

SEQ ID NO: 973884 - DNA, 20 bp, Homo sapiens
agaggagattggccagtgag

SEQ ID NO: 973885 - DNA, 15 bp, Homo sapiens
agaggagcgcaggca

SEQ ID NO: 973886 - DNA, 17 bp, Homo sapiens
agaggagcgcaggcagc

SEQ ID NO: 973887 - DNA, 20 bp, Homo sapiens
agaggagcgcaggcagcgca

SEQ ID NO: 973888 - DNA, 19 bp, Homo sapiens
agaggaggacccctgcctt

SEQ ID NO: 973889 - DNA, 13 bp, Homo sapiens
agaggaggcctca

SEQ ID NO: 973890 - DNA, 21 bp, Homo sapiens
agaggaggcctcaaagcaacc

SEQ ID NO: 973891 - DNA, 13 bp, Homo sapiens
agaggaggcctgg

SEQ ID NO: 973892 - DNA, 17 bp, Homo sapiens
agaggagggatgctgcc

SEQ ID NO: 973893 - DNA, 12 bp, Homo sapiens
agaggaggggcc

SEQ ID NO: 973894 - DNA, 14 bp, Homo sapiens
agaggaggggccgc

SEQ ID NO: 973895 - DNA, 20 bp, Homo sapiens
agaggaggtttgcctgtgat

SEQ ID NO: 973896 - DNA, 16 bp, Homo sapiens
agaggagtctgtggct

SEQ ID NO: 973897 - DNA, 22 bp, Homo sapiens
agaggagtgattgaaccagctc

SEQ ID NO: 973898 - DNA, 18 bp, Homo sapiens
agaggagtgttattgcat

SEQ ID NO: 973899 - DNA, 20 bp, Homo sapiens
agaggatgaatgtatgtgca

SEQ ID NO: 973900 - DNA, 22 bp, Homo sapiens
agaggatgaatgtatgtgcact

SEQ ID NO: 973901 - DNA, 16 bp, Homo sapiens
agaggatgatttcaga

SEQ ID NO: 973902 - DNA, 17 bp, Homo sapiens
agaggatgctgggctct

SEQ ID NO: 973903 - DNA, 22 bp, Homo sapiens
agaggattaggttccatccttt

SEQ ID NO: 973904 - DNA, 19 bp, Homo sapiens
agaggattagtaagatctc

SEQ ID NO: 973905 - DNA, 24 bp, Homo sapiens
agaggcaccactaaaagatcgcag

SEQ ID NO: 973906 - DNA, 13 bp, Homo sapiens
agaggcacctgct

SEQ ID NO: 973907 - DNA, 19 bp, Homo sapiens
agaggcagaagtcagcccg

SEQ ID NO: 973908 - DNA, 14 bp, Homo sapiens
agaggcagagaaag

SEQ ID NO: 973909 - DNA, 17 bp, Homo sapiens
agaggcagagaaagaag

SEQ ID NO: 973910 - DNA, 20 bp, Homo sapiens
agaggcagagaaagaagaga

SEQ ID NO: 973911 - DNA, 21 bp, Homo sapiens
agaggcagagaaagaagagac

SEQ ID NO: 973912 - DNA, 17 bp, Homo sapiens
agaggcagcatgcttgg

SEQ ID NO: 973913 - DNA, 19 bp, Homo sapiens
agaggcagcatgcttgggc

SEQ ID NO: 973914 - DNA, 21 bp, Homo sapiens
agaggcagcttctagacagag

SEQ ID NO: 973915 - DNA, 12 bp, Homo sapiens
agaggtccagcc

SEQ ID NO: 973916 - DNA, 13 bp, Homo sapiens
agaggtccagccc

SEQ ID NO: 973917 - DNA, 22 bp, Homo sapiens
agaggtcccagccccaggcctg

SEQ ID NO: 973918 - DNA, 22 bp, Homo sapiens
agaggtctctgccggctctttc

SEQ ID NO: 973919 - DNA, 13 bp, Homo sapiens
agaggtctgagcc

SEQ ID NO: 973920 - DNA, 13 bp, Homo sapiens
agaggtctgtgct

SEQ ID NO: 973921 - DNA, 16 bp, Homo sapiens
agaggtctgtgctgag

SEQ ID NO: 973922 - DNA, 18 bp, Homo sapiens
agaggtctgtgctgaggc

SEQ ID NO: 973923 - DNA, 13 bp, Homo sapiens
agagtggtggggg

SEQ ID NO: 973924 - DNA, 18 bp, Homo sapiens
agagtggttattcattat

SEQ ID NO: 973925 - DNA, 18 bp, Homo sapiens
agagtgtagactgtggct

SEQ ID NO: 973926 - DNA, 20 bp, Homo sapiens
agagtgtagcctaaagggca

SEQ ID NO: 973927 - DNA, 16 bp, Homo sapiens
agagtgtagctgtaag

SEQ ID NO: 973928 - DNA, 19 bp, Homo sapiens
agagtgtagctgtaagggc

SEQ ID NO: 973929 - DNA, 22 bp, Homo sapiens
agagtgtagctgtaagggcagt

SEQ ID NO: 973930 - DNA, 14 bp, Homo sapiens
agagtgtctttcca

SEQ ID NO: 973931 - DNA, 11 bp, Homo sapiens
agagtgtgacc

SEQ ID NO: 973932 - DNA, 14 bp, Homo sapiens
agagtgtgaccaaa

SEQ ID NO: 973933 - DNA, 18 bp, Homo sapiens
agagtgtgagagagactg

SEQ ID NO: 973934 - DNA, 17 bp, Homo sapiens
agagtgtgcagactgat

SEQ ID NO: 973935 - DNA, 15 bp, Homo sapiens
agagtgtgtgggcag

SEQ ID NO: 973936 - DNA, 22 bp, Homo sapiens
agagtgttgttgctgaccagct

SEQ ID NO: 973937 - DNA, 23 bp, Homo sapiens
agagttaaatagagtatatgcac

SEQ ID NO: 973938 - DNA, 12 bp, Homo sapiens
agagttaagaat

SEQ ID NO: 973939 - DNA, 13 bp, Homo sapiens
agagttaagaatg

SEQ ID NO: 973940 - DNA, 15 bp, Homo sapiens
agagttacagttctg

SEQ ID NO: 973941 - DNA, 22 bp, Homo sapiens
agagttacagttctgtggtttc

SEQ ID NO: 973942 - DNA, 16 bp, Homo sapiens
agagttagctgataag

SEQ ID NO: 973943 - DNA, 20 bp, Homo sapiens
agagttagctgataaggaaa

SEQ ID NO: 973944 - DNA, 19 bp, Homo sapiens
agagttagtttctttggga

SEQ ID NO: 973945 - DNA, 17 bp, Homo sapiens
agagttatcttctttat

SEQ ID NO: 973946 - DNA, 15 bp, Homo sapiens
agagttattcaaatg

SEQ ID NO: 973947 - DNA, 16 bp, Homo sapiens
agagttattcaaatga

SEQ ID NO: 973948 - DNA, 18 bp, Homo sapiens
agagttattcaaatgaag

SEQ ID NO: 973949 - DNA, 22 bp, Homo sapiens
agagttattcaaatgaaggtgg

SEQ ID NO: 973950 - DNA, 14 bp, Homo sapiens
agagttcaagaaat

SEQ ID NO: 973951 - DNA, 16 bp, Homo sapiens
agagttcactataaat

SEQ ID NO: 973952 - DNA, 16 bp, Homo sapiens
agagttcctgcggagt

SEQ ID NO: 973953 - DNA, 22 bp, Homo sapiens
agagttcctgcggagtgaagag

SEQ ID NO: 973954 - DNA, 14 bp, Homo sapiens
agagttccttctca

SEQ ID NO: 973955 - DNA, 15 bp, Homo sapiens
agagttctagacctc

SEQ ID NO: 973956 - DNA, 20 bp, Homo sapiens
agagttctatccccaagctg

SEQ ID NO: 973957 - DNA, 21 bp, Homo sapiens
agagttctatccccaagctgg

SEQ ID NO: 973958 - DNA, 14 bp, Homo sapiens
agagttctgctcta

SEQ ID NO: 973959 - DNA, 13 bp, Homo sapiens
agagttcttcttt

SEQ ID NO: 973960 - DNA, 15 bp, Homo sapiens
agagttctttgctgc

SEQ ID NO: 973961 - DNA, 22 bp, Homo sapiens
agagttgatactacagtttgtt

SEQ ID NO: 973962 - DNA, 21 bp, Homo sapiens
agagttgctgagagggctcga

SEQ ID NO: 973963 - DNA, 20 bp, Homo sapiens
agagttgctttgccagagca

SEQ ID NO: 973964 - DNA, 14 bp, Homo sapiens
agagttggagtttt

SEQ ID NO: 973965 - DNA, 13 bp, Homo sapiens
agagttgtaaata

SEQ ID NO: 973966 - DNA, 15 bp, Homo sapiens
agagttgtaaatata

SEQ ID NO: 973967 - DNA, 16 bp, Homo sapiens
agagttgtaaatatat

SEQ ID NO: 973968 - DNA, 18 bp, Homo sapiens
agagttgtaaatatataa

SEQ ID NO: 973969 - DNA, 22 bp, Homo sapiens
agagttgtaaatatataaatat

SEQ ID NO: 973970 - DNA, 23 bp, Homo sapiens
agagttgtctgtccaggccctta

SEQ ID NO: 973971 - DNA, 17 bp, Homo sapiens
agagttgttacattttt

SEQ ID NO: 973972 - DNA, 20 bp, Homo sapiens
agagttgttgtttgccaagc

SEQ ID NO: 973973 - DNA, 14 bp, Homo sapiens
agagtttaacacaa

SEQ ID NO: 973974 - DNA, 15 bp, Homo sapiens
agagtttaacacaag

SEQ ID NO: 973975 - DNA, 13 bp, Homo sapiens
agagtttacagtt

SEQ ID NO: 973976 - DNA, 22 bp, Homo sapiens
agagtttacagtttgtgtttta

SEQ ID NO: 973977 - DNA, 13 bp, Homo sapiens
agagtttcaaaag

SEQ ID NO: 973978 - DNA, 17 bp, Homo sapiens
agagtttctgcagttcc

SEQ ID NO: 973979 - DNA, 19 bp, Homo sapiens
agagtttctgcagttccat

SEQ ID NO: 973980 - DNA, 15 bp, Homo sapiens
agagtttctgtttga

SEQ ID NO: 973981 - DNA, 17 bp, Homo sapiens
agagtttctttacattg

SEQ ID NO: 973982 - DNA, 13 bp, Homo sapiens
agagtttgaagga

SEQ ID NO: 973983 - DNA, 14 bp, Homo sapiens
agagtttgtgtgta

SEQ ID NO: 973984 - DNA, 15 bp, Homo sapiens
agagtttgtgtgtat

SEQ ID NO: 973985 - DNA, 18 bp, Homo sapiens
agagtttgtgtgtatttg

SEQ ID NO: 973986 - DNA, 22 bp, Homo sapiens
agagtttgtgtgttgtcttgaa

SEQ ID NO: 973987 - DNA, 17 bp, Homo sapiens
agagtttgttctgttct

SEQ ID NO: 973988 - DNA, 23 bp, Homo sapiens
agagtttgttctgttctggggga

SEQ ID NO: 973989 - DNA, 22 bp, Homo sapiens
agagttttaacacttctagatc

SEQ ID NO: 973990 - DNA, 16 bp, Homo sapiens
agagttttagagaaaa

SEQ ID NO: 973991 - DNA, 13 bp, Homo sapiens
agagttttgtctt

SEQ ID NO: 973992 - DNA, 22 bp, Homo sapiens
agataaaagcaattctgactgt

SEQ ID NO: 973993 - DNA, 17 bp, Homo sapiens
agataaacaccaaccca

SEQ ID NO: 973994 - DNA, 19 bp, Homo sapiens
agataaactcagaaattta

SEQ ID NO: 973995 - DNA, 23 bp, Homo sapiens
agataaagatttctagtaggcag

SEQ ID NO: 973996 - DNA, 17 bp, Homo sapiens
agataaagatttcttga

SEQ ID NO: 973997 - DNA, 15 bp, Homo sapiens
agataaatagaacta

SEQ ID NO: 973998 - DNA, 18 bp, Homo sapiens
agataaatttgttgaata

SEQ ID NO: 973999 - DNA, 17 bp, Homo sapiens
agataactctctttcct

SEQ ID NO: 974000 - DNA, 18 bp, Homo sapiens
agataactctctttcctt

SEQ ID NO: 974001 - DNA, 18 bp, Homo sapiens
agataactgaaaattatt

SEQ ID NO: 974002 - DNA, 14 bp, Homo sapiens
agataactgagaat

SEQ ID NO: 974003 - DNA, 20 bp, Homo sapiens
agataacttactgtatatgt

SEQ ID NO: 974004 - DNA, 22 bp, Homo sapiens
agataacttactgtatatgtat

SEQ ID NO: 974005 - DNA, 23 bp, Homo sapiens
agataacttactgtatatgtatt

SEQ ID NO: 974006 - DNA, 17 bp, Homo sapiens
agataaggtttcctgct

SEQ ID NO: 974007 - DNA, 14 bp, Homo sapiens
agataagtgtaaat

SEQ ID NO: 974008 - DNA, 15 bp, Homo sapiens
agataagtgtaaata

SEQ ID NO: 974009 - DNA, 14 bp, Homo sapiens
agataataaattga

SEQ ID NO: 974010 - DNA, 18 bp, Homo sapiens
agataatacaccactaca

SEQ ID NO: 974011 - DNA, 14 bp, Homo sapiens
agataatcattgct

SEQ ID NO: 974012 - DNA, 15 bp, Homo sapiens
agataatcattgctt

SEQ ID NO: 974013 - DNA, 18 bp, Homo sapiens
agataatcattgcttatg

SEQ ID NO: 974014 - DNA, 13 bp, Homo sapiens
agataattcattt

SEQ ID NO: 974015 - DNA, 18 bp, Homo sapiens
agataattgctatttatt

SEQ ID NO: 974016 - DNA, 20 bp, Homo sapiens
agataatttgcatattctat

SEQ ID NO: 974017 - DNA, 18 bp, Homo sapiens
agatacactgcactttgt

SEQ ID NO: 974018 - DNA, 23 bp, Homo sapiens
agatacactgcactttgtttaga

SEQ ID NO: 974019 - DNA, 24 bp, Homo sapiens
agatacagggtgctccttgtcaat

SEQ ID NO: 974020 - DNA, 16 bp, Homo sapiens
agatacatcactgctt

SEQ ID NO: 974021 - DNA, 21 bp, Homo sapiens
agatacatggttgtgacctga

SEQ ID NO: 974022 - DNA, 14 bp, Homo sapiens
agataccagcgagg

SEQ ID NO: 974023 - DNA, 19 bp, Homo sapiens
agataccagcgaggaggct

SEQ ID NO: 974024 - DNA, 19 bp, Homo sapiens
agataccaggttgaaagac

SEQ ID NO: 974025 - DNA, 22 bp, Homo sapiens
agataccctacgctgtccagaa

SEQ ID NO: 974026 - DNA, 23 bp, Homo sapiens
agataccctacgctgtccagaaa

SEQ ID NO: 974027 - DNA, 19 bp, Homo sapiens
agatacctcatcatccacc

SEQ ID NO: 974028 - DNA, 23 bp, Homo sapiens
agatactgctactgtaattttat

SEQ ID NO: 974029 - DNA, 19 bp, Homo sapiens
agatactggaagttttgca

SEQ ID NO: 974030 - DNA, 15 bp, Homo sapiens
agatacttacatttc

SEQ ID NO: 974031 - DNA, 17 bp, Homo sapiens
agatacttacatttcca

SEQ ID NO: 974032 - DNA, 17 bp, Homo sapiens
agatacttatgcaagat

SEQ ID NO: 974033 - DNA, 20 bp, Homo sapiens
agatagaaagggtgctgcca

SEQ ID NO: 974034 - DNA, 11 bp, Homo sapiens
agatagaaata

SEQ ID NO: 974035 - DNA, 18 bp, Homo sapiens
agatagaaataaatagct

SEQ ID NO: 974036 - DNA, 22 bp, Homo sapiens
agatagaacacaaaacttgaaa

SEQ ID NO: 974037 - DNA, 14 bp, Homo sapiens
agatagaagaactg

SEQ ID NO: 974038 - DNA, 17 bp, Homo sapiens
agatagaagaattttat

SEQ ID NO: 974039 - DNA, 16 bp, Homo sapiens
agatagaatgacagtc

SEQ ID NO: 974040 - DNA, 16 bp, Homo sapiens
agatagaatttccaat

SEQ ID NO: 974041 - DNA, 13 bp, Homo sapiens
agatagagaaata

SEQ ID NO: 974042 - DNA, 14 bp, Homo sapiens
agatagagagctat

SEQ ID NO: 974043 - DNA, 14 bp, Homo sapiens
agatagcattgtga

SEQ ID NO: 974044 - DNA, 22 bp, Homo sapiens
agactccagaatctgctgttgc

SEQ ID NO: 974045 - DNA, 15 bp, Homo sapiens
agactccagcccctg

SEQ ID NO: 974046 - DNA, 16 bp, Homo sapiens
agactccatagtttgg

SEQ ID NO: 974047 - DNA, 14 bp, Homo sapiens
agactcctcctggg

SEQ ID NO: 974048 - DNA, 19 bp, Homo sapiens
agactcctgggcagccgtt

SEQ ID NO: 974049 - DNA, 21 bp, Homo sapiens
agactccttcaacaattctaa

SEQ ID NO: 974050 - DNA, 13 bp, Homo sapiens
agactccttctcc

SEQ ID NO: 974051 - DNA, 15 bp, Homo sapiens
agactccttgtggac

SEQ ID NO: 974052 - DNA, 20 bp, Homo sapiens
agactcgattcatattgaat

SEQ ID NO: 974053 - DNA, 23 bp, Homo sapiens
agactcgattcatattgaatata

SEQ ID NO: 974054 - DNA, 18 bp, Homo sapiens
agactctaggttatacaa

SEQ ID NO: 974055 - DNA, 19 bp, Homo sapiens
agactctaggttatacaat

SEQ ID NO: 974056 - DNA, 17 bp, Homo sapiens
agactctagtatttatg

SEQ ID NO: 974057 - DNA, 16 bp, Homo sapiens
agactctattttaatg

SEQ ID NO: 974058 - DNA, 20 bp, Homo sapiens
agactctattttaatgtata

SEQ ID NO: 974059 - DNA, 12 bp, Homo sapiens
agactctcacag

SEQ ID NO: 974060 - DNA, 11 bp, Homo sapiens
agactctgagc

SEQ ID NO: 974061 - DNA, 23 bp, Homo sapiens
agactctgatggaatgtgccacc

SEQ ID NO: 974062 - DNA, 20 bp, Homo sapiens
agactcttaagtatattgtg

SEQ ID NO: 974063 - DNA, 22 bp, Homo sapiens
agactcttacgtggagagtgca

SEQ ID NO: 974064 - DNA, 20 bp, Homo sapiens
agactcttcccctccctccc

SEQ ID NO: 974065 - DNA, 17 bp, Homo sapiens
agactcttgcctgtttc

SEQ ID NO: 974066 - DNA, 22 bp, Homo sapiens
agactcttgcctgtttcccagg

SEQ ID NO: 974067 - DNA, 14 bp, Homo sapiens
agactctttgaaat

SEQ ID NO: 974068 - DNA, 16 bp, Homo sapiens
agactctttggacact

SEQ ID NO: 974069 - DNA, 23 bp, Homo sapiens
agactctttgggtccattcagat

SEQ ID NO: 974070 - DNA, 18 bp, Homo sapiens
agactgaaagcagcagct

SEQ ID NO: 974071 - DNA, 21 bp, Homo sapiens
agactgaaagcagcagctagg

SEQ ID NO: 974072 - DNA, 13 bp, Homo sapiens
agactgaaattta

SEQ ID NO: 974073 - DNA, 17 bp, Homo sapiens
agactgaacatgtacac

SEQ ID NO: 974074 - DNA, 16 bp, Homo sapiens
agactgaactgtgtga

SEQ ID NO: 974075 - DNA, 24 bp, Homo sapiens
agactgaatagatatgaaagctga

SEQ ID NO: 974076 - DNA, 13 bp, Homo sapiens
agactgaatgttt

SEQ ID NO: 974077 - DNA, 14 bp, Homo sapiens
agactgacactact

SEQ ID NO: 974078 - DNA, 22 bp, Homo sapiens
agactgaccaatattgtacagt

SEQ ID NO: 974079 - DNA, 22 bp, Homo sapiens
agactgactgggcgtggtggct

SEQ ID NO: 974080 - DNA, 19 bp, Homo sapiens
agactgagaggcagaagtc

SEQ ID NO: 974081 - DNA, 20 bp, Homo sapiens
agactgagctctccaggcca

SEQ ID NO: 974082 - DNA, 22 bp, Homo sapiens
agactgagggattttagcctct

SEQ ID NO: 974083 - DNA, 13 bp, Homo sapiens
agagaaacagttg

SEQ ID NO: 974084 - DNA, 18 bp, Homo sapiens
agagaaactaacttggtg

SEQ ID NO: 974085 - DNA, 19 bp, Homo sapiens
agagaaactacccaggtat

SEQ ID NO: 974086 - DNA, 16 bp, Homo sapiens
agagaaagaaagggaa

SEQ ID NO: 974087 - DNA, 19 bp, Homo sapiens
agagaaagtgatttctaga

SEQ ID NO: 974088 - DNA, 16 bp, Homo sapiens
agagaaatacagctgg

SEQ ID NO: 974089 - DNA, 18 bp, Homo sapiens
agagaaatacagctggct

SEQ ID NO: 974090 - DNA, 22 bp, Homo sapiens
agagaaatacagctggctatct

SEQ ID NO: 974091 - DNA, 20 bp, Homo sapiens
agagaaatttttatttttga

SEQ ID NO: 974092 - DNA, 23 bp, Homo sapiens
agagaacagaaaacaacaaaaga

SEQ ID NO: 974093 - DNA, 11 bp, Homo sapiens
agagaacagtt

SEQ ID NO: 974094 - DNA, 21 bp, Homo sapiens
agagaaccgagcaaagatcaa

SEQ ID NO: 974095 - DNA, 15 bp, Homo sapiens
agagaagaaatagca

SEQ ID NO: 974096 - DNA, 14 bp, Homo sapiens
agagaagacaaaac

SEQ ID NO: 974097 - DNA, 16 bp, Homo sapiens
agagaagagggcccag

SEQ ID NO: 974098 - DNA, 21 bp, Homo sapiens
agagaagagggcccagcccag

SEQ ID NO: 974099 - DNA, 20 bp, Homo sapiens
agagaagataatgttcttta

SEQ ID NO: 974100 - DNA, 13 bp, Homo sapiens
agagaagcaattt

SEQ ID NO: 974101 - DNA, 17 bp, Homo sapiens
agagaagccacgctgtc

SEQ ID NO: 974102 - DNA, 20 bp, Homo sapiens
agagaagccacgctgtcctc

SEQ ID NO: 974103 - DNA, 17 bp, Homo sapiens
agagaagcggatttcca

SEQ ID NO: 974104 - DNA, 13 bp, Homo sapiens
agagaagctgctg

SEQ ID NO: 974105 - DNA, 13 bp, Homo sapiens
agagaaggcagga

SEQ ID NO: 974106 - DNA, 18 bp, Homo sapiens
agagaaggcctccctagc

SEQ ID NO: 974107 - DNA, 18 bp, Homo sapiens
agagaagtatacataagt

SEQ ID NO: 974108 - DNA, 14 bp, Homo sapiens
agagaagtgcccct

SEQ ID NO: 974109 - DNA, 20 bp, Homo sapiens
agagaatagagctgccactg

SEQ ID NO: 974110 - DNA, 19 bp, Homo sapiens
agagaatcaacagatgata

SEQ ID NO: 974111 - DNA, 18 bp, Homo sapiens
agagaatctcttgggagt

SEQ ID NO: 974112 - DNA, 13 bp, Homo sapiens
agagaatctgcct

SEQ ID NO: 974113 - DNA, 19 bp, Homo sapiens
agagaatcttaaggtctaa

SEQ ID NO: 974114 - DNA, 22 bp, Homo sapiens
agagaatgaaattgctgaaaga

SEQ ID NO: 974115 - DNA, 19 bp, Homo sapiens
agagaatgaactgtggaat

SEQ ID NO: 974116 - DNA, 14 bp, Homo sapiens
agagaatgagaaat

SEQ ID NO: 974117 - DNA, 17 bp, Homo sapiens
agagaatgagagcgaca

SEQ ID NO: 974118 - DNA, 21 bp, Homo sapiens
agagaatgcccttctccttat

SEQ ID NO: 974119 - DNA, 17 bp, Homo sapiens
agagaatggctgggtca

SEQ ID NO: 974120 - DNA, 14 bp, Homo sapiens
agagaatgtatttg

SEQ ID NO: 974121 - DNA, 22 bp, Homo sapiens
agagaatgtattttcatagatg

SEQ ID NO: 974122 - DNA, 12 bp, Homo sapiens
agagaatgtgtg

SEQ ID NO: 974123 - DNA, 16 bp, Homo sapiens
agagaatgttccagac

SEQ ID NO: 974124 - DNA, 13 bp, Homo sapiens
agagaattcatgt

SEQ ID NO: 974125 - DNA, 19 bp, Homo sapiens
agagaatttctaaagtaaa

SEQ ID NO: 974126 - DNA, 22 bp, Homo sapiens
agagaatttctaaagtaaaatt

SEQ ID NO: 974127 - DNA, 21 bp, Homo sapiens
agagacaaacacctcccagga

SEQ ID NO: 974128 - DNA, 18 bp, Homo sapiens
agagacaaagtgggtgtg

SEQ ID NO: 974129 - DNA, 21 bp, Homo sapiens
agagacaactatcaattcttg

SEQ ID NO: 974130 - DNA, 16 bp, Homo sapiens
agagacaagaagcaaa

SEQ ID NO: 974131 - DNA, 19 bp, Homo sapiens
agagacaagtaatttcagt

SEQ ID NO: 974132 - DNA, 20 bp, Homo sapiens
agagacaagtaatttcagtg

SEQ ID NO: 974133 - DNA, 13 bp, Homo sapiens
agagacacctgca

SEQ ID NO: 974134 - DNA, 14 bp, Homo sapiens
agagacacctgcac

SEQ ID NO: 974135 - DNA, 21 bp, Homo sapiens
agagacacctgcacctccccc

SEQ ID NO: 974136 - DNA, 20 bp, Homo sapiens
agagacactgttgataaaaa

SEQ ID NO: 974137 - DNA, 13 bp, Homo sapiens
agagacagaagca

SEQ ID NO: 974138 - DNA, 16 bp, Homo sapiens
agagacagcccaggat

SEQ ID NO: 974139 - DNA, 13 bp, Homo sapiens
agagacaggaaaa

SEQ ID NO: 974140 - DNA, 14 bp, Homo sapiens
agagacaggcagcc

SEQ ID NO: 974141 - DNA, 20 bp, Homo sapiens
agagacaggcagcccagcag

SEQ ID NO: 974142 - DNA, 16 bp, Homo sapiens
agagacaggcagctcg

SEQ ID NO: 974143 - DNA, 18 bp, Homo sapiens
agagacaggcccaagaga

SEQ ID NO: 974144 - DNA, 20 bp, Homo sapiens
agagacaggcccaagagatg

SEQ ID NO: 974145 - DNA, 15 bp, Homo sapiens
agagacagttctctg

SEQ ID NO: 974146 - DNA, 17 bp, Homo sapiens
agagacatggaagagag

SEQ ID NO: 974147 - DNA, 18 bp, Homo sapiens
agagacattaactcatta

SEQ ID NO: 974148 - DNA, 23 bp, Homo sapiens
agagacattaactcattagactg

SEQ ID NO: 974149 - DNA, 19 bp, Homo sapiens
agagaccacccatatcatg

SEQ ID NO: 974150 - DNA, 15 bp, Homo sapiens
agagaccagcactca

SEQ ID NO: 974151 - DNA, 16 bp, Homo sapiens
agagacccaaggagga

SEQ ID NO: 974152 - DNA, 21 bp, Homo sapiens
agagacccaaggaggaaaaac

SEQ ID NO: 974153 - DNA, 14 bp, Homo sapiens
agagacccccaggc

SEQ ID NO: 974154 - DNA, 20 bp, Homo sapiens
agagaccccttcctttcctc

SEQ ID NO: 974155 - DNA, 21 bp, Homo sapiens
agagaccccttcctttcctct

SEQ ID NO: 974156 - DNA, 21 bp, Homo sapiens
agagaccctcactgctgggga

SEQ ID NO: 974157 - DNA, 22 bp, Homo sapiens
agagaccctcactgctggggag

SEQ ID NO: 974158 - DNA, 20 bp, Homo sapiens
agagaccgtcgggggctgag

SEQ ID NO: 974159 - DNA, 16 bp, Homo sapiens
agagacctcatcagga

SEQ ID NO: 974160 - DNA, 16 bp, Homo sapiens
agagacctcatcctgc

SEQ ID NO: 974161 - DNA, 14 bp, Homo sapiens
agagacctgaccct

SEQ ID NO: 974162 - DNA, 18 bp, Homo sapiens
agagacgccactccctgg

SEQ ID NO: 974163 - DNA, 19 bp, Homo sapiens
agagacgccactccctggg

SEQ ID NO: 974164 - DNA, 21 bp, Homo sapiens
agagacgccactccctgggac

SEQ ID NO: 974165 - DNA, 15 bp, Homo sapiens
agagactcagatgag

SEQ ID NO: 974166 - DNA, 23 bp, Homo sapiens
agagactgaaagcagcagctagg

SEQ ID NO: 974167 - DNA, 22 bp, Homo sapiens
agagactgaatagatatgaaag

SEQ ID NO: 974168 - DNA, 20 bp, Homo sapiens
agagactgagcagccgccag

SEQ ID NO: 974169 - DNA, 17 bp, Homo sapiens
agagactgcccttctca

SEQ ID NO: 974170 - DNA, 17 bp, Homo sapiens
agagactggagcatctg

SEQ ID NO: 974171 - DNA, 20 bp, Homo sapiens
agagactggttagtgatgca

SEQ ID NO: 974172 - DNA, 13 bp, Homo sapiens
agagactgtagat

SEQ ID NO: 974173 - DNA, 22 bp, Homo sapiens
actgtttctcttgagctggcct

SEQ ID NO: 974174 - DNA, 15 bp, Homo sapiens
actgtttcttttgta

SEQ ID NO: 974175 - DNA, 22 bp, Homo sapiens
actgtttgccttctacttttaa

SEQ ID NO: 974176 - DNA, 14 bp, Homo sapiens
actgtttggcttat

SEQ ID NO: 974177 - DNA, 12 bp, Homo sapiens
actgtttgttat

SEQ ID NO: 974178 - DNA, 21 bp, Homo sapiens
actgtttgtttttatttaaat

SEQ ID NO: 974179 - DNA, 15 bp, Homo sapiens
actgttttaaagggt

SEQ ID NO: 974180 - DNA, 17 bp, Homo sapiens
actgttttagaaattgg

SEQ ID NO: 974181 - DNA, 16 bp, Homo sapiens
actgttttatgttgat

SEQ ID NO: 974182 - DNA, 20 bp, Homo sapiens
actgttttcaataacaaagc

SEQ ID NO: 974183 - DNA, 13 bp, Homo sapiens
actgttttgggcc

SEQ ID NO: 974184 - DNA, 17 bp, Homo sapiens
actgtttttaagtaact

SEQ ID NO: 974185 - DNA, 13 bp, Homo sapiens
actgtttttaatg

SEQ ID NO: 974186 - DNA, 18 bp, Homo sapiens
actgtttttattccttcc

SEQ ID NO: 974187 - DNA, 19 bp, Homo sapiens
actgtttttgaaaaattac

SEQ ID NO: 974188 - DNA, 14 bp, Homo sapiens
actgttttttcctg

SEQ ID NO: 974189 - DNA, 13 bp, Homo sapiens
acttaaaaaaatg

SEQ ID NO: 974190 - DNA, 13 bp, Homo sapiens
aaaaaaaaatgtt

SEQ ID NO: 974191 - DNA, 12 bp, Homo sapiens
aaaaaaaacagt

SEQ ID NO: 974192 - DNA, 12 bp, Homo sapiens
aaaaaaaactta

SEQ ID NO: 974193 - DNA, 10 bp, Homo sapiens
aaaaaaaaga

SEQ ID NO: 974194 - DNA, 12 bp, Homo sapiens
aaaaaaaagtca

SEQ ID NO: 974195 - DNA, 14 bp, Homo sapiens
aaaaaaaagttgca

SEQ ID NO: 974196 - DNA, 12 bp, Homo sapiens
aaaaaaaataca

SEQ ID NO: 974197 - DNA, 13 bp, Homo sapiens
aaaaaaaattccc

SEQ ID NO: 974198 - DNA, 13 bp, Homo sapiens
aaaaaaacattct

SEQ ID NO: 974199 - DNA, 11 bp, Homo sapiens
aaaaaaactac

SEQ ID NO: 974200 - DNA, 12 bp, Homo sapiens
aaaaaaactgaa

SEQ ID NO: 974201 - DNA, 10 bp, Homo sapiens
aaaaaaagaa

SEQ ID NO: 974202 - DNA, 11 bp, Homo sapiens
aaaaaaagaaa

SEQ ID NO: 974203 - DNA, 13 bp, Homo sapiens
aaaaaaagaataa

SEQ ID NO: 974204 - DNA, 10 bp, Homo sapiens
aaaaaaagat

SEQ ID NO: 974205 - DNA, 12 bp, Homo sapiens
aaaaaaagatga

SEQ ID NO: 974206 - DNA, 13 bp, Homo sapiens
aaaaaaaggaaaa

SEQ ID NO: 974207 - DNA, 12 bp, Homo sapiens
aaaaaaataact

SEQ ID NO: 974208 - DNA, 13 bp, Homo sapiens
aaaaaaatacttg

SEQ ID NO: 974209 - DNA, 11 bp, Homo sapiens
aaaaaaatagt

SEQ ID NO: 974210 - DNA, 12 bp, Homo sapiens
aaaaaaatcaca

SEQ ID NO: 974211 - DNA, 13 bp, Homo sapiens
aaaaaaatgaata

SEQ ID NO: 974212 - DNA, 13 bp, Homo sapiens
aaaaaaatgttgt

SEQ ID NO: 974213 - DNA, 19 bp, Homo sapiens
aaaaaaattgaaatgtaag

SEQ ID NO: 974214 - DNA, 11 bp, Homo sapiens
aaaaaaatttg

SEQ ID NO: 974215 - DNA, 12 bp, Homo sapiens
aaaaaaattttt

SEQ ID NO: 974216 - DNA, 13 bp, Homo sapiens
aaaaaaatttttg

SEQ ID NO: 974217 - DNA, 12 bp, Homo sapiens
aaaaaacaaaaa

SEQ ID NO: 974218 - DNA, 19 bp, Homo sapiens
aaaaaacacttggcataca

SEQ ID NO: 974219 - DNA, 15 bp, Homo sapiens
aaaaaacagaggcca

SEQ ID NO: 974220 - DNA, 13 bp, Homo sapiens
aaaaaactcctgt

SEQ ID NO: 974221 - DNA, 20 bp, Homo sapiens
aaaaaactcttaatctgtgt

SEQ ID NO: 974222 - DNA, 13 bp, Homo sapiens
aaaaaactgaagg

SEQ ID NO: 974223 - DNA, 10 bp, Homo sapiens
aaaaaagaaa

SEQ ID NO: 974224 - DNA, 13 bp, Homo sapiens
aaaaaagaaagtt

SEQ ID NO: 974225 - DNA, 12 bp, Homo sapiens
aaaaaagaaatg

SEQ ID NO: 974226 - DNA, 11 bp, Homo sapiens
aaaaaagactg

SEQ ID NO: 974227 - DNA, 12 bp, Homo sapiens
aaaaaagactga

SEQ ID NO: 974228 - DNA, 14 bp, Homo sapiens
aaaaaagattctac

SEQ ID NO: 974229 - DNA, 12 bp, Homo sapiens
aaaaaagatttt

SEQ ID NO: 974230 - DNA, 11 bp, Homo sapiens
aaaaaagcaaa

SEQ ID NO: 974231 - DNA, 13 bp, Homo sapiens
aaaaaagctgaat

SEQ ID NO: 974232 - DNA, 12 bp, Homo sapiens
aaaaaagtcaga

SEQ ID NO: 974233 - DNA, 12 bp, Homo sapiens
aaaaaataatta

SEQ ID NO: 974234 - DNA, 16 bp, Homo sapiens
aaaaaataccattgaa

SEQ ID NO: 974235 - DNA, 17 bp, Homo sapiens
aaaaaataccattgaaa

SEQ ID NO: 974236 - DNA, 9 bp, Homo sapiens
aaaaaatag

SEQ ID NO: 974237 - DNA, 16 bp, Homo sapiens
aaaaaatagacatgta

SEQ ID NO: 974238 - DNA, 12 bp, Homo sapiens
aaaaaatgatgc

SEQ ID NO: 974239 - DNA, 21 bp, Homo sapiens
aaaaaatgatgcagctgttga

SEQ ID NO: 974240 - DNA, 20 bp, Homo sapiens
aaaaaatgctgaacattgca

SEQ ID NO: 974241 - DNA, 12 bp, Homo sapiens
aaaaaatgtaat

SEQ ID NO: 974242 - DNA, 11 bp, Homo sapiens
aaaaaatgttg

SEQ ID NO: 974243 - DNA, 12 bp, Homo sapiens
aaaaaatttgtc

SEQ ID NO: 974244 - DNA, 23 bp, Homo sapiens
aaaaacaaaataccaccctacaa

SEQ ID NO: 974245 - DNA, 22 bp, Homo sapiens
aaaaacaaacaaaaaactgcct

SEQ ID NO: 974246 - DNA, 12 bp, Homo sapiens
aaaaacaaagct

SEQ ID NO: 974247 - DNA, 18 bp, Homo sapiens
aaaaacaagactgcctcc

SEQ ID NO: 974248 - DNA, 22 bp, Homo sapiens
aaaaacaattgcaacagaagca

SEQ ID NO: 974249 - DNA, 19 bp, Homo sapiens
aaaaacacaaaacaacaaa

SEQ ID NO: 974250 - DNA, 15 bp, Homo sapiens
aaaaacacctagctt

SEQ ID NO: 974251 - DNA, 17 bp, Homo sapiens
aaaaacacctagcttta

SEQ ID NO: 974252 - DNA, 12 bp, Homo sapiens
aaaaacactagt

SEQ ID NO: 974253 - DNA, 14 bp, Homo sapiens
aaaaacagcagctc

SEQ ID NO: 974254 - DNA, 15 bp, Homo sapiens
aaaaatgaaagtgac

SEQ ID NO: 974255 - DNA, 18 bp, Homo sapiens
aaaaatgaaagtgacttt

SEQ ID NO: 974256 - DNA, 21 bp, Homo sapiens
aaaaatgaaagtgactttaaa

SEQ ID NO: 974257 - DNA, 12 bp, Homo sapiens
aaaaatgaaatt

SEQ ID NO: 974258 - DNA, 20 bp, Homo sapiens
aaaaatgatttcagtagcac

SEQ ID NO: 974259 - DNA, 14 bp, Homo sapiens
aaaaatgctgaaca

SEQ ID NO: 974260 - DNA, 22 bp, Homo sapiens
aaaaatggctaactgatgaatt

SEQ ID NO: 974261 - DNA, 19 bp, Homo sapiens
aaaaatggtagcattttaa

SEQ ID NO: 974262 - DNA, 20 bp, Homo sapiens
aaaaatggtagcattttaaa

SEQ ID NO: 974263 - DNA, 19 bp, Homo sapiens
aaaaatggttgatggaaaa

SEQ ID NO: 974264 - DNA, 20 bp, Homo sapiens
aaaaatggttgatggaaaat

SEQ ID NO: 974265 - DNA, 21 bp, Homo sapiens
aaaaatggttttgaatagatc

SEQ ID NO: 974266 - DNA, 14 bp, Homo sapiens
aaaaatgtaaatac

SEQ ID NO: 974267 - DNA, 14 bp, Homo sapiens
aaaaatgtaacatc

SEQ ID NO: 974268 - DNA, 16 bp, Homo sapiens
aaaaatgtaacatcat

SEQ ID NO: 974269 - DNA, 13 bp, Homo sapiens
aaaaatgtacatt

SEQ ID NO: 974270 - DNA, 22 bp, Homo sapiens
aaaaatgtcttgggtaggcggg

SEQ ID NO: 974271 - DNA, 12 bp, Homo sapiens
aaaaatgtgtgg

SEQ ID NO: 974272 - DNA, 21 bp, Homo sapiens
aaaaatgttacgtgaagaaat

SEQ ID NO: 974273 - DNA, 21 bp, Homo sapiens
aaaaatgttcccttgaccatt

SEQ ID NO: 974274 - DNA, 13 bp, Homo sapiens
aaaaatgttctca

SEQ ID NO: 974275 - DNA, 22 bp, Homo sapiens
aaaaatgttggatttataaatg

SEQ ID NO: 974276 - DNA, 23 bp, Homo sapiens
aaaaatgtttttggtcttttata

SEQ ID NO: 974277 - DNA, 16 bp, Homo sapiens
aaaaatgttttttcat

SEQ ID NO: 974278 - DNA, 12 bp, Homo sapiens
aaaaattaaaat

SEQ ID NO: 974279 - DNA, 13 bp, Homo sapiens
aaaaattaaaatg

SEQ ID NO: 974280 - DNA, 17 bp, Homo sapiens
aaaaattaaaccaagca

SEQ ID NO: 974281 - DNA, 19 bp, Homo sapiens
aaaaattaaaccaagcagc

SEQ ID NO: 974282 - DNA, 23 bp, Homo sapiens
aaaaattacctttaattttaatg

SEQ ID NO: 974283 - DNA, 15 bp, Homo sapiens
aaaaattatcaaaaa

SEQ ID NO: 974284 - DNA, 19 bp, Homo sapiens
aaaaattatctatagctaa

SEQ ID NO: 974285 - DNA, 21 bp, Homo sapiens
aaaaattcagagtccttgcaa

SEQ ID NO: 974286 - DNA, 15 bp, Homo sapiens
aaaaattcccttcct

SEQ ID NO: 974287 - DNA, 22 bp, Homo sapiens
aaaaattctgcccccacctaga

SEQ ID NO: 974288 - DNA, 13 bp, Homo sapiens
aaaaattgaaatg

SEQ ID NO: 974289 - DNA, 21 bp, Homo sapiens
aaaaattgtattgaaaacact

SEQ ID NO: 974290 - DNA, 14 bp, Homo sapiens
aaaaattgtgatca

SEQ ID NO: 974291 - DNA, 16 bp, Homo sapiens
aaaaattgtttcttga

SEQ ID NO: 974292 - DNA, 22 bp, Homo sapiens
aaaaatttaagcattgtttgct

SEQ ID NO: 974293 - DNA, 22 bp, Homo sapiens
aaaaatttatacaccagcaatt

SEQ ID NO: 974294 - DNA, 12 bp, Homo sapiens
aaaaatttatta

SEQ ID NO: 974295 - DNA, 13 bp, Homo sapiens
aaaaatttcacga

SEQ ID NO: 974296 - DNA, 17 bp, Homo sapiens
aaaaatttgaacactgg

SEQ ID NO: 974297 - DNA, 23 bp, Homo sapiens
aaaaatttgtgtgcttctgctca

SEQ ID NO: 974298 - DNA, 23 bp, Homo sapiens
aaaaattttgtgacattccttct

SEQ ID NO: 974299 - DNA, 22 bp, Homo sapiens
aaaaatttttttttctcttttt

SEQ ID NO: 974300 - DNA, 15 bp, Homo sapiens
aaaacaaaaacagaa

SEQ ID NO: 974301 - DNA, 17 bp, Homo sapiens
aggaagtctaggagctg

SEQ ID NO: 974302 - DNA, 18 bp, Homo sapiens
aggaagtctaggagctgg

SEQ ID NO: 974303 - DNA, 17 bp, Homo sapiens
aggaagtggcagttctt

SEQ ID NO: 974304 - DNA, 14 bp, Homo sapiens
aggaagtggctggt

SEQ ID NO: 974305 - DNA, 17 bp, Homo sapiens
aggaagtggctggtctg

SEQ ID NO: 974306 - DNA, 22 bp, Homo sapiens
aggaagtggctggtctggagtc

SEQ ID NO: 974307 - DNA, 20 bp, Homo sapiens
aggaagtggggtctggcctg

SEQ ID NO: 974308 - DNA, 21 bp, Homo sapiens
aggaagtgttgaagggaggtg

SEQ ID NO: 974309 - DNA, 14 bp, Homo sapiens
aggaagtgtttatg

SEQ ID NO: 974310 - DNA, 23 bp, Homo sapiens
aggaagttattaacgggcatgta

SEQ ID NO: 974311 - DNA, 14 bp, Homo sapiens
aggaagttcagatc

SEQ ID NO: 974312 - DNA, 23 bp, Homo sapiens
aggaagttgacttatagtacatg

SEQ ID NO: 974313 - DNA, 16 bp, Homo sapiens
aggaataaagtttttt

SEQ ID NO: 974314 - DNA, 21 bp, Homo sapiens
aggaataaataaaaatggata

SEQ ID NO: 974315 - DNA, 14 bp, Homo sapiens
aggaataaatgaga

SEQ ID NO: 974316 - DNA, 17 bp, Homo sapiens
aggaataataaattcat

SEQ ID NO: 974317 - DNA, 17 bp, Homo sapiens
aggaataattatttatt

SEQ ID NO: 974318 - DNA, 18 bp, Homo sapiens
aggaataattatttattt

SEQ ID NO: 974319 - DNA, 22 bp, Homo sapiens
aggaataattatttatttaata

SEQ ID NO: 974320 - DNA, 15 bp, Homo sapiens
aggaatacattttat

SEQ ID NO: 974321 - DNA, 18 bp, Homo sapiens
aggaatacattttattct

SEQ ID NO: 974322 - DNA, 15 bp, Homo sapiens
aggaatagccagaga

SEQ ID NO: 974323 - DNA, 16 bp, Homo sapiens
aggaatagtggacatg

SEQ ID NO: 974324 - DNA, 17 bp, Homo sapiens
aggaatatatggcagag

SEQ ID NO: 974325 - DNA, 17 bp, Homo sapiens
aggaatatatgtgtgcc

SEQ ID NO: 974326 - DNA, 15 bp, Homo sapiens
aggaatattttccaa

SEQ ID NO: 974327 - DNA, 16 bp, Homo sapiens
aggaatattttccaaa

SEQ ID NO: 974328 - DNA, 18 bp, Homo sapiens
aggaatcactggggatgg

SEQ ID NO: 974329 - DNA, 23 bp, Homo sapiens
aggaatcatgtcaggcctgtgtg

SEQ ID NO: 974330 - DNA, 21 bp, Homo sapiens
aggaatccaaaagacaaaaat

SEQ ID NO: 974331 - DNA, 15 bp, Homo sapiens
aggaatcctggcagc

SEQ ID NO: 974332 - DNA, 18 bp, Homo sapiens
aggaatcctggcagccca

SEQ ID NO: 974333 - DNA, 15 bp, Homo sapiens
aggaatcctttgaga

SEQ ID NO: 974334 - DNA, 22 bp, Homo sapiens
aggaatctgaaagtatattttc

SEQ ID NO: 974335 - DNA, 12 bp, Homo sapiens
aggaatctgcct

SEQ ID NO: 974336 - DNA, 16 bp, Homo sapiens
aggaatctgccttcca

SEQ ID NO: 974337 - DNA, 14 bp, Homo sapiens
aggaatctgtttct

SEQ ID NO: 974338 - DNA, 22 bp, Homo sapiens
aggaatgagtcaatcagccttt

SEQ ID NO: 974339 - DNA, 16 bp, Homo sapiens
aggaatgatattgctg

SEQ ID NO: 974340 - DNA, 16 bp, Homo sapiens
aggaatgcctgtgtga

SEQ ID NO: 974341 - DNA, 12 bp, Homo sapiens
aggaatgctccc

SEQ ID NO: 974342 - DNA, 15 bp, Homo sapiens
aggaatgctccccca

SEQ ID NO: 974343 - DNA, 14 bp, Homo sapiens
aggaatgctctgtg

SEQ ID NO: 974344 - DNA, 14 bp, Homo sapiens
aggaatggaagtcc

SEQ ID NO: 974345 - DNA, 23 bp, Homo sapiens
aggaatggaatcttctccagtat

SEQ ID NO: 974346 - DNA, 23 bp, Homo sapiens
aggaatggctgcacctttttgca

SEQ ID NO: 974347 - DNA, 22 bp, Homo sapiens
aggaatggggggcgggccaggg

SEQ ID NO: 974348 - DNA, 23 bp, Homo sapiens
aggaatggggggcgggccagggt

SEQ ID NO: 974349 - DNA, 15 bp, Homo sapiens
aggaatgtagaagtc

SEQ ID NO: 974350 - DNA, 16 bp, Homo sapiens
aggaatgtgaaattta

SEQ ID NO: 974351 - DNA, 22 bp, Homo sapiens
aggaatgttaaagtcagtggga

SEQ ID NO: 974352 - DNA, 16 bp, Homo sapiens
aggaattacgtgctct

SEQ ID NO: 974353 - DNA, 23 bp, Homo sapiens
aggaattcccagcccaaagctgt

SEQ ID NO: 974354 - DNA, 20 bp, Homo sapiens
aggaattctaaataaatttc

SEQ ID NO: 974355 - DNA, 20 bp, Homo sapiens
aggaattcttctgttctctg

SEQ ID NO: 974356 - DNA, 14 bp, Homo sapiens
aggaattgtttata

SEQ ID NO: 974357 - DNA, 19 bp, Homo sapiens
aggaatttaaaattaagta

SEQ ID NO: 974358 - DNA, 13 bp, Homo sapiens
aggaatttacttt

SEQ ID NO: 974359 - DNA, 12 bp, Homo sapiens
aggaatttcctc

SEQ ID NO: 974360 - DNA, 13 bp, Homo sapiens
aggaatttcttaa

SEQ ID NO: 974361 - DNA, 19 bp, Homo sapiens
aggaatttgaagctgcagt

SEQ ID NO: 974362 - DNA, 18 bp, Homo sapiens
aggaatttgatgattttc

SEQ ID NO: 974363 - DNA, 15 bp, Homo sapiens
aggaatttgattgct

SEQ ID NO: 974364 - DNA, 19 bp, Homo sapiens
aggaatttgattgctttgc

SEQ ID NO: 974365 - DNA, 16 bp, Homo sapiens
aggaatttggctgctt

SEQ ID NO: 974366 - DNA, 17 bp, Homo sapiens
aggaatttggctgcttc

SEQ ID NO: 974367 - DNA, 18 bp, Homo sapiens
aggaattttattttgctg

SEQ ID NO: 974368 - DNA, 16 bp, Homo sapiens
aggacaaacagctcag

SEQ ID NO: 974369 - DNA, 22 bp, Homo sapiens
aggacaaacgggctcgggtctg

SEQ ID NO: 974370 - DNA, 16 bp, Homo sapiens
aggacaagaaggagag

SEQ ID NO: 974371 - DNA, 21 bp, Homo sapiens
aggacaatcagtcccctccca

SEQ ID NO: 974372 - DNA, 23 bp, Homo sapiens
aggacaatcagtcccctcccatc

SEQ ID NO: 974373 - DNA, 22 bp, Homo sapiens
aggacacaccccacaccccagc

SEQ ID NO: 974374 - DNA, 12 bp, Homo sapiens
aggacacagcag

SEQ ID NO: 974375 - DNA, 19 bp, Homo sapiens
aggactatagcccaggtcc

SEQ ID NO: 974376 - DNA, 14 bp, Homo sapiens
aggactccaggcag

SEQ ID NO: 974377 - DNA, 20 bp, Homo sapiens
aggactccaggcccaaggct

SEQ ID NO: 974378 - DNA, 19 bp, Homo sapiens
aggactcccaaccctggct

SEQ ID NO: 974379 - DNA, 20 bp, Homo sapiens
aggactccccaggccaggcc

SEQ ID NO: 974380 - DNA, 21 bp, Homo sapiens
aggactcctcctttttccatg

SEQ ID NO: 974381 - DNA, 18 bp, Homo sapiens
aggactcggccactgtgt

SEQ ID NO: 974382 - DNA, 12 bp, Homo sapiens
aggactctcagg

SEQ ID NO: 974383 - DNA, 16 bp, Homo sapiens
aggactctgcctcctc

SEQ ID NO: 974384 - DNA, 19 bp, Homo sapiens
aggactctgcctcctcttc

SEQ ID NO: 974385 - DNA, 20 bp, Homo sapiens
aggactctgcttaaacaaag

SEQ ID NO: 974386 - DNA, 13 bp, Homo sapiens
aggactgaaagaa

SEQ ID NO: 974387 - DNA, 14 bp, Homo sapiens
aggactgagccctc

SEQ ID NO: 974388 - DNA, 15 bp, Homo sapiens
aggactgagggcagt

SEQ ID NO: 974389 - DNA, 15 bp, Homo sapiens
aggactgcagacagg

SEQ ID NO: 974390 - DNA, 13 bp, Homo sapiens
aggactgcagtgt

SEQ ID NO: 974391 - DNA, 12 bp, Homo sapiens
aggactgcattg

SEQ ID NO: 974392 - DNA, 21 bp, Homo sapiens
aggactgccgaccgaggctgg

SEQ ID NO: 974393 - DNA, 15 bp, Homo sapiens
aggactggactgttt

SEQ ID NO: 974394 - DNA, 22 bp, Homo sapiens
aggactggagaccgcttcaccc

SEQ ID NO: 974395 - DNA, 17 bp, Homo sapiens
aggactggattggccaa

SEQ ID NO: 974396 - DNA, 13 bp, Homo sapiens
aggactgtaaaca

SEQ ID NO: 974397 - DNA, 15 bp, Homo sapiens
aggactgtaaagatt

SEQ ID NO: 974398 - DNA, 12 bp, Homo sapiens
aggactgtataa

SEQ ID NO: 974399 - DNA, 14 bp, Homo sapiens
aggactgtcctccc

SEQ ID NO: 974400 - DNA, 15 bp, Homo sapiens
aggactgtcctccca

SEQ ID NO: 974401 - DNA, 21 bp, Homo sapiens
aggactgtcctcccacagacc

SEQ ID NO: 974402 - DNA, 14 bp, Homo sapiens
aggactgtgtgaga

SEQ ID NO: 974403 - DNA, 23 bp, Homo sapiens
aggactgtgtttccaaaggttcc

SEQ ID NO: 974404 - DNA, 14 bp, Homo sapiens
aggactgtttcagt

SEQ ID NO: 974405 - DNA, 15 bp, Homo sapiens
aggacttaaaattag

SEQ ID NO: 974406 - DNA, 20 bp, Homo sapiens
aggacttagaatagtgccta

SEQ ID NO: 974407 - DNA, 19 bp, Homo sapiens
aggacttcaggaacaagta

SEQ ID NO: 974408 - DNA, 13 bp, Homo sapiens
aggacttctgcag

SEQ ID NO: 974409 - DNA, 13 bp, Homo sapiens
aggacttgaaaga

SEQ ID NO: 974410 - DNA, 16 bp, Homo sapiens
aggacttgaaagcatc

SEQ ID NO: 974411 - DNA, 19 bp, Homo sapiens
aggacttgaaagcatccat

SEQ ID NO: 974412 - DNA, 24 bp, Homo sapiens
aggacttgctaaagcactttgcac

SEQ ID NO: 974413 - DNA, 21 bp, Homo sapiens
aggacttggagggtctggggg

SEQ ID NO: 974414 - DNA, 14 bp, Homo sapiens
aggactttgaatta

SEQ ID NO: 974415 - DNA, 23 bp, Homo sapiens
aggactttgaggcaagtgtgggc

SEQ ID NO: 974416 - DNA, 17 bp, Homo sapiens
aggacttttttgattaa

SEQ ID NO: 974417 - DNA, 13 bp, Homo sapiens
aggagaaaaacaa

SEQ ID NO: 974418 - DNA, 22 bp, Homo sapiens
aggagaaaagtgggctgcagca

SEQ ID NO: 974419 - DNA, 12 bp, Homo sapiens
aggagaaacaca

SEQ ID NO: 974420 - DNA, 14 bp, Homo sapiens
aggagaaacacatc

SEQ ID NO: 974421 - DNA, 18 bp, Homo sapiens
aggagaaacacattctta

SEQ ID NO: 974422 - DNA, 20 bp, Homo sapiens
aggagaaagccgggggaggg

SEQ ID NO: 974423 - DNA, 16 bp, Homo sapiens
aggagaaatgcatcca

SEQ ID NO: 974424 - DNA, 22 bp, Homo sapiens
aggagaacagtaggattgctgt

SEQ ID NO: 974425 - DNA, 16 bp, Homo sapiens
aggagaaccagattct

SEQ ID NO: 974426 - DNA, 12 bp, Homo sapiens
aggagaagctca

SEQ ID NO: 974427 - DNA, 13 bp, Homo sapiens
aggagaagctcag

SEQ ID NO: 974428 - DNA, 13 bp, Homo sapiens
aggagaaggagga

SEQ ID NO: 974429 - DNA, 14 bp, Homo sapiens
aggagaaggaggag

SEQ ID NO: 974430 - DNA, 17 bp, Homo sapiens
aggagaaggaggagaga

SEQ ID NO: 974431 - DNA, 12 bp, Homo sapiens
aaaactgtattt

SEQ ID NO: 974432 - DNA, 14 bp, Homo sapiens
aaaactgtatttaa

SEQ ID NO: 974433 - DNA, 21 bp, Homo sapiens
aaaactgtgaccaagtataaa

SEQ ID NO: 974434 - DNA, 19 bp, Homo sapiens
aaaactgtgcaacttttta

SEQ ID NO: 974435 - DNA, 15 bp, Homo sapiens
aaaactgtgggaaga

SEQ ID NO: 974436 - DNA, 11 bp, Homo sapiens
aaaactgtgta

SEQ ID NO: 974437 - DNA, 13 bp, Homo sapiens
aaaactgtgtaaa

SEQ ID NO: 974438 - DNA, 17 bp, Homo sapiens
aaaactgtgtatcatta

SEQ ID NO: 974439 - DNA, 19 bp, Homo sapiens
aaaactgtgtatcattaaa

SEQ ID NO: 974440 - DNA, 21 bp, Homo sapiens
aaaactgtgtatcattaaaat

SEQ ID NO: 974441 - DNA, 22 bp, Homo sapiens
aaaactgtgtatcattaaaata

SEQ ID NO: 974442 - DNA, 20 bp, Homo sapiens
aaaactgttcttttgcattt

SEQ ID NO: 974443 - DNA, 14 bp, Homo sapiens
aaaacttaaagcaa

SEQ ID NO: 974444 - DNA, 21 bp, Homo sapiens
aaaacttatgctgatttattt

SEQ ID NO: 974445 - DNA, 11 bp, Homo sapiens
aaaacttcaaa

SEQ ID NO: 974446 - DNA, 22 bp, Homo sapiens
aaaacttcaaagctgaatattt

SEQ ID NO: 974447 - DNA, 21 bp, Homo sapiens
aaaacttcagtttcacagaaa

SEQ ID NO: 974448 - DNA, 22 bp, Homo sapiens
aaaacttcattctaaaccaaaa

SEQ ID NO: 974449 - DNA, 21 bp, Homo sapiens
aaaacttgactccatttcatc

SEQ ID NO: 974450 - DNA, 22 bp, Homo sapiens
aaaacttgatgtgttatctctt

SEQ ID NO: 974451 - DNA, 18 bp, Homo sapiens
aaaactttaaaaggcaac

SEQ ID NO: 974452 - DNA, 15 bp, Homo sapiens
aaaactttaaacctg

SEQ ID NO: 974453 - DNA, 21 bp, Homo sapiens
aaaactttattgggtttttat

SEQ ID NO: 974454 - DNA, 13 bp, Homo sapiens
aaaactttatttt

SEQ ID NO: 974455 - DNA, 17 bp, Homo sapiens
aaaactttattttatat

SEQ ID NO: 974456 - DNA, 18 bp, Homo sapiens
aaaactttattttatata

SEQ ID NO: 974457 - DNA, 19 bp, Homo sapiens
aaaactttattttatataa

SEQ ID NO: 974458 - DNA, 16 bp, Homo sapiens
aaaactttcctcgcct

SEQ ID NO: 974459 - DNA, 13 bp, Homo sapiens
aaaacttttataa

SEQ ID NO: 974460 - DNA, 15 bp, Homo sapiens
aaaacttttataaat

SEQ ID NO: 974461 - DNA, 18 bp, Homo sapiens
aaaacttttataaattaa

SEQ ID NO: 974462 - DNA, 22 bp, Homo sapiens
aaaacttttataaattaaatat

SEQ ID NO: 974463 - DNA, 11 bp, Homo sapiens
aaaacttttgt

SEQ ID NO: 974464 - DNA, 17 bp, Homo sapiens
aaaagaaaaaaaaaaga

SEQ ID NO: 974465 - DNA, 18 bp, Homo sapiens
aaaagaaaaaaagaaaaa

SEQ ID NO: 974466 - DNA, 13 bp, Homo sapiens
aaaagaaaacatt

SEQ ID NO: 974467 - DNA, 14 bp, Homo sapiens
aaaagaaaacattt

SEQ ID NO: 974468 - DNA, 16 bp, Homo sapiens
aaaagaaaacatttaa

SEQ ID NO: 974469 - DNA, 10 bp, Homo sapiens
aaaagaaaag

SEQ ID NO: 974470 - DNA, 15 bp, Homo sapiens
aaaagaaaataaaaa

SEQ ID NO: 974471 - DNA, 22 bp, Homo sapiens
aaaagaaaatctttataaatgt

SEQ ID NO: 974472 - DNA, 14 bp, Homo sapiens
aaaagaaacacaag

SEQ ID NO: 974473 - DNA, 18 bp, Homo sapiens
aaaagaaaccatgacaaa

SEQ ID NO: 974474 - DNA, 10 bp, Homo sapiens
aaaagaaagc

SEQ ID NO: 974475 - DNA, 11 bp, Homo sapiens
aaaagaaaggc

SEQ ID NO: 974476 - DNA, 23 bp, Homo sapiens
aaaagaaatatacagtttgactt

SEQ ID NO: 974477 - DNA, 19 bp, Homo sapiens
aaaagaaatccagtttgtg

SEQ ID NO: 974478 - DNA, 12 bp, Homo sapiens
aaaagaaatgaa

SEQ ID NO: 974479 - DNA, 13 bp, Homo sapiens
aaaagaaatgtca

SEQ ID NO: 974480 - DNA, 16 bp, Homo sapiens
aaaagaacagtaaaca

SEQ ID NO: 974481 - DNA, 14 bp, Homo sapiens
aaaagaagacatct

SEQ ID NO: 974482 - DNA, 16 bp, Homo sapiens
aaaagaagagccttgt

SEQ ID NO: 974483 - DNA, 14 bp, Homo sapiens
aaaagaagcacttt

SEQ ID NO: 974484 - DNA, 23 bp, Homo sapiens
aaaagaaggggggtctctggctt

SEQ ID NO: 974485 - DNA, 19 bp, Homo sapiens
aaaagaatatttagaaaaa

SEQ ID NO: 974486 - DNA, 13 bp, Homo sapiens
aaaagacaagaga

SEQ ID NO: 974487 - DNA, 20 bp, Homo sapiens
aaaagacagacccagtgagt

SEQ ID NO: 974488 - DNA, 14 bp, Homo sapiens
aaaagacattttaa

SEQ ID NO: 974489 - DNA, 14 bp, Homo sapiens
aaaagaccaagact

SEQ ID NO: 974490 - DNA, 16 bp, Homo sapiens
aaaagaccaagacttt

SEQ ID NO: 974491 - DNA, 14 bp, Homo sapiens
aaaagaccagggct

SEQ ID NO: 974492 - DNA, 19 bp, Homo sapiens
aaaagaccctgagactcca

SEQ ID NO: 974493 - DNA, 13 bp, Homo sapiens
aaaagactgaaca

SEQ ID NO: 974494 - DNA, 16 bp, Homo sapiens
aaaagactgaacatgt

SEQ ID NO: 974495 - DNA, 17 bp, Homo sapiens
aaaagactgaacatgtt

SEQ ID NO: 974496 - DNA, 18 bp, Homo sapiens
aaaagactgtcaaatgaa

SEQ ID NO: 974497 - DNA, 16 bp, Homo sapiens
aaaagagaacagaaaa

SEQ ID NO: 974498 - DNA, 23 bp, Homo sapiens
aaaagtgatcaataaaatgtgat

SEQ ID NO: 974499 - DNA, 22 bp, Homo sapiens
aaaagtgatcttaggtttgttt

SEQ ID NO: 974500 - DNA, 22 bp, Homo sapiens
aaaagtgatgtattttcatagt

SEQ ID NO: 974501 - DNA, 23 bp, Homo sapiens
aaaagtgatgtattttcatagtg

SEQ ID NO: 974502 - DNA, 20 bp, Homo sapiens
aaaagtgattatctctttga

SEQ ID NO: 974503 - DNA, 14 bp, Homo sapiens
aaaagtgcatttaa

SEQ ID NO: 974504 - DNA, 15 bp, Homo sapiens
aaaagtgcatttaag

SEQ ID NO: 974505 - DNA, 20 bp, Homo sapiens
aaaagtgccattaacaaatg

SEQ ID NO: 974506 - DNA, 15 bp, Homo sapiens
aaaagtgcttcattc

SEQ ID NO: 974507 - DNA, 18 bp, Homo sapiens
aaaagtgcttcattcttt

SEQ ID NO: 974508 - DNA, 12 bp, Homo sapiens
aaaagtgtattt

SEQ ID NO: 974509 - DNA, 23 bp, Homo sapiens
aaaagtgttttgttttttaattc

SEQ ID NO: 974510 - DNA, 14 bp, Homo sapiens
aaaagttagctgag

SEQ ID NO: 974511 - DNA, 16 bp, Homo sapiens
aaaagttataataact

SEQ ID NO: 974512 - DNA, 17 bp, Homo sapiens
aaaagttataataactg

SEQ ID NO: 974513 - DNA, 18 bp, Homo sapiens
aaaagttgcagctgtttt

SEQ ID NO: 974514 - DNA, 21 bp, Homo sapiens
aaaagttgcagctgttttgtt

SEQ ID NO: 974515 - DNA, 21 bp, Homo sapiens
aaaagttgcgtttaagttgta

SEQ ID NO: 974516 - DNA, 21 bp, Homo sapiens
aaaagttggaaggatctgctg

SEQ ID NO: 974517 - DNA, 19 bp, Homo sapiens
aaaagtttcacgtcttggt

SEQ ID NO: 974518 - DNA, 12 bp, Homo sapiens
aaaagtttccat

SEQ ID NO: 974519 - DNA, 18 bp, Homo sapiens
aaaagtttgaaaagcaat

SEQ ID NO: 974520 - DNA, 12 bp, Homo sapiens
aaaagtttgttt

SEQ ID NO: 974521 - DNA, 20 bp, Homo sapiens
aaaagttttttattatgcat

SEQ ID NO: 974522 - DNA, 15 bp, Homo sapiens
aaaataaaaaaaaga

SEQ ID NO: 974523 - DNA, 16 bp, Homo sapiens
aaaataaaaaaaagaa

SEQ ID NO: 974524 - DNA, 17 bp, Homo sapiens
aaaataaaaaaaagaaa

SEQ ID NO: 974525 - DNA, 17 bp, Homo sapiens
aaaataaaaaacatata

SEQ ID NO: 974526 - DNA, 20 bp, Homo sapiens
aaaataaaaagatcactttc

SEQ ID NO: 974527 - DNA, 20 bp, Homo sapiens
aaaataaaaagcctcagtga

SEQ ID NO: 974528 - DNA, 12 bp, Homo sapiens
aaaataaaacat

SEQ ID NO: 974529 - DNA, 17 bp, Homo sapiens
aaaataaaacatagcaa

SEQ ID NO: 974530 - DNA, 12 bp, Homo sapiens
aaaataaaactg

SEQ ID NO: 974531 - DNA, 14 bp, Homo sapiens
aaaataaaactgtc

SEQ ID NO: 974532 - DNA, 20 bp, Homo sapiens
aaaataaaacttcacattta

SEQ ID NO: 974533 - DNA, 16 bp, Homo sapiens
aaaataaaacttttta

SEQ ID NO: 974534 - DNA, 21 bp, Homo sapiens
aaaataaaatttccttcaggt

SEQ ID NO: 974535 - DNA, 14 bp, Homo sapiens
aaaataaacaaata

SEQ ID NO: 974536 - DNA, 22 bp, Homo sapiens
aaaataaacgtggattttaaaa

SEQ ID NO: 974537 - DNA, 15 bp, Homo sapiens
aaaataaacttctta

SEQ ID NO: 974538 - DNA, 22 bp, Homo sapiens
aaaataaagcctatttttcaaa

SEQ ID NO: 974539 - DNA, 13 bp, Homo sapiens
aaaataaagttgg

SEQ ID NO: 974540 - DNA, 15 bp, Homo sapiens
aaaataaataatttt

SEQ ID NO: 974541 - DNA, 11 bp, Homo sapiens
aaaataaatat

SEQ ID NO: 974542 - DNA, 20 bp, Homo sapiens
aaaataaatcttagtgttca

SEQ ID NO: 974543 - DNA, 14 bp, Homo sapiens
aaaataacacacat

SEQ ID NO: 974544 - DNA, 13 bp, Homo sapiens
aaaataacactgt

SEQ ID NO: 974545 - DNA, 17 bp, Homo sapiens
aaaataacctaattaat

SEQ ID NO: 974546 - DNA, 17 bp, Homo sapiens
aaaataactaaaatgta

SEQ ID NO: 974547 - DNA, 13 bp, Homo sapiens
aaaataactattt

SEQ ID NO: 974548 - DNA, 20 bp, Homo sapiens
aaaataactattttgtttta

SEQ ID NO: 974549 - DNA, 18 bp, Homo sapiens
aaaataacttagactcta

SEQ ID NO: 974550 - DNA, 19 bp, Homo sapiens
aaaataagcaggtggatct

SEQ ID NO: 974551 - DNA, 12 bp, Homo sapiens
aaaataagcttt

SEQ ID NO: 974552 - DNA, 16 bp, Homo sapiens
aaaataagtcaacagt

SEQ ID NO: 974553 - DNA, 16 bp, Homo sapiens
aaaataatcaagattt

SEQ ID NO: 974554 - DNA, 14 bp, Homo sapiens
aaaataatctctga

SEQ ID NO: 974555 - DNA, 20 bp, Homo sapiens
aaaataatggagaatcactt

SEQ ID NO: 974556 - DNA, 12 bp, Homo sapiens
aaaataatgtaa

SEQ ID NO: 974557 - DNA, 14 bp, Homo sapiens
aaaataattattta

SEQ ID NO: 974558 - DNA, 14 bp, Homo sapiens
aaaataattgttgg

SEQ ID NO: 974559 - DNA, 14 bp, Homo sapiens
aaaatacaaaaagc

SEQ ID NO: 974560 - DNA, 15 bp, Homo sapiens
aaaatacaatcctgt

SEQ ID NO: 974561 - DNA, 17 bp, Homo sapiens
aaaatacaatcctgttt

SEQ ID NO: 974562 - DNA, 19 bp, Homo sapiens
aggaggacttggagggtct

SEQ ID NO: 974563 - DNA, 22 bp, Homo sapiens
aggaggacttggagggtctggg

SEQ ID NO: 974564 - DNA, 13 bp, Homo sapiens
aggaggagaagga

SEQ ID NO: 974565 - DNA, 17 bp, Homo sapiens
aggaggagatggccata

SEQ ID NO: 974566 - DNA, 11 bp, Homo sapiens
aggaggagcct

SEQ ID NO: 974567 - DNA, 13 bp, Homo sapiens
aggaggaggagcc

SEQ ID NO: 974568 - DNA, 16 bp, Homo sapiens
aggaggagggaggccg

SEQ ID NO: 974569 - DNA, 20 bp, Homo sapiens
aggaggatgtccctgggcca

SEQ ID NO: 974570 - DNA, 16 bp, Homo sapiens
aggaggcagccccctc

SEQ ID NO: 974571 - DNA, 19 bp, Homo sapiens
aggaggccaaccagcccga

SEQ ID NO: 974572 - DNA, 22 bp, Homo sapiens
aggaggccaaccagcccgacag

SEQ ID NO: 974573 - DNA, 13 bp, Homo sapiens
aggaggccaataa

SEQ ID NO: 974574 - DNA, 20 bp, Homo sapiens
aggaggccaataaaaagttc

SEQ ID NO: 974575 - DNA, 14 bp, Homo sapiens
aggaggccacctct

SEQ ID NO: 974576 - DNA, 15 bp, Homo sapiens
aggaggccacctctc

SEQ ID NO: 974577 - DNA, 17 bp, Homo sapiens
aggaggccacctctcca

SEQ ID NO: 974578 - DNA, 20 bp, Homo sapiens
aggaggccccccgtgtggac

SEQ ID NO: 974579 - DNA, 17 bp, Homo sapiens
aggaggcccctggccca

SEQ ID NO: 974580 - DNA, 19 bp, Homo sapiens
aggaggcctcaaagcaacc

SEQ ID NO: 974581 - DNA, 15 bp, Homo sapiens
aggaggcctgcacca

SEQ ID NO: 974582 - DNA, 13 bp, Homo sapiens
aggaggcctggac

SEQ ID NO: 974583 - DNA, 14 bp, Homo sapiens
aggaggcctgggga

SEQ ID NO: 974584 - DNA, 22 bp, Homo sapiens
aggaggcctggggaggccctag

SEQ ID NO: 974585 - DNA, 20 bp, Homo sapiens
aggaggctcaggtgatctgt

SEQ ID NO: 974586 - DNA, 18 bp, Homo sapiens
aggaggctccagagggca

SEQ ID NO: 974587 - DNA, 15 bp, Homo sapiens
aggaggctccggccc

SEQ ID NO: 974588 - DNA, 16 bp, Homo sapiens
aggaggctgaggcaga

SEQ ID NO: 974589 - DNA, 17 bp, Homo sapiens
aggaggctgaggcagaa

SEQ ID NO: 974590 - DNA, 17 bp, Homo sapiens
aggaggctgaggcagga

SEQ ID NO: 974591 - DNA, 15 bp, Homo sapiens
aggaggctgcatgct

SEQ ID NO: 974592 - DNA, 18 bp, Homo sapiens
aggaggctgcatgctctg

SEQ ID NO: 974593 - DNA, 20 bp, Homo sapiens
aggaggctgcatgctctgga

SEQ ID NO: 974594 - DNA, 18 bp, Homo sapiens
aggaggctgccctgaggg

SEQ ID NO: 974595 - DNA, 13 bp, Homo sapiens
aggaggctggcag

SEQ ID NO: 974596 - DNA, 13 bp, Homo sapiens
aggaggctggcca

SEQ ID NO: 974597 - DNA, 14 bp, Homo sapiens
aggaggctggccaa

SEQ ID NO: 974598 - DNA, 19 bp, Homo sapiens
aggaggctttaagctccag

SEQ ID NO: 974599 - DNA, 23 bp, Homo sapiens
aggaggctttaagctccagcttt

SEQ ID NO: 974600 - DNA, 15 bp, Homo sapiens
aggagggacttggct

SEQ ID NO: 974601 - DNA, 20 bp, Homo sapiens
aggagggacttggctgtcct

SEQ ID NO: 974602 - DNA, 22 bp, Homo sapiens
aggagggaggcaggggaggggt

SEQ ID NO: 974603 - DNA, 14 bp, Homo sapiens
aggagggaggccag

SEQ ID NO: 974604 - DNA, 15 bp, Homo sapiens
aggagggagggggct

SEQ ID NO: 974605 - DNA, 20 bp, Homo sapiens
aggagggcaagggccatgct

SEQ ID NO: 974606 - DNA, 13 bp, Homo sapiens
aggagggcagagc

SEQ ID NO: 974607 - DNA, 18 bp, Homo sapiens
aggagggcagagccatgg

SEQ ID NO: 974608 - DNA, 15 bp, Homo sapiens
aggagggcagaggga

SEQ ID NO: 974609 - DNA, 22 bp, Homo sapiens
aggagggcagagggagaatcca

SEQ ID NO: 974610 - DNA, 14 bp, Homo sapiens
aggagggcccggag

SEQ ID NO: 974611 - DNA, 22 bp, Homo sapiens
aggagggcccggagaaactgag

SEQ ID NO: 974612 - DNA, 15 bp, Homo sapiens
aggaggggaagaggc

SEQ ID NO: 974613 - DNA, 16 bp, Homo sapiens
aggaggggaagaggcc

SEQ ID NO: 974614 - DNA, 21 bp, Homo sapiens
aggaggggagagacaggcagc

SEQ ID NO: 974615 - DNA, 14 bp, Homo sapiens
aggaggggagggta

SEQ ID NO: 974616 - DNA, 13 bp, Homo sapiens
aggaggggccgct

SEQ ID NO: 974617 - DNA, 15 bp, Homo sapiens
aggaggggcctgggc

SEQ ID NO: 974618 - DNA, 19 bp, Homo sapiens
aggaggggcctgggcagcc

SEQ ID NO: 974619 - DNA, 19 bp, Homo sapiens
aggagggggccgggcgcgg

SEQ ID NO: 974620 - DNA, 21 bp, Homo sapiens
aggaggggtctggacatgtgg

SEQ ID NO: 974621 - DNA, 17 bp, Homo sapiens
aaaatggttgatggaaa

SEQ ID NO: 974622 - DNA, 18 bp, Homo sapiens
aaaatggttgatggaaaa

SEQ ID NO: 974623 - DNA, 19 bp, Homo sapiens
aaaatggttgatggaaaat

SEQ ID NO: 974624 - DNA, 14 bp, Homo sapiens
aaaatggtttttgt

SEQ ID NO: 974625 - DNA, 17 bp, Homo sapiens
aaaatgtaaatactcat

SEQ ID NO: 974626 - DNA, 23 bp, Homo sapiens
aaaatgtaaatactcatgaatga

SEQ ID NO: 974627 - DNA, 22 bp, Homo sapiens
aaaatgtaacatcataattaca

SEQ ID NO: 974628 - DNA, 18 bp, Homo sapiens
aaaatgtaatttagaaac

SEQ ID NO: 974629 - DNA, 15 bp, Homo sapiens
aaaatgtacatttat

SEQ ID NO: 974630 - DNA, 14 bp, Homo sapiens
aaaatgtacttaaa

SEQ ID NO: 974631 - DNA, 18 bp, Homo sapiens
aaaatgtacttaaatgag

SEQ ID NO: 974632 - DNA, 11 bp, Homo sapiens
aaaatgtatat

SEQ ID NO: 974633 - DNA, 13 bp, Homo sapiens
aaaatgtatattt

SEQ ID NO: 974634 - DNA, 21 bp, Homo sapiens
aaaatgtattcaagcaaacat

SEQ ID NO: 974635 - DNA, 17 bp, Homo sapiens
aaaatgtcacattctat

SEQ ID NO: 974636 - DNA, 18 bp, Homo sapiens
aaaatgtcctgcctttta

SEQ ID NO: 974637 - DNA, 21 bp, Homo sapiens
aaaatgtctttccaaattatt

SEQ ID NO: 974638 - DNA, 22 bp, Homo sapiens
aaaatgtgaaatctcagaattt

SEQ ID NO: 974639 - DNA, 13 bp, Homo sapiens
aaaatgtgaaatg

SEQ ID NO: 974640 - DNA, 14 bp, Homo sapiens
aaaatgtgaaatgc

SEQ ID NO: 974641 - DNA, 15 bp, Homo sapiens
aaaatgtgaggaaga

SEQ ID NO: 974642 - DNA, 14 bp, Homo sapiens
aaaatgtgtctctg

SEQ ID NO: 974643 - DNA, 15 bp, Homo sapiens
aaaatgttacgtgaa

SEQ ID NO: 974644 - DNA, 16 bp, Homo sapiens
aaaatgttcagaaggt

SEQ ID NO: 974645 - DNA, 20 bp, Homo sapiens
aaaatgttcccttgaccatt

SEQ ID NO: 974646 - DNA, 11 bp, Homo sapiens
aaaatgttcta

SEQ ID NO: 974647 - DNA, 18 bp, Homo sapiens
aaaatgttctatttaaca

SEQ ID NO: 974648 - DNA, 23 bp, Homo sapiens
aaaatgttctatttaacaactgg

SEQ ID NO: 974649 - DNA, 15 bp, Homo sapiens
aaaatgttggattta

SEQ ID NO: 974650 - DNA, 16 bp, Homo sapiens
aaaatgtttaagtatt

SEQ ID NO: 974651 - DNA, 15 bp, Homo sapiens
aaaatgtttcattat

SEQ ID NO: 974652 - DNA, 15 bp, Homo sapiens
aaaatgtttgagcac

SEQ ID NO: 974653 - DNA, 16 bp, Homo sapiens
aaaatgttttttgata

SEQ ID NO: 974654 - DNA, 11 bp, Homo sapiens
aaaattaaagc

SEQ ID NO: 974655 - DNA, 15 bp, Homo sapiens
aaaattaaatctaga

SEQ ID NO: 974656 - DNA, 17 bp, Homo sapiens
aaaattaaatgccttgt

SEQ ID NO: 974657 - DNA, 13 bp, Homo sapiens
aaaattaactttt

SEQ ID NO: 974658 - DNA, 17 bp, Homo sapiens
aaaattaagtagaacaa

SEQ ID NO: 974659 - DNA, 15 bp, Homo sapiens
aaaattaatagcttt

SEQ ID NO: 974660 - DNA, 18 bp, Homo sapiens
aaaattacctttaatttt

SEQ ID NO: 974661 - DNA, 17 bp, Homo sapiens
aaaattactaattttac

SEQ ID NO: 974662 - DNA, 19 bp, Homo sapiens
aaaattactgtgaattgtt

SEQ ID NO: 974663 - DNA, 22 bp, Homo sapiens
aaaattagaaaggacaacagtt

SEQ ID NO: 974664 - DNA, 20 bp, Homo sapiens
aaaattagtacctcaaagta

SEQ ID NO: 974665 - DNA, 17 bp, Homo sapiens
aaaattagtcttttgta

SEQ ID NO: 974666 - DNA, 22 bp, Homo sapiens
aaaattatactaacttatttat

SEQ ID NO: 974667 - DNA, 13 bp, Homo sapiens
aaaattatactgt

SEQ ID NO: 974668 - DNA, 15 bp, Homo sapiens
aaaattatgcaaaag

SEQ ID NO: 974669 - DNA, 23 bp, Homo sapiens
aaaattatgtttgccactttgca

SEQ ID NO: 974670 - DNA, 13 bp, Homo sapiens
aaaattatttgca

SEQ ID NO: 974671 - DNA, 15 bp, Homo sapiens
aaaattatttgctat

SEQ ID NO: 974672 - DNA, 13 bp, Homo sapiens
aaaattatttgta

SEQ ID NO: 974673 - DNA, 16 bp, Homo sapiens
aaaattcaaaaagtgt

SEQ ID NO: 974674 - DNA, 22 bp, Homo sapiens
aaaattcaaagcatggacattt

SEQ ID NO: 974675 - DNA, 21 bp, Homo sapiens
aaaattcaagcatttaggaat

SEQ ID NO: 974676 - DNA, 20 bp, Homo sapiens
aaaattcaaggccacaaaaa

SEQ ID NO: 974677 - DNA, 22 bp, Homo sapiens
aaaattcaaggccacaaaaaca

SEQ ID NO: 974678 - DNA, 23 bp, Homo sapiens
aaaattcaaggccacaaaaacaa

SEQ ID NO: 974679 - DNA, 16 bp, Homo sapiens
aaaattcagagtcctt

SEQ ID NO: 974680 - DNA, 21 bp, Homo sapiens
aaaattcagcaaaccattttt

SEQ ID NO: 974681 - DNA, 17 bp, Homo sapiens
aaaattcagtttttgta

SEQ ID NO: 974682 - DNA, 18 bp, Homo sapiens
aaaattcagtttttgtat

SEQ ID NO: 974683 - DNA, 20 bp, Homo sapiens
aaaattcagtttttgtatct

SEQ ID NO: 974684 - DNA, 13 bp, Homo sapiens
aaaattcattttt

SEQ ID NO: 974685 - DNA, 20 bp, Homo sapiens
aaaattccaaatttttttct

SEQ ID NO: 974686 - DNA, 14 bp, Homo sapiens
aaaattcccttcct

SEQ ID NO: 974687 - DNA, 17 bp, Homo sapiens
aaaattcccttcctgtt

SEQ ID NO: 974688 - DNA, 15 bp, Homo sapiens
aaaattcctgtgttc

SEQ ID NO: 974689 - DNA, 23 bp, Homo sapiens
aaaattcctgtgttcaatattta

SEQ ID NO: 974690 - DNA, 22 bp, Homo sapiens
aaaattcctttgtgtttctatt

SEQ ID NO: 974691 - DNA, 15 bp, Homo sapiens
aaaattctaaatgta

SEQ ID NO: 974692 - DNA, 17 bp, Homo sapiens
aaaattctcttaaataa

SEQ ID NO: 974693 - DNA, 15 bp, Homo sapiens
aaaattctgaatgta

SEQ ID NO: 974694 - DNA, 17 bp, Homo sapiens
aggcaaatgtgtacatg

SEQ ID NO: 974695 - DNA, 23 bp, Homo sapiens
aggcaaattaactgtatgtgtgt

SEQ ID NO: 974696 - DNA, 14 bp, Homo sapiens
aggcaacattcctt

SEQ ID NO: 974697 - DNA, 16 bp, Homo sapiens
aggcaactcaaagatg

SEQ ID NO: 974698 - DNA, 16 bp, Homo sapiens
aggcaactgaggcaga

SEQ ID NO: 974699 - DNA, 17 bp, Homo sapiens
aggcaactgaggcagac

SEQ ID NO: 974700 - DNA, 19 bp, Homo sapiens
aggcaactgaggcagacag

SEQ ID NO: 974701 - DNA, 14 bp, Homo sapiens
aggcaacttttaaa

SEQ ID NO: 974702 - DNA, 13 bp, Homo sapiens
aggcaagaaaagg

SEQ ID NO: 974703 - DNA, 19 bp, Homo sapiens
aggcaagagggaggggaca

SEQ ID NO: 974704 - DNA, 21 bp, Homo sapiens
aggcaagattggaaagacagg

SEQ ID NO: 974705 - DNA, 18 bp, Homo sapiens
aggcaagcccctcagccc

SEQ ID NO: 974706 - DNA, 21 bp, Homo sapiens
aggcaagcccctcagcccttg

SEQ ID NO: 974707 - DNA, 21 bp, Homo sapiens
aggcaagcccttcggtcacct

SEQ ID NO: 974708 - DNA, 15 bp, Homo sapiens
aggcaaggcaggtgc

SEQ ID NO: 974709 - DNA, 20 bp, Homo sapiens
aggcaaggcaggtgcctcca

SEQ ID NO: 974710 - DNA, 22 bp, Homo sapiens
aggcaaggcaggtgcctccagg

SEQ ID NO: 974711 - DNA, 18 bp, Homo sapiens
aggcaaggctatgtgatt

SEQ ID NO: 974712 - DNA, 15 bp, Homo sapiens
aggcaaggctgactt

SEQ ID NO: 974713 - DNA, 16 bp, Homo sapiens
aggcaagtccacccca

SEQ ID NO: 974714 - DNA, 17 bp, Homo sapiens
aggcaagtccaccccat

SEQ ID NO: 974715 - DNA, 18 bp, Homo sapiens
aggcaagtttctagctag

SEQ ID NO: 974716 - DNA, 17 bp, Homo sapiens
aggcaataaaaatcata

SEQ ID NO: 974717 - DNA, 18 bp, Homo sapiens
aggcaatcacttgaggtc

SEQ ID NO: 974718 - DNA, 18 bp, Homo sapiens
aggcaatcttaaaacaga

SEQ ID NO: 974719 - DNA, 21 bp, Homo sapiens
aggcaatgattcacgcttttg

SEQ ID NO: 974720 - DNA, 23 bp, Homo sapiens
aggcaatgtcaggaacagaagga

SEQ ID NO: 974721 - DNA, 17 bp, Homo sapiens
aggcaattttagtgtat

SEQ ID NO: 974722 - DNA, 14 bp, Homo sapiens
aggcacaatatggg

SEQ ID NO: 974723 - DNA, 22 bp, Homo sapiens
aggcacacaaggggcccttgga

SEQ ID NO: 974724 - DNA, 15 bp, Homo sapiens
aggcacacacagccc

SEQ ID NO: 974725 - DNA, 15 bp, Homo sapiens
aggcacacagcagcc

SEQ ID NO: 974726 - DNA, 17 bp, Homo sapiens
aggcacacagcagcccc

SEQ ID NO: 974727 - DNA, 21 bp, Homo sapiens
aggcacacagcagccccccag

SEQ ID NO: 974728 - DNA, 20 bp, Homo sapiens
aggcacacagggcccggcca

SEQ ID NO: 974729 - DNA, 18 bp, Homo sapiens
aggcacaccagtgcaagc

SEQ ID NO: 974730 - DNA, 16 bp, Homo sapiens
aggcacacttcttctt

SEQ ID NO: 974731 - DNA, 18 bp, Homo sapiens
aggcacagaggaggtcag

SEQ ID NO: 974732 - DNA, 19 bp, Homo sapiens
aggcacagaggaggtcagc

SEQ ID NO: 974733 - DNA, 14 bp, Homo sapiens
aggcacagctgagt

SEQ ID NO: 974734 - DNA, 18 bp, Homo sapiens
aggcacaggctgttgaag

SEQ ID NO: 974735 - DNA, 15 bp, Homo sapiens
aggcacagtgggagc

SEQ ID NO: 974736 - DNA, 18 bp, Homo sapiens
aggcacagtgggagctga

SEQ ID NO: 974737 - DNA, 22 bp, Homo sapiens
aggcacagtgggagctgagctg

SEQ ID NO: 974738 - DNA, 23 bp, Homo sapiens
aggcacagtgggagctgagctgg

SEQ ID NO: 974739 - DNA, 23 bp, Homo sapiens
aggcacataggctggtggccttg

SEQ ID NO: 974740 - DNA, 14 bp, Homo sapiens
aggcacatggagga

SEQ ID NO: 974741 - DNA, 17 bp, Homo sapiens
aggcacatggaggagct

SEQ ID NO: 974742 - DNA, 16 bp, Homo sapiens
aggcaccacagagaag

SEQ ID NO: 974743 - DNA, 22 bp, Homo sapiens
aggccacgtatagtcctagctg

SEQ ID NO: 974744 - DNA, 13 bp, Homo sapiens
aggccactagtga

SEQ ID NO: 974745 - DNA, 18 bp, Homo sapiens
aggccactcagaggcccc

SEQ ID NO: 974746 - DNA, 21 bp, Homo sapiens
aggccactcagaggcccccag

SEQ ID NO: 974747 - DNA, 14 bp, Homo sapiens
aggccactgtgagc

SEQ ID NO: 974748 - DNA, 18 bp, Homo sapiens
aggccactgtgagcgctg

SEQ ID NO: 974749 - DNA, 14 bp, Homo sapiens
aggccactgtggcc

SEQ ID NO: 974750 - DNA, 22 bp, Homo sapiens
aggccactgtggccagagctgg

SEQ ID NO: 974751 - DNA, 21 bp, Homo sapiens
aggccagagccatgccaggct

SEQ ID NO: 974752 - DNA, 17 bp, Homo sapiens
aggccagagtggcctgg

SEQ ID NO: 974753 - DNA, 20 bp, Homo sapiens
aggccagagtggcctggcca

SEQ ID NO: 974754 - DNA, 21 bp, Homo sapiens
aggccagagtggcctggccag

SEQ ID NO: 974755 - DNA, 22 bp, Homo sapiens
aggccagatggcccctccactg

SEQ ID NO: 974756 - DNA, 12 bp, Homo sapiens
aggccagcccag

SEQ ID NO: 974757 - DNA, 17 bp, Homo sapiens
aggccagcccagccagg

SEQ ID NO: 974758 - DNA, 19 bp, Homo sapiens
aggccagcccagccaggcc

SEQ ID NO: 974759 - DNA, 13 bp, Homo sapiens
aggccagccccac

SEQ ID NO: 974760 - DNA, 14 bp, Homo sapiens
aggccagccccccc

SEQ ID NO: 974761 - DNA, 11 bp, Homo sapiens
aggccagcctc

SEQ ID NO: 974762 - DNA, 17 bp, Homo sapiens
aggccagcctccgagag

SEQ ID NO: 974763 - DNA, 18 bp, Homo sapiens
aggccagcctccgagagg

SEQ ID NO: 974764 - DNA, 21 bp, Homo sapiens
aggccagcctgtccctgaaag

SEQ ID NO: 974765 - DNA, 13 bp, Homo sapiens
aggccagctgcct

SEQ ID NO: 974766 - DNA, 18 bp, Homo sapiens
aggccagcttcgtgctgg

SEQ ID NO: 974767 - DNA, 20 bp, Homo sapiens
aggccagcttcgtgctggag

SEQ ID NO: 974768 - DNA, 11 bp, Homo sapiens
aggccaggagt

SEQ ID NO: 974769 - DNA, 15 bp, Homo sapiens
aggccaggccagctg

SEQ ID NO: 974770 - DNA, 17 bp, Homo sapiens
aggccaggcgagcctga

SEQ ID NO: 974771 - DNA, 20 bp, Homo sapiens
aggccaggcgagcctgactc

SEQ ID NO: 974772 - DNA, 18 bp, Homo sapiens
aggccagggatagaggat

SEQ ID NO: 974773 - DNA, 15 bp, Homo sapiens
aggccagggcagagt

SEQ ID NO: 974774 - DNA, 19 bp, Homo sapiens
aggccagggcagcaaggga

SEQ ID NO: 974775 - DNA, 13 bp, Homo sapiens
aggccagggcctc

SEQ ID NO: 974776 - DNA, 23 bp, Homo sapiens
aggccaggtagcaagagagcagc

SEQ ID NO: 974777 - DNA, 11 bp, Homo sapiens
aggccaggtgg

SEQ ID NO: 974778 - DNA, 16 bp, Homo sapiens
aggccagtggaagaaa

SEQ ID NO: 974779 - DNA, 23 bp, Homo sapiens
aggccagtggcccccgggcctgc

SEQ ID NO: 974780 - DNA, 13 bp, Homo sapiens
aggccagtgggcc

SEQ ID NO: 974781 - DNA, 14 bp, Homo sapiens
aggccagtgggcct

SEQ ID NO: 974782 - DNA, 17 bp, Homo sapiens
aggccagtgggcctggt

SEQ ID NO: 974783 - DNA, 20 bp, Homo sapiens
aggccagtgggcctggtagc

SEQ ID NO: 974784 - DNA, 18 bp, Homo sapiens
aggccagtgttgtgggct

SEQ ID NO: 974785 - DNA, 19 bp, Homo sapiens
aggccagtgttgtgggctt

SEQ ID NO: 974786 - DNA, 22 bp, Homo sapiens
aggccagtgttgtgggcttcct

SEQ ID NO: 974787 - DNA, 19 bp, Homo sapiens
aggccagttgatctgctct

SEQ ID NO: 974788 - DNA, 13 bp, Homo sapiens
aggccatcagggc

SEQ ID NO: 974789 - DNA, 14 bp, Homo sapiens
aggccatcagggcc

SEQ ID NO: 974790 - DNA, 15 bp, Homo sapiens
aggccatcagggccc

SEQ ID NO: 974791 - DNA, 15 bp, Homo sapiens
aggccatctcaggag

SEQ ID NO: 974792 - DNA, 18 bp, Homo sapiens
aggccatctcaggagatg

SEQ ID NO: 974793 - DNA, 22 bp, Homo sapiens
aggccatctgggctcctccagg

SEQ ID NO: 974794 - DNA, 18 bp, Homo sapiens
aggccatctgtaaatatc

SEQ ID NO: 974795 - DNA, 19 bp, Homo sapiens
aggccatgaaaaaaatgat

SEQ ID NO: 974796 - DNA, 15 bp, Homo sapiens
aggccatggcagaat

SEQ ID NO: 974797 - DNA, 15 bp, Homo sapiens
aggccatgtgagcca

SEQ ID NO: 974798 - DNA, 20 bp, Homo sapiens
aggccatgtgagccaccgct

SEQ ID NO: 974799 - DNA, 19 bp, Homo sapiens
aggccatgtggcctgccca

SEQ ID NO: 974800 - DNA, 20 bp, Homo sapiens
aggccatgtggcctgcccag

SEQ ID NO: 974801 - DNA, 22 bp, Homo sapiens
aggccatgtggcctgcccagcc

SEQ ID NO: 974802 - DNA, 15 bp, Homo sapiens
aggccattccccaac

SEQ ID NO: 974803 - DNA, 23 bp, Homo sapiens
aggccattccccaacggggtggg

SEQ ID NO: 974804 - DNA, 20 bp, Homo sapiens
aggccattgggtttggggcc

SEQ ID NO: 974805 - DNA, 23 bp, Homo sapiens
aggccattgggtttggggccatg

SEQ ID NO: 974806 - DNA, 19 bp, Homo sapiens
aggcccaaagcacttgctt

SEQ ID NO: 974807 - DNA, 12 bp, Homo sapiens
aggcccaaatga

SEQ ID NO: 974808 - DNA, 14 bp, Homo sapiens
aggcccaaatgatg

SEQ ID NO: 974809 - DNA, 18 bp, Homo sapiens
aggcccaaccaccagatg

SEQ ID NO: 974810 - DNA, 19 bp, Homo sapiens
aggcccaaccaccagatga

SEQ ID NO: 974811 - DNA, 14 bp, Homo sapiens
aggcccaaggagct

SEQ ID NO: 974812 - DNA, 17 bp, Homo sapiens
aggcccaaggagggtcc

SEQ ID NO: 974813 - DNA, 18 bp, Homo sapiens
aggcccaaggagggtcca

SEQ ID NO: 974814 - DNA, 19 bp, Homo sapiens
aggcccaaggagggtccag

SEQ ID NO: 974815 - DNA, 19 bp, Homo sapiens
aggcccacgaggagcagca

SEQ ID NO: 974816 - DNA, 17 bp, Homo sapiens
aggcccactagagggcc

SEQ ID NO: 974817 - DNA, 19 bp, Homo sapiens
aggcccactagagggccca

SEQ ID NO: 974818 - DNA, 12 bp, Homo sapiens
aggcccactccc

SEQ ID NO: 974819 - DNA, 16 bp, Homo sapiens
aggcccactccccagc

SEQ ID NO: 974820 - DNA, 21 bp, Homo sapiens
aggcccactccccagccccag

SEQ ID NO: 974821 - DNA, 12 bp, Homo sapiens
aggcccagcatg

SEQ ID NO: 974822 - DNA, 14 bp, Homo sapiens
aggcccagcatgca

SEQ ID NO: 974823 - DNA, 12 bp, Homo sapiens
aggcccagccag

SEQ ID NO: 974824 - DNA, 13 bp, Homo sapiens
aggcccagcccct

SEQ ID NO: 974825 - DNA, 13 bp, Homo sapiens
aggcccagccctc

SEQ ID NO: 974826 - DNA, 14 bp, Homo sapiens
aggcccagccctcc

SEQ ID NO: 974827 - DNA, 15 bp, Homo sapiens
aggcccagccctcct

SEQ ID NO: 974828 - DNA, 16 bp, Homo sapiens
aggcccagccctcctt

SEQ ID NO: 974829 - DNA, 23 bp, Homo sapiens
aggcccagccgcaggaaggcaga

SEQ ID NO: 974830 - DNA, 21 bp, Homo sapiens
aaacatttctggacagtacct

SEQ ID NO: 974831 - DNA, 16 bp, Homo sapiens
aaacatttgttcctgg

SEQ ID NO: 974832 - DNA, 17 bp, Homo sapiens
aaacatttgtttccccc

SEQ ID NO: 974833 - DNA, 17 bp, Homo sapiens
aaacattttaaatgaaa

SEQ ID NO: 974834 - DNA, 20 bp, Homo sapiens
aaacattttatactgtacat

SEQ ID NO: 974835 - DNA, 22 bp, Homo sapiens
aaacattttatcattaaaaatt

SEQ ID NO: 974836 - DNA, 20 bp, Homo sapiens
aaacattttatttttaaaat

SEQ ID NO: 974837 - DNA, 21 bp, Homo sapiens
aaacattttatttttaaaata

SEQ ID NO: 974838 - DNA, 12 bp, Homo sapiens
aaacattttctg

SEQ ID NO: 974839 - DNA, 20 bp, Homo sapiens
aaaccaaaaaaaaaaaaaat

SEQ ID NO: 974840 - DNA, 15 bp, Homo sapiens
aaaccaaaaactgaa

SEQ ID NO: 974841 - DNA, 12 bp, Homo sapiens
aaaccaaaacat

SEQ ID NO: 974842 - DNA, 18 bp, Homo sapiens
aaaccaaacttgttcatt

SEQ ID NO: 974843 - DNA, 20 bp, Homo sapiens
aaaccaaacttgttcattta

SEQ ID NO: 974844 - DNA, 14 bp, Homo sapiens
aaaccaaagaagaa

SEQ ID NO: 974845 - DNA, 21 bp, Homo sapiens
aaaccaaagagggcttcctct

SEQ ID NO: 974846 - DNA, 22 bp, Homo sapiens
aaaccaaagctgcctgtgccat

SEQ ID NO: 974847 - DNA, 19 bp, Homo sapiens
aaaccaaagtctgccgccc

SEQ ID NO: 974848 - DNA, 15 bp, Homo sapiens
aaaccaaattttaaa

SEQ ID NO: 974849 - DNA, 14 bp, Homo sapiens
aaaccaagaaggag

SEQ ID NO: 974850 - DNA, 15 bp, Homo sapiens
aaaccaagaaggaga

SEQ ID NO: 974851 - DNA, 16 bp, Homo sapiens
aaaccaagataaatga

SEQ ID NO: 974852 - DNA, 18 bp, Homo sapiens
aaaccaagccattaatga

SEQ ID NO: 974853 - DNA, 23 bp, Homo sapiens
aaaccaagccattaatgagatgt

SEQ ID NO: 974854 - DNA, 19 bp, Homo sapiens
aaaccaagttatttttctt

SEQ ID NO: 974855 - DNA, 20 bp, Homo sapiens
aaaccaagttatttttcttt

SEQ ID NO: 974856 - DNA, 17 bp, Homo sapiens
aaaccaatttcttcctt

SEQ ID NO: 974857 - DNA, 20 bp, Homo sapiens
aaaccacaaggctgttgcat

SEQ ID NO: 974858 - DNA, 15 bp, Homo sapiens
aaaccacagccctgt

SEQ ID NO: 974859 - DNA, 17 bp, Homo sapiens
aaaccacagccctgtca

SEQ ID NO: 974860 - DNA, 12 bp, Homo sapiens
aaaccacagctg

SEQ ID NO: 974861 - DNA, 18 bp, Homo sapiens
aaaccacataatttttgt

SEQ ID NO: 974862 - DNA, 19 bp, Homo sapiens
aaaccacataatttttgta

SEQ ID NO: 974863 - DNA, 21 bp, Homo sapiens
aaaccacataatttttgtaca

SEQ ID NO: 974864 - DNA, 22 bp, Homo sapiens
aaaccacataatttttgtacat

SEQ ID NO: 974865 - DNA, 17 bp, Homo sapiens
aaacttaaagcaaaata

SEQ ID NO: 974866 - DNA, 19 bp, Homo sapiens
aaacttaaagcaaaatagt

SEQ ID NO: 974867 - DNA, 23 bp, Homo sapiens
aaacttaaagcaaaatagtattg

SEQ ID NO: 974868 - DNA, 14 bp, Homo sapiens
aaacttaagaaaca

SEQ ID NO: 974869 - DNA, 14 bp, Homo sapiens
aaacttaatctaaa

SEQ ID NO: 974870 - DNA, 17 bp, Homo sapiens
aaacttaatctaaatgg

SEQ ID NO: 974871 - DNA, 18 bp, Homo sapiens
aaacttaatctaaatgga

SEQ ID NO: 974872 - DNA, 19 bp, Homo sapiens
aaacttaatctaaatggaa

SEQ ID NO: 974873 - DNA, 21 bp, Homo sapiens
aaacttacctataaattaaga

SEQ ID NO: 974874 - DNA, 15 bp, Homo sapiens
aaacttactattttg

SEQ ID NO: 974875 - DNA, 14 bp, Homo sapiens
aaacttagaggaaa

SEQ ID NO: 974876 - DNA, 18 bp, Homo sapiens
aaacttaggatataagag

SEQ ID NO: 974877 - DNA, 13 bp, Homo sapiens
aaacttatgctag

SEQ ID NO: 974878 - DNA, 18 bp, Homo sapiens
aaacttatgctagtttat

SEQ ID NO: 974879 - DNA, 16 bp, Homo sapiens
aaacttcaaagctgaa

SEQ ID NO: 974880 - DNA, 17 bp, Homo sapiens
aaacttcacatttatgt

SEQ ID NO: 974881 - DNA, 15 bp, Homo sapiens
aaacttccaaagctt

SEQ ID NO: 974882 - DNA, 17 bp, Homo sapiens
aaacttcggaaacaagt

SEQ ID NO: 974883 - DNA, 17 bp, Homo sapiens
aaacttctgaagactga

SEQ ID NO: 974884 - DNA, 14 bp, Homo sapiens
aaacttcttaacat

SEQ ID NO: 974885 - DNA, 22 bp, Homo sapiens
aaacttgaaagaagttttatgc

SEQ ID NO: 974886 - DNA, 18 bp, Homo sapiens
aaacttgaaatatataat

SEQ ID NO: 974887 - DNA, 13 bp, Homo sapiens
aaacttgacccag

SEQ ID NO: 974888 - DNA, 19 bp, Homo sapiens
aaacttgactccatttcat

SEQ ID NO: 974889 - DNA, 17 bp, Homo sapiens
aaacttgagcccactcc

SEQ ID NO: 974890 - DNA, 21 bp, Homo sapiens
aaacttgagttggagtactat

SEQ ID NO: 974891 - DNA, 18 bp, Homo sapiens
aaacttggaatcaaggta

SEQ ID NO: 974892 - DNA, 18 bp, Homo sapiens
aaacttggatacttggat

SEQ ID NO: 974893 - DNA, 20 bp, Homo sapiens
aaacttggatacttggattt

SEQ ID NO: 974894 - DNA, 18 bp, Homo sapiens
aaacttggattctctaac

SEQ ID NO: 974895 - DNA, 11 bp, Homo sapiens
aaacttgtaaa

SEQ ID NO: 974896 - DNA, 16 bp, Homo sapiens
aaacttgtaatttttt

SEQ ID NO: 974897 - DNA, 20 bp, Homo sapiens
aaacttgtaatttttttaat

SEQ ID NO: 974898 - DNA, 13 bp, Homo sapiens
aaacttgtgtatt

SEQ ID NO: 974899 - DNA, 19 bp, Homo sapiens
aaacttgttattgtgaatg

SEQ ID NO: 974900 - DNA, 14 bp, Homo sapiens
aaactttacctttt

SEQ ID NO: 974901 - DNA, 19 bp, Homo sapiens
aaactttattgggttttta

SEQ ID NO: 974902 - DNA, 20 bp, Homo sapiens
aaactttattgggtttttat

SEQ ID NO: 974903 - DNA, 21 bp, Homo sapiens
aaactttattgggtttttatt

SEQ ID NO: 974904 - DNA, 11 bp, Homo sapiens
aaactttattt

SEQ ID NO: 974905 - DNA, 17 bp, Homo sapiens
aaactttatttaaatgc

SEQ ID NO: 974906 - DNA, 18 bp, Homo sapiens
aaactttatttaaatgca

SEQ ID NO: 974907 - DNA, 14 bp, Homo sapiens
aaactttattttat

SEQ ID NO: 974908 - DNA, 20 bp, Homo sapiens
aaactttcattccttcagat

SEQ ID NO: 974909 - DNA, 18 bp, Homo sapiens
aaactttccaaatatttc

SEQ ID NO: 974910 - DNA, 19 bp, Homo sapiens
aaactttgatctctgctta

SEQ ID NO: 974911 - DNA, 16 bp, Homo sapiens
aaacttttaattcatt

SEQ ID NO: 974912 - DNA, 16 bp, Homo sapiens
aaacttttaggttgtt

SEQ ID NO: 974913 - DNA, 14 bp, Homo sapiens
aaacttttataaat

SEQ ID NO: 974914 - DNA, 18 bp, Homo sapiens
aaacttttataaattaaa

SEQ ID NO: 974915 - DNA, 19 bp, Homo sapiens
aaacttttataaattaaat

SEQ ID NO: 974916 - DNA, 14 bp, Homo sapiens
aaacttttgtaaat

SEQ ID NO: 974917 - DNA, 16 bp, Homo sapiens
aaacttttgtaaatta

SEQ ID NO: 974918 - DNA, 12 bp, Homo sapiens
aaacttttgttt

SEQ ID NO: 974919 - DNA, 16 bp, Homo sapiens
aaacttttgttttttg

SEQ ID NO: 974920 - DNA, 18 bp, Homo sapiens
aaacttttgttttttggg

SEQ ID NO: 974921 - DNA, 18 bp, Homo sapiens
aaactttttaaaatactt

SEQ ID NO: 974922 - DNA, 15 bp, Homo sapiens
aaactttttcaatgg

SEQ ID NO: 974923 - DNA, 22 bp, Homo sapiens
aaactttttccagcaaaatgga

SEQ ID NO: 974924 - DNA, 23 bp, Homo sapiens
aaactttttccagcaaaatggaa

SEQ ID NO: 974925 - DNA, 12 bp, Homo sapiens
aaacttttttat

SEQ ID NO: 974926 - DNA, 19 bp, Homo sapiens
aaacttttttatttaaaaa

SEQ ID NO: 974927 - DNA, 22 bp, Homo sapiens
aaactttttttctgtaccagtt

SEQ ID NO: 974928 - DNA, 17 bp, Homo sapiens
aaacttttttttgagaa

SEQ ID NO: 974929 - DNA, 10 bp, Homo sapiens
aaagaaaaaa

SEQ ID NO: 974930 - DNA, 13 bp, Homo sapiens
aaagaaaaaaatt

SEQ ID NO: 974931 - DNA, 18 bp, Homo sapiens
aaagaaaaaaattgaaat

SEQ ID NO: 974932 - DNA, 19 bp, Homo sapiens
aaagaaaaaaattgaaatg

SEQ ID NO: 974933 - DNA, 21 bp, Homo sapiens
aaagaaaaaaattgaaatgta

SEQ ID NO: 974934 - DNA, 18 bp, Homo sapiens
aaagaaaaaataattgat

SEQ ID NO: 974935 - DNA, 13 bp, Homo sapiens
aaagaaaaaatca

SEQ ID NO: 974936 - DNA, 13 bp, Homo sapiens
aaagaaaaacaaa

SEQ ID NO: 974937 - DNA, 21 bp, Homo sapiens
aaagaaaaacaatgaaattga

SEQ ID NO: 974938 - DNA, 10 bp, Homo sapiens
aaagaaaaat

SEQ ID NO: 974939 - DNA, 14 bp, Homo sapiens
aaagaaaacaaaaa

SEQ ID NO: 974940 - DNA, 14 bp, Homo sapiens
aaagaaaacattta

SEQ ID NO: 974941 - DNA, 15 bp, Homo sapiens
aaagaaaagccaagc

SEQ ID NO: 974942 - DNA, 16 bp, Homo sapiens
aaagaaaattcctata

SEQ ID NO: 974943 - DNA, 14 bp, Homo sapiens
aaagaaaattgcat

SEQ ID NO: 974944 - DNA, 13 bp, Homo sapiens
aaagaaaccatga

SEQ ID NO: 974945 - DNA, 15 bp, Homo sapiens
aaagaaaccatgaca

SEQ ID NO: 974946 - DNA, 13 bp, Homo sapiens
aaagaaagaaaaa

SEQ ID NO: 974947 - DNA, 14 bp, Homo sapiens
aaagaaagaaaaag

SEQ ID NO: 974948 - DNA, 16 bp, Homo sapiens
aaagaaatatacagtt

SEQ ID NO: 974949 - DNA, 18 bp, Homo sapiens
aaagaaatatattttttg

SEQ ID NO: 974950 - DNA, 16 bp, Homo sapiens
aaagaaatccaaattt

SEQ ID NO: 974951 - DNA, 23 bp, Homo sapiens
aaagaaatccccccttcagaaca

SEQ ID NO: 974952 - DNA, 15 bp, Homo sapiens
aaagaaatcttgctt

SEQ ID NO: 974953 - DNA, 23 bp, Homo sapiens
aaagaaattcagaacagcctgcc

SEQ ID NO: 974954 - DNA, 14 bp, Homo sapiens
aaagaaattctgaa

SEQ ID NO: 974955 - DNA, 18 bp, Homo sapiens
aaagaacatggacttgta

SEQ ID NO: 974956 - DNA, 20 bp, Homo sapiens
aaagaacatggacttgtata

SEQ ID NO: 974957 - DNA, 20 bp, Homo sapiens
aaagaacgctgatttaaaga

SEQ ID NO: 974958 - DNA, 19 bp, Homo sapiens
aaagaactcattcatagga

SEQ ID NO: 974959 - DNA, 21 bp, Homo sapiens
aaagaactttaaagctcagga

SEQ ID NO: 974960 - DNA, 16 bp, Homo sapiens
aaagaagaacagctgt

SEQ ID NO: 974961 - DNA, 15 bp, Homo sapiens
aaagaagacaaactt

SEQ ID NO: 974962 - DNA, 12 bp, Homo sapiens
aaagaagagaca

SEQ ID NO: 974963 - DNA, 20 bp, Homo sapiens
aaagaagagaggggaagaat

SEQ ID NO: 974964 - DNA, 22 bp, Homo sapiens
aaagaagagaggggaagaattt

SEQ ID NO: 974965 - DNA, 23 bp, Homo sapiens
aaagaagagaggggaagaattta

SEQ ID NO: 974966 - DNA, 12 bp, Homo sapiens
aaagaagccata

SEQ ID NO: 974967 - DNA, 18 bp, Homo sapiens
aggcggtcatgtgtgcat

SEQ ID NO: 974968 - DNA, 21 bp, Homo sapiens
aggcggtgggcacccaccctg

SEQ ID NO: 974969 - DNA, 19 bp, Homo sapiens
aggcgtcttcatctccctg

SEQ ID NO: 974970 - DNA, 12 bp, Homo sapiens
aggcgtgccccc

SEQ ID NO: 974971 - DNA, 16 bp, Homo sapiens
aggcgtgcccccctcc

SEQ ID NO: 974972 - DNA, 20 bp, Homo sapiens
aggcgtgcccccctcctcca

SEQ ID NO: 974973 - DNA, 13 bp, Homo sapiens
aggcgtggaggag

SEQ ID NO: 974974 - DNA, 16 bp, Homo sapiens
aggcgtggaggagagg

SEQ ID NO: 974975 - DNA, 19 bp, Homo sapiens
aggcgtggaggagaggaga

SEQ ID NO: 974976 - DNA, 21 bp, Homo sapiens
aggcgtggaggagaggagact

SEQ ID NO: 974977 - DNA, 15 bp, Homo sapiens
aggcgtgtggcagcc

SEQ ID NO: 974978 - DNA, 16 bp, Homo sapiens
aggcgtgtggcagcca

SEQ ID NO: 974979 - DNA, 22 bp, Homo sapiens
aggcgtgtggcagccacacgca

SEQ ID NO: 974980 - DNA, 18 bp, Homo sapiens
aggcgttctcctgcttgt

SEQ ID NO: 974981 - DNA, 18 bp, Homo sapiens
aggcgttcttcgaggtgg

SEQ ID NO: 974982 - DNA, 19 bp, Homo sapiens
aggcgttcttcgaggtgga

SEQ ID NO: 974983 - DNA, 13 bp, Homo sapiens
aggcgttttttgg

SEQ ID NO: 974984 - DNA, 14 bp, Homo sapiens
aggctaaaaagcaa

SEQ ID NO: 974985 - DNA, 16 bp, Homo sapiens
aggctaaactggtgca

SEQ ID NO: 974986 - DNA, 17 bp, Homo sapiens
aggctaaactggtgcat

SEQ ID NO: 974987 - DNA, 21 bp, Homo sapiens
aggctaagttcagttctgttt

SEQ ID NO: 974988 - DNA, 14 bp, Homo sapiens
aaagcaaatcattt

SEQ ID NO: 974989 - DNA, 13 bp, Homo sapiens
aaagcaaatgaga

SEQ ID NO: 974990 - DNA, 15 bp, Homo sapiens
aaagcaacaaagaaa

SEQ ID NO: 974991 - DNA, 18 bp, Homo sapiens
aaagcaacccgctggagc

SEQ ID NO: 974992 - DNA, 20 bp, Homo sapiens
aaagcaagcattcagaagaa

SEQ ID NO: 974993 - DNA, 20 bp, Homo sapiens
aaagcaaggaaactatgtaa

SEQ ID NO: 974994 - DNA, 18 bp, Homo sapiens
aaagcaagggagaaaaga

SEQ ID NO: 974995 - DNA, 20 bp, Homo sapiens
aaagcaagggctccagcatc

SEQ ID NO: 974996 - DNA, 19 bp, Homo sapiens
aaagcaagtgttcactgct

SEQ ID NO: 974997 - DNA, 13 bp, Homo sapiens
aaagcaagtgttg

SEQ ID NO: 974998 - DNA, 15 bp, Homo sapiens
aaagcaataaatgaa

SEQ ID NO: 974999 - DNA, 17 bp, Homo sapiens
aaagcaatacaacttta

SEQ ID NO: 975000 - DNA, 14 bp, Homo sapiens
aaagcaatatgcat

SEQ ID NO: 975001 - DNA, 17 bp, Homo sapiens
aaagcaattctgactgt

SEQ ID NO: 975002 - DNA, 14 bp, Homo sapiens
aaagcaattgccct

SEQ ID NO: 975003 - DNA, 20 bp, Homo sapiens
aaagcacaatcactaaactt

SEQ ID NO: 975004 - DNA, 15 bp, Homo sapiens
aaagcacagtttgaa

SEQ ID NO: 975005 - DNA, 18 bp, Homo sapiens
aaagcaccaaaataagaa

SEQ ID NO: 975006 - DNA, 23 bp, Homo sapiens
aaagcaccaaaataagaaaagat

SEQ ID NO: 975007 - DNA, 13 bp, Homo sapiens
aaagcacctgccg

SEQ ID NO: 975008 - DNA, 19 bp, Homo sapiens
aaagcacgaaatgttattt

SEQ ID NO: 975009 - DNA, 21 bp, Homo sapiens
aaagcactcccttaggcatta

SEQ ID NO: 975010 - DNA, 22 bp, Homo sapiens
aaagcactcccttaggcattat

SEQ ID NO: 975011 - DNA, 15 bp, Homo sapiens
aaagcactctctgca

SEQ ID NO: 975012 - DNA, 14 bp, Homo sapiens
aaagcactgacctg

SEQ ID NO: 975013 - DNA, 19 bp, Homo sapiens
aaagcacttggactcttgc

SEQ ID NO: 975014 - DNA, 15 bp, Homo sapiens
aaagcactttgcact

SEQ ID NO: 975015 - DNA, 18 bp, Homo sapiens
aaagcagaagtctggctt

SEQ ID NO: 975016 - DNA, 23 bp, Homo sapiens
aaagcagaattttaatgtgaaga

SEQ ID NO: 975017 - DNA, 19 bp, Homo sapiens
aaagcagagccaaggccac

SEQ ID NO: 975018 - DNA, 20 bp, Homo sapiens
aaagcagaggcaacactgga

SEQ ID NO: 975019 - DNA, 21 bp, Homo sapiens
aaagcagattacctcttgccc

SEQ ID NO: 975020 - DNA, 15 bp, Homo sapiens
aaagcagcacaagga

SEQ ID NO: 975021 - DNA, 20 bp, Homo sapiens
aaagcagcagctaggactga

SEQ ID NO: 975022 - DNA, 20 bp, Homo sapiens
aaagcagcaggcctctggtt

SEQ ID NO: 975023 - DNA, 12 bp, Homo sapiens
aaagcagccacg

SEQ ID NO: 975024 - DNA, 19 bp, Homo sapiens
aaagcagcctcattctgag

SEQ ID NO: 975025 - DNA, 15 bp, Homo sapiens
aaagcagctctcccc

SEQ ID NO: 975026 - DNA, 18 bp, Homo sapiens
aaagcagctctcccctca

SEQ ID NO: 975027 - DNA, 13 bp, Homo sapiens
aaagcaggagtgg

SEQ ID NO: 975028 - DNA, 20 bp, Homo sapiens
aaagcaggggagtatgcaaa

SEQ ID NO: 975029 - DNA, 16 bp, Homo sapiens
aaagcaggttcttgtt

SEQ ID NO: 975030 - DNA, 17 bp, Homo sapiens
aaagcaggttcttgttg

SEQ ID NO: 975031 - DNA, 17 bp, Homo sapiens
aaagcagtaactgacaa

SEQ ID NO: 975032 - DNA, 15 bp, Homo sapiens
aaagcagtatataat

SEQ ID NO: 975033 - DNA, 15 bp, Homo sapiens
aaagcagtatttttc

SEQ ID NO: 975034 - DNA, 16 bp, Homo sapiens
aaagcagtatttttct

SEQ ID NO: 975035 - DNA, 19 bp, Homo sapiens
aaagcagtcctgttcaaat

SEQ ID NO: 975036 - DNA, 21 bp, Homo sapiens
aaagcataaagctcaaatgaa

SEQ ID NO: 975037 - DNA, 14 bp, Homo sapiens
aaagcatgaaacat

SEQ ID NO: 975038 - DNA, 21 bp, Homo sapiens
aaagcatgatgggaaaatatt

SEQ ID NO: 975039 - DNA, 23 bp, Homo sapiens
aaagcatgatgggaaaatatttc

SEQ ID NO: 975040 - DNA, 15 bp, Homo sapiens
aaagcatggacattt

SEQ ID NO: 975041 - DNA, 20 bp, Homo sapiens
aaagcatggtataattgaaa

SEQ ID NO: 975042 - DNA, 13 bp, Homo sapiens
aaagcattactct

SEQ ID NO: 975043 - DNA, 15 bp, Homo sapiens
aaagcattctttaac

SEQ ID NO: 975044 - DNA, 14 bp, Homo sapiens
aaagcattgtctct

SEQ ID NO: 975045 - DNA, 15 bp, Homo sapiens
aaagcatttataaat

SEQ ID NO: 975046 - DNA, 18 bp, Homo sapiens
aaagcattttcagtcttg

SEQ ID NO: 975047 - DNA, 15 bp, Homo sapiens
aaagcattttgtaat

SEQ ID NO: 975048 - DNA, 13 bp, Homo sapiens
aaagcatttttca

SEQ ID NO: 975049 - DNA, 19 bp, Homo sapiens
aaagccaaacaaaactgaa

SEQ ID NO: 975050 - DNA, 18 bp, Homo sapiens
aaagccaaagtttctgtt

SEQ ID NO: 975051 - DNA, 23 bp, Homo sapiens
aaagccaagcaaaccaatggtga

SEQ ID NO: 975052 - DNA, 14 bp, Homo sapiens
aaagccaagggcaa

SEQ ID NO: 975053 - DNA, 17 bp, Homo sapiens
aaagccacaaggctggc

SEQ ID NO: 975054 - DNA, 21 bp, Homo sapiens
aaagccacaaggctggccagc

SEQ ID NO: 975055 - DNA, 12 bp, Homo sapiens
aaagccacctct

SEQ ID NO: 975056 - DNA, 17 bp, Homo sapiens
aaagccagacaacttct

SEQ ID NO: 975057 - DNA, 19 bp, Homo sapiens
aaagccagacaacttctgt

SEQ ID NO: 975058 - DNA, 19 bp, Homo sapiens
aaagccagctgccgaccag

SEQ ID NO: 975059 - DNA, 16 bp, Homo sapiens
aaagccagggctggag

SEQ ID NO: 975060 - DNA, 14 bp, Homo sapiens
aaagccatattcca

SEQ ID NO: 975061 - DNA, 22 bp, Homo sapiens
aaagccatattccagcagtgaa

SEQ ID NO: 975062 - DNA, 16 bp, Homo sapiens
aaagccatcatgcctt

SEQ ID NO: 975063 - DNA, 22 bp, Homo sapiens
aaagccatgccaataaagtgat

SEQ ID NO: 975064 - DNA, 22 bp, Homo sapiens
aaagccatgtatttcagggacc

SEQ ID NO: 975065 - DNA, 13 bp, Homo sapiens
aaagccattcttt

SEQ ID NO: 975066 - DNA, 14 bp, Homo sapiens
aaagccattctttt

SEQ ID NO: 975067 - DNA, 18 bp, Homo sapiens
aaagcccaaagtggtata

SEQ ID NO: 975068 - DNA, 18 bp, Homo sapiens
aaagcccaagggatctgg

SEQ ID NO: 975069 - DNA, 16 bp, Homo sapiens
aaagcccacaggcctg

SEQ ID NO: 975070 - DNA, 13 bp, Homo sapiens
aaagcccacctgg

SEQ ID NO: 975071 - DNA, 19 bp, Homo sapiens
aaagcccccttctccatgg

SEQ ID NO: 975072 - DNA, 21 bp, Homo sapiens
aaagcccccttctccatggag

SEQ ID NO: 975073 - DNA, 17 bp, Homo sapiens
aaagccctcccccttcc

SEQ ID NO: 975074 - DNA, 17 bp, Homo sapiens
aaagccctgcctctgtg

SEQ ID NO: 975075 - DNA, 22 bp, Homo sapiens
aaagcccttccatgtcgcctct

SEQ ID NO: 975076 - DNA, 23 bp, Homo sapiens
aaagcccttccatgtcgcctctg

SEQ ID NO: 975077 - DNA, 20 bp, Homo sapiens
aaagccgggggaggggccct

SEQ ID NO: 975078 - DNA, 14 bp, Homo sapiens
aaagcctaaaattg

SEQ ID NO: 975079 - DNA, 13 bp, Homo sapiens
aaagcctcaacca

SEQ ID NO: 975080 - DNA, 22 bp, Homo sapiens
aaagcctcatttgaatgtgtga

SEQ ID NO: 975081 - DNA, 14 bp, Homo sapiens
aaagcctctctctc

SEQ ID NO: 975082 - DNA, 17 bp, Homo sapiens
aaagcctctgttttgat

SEQ ID NO: 975083 - DNA, 11 bp, Homo sapiens
aaagcctggct

SEQ ID NO: 975084 - DNA, 17 bp, Homo sapiens
aaagcctgggtgacatt

SEQ ID NO: 975085 - DNA, 18 bp, Homo sapiens
aaagcctgggtgacattt

SEQ ID NO: 975086 - DNA, 13 bp, Homo sapiens
aaagcctggtttt

SEQ ID NO: 975087 - DNA, 17 bp, Homo sapiens
aaagcctgtaagcctgc

SEQ ID NO: 975088 - DNA, 13 bp, Homo sapiens
aaagcctgttccc

SEQ ID NO: 975089 - DNA, 17 bp, Homo sapiens
aaagccttaagcaaatt

SEQ ID NO: 975090 - DNA, 19 bp, Homo sapiens
aaagccttagggaagctgg

SEQ ID NO: 975091 - DNA, 23 bp, Homo sapiens
aaagccttgaagaaaatgacttt

SEQ ID NO: 975092 - DNA, 17 bp, Homo sapiens
aaagcctttaaaaccag

SEQ ID NO: 975093 - DNA, 10 bp, Homo sapiens
aaagcctttt

SEQ ID NO: 975094 - DNA, 16 bp, Homo sapiens
aaagccttttaaatca

SEQ ID NO: 975095 - DNA, 21 bp, Homo sapiens
aaagccttttgctttatgctt

SEQ ID NO: 975096 - DNA, 23 bp, Homo sapiens
aaagccttttgctttatgcttga

SEQ ID NO: 975097 - DNA, 12 bp, Homo sapiens
aaagcgaaaaaa

SEQ ID NO: 975098 - DNA, 15 bp, Homo sapiens
aaagcgggcagcccc

SEQ ID NO: 975099 - DNA, 21 bp, Homo sapiens
aaagcggggcttcatctgcaa

SEQ ID NO: 975100 - DNA, 17 bp, Homo sapiens
aggcttgtcagagctgg

SEQ ID NO: 975101 - DNA, 13 bp, Homo sapiens
aggctttaaaagt

SEQ ID NO: 975102 - DNA, 14 bp, Homo sapiens
aggctttaaagctg

SEQ ID NO: 975103 - DNA, 19 bp, Homo sapiens
aggctttaagctccagctt

SEQ ID NO: 975104 - DNA, 15 bp, Homo sapiens
aggctttcactattt

SEQ ID NO: 975105 - DNA, 22 bp, Homo sapiens
aggctttctgttgccatggtga

SEQ ID NO: 975106 - DNA, 14 bp, Homo sapiens
aggctttggcccaa

SEQ ID NO: 975107 - DNA, 23 bp, Homo sapiens
aggctttggggtcctagcccagt

SEQ ID NO: 975108 - DNA, 18 bp, Homo sapiens
aggctttgggtggctcac

SEQ ID NO: 975109 - DNA, 14 bp, Homo sapiens
aggcttttgctaga

SEQ ID NO: 975110 - DNA, 23 bp, Homo sapiens
aaaggcagctgcctctgctccct

SEQ ID NO: 975111 - DNA, 20 bp, Homo sapiens
aaaggcaggaagggaagcgt

SEQ ID NO: 975112 - DNA, 17 bp, Homo sapiens
aaaggcaggtttcattt

SEQ ID NO: 975113 - DNA, 17 bp, Homo sapiens
aaaggcagtccagagct

SEQ ID NO: 975114 - DNA, 13 bp, Homo sapiens
aaaggcagttttc

SEQ ID NO: 975115 - DNA, 14 bp, Homo sapiens
aaaggcagttttct

SEQ ID NO: 975116 - DNA, 16 bp, Homo sapiens
aaaggcagttttctaa

SEQ ID NO: 975117 - DNA, 15 bp, Homo sapiens
aaaggcatattgctt

SEQ ID NO: 975118 - DNA, 15 bp, Homo sapiens
aaaggccaaagataa

SEQ ID NO: 975119 - DNA, 16 bp, Homo sapiens
aaaggccaaagataaa

SEQ ID NO: 975120 - DNA, 17 bp, Homo sapiens
aaaggcccagcccctag

SEQ ID NO: 975121 - DNA, 20 bp, Homo sapiens
aaaggcccggaagcgccagg

SEQ ID NO: 975122 - DNA, 18 bp, Homo sapiens
aaaggcctcaagaacaaa

SEQ ID NO: 975123 - DNA, 21 bp, Homo sapiens
aaaggcctcttgtaaagactg

SEQ ID NO: 975124 - DNA, 18 bp, Homo sapiens
aaaggcgcccccgcccca

SEQ ID NO: 975125 - DNA, 22 bp, Homo sapiens
aaaggcgcccccgccccaggct

SEQ ID NO: 975126 - DNA, 13 bp, Homo sapiens
aaaggcgctgaga

SEQ ID NO: 975127 - DNA, 21 bp, Homo sapiens
aaaggctcagtctcaggagca

SEQ ID NO: 975128 - DNA, 24 bp, Homo sapiens
aaaggctcatttaaaacaggcaaa

SEQ ID NO: 975129 - DNA, 17 bp, Homo sapiens
aaaggctcgattttgta

SEQ ID NO: 975130 - DNA, 17 bp, Homo sapiens
aaaggctgattactgaa

SEQ ID NO: 975131 - DNA, 20 bp, Homo sapiens
aaaggctggagagagattct

SEQ ID NO: 975132 - DNA, 17 bp, Homo sapiens
aaaggctgtagaaggaa

SEQ ID NO: 975133 - DNA, 15 bp, Homo sapiens
aaaggctgtgctgcc

SEQ ID NO: 975134 - DNA, 14 bp, Homo sapiens
aaagggaaaaaaga

SEQ ID NO: 975135 - DNA, 16 bp, Homo sapiens
aaagggaaaagggaga

SEQ ID NO: 975136 - DNA, 14 bp, Homo sapiens
aaagggaagaaact

SEQ ID NO: 975137 - DNA, 24 bp, Homo sapiens
aaagggaagtaacagacacacgat

SEQ ID NO: 975138 - DNA, 19 bp, Homo sapiens
aaagggaagtgaggcccaa

SEQ ID NO: 975139 - DNA, 17 bp, Homo sapiens
aaagggagaaagaaaac

SEQ ID NO: 975140 - DNA, 18 bp, Homo sapiens
aaagggagaaagaaaact

SEQ ID NO: 975141 - DNA, 15 bp, Homo sapiens
aaagggagtttaaaa

SEQ ID NO: 975142 - DNA, 15 bp, Homo sapiens
aaagggagtttttga

SEQ ID NO: 975143 - DNA, 21 bp, Homo sapiens
aaagggattgaggagttgcct

SEQ ID NO: 975144 - DNA, 16 bp, Homo sapiens
aaagggcactcccaac

SEQ ID NO: 975145 - DNA, 17 bp, Homo sapiens
aaagggcacttaatttg

SEQ ID NO: 975146 - DNA, 23 bp, Homo sapiens
aaagggcacttaatttgtaaact

SEQ ID NO: 975147 - DNA, 20 bp, Homo sapiens
aaagggccctttcatcttga

SEQ ID NO: 975148 - DNA, 17 bp, Homo sapiens
aaagggctatggcaagg

SEQ ID NO: 975149 - DNA, 23 bp, Homo sapiens
aaagggctggctccccctcccca

SEQ ID NO: 975150 - DNA, 22 bp, Homo sapiens
aaaggggacccaagaaaccaaa

SEQ ID NO: 975151 - DNA, 16 bp, Homo sapiens
aaaggggagagcctgc

SEQ ID NO: 975152 - DNA, 14 bp, Homo sapiens
aaaggggctgctgg

SEQ ID NO: 975153 - DNA, 15 bp, Homo sapiens
aaaggggctgctggg

SEQ ID NO: 975154 - DNA, 24 bp, Homo sapiens
aaaggggtcggctgaccatgctca

SEQ ID NO: 975155 - DNA, 17 bp, Homo sapiens
aaagggtcttgggaaat

SEQ ID NO: 975156 - DNA, 14 bp, Homo sapiens
aaagggtgtactta

SEQ ID NO: 975157 - DNA, 18 bp, Homo sapiens
aaagggtgtaggggccac

SEQ ID NO: 975158 - DNA, 16 bp, Homo sapiens
aaaggtaaaatcactt

SEQ ID NO: 975159 - DNA, 22 bp, Homo sapiens
aaaggtaaaatggcagtttgaa

SEQ ID NO: 975160 - DNA, 19 bp, Homo sapiens
aaaggtaaatggttaaatt

SEQ ID NO: 975161 - DNA, 22 bp, Homo sapiens
aaaggtaaatggttaaatttta

SEQ ID NO: 975162 - DNA, 23 bp, Homo sapiens
aaaggtaaatggttaaattttac

SEQ ID NO: 975163 - DNA, 13 bp, Homo sapiens
aaaggtaactaac

SEQ ID NO: 975164 - DNA, 20 bp, Homo sapiens
aaaggtgagtttgagctgcc

SEQ ID NO: 975165 - DNA, 23 bp, Homo sapiens
aaaggtgagtttgagctgccttc

SEQ ID NO: 975166 - DNA, 13 bp, Homo sapiens
aaaggtgcctcat

SEQ ID NO: 975167 - DNA, 20 bp, Homo sapiens
aaaggtggaataaacattaa

SEQ ID NO: 975168 - DNA, 16 bp, Homo sapiens
aaaggtggcaatgctt

SEQ ID NO: 975169 - DNA, 13 bp, Homo sapiens
aaaggtgtattta

SEQ ID NO: 975170 - DNA, 15 bp, Homo sapiens
aaaggtgtatttaaa

SEQ ID NO: 975171 - DNA, 21 bp, Homo sapiens
aaaggttatgaaacatatcat

SEQ ID NO: 975172 - DNA, 19 bp, Homo sapiens
aaaggttcttcttgggagt

SEQ ID NO: 975173 - DNA, 17 bp, Homo sapiens
aaaggttgaataatata

SEQ ID NO: 975174 - DNA, 19 bp, Homo sapiens
aaaggtttatgaaaaagaa

SEQ ID NO: 975175 - DNA, 21 bp, Homo sapiens
aaaggtttatttttctgttac

SEQ ID NO: 975176 - DNA, 23 bp, Homo sapiens
aaaggttttggatcttgaatgtg

SEQ ID NO: 975177 - DNA, 16 bp, Homo sapiens
aaaggttttgtatttt

SEQ ID NO: 975178 - DNA, 12 bp, Homo sapiens
aaagtaaacttg

SEQ ID NO: 975179 - DNA, 17 bp, Homo sapiens
aaagtaaacttgtgtat

SEQ ID NO: 975180 - DNA, 13 bp, Homo sapiens
aaagtaaagctaa

SEQ ID NO: 975181 - DNA, 18 bp, Homo sapiens
aaagtaaatacatgcata

SEQ ID NO: 975182 - DNA, 19 bp, Homo sapiens
aaagtaagcccttgaagat

SEQ ID NO: 975183 - DNA, 13 bp, Homo sapiens
aaagtaagtcttt

SEQ ID NO: 975184 - DNA, 22 bp, Homo sapiens
aaagtaagttaataatgtattg

SEQ ID NO: 975185 - DNA, 23 bp, Homo sapiens
aaagtaatagtaaaatgcttaca

SEQ ID NO: 975186 - DNA, 14 bp, Homo sapiens
aaagtaatttggaa

SEQ ID NO: 975187 - DNA, 22 bp, Homo sapiens
aaagtaatttggaaattaggtt

SEQ ID NO: 975188 - DNA, 13 bp, Homo sapiens
aaagtaattttgt

SEQ ID NO: 975189 - DNA, 14 bp, Homo sapiens
aaagtaattttgtc

SEQ ID NO: 975190 - DNA, 17 bp, Homo sapiens
aaagtaattttgtcaca

SEQ ID NO: 975191 - DNA, 18 bp, Homo sapiens
aaagtaattttgtcacat

SEQ ID NO: 975192 - DNA, 13 bp, Homo sapiens
aaagtacaaaatt

SEQ ID NO: 975193 - DNA, 19 bp, Homo sapiens
aaagtacactgtttcaaac

SEQ ID NO: 975194 - DNA, 20 bp, Homo sapiens
aaagtacactgtttcaaact

SEQ ID NO: 975195 - DNA, 13 bp, Homo sapiens
aaagtacagaatt

SEQ ID NO: 975196 - DNA, 14 bp, Homo sapiens
aaagtacagaattt

SEQ ID NO: 975197 - DNA, 16 bp, Homo sapiens
aaagtaccacactgag

SEQ ID NO: 975198 - DNA, 14 bp, Homo sapiens
aaagtactttaaaa

SEQ ID NO: 975199 - DNA, 19 bp, Homo sapiens
aaagtactttaaaaaggaa

SEQ ID NO: 975200 - DNA, 20 bp, Homo sapiens
aaagtagaagagggttttag

SEQ ID NO: 975201 - DNA, 20 bp, Homo sapiens
aaagtagaagtcttagatgt

SEQ ID NO: 975202 - DNA, 22 bp, Homo sapiens
aaagtagatcatgcatagagtg

SEQ ID NO: 975203 - DNA, 20 bp, Homo sapiens
aaagtaggaactcttaagca

SEQ ID NO: 975204 - DNA, 19 bp, Homo sapiens
aaagtagtcctggcagctg

SEQ ID NO: 975205 - DNA, 16 bp, Homo sapiens
aaagtagtgatgaaaa

SEQ ID NO: 975206 - DNA, 22 bp, Homo sapiens
aaagtagttggctagtactttg

SEQ ID NO: 975207 - DNA, 14 bp, Homo sapiens
aaagtataatcttt

SEQ ID NO: 975208 - DNA, 16 bp, Homo sapiens
aaagtataatgtttat

SEQ ID NO: 975209 - DNA, 20 bp, Homo sapiens
aaagtataatgtttattaaa

SEQ ID NO: 975210 - DNA, 23 bp, Homo sapiens
aaagtataatgtttattaaatgc

SEQ ID NO: 975211 - DNA, 18 bp, Homo sapiens
aaagtatatatagaatct

SEQ ID NO: 975212 - DNA, 14 bp, Homo sapiens
aaagtatatattta

SEQ ID NO: 975213 - DNA, 23 bp, Homo sapiens
aaagtatatatttatttaagctt

SEQ ID NO: 975214 - DNA, 13 bp, Homo sapiens
aaagtatcacttt

SEQ ID NO: 975215 - DNA, 17 bp, Homo sapiens
aaagtatcacttttctg

SEQ ID NO: 975216 - DNA, 14 bp, Homo sapiens
aaagtatcatgcat

SEQ ID NO: 975217 - DNA, 18 bp, Homo sapiens
aaagtatccctactgtaa

SEQ ID NO: 975218 - DNA, 16 bp, Homo sapiens
aaagtatgtattattt

SEQ ID NO: 975219 - DNA, 17 bp, Homo sapiens
aaagtatgtattattta

SEQ ID NO: 975220 - DNA, 13 bp, Homo sapiens
aaagtatgtgttt

SEQ ID NO: 975221 - DNA, 12 bp, Homo sapiens
aaagtatgttct

SEQ ID NO: 975222 - DNA, 14 bp, Homo sapiens
aaagtattatcatt

SEQ ID NO: 975223 - DNA, 17 bp, Homo sapiens
aaagtattatcattgct

SEQ ID NO: 975224 - DNA, 17 bp, Homo sapiens
aaagtattcaacaattt

SEQ ID NO: 975225 - DNA, 15 bp, Homo sapiens
aaagtattcagaaat

SEQ ID NO: 975226 - DNA, 18 bp, Homo sapiens
aaagtattcagaaattaa

SEQ ID NO: 975227 - DNA, 22 bp, Homo sapiens
aaagtattcagaaattaaaata

SEQ ID NO: 975228 - DNA, 14 bp, Homo sapiens
aaagtattccacct

SEQ ID NO: 975229 - DNA, 18 bp, Homo sapiens
aaagtattccaccttaaa

SEQ ID NO: 975230 - DNA, 14 bp, Homo sapiens
aaagtattcgttac

SEQ ID NO: 975231 - DNA, 12 bp, Homo sapiens
aaagtattcttc

SEQ ID NO: 975232 - DNA, 16 bp, Homo sapiens
agggctgcatgatgtt

SEQ ID NO: 975233 - DNA, 21 bp, Homo sapiens
agggctgcccctaatctctgt

SEQ ID NO: 975234 - DNA, 20 bp, Homo sapiens
agggctgccttctggccttg

SEQ ID NO: 975235 - DNA, 18 bp, Homo sapiens
agggctgctgcttctgct

SEQ ID NO: 975236 - DNA, 19 bp, Homo sapiens
agggctgctgcttctgctc

SEQ ID NO: 975237 - DNA, 23 bp, Homo sapiens
agggctgctgcttctgctccagc

SEQ ID NO: 975238 - DNA, 19 bp, Homo sapiens
agggctgctgggagcctct

SEQ ID NO: 975239 - DNA, 15 bp, Homo sapiens
aaataaaacaagcct

SEQ ID NO: 975240 - DNA, 16 bp, Homo sapiens
aaataaaacaagcctt

SEQ ID NO: 975241 - DNA, 12 bp, Homo sapiens
aaataaaacaca

SEQ ID NO: 975242 - DNA, 13 bp, Homo sapiens
aaataaaaccttt

SEQ ID NO: 975243 - DNA, 13 bp, Homo sapiens
aaataaaactatt

SEQ ID NO: 975244 - DNA, 16 bp, Homo sapiens
aaataaaactatttaa

SEQ ID NO: 975245 - DNA, 13 bp, Homo sapiens
aaataaaagcaca

SEQ ID NO: 975246 - DNA, 14 bp, Homo sapiens
aaataaaagcacaa

SEQ ID NO: 975247 - DNA, 17 bp, Homo sapiens
aaataaaaggaagccaa

SEQ ID NO: 975248 - DNA, 14 bp, Homo sapiens
aaataaaagtataa

SEQ ID NO: 975249 - DNA, 16 bp, Homo sapiens
aaataaaagtgatcaa

SEQ ID NO: 975250 - DNA, 15 bp, Homo sapiens
aaataaaatgaaaat

SEQ ID NO: 975251 - DNA, 23 bp, Homo sapiens
aaataaaatgaaaattgtattat

SEQ ID NO: 975252 - DNA, 15 bp, Homo sapiens
aaataaaatgaacat

SEQ ID NO: 975253 - DNA, 16 bp, Homo sapiens
aaataaaatgtgtaca

SEQ ID NO: 975254 - DNA, 12 bp, Homo sapiens
aaataaaattac

SEQ ID NO: 975255 - DNA, 13 bp, Homo sapiens
aaataaaattatg

SEQ ID NO: 975256 - DNA, 16 bp, Homo sapiens
aaataaaatttgttgc

SEQ ID NO: 975257 - DNA, 18 bp, Homo sapiens
aaataaaatttgttgcat

SEQ ID NO: 975258 - DNA, 15 bp, Homo sapiens
aaataaacaataaga

SEQ ID NO: 975259 - DNA, 18 bp, Homo sapiens
aaataaacaataagacat

SEQ ID NO: 975260 - DNA, 19 bp, Homo sapiens
aaataaacacatagattca

SEQ ID NO: 975261 - DNA, 15 bp, Homo sapiens
aaataaacacgattt

SEQ ID NO: 975262 - DNA, 14 bp, Homo sapiens
aaataaaccttaat

SEQ ID NO: 975263 - DNA, 18 bp, Homo sapiens
aaataaacgtggatttta

SEQ ID NO: 975264 - DNA, 12 bp, Homo sapiens
aaataaactaga

SEQ ID NO: 975265 - DNA, 14 bp, Homo sapiens
aaataaactgttgc

SEQ ID NO: 975266 - DNA, 11 bp, Homo sapiens
aaataaacttc

SEQ ID NO: 975267 - DNA, 15 bp, Homo sapiens
aaataaacttcttaa

SEQ ID NO: 975268 - DNA, 13 bp, Homo sapiens
aaataaagaaata

SEQ ID NO: 975269 - DNA, 13 bp, Homo sapiens
aaataaagaagta

SEQ ID NO: 975270 - DNA, 12 bp, Homo sapiens
aaataaagccct

SEQ ID NO: 975271 - DNA, 12 bp, Homo sapiens
aaataaagcctt

SEQ ID NO: 975272 - DNA, 16 bp, Homo sapiens
aaataaagccttttaa

SEQ ID NO: 975273 - DNA, 21 bp, Homo sapiens
aaataaagccttttaaatcat

SEQ ID NO: 975274 - DNA, 23 bp, Homo sapiens
aaataaaggatgtgattgtggaa

SEQ ID NO: 975275 - DNA, 20 bp, Homo sapiens
aaataaaggcgctaatttat

SEQ ID NO: 975276 - DNA, 20 bp, Homo sapiens
aaataaaggtaaaatcactt

SEQ ID NO: 975277 - DNA, 15 bp, Homo sapiens
aaataaagtatcatg

SEQ ID NO: 975278 - DNA, 18 bp, Homo sapiens
aaataaagttggtgacag

SEQ ID NO: 975279 - DNA, 11 bp, Homo sapiens
aaataaataat

SEQ ID NO: 975280 - DNA, 16 bp, Homo sapiens
aaataaatagctatat

SEQ ID NO: 975281 - DNA, 13 bp, Homo sapiens
aaataaatatacc

SEQ ID NO: 975282 - DNA, 12 bp, Homo sapiens
aaataaatatat

SEQ ID NO: 975283 - DNA, 17 bp, Homo sapiens
aaataaatcatcctcat

SEQ ID NO: 975284 - DNA, 11 bp, Homo sapiens
aaataaatgaa

SEQ ID NO: 975285 - DNA, 12 bp, Homo sapiens
aaataaatgaaa

SEQ ID NO: 975286 - DNA, 23 bp, Homo sapiens
aaataaatgattatattcacaga

SEQ ID NO: 975287 - DNA, 21 bp, Homo sapiens
aaataaatggtttctgaaaat

SEQ ID NO: 975288 - DNA, 21 bp, Homo sapiens
aaataaatggtttggtgcttt

SEQ ID NO: 975289 - DNA, 15 bp, Homo sapiens
aaataaatgtatcat

SEQ ID NO: 975290 - DNA, 20 bp, Homo sapiens
aaataaatgtcactgccaac

SEQ ID NO: 975291 - DNA, 14 bp, Homo sapiens
aaataaattagaaa

SEQ ID NO: 975292 - DNA, 11 bp, Homo sapiens
aaataaattat

SEQ ID NO: 975293 - DNA, 16 bp, Homo sapiens
aaataaattcctacaa

SEQ ID NO: 975294 - DNA, 22 bp, Homo sapiens
aaataaattcctacaacttaat

SEQ ID NO: 975295 - DNA, 16 bp, Homo sapiens
aaataaatttatatga

SEQ ID NO: 975296 - DNA, 22 bp, Homo sapiens
aaataaatttcccagttaaaga

SEQ ID NO: 975297 - DNA, 13 bp, Homo sapiens
aaataaatttctg

SEQ ID NO: 975298 - DNA, 13 bp, Homo sapiens
aaataaattttgt

SEQ ID NO: 975299 - DNA, 14 bp, Homo sapiens
aaataaattttgtt

SEQ ID NO: 975300 - DNA, 21 bp, Homo sapiens
aaataacaagtcgatgaacta

SEQ ID NO: 975301 - DNA, 23 bp, Homo sapiens
aaataacacagatattgttataa

SEQ ID NO: 975302 - DNA, 19 bp, Homo sapiens
aaataacactgttggcact

SEQ ID NO: 975303 - DNA, 16 bp, Homo sapiens
aaataacagaagaaaa

SEQ ID NO: 975304 - DNA, 14 bp, Homo sapiens
aaataacattgcac

SEQ ID NO: 975305 - DNA, 20 bp, Homo sapiens
aaataaccacaaggtccact

SEQ ID NO: 975306 - DNA, 20 bp, Homo sapiens
aaataacctaattaatatat

SEQ ID NO: 975307 - DNA, 13 bp, Homo sapiens
aaataacctctgg

SEQ ID NO: 975308 - DNA, 18 bp, Homo sapiens
aaataacctctggccctt

SEQ ID NO: 975309 - DNA, 14 bp, Homo sapiens
aaataactaaaatg

SEQ ID NO: 975310 - DNA, 22 bp, Homo sapiens
aaataactgtgtggcagttaat

SEQ ID NO: 975311 - DNA, 15 bp, Homo sapiens
aaataacttcaagca

SEQ ID NO: 975312 - DNA, 15 bp, Homo sapiens
aaataagaaaaatca

SEQ ID NO: 975313 - DNA, 15 bp, Homo sapiens
aaataagaagaatgc

SEQ ID NO: 975314 - DNA, 20 bp, Homo sapiens
aaataagaagaatgcttaat

SEQ ID NO: 975315 - DNA, 12 bp, Homo sapiens
aaataagagatt

SEQ ID NO: 975316 - DNA, 20 bp, Homo sapiens
aaataagagcatgatttgaa

SEQ ID NO: 975317 - DNA, 22 bp, Homo sapiens
aaataagcccagtgctgctgta

SEQ ID NO: 975318 - DNA, 15 bp, Homo sapiens
aaataaggaatttcc

SEQ ID NO: 975319 - DNA, 20 bp, Homo sapiens
aaataaggatgactttagaa

SEQ ID NO: 975320 - DNA, 19 bp, Homo sapiens
aaataaggcacccatctgt

SEQ ID NO: 975321 - DNA, 13 bp, Homo sapiens
aaataagtcaaca

SEQ ID NO: 975322 - DNA, 12 bp, Homo sapiens
aaataagtctga

SEQ ID NO: 975323 - DNA, 16 bp, Homo sapiens
aaataagtctgattta

SEQ ID NO: 975324 - DNA, 19 bp, Homo sapiens
aaataagtgtattttgaaa

SEQ ID NO: 975325 - DNA, 11 bp, Homo sapiens
aaataagtttt

SEQ ID NO: 975326 - DNA, 13 bp, Homo sapiens
aaataagtttttc

SEQ ID NO: 975327 - DNA, 19 bp, Homo sapiens
aaataagtttttctttaat

SEQ ID NO: 975328 - DNA, 13 bp, Homo sapiens
aaataagtttttg

SEQ ID NO: 975329 - DNA, 17 bp, Homo sapiens
aaataataaagatgctc

SEQ ID NO: 975330 - DNA, 12 bp, Homo sapiens
aaataataaatc

SEQ ID NO: 975331 - DNA, 16 bp, Homo sapiens
aaataatatatttctt

SEQ ID NO: 975332 - DNA, 13 bp, Homo sapiens
aaataatatgcat

SEQ ID NO: 975333 - DNA, 20 bp, Homo sapiens
aaataatccattccaaaata

SEQ ID NO: 975334 - DNA, 13 bp, Homo sapiens
aaataatctctga

SEQ ID NO: 975335 - DNA, 13 bp, Homo sapiens
aaataatgaataa

SEQ ID NO: 975336 - DNA, 19 bp, Homo sapiens
aaataatgaataaactgaa

SEQ ID NO: 975337 - DNA, 12 bp, Homo sapiens
aaataatgtgaa

SEQ ID NO: 975338 - DNA, 22 bp, Homo sapiens
aaataatgtgaaactggattaa

SEQ ID NO: 975339 - DNA, 23 bp, Homo sapiens
aaataatgttctgtcacgtgaaa

SEQ ID NO: 975340 - DNA, 13 bp, Homo sapiens
aaataattaaatc

SEQ ID NO: 975341 - DNA, 22 bp, Homo sapiens
aaataattaaatctctttaaga

SEQ ID NO: 975342 - DNA, 21 bp, Homo sapiens
aaataattatataactgtatt

SEQ ID NO: 975343 - DNA, 23 bp, Homo sapiens
aaataattgatcagatgctgaat

SEQ ID NO: 975344 - DNA, 14 bp, Homo sapiens
aaataattgccaca

SEQ ID NO: 975345 - DNA, 13 bp, Homo sapiens
aaataatttccta

SEQ ID NO: 975346 - DNA, 20 bp, Homo sapiens
aaataatttgaatgtatttg

SEQ ID NO: 975347 - DNA, 23 bp, Homo sapiens
aaataatttgaatgtatttgatt

SEQ ID NO: 975348 - DNA, 18 bp, Homo sapiens
aaataattttaaacaaag

SEQ ID NO: 975349 - DNA, 20 bp, Homo sapiens
aaataattttaaacaaaggt

SEQ ID NO: 975350 - DNA, 13 bp, Homo sapiens
aaataattttcca

SEQ ID NO: 975351 - DNA, 21 bp, Homo sapiens
aaataattttccaagtaaagt

SEQ ID NO: 975352 - DNA, 20 bp, Homo sapiens
aaataattttctaagacagt

SEQ ID NO: 975353 - DNA, 12 bp, Homo sapiens
aaataattttgt

SEQ ID NO: 975354 - DNA, 22 bp, Homo sapiens
aaatacaaaaagcaaaacaaaa

SEQ ID NO: 975355 - DNA, 13 bp, Homo sapiens
aaatacaaagtta

SEQ ID NO: 975356 - DNA, 17 bp, Homo sapiens
aaatcaatatgcagaat

SEQ ID NO: 975357 - DNA, 12 bp, Homo sapiens
aaatcaatcaat

SEQ ID NO: 975358 - DNA, 21 bp, Homo sapiens
aaatcaatcaatggtgcaaaa

SEQ ID NO: 975359 - DNA, 13 bp, Homo sapiens
aaatcaatgtcac

SEQ ID NO: 975360 - DNA, 19 bp, Homo sapiens
aaatcaattactggtccaa

SEQ ID NO: 975361 - DNA, 14 bp, Homo sapiens
aaatcacatcacta

SEQ ID NO: 975362 - DNA, 14 bp, Homo sapiens
aaatcacatttcca

SEQ ID NO: 975363 - DNA, 12 bp, Homo sapiens
aaatcacatttt

SEQ ID NO: 975364 - DNA, 18 bp, Homo sapiens
aaatcactgtgaaatttc

SEQ ID NO: 975365 - DNA, 22 bp, Homo sapiens
aaatcactgtgaaatttcatga

SEQ ID NO: 975366 - DNA, 13 bp, Homo sapiens
aaatcacttcaat

SEQ ID NO: 975367 - DNA, 21 bp, Homo sapiens
aaatcagaaagtttagatctg

SEQ ID NO: 975368 - DNA, 21 bp, Homo sapiens
aaatcagaagtcatcttgcta

SEQ ID NO: 975369 - DNA, 22 bp, Homo sapiens
aaatcagagacaaaatatttcc

SEQ ID NO: 975370 - DNA, 22 bp, Homo sapiens
aaatcagcatgacaaaaataac

SEQ ID NO: 975371 - DNA, 21 bp, Homo sapiens
aaatcagccaagttttataat

SEQ ID NO: 975372 - DNA, 16 bp, Homo sapiens
aaatcagcccccagcc

SEQ ID NO: 975373 - DNA, 21 bp, Homo sapiens
aaatcaggtagaccatattct

SEQ ID NO: 975374 - DNA, 13 bp, Homo sapiens
aaatcaggtgttt

SEQ ID NO: 975375 - DNA, 14 bp, Homo sapiens
aaatcaggttttct

SEQ ID NO: 975376 - DNA, 18 bp, Homo sapiens
aaatcaggttttctttta

SEQ ID NO: 975377 - DNA, 18 bp, Homo sapiens
agggggcttgaagccaaa

SEQ ID NO: 975378 - DNA, 15 bp, Homo sapiens
agggggctttcacta

SEQ ID NO: 975379 - DNA, 16 bp, Homo sapiens
aggggggctgtgccaa

SEQ ID NO: 975380 - DNA, 20 bp, Homo sapiens
aggggggtcggaagcctgtc

SEQ ID NO: 975381 - DNA, 22 bp, Homo sapiens
aggggggtcggaagcctgtcct

SEQ ID NO: 975382 - DNA, 19 bp, Homo sapiens
aggggggtgctggccccca

SEQ ID NO: 975383 - DNA, 21 bp, Homo sapiens
aggggggttgtgaggcctggc

SEQ ID NO: 975384 - DNA, 18 bp, Homo sapiens
agggggtacctcatgagg

SEQ ID NO: 975385 - DNA, 16 bp, Homo sapiens
agggggtaggagagca

SEQ ID NO: 975386 - DNA, 21 bp, Homo sapiens
agggggtaggagagcactgcc

SEQ ID NO: 975387 - DNA, 16 bp, Homo sapiens
agggggtcccagtggg

SEQ ID NO: 975388 - DNA, 19 bp, Homo sapiens
agggggtcccagtgggagg

SEQ ID NO: 975389 - DNA, 24 bp, Homo sapiens
agggggtcccagtgggaggggcag

SEQ ID NO: 975390 - DNA, 13 bp, Homo sapiens
agggggtgactgg

SEQ ID NO: 975391 - DNA, 14 bp, Homo sapiens
agggggtgagaggc

SEQ ID NO: 975392 - DNA, 19 bp, Homo sapiens
agggggtgcaaagactctg

SEQ ID NO: 975393 - DNA, 22 bp, Homo sapiens
agggggtgcaaagactctgagc

SEQ ID NO: 975394 - DNA, 23 bp, Homo sapiens
agggggtgcaaagactctgagcc

SEQ ID NO: 975395 - DNA, 14 bp, Homo sapiens
agggggtgtcagaa

SEQ ID NO: 975396 - DNA, 15 bp, Homo sapiens
agggggtgtcagaag

SEQ ID NO: 975397 - DNA, 21 bp, Homo sapiens
agggggtgtcagaagctggga

SEQ ID NO: 975398 - DNA, 16 bp, Homo sapiens
agggggtttgggggct

SEQ ID NO: 975399 - DNA, 22 bp, Homo sapiens
agggggtttgggggcttgcaag

SEQ ID NO: 975400 - DNA, 18 bp, Homo sapiens
aggggtaggatgtacagg

SEQ ID NO: 975401 - DNA, 17 bp, Homo sapiens
aggggtaggcagagcct

SEQ ID NO: 975402 - DNA, 20 bp, Homo sapiens
aggggtcagggaccaaggac

SEQ ID NO: 975403 - DNA, 17 bp, Homo sapiens
aggggtcaggtgtcagg

SEQ ID NO: 975404 - DNA, 18 bp, Homo sapiens
aggggtcccagccacccc

SEQ ID NO: 975405 - DNA, 19 bp, Homo sapiens
aggggtcccagccaccccg

SEQ ID NO: 975406 - DNA, 13 bp, Homo sapiens
aggggtccctgct

SEQ ID NO: 975407 - DNA, 14 bp, Homo sapiens
aggggtcctgcagg

SEQ ID NO: 975408 - DNA, 15 bp, Homo sapiens
aggggtcggctgacc

SEQ ID NO: 975409 - DNA, 21 bp, Homo sapiens
aggggtcggctgaccatgctc

SEQ ID NO: 975410 - DNA, 14 bp, Homo sapiens
aggggtctccctgg

SEQ ID NO: 975411 - DNA, 15 bp, Homo sapiens
aggggtctccctggc

SEQ ID NO: 975412 - DNA, 16 bp, Homo sapiens
aggggtctccctggct

SEQ ID NO: 975413 - DNA, 13 bp, Homo sapiens
aggggtgatttca

SEQ ID NO: 975414 - DNA, 23 bp, Homo sapiens
aggggtgcacccactcaccaggg

SEQ ID NO: 975415 - DNA, 17 bp, Homo sapiens
aggggtgcagaggctgt

SEQ ID NO: 975416 - DNA, 14 bp, Homo sapiens
aggggtgcaggtgg

SEQ ID NO: 975417 - DNA, 16 bp, Homo sapiens
aggggtgccccctcct

SEQ ID NO: 975418 - DNA, 23 bp, Homo sapiens
aggggtgccccctcctctcccat

SEQ ID NO: 975419 - DNA, 20 bp, Homo sapiens
aggggtgcggcggtcccagc

SEQ ID NO: 975420 - DNA, 17 bp, Homo sapiens
aggggtggagactgctt

SEQ ID NO: 975421 - DNA, 17 bp, Homo sapiens
aggggtggctgggtctt

SEQ ID NO: 975422 - DNA, 15 bp, Homo sapiens
aggggtgggagagcc

SEQ ID NO: 975423 - DNA, 18 bp, Homo sapiens
aggggtgggagagccagc

SEQ ID NO: 975424 - DNA, 21 bp, Homo sapiens
aggggtggggagatgcttctc

SEQ ID NO: 975425 - DNA, 21 bp, Homo sapiens
aggggtgggtcagaacatgtt

SEQ ID NO: 975426 - DNA, 13 bp, Homo sapiens
aggggtggtcctg

SEQ ID NO: 975427 - DNA, 15 bp, Homo sapiens
aggggtgtggctcct

SEQ ID NO: 975428 - DNA, 15 bp, Homo sapiens
aggggtgtgggtcaa

SEQ ID NO: 975429 - DNA, 14 bp, Homo sapiens
aggggttcctcaaa

SEQ ID NO: 975430 - DNA, 15 bp, Homo sapiens
aggggttcgagacca

SEQ ID NO: 975431 - DNA, 21 bp, Homo sapiens
aggggttctatttattcctgt

SEQ ID NO: 975432 - DNA, 20 bp, Homo sapiens
aggggttcttgagccagcca

SEQ ID NO: 975433 - DNA, 18 bp, Homo sapiens
aggggttgcagtgagcgg

SEQ ID NO: 975434 - DNA, 19 bp, Homo sapiens
aggggttggttgaggtgga

SEQ ID NO: 975435 - DNA, 20 bp, Homo sapiens
aggggttggttgaggtggaa

SEQ ID NO: 975436 - DNA, 14 bp, Homo sapiens
aggggttgttttgg

SEQ ID NO: 975437 - DNA, 11 bp, Homo sapiens
aggggtttaca

SEQ ID NO: 975438 - DNA, 23 bp, Homo sapiens
aggggtttcagaattttgcattg

SEQ ID NO: 975439 - DNA, 17 bp, Homo sapiens
aggggtttggtctggga

SEQ ID NO: 975440 - DNA, 21 bp, Homo sapiens
aggggttttcgaagctcagcc

SEQ ID NO: 975441 - DNA, 22 bp, Homo sapiens
agggtaaataaaccactgtgcg

SEQ ID NO: 975442 - DNA, 16 bp, Homo sapiens
agggtaactggggggc

SEQ ID NO: 975443 - DNA, 17 bp, Homo sapiens
agggtaagaagtttgtg

SEQ ID NO: 975444 - DNA, 14 bp, Homo sapiens
agggtaaggtgcct

SEQ ID NO: 975445 - DNA, 18 bp, Homo sapiens
agggtaccctttggggag

SEQ ID NO: 975446 - DNA, 19 bp, Homo sapiens
agggtactaaggaatcttt

SEQ ID NO: 975447 - DNA, 20 bp, Homo sapiens
agggtactttattttgcttt

SEQ ID NO: 975448 - DNA, 19 bp, Homo sapiens
agggtagaatgattaatca

SEQ ID NO: 975449 - DNA, 22 bp, Homo sapiens
agggtagaatgattaatcaaag

SEQ ID NO: 975450 - DNA, 22 bp, Homo sapiens
agggtagaattcaatcagagct

SEQ ID NO: 975451 - DNA, 14 bp, Homo sapiens
agggtagagcaaag

SEQ ID NO: 975452 - DNA, 17 bp, Homo sapiens
agggtagagcaaaggag

SEQ ID NO: 975453 - DNA, 14 bp, Homo sapiens
agggtataatgtgt

SEQ ID NO: 975454 - DNA, 20 bp, Homo sapiens
agggtatccaagttggactg

SEQ ID NO: 975455 - DNA, 22 bp, Homo sapiens
agggtatccaagttggactggg

SEQ ID NO: 975456 - DNA, 21 bp, Homo sapiens
agggtatcccagacccctctc

SEQ ID NO: 975457 - DNA, 16 bp, Homo sapiens
agggtatgggaagcca

SEQ ID NO: 975458 - DNA, 19 bp, Homo sapiens
agggtcaaagacagaatgg

SEQ ID NO: 975459 - DNA, 18 bp, Homo sapiens
agggtcagccatttttaa

SEQ ID NO: 975460 - DNA, 15 bp, Homo sapiens
agggtcaggagaggg

SEQ ID NO: 975461 - DNA, 14 bp, Homo sapiens
agggtcccaccccc

SEQ ID NO: 975462 - DNA, 13 bp, Homo sapiens
agggtcccagggc

SEQ ID NO: 975463 - DNA, 16 bp, Homo sapiens
agggtcccagggctgc

SEQ ID NO: 975464 - DNA, 18 bp, Homo sapiens
agggtcccattgtgcaga

SEQ ID NO: 975465 - DNA, 19 bp, Homo sapiens
agggtccccgagtgcctag

SEQ ID NO: 975466 - DNA, 15 bp, Homo sapiens
agggtcccctcccca

SEQ ID NO: 975467 - DNA, 14 bp, Homo sapiens
agggtcccctgcca

SEQ ID NO: 975468 - DNA, 15 bp, Homo sapiens
agggtcccctgccac

SEQ ID NO: 975469 - DNA, 12 bp, Homo sapiens
agggtccctctg

SEQ ID NO: 975470 - DNA, 15 bp, Homo sapiens
agggtccctctgtgt

SEQ ID NO: 975471 - DNA, 24 bp, Homo sapiens
agggtccgcaccagctgctctgcc

SEQ ID NO: 975472 - DNA, 16 bp, Homo sapiens
agggtcctgcagcctg

SEQ ID NO: 975473 - DNA, 17 bp, Homo sapiens
agggtcctgcagcctgc

SEQ ID NO: 975474 - DNA, 23 bp, Homo sapiens
agggtcctgccggtgggaccctg

SEQ ID NO: 975475 - DNA, 23 bp, Homo sapiens
agggtcctggtcctaaagagtta

SEQ ID NO: 975476 - DNA, 14 bp, Homo sapiens
agggtcgtctttgt

SEQ ID NO: 975477 - DNA, 20 bp, Homo sapiens
aaatgccttcatgaatcttt

SEQ ID NO: 975478 - DNA, 16 bp, Homo sapiens
aaatgccttttcccaa

SEQ ID NO: 975479 - DNA, 21 bp, Homo sapiens
aaatgccttttcccaaaatgt

SEQ ID NO: 975480 - DNA, 16 bp, Homo sapiens
aaatgcgaaattattg

SEQ ID NO: 975481 - DNA, 15 bp, Homo sapiens
aaatgcggttataaa

SEQ ID NO: 975482 - DNA, 22 bp, Homo sapiens
aaatgcggttataaaaaatggt

SEQ ID NO: 975483 - DNA, 18 bp, Homo sapiens
aaatgctcataaagatgt

SEQ ID NO: 975484 - DNA, 18 bp, Homo sapiens
aaatgctcattttcttta

SEQ ID NO: 975485 - DNA, 13 bp, Homo sapiens
aaatgctccccac

SEQ ID NO: 975486 - DNA, 15 bp, Homo sapiens
aaatgctgaacattg

SEQ ID NO: 975487 - DNA, 13 bp, Homo sapiens
aaatgctgcctgc

SEQ ID NO: 975488 - DNA, 14 bp, Homo sapiens
aaatgctgcctgcc

SEQ ID NO: 975489 - DNA, 12 bp, Homo sapiens
aaatgctgctct

SEQ ID NO: 975490 - DNA, 13 bp, Homo sapiens
aaatgctgctctc

SEQ ID NO: 975491 - DNA, 19 bp, Homo sapiens
aaatgctgctgtcagacga

SEQ ID NO: 975492 - DNA, 23 bp, Homo sapiens
aaatgctggctatagatgtcttt

SEQ ID NO: 975493 - DNA, 18 bp, Homo sapiens
aaatgctgtagaagtgag

SEQ ID NO: 975494 - DNA, 22 bp, Homo sapiens
aaatgcttccactgcaagtctg

SEQ ID NO: 975495 - DNA, 18 bp, Homo sapiens
aaatgcttctgttgtaat

SEQ ID NO: 975496 - DNA, 20 bp, Homo sapiens
aaatgcttttaaatgctctc

SEQ ID NO: 975497 - DNA, 15 bp, Homo sapiens
aaatgcttttatatt

SEQ ID NO: 975498 - DNA, 18 bp, Homo sapiens
aaatggaagcaaagacaa

SEQ ID NO: 975499 - DNA, 20 bp, Homo sapiens
aaatggaggatctctaaaga

SEQ ID NO: 975500 - DNA, 22 bp, Homo sapiens
aaatggaggtccttctgctgga

SEQ ID NO: 975501 - DNA, 21 bp, Homo sapiens
aaatggatactacatctttaa

SEQ ID NO: 975502 - DNA, 14 bp, Homo sapiens
aaatggatatagaa

SEQ ID NO: 975503 - DNA, 19 bp, Homo sapiens
aaatggatattattagaaa

SEQ ID NO: 975504 - DNA, 17 bp, Homo sapiens
aaatggatgccttgaat

SEQ ID NO: 975505 - DNA, 21 bp, Homo sapiens
aaatggatgccttgaataata

SEQ ID NO: 975506 - DNA, 13 bp, Homo sapiens
aaatggcagtttt

SEQ ID NO: 975507 - DNA, 17 bp, Homo sapiens
aaatggccagtgctgct

SEQ ID NO: 975508 - DNA, 17 bp, Homo sapiens
aggtagcaagagagcag

SEQ ID NO: 975509 - DNA, 20 bp, Homo sapiens
aggtagcattctttggagtt

SEQ ID NO: 975510 - DNA, 15 bp, Homo sapiens
aggtagcgagctgct

SEQ ID NO: 975511 - DNA, 19 bp, Homo sapiens
aggtagcgagctgctctgc

SEQ ID NO: 975512 - DNA, 13 bp, Homo sapiens
aggtagcttcagc

SEQ ID NO: 975513 - DNA, 21 bp, Homo sapiens
aggtaggaagcaacagcttca

SEQ ID NO: 975514 - DNA, 19 bp, Homo sapiens
aggtaggcccttgtcctgc

SEQ ID NO: 975515 - DNA, 21 bp, Homo sapiens
aggtaggcccttgtcctgcca

SEQ ID NO: 975516 - DNA, 23 bp, Homo sapiens
aggtagtgattaactgtgaataa

SEQ ID NO: 975517 - DNA, 23 bp, Homo sapiens
aggtagttgggtagaaaaattat

SEQ ID NO: 975518 - DNA, 13 bp, Homo sapiens
aggtataaagaca

SEQ ID NO: 975519 - DNA, 15 bp, Homo sapiens
aggtataattttatg

SEQ ID NO: 975520 - DNA, 17 bp, Homo sapiens
aggtatcagttatatga

SEQ ID NO: 975521 - DNA, 13 bp, Homo sapiens
aggtatgaataag

SEQ ID NO: 975522 - DNA, 23 bp, Homo sapiens
aggtatggctctgcacccctctg

SEQ ID NO: 975523 - DNA, 14 bp, Homo sapiens
aggtatgttgcctt

SEQ ID NO: 975524 - DNA, 22 bp, Homo sapiens
aggtattccttttgtgtacagt

SEQ ID NO: 975525 - DNA, 18 bp, Homo sapiens
aggtattgtctactctga

SEQ ID NO: 975526 - DNA, 17 bp, Homo sapiens
aggtatttaagactgat

SEQ ID NO: 975527 - DNA, 20 bp, Homo sapiens
aggtatttaagactgataat

SEQ ID NO: 975528 - DNA, 14 bp, Homo sapiens
aggtatttatcttt

SEQ ID NO: 975529 - DNA, 17 bp, Homo sapiens
aggtatttcgaaactgc

SEQ ID NO: 975530 - DNA, 18 bp, Homo sapiens
aggtatttcgaaactgcc

SEQ ID NO: 975531 - DNA, 12 bp, Homo sapiens
aggtatttgaaa

SEQ ID NO: 975532 - DNA, 14 bp, Homo sapiens
aggtattttgaata

SEQ ID NO: 975533 - DNA, 20 bp, Homo sapiens
aggtatttttccaatcacag

SEQ ID NO: 975534 - DNA, 14 bp, Homo sapiens
aggtcaacagagaa

SEQ ID NO: 975535 - DNA, 17 bp, Homo sapiens
aggtcaagaacatgcaa

SEQ ID NO: 975536 - DNA, 20 bp, Homo sapiens
aggtcaataaagcagagcca

SEQ ID NO: 975537 - DNA, 14 bp, Homo sapiens
aggtcaatgtcaag

SEQ ID NO: 975538 - DNA, 19 bp, Homo sapiens
aggtcacagaaaggcaggt

SEQ ID NO: 975539 - DNA, 18 bp, Homo sapiens
aggtcacattcaggaaga

SEQ ID NO: 975540 - DNA, 15 bp, Homo sapiens
aggtcaccagctgct

SEQ ID NO: 975541 - DNA, 18 bp, Homo sapiens
aggtcaccagctgctgtg

SEQ ID NO: 975542 - DNA, 21 bp, Homo sapiens
aggtcaccagctgctgtgccc

SEQ ID NO: 975543 - DNA, 16 bp, Homo sapiens
aggtcaccatcctcag

SEQ ID NO: 975544 - DNA, 17 bp, Homo sapiens
aggtcacgttggccctc

SEQ ID NO: 975545 - DNA, 23 bp, Homo sapiens
aggtcactcttcctgcaaggact

SEQ ID NO: 975546 - DNA, 19 bp, Homo sapiens
aggtcactcttggtccctg

SEQ ID NO: 975547 - DNA, 21 bp, Homo sapiens
aggtcactggaaaggggagag

SEQ ID NO: 975548 - DNA, 15 bp, Homo sapiens
aggtcactggctctc

SEQ ID NO: 975549 - DNA, 16 bp, Homo sapiens
aggtcactggctctcc

SEQ ID NO: 975550 - DNA, 19 bp, Homo sapiens
aggtcactgtcactgccga

SEQ ID NO: 975551 - DNA, 16 bp, Homo sapiens
aggtcactgtttcctg

SEQ ID NO: 975552 - DNA, 15 bp, Homo sapiens
aggtcagaggagggc

SEQ ID NO: 975553 - DNA, 13 bp, Homo sapiens
aggtcagatggag

SEQ ID NO: 975554 - DNA, 19 bp, Homo sapiens
aggtcagcatttgatctgt

SEQ ID NO: 975555 - DNA, 20 bp, Homo sapiens
aggtcagcccgtttcagaag

SEQ ID NO: 975556 - DNA, 17 bp, Homo sapiens
aggtcagcgagaaggag

SEQ ID NO: 975557 - DNA, 17 bp, Homo sapiens
aggtcagctgggagcca

SEQ ID NO: 975558 - DNA, 18 bp, Homo sapiens
aggtcagctgggagccag

SEQ ID NO: 975559 - DNA, 19 bp, Homo sapiens
aggtcagctgggagccagt

SEQ ID NO: 975560 - DNA, 21 bp, Homo sapiens
aggtcagctgttactttcttt

SEQ ID NO: 975561 - DNA, 17 bp, Homo sapiens
aggtcaggacggctcct

SEQ ID NO: 975562 - DNA, 23 bp, Homo sapiens
aggtcaggacggctcctcagagc

SEQ ID NO: 975563 - DNA, 21 bp, Homo sapiens
aggtcaggagatcgagaccat

SEQ ID NO: 975564 - DNA, 16 bp, Homo sapiens
aggtcaggagttccta

SEQ ID NO: 975565 - DNA, 23 bp, Homo sapiens
aggtcaggatgcacatttctgga

SEQ ID NO: 975566 - DNA, 17 bp, Homo sapiens
aggtcagggctcagagt

SEQ ID NO: 975567 - DNA, 16 bp, Homo sapiens
aggtcatcagatgcct

SEQ ID NO: 975568 - DNA, 17 bp, Homo sapiens
aggtcatcagatgcctg

SEQ ID NO: 975569 - DNA, 17 bp, Homo sapiens
aggtcatctgaccttca

SEQ ID NO: 975570 - DNA, 19 bp, Homo sapiens
aggtcatgcagttcctggc

SEQ ID NO: 975571 - DNA, 18 bp, Homo sapiens
aggtcatgctggtgggtt

SEQ ID NO: 975572 - DNA, 14 bp, Homo sapiens
aggtcatgtctgta

SEQ ID NO: 975573 - DNA, 22 bp, Homo sapiens
aggtcattttttttaagaaaaa

SEQ ID NO: 975574 - DNA, 21 bp, Homo sapiens
aggtccaagccccccacacct

SEQ ID NO: 975575 - DNA, 18 bp, Homo sapiens
aggtccaccggcccctgg

SEQ ID NO: 975576 - DNA, 21 bp, Homo sapiens
aggtccacggtctgttcttga

SEQ ID NO: 975577 - DNA, 22 bp, Homo sapiens
aggtccacggtctgttcttgaa

SEQ ID NO: 975578 - DNA, 17 bp, Homo sapiens
aggtccactccctgctc

SEQ ID NO: 975579 - DNA, 19 bp, Homo sapiens
aggtccactccctgctcca

SEQ ID NO: 975580 - DNA, 13 bp, Homo sapiens
aggtccagcatcc

SEQ ID NO: 975581 - DNA, 14 bp, Homo sapiens
aggtccagcccatc

SEQ ID NO: 975582 - DNA, 16 bp, Homo sapiens
aggtccagcccatctc

SEQ ID NO: 975583 - DNA, 23 bp, Homo sapiens
aggtccagcccatctcggagcat

SEQ ID NO: 975584 - DNA, 17 bp, Homo sapiens
aggtccagctctggagg

SEQ ID NO: 975585 - DNA, 20 bp, Homo sapiens
aggtccattattttgtattc

SEQ ID NO: 975586 - DNA, 19 bp, Homo sapiens
aggtccattcattaattag

SEQ ID NO: 975587 - DNA, 22 bp, Homo sapiens
aggtcccaattcggggcctgct

SEQ ID NO: 975588 - DNA, 15 bp, Homo sapiens
aggtcccacctccag

SEQ ID NO: 975589 - DNA, 17 bp, Homo sapiens
aggtcccacctccagcc

SEQ ID NO: 975590 - DNA, 17 bp, Homo sapiens
aggtcccagcgagccac

SEQ ID NO: 975591 - DNA, 19 bp, Homo sapiens
aggtcccagcgagccacag

SEQ ID NO: 975592 - DNA, 10 bp, Homo sapiens
aggtccccaa

SEQ ID NO: 975593 - DNA, 21 bp, Homo sapiens
aggtccccccacagctccagg

SEQ ID NO: 975594 - DNA, 19 bp, Homo sapiens
aggtcccccgactgcctgt

SEQ ID NO: 975595 - DNA, 18 bp, Homo sapiens
aggtccccggttgctggt

SEQ ID NO: 975596 - DNA, 20 bp, Homo sapiens
aggtccccggttgctggtca

SEQ ID NO: 975597 - DNA, 13 bp, Homo sapiens
aggtcccctccac

SEQ ID NO: 975598 - DNA, 21 bp, Homo sapiens
aaattatgttttaaacacatg

SEQ ID NO: 975599 - DNA, 21 bp, Homo sapiens
aaattattcagaactatttaa

SEQ ID NO: 975600 - DNA, 16 bp, Homo sapiens
aaattattgtaaactt

SEQ ID NO: 975601 - DNA, 13 bp, Homo sapiens
aaattatttaaac

SEQ ID NO: 975602 - DNA, 12 bp, Homo sapiens
aaattatttctt

SEQ ID NO: 975603 - DNA, 14 bp, Homo sapiens
aaattatttcttaa

SEQ ID NO: 975604 - DNA, 13 bp, Homo sapiens
aaattatttgtgt

SEQ ID NO: 975605 - DNA, 20 bp, Homo sapiens
aaattattttaatattttgt

SEQ ID NO: 975606 - DNA, 14 bp, Homo sapiens
aaattattttatat

SEQ ID NO: 975607 - DNA, 22 bp, Homo sapiens
aaattattttatatcatacagt

SEQ ID NO: 975608 - DNA, 17 bp, Homo sapiens
aaattcaaaatgctcta

SEQ ID NO: 975609 - DNA, 21 bp, Homo sapiens
aaattcaaagcatggacattt

SEQ ID NO: 975610 - DNA, 11 bp, Homo sapiens
aaattcaaata

SEQ ID NO: 975611 - DNA, 17 bp, Homo sapiens
aaattcaagaaaataaa

SEQ ID NO: 975612 - DNA, 20 bp, Homo sapiens
aaattcaagaaaataaaact

SEQ ID NO: 975613 - DNA, 21 bp, Homo sapiens
aaattcaagagctagaaaaat

SEQ ID NO: 975614 - DNA, 22 bp, Homo sapiens
aaattcaagagctagaaaaata

SEQ ID NO: 975615 - DNA, 17 bp, Homo sapiens
aaattcaattgtaaatt

SEQ ID NO: 975616 - DNA, 19 bp, Homo sapiens
aaattcaattgtaaattga

SEQ ID NO: 975617 - DNA, 18 bp, Homo sapiens
aaattcacaaacttttat

SEQ ID NO: 975618 - DNA, 16 bp, Homo sapiens
aaattcacaatagaaa

SEQ ID NO: 975619 - DNA, 15 bp, Homo sapiens
aaattcactgtttgt

SEQ ID NO: 975620 - DNA, 14 bp, Homo sapiens
aaattcactttcat

SEQ ID NO: 975621 - DNA, 16 bp, Homo sapiens
aaattcagaacagcct

SEQ ID NO: 975622 - DNA, 15 bp, Homo sapiens
aaattcagagtcctt

SEQ ID NO: 975623 - DNA, 20 bp, Homo sapiens
aaattcagatatatttttca

SEQ ID NO: 975624 - DNA, 15 bp, Homo sapiens
aaattcagcatttga

SEQ ID NO: 975625 - DNA, 16 bp, Homo sapiens
aaattcaggtacagaa

SEQ ID NO: 975626 - DNA, 23 bp, Homo sapiens
aaattcaggtacagaaaacatgt

SEQ ID NO: 975627 - DNA, 17 bp, Homo sapiens
aaattcagtattttgcc

SEQ ID NO: 975628 - DNA, 18 bp, Homo sapiens
aaattcagtattttgcct

SEQ ID NO: 975629 - DNA, 13 bp, Homo sapiens
aaattcagtctct

SEQ ID NO: 975630 - DNA, 13 bp, Homo sapiens
aaattcagtttca

SEQ ID NO: 975631 - DNA, 13 bp, Homo sapiens
aaattcagttttt

SEQ ID NO: 975632 - DNA, 16 bp, Homo sapiens
aaattcagtttttgta

SEQ ID NO: 975633 - DNA, 17 bp, Homo sapiens
aaattcagtttttgtat

SEQ ID NO: 975634 - DNA, 18 bp, Homo sapiens
aaattcagtttttgtatc

SEQ ID NO: 975635 - DNA, 20 bp, Homo sapiens
aaattcagtttttgtatctt

SEQ ID NO: 975636 - DNA, 23 bp, Homo sapiens
aaattcagtttttgtatcttggg

SEQ ID NO: 975637 - DNA, 20 bp, Homo sapiens
aaattcagtttttttccagt

SEQ ID NO: 975638 - DNA, 18 bp, Homo sapiens
aaattcatggcatgctta

SEQ ID NO: 975639 - DNA, 16 bp, Homo sapiens
aaattcattttattct

SEQ ID NO: 975640 - DNA, 15 bp, Homo sapiens
aaattccaaattttt

SEQ ID NO: 975641 - DNA, 15 bp, Homo sapiens
aaattccactgaaaa

SEQ ID NO: 975642 - DNA, 17 bp, Homo sapiens
aaattccactgaaaatt

SEQ ID NO: 975643 - DNA, 16 bp, Homo sapiens
aaattccccaccctga

SEQ ID NO: 975644 - DNA, 21 bp, Homo sapiens
aaattccgattagacctttat

SEQ ID NO: 975645 - DNA, 11 bp, Homo sapiens
aaattcctcct

SEQ ID NO: 975646 - DNA, 20 bp, Homo sapiens
aaattcctctttgctttgct

SEQ ID NO: 975647 - DNA, 14 bp, Homo sapiens
aaattcctgtagca

SEQ ID NO: 975648 - DNA, 14 bp, Homo sapiens
aaattctagattac

SEQ ID NO: 975649 - DNA, 23 bp, Homo sapiens
aaattctataggaacatatgaaa

SEQ ID NO: 975650 - DNA, 15 bp, Homo sapiens
aaattctatgttaaa

SEQ ID NO: 975651 - DNA, 20 bp, Homo sapiens
aaattctatgttaaatactg

SEQ ID NO: 975652 - DNA, 21 bp, Homo sapiens
aaattctatgttaaatactgt

SEQ ID NO: 975653 - DNA, 22 bp, Homo sapiens
aaattctatgttaaatactgtg

SEQ ID NO: 975654 - DNA, 19 bp, Homo sapiens
aaattctattacagtatgt

SEQ ID NO: 975655 - DNA, 21 bp, Homo sapiens
aaattctattctgatcttatt

SEQ ID NO: 975656 - DNA, 20 bp, Homo sapiens
aaattctcagtcagtaattg

SEQ ID NO: 975657 - DNA, 14 bp, Homo sapiens
aaattctcctggag

SEQ ID NO: 975658 - DNA, 15 bp, Homo sapiens
aaattctcttaaata

SEQ ID NO: 975659 - DNA, 18 bp, Homo sapiens
aaattctggtatacattg

SEQ ID NO: 975660 - DNA, 23 bp, Homo sapiens
aaattcttctgaactcaaactga

SEQ ID NO: 975661 - DNA, 12 bp, Homo sapiens
aaattcttgaaa

SEQ ID NO: 975662 - DNA, 18 bp, Homo sapiens
aaattcttgaagttcatg

SEQ ID NO: 975663 - DNA, 22 bp, Homo sapiens
aaattctttcacttgatgtttg

SEQ ID NO: 975664 - DNA, 15 bp, Homo sapiens
aaattgaaagaactt

SEQ ID NO: 975665 - DNA, 14 bp, Homo sapiens
aaattgaaagtatt

SEQ ID NO: 975666 - DNA, 16 bp, Homo sapiens
aaattgaacaaaaatg

SEQ ID NO: 975667 - DNA, 23 bp, Homo sapiens
aaattgaagcaactacaacttct

SEQ ID NO: 975668 - DNA, 20 bp, Homo sapiens
aaattgaagtgtcttctgtt

SEQ ID NO: 975669 - DNA, 21 bp, Homo sapiens
aaattgaataggtagtatcat

SEQ ID NO: 975670 - DNA, 15 bp, Homo sapiens
aaattgaatgcaaac

SEQ ID NO: 975671 - DNA, 22 bp, Homo sapiens
aaattgacagatcaagctgtga

SEQ ID NO: 975672 - DNA, 18 bp, Homo sapiens
aaattgacctagttcaga

SEQ ID NO: 975673 - DNA, 15 bp, Homo sapiens
aaattgacttagata

SEQ ID NO: 975674 - DNA, 16 bp, Homo sapiens
aaattgacttagatat

SEQ ID NO: 975675 - DNA, 17 bp, Homo sapiens
aaattgagagaatggaa

SEQ ID NO: 975676 - DNA, 20 bp, Homo sapiens
aaattgagataatgatactt

SEQ ID NO: 975677 - DNA, 18 bp, Homo sapiens
aaattgatttttctcttc

SEQ ID NO: 975678 - DNA, 13 bp, Homo sapiens
aaattgcacagag

SEQ ID NO: 975679 - DNA, 16 bp, Homo sapiens
aaattgcactattgca

SEQ ID NO: 975680 - DNA, 15 bp, Homo sapiens
aaattgcagtttcat

SEQ ID NO: 975681 - DNA, 18 bp, Homo sapiens
aaattgccctatgctgtg

SEQ ID NO: 975682 - DNA, 19 bp, Homo sapiens
aaattgccctatgctgtgc

SEQ ID NO: 975683 - DNA, 15 bp, Homo sapiens
aaattgcctgatttg

SEQ ID NO: 975684 - DNA, 17 bp, Homo sapiens
aaattgctaatgttgct

SEQ ID NO: 975685 - DNA, 13 bp, Homo sapiens
aaattgctatgtt

SEQ ID NO: 975686 - DNA, 17 bp, Homo sapiens
aaattgctatgttacta

SEQ ID NO: 975687 - DNA, 21 bp, Homo sapiens
aaattgctatgttactatttt

SEQ ID NO: 975688 - DNA, 22 bp, Homo sapiens
aaattgctatgttactattttc

SEQ ID NO: 975689 - DNA, 14 bp, Homo sapiens
aaattgctgtgctt

SEQ ID NO: 975690 - DNA, 18 bp, Homo sapiens
aaattgctttgtattgta

SEQ ID NO: 975691 - DNA, 19 bp, Homo sapiens
aaattgcttttgttgtgac

SEQ ID NO: 975692 - DNA, 23 bp, Homo sapiens
aaattgcttttgttgtgactttt

SEQ ID NO: 975693 - DNA, 19 bp, Homo sapiens
aaattggaaacattttctt

SEQ ID NO: 975694 - DNA, 19 bp, Homo sapiens
aaattggaacagaatgttt

SEQ ID NO: 975695 - DNA, 13 bp, Homo sapiens
aaattggaactct

SEQ ID NO: 975696 - DNA, 18 bp, Homo sapiens
aaattgggatctgtcttg

SEQ ID NO: 975697 - DNA, 22 bp, Homo sapiens
aaattggttggagaatttaggt

SEQ ID NO: 975698 - DNA, 22 bp, Homo sapiens
aaattgtacatatttgtggaat

SEQ ID NO: 975699 - DNA, 20 bp, Homo sapiens
aaattgtataccaatgtgtt

SEQ ID NO: 975700 - DNA, 21 bp, Homo sapiens
aaattgtataccaatgtgttt

SEQ ID NO: 975701 - DNA, 19 bp, Homo sapiens
aaattgtatattgtaattt

SEQ ID NO: 975702 - DNA, 18 bp, Homo sapiens
aaattgtatctcattact

SEQ ID NO: 975703 - DNA, 13 bp, Homo sapiens
aaattgtgatgtt

SEQ ID NO: 975704 - DNA, 17 bp, Homo sapiens
aaattgtgatgttttgt

SEQ ID NO: 975705 - DNA, 18 bp, Homo sapiens
aaattgtgattgttttat

SEQ ID NO: 975706 - DNA, 19 bp, Homo sapiens
aaattgtgttgtcttcagc

SEQ ID NO: 975707 - DNA, 16 bp, Homo sapiens
aaattgttgcaaacta

SEQ ID NO: 975708 - DNA, 22 bp, Homo sapiens
aaattgtttaagtgttgtaaat

SEQ ID NO: 975709 - DNA, 19 bp, Homo sapiens
aaattgtttagtggaaaat

SEQ ID NO: 975710 - DNA, 21 bp, Homo sapiens
aaattgtttatgtgttatgaa

SEQ ID NO: 975711 - DNA, 12 bp, Homo sapiens
aaattgtttctt

SEQ ID NO: 975712 - DNA, 15 bp, Homo sapiens
aaattgttttcactt

SEQ ID NO: 975713 - DNA, 19 bp, Homo sapiens
aaattgttttcacttgtat

SEQ ID NO: 975714 - DNA, 23 bp, Homo sapiens
aaatttaaaagacactgtttaca

SEQ ID NO: 975715 - DNA, 19 bp, Homo sapiens
aaatttaaaagtaaaatgt

SEQ ID NO: 975716 - DNA, 12 bp, Homo sapiens
aaatttaaaatt

SEQ ID NO: 975717 - DNA, 13 bp, Homo sapiens
aaatttaaagcag

SEQ ID NO: 975718 - DNA, 18 bp, Homo sapiens
aaatttaaagcaggttct

SEQ ID NO: 975719 - DNA, 21 bp, Homo sapiens
aaatttaaagcaggttcttgt

SEQ ID NO: 975720 - DNA, 17 bp, Homo sapiens
aaccagcccagcctgcc

SEQ ID NO: 975721 - DNA, 19 bp, Homo sapiens
aaccagcccagcctgcccc

SEQ ID NO: 975722 - DNA, 19 bp, Homo sapiens
aaccagcccgacagtgcca

SEQ ID NO: 975723 - DNA, 20 bp, Homo sapiens
aaccagccgtattttacatg

SEQ ID NO: 975724 - DNA, 21 bp, Homo sapiens
aaccagctaagaaaagatttt

SEQ ID NO: 975725 - DNA, 13 bp, Homo sapiens
aaccaggacccag

SEQ ID NO: 975726 - DNA, 17 bp, Homo sapiens
aaccaggacccagggtc

SEQ ID NO: 975727 - DNA, 21 bp, Homo sapiens
aaccaggagctgatggcagct

SEQ ID NO: 975728 - DNA, 22 bp, Homo sapiens
aaccaggattttgtgttttttc

SEQ ID NO: 975729 - DNA, 16 bp, Homo sapiens
aaccaggcacctcttc

SEQ ID NO: 975730 - DNA, 12 bp, Homo sapiens
aaccaggcagct

SEQ ID NO: 975731 - DNA, 19 bp, Homo sapiens
aaccaggcagctgagacca

SEQ ID NO: 975732 - DNA, 12 bp, Homo sapiens
aaccaggccctg

SEQ ID NO: 975733 - DNA, 17 bp, Homo sapiens
aaccagggaggagagga

SEQ ID NO: 975734 - DNA, 22 bp, Homo sapiens
aaccaggtcaccatcctcagag

SEQ ID NO: 975735 - DNA, 18 bp, Homo sapiens
aaccaggtccagatgtgc

SEQ ID NO: 975736 - DNA, 21 bp, Homo sapiens
aaccaggtttagacagtatga

SEQ ID NO: 975737 - DNA, 17 bp, Homo sapiens
aaccagtaacgtgctgc

SEQ ID NO: 975738 - DNA, 20 bp, Homo sapiens
aaccagtaacgtgctgctca

SEQ ID NO: 975739 - DNA, 22 bp, Homo sapiens
aaccagtaacgtgctgctcaag

SEQ ID NO: 975740 - DNA, 14 bp, Homo sapiens
aaccagtctcctca

SEQ ID NO: 975741 - DNA, 14 bp, Homo sapiens
aaccagtctgaagt

SEQ ID NO: 975742 - DNA, 23 bp, Homo sapiens
aaccagtctgaagtttcatttat

SEQ ID NO: 975743 - DNA, 17 bp, Homo sapiens
aaccagtgttgtggatt

SEQ ID NO: 975744 - DNA, 17 bp, Homo sapiens
aaccagttaaagccaca

SEQ ID NO: 975745 - DNA, 16 bp, Homo sapiens
aaccagtttattctgt

SEQ ID NO: 975746 - DNA, 18 bp, Homo sapiens
aaccagtttattctgtgg

SEQ ID NO: 975747 - DNA, 20 bp, Homo sapiens
aaccagtttattctgtggtt

SEQ ID NO: 975748 - DNA, 19 bp, Homo sapiens
aaccataaaaccctataca

SEQ ID NO: 975749 - DNA, 15 bp, Homo sapiens
aaccataatgtcttt

SEQ ID NO: 975750 - DNA, 22 bp, Homo sapiens
aaccataggctgctctgcctgt

SEQ ID NO: 975751 - DNA, 13 bp, Homo sapiens
aaccatatgatac

SEQ ID NO: 975752 - DNA, 22 bp, Homo sapiens
aaccatccagtgacaaaccatc

SEQ ID NO: 975753 - DNA, 18 bp, Homo sapiens
aaccatccatccctagaa

SEQ ID NO: 975754 - DNA, 20 bp, Homo sapiens
aaccatctcagacctttact

SEQ ID NO: 975755 - DNA, 19 bp, Homo sapiens
aaccatctgaagaaacttc

SEQ ID NO: 975756 - DNA, 12 bp, Homo sapiens
aaccatgacaaa

SEQ ID NO: 975757 - DNA, 22 bp, Homo sapiens
aaccatgctcttgttctgttcc

SEQ ID NO: 975758 - DNA, 17 bp, Homo sapiens
aaccatgtcagcaaaaa

SEQ ID NO: 975759 - DNA, 23 bp, Homo sapiens
aaccattactgaggggattctct

SEQ ID NO: 975760 - DNA, 19 bp, Homo sapiens
aggtggggcctcagcctgg

SEQ ID NO: 975761 - DNA, 17 bp, Homo sapiens
aggtgggggaaaatgaa

SEQ ID NO: 975762 - DNA, 18 bp, Homo sapiens
aggtgggggcctcctcag

SEQ ID NO: 975763 - DNA, 19 bp, Homo sapiens
aggtgggggcctcctcagc

SEQ ID NO: 975764 - DNA, 16 bp, Homo sapiens
aggtggggtgatggcc

SEQ ID NO: 975765 - DNA, 20 bp, Homo sapiens
aggtggggtgatggccagag

SEQ ID NO: 975766 - DNA, 21 bp, Homo sapiens
aggtggggtgatggccagagg

SEQ ID NO: 975767 - DNA, 22 bp, Homo sapiens
aggtgggtaggagcccttctct

SEQ ID NO: 975768 - DNA, 21 bp, Homo sapiens
aggtgggtccaggaaggcagc

SEQ ID NO: 975769 - DNA, 23 bp, Homo sapiens
aggtgggtctacctcatctctga

SEQ ID NO: 975770 - DNA, 17 bp, Homo sapiens
aggtgggtgctgccctg

SEQ ID NO: 975771 - DNA, 17 bp, Homo sapiens
aggtgggtgggcctgac

SEQ ID NO: 975772 - DNA, 19 bp, Homo sapiens
aggtgggtggtgggcttct

SEQ ID NO: 975773 - DNA, 20 bp, Homo sapiens
aggtgggtgtgggacacctg

SEQ ID NO: 975774 - DNA, 18 bp, Homo sapiens
aggtgggttgaaagccaa

SEQ ID NO: 975775 - DNA, 22 bp, Homo sapiens
aggtgggttttcttcccatcac

SEQ ID NO: 975776 - DNA, 17 bp, Homo sapiens
aggtggtagatattgag

SEQ ID NO: 975777 - DNA, 15 bp, Homo sapiens
aggtggtctgaatgt

SEQ ID NO: 975778 - DNA, 16 bp, Homo sapiens
aggtggtctgaatgtt

SEQ ID NO: 975779 - DNA, 17 bp, Homo sapiens
aggtggtctgaatgttc

SEQ ID NO: 975780 - DNA, 22 bp, Homo sapiens
aggtggtctgaatgttctgaca

SEQ ID NO: 975781 - DNA, 15 bp, Homo sapiens
aggtggtggaggggc

SEQ ID NO: 975782 - DNA, 20 bp, Homo sapiens
aggtggtggcactgagcccc

SEQ ID NO: 975783 - DNA, 13 bp, Homo sapiens
aggtggtggggct

SEQ ID NO: 975784 - DNA, 21 bp, Homo sapiens
aggtggtggtagagaagcaag

SEQ ID NO: 975785 - DNA, 17 bp, Homo sapiens
aggtggttatggagagg

SEQ ID NO: 975786 - DNA, 19 bp, Homo sapiens
aggtgtaaatgagaagacg

SEQ ID NO: 975787 - DNA, 15 bp, Homo sapiens
aggtgtagaaaaggt

SEQ ID NO: 975788 - DNA, 22 bp, Homo sapiens
aggtgtatgccacacctggcct

SEQ ID NO: 975789 - DNA, 13 bp, Homo sapiens
aggtgtcacatgg

SEQ ID NO: 975790 - DNA, 13 bp, Homo sapiens
aggtgtcatgctt

SEQ ID NO: 975791 - DNA, 17 bp, Homo sapiens
aggtgtcatttccatta

SEQ ID NO: 975792 - DNA, 22 bp, Homo sapiens
aggtgtccccaacgtcccctcc

SEQ ID NO: 975793 - DNA, 13 bp, Homo sapiens
aggtgtctctggg

SEQ ID NO: 975794 - DNA, 20 bp, Homo sapiens
aggtgtctgccttcacaaat

SEQ ID NO: 975795 - DNA, 23 bp, Homo sapiens
aggtgtcttttccactcctatgg

SEQ ID NO: 975796 - DNA, 16 bp, Homo sapiens
aggtgtgcacagaaaa

SEQ ID NO: 975797 - DNA, 17 bp, Homo sapiens
aggtgtgcttcctgctg

SEQ ID NO: 975798 - DNA, 23 bp, Homo sapiens
aggtgtggctttaggagcagtgg

SEQ ID NO: 975799 - DNA, 16 bp, Homo sapiens
aggtgtgggggctgca

SEQ ID NO: 975800 - DNA, 16 bp, Homo sapiens
aggtgtggtggctcat

SEQ ID NO: 975801 - DNA, 23 bp, Homo sapiens
aggtgttacagaggacccttacg

SEQ ID NO: 975802 - DNA, 14 bp, Homo sapiens
aggtgttagagagg

SEQ ID NO: 975803 - DNA, 20 bp, Homo sapiens
aggtgttctacactcatctt

SEQ ID NO: 975804 - DNA, 23 bp, Homo sapiens
aggtgttgccaaatatgtcctgg

SEQ ID NO: 975805 - DNA, 18 bp, Homo sapiens
aggtgttggttttggggg

SEQ ID NO: 975806 - DNA, 17 bp, Homo sapiens
aggtgtttaaagagagg

SEQ ID NO: 975807 - DNA, 18 bp, Homo sapiens
aggtgtttaaagagaggt

SEQ ID NO: 975808 - DNA, 18 bp, Homo sapiens
aggtgtttattaaaattc

SEQ ID NO: 975809 - DNA, 16 bp, Homo sapiens
aggtgtttccatttct

SEQ ID NO: 975810 - DNA, 20 bp, Homo sapiens
aggtgtttccatttctcaat

SEQ ID NO: 975811 - DNA, 12 bp, Homo sapiens
aggttaaaaaaa

SEQ ID NO: 975812 - DNA, 20 bp, Homo sapiens
aggttaaagctaaactgaat

SEQ ID NO: 975813 - DNA, 18 bp, Homo sapiens
aggttaaggtgggtccag

SEQ ID NO: 975814 - DNA, 15 bp, Homo sapiens
aggttaataaagtaa

SEQ ID NO: 975815 - DNA, 23 bp, Homo sapiens
aggttaatttttaccttacatgt

SEQ ID NO: 975816 - DNA, 15 bp, Homo sapiens
aggttacaagcctgc

SEQ ID NO: 975817 - DNA, 15 bp, Homo sapiens
aggttaccaagaagc

SEQ ID NO: 975818 - DNA, 16 bp, Homo sapiens
aggttaccaagaagcc

SEQ ID NO: 975819 - DNA, 17 bp, Homo sapiens
aggttactaaaacaggg

SEQ ID NO: 975820 - DNA, 19 bp, Homo sapiens
aggttagaaaggcagccct

SEQ ID NO: 975821 - DNA, 17 bp, Homo sapiens
aggttaggaaggcagca

SEQ ID NO: 975822 - DNA, 21 bp, Homo sapiens
aggttaggagttcgagaccag

SEQ ID NO: 975823 - DNA, 18 bp, Homo sapiens
aggttatacaataaccca

SEQ ID NO: 975824 - DNA, 16 bp, Homo sapiens
aggttatctgcctggc

SEQ ID NO: 975825 - DNA, 23 bp, Homo sapiens
aggttatctgcctggcctggctc

SEQ ID NO: 975826 - DNA, 15 bp, Homo sapiens
aggttatgctatttg

SEQ ID NO: 975827 - DNA, 19 bp, Homo sapiens
aggttatttaaaataaatt

SEQ ID NO: 975828 - DNA, 23 bp, Homo sapiens
aggttattttctttatcattgct

SEQ ID NO: 975829 - DNA, 13 bp, Homo sapiens
aggttattttgct

SEQ ID NO: 975830 - DNA, 16 bp, Homo sapiens
aggttattttgctttg

SEQ ID NO: 975831 - DNA, 17 bp, Homo sapiens
aggttcaaaagaagttg

SEQ ID NO: 975832 - DNA, 18 bp, Homo sapiens
aggttcaagcgattctcc

SEQ ID NO: 975833 - DNA, 17 bp, Homo sapiens
aggttccaactgtatat

SEQ ID NO: 975834 - DNA, 13 bp, Homo sapiens
aggttccagaggc

SEQ ID NO: 975835 - DNA, 16 bp, Homo sapiens
aggttccagaggccct

SEQ ID NO: 975836 - DNA, 15 bp, Homo sapiens
aggttcccaagctca

SEQ ID NO: 975837 - DNA, 16 bp, Homo sapiens
aggttcccaagctcag

SEQ ID NO: 975838 - DNA, 16 bp, Homo sapiens
aggttcccaaggacat

SEQ ID NO: 975839 - DNA, 20 bp, Homo sapiens
aggttccctgttcttcctcc

SEQ ID NO: 975840 - DNA, 23 bp, Homo sapiens
aggttccgcttggagcagagggg

SEQ ID NO: 975841 - DNA, 18 bp, Homo sapiens
aggttccgtatctccctg

SEQ ID NO: 975842 - DNA, 13 bp, Homo sapiens
aggttcctctgcc

SEQ ID NO: 975843 - DNA, 15 bp, Homo sapiens
aggttcctctgcctg

SEQ ID NO: 975844 - DNA, 12 bp, Homo sapiens
aggttcctgggg

SEQ ID NO: 975845 - DNA, 13 bp, Homo sapiens
aggttcctggggc

SEQ ID NO: 975846 - DNA, 15 bp, Homo sapiens
aggttcctggggccg

SEQ ID NO: 975847 - DNA, 23 bp, Homo sapiens
aggttcctggggccgcctgccct

SEQ ID NO: 975848 - DNA, 11 bp, Homo sapiens
aggttctaaaa

SEQ ID NO: 975849 - DNA, 13 bp, Homo sapiens
aggttctcagagc

SEQ ID NO: 975850 - DNA, 15 bp, Homo sapiens
aggttctcatttctc

SEQ ID NO: 975851 - DNA, 17 bp, Homo sapiens
aacctggagatgcagct

SEQ ID NO: 975852 - DNA, 16 bp, Homo sapiens
aacctggatccagcac

SEQ ID NO: 975853 - DNA, 17 bp, Homo sapiens
aacctggatccagcact

SEQ ID NO: 975854 - DNA, 21 bp, Homo sapiens
aacctgggattcaggaatgtg

SEQ ID NO: 975855 - DNA, 11 bp, Homo sapiens
aacctggtgct

SEQ ID NO: 975856 - DNA, 18 bp, Homo sapiens
aacctgtagaatcaattt

SEQ ID NO: 975857 - DNA, 16 bp, Homo sapiens
aacctgtattactgaa

SEQ ID NO: 975858 - DNA, 22 bp, Homo sapiens
aacctgtattactgaataatat

SEQ ID NO: 975859 - DNA, 23 bp, Homo sapiens
aacctgtcctaaggaaccttcct

SEQ ID NO: 975860 - DNA, 17 bp, Homo sapiens
aacctgtgccaggctga

SEQ ID NO: 975861 - DNA, 15 bp, Homo sapiens
aacctgtggctcagg

SEQ ID NO: 975862 - DNA, 22 bp, Homo sapiens
aacctgtggctcaggggagcaa

SEQ ID NO: 975863 - DNA, 23 bp, Homo sapiens
aacctgttcttagagtgtagctg

SEQ ID NO: 975864 - DNA, 21 bp, Homo sapiens
aacctgttttgttaatgctct

SEQ ID NO: 975865 - DNA, 18 bp, Homo sapiens
aaccttaaaaaatgtttc

SEQ ID NO: 975866 - DNA, 13 bp, Homo sapiens
aaccttaagatac

SEQ ID NO: 975867 - DNA, 13 bp, Homo sapiens
aaccttaagtgct

SEQ ID NO: 975868 - DNA, 18 bp, Homo sapiens
aaccttaatttattatta

SEQ ID NO: 975869 - DNA, 23 bp, Homo sapiens
aaccttagatgttctaagtcttt

SEQ ID NO: 975870 - DNA, 23 bp, Homo sapiens
aaccttagtcatcagatatgctt

SEQ ID NO: 975871 - DNA, 17 bp, Homo sapiens
aaccttatcaaggattt

SEQ ID NO: 975872 - DNA, 19 bp, Homo sapiens
aaccttattttgataaaat

SEQ ID NO: 975873 - DNA, 24 bp, Homo sapiens
aaccttccaagactgaagactgca

SEQ ID NO: 975874 - DNA, 14 bp, Homo sapiens
aaccttcctgggag

SEQ ID NO: 975875 - DNA, 19 bp, Homo sapiens
aaccttcctgggaggacag

SEQ ID NO: 975876 - DNA, 15 bp, Homo sapiens
aaccttcgtcctttt

SEQ ID NO: 975877 - DNA, 14 bp, Homo sapiens
aaccttgaatgctg

SEQ ID NO: 975878 - DNA, 19 bp, Homo sapiens
aaccttgaatgctgccagt

SEQ ID NO: 975879 - DNA, 20 bp, Homo sapiens
aaccttgaatgctgccagtg

SEQ ID NO: 975880 - DNA, 14 bp, Homo sapiens
aaccttgcaacggt

SEQ ID NO: 975881 - DNA, 19 bp, Homo sapiens
agtaatagtccaatatttg

SEQ ID NO: 975882 - DNA, 20 bp, Homo sapiens
agtaatagtccaatatttgg

SEQ ID NO: 975883 - DNA, 17 bp, Homo sapiens
agtaatatgcacacatt

SEQ ID NO: 975884 - DNA, 15 bp, Homo sapiens
agtaatcaataaaga

SEQ ID NO: 975885 - DNA, 20 bp, Homo sapiens
agtaatcagattactgcttt

SEQ ID NO: 975886 - DNA, 15 bp, Homo sapiens
agtaatcatactcaa

SEQ ID NO: 975887 - DNA, 14 bp, Homo sapiens
agtaatcccgccac

SEQ ID NO: 975888 - DNA, 17 bp, Homo sapiens
agtaatcccgccaccta

SEQ ID NO: 975889 - DNA, 16 bp, Homo sapiens
agtaatctaggtgtgg

SEQ ID NO: 975890 - DNA, 22 bp, Homo sapiens
agtaatctaggtgtggctgtga

SEQ ID NO: 975891 - DNA, 15 bp, Homo sapiens
agtaatctgtataat

SEQ ID NO: 975892 - DNA, 16 bp, Homo sapiens
agtaatctttatactg

SEQ ID NO: 975893 - DNA, 15 bp, Homo sapiens
agtaatgaaatggag

SEQ ID NO: 975894 - DNA, 15 bp, Homo sapiens
agtaatgaagaatca

SEQ ID NO: 975895 - DNA, 16 bp, Homo sapiens
agtaatgacttagaaa

SEQ ID NO: 975896 - DNA, 21 bp, Homo sapiens
agtaatgggtttcatatttct

SEQ ID NO: 975897 - DNA, 23 bp, Homo sapiens
agtaatgggtttcatatttctta

SEQ ID NO: 975898 - DNA, 14 bp, Homo sapiens
agtaattaataaag

SEQ ID NO: 975899 - DNA, 15 bp, Homo sapiens
agtaattaataaaga

SEQ ID NO: 975900 - DNA, 16 bp, Homo sapiens
agtaattaataaagaa

SEQ ID NO: 975901 - DNA, 23 bp, Homo sapiens
agtaattaataaagaaaaagaag

SEQ ID NO: 975902 - DNA, 20 bp, Homo sapiens
agtaattagtagaaatgcca

SEQ ID NO: 975903 - DNA, 20 bp, Homo sapiens
agtaattcaagcctctaaac

SEQ ID NO: 975904 - DNA, 21 bp, Homo sapiens
agtaattcaagcctctaaaca

SEQ ID NO: 975905 - DNA, 17 bp, Homo sapiens
agtaattgcacattttt

SEQ ID NO: 975906 - DNA, 19 bp, Homo sapiens
agtaattgcatttctgctc

SEQ ID NO: 975907 - DNA, 16 bp, Homo sapiens
agtaattgtgaaaaag

SEQ ID NO: 975908 - DNA, 22 bp, Homo sapiens
agtaatttattgtttttccttg

SEQ ID NO: 975909 - DNA, 12 bp, Homo sapiens
agtaatttcctt

SEQ ID NO: 975910 - DNA, 15 bp, Homo sapiens
agtaatttgaggaca

SEQ ID NO: 975911 - DNA, 14 bp, Homo sapiens
agtaatttggaaat

SEQ ID NO: 975912 - DNA, 14 bp, Homo sapiens
agtaattttgtcac

SEQ ID NO: 975913 - DNA, 14 bp, Homo sapiens
agtacaaaattgcc

SEQ ID NO: 975914 - DNA, 13 bp, Homo sapiens
agtacaaacatga

SEQ ID NO: 975915 - DNA, 14 bp, Homo sapiens
agtacaaacatgaa

SEQ ID NO: 975916 - DNA, 16 bp, Homo sapiens
agtacaaacatgaaaa

SEQ ID NO: 975917 - DNA, 18 bp, Homo sapiens
agtacaaatgaagaaagt

SEQ ID NO: 975918 - DNA, 21 bp, Homo sapiens
agtacaacccataatcatgta

SEQ ID NO: 975919 - DNA, 15 bp, Homo sapiens
agtacaagggctgag

SEQ ID NO: 975920 - DNA, 20 bp, Homo sapiens
agtacaataataaatcctca

SEQ ID NO: 975921 - DNA, 18 bp, Homo sapiens
agtacaatgaactgcttt

SEQ ID NO: 975922 - DNA, 16 bp, Homo sapiens
agtacacaataagcaa

SEQ ID NO: 975923 - DNA, 17 bp, Homo sapiens
agtacacaataagcaaa

SEQ ID NO: 975924 - DNA, 21 bp, Homo sapiens
agtacacaataagcaaaaaca

SEQ ID NO: 975925 - DNA, 20 bp, Homo sapiens
agtacactgtttcaaacttt

SEQ ID NO: 975926 - DNA, 17 bp, Homo sapiens
agtacagaaaaatactt

SEQ ID NO: 975927 - DNA, 18 bp, Homo sapiens
agtacagactgcagacat

SEQ ID NO: 975928 - DNA, 15 bp, Homo sapiens
agtacagcatgtgcc

SEQ ID NO: 975929 - DNA, 16 bp, Homo sapiens
agtacagcatgtgcct

SEQ ID NO: 975930 - DNA, 15 bp, Homo sapiens
agtacagtgtgtgtg

SEQ ID NO: 975931 - DNA, 17 bp, Homo sapiens
agtacataattgattaa

SEQ ID NO: 975932 - DNA, 14 bp, Homo sapiens
agtacatgttaaac

SEQ ID NO: 975933 - DNA, 13 bp, Homo sapiens
agtacattgctta

SEQ ID NO: 975934 - DNA, 16 bp, Homo sapiens
agtacatttaaatttt

SEQ ID NO: 975935 - DNA, 21 bp, Homo sapiens
agtacatttaaattttttggc

SEQ ID NO: 975936 - DNA, 13 bp, Homo sapiens
agtacatttaata

SEQ ID NO: 975937 - DNA, 20 bp, Homo sapiens
agtaccaaatccacaagcca

SEQ ID NO: 975938 - DNA, 15 bp, Homo sapiens
agtaccaatcatttt

SEQ ID NO: 975939 - DNA, 16 bp, Homo sapiens
agtaccaatcatttta

SEQ ID NO: 975940 - DNA, 15 bp, Homo sapiens
agtaccaatgctgtt

SEQ ID NO: 975941 - DNA, 19 bp, Homo sapiens
agtaccaatgggaagcagg

SEQ ID NO: 975942 - DNA, 13 bp, Homo sapiens
agtaccacactga

SEQ ID NO: 975943 - DNA, 15 bp, Homo sapiens
agtaccacactgagt

SEQ ID NO: 975944 - DNA, 23 bp, Homo sapiens
agtaccatttaatggggaggaca

SEQ ID NO: 975945 - DNA, 16 bp, Homo sapiens
agtaccctctcagctc

SEQ ID NO: 975946 - DNA, 21 bp, Homo sapiens
agtaccctgatgccttttgga

SEQ ID NO: 975947 - DNA, 15 bp, Homo sapiens
agtacctataaagta

SEQ ID NO: 975948 - DNA, 21 bp, Homo sapiens
agtacctataaagtaaagcta

SEQ ID NO: 975949 - DNA, 23 bp, Homo sapiens
agtacctataaagtaaagctaaa

SEQ ID NO: 975950 - DNA, 15 bp, Homo sapiens
agtacctcaaagtaa

SEQ ID NO: 975951 - DNA, 21 bp, Homo sapiens
agtacctctcaagctagtgtt

SEQ ID NO: 975952 - DNA, 15 bp, Homo sapiens
agtacctgaaaagta

SEQ ID NO: 975953 - DNA, 13 bp, Homo sapiens
agtacctgctgcc

SEQ ID NO: 975954 - DNA, 15 bp, Homo sapiens
agtacctgctgcccc

SEQ ID NO: 975955 - DNA, 17 bp, Homo sapiens
agtaccttgaactctta

SEQ ID NO: 975956 - DNA, 12 bp, Homo sapiens
agtaccttgctt

SEQ ID NO: 975957 - DNA, 16 bp, Homo sapiens
agtacgaacctacagt

SEQ ID NO: 975958 - DNA, 18 bp, Homo sapiens
agtacgaacctacagttt

SEQ ID NO: 975959 - DNA, 20 bp, Homo sapiens
agtacgatcaagttgttgac

SEQ ID NO: 975960 - DNA, 18 bp, Homo sapiens
agtacgtcccgctgctgt

SEQ ID NO: 975961 - DNA, 18 bp, Homo sapiens
agtacgtgctaacaggct

SEQ ID NO: 975962 - DNA, 17 bp, Homo sapiens
agtacgtgctttgagaa

SEQ ID NO: 975963 - DNA, 15 bp, Homo sapiens
agtacgttattgttg

SEQ ID NO: 975964 - DNA, 17 bp, Homo sapiens
agtacgttgtgcatttg

SEQ ID NO: 975965 - DNA, 14 bp, Homo sapiens
agtactagaaactg

SEQ ID NO: 975966 - DNA, 21 bp, Homo sapiens
agtactagagatattttgtaa

SEQ ID NO: 975967 - DNA, 17 bp, Homo sapiens
agtactcactttttcca

SEQ ID NO: 975968 - DNA, 16 bp, Homo sapiens
agtactcctgcaaaat

SEQ ID NO: 975969 - DNA, 20 bp, Homo sapiens
agtactcctgcaaaatttta

SEQ ID NO: 975970 - DNA, 17 bp, Homo sapiens
agtactccttaagaaca

SEQ ID NO: 975971 - DNA, 15 bp, Homo sapiens
agtactctctgctct

SEQ ID NO: 975972 - DNA, 16 bp, Homo sapiens
agtactctctgctcta

SEQ ID NO: 975973 - DNA, 17 bp, Homo sapiens
agtactctctgctctag

SEQ ID NO: 975974 - DNA, 19 bp, Homo sapiens
agtactctctgctctagcc

SEQ ID NO: 975975 - DNA, 18 bp, Homo sapiens
agtactggaataaacagt

SEQ ID NO: 975976 - DNA, 16 bp, Homo sapiens
agtactggctctttat

SEQ ID NO: 975977 - DNA, 15 bp, Homo sapiens
agtactgggaaggag

SEQ ID NO: 975978 - DNA, 20 bp, Homo sapiens
agtactggtaagattgttat

SEQ ID NO: 975979 - DNA, 23 bp, Homo sapiens
agtactggtaagattgttattaa

SEQ ID NO: 975980 - DNA, 16 bp, Homo sapiens
agtactgtgtacagaa

SEQ ID NO: 975981 - DNA, 18 bp, Homo sapiens
agtactgttttgaagctg

SEQ ID NO: 975982 - DNA, 23 bp, Homo sapiens
agtacttagctagttttattctt

SEQ ID NO: 975983 - DNA, 21 bp, Homo sapiens
aactccaacctctcggcccca

SEQ ID NO: 975984 - DNA, 18 bp, Homo sapiens
aactccacatctgcctta

SEQ ID NO: 975985 - DNA, 18 bp, Homo sapiens
aactccacccccagagga

SEQ ID NO: 975986 - DNA, 19 bp, Homo sapiens
aactccaccgaccaactgc

SEQ ID NO: 975987 - DNA, 13 bp, Homo sapiens
aactccagcaact

SEQ ID NO: 975988 - DNA, 19 bp, Homo sapiens
aactccaggatttataaag

SEQ ID NO: 975989 - DNA, 15 bp, Homo sapiens
aactccaggggcacc

SEQ ID NO: 975990 - DNA, 16 bp, Homo sapiens
aactccagggtcccct

SEQ ID NO: 975991 - DNA, 17 bp, Homo sapiens
aactccagggtcccctg

SEQ ID NO: 975992 - DNA, 15 bp, Homo sapiens
aactccatacagcct

SEQ ID NO: 975993 - DNA, 22 bp, Homo sapiens
aactccatcgccatcttcttcc

SEQ ID NO: 975994 - DNA, 16 bp, Homo sapiens
aactccatgcaaacca

SEQ ID NO: 975995 - DNA, 17 bp, Homo sapiens
aactccatggggttcga

SEQ ID NO: 975996 - DNA, 21 bp, Homo sapiens
aactcccattaccatgtaatg

SEQ ID NO: 975997 - DNA, 15 bp, Homo sapiens
aactccccttccctg

SEQ ID NO: 975998 - DNA, 20 bp, Homo sapiens
aactccccttccctggggag

SEQ ID NO: 975999 - DNA, 21 bp, Homo sapiens
aactccccttccctggggagc

SEQ ID NO: 976000 - DNA, 11 bp, Homo sapiens
aactccctcca

SEQ ID NO: 976001 - DNA, 21 bp, Homo sapiens
aactccctccaccagcctgct

SEQ ID NO: 976002 - DNA, 22 bp, Homo sapiens
aactccctccaccagcctgctg

SEQ ID NO: 976003 - DNA, 23 bp, Homo sapiens
agtatgttgtcataacatttaaa

SEQ ID NO: 976004 - DNA, 20 bp, Homo sapiens
agtatgttttagcatgtgtt

SEQ ID NO: 976005 - DNA, 11 bp, Homo sapiens
agtattaaggg

SEQ ID NO: 976006 - DNA, 19 bp, Homo sapiens
agtattactttctgccgct

SEQ ID NO: 976007 - DNA, 14 bp, Homo sapiens
agtattataccttt

SEQ ID NO: 976008 - DNA, 20 bp, Homo sapiens
agtattataggccaaactgg

SEQ ID NO: 976009 - DNA, 19 bp, Homo sapiens
agtattcaacaatttcaat

SEQ ID NO: 976010 - DNA, 16 bp, Homo sapiens
agtattcagagtctct

SEQ ID NO: 976011 - DNA, 18 bp, Homo sapiens
agtattcagagtctctga

SEQ ID NO: 976012 - DNA, 17 bp, Homo sapiens
agtattcaggcactgag

SEQ ID NO: 976013 - DNA, 14 bp, Homo sapiens
agtattcgttacat

SEQ ID NO: 976014 - DNA, 17 bp, Homo sapiens
agtattctgacatgtaa

SEQ ID NO: 976015 - DNA, 14 bp, Homo sapiens
agtattcttctctt

SEQ ID NO: 976016 - DNA, 15 bp, Homo sapiens
agtattcttgtcaaa

SEQ ID NO: 976017 - DNA, 12 bp, Homo sapiens
agtattcttttt

SEQ ID NO: 976018 - DNA, 14 bp, Homo sapiens
agtattctttttct

SEQ ID NO: 976019 - DNA, 16 bp, Homo sapiens
agtattgccacctctg

SEQ ID NO: 976020 - DNA, 12 bp, Homo sapiens
agtattgctgat

SEQ ID NO: 976021 - DNA, 19 bp, Homo sapiens
agtattggaagacttgggt

SEQ ID NO: 976022 - DNA, 18 bp, Homo sapiens
agtattggggtctgaccc

SEQ ID NO: 976023 - DNA, 18 bp, Homo sapiens
agtattgtaaattatatt

SEQ ID NO: 976024 - DNA, 16 bp, Homo sapiens
agtattgtaatgagtg

SEQ ID NO: 976025 - DNA, 12 bp, Homo sapiens
agtattgttgtc

SEQ ID NO: 976026 - DNA, 24 bp, Homo sapiens
agtattgttgtccttttcataggt

SEQ ID NO: 976027 - DNA, 15 bp, Homo sapiens
agtatttacactatg

SEQ ID NO: 976028 - DNA, 22 bp, Homo sapiens
agtatttactctgctccaaagt

SEQ ID NO: 976029 - DNA, 18 bp, Homo sapiens
agtatttataaaaatata

SEQ ID NO: 976030 - DNA, 17 bp, Homo sapiens
agtatttatatatttat

SEQ ID NO: 976031 - DNA, 13 bp, Homo sapiens
agtatttatgggt

SEQ ID NO: 976032 - DNA, 22 bp, Homo sapiens
agtatttatgtaatttgtacag

SEQ ID NO: 976033 - DNA, 16 bp, Homo sapiens
agtatttattgtcagt

SEQ ID NO: 976034 - DNA, 21 bp, Homo sapiens
agtatttattgtcagttttgt

SEQ ID NO: 976035 - DNA, 15 bp, Homo sapiens
agtatttatttaatg

SEQ ID NO: 976036 - DNA, 17 bp, Homo sapiens
agtatttcagatgcttt

SEQ ID NO: 976037 - DNA, 14 bp, Homo sapiens
agtatttccttcca

SEQ ID NO: 976038 - DNA, 13 bp, Homo sapiens
agtatttctcagg

SEQ ID NO: 976039 - DNA, 23 bp, Homo sapiens
agtatttgaaactgaatgtttat

SEQ ID NO: 976040 - DNA, 20 bp, Homo sapiens
agtatttgattcaaaatatt

SEQ ID NO: 976041 - DNA, 17 bp, Homo sapiens
agtatttgggaagtgaa

SEQ ID NO: 976042 - DNA, 13 bp, Homo sapiens
agtatttgttaat

SEQ ID NO: 976043 - DNA, 18 bp, Homo sapiens
agtatttgttaatttaga

SEQ ID NO: 976044 - DNA, 16 bp, Homo sapiens
agtattttatctggaa

SEQ ID NO: 976045 - DNA, 17 bp, Homo sapiens
agtattttccagcctta

SEQ ID NO: 976046 - DNA, 21 bp, Homo sapiens
agtattttcctgttgtcaaga

SEQ ID NO: 976047 - DNA, 17 bp, Homo sapiens
agtattttgctggaata

SEQ ID NO: 976048 - DNA, 15 bp, Homo sapiens
agtattttgtgtcct

SEQ ID NO: 976049 - DNA, 14 bp, Homo sapiens
agtatttttatacg

SEQ ID NO: 976050 - DNA, 18 bp, Homo sapiens
agtatttttcctttttaa

SEQ ID NO: 976051 - DNA, 23 bp, Homo sapiens
agtatttttctgtgaccatcaat

SEQ ID NO: 976052 - DNA, 13 bp, Homo sapiens
agtatttttgccg

SEQ ID NO: 976053 - DNA, 15 bp, Homo sapiens
agtatttttgtctct

SEQ ID NO: 976054 - DNA, 20 bp, Homo sapiens
agtattttttacattttaca

SEQ ID NO: 976055 - DNA, 22 bp, Homo sapiens
agtattttttacattttacaca

SEQ ID NO: 976056 - DNA, 13 bp, Homo sapiens
agtattttttgta

SEQ ID NO: 976057 - DNA, 20 bp, Homo sapiens
agtattttttgtataattgg

SEQ ID NO: 976058 - DNA, 13 bp, Homo sapiens
agtcaaaaaatta

SEQ ID NO: 976059 - DNA, 13 bp, Homo sapiens
agtcaaaaacaaa

SEQ ID NO: 976060 - DNA, 16 bp, Homo sapiens
agtcaaaaggtgcctg

SEQ ID NO: 976061 - DNA, 21 bp, Homo sapiens
agtcaaaaggtgcctgtgagg

SEQ ID NO: 976062 - DNA, 14 bp, Homo sapiens
agtcaaaataattc

SEQ ID NO: 976063 - DNA, 18 bp, Homo sapiens
agtcaaacatttcaaagt

SEQ ID NO: 976064 - DNA, 15 bp, Homo sapiens
agtcaaatgccaaac

SEQ ID NO: 976065 - DNA, 23 bp, Homo sapiens
agtcaaatgccaaacactagctc

SEQ ID NO: 976066 - DNA, 14 bp, Homo sapiens
agtcaaatgggaaa

SEQ ID NO: 976067 - DNA, 22 bp, Homo sapiens
agtcaaatggtaggcatttcct

SEQ ID NO: 976068 - DNA, 22 bp, Homo sapiens
agtcaaattaataatcttatta

SEQ ID NO: 976069 - DNA, 12 bp, Homo sapiens
agtcaacaaact

SEQ ID NO: 976070 - DNA, 13 bp, Homo sapiens
agtcaacagtaaa

SEQ ID NO: 976071 - DNA, 18 bp, Homo sapiens
agtcaacagtaaaccact

SEQ ID NO: 976072 - DNA, 14 bp, Homo sapiens
agtcaacctgggca

SEQ ID NO: 976073 - DNA, 21 bp, Homo sapiens
agtcaactacacaaagcaggc

SEQ ID NO: 976074 - DNA, 14 bp, Homo sapiens
agtcaactggagca

SEQ ID NO: 976075 - DNA, 19 bp, Homo sapiens
agtcaactggctggccagt

SEQ ID NO: 976076 - DNA, 16 bp, Homo sapiens
agtcaagctcctcctc

SEQ ID NO: 976077 - DNA, 17 bp, Homo sapiens
agtcaagctcctcctcc

SEQ ID NO: 976078 - DNA, 20 bp, Homo sapiens
agtcaagctcctcctccctg

SEQ ID NO: 976079 - DNA, 20 bp, Homo sapiens
agtcaagtgaaaaaggagga

SEQ ID NO: 976080 - DNA, 20 bp, Homo sapiens
agtcaagtgcgtccacgagc

SEQ ID NO: 976081 - DNA, 17 bp, Homo sapiens
agtcaataaaagagctg

SEQ ID NO: 976082 - DNA, 22 bp, Homo sapiens
agtcaataaaagagctgtctga

SEQ ID NO: 976083 - DNA, 12 bp, Homo sapiens
agtcaatacata

SEQ ID NO: 976084 - DNA, 21 bp, Homo sapiens
agtcaatacatagtgctgctg

SEQ ID NO: 976085 - DNA, 18 bp, Homo sapiens
agtcaatcagcctttagg

SEQ ID NO: 976086 - DNA, 17 bp, Homo sapiens
agtcaatggatccacaa

SEQ ID NO: 976087 - DNA, 14 bp, Homo sapiens
agtcaatggcttgt

SEQ ID NO: 976088 - DNA, 19 bp, Homo sapiens
agtcaatgtacttgtttga

SEQ ID NO: 976089 - DNA, 24 bp, Homo sapiens
agtcaattaaacagctggtcctcc

SEQ ID NO: 976090 - DNA, 11 bp, Homo sapiens
agtcacacagt

SEQ ID NO: 976091 - DNA, 18 bp, Homo sapiens
agtcacacattacaaagt

SEQ ID NO: 976092 - DNA, 23 bp, Homo sapiens
agtcacaccatcttaaatgacag

SEQ ID NO: 976093 - DNA, 13 bp, Homo sapiens
agtcacagccacc

SEQ ID NO: 976094 - DNA, 16 bp, Homo sapiens
agtcacagctgcagct

SEQ ID NO: 976095 - DNA, 14 bp, Homo sapiens
agtcacatcacagg

SEQ ID NO: 976096 - DNA, 15 bp, Homo sapiens
agtcacattctgctt

SEQ ID NO: 976097 - DNA, 13 bp, Homo sapiens
agtcaccacccag

SEQ ID NO: 976098 - DNA, 20 bp, Homo sapiens
agtcaccacccagcccttcc

SEQ ID NO: 976099 - DNA, 21 bp, Homo sapiens
agtcacccaaacacttctgct

SEQ ID NO: 976100 - DNA, 17 bp, Homo sapiens
agtcacccagagcacag

SEQ ID NO: 976101 - DNA, 18 bp, Homo sapiens
agtcacccagagcacagg

SEQ ID NO: 976102 - DNA, 14 bp, Homo sapiens
agtcacccccactt

SEQ ID NO: 976103 - DNA, 17 bp, Homo sapiens
agtcacccttctgggca

SEQ ID NO: 976104 - DNA, 14 bp, Homo sapiens
agtcacctcctcca

SEQ ID NO: 976105 - DNA, 17 bp, Homo sapiens
agtcacctcctccactc

SEQ ID NO: 976106 - DNA, 22 bp, Homo sapiens
agtcacctcctccactcactcc

SEQ ID NO: 976107 - DNA, 23 bp, Homo sapiens
agtcacctcgtctccctggtgcc

SEQ ID NO: 976108 - DNA, 13 bp, Homo sapiens
agtcacctgcaag

SEQ ID NO: 976109 - DNA, 15 bp, Homo sapiens
agtcacctgcaagcc

SEQ ID NO: 976110 - DNA, 18 bp, Homo sapiens
agtcacctgcaagcccca

SEQ ID NO: 976111 - DNA, 19 bp, Homo sapiens
agtcacctgcaagccccag

SEQ ID NO: 976112 - DNA, 20 bp, Homo sapiens
agtcacctgcaagccccagg

SEQ ID NO: 976113 - DNA, 17 bp, Homo sapiens
agtcacctgctccagaa

SEQ ID NO: 976114 - DNA, 17 bp, Homo sapiens
agtcaccttcccttgcc

SEQ ID NO: 976115 - DNA, 12 bp, Homo sapiens
agtcacctttct

SEQ ID NO: 976116 - DNA, 18 bp, Homo sapiens
aactgtgtatttatttaa

SEQ ID NO: 976117 - DNA, 22 bp, Homo sapiens
aactgtgtatttatttaaaact

SEQ ID NO: 976118 - DNA, 21 bp, Homo sapiens
aactgtgtgtaattgttcctt

SEQ ID NO: 976119 - DNA, 17 bp, Homo sapiens
aactgtgttcattagaa

SEQ ID NO: 976120 - DNA, 18 bp, Homo sapiens
aactgtgttgtattaaca

SEQ ID NO: 976121 - DNA, 23 bp, Homo sapiens
aactgtgttgtattaacaaaagt

SEQ ID NO: 976122 - DNA, 14 bp, Homo sapiens
aactgttagcactg

SEQ ID NO: 976123 - DNA, 20 bp, Homo sapiens
aactgttagcactgttgatg

SEQ ID NO: 976124 - DNA, 13 bp, Homo sapiens
aactgttcccacc

SEQ ID NO: 976125 - DNA, 13 bp, Homo sapiens
aactttaaaatgc

SEQ ID NO: 976126 - DNA, 13 bp, Homo sapiens
aactttaagagga

SEQ ID NO: 976127 - DNA, 20 bp, Homo sapiens
aactttaattctctttcaaa

SEQ ID NO: 976128 - DNA, 17 bp, Homo sapiens
aactttacctatggaag

SEQ ID NO: 976129 - DNA, 18 bp, Homo sapiens
aactttactctgtgttta

SEQ ID NO: 976130 - DNA, 12 bp, Homo sapiens
aactttactgta

SEQ ID NO: 976131 - DNA, 22 bp, Homo sapiens
aactttagagtagcatgagaga

SEQ ID NO: 976132 - DNA, 14 bp, Homo sapiens
aactttatgtgtaa

SEQ ID NO: 976133 - DNA, 21 bp, Homo sapiens
aactttattgcatatagattt

SEQ ID NO: 976134 - DNA, 21 bp, Homo sapiens
aactttattgggtttttattg

SEQ ID NO: 976135 - DNA, 14 bp, Homo sapiens
aactttatttgtaa

SEQ ID NO: 976136 - DNA, 16 bp, Homo sapiens
aactttatttgtaaac

SEQ ID NO: 976137 - DNA, 22 bp, Homo sapiens
aactttcactataatgtgaaat

SEQ ID NO: 976138 - DNA, 16 bp, Homo sapiens
aactttcacttcttcc

SEQ ID NO: 976139 - DNA, 14 bp, Homo sapiens
aactttcagtggct

SEQ ID NO: 976140 - DNA, 12 bp, Homo sapiens
aactttcatacc

SEQ ID NO: 976141 - DNA, 22 bp, Homo sapiens
aactttcgaccgactttcccca

SEQ ID NO: 976142 - DNA, 23 bp, Homo sapiens
aactttctaagagggttcttgct

SEQ ID NO: 976143 - DNA, 13 bp, Homo sapiens
aactttctccctc

SEQ ID NO: 976144 - DNA, 16 bp, Homo sapiens
aactttctccctcatc

SEQ ID NO: 976145 - DNA, 14 bp, Homo sapiens
aactttgacctctg

SEQ ID NO: 976146 - DNA, 17 bp, Homo sapiens
aactttgacctctgcag

SEQ ID NO: 976147 - DNA, 19 bp, Homo sapiens
aactttgacctctgcagca

SEQ ID NO: 976148 - DNA, 20 bp, Homo sapiens
aactttgacctctgcagcaa

SEQ ID NO: 976149 - DNA, 19 bp, Homo sapiens
aactttgcaggcggccctc

SEQ ID NO: 976150 - DNA, 18 bp, Homo sapiens
aactttgccagtctttaa

SEQ ID NO: 976151 - DNA, 13 bp, Homo sapiens
aactttgtatttt

SEQ ID NO: 976152 - DNA, 15 bp, Homo sapiens
aacttttaaagaaaa

SEQ ID NO: 976153 - DNA, 12 bp, Homo sapiens
aacttttacaga

SEQ ID NO: 976154 - DNA, 13 bp, Homo sapiens
aacttttacagaa

SEQ ID NO: 976155 - DNA, 22 bp, Homo sapiens
aacttttataaattaaatatat

SEQ ID NO: 976156 - DNA, 15 bp, Homo sapiens
aacttttcaatgtga

SEQ ID NO: 976157 - DNA, 15 bp, Homo sapiens
aacttttcccctgtc

SEQ ID NO: 976158 - DNA, 13 bp, Homo sapiens
aacttttctaaag

SEQ ID NO: 976159 - DNA, 14 bp, Homo sapiens
aacttttgatgact

SEQ ID NO: 976160 - DNA, 14 bp, Homo sapiens
aacttttggaatca

SEQ ID NO: 976161 - DNA, 21 bp, Homo sapiens
aacttttgtaatttgaattgg

SEQ ID NO: 976162 - DNA, 19 bp, Homo sapiens
aacttttgtactgaatttt

SEQ ID NO: 976163 - DNA, 20 bp, Homo sapiens
aacttttgtactgaattttt

SEQ ID NO: 976164 - DNA, 19 bp, Homo sapiens
aacttttgtgaattaggct

SEQ ID NO: 976165 - DNA, 20 bp, Homo sapiens
aacttttgtgtaatgaaaat

SEQ ID NO: 976166 - DNA, 23 bp, Homo sapiens
aacttttgttaggaaaaaattga

SEQ ID NO: 976167 - DNA, 16 bp, Homo sapiens
aactttttcaatggtt

SEQ ID NO: 976168 - DNA, 15 bp, Homo sapiens
aactttttccagcaa

SEQ ID NO: 976169 - DNA, 15 bp, Homo sapiens
aactttttgttctgg

SEQ ID NO: 976170 - DNA, 16 bp, Homo sapiens
aacttttttaaattaa

SEQ ID NO: 976171 - DNA, 23 bp, Homo sapiens
aacttttttatttaaaaaactaa

SEQ ID NO: 976172 - DNA, 19 bp, Homo sapiens
aacttttttgaaataataa

SEQ ID NO: 976173 - DNA, 16 bp, Homo sapiens
aacttttttgtgtatg

SEQ ID NO: 976174 - DNA, 22 bp, Homo sapiens
aacttttttgtgtatgtactta

SEQ ID NO: 976175 - DNA, 16 bp, Homo sapiens
aactttttttcagttc

SEQ ID NO: 976176 - DNA, 21 bp, Homo sapiens
aactttttttgagaaggaaat

SEQ ID NO: 976177 - DNA, 20 bp, Homo sapiens
aacttttttttaagttacac

SEQ ID NO: 976178 - DNA, 20 bp, Homo sapiens
aacttttttttttttaacat

SEQ ID NO: 976179 - DNA, 22 bp, Homo sapiens
aagaaaaaaaaaaggtgtttat

SEQ ID NO: 976180 - DNA, 17 bp, Homo sapiens
aagaaaaaaaaagaaaa

SEQ ID NO: 976181 - DNA, 16 bp, Homo sapiens
aagaaaaaaaataaca

SEQ ID NO: 976182 - DNA, 16 bp, Homo sapiens
aagaaaaaaaatgtac

SEQ ID NO: 976183 - DNA, 12 bp, Homo sapiens
aagaaaaaaaga

SEQ ID NO: 976184 - DNA, 19 bp, Homo sapiens
aagaaaaaaagcacaaagt

SEQ ID NO: 976185 - DNA, 21 bp, Homo sapiens
aagaaaaaaagcacaaagttc

SEQ ID NO: 976186 - DNA, 18 bp, Homo sapiens
aagaaaaaaattgaaatg

SEQ ID NO: 976187 - DNA, 21 bp, Homo sapiens
aagaaaaaaattgaaatgtaa

SEQ ID NO: 976188 - DNA, 10 bp, Homo sapiens
aagaaaaaag

SEQ ID NO: 976189 - DNA, 18 bp, Homo sapiens
aagaaaaaagagaaaaga

SEQ ID NO: 976190 - DNA, 16 bp, Homo sapiens
aagaaaaaagcttata

SEQ ID NO: 976191 - DNA, 19 bp, Homo sapiens
aagaaaaaatattttccct

SEQ ID NO: 976192 - DNA, 13 bp, Homo sapiens
aagaaaaaatcag

SEQ ID NO: 976193 - DNA, 13 bp, Homo sapiens
aagaaaaacaagt

SEQ ID NO: 976194 - DNA, 11 bp, Homo sapiens
aagaaaaactt

SEQ ID NO: 976195 - DNA, 15 bp, Homo sapiens
aagaaaaagtacaat

SEQ ID NO: 976196 - DNA, 14 bp, Homo sapiens
aagaaaaatgaaaa

SEQ ID NO: 976197 - DNA, 16 bp, Homo sapiens
aagaaaaatgaaaact

SEQ ID NO: 976198 - DNA, 22 bp, Homo sapiens
aagaaaaatgaaaacttttgta

SEQ ID NO: 976199 - DNA, 15 bp, Homo sapiens
aagaaaacaagtata

SEQ ID NO: 976200 - DNA, 22 bp, Homo sapiens
aagaaaacagtacagaaggcaa

SEQ ID NO: 976201 - DNA, 21 bp, Homo sapiens
aagaaaacatttaacataatg

SEQ ID NO: 976202 - DNA, 13 bp, Homo sapiens
aagaaaagaaaaa

SEQ ID NO: 976203 - DNA, 13 bp, Homo sapiens
aagaaaagacctt

SEQ ID NO: 976204 - DNA, 23 bp, Homo sapiens
aagaaaagagatattttaaaatg

SEQ ID NO: 976205 - DNA, 24 bp, Homo sapiens
aagaaaagcattttcagtcttgta

SEQ ID NO: 976206 - DNA, 15 bp, Homo sapiens
aagaaaaggacaaat

SEQ ID NO: 976207 - DNA, 13 bp, Homo sapiens
aagaaaaggcaaa

SEQ ID NO: 976208 - DNA, 17 bp, Homo sapiens
aagaaaaggcaaaagac

SEQ ID NO: 976209 - DNA, 18 bp, Homo sapiens
aagaaaaggcaaaagact

SEQ ID NO: 976210 - DNA, 23 bp, Homo sapiens
aagaaaaggcaaaagactggttt

SEQ ID NO: 976211 - DNA, 22 bp, Homo sapiens
aagaaaagttgggctttcacaa

SEQ ID NO: 976212 - DNA, 18 bp, Homo sapiens
aagaaaagtttataaaag

SEQ ID NO: 976213 - DNA, 18 bp, Homo sapiens
aagaaaatacaataaact

SEQ ID NO: 976214 - DNA, 11 bp, Homo sapiens
aagaaaatatc

SEQ ID NO: 976215 - DNA, 13 bp, Homo sapiens
aagaaaatatttt

SEQ ID NO: 976216 - DNA, 20 bp, Homo sapiens
aagaaaatattttgtctaaa

SEQ ID NO: 976217 - DNA, 15 bp, Homo sapiens
aagaaaatcatattg

SEQ ID NO: 976218 - DNA, 14 bp, Homo sapiens
aagaaaatctttgt

SEQ ID NO: 976219 - DNA, 12 bp, Homo sapiens
aagaaaatgaag

SEQ ID NO: 976220 - DNA, 16 bp, Homo sapiens
aagaaaatggctaata

SEQ ID NO: 976221 - DNA, 22 bp, Homo sapiens
aagaaaatgtaaaggtttttgt

SEQ ID NO: 976222 - DNA, 12 bp, Homo sapiens
aagaaaatgtct

SEQ ID NO: 976223 - DNA, 14 bp, Homo sapiens
aagaaaatgttacg

SEQ ID NO: 976224 - DNA, 13 bp, Homo sapiens
aagaaaattgcat

SEQ ID NO: 976225 - DNA, 14 bp, Homo sapiens
aagaaaattgcatg

SEQ ID NO: 976226 - DNA, 19 bp, Homo sapiens
aagaaaattgcatgaaact

SEQ ID NO: 976227 - DNA, 21 bp, Homo sapiens
aagaaaattgcatgaaactag

SEQ ID NO: 976228 - DNA, 16 bp, Homo sapiens
aagaaaattgctgtgc

SEQ ID NO: 976229 - DNA, 12 bp, Homo sapiens
aagaaaatttac

SEQ ID NO: 976230 - DNA, 14 bp, Homo sapiens
aagaaacaaagatg

SEQ ID NO: 976231 - DNA, 19 bp, Homo sapiens
aagaaacaactctttgaga

SEQ ID NO: 976232 - DNA, 13 bp, Homo sapiens
aagaaacaagctg

SEQ ID NO: 976233 - DNA, 17 bp, Homo sapiens
aagaaacaagctgtgca

SEQ ID NO: 976234 - DNA, 20 bp, Homo sapiens
aagaaaccaagtgggctggt

SEQ ID NO: 976235 - DNA, 24 bp, Homo sapiens
aagaaactaaaaatatagcaaatg

SEQ ID NO: 976236 - DNA, 13 bp, Homo sapiens
aagaaactgaatg

SEQ ID NO: 976237 - DNA, 22 bp, Homo sapiens
aagaaactgacatgccctccct

SEQ ID NO: 976238 - DNA, 16 bp, Homo sapiens
aagaaactgaggaatt

SEQ ID NO: 976239 - DNA, 19 bp, Homo sapiens
aagaaactgaggaattttc

SEQ ID NO: 976240 - DNA, 21 bp, Homo sapiens
aagaaactgaggaattttctt

SEQ ID NO: 976241 - DNA, 22 bp, Homo sapiens
aagaaacttaccaattgatgtt

SEQ ID NO: 976242 - DNA, 16 bp, Homo sapiens
aagaaacttggctgga

SEQ ID NO: 976243 - DNA, 17 bp, Homo sapiens
aagaaacttggctggaa

SEQ ID NO: 976244 - DNA, 18 bp, Homo sapiens
aagaaacttggctggaat

SEQ ID NO: 976245 - DNA, 21 bp, Homo sapiens
aagaaagaatgcaagagtgga

SEQ ID NO: 976246 - DNA, 23 bp, Homo sapiens
agtccagttgtgttgacacatat

SEQ ID NO: 976247 - DNA, 14 bp, Homo sapiens
agtcttatgtaaag

SEQ ID NO: 976248 - DNA, 22 bp, Homo sapiens
agtcttccaaggccagaaggag

SEQ ID NO: 976249 - DNA, 16 bp, Homo sapiens
agtcttccatttgcaa

SEQ ID NO: 976250 - DNA, 19 bp, Homo sapiens
agtcttccatttgcaaggg

SEQ ID NO: 976251 - DNA, 12 bp, Homo sapiens
agtcttccctca

SEQ ID NO: 976252 - DNA, 13 bp, Homo sapiens
agtcttccctgat

SEQ ID NO: 976253 - DNA, 15 bp, Homo sapiens
agtcttcctgacact

SEQ ID NO: 976254 - DNA, 16 bp, Homo sapiens
agtcttcctgacactt

SEQ ID NO: 976255 - DNA, 17 bp, Homo sapiens
aagaatgccatttctca

SEQ ID NO: 976256 - DNA, 22 bp, Homo sapiens
aagaatgccatttctcacgccc

SEQ ID NO: 976257 - DNA, 22 bp, Homo sapiens
aagaatgctggttttcctaaat

SEQ ID NO: 976258 - DNA, 13 bp, Homo sapiens
aagaatgcttaat

SEQ ID NO: 976259 - DNA, 17 bp, Homo sapiens
aagaatgcttaatcaga

SEQ ID NO: 976260 - DNA, 19 bp, Homo sapiens
aagaatggaagcctgaact

SEQ ID NO: 976261 - DNA, 20 bp, Homo sapiens
aagaatgttactgccttaat

SEQ ID NO: 976262 - DNA, 12 bp, Homo sapiens
aagaatgttagt

SEQ ID NO: 976263 - DNA, 13 bp, Homo sapiens
aagaatgtttctg

SEQ ID NO: 976264 - DNA, 22 bp, Homo sapiens
aagaattaaacccacaagctgc

SEQ ID NO: 976265 - DNA, 18 bp, Homo sapiens
aagaattaagatacaaat

SEQ ID NO: 976266 - DNA, 12 bp, Homo sapiens
aagaattacagt

SEQ ID NO: 976267 - DNA, 20 bp, Homo sapiens
aagaattagaagtctttcag

SEQ ID NO: 976268 - DNA, 21 bp, Homo sapiens
aagaattatgtaatatattgt

SEQ ID NO: 976269 - DNA, 22 bp, Homo sapiens
aagaattatgtaatatattgta

SEQ ID NO: 976270 - DNA, 18 bp, Homo sapiens
aagaattattcagtgaat

SEQ ID NO: 976271 - DNA, 17 bp, Homo sapiens
aagaattatttttgtgt

SEQ ID NO: 976272 - DNA, 13 bp, Homo sapiens
aagaattccaaag

SEQ ID NO: 976273 - DNA, 16 bp, Homo sapiens
aagaattgaacccagg

SEQ ID NO: 976274 - DNA, 18 bp, Homo sapiens
aagaattgaacccaggag

SEQ ID NO: 976275 - DNA, 16 bp, Homo sapiens
aagaattgaagcagga

SEQ ID NO: 976276 - DNA, 17 bp, Homo sapiens
aagaattgagtaatggt

SEQ ID NO: 976277 - DNA, 20 bp, Homo sapiens
aagaattgccagtcttttgt

SEQ ID NO: 976278 - DNA, 20 bp, Homo sapiens
aagaattgtttttgaattta

SEQ ID NO: 976279 - DNA, 22 bp, Homo sapiens
aagaatttcttggtaagaagcc

SEQ ID NO: 976280 - DNA, 20 bp, Homo sapiens
aagaatttgaagacttcaaa

SEQ ID NO: 976281 - DNA, 20 bp, Homo sapiens
aagaatttgaggtctacatt

SEQ ID NO: 976282 - DNA, 12 bp, Homo sapiens
aagaatttgcat

SEQ ID NO: 976283 - DNA, 14 bp, Homo sapiens
aagaatttgcatac

SEQ ID NO: 976284 - DNA, 20 bp, Homo sapiens
aagaattttatttttctgtg

SEQ ID NO: 976285 - DNA, 17 bp, Homo sapiens
aagaattttgagtgaat

SEQ ID NO: 976286 - DNA, 21 bp, Homo sapiens
aagaattttgttttacttttt

SEQ ID NO: 976287 - DNA, 23 bp, Homo sapiens
aagaatttttgtttggactgttt

SEQ ID NO: 976288 - DNA, 21 bp, Homo sapiens
aagacaaaacgagtctttcat

SEQ ID NO: 976289 - DNA, 17 bp, Homo sapiens
aagacaaaagaaactta

SEQ ID NO: 976290 - DNA, 14 bp, Homo sapiens
aagacaaaagtctg

SEQ ID NO: 976291 - DNA, 15 bp, Homo sapiens
aagacaaactttgca

SEQ ID NO: 976292 - DNA, 13 bp, Homo sapiens
aagacaaataaat

SEQ ID NO: 976293 - DNA, 21 bp, Homo sapiens
aagacaaataaatgattatat

SEQ ID NO: 976294 - DNA, 16 bp, Homo sapiens
aagacaaattctgttt

SEQ ID NO: 976295 - DNA, 18 bp, Homo sapiens
aagacaaattctgtttct

SEQ ID NO: 976296 - DNA, 12 bp, Homo sapiens
aagacaacatta

SEQ ID NO: 976297 - DNA, 21 bp, Homo sapiens
aagacaacattaaaacaatat

SEQ ID NO: 976298 - DNA, 23 bp, Homo sapiens
aagacaagtatgaatattactct

SEQ ID NO: 976299 - DNA, 15 bp, Homo sapiens
aagacaatactccct

SEQ ID NO: 976300 - DNA, 19 bp, Homo sapiens
aagacaatgtgaaaagaaa

SEQ ID NO: 976301 - DNA, 16 bp, Homo sapiens
aagacaatttgataca

SEQ ID NO: 976302 - DNA, 18 bp, Homo sapiens
aagacacttatattttga

SEQ ID NO: 976303 - DNA, 14 bp, Homo sapiens
aagacagaaaagtg

SEQ ID NO: 976304 - DNA, 19 bp, Homo sapiens
aagacagaaaagtgcctga

SEQ ID NO: 976305 - DNA, 18 bp, Homo sapiens
aagacagaatgtcaccag

SEQ ID NO: 976306 - DNA, 20 bp, Homo sapiens
aagacagacccagtgagtga

SEQ ID NO: 976307 - DNA, 19 bp, Homo sapiens
aagacagagcaaagcgccc

SEQ ID NO: 976308 - DNA, 12 bp, Homo sapiens
aagacagagtct

SEQ ID NO: 976309 - DNA, 15 bp, Homo sapiens
aagacagagtcttgc

SEQ ID NO: 976310 - DNA, 16 bp, Homo sapiens
aagacagatgccccag

SEQ ID NO: 976311 - DNA, 19 bp, Homo sapiens
aagacagatggacactgcc

SEQ ID NO: 976312 - DNA, 21 bp, Homo sapiens
aagacagcagacaaaatgaaa

SEQ ID NO: 976313 - DNA, 15 bp, Homo sapiens
aagacagtatgagaa

SEQ ID NO: 976314 - DNA, 19 bp, Homo sapiens
aagacagtgcccatgaatg

SEQ ID NO: 976315 - DNA, 19 bp, Homo sapiens
aagacagtgtacaaaactg

SEQ ID NO: 976316 - DNA, 14 bp, Homo sapiens
aagacagtttttat

SEQ ID NO: 976317 - DNA, 15 bp, Homo sapiens
aagacataaaacttt

SEQ ID NO: 976318 - DNA, 13 bp, Homo sapiens
aagacataatcat

SEQ ID NO: 976319 - DNA, 23 bp, Homo sapiens
aagacatactccttccatcaaat

SEQ ID NO: 976320 - DNA, 22 bp, Homo sapiens
aagacatagccgattctctgcc

SEQ ID NO: 976321 - DNA, 16 bp, Homo sapiens
aagacatcagtctcca

SEQ ID NO: 976322 - DNA, 19 bp, Homo sapiens
aagacatctgcctgtaatt

SEQ ID NO: 976323 - DNA, 15 bp, Homo sapiens
aagacatgatttcct

SEQ ID NO: 976324 - DNA, 19 bp, Homo sapiens
aagacatgcactatgagga

SEQ ID NO: 976325 - DNA, 18 bp, Homo sapiens
aagacatgcttacttttt

SEQ ID NO: 976326 - DNA, 16 bp, Homo sapiens
aagacatgtctgttct

SEQ ID NO: 976327 - DNA, 13 bp, Homo sapiens
aagacattctggt

SEQ ID NO: 976328 - DNA, 14 bp, Homo sapiens
aagacattgtcaat

SEQ ID NO: 976329 - DNA, 17 bp, Homo sapiens
aagacattgtcaataaa

SEQ ID NO: 976330 - DNA, 18 bp, Homo sapiens
aagacatttatactcttt

SEQ ID NO: 976331 - DNA, 13 bp, Homo sapiens
aagacatttgctg

SEQ ID NO: 976332 - DNA, 16 bp, Homo sapiens
aagacatttgtttgct

SEQ ID NO: 976333 - DNA, 18 bp, Homo sapiens
aagacattttaagtttgt

SEQ ID NO: 976334 - DNA, 13 bp, Homo sapiens
aagacattttgtt

SEQ ID NO: 976335 - DNA, 13 bp, Homo sapiens
aagacatttttat

SEQ ID NO: 976336 - DNA, 21 bp, Homo sapiens
aagaccaagacttttgtctga

SEQ ID NO: 976337 - DNA, 18 bp, Homo sapiens
aagaccaccacttcgaaa

SEQ ID NO: 976338 - DNA, 13 bp, Homo sapiens
aagaccacctcca

SEQ ID NO: 976339 - DNA, 21 bp, Homo sapiens
aagaccagaattcccttgaat

SEQ ID NO: 976340 - DNA, 22 bp, Homo sapiens
aagaccagaattcccttgaatt

SEQ ID NO: 976341 - DNA, 12 bp, Homo sapiens
aagaccagcctg

SEQ ID NO: 976342 - DNA, 12 bp, Homo sapiens
aagaccagtcca

SEQ ID NO: 976343 - DNA, 16 bp, Homo sapiens
aagaccatccctgaag

SEQ ID NO: 976344 - DNA, 20 bp, Homo sapiens
aagaccatgcctaggaacat

SEQ ID NO: 976345 - DNA, 16 bp, Homo sapiens
aagaccccacccaagc

SEQ ID NO: 976346 - DNA, 18 bp, Homo sapiens
aagaccctaaacatccat

SEQ ID NO: 976347 - DNA, 16 bp, Homo sapiens
aagaccctcttgccca

SEQ ID NO: 976348 - DNA, 22 bp, Homo sapiens
aagaccctcttgcccatcctga

SEQ ID NO: 976349 - DNA, 15 bp, Homo sapiens
aagaccgccccaggg

SEQ ID NO: 976350 - DNA, 17 bp, Homo sapiens
aagaccgccccagggct

SEQ ID NO: 976351 - DNA, 22 bp, Homo sapiens
aagaccgtgtcccaaggagctg

SEQ ID NO: 976352 - DNA, 17 bp, Homo sapiens
aagacctacattccctc

SEQ ID NO: 976353 - DNA, 17 bp, Homo sapiens
aagacctcacctagaaa

SEQ ID NO: 976354 - DNA, 20 bp, Homo sapiens
aagacctggtgtgcggaggc

SEQ ID NO: 976355 - DNA, 23 bp, Homo sapiens
aagacgccttcatctgggacaaa

SEQ ID NO: 976356 - DNA, 15 bp, Homo sapiens
aagacggaaaacaat

SEQ ID NO: 976357 - DNA, 15 bp, Homo sapiens
aagacgtatgtaaca

SEQ ID NO: 976358 - DNA, 16 bp, Homo sapiens
aagacgtgattttgct

SEQ ID NO: 976359 - DNA, 22 bp, Homo sapiens
aagacgtttttgtgctgtgggc

SEQ ID NO: 976360 - DNA, 12 bp, Homo sapiens
aagactaaaagt

SEQ ID NO: 976361 - DNA, 16 bp, Homo sapiens
aagactaatttaaaaa

SEQ ID NO: 976362 - DNA, 16 bp, Homo sapiens
aagactatctaaatgt

SEQ ID NO: 976363 - DNA, 16 bp, Homo sapiens
aagactatctacaaaa

SEQ ID NO: 976364 - DNA, 14 bp, Homo sapiens
aagactatttttct

SEQ ID NO: 976365 - DNA, 11 bp, Homo sapiens
aagactcagcc

SEQ ID NO: 976366 - DNA, 15 bp, Homo sapiens
aagactcaggagtct

SEQ ID NO: 976367 - DNA, 21 bp, Homo sapiens
aagactcaggagtctgccact

SEQ ID NO: 976368 - DNA, 14 bp, Homo sapiens
aagactcagtgttc

SEQ ID NO: 976369 - DNA, 18 bp, Homo sapiens
agtgatgtattttcatag

SEQ ID NO: 976370 - DNA, 15 bp, Homo sapiens
agtgatgttagcaga

SEQ ID NO: 976371 - DNA, 17 bp, Homo sapiens
agtgattaagaaaacat

SEQ ID NO: 976372 - DNA, 15 bp, Homo sapiens
agtgattatctcttt

SEQ ID NO: 976373 - DNA, 14 bp, Homo sapiens
agtgattctgtttg

SEQ ID NO: 976374 - DNA, 18 bp, Homo sapiens
agtgattgaaccagctca

SEQ ID NO: 976375 - DNA, 23 bp, Homo sapiens
agtgattgagactcaaaaaaaca

SEQ ID NO: 976376 - DNA, 16 bp, Homo sapiens
agtgatttccacaggt

SEQ ID NO: 976377 - DNA, 13 bp, Homo sapiens
agtgatttctaga

SEQ ID NO: 976378 - DNA, 20 bp, Homo sapiens
agtgattttcaagtctgtgt

SEQ ID NO: 976379 - DNA, 15 bp, Homo sapiens
agtgcaaaaaacata

SEQ ID NO: 976380 - DNA, 16 bp, Homo sapiens
agtgcaaaagattaag

SEQ ID NO: 976381 - DNA, 13 bp, Homo sapiens
agtgcaaaccact

SEQ ID NO: 976382 - DNA, 18 bp, Homo sapiens
agtgcaaaccacttctcc

SEQ ID NO: 976383 - DNA, 19 bp, Homo sapiens
agtgcaaaccacttctcca

SEQ ID NO: 976384 - DNA, 17 bp, Homo sapiens
agtgcaaatcatagctg

SEQ ID NO: 976385 - DNA, 16 bp, Homo sapiens
agtgcaaattcatttt

SEQ ID NO: 976386 - DNA, 19 bp, Homo sapiens
agtgcaaattgtatcttat

SEQ ID NO: 976387 - DNA, 16 bp, Homo sapiens
aagaggactgtgtgag

SEQ ID NO: 976388 - DNA, 20 bp, Homo sapiens
aagaggagattggccagtga

SEQ ID NO: 976389 - DNA, 21 bp, Homo sapiens
aagaggaggacccctgccttc

SEQ ID NO: 976390 - DNA, 12 bp, Homo sapiens
aagaggaggagg

SEQ ID NO: 976391 - DNA, 20 bp, Homo sapiens
aagaggaggggaagaggcct

SEQ ID NO: 976392 - DNA, 20 bp, Homo sapiens
aagaggagtttcgaggtaga

SEQ ID NO: 976393 - DNA, 16 bp, Homo sapiens
aagaggatcggaggct

SEQ ID NO: 976394 - DNA, 22 bp, Homo sapiens
aagaggatgctgggctctgttc

SEQ ID NO: 976395 - DNA, 22 bp, Homo sapiens
aagaggcagagttctgtgaaga

SEQ ID NO: 976396 - DNA, 19 bp, Homo sapiens
aagaggcaggttagaagaa

SEQ ID NO: 976397 - DNA, 15 bp, Homo sapiens
aagaggccaatgccc

SEQ ID NO: 976398 - DNA, 19 bp, Homo sapiens
aagaggccatttaagtatc

SEQ ID NO: 976399 - DNA, 22 bp, Homo sapiens
aagaggcccactagagggccca

SEQ ID NO: 976400 - DNA, 23 bp, Homo sapiens
aagaggccctgtctgtacctaac

SEQ ID NO: 976401 - DNA, 15 bp, Homo sapiens
aagaggcgggccagc

SEQ ID NO: 976402 - DNA, 18 bp, Homo sapiens
aagaggcgggccagccag

SEQ ID NO: 976403 - DNA, 15 bp, Homo sapiens
aagaggctgaggcct

SEQ ID NO: 976404 - DNA, 18 bp, Homo sapiens
aagaggctgaggcctgga

SEQ ID NO: 976405 - DNA, 17 bp, Homo sapiens
aagaggctggtgctgtg

SEQ ID NO: 976406 - DNA, 13 bp, Homo sapiens
aagaggctggttt

SEQ ID NO: 976407 - DNA, 17 bp, Homo sapiens
aagaggctgtgtggcca

SEQ ID NO: 976408 - DNA, 14 bp, Homo sapiens
aagagggacaggct

SEQ ID NO: 976409 - DNA, 16 bp, Homo sapiens
aagagggacgcctggg

SEQ ID NO: 976410 - DNA, 13 bp, Homo sapiens
aagagggcaagtg

SEQ ID NO: 976411 - DNA, 14 bp, Homo sapiens
aagagggcctgtgg

SEQ ID NO: 976412 - DNA, 14 bp, Homo sapiens
aagagggctgagct

SEQ ID NO: 976413 - DNA, 15 bp, Homo sapiens
aagagggctgagctg

SEQ ID NO: 976414 - DNA, 20 bp, Homo sapiens
aagagggctttttaaatttg

SEQ ID NO: 976415 - DNA, 14 bp, Homo sapiens
aagaggggaaaaca

SEQ ID NO: 976416 - DNA, 19 bp, Homo sapiens
aagaggggaccagaagcca

SEQ ID NO: 976417 - DNA, 21 bp, Homo sapiens
aagaggggaggggcctaggga

SEQ ID NO: 976418 - DNA, 21 bp, Homo sapiens
aagaggggcgggctcagagct

SEQ ID NO: 976419 - DNA, 13 bp, Homo sapiens
aagaggggctggg

SEQ ID NO: 976420 - DNA, 15 bp, Homo sapiens
aagaggggtggagac

SEQ ID NO: 976421 - DNA, 15 bp, Homo sapiens
aagagggtcccaggg

SEQ ID NO: 976422 - DNA, 20 bp, Homo sapiens
aagagggtcccagggctgca

SEQ ID NO: 976423 - DNA, 17 bp, Homo sapiens
aagagggtttattttca

SEQ ID NO: 976424 - DNA, 23 bp, Homo sapiens
aagaggtactgtaatgggtaatt

SEQ ID NO: 976425 - DNA, 15 bp, Homo sapiens
aagaggtataaagct

SEQ ID NO: 976426 - DNA, 21 bp, Homo sapiens
aagaggtatttatctttactt

SEQ ID NO: 976427 - DNA, 15 bp, Homo sapiens
aagagtagaattgca

SEQ ID NO: 976428 - DNA, 23 bp, Homo sapiens
aagagtagcaagttctagagaag

SEQ ID NO: 976429 - DNA, 19 bp, Homo sapiens
aagagtagttgatgttgca

SEQ ID NO: 976430 - DNA, 15 bp, Homo sapiens
aagagtatccttcct

SEQ ID NO: 976431 - DNA, 18 bp, Homo sapiens
aagagtatccttccttca

SEQ ID NO: 976432 - DNA, 15 bp, Homo sapiens
aagagtatttttaac

SEQ ID NO: 976433 - DNA, 23 bp, Homo sapiens
aagagtccaactcacttccagtg

SEQ ID NO: 976434 - DNA, 22 bp, Homo sapiens
aagagtctaaaccccagattct

SEQ ID NO: 976435 - DNA, 21 bp, Homo sapiens
aagagtctacccgacataagt

SEQ ID NO: 976436 - DNA, 16 bp, Homo sapiens
aagagtctattgtctc

SEQ ID NO: 976437 - DNA, 13 bp, Homo sapiens
aagagtctgtctt

SEQ ID NO: 976438 - DNA, 20 bp, Homo sapiens
aagagtgattgcagctttat

SEQ ID NO: 976439 - DNA, 21 bp, Homo sapiens
aagagtgattgcagctttatg

SEQ ID NO: 976440 - DNA, 14 bp, Homo sapiens
aagagtgcattttc

SEQ ID NO: 976441 - DNA, 15 bp, Homo sapiens
aagagtggaggagga

SEQ ID NO: 976442 - DNA, 20 bp, Homo sapiens
aagagtgtgagagagactga

SEQ ID NO: 976443 - DNA, 19 bp, Homo sapiens
aagagttaagatatcccta

SEQ ID NO: 976444 - DNA, 20 bp, Homo sapiens
aagagttctatccccaagct

SEQ ID NO: 976445 - DNA, 19 bp, Homo sapiens
aagagtttaaagagaaaag

SEQ ID NO: 976446 - DNA, 17 bp, Homo sapiens
aagataaacctggagat

SEQ ID NO: 976447 - DNA, 18 bp, Homo sapiens
aagataaagaccagaaat

SEQ ID NO: 976448 - DNA, 12 bp, Homo sapiens
aagataaagatg

SEQ ID NO: 976449 - DNA, 19 bp, Homo sapiens
aagataacaagatctttca

SEQ ID NO: 976450 - DNA, 15 bp, Homo sapiens
aagataacttgagca

SEQ ID NO: 976451 - DNA, 19 bp, Homo sapiens
aagataagaaatgatcttt

SEQ ID NO: 976452 - DNA, 21 bp, Homo sapiens
aagataattgctatttatttt

SEQ ID NO: 976453 - DNA, 14 bp, Homo sapiens
aagataatttgcat

SEQ ID NO: 976454 - DNA, 19 bp, Homo sapiens
aagataatttgcatattct

SEQ ID NO: 976455 - DNA, 21 bp, Homo sapiens
aagatacactgcactttgttt

SEQ ID NO: 976456 - DNA, 16 bp, Homo sapiens
aagatacactgcagct

SEQ ID NO: 976457 - DNA, 19 bp, Homo sapiens
aagatacactgcagctgaa

SEQ ID NO: 976458 - DNA, 14 bp, Homo sapiens
aagatacttaagtg

SEQ ID NO: 976459 - DNA, 13 bp, Homo sapiens
aagatagaacaca

SEQ ID NO: 976460 - DNA, 23 bp, Homo sapiens
aagatagatttggaataggaata

SEQ ID NO: 976461 - DNA, 16 bp, Homo sapiens
aagataggctctgcac

SEQ ID NO: 976462 - DNA, 16 bp, Homo sapiens
aagatagtcttggaag

SEQ ID NO: 976463 - DNA, 15 bp, Homo sapiens
aagatagtgtaactt

SEQ ID NO: 976464 - DNA, 14 bp, Homo sapiens
aagatatatgtgta

SEQ ID NO: 976465 - DNA, 19 bp, Homo sapiens
aagatatatgtgtatacat

SEQ ID NO: 976466 - DNA, 20 bp, Homo sapiens
aagatatatgtgtatacata

SEQ ID NO: 976467 - DNA, 11 bp, Homo sapiens
aagatatatta

SEQ ID NO: 976468 - DNA, 14 bp, Homo sapiens
aagatatattaaaa

SEQ ID NO: 976469 - DNA, 22 bp, Homo sapiens
aagatatatttcacttttgttc

SEQ ID NO: 976470 - DNA, 22 bp, Homo sapiens
aagatatcagagctcttaatgt

SEQ ID NO: 976471 - DNA, 20 bp, Homo sapiens
aagatatccatctttttctt

SEQ ID NO: 976472 - DNA, 17 bp, Homo sapiens
aagatatggcacttctc

SEQ ID NO: 976473 - DNA, 22 bp, Homo sapiens
aagatattgatcaaatatagaa

SEQ ID NO: 976474 - DNA, 13 bp, Homo sapiens
aagatattgtaca

SEQ ID NO: 976475 - DNA, 13 bp, Homo sapiens
aagatatttatat

SEQ ID NO: 976476 - DNA, 18 bp, Homo sapiens
aagatatttatatatatt

SEQ ID NO: 976477 - DNA, 20 bp, Homo sapiens
aagatatttgcagtttttca

SEQ ID NO: 976478 - DNA, 17 bp, Homo sapiens
aagatattttgctttgt

SEQ ID NO: 976479 - DNA, 17 bp, Homo sapiens
aagatatttttatcttt

SEQ ID NO: 976480 - DNA, 22 bp, Homo sapiens
aagatcaaaagcttattcatct

SEQ ID NO: 976481 - DNA, 14 bp, Homo sapiens
aagatcaatttctc

SEQ ID NO: 976482 - DNA, 21 bp, Homo sapiens
aagatcacacatcaagactat

SEQ ID NO: 976483 - DNA, 14 bp, Homo sapiens
aagatcaccttgta

SEQ ID NO: 976484 - DNA, 15 bp, Homo sapiens
aagatcaccttgtat

SEQ ID NO: 976485 - DNA, 12 bp, Homo sapiens
aagatcactgta

SEQ ID NO: 976486 - DNA, 24 bp, Homo sapiens
aagatcactgtagtttagttctgt

SEQ ID NO: 976487 - DNA, 14 bp, Homo sapiens
aagatccaagaagg

SEQ ID NO: 976488 - DNA, 13 bp, Homo sapiens
aagatcctaaact

SEQ ID NO: 976489 - DNA, 14 bp, Homo sapiens
aagatcctaaactc

SEQ ID NO: 976490 - DNA, 16 bp, Homo sapiens
aagatcctaaactctc

SEQ ID NO: 976491 - DNA, 13 bp, Homo sapiens
agtggagccaggt

SEQ ID NO: 976492 - DNA, 20 bp, Homo sapiens
agtggaggaggtggcttcat

SEQ ID NO: 976493 - DNA, 23 bp, Homo sapiens
agtggaggaggtggcttcatgtg

SEQ ID NO: 976494 - DNA, 14 bp, Homo sapiens
agtggaggcacttt

SEQ ID NO: 976495 - DNA, 19 bp, Homo sapiens
agtggaggcgggcttggaa

SEQ ID NO: 976496 - DNA, 19 bp, Homo sapiens
agtggaggtgggctgggcc

SEQ ID NO: 976497 - DNA, 23 bp, Homo sapiens
agtggaggttgagtgagccggga

SEQ ID NO: 976498 - DNA, 16 bp, Homo sapiens
agtggaggttgctgta

SEQ ID NO: 976499 - DNA, 14 bp, Homo sapiens
agtggaggtttgtc

SEQ ID NO: 976500 - DNA, 15 bp, Homo sapiens
agtggagtatttgga

SEQ ID NO: 976501 - DNA, 18 bp, Homo sapiens
agtggagtctgagtctga

SEQ ID NO: 976502 - DNA, 19 bp, Homo sapiens
agtggagtctgagtctgag

SEQ ID NO: 976503 - DNA, 14 bp, Homo sapiens
agtggatcttcaga

SEQ ID NO: 976504 - DNA, 18 bp, Homo sapiens
agtggatcttcagaactg

SEQ ID NO: 976505 - DNA, 19 bp, Homo sapiens
agtggatcttcagaactgc

SEQ ID NO: 976506 - DNA, 21 bp, Homo sapiens
agtggatcttcagaactgccc

SEQ ID NO: 976507 - DNA, 20 bp, Homo sapiens
agtggatggaatatcagaag

SEQ ID NO: 976508 - DNA, 15 bp, Homo sapiens
agtggatggcccagc

SEQ ID NO: 976509 - DNA, 19 bp, Homo sapiens
agtggatggcccagcaggc

SEQ ID NO: 976510 - DNA, 21 bp, Homo sapiens
agtggatgtttttaatgacca

SEQ ID NO: 976511 - DNA, 18 bp, Homo sapiens
agtggattggctttgtgc

SEQ ID NO: 976512 - DNA, 21 bp, Homo sapiens
agtggcaagaccaaaatgaca

SEQ ID NO: 976513 - DNA, 16 bp, Homo sapiens
agtggcacaatcatgg

SEQ ID NO: 976514 - DNA, 13 bp, Homo sapiens
agtggcactgaag

SEQ ID NO: 976515 - DNA, 12 bp, Homo sapiens
agtggcagccat

SEQ ID NO: 976516 - DNA, 22 bp, Homo sapiens
agtggcagccatgcctcatgcc

SEQ ID NO: 976517 - DNA, 11 bp, Homo sapiens
agtggcagggg

SEQ ID NO: 976518 - DNA, 18 bp, Homo sapiens
agtggcaggggacaggag

SEQ ID NO: 976519 - DNA, 20 bp, Homo sapiens
agtggcatactttttaaaaa

SEQ ID NO: 976520 - DNA, 16 bp, Homo sapiens
aagcaataactccaag

SEQ ID NO: 976521 - DNA, 20 bp, Homo sapiens
aagcaataatggtcccatcc

SEQ ID NO: 976522 - DNA, 13 bp, Homo sapiens
aagcaataattgt

SEQ ID NO: 976523 - DNA, 17 bp, Homo sapiens
aagcaataattgtttcc

SEQ ID NO: 976524 - DNA, 14 bp, Homo sapiens
aagcaatacaactt

SEQ ID NO: 976525 - DNA, 21 bp, Homo sapiens
aagcaatacaactttaccata

SEQ ID NO: 976526 - DNA, 13 bp, Homo sapiens
aagcaatatgcat

SEQ ID NO: 976527 - DNA, 16 bp, Homo sapiens
aagcaatcctcctgcc

SEQ ID NO: 976528 - DNA, 16 bp, Homo sapiens
aagcaatctttgaaat

SEQ ID NO: 976529 - DNA, 15 bp, Homo sapiens
aagcaattatttaaa

SEQ ID NO: 976530 - DNA, 18 bp, Homo sapiens
aagcaattatttaaagaa

SEQ ID NO: 976531 - DNA, 21 bp, Homo sapiens
aagcaattatttaaagaaagt

SEQ ID NO: 976532 - DNA, 15 bp, Homo sapiens
aagcaattctgactg

SEQ ID NO: 976533 - DNA, 14 bp, Homo sapiens
aagcacaactccct

SEQ ID NO: 976534 - DNA, 18 bp, Homo sapiens
aagcacaactgaaaccag

SEQ ID NO: 976535 - DNA, 16 bp, Homo sapiens
aagcacacacatctgg

SEQ ID NO: 976536 - DNA, 21 bp, Homo sapiens
aagcacacacatctggccctg

SEQ ID NO: 976537 - DNA, 18 bp, Homo sapiens
aagcacactaaaccaagt

SEQ ID NO: 976538 - DNA, 13 bp, Homo sapiens
aagcacagagcct

SEQ ID NO: 976539 - DNA, 17 bp, Homo sapiens
aagcacagcctcgggga

SEQ ID NO: 976540 - DNA, 17 bp, Homo sapiens
aagcacagctcctgcca

SEQ ID NO: 976541 - DNA, 20 bp, Homo sapiens
aagcacagtgttaaatgaaa

SEQ ID NO: 976542 - DNA, 15 bp, Homo sapiens
aagcacagtttgaac

SEQ ID NO: 976543 - DNA, 22 bp, Homo sapiens
aagcacatgcttagcttatctt

SEQ ID NO: 976544 - DNA, 13 bp, Homo sapiens
aagcacatgtaat

SEQ ID NO: 976545 - DNA, 19 bp, Homo sapiens
aagcaccagcttctccagg

SEQ ID NO: 976546 - DNA, 14 bp, Homo sapiens
aagcaccaggaagt

SEQ ID NO: 976547 - DNA, 18 bp, Homo sapiens
aagcaccccagtcactag

SEQ ID NO: 976548 - DNA, 16 bp, Homo sapiens
aagcacctactatgtg

SEQ ID NO: 976549 - DNA, 12 bp, Homo sapiens
aagcacctgccg

SEQ ID NO: 976550 - DNA, 13 bp, Homo sapiens
aagcacctgccga

SEQ ID NO: 976551 - DNA, 17 bp, Homo sapiens
aagcacctgccgacctc

SEQ ID NO: 976552 - DNA, 15 bp, Homo sapiens
aagcacgaaatgtta

SEQ ID NO: 976553 - DNA, 21 bp, Homo sapiens
aagcactattttatatttaaa

SEQ ID NO: 976554 - DNA, 14 bp, Homo sapiens
aagcactctctgca

SEQ ID NO: 976555 - DNA, 22 bp, Homo sapiens
aagcactctctgcagtcctccg

SEQ ID NO: 976556 - DNA, 19 bp, Homo sapiens
aagcactctggatgatgga

SEQ ID NO: 976557 - DNA, 13 bp, Homo sapiens
aagcactgaaaaa

SEQ ID NO: 976558 - DNA, 22 bp, Homo sapiens
aagcactggtttcaagaatatg

SEQ ID NO: 976559 - DNA, 21 bp, Homo sapiens
aagcacttaagtcttccttaa

SEQ ID NO: 976560 - DNA, 18 bp, Homo sapiens
aagcacttcacagctgga

SEQ ID NO: 976561 - DNA, 15 bp, Homo sapiens
aagcacttgcctgga

SEQ ID NO: 976562 - DNA, 18 bp, Homo sapiens
aagcactttgaaaatatt

SEQ ID NO: 976563 - DNA, 23 bp, Homo sapiens
aagcactttgaaaatatttctat

SEQ ID NO: 976564 - DNA, 20 bp, Homo sapiens
aagcagaaaataaaggaagc

SEQ ID NO: 976565 - DNA, 14 bp, Homo sapiens
aagcagaacaaatg

SEQ ID NO: 976566 - DNA, 17 bp, Homo sapiens
aagcagaactgaagcca

SEQ ID NO: 976567 - DNA, 20 bp, Homo sapiens
aagcagaattttaatgtgaa

SEQ ID NO: 976568 - DNA, 16 bp, Homo sapiens
aagcagacattttaaa

SEQ ID NO: 976569 - DNA, 21 bp, Homo sapiens
aagcagaccactgataaaacc

SEQ ID NO: 976570 - DNA, 18 bp, Homo sapiens
aagcagactccagcccct

SEQ ID NO: 976571 - DNA, 21 bp, Homo sapiens
aagcagactccagcccctgga

SEQ ID NO: 976572 - DNA, 22 bp, Homo sapiens
aagcagactccagcccctggac

SEQ ID NO: 976573 - DNA, 16 bp, Homo sapiens
aagcagagccaaggcc

SEQ ID NO: 976574 - DNA, 18 bp, Homo sapiens
aagcagagccaaggccac

SEQ ID NO: 976575 - DNA, 19 bp, Homo sapiens
aagcagagccaaggccacc

SEQ ID NO: 976576 - DNA, 14 bp, Homo sapiens
aagcagaggaagga

SEQ ID NO: 976577 - DNA, 15 bp, Homo sapiens
aagcagcacaaggaa

SEQ ID NO: 976578 - DNA, 23 bp, Homo sapiens
aagcagcactcaaacctggagct

SEQ ID NO: 976579 - DNA, 18 bp, Homo sapiens
aagcagcagaggtgagaa

SEQ ID NO: 976580 - DNA, 11 bp, Homo sapiens
aagcagccagc

SEQ ID NO: 976581 - DNA, 12 bp, Homo sapiens
aagcagccagcc

SEQ ID NO: 976582 - DNA, 22 bp, Homo sapiens
aagcagccagccagtcttgcct

SEQ ID NO: 976583 - DNA, 17 bp, Homo sapiens
aagcagccaggagggac

SEQ ID NO: 976584 - DNA, 14 bp, Homo sapiens
aagcagcccctcga

SEQ ID NO: 976585 - DNA, 15 bp, Homo sapiens
aagcagccctctgcc

SEQ ID NO: 976586 - DNA, 17 bp, Homo sapiens
aagcagcctcagagtgg

SEQ ID NO: 976587 - DNA, 17 bp, Homo sapiens
aagcagccttaagctta

SEQ ID NO: 976588 - DNA, 17 bp, Homo sapiens
aagcagccttgatatgt

SEQ ID NO: 976589 - DNA, 14 bp, Homo sapiens
aagcagcgtttcta

SEQ ID NO: 976590 - DNA, 19 bp, Homo sapiens
aagcagctaaatgtaactt

SEQ ID NO: 976591 - DNA, 22 bp, Homo sapiens
aagcagctaaatgtaacttatt

SEQ ID NO: 976592 - DNA, 20 bp, Homo sapiens
aagcagctaacaatgtctgg

SEQ ID NO: 976593 - DNA, 14 bp, Homo sapiens
aagcagctctcccc

SEQ ID NO: 976594 - DNA, 19 bp, Homo sapiens
aagcagctgcattttttat

SEQ ID NO: 976595 - DNA, 20 bp, Homo sapiens
aagcagctggtcagtctttg

SEQ ID NO: 976596 - DNA, 19 bp, Homo sapiens
aagcagctggtcttttctc

SEQ ID NO: 976597 - DNA, 16 bp, Homo sapiens
aagcagctttaaacaa

SEQ ID NO: 976598 - DNA, 17 bp, Homo sapiens
aagcagctttaaacaaa

SEQ ID NO: 976599 - DNA, 22 bp, Homo sapiens
aagcagctttttattccctgcc

SEQ ID NO: 976600 - DNA, 17 bp, Homo sapiens
aagcaggaggcccttgt

SEQ ID NO: 976601 - DNA, 18 bp, Homo sapiens
aagcaggaggcccttgtc

SEQ ID NO: 976602 - DNA, 13 bp, Homo sapiens
aagcaggccactt

SEQ ID NO: 976603 - DNA, 21 bp, Homo sapiens
aagcaggcttgcccagtacat

SEQ ID NO: 976604 - DNA, 23 bp, Homo sapiens
aagcagggagagttggggaaggc

SEQ ID NO: 976605 - DNA, 18 bp, Homo sapiens
aagcaggggagtatgcaa

SEQ ID NO: 976606 - DNA, 20 bp, Homo sapiens
aagcaggtggatctatttca

SEQ ID NO: 976607 - DNA, 18 bp, Homo sapiens
aagcaggttcccaagctc

SEQ ID NO: 976608 - DNA, 16 bp, Homo sapiens
aagcaggttcttgatg

SEQ ID NO: 976609 - DNA, 22 bp, Homo sapiens
aagcaggttgaggggctcctgg

SEQ ID NO: 976610 - DNA, 14 bp, Homo sapiens
aagcaggtttgttt

SEQ ID NO: 976611 - DNA, 22 bp, Homo sapiens
aagcagtaaaaactgttctcta

SEQ ID NO: 976612 - DNA, 17 bp, Homo sapiens
aagcagtatataataac

SEQ ID NO: 976613 - DNA, 21 bp, Homo sapiens
aagcgcctcagttacacagga

SEQ ID NO: 976614 - DNA, 14 bp, Homo sapiens
aagcgcctccaacc

SEQ ID NO: 976615 - DNA, 15 bp, Homo sapiens
aagcgcctccaaccc

SEQ ID NO: 976616 - DNA, 19 bp, Homo sapiens
aagcgctcatgttgagcca

SEQ ID NO: 976617 - DNA, 21 bp, Homo sapiens
aagcggaggttgcagggagcc

SEQ ID NO: 976618 - DNA, 16 bp, Homo sapiens
aagcggccctgtgtgt

SEQ ID NO: 976619 - DNA, 12 bp, Homo sapiens
aagcgggcagcc

SEQ ID NO: 976620 - DNA, 17 bp, Homo sapiens
aagcgggggcgtggctg

SEQ ID NO: 976621 - DNA, 20 bp, Homo sapiens
aagcgtcacttctcctgctg

SEQ ID NO: 976622 - DNA, 22 bp, Homo sapiens
aagcgtgagcttaaaatacaag

SEQ ID NO: 976623 - DNA, 20 bp, Homo sapiens
aagcgttcatatgctctgct

SEQ ID NO: 976624 - DNA, 21 bp, Homo sapiens
aagcgtttttaacctgttttg

SEQ ID NO: 976625 - DNA, 13 bp, Homo sapiens
aagctaaaataaa

SEQ ID NO: 976626 - DNA, 11 bp, Homo sapiens
aagctaaactg

SEQ ID NO: 976627 - DNA, 16 bp, Homo sapiens
aagctaacatctttac

SEQ ID NO: 976628 - DNA, 18 bp, Homo sapiens
aagctaagtaaaaatatg

SEQ ID NO: 976629 - DNA, 18 bp, Homo sapiens
aagctaataattcttcac

SEQ ID NO: 976630 - DNA, 13 bp, Homo sapiens
aagctaatgaact

SEQ ID NO: 976631 - DNA, 20 bp, Homo sapiens
aagctaattgggagtccagg

SEQ ID NO: 976632 - DNA, 19 bp, Homo sapiens
aagctacctcaaacttcca

SEQ ID NO: 976633 - DNA, 22 bp, Homo sapiens
aagctactagcaaaataaaaca

SEQ ID NO: 976634 - DNA, 23 bp, Homo sapiens
aagctactgtgtgtgtgaatgaa

SEQ ID NO: 976635 - DNA, 21 bp, Homo sapiens
aagctacttgccttgagttta

SEQ ID NO: 976636 - DNA, 19 bp, Homo sapiens
aagctagaattgagtgttt

SEQ ID NO: 976637 - DNA, 21 bp, Homo sapiens
aagctagacacatgaaggtaa

SEQ ID NO: 976638 - DNA, 14 bp, Homo sapiens
aagctaggaatgaa

SEQ ID NO: 976639 - DNA, 18 bp, Homo sapiens
aagctagtggcttcaaaa

SEQ ID NO: 976640 - DNA, 21 bp, Homo sapiens
aagctagtgtacctcctctca

SEQ ID NO: 976641 - DNA, 13 bp, Homo sapiens
aagctagtgtttc

SEQ ID NO: 976642 - DNA, 15 bp, Homo sapiens
aagctataaagcagt

SEQ ID NO: 976643 - DNA, 21 bp, Homo sapiens
aagctataaattcctctttgc

SEQ ID NO: 976644 - DNA, 20 bp, Homo sapiens
aagctatattagctgaaaca

SEQ ID NO: 976645 - DNA, 21 bp, Homo sapiens
aagctatattagctgaaacaa

SEQ ID NO: 976646 - DNA, 21 bp, Homo sapiens
aagctatccttgcacctcagc

SEQ ID NO: 976647 - DNA, 21 bp, Homo sapiens
aagctatgacacgagaatcag

SEQ ID NO: 976648 - DNA, 15 bp, Homo sapiens
aagctatggtgagat

SEQ ID NO: 976649 - DNA, 23 bp, Homo sapiens
aagctatgtatcgctcctattga

SEQ ID NO: 976650 - DNA, 19 bp, Homo sapiens
aagctattaaagtttgtgt

SEQ ID NO: 976651 - DNA, 22 bp, Homo sapiens
agtgtagcctaaagggcagggc

SEQ ID NO: 976652 - DNA, 15 bp, Homo sapiens
agtgtagccttgccc

SEQ ID NO: 976653 - DNA, 17 bp, Homo sapiens
agtgtagccttgcccgg

SEQ ID NO: 976654 - DNA, 16 bp, Homo sapiens
agtgtagcgggaggaa

SEQ ID NO: 976655 - DNA, 12 bp, Homo sapiens
agtgtagctgta

SEQ ID NO: 976656 - DNA, 13 bp, Homo sapiens
agtgtagctgtaa

SEQ ID NO: 976657 - DNA, 20 bp, Homo sapiens
agtgtagctgtaagggcagt

SEQ ID NO: 976658 - DNA, 13 bp, Homo sapiens
agtgtagctgtga

SEQ ID NO: 976659 - DNA, 20 bp, Homo sapiens
agtgtagttaaggagcctaa

SEQ ID NO: 976660 - DNA, 23 bp, Homo sapiens
agtgtatacatgtgtgggtgctg

SEQ ID NO: 976661 - DNA, 18 bp, Homo sapiens
agtgtataccacctgtac

SEQ ID NO: 976662 - DNA, 19 bp, Homo sapiens
agtgtataccacctgtaca

SEQ ID NO: 976663 - DNA, 21 bp, Homo sapiens
agtgtataccacctgtacata

SEQ ID NO: 976664 - DNA, 15 bp, Homo sapiens
agtgtatgattactg

SEQ ID NO: 976665 - DNA, 17 bp, Homo sapiens
agtgtatgcacgtgtgc

SEQ ID NO: 976666 - DNA, 14 bp, Homo sapiens
agtgtatgtgtgtg

SEQ ID NO: 976667 - DNA, 13 bp, Homo sapiens
agtgtattaatct

SEQ ID NO: 976668 - DNA, 21 bp, Homo sapiens
agtgtatttttcaataaagca

SEQ ID NO: 976669 - DNA, 22 bp, Homo sapiens
agtgtattttttaaaattgatt

SEQ ID NO: 976670 - DNA, 17 bp, Homo sapiens
agtgtcaagaaggaaga

SEQ ID NO: 976671 - DNA, 14 bp, Homo sapiens
agtgtcaagttgtg

SEQ ID NO: 976672 - DNA, 19 bp, Homo sapiens
agtgtcacttacctagatt

SEQ ID NO: 976673 - DNA, 14 bp, Homo sapiens
agtgtcagggtcca

SEQ ID NO: 976674 - DNA, 23 bp, Homo sapiens
agtgtcagttcaactttcagaag

SEQ ID NO: 976675 - DNA, 20 bp, Homo sapiens
agtgtcatataaactcattt

SEQ ID NO: 976676 - DNA, 19 bp, Homo sapiens
agtgtcatttatgaaaaga

SEQ ID NO: 976677 - DNA, 17 bp, Homo sapiens
agtgtccagcttccaaa

SEQ ID NO: 976678 - DNA, 18 bp, Homo sapiens
agtgtccagcttccaaag

SEQ ID NO: 976679 - DNA, 19 bp, Homo sapiens
agtgtccagcttccaaagc

SEQ ID NO: 976680 - DNA, 15 bp, Homo sapiens
agtgtcccctccact

SEQ ID NO: 976681 - DNA, 22 bp, Homo sapiens
agtgtcctcttccctctctgca

SEQ ID NO: 976682 - DNA, 13 bp, Homo sapiens
agtgtcctgccca

SEQ ID NO: 976683 - DNA, 18 bp, Homo sapiens
agtgtcctgcccatgccc

SEQ ID NO: 976684 - DNA, 22 bp, Homo sapiens
agtgtccttggcaggctgattt

SEQ ID NO: 976685 - DNA, 17 bp, Homo sapiens
agtgtcgggaattttcc

SEQ ID NO: 976686 - DNA, 19 bp, Homo sapiens
agtgtctataaaagaaaca

SEQ ID NO: 976687 - DNA, 23 bp, Homo sapiens
agtgtctggatcagtaaaattat

SEQ ID NO: 976688 - DNA, 19 bp, Homo sapiens
agtgtctgggtttggccca

SEQ ID NO: 976689 - DNA, 20 bp, Homo sapiens
agtgtctgggtttggcccaa

SEQ ID NO: 976690 - DNA, 22 bp, Homo sapiens
agtgtctgtgttttgaaagaat

SEQ ID NO: 976691 - DNA, 19 bp, Homo sapiens
agtgtcttatggtcttgat

SEQ ID NO: 976692 - DNA, 14 bp, Homo sapiens
agtgtcttccataa

SEQ ID NO: 976693 - DNA, 18 bp, Homo sapiens
agtgtcttctgttcccaa

SEQ ID NO: 976694 - DNA, 23 bp, Homo sapiens
agtgtctttccacggagccactc

SEQ ID NO: 976695 - DNA, 23 bp, Homo sapiens
agtgtctttctagccataataaa

SEQ ID NO: 976696 - DNA, 15 bp, Homo sapiens
agtgtctttctggtg

SEQ ID NO: 976697 - DNA, 19 bp, Homo sapiens
agtgtctttttttgtatag

SEQ ID NO: 976698 - DNA, 21 bp, Homo sapiens
agtgtgaatagcctggccacc

SEQ ID NO: 976699 - DNA, 18 bp, Homo sapiens
agtgtgaatataaatgtg

SEQ ID NO: 976700 - DNA, 14 bp, Homo sapiens
agtgtgaatattaa

SEQ ID NO: 976701 - DNA, 17 bp, Homo sapiens
agtgtgaatattccttt

SEQ ID NO: 976702 - DNA, 16 bp, Homo sapiens
agtgtgacagggccag

SEQ ID NO: 976703 - DNA, 18 bp, Homo sapiens
agtgtgacagtttccaaa

SEQ ID NO: 976704 - DNA, 19 bp, Homo sapiens
agtgtgacttcccttctaa

SEQ ID NO: 976705 - DNA, 16 bp, Homo sapiens
agtgtgagagagactg

SEQ ID NO: 976706 - DNA, 21 bp, Homo sapiens
agtgtgagcagtgagttacag

SEQ ID NO: 976707 - DNA, 15 bp, Homo sapiens
agtgtgaggccaggg

SEQ ID NO: 976708 - DNA, 13 bp, Homo sapiens
agtgtgagggcag

SEQ ID NO: 976709 - DNA, 15 bp, Homo sapiens
agtgtgagggcagca

SEQ ID NO: 976710 - DNA, 17 bp, Homo sapiens
agtgtgagtaagagctg

SEQ ID NO: 976711 - DNA, 18 bp, Homo sapiens
agtgtgagtaagagctgg

SEQ ID NO: 976712 - DNA, 23 bp, Homo sapiens
agtgtgatgtttggattgatatc

SEQ ID NO: 976713 - DNA, 16 bp, Homo sapiens
agtgtgcacgagtggg

SEQ ID NO: 976714 - DNA, 19 bp, Homo sapiens
agtgtgcacgcctgcaggc

SEQ ID NO: 976715 - DNA, 22 bp, Homo sapiens
agtgtgcacgcctgcaggctgg

SEQ ID NO: 976716 - DNA, 22 bp, Homo sapiens
agtgtgcactaaggggcccggc

SEQ ID NO: 976717 - DNA, 14 bp, Homo sapiens
agtgtgcagacagc

SEQ ID NO: 976718 - DNA, 14 bp, Homo sapiens
agtgtgcagggtgg

SEQ ID NO: 976719 - DNA, 18 bp, Homo sapiens
agtgtgccaaatcagttt

SEQ ID NO: 976720 - DNA, 19 bp, Homo sapiens
agtgtgcccaaaagccatg

SEQ ID NO: 976721 - DNA, 21 bp, Homo sapiens
agtgtgcctgaagtcccagat

SEQ ID NO: 976722 - DNA, 14 bp, Homo sapiens
agtgtgctaaaaat

SEQ ID NO: 976723 - DNA, 23 bp, Homo sapiens
agtgtgctgtatggcccaggcag

SEQ ID NO: 976724 - DNA, 16 bp, Homo sapiens
agtgtgctttgcattt

SEQ ID NO: 976725 - DNA, 21 bp, Homo sapiens
agtgtgctttgcattttctga

SEQ ID NO: 976726 - DNA, 19 bp, Homo sapiens
agtgtggaaattaagaaga

SEQ ID NO: 976727 - DNA, 20 bp, Homo sapiens
agtgtggaagccggagggtg

SEQ ID NO: 976728 - DNA, 14 bp, Homo sapiens
agtgtggccaggct

SEQ ID NO: 976729 - DNA, 17 bp, Homo sapiens
agtgtggctggtgtccc

SEQ ID NO: 976730 - DNA, 14 bp, Homo sapiens
agtgtgggaatgcg

SEQ ID NO: 976731 - DNA, 18 bp, Homo sapiens
agtgtgggcttgaccagg

SEQ ID NO: 976732 - DNA, 19 bp, Homo sapiens
agtgtggggggacagacag

SEQ ID NO: 976733 - DNA, 15 bp, Homo sapiens
agtgtggggggtcct

SEQ ID NO: 976734 - DNA, 23 bp, Homo sapiens
agttcccggagcacagccctggg

SEQ ID NO: 976735 - DNA, 15 bp, Homo sapiens
agttccctacttcct

SEQ ID NO: 976736 - DNA, 17 bp, Homo sapiens
agttccctacttcctgt

SEQ ID NO: 976737 - DNA, 12 bp, Homo sapiens
agttccctcctg

SEQ ID NO: 976738 - DNA, 17 bp, Homo sapiens
agttccctcctgcccag

SEQ ID NO: 976739 - DNA, 19 bp, Homo sapiens
agttccctgaaaacccaga

SEQ ID NO: 976740 - DNA, 17 bp, Homo sapiens
agttccctgaaacacga

SEQ ID NO: 976741 - DNA, 13 bp, Homo sapiens
agttcccttggcc

SEQ ID NO: 976742 - DNA, 16 bp, Homo sapiens
agttccggcctgggca

SEQ ID NO: 976743 - DNA, 17 bp, Homo sapiens
agttcctatgacacagt

SEQ ID NO: 976744 - DNA, 23 bp, Homo sapiens
agttcctcattagcattttgcta

SEQ ID NO: 976745 - DNA, 14 bp, Homo sapiens
agttcctcgccctg

SEQ ID NO: 976746 - DNA, 17 bp, Homo sapiens
agttcctcgccctgggt

SEQ ID NO: 976747 - DNA, 19 bp, Homo sapiens
agttcctctcccttccctt

SEQ ID NO: 976748 - DNA, 12 bp, Homo sapiens
agttcctctgca

SEQ ID NO: 976749 - DNA, 14 bp, Homo sapiens
agttcctctgcagt

SEQ ID NO: 976750 - DNA, 20 bp, Homo sapiens
agttcctgcggagtgaagag

SEQ ID NO: 976751 - DNA, 21 bp, Homo sapiens
agttcctgcggagtgaagagg

SEQ ID NO: 976752 - DNA, 23 bp, Homo sapiens
agttcctgctacaacttcagcag

SEQ ID NO: 976753 - DNA, 21 bp, Homo sapiens
agttcctgtcccttctcttaa

SEQ ID NO: 976754 - DNA, 18 bp, Homo sapiens
agttcctgtggccaggag

SEQ ID NO: 976755 - DNA, 19 bp, Homo sapiens
agttccttactgtttacag

SEQ ID NO: 976756 - DNA, 10 bp, Homo sapiens
agttccttgc

SEQ ID NO: 976757 - DNA, 14 bp, Homo sapiens
agttcctttagaaa

SEQ ID NO: 976758 - DNA, 16 bp, Homo sapiens
agttcctttgtgtgta

SEQ ID NO: 976759 - DNA, 18 bp, Homo sapiens
agttcgagaccaacctga

SEQ ID NO: 976760 - DNA, 14 bp, Homo sapiens
agttcgagaccagc

SEQ ID NO: 976761 - DNA, 21 bp, Homo sapiens
agttcgagaccagcctggcca

SEQ ID NO: 976762 - DNA, 21 bp, Homo sapiens
agttcgtaccgcttccttaga

SEQ ID NO: 976763 - DNA, 22 bp, Homo sapiens
agttctaagttcatgtttgtaa

SEQ ID NO: 976764 - DNA, 18 bp, Homo sapiens
agttctacaagcatattt

SEQ ID NO: 976765 - DNA, 22 bp, Homo sapiens
agttctacctcaggcagctcaa

SEQ ID NO: 976766 - DNA, 16 bp, Homo sapiens
agttctactcaggctg

SEQ ID NO: 976767 - DNA, 17 bp, Homo sapiens
agttctactcaggctgg

SEQ ID NO: 976768 - DNA, 13 bp, Homo sapiens
agttctagagaag

SEQ ID NO: 976769 - DNA, 20 bp, Homo sapiens
agttctagagaagaggctgg

SEQ ID NO: 976770 - DNA, 10 bp, Homo sapiens
agttctagat

SEQ ID NO: 976771 - DNA, 19 bp, Homo sapiens
agttctaggaaattcttga

SEQ ID NO: 976772 - DNA, 21 bp, Homo sapiens
agttctaggggagaagagccc

SEQ ID NO: 976773 - DNA, 18 bp, Homo sapiens
agttctatccccaagctg

SEQ ID NO: 976774 - DNA, 23 bp, Homo sapiens
agttctcaattattggcctgcta

SEQ ID NO: 976775 - DNA, 13 bp, Homo sapiens
agttctcactggg

SEQ ID NO: 976776 - DNA, 20 bp, Homo sapiens
agttctcactgttccctctg

SEQ ID NO: 976777 - DNA, 15 bp, Homo sapiens
agttctccagcttca

SEQ ID NO: 976778 - DNA, 16 bp, Homo sapiens
agttctccagcttcag

SEQ ID NO: 976779 - DNA, 18 bp, Homo sapiens
agttctccagcttcagct

SEQ ID NO: 976780 - DNA, 23 bp, Homo sapiens
agttctcccagggagtgagcagc

SEQ ID NO: 976781 - DNA, 22 bp, Homo sapiens
agttctccctgtacagtgttac

SEQ ID NO: 976782 - DNA, 14 bp, Homo sapiens
agttctccttccct

SEQ ID NO: 976783 - DNA, 13 bp, Homo sapiens
aagctttatcttt

SEQ ID NO: 976784 - DNA, 13 bp, Homo sapiens
aagctttatttct

SEQ ID NO: 976785 - DNA, 20 bp, Homo sapiens
aagctttatttctagctttt

SEQ ID NO: 976786 - DNA, 23 bp, Homo sapiens
aagctttcatgtaaactgtgcac

SEQ ID NO: 976787 - DNA, 18 bp, Homo sapiens
aagctttcctgccccagg

SEQ ID NO: 976788 - DNA, 21 bp, Homo sapiens
aagctttcctgccccaggcct

SEQ ID NO: 976789 - DNA, 20 bp, Homo sapiens
aagctttgactctataagca

SEQ ID NO: 976790 - DNA, 17 bp, Homo sapiens
aagctttgccagctgct

SEQ ID NO: 976791 - DNA, 17 bp, Homo sapiens
aagctttgctacaaatt

SEQ ID NO: 976792 - DNA, 23 bp, Homo sapiens
aagctttgcttatggtaataaaa

SEQ ID NO: 976793 - DNA, 13 bp, Homo sapiens
aagctttgtgaaa

SEQ ID NO: 976794 - DNA, 20 bp, Homo sapiens
aagcttttaagaaaaacaaa

SEQ ID NO: 976795 - DNA, 14 bp, Homo sapiens
aagcttttagaaat

SEQ ID NO: 976796 - DNA, 13 bp, Homo sapiens
aagcttttctttt

SEQ ID NO: 976797 - DNA, 12 bp, Homo sapiens
aagctttttgga

SEQ ID NO: 976798 - DNA, 14 bp, Homo sapiens
aagctttttggaat

SEQ ID NO: 976799 - DNA, 22 bp, Homo sapiens
aagctttttttttttgaacccc

SEQ ID NO: 976800 - DNA, 23 bp, Homo sapiens
aaggaaaaaaaacacaaaacaac

SEQ ID NO: 976801 - DNA, 19 bp, Homo sapiens
aaggaaaaacacaagcaaa

SEQ ID NO: 976802 - DNA, 16 bp, Homo sapiens
aaggaaaaataatcaa

SEQ ID NO: 976803 - DNA, 17 bp, Homo sapiens
aaggaaaaataatcaag

SEQ ID NO: 976804 - DNA, 21 bp, Homo sapiens
aaggaaaaatgtgtaattttg

SEQ ID NO: 976805 - DNA, 20 bp, Homo sapiens
aaggaaaagaaaacaaaaaa

SEQ ID NO: 976806 - DNA, 19 bp, Homo sapiens
aaggaaacaaatgtgtata

SEQ ID NO: 976807 - DNA, 16 bp, Homo sapiens
aaggaaacactaaggc

SEQ ID NO: 976808 - DNA, 17 bp, Homo sapiens
aaggaaacactaaggct

SEQ ID NO: 976809 - DNA, 20 bp, Homo sapiens
aaggaaacacttctatttaa

SEQ ID NO: 976810 - DNA, 21 bp, Homo sapiens
aaggaaaccacagtgagcctg

SEQ ID NO: 976811 - DNA, 12 bp, Homo sapiens
aaggaaaccttt

SEQ ID NO: 976812 - DNA, 12 bp, Homo sapiens
aaggaaagaaaa

SEQ ID NO: 976813 - DNA, 13 bp, Homo sapiens
aaggaaagcaata

SEQ ID NO: 976814 - DNA, 13 bp, Homo sapiens
aaggaaaggcaga

SEQ ID NO: 976815 - DNA, 19 bp, Homo sapiens
aaggaaaggtctcagcttg

SEQ ID NO: 976816 - DNA, 12 bp, Homo sapiens
aaggaaataaag

SEQ ID NO: 976817 - DNA, 15 bp, Homo sapiens
aaggaaataacattg

SEQ ID NO: 976818 - DNA, 16 bp, Homo sapiens
aaggaaataacattgc

SEQ ID NO: 976819 - DNA, 16 bp, Homo sapiens
aaggaaatacacttct

SEQ ID NO: 976820 - DNA, 13 bp, Homo sapiens
aaggaaatacttt

SEQ ID NO: 976821 - DNA, 14 bp, Homo sapiens
aaggaaatatacct

SEQ ID NO: 976822 - DNA, 13 bp, Homo sapiens
aaggaaatatatt

SEQ ID NO: 976823 - DNA, 19 bp, Homo sapiens
aaggaaatctcctcttttg

SEQ ID NO: 976824 - DNA, 18 bp, Homo sapiens
aaggaaatgagtggccag

SEQ ID NO: 976825 - DNA, 19 bp, Homo sapiens
aaggaaatgagtggccagc

SEQ ID NO: 976826 - DNA, 24 bp, Homo sapiens
aaggaaatgagtggccagcgccag

SEQ ID NO: 976827 - DNA, 18 bp, Homo sapiens
aaggaaatgtcctgcatg

SEQ ID NO: 976828 - DNA, 17 bp, Homo sapiens
aaggaaatgttgagggc

SEQ ID NO: 976829 - DNA, 17 bp, Homo sapiens
aaggaacagcaatggtg

SEQ ID NO: 976830 - DNA, 18 bp, Homo sapiens
aaggaaccctcaggccac

SEQ ID NO: 976831 - DNA, 13 bp, Homo sapiens
aaggaacctggga

SEQ ID NO: 976832 - DNA, 18 bp, Homo sapiens
aaggaacgtatatcacat

SEQ ID NO: 976833 - DNA, 23 bp, Homo sapiens
aaggaactaggtcaaaaatctgt

SEQ ID NO: 976834 - DNA, 20 bp, Homo sapiens
aaggaactctggcttccagg

SEQ ID NO: 976835 - DNA, 13 bp, Homo sapiens
aaggaacttgtct

SEQ ID NO: 976836 - DNA, 13 bp, Homo sapiens
aaggaagactaga

SEQ ID NO: 976837 - DNA, 15 bp, Homo sapiens
aaggaagagggctga

SEQ ID NO: 976838 - DNA, 18 bp, Homo sapiens
aaggaagatatacatgaa

SEQ ID NO: 976839 - DNA, 18 bp, Homo sapiens
aaggaagcattgtaaaat

SEQ ID NO: 976840 - DNA, 13 bp, Homo sapiens
aaggaagccaaag

SEQ ID NO: 976841 - DNA, 15 bp, Homo sapiens
aaggaagctccagat

SEQ ID NO: 976842 - DNA, 15 bp, Homo sapiens
aaggaagctccttcc

SEQ ID NO: 976843 - DNA, 12 bp, Homo sapiens
aaggaaggaaag

SEQ ID NO: 976844 - DNA, 16 bp, Homo sapiens
aaggaaggaaagaaag

SEQ ID NO: 976845 - DNA, 12 bp, Homo sapiens
aaggaaggagag

SEQ ID NO: 976846 - DNA, 14 bp, Homo sapiens
aaggaaggagggca

SEQ ID NO: 976847 - DNA, 16 bp, Homo sapiens
aaggaaggttttctcc

SEQ ID NO: 976848 - DNA, 19 bp, Homo sapiens
aaggaagtggggtgttctt

SEQ ID NO: 976849 - DNA, 17 bp, Homo sapiens
aaggaagtgtgtttgcc

SEQ ID NO: 976850 - DNA, 17 bp, Homo sapiens
aaggaagtttgattttt

SEQ ID NO: 976851 - DNA, 13 bp, Homo sapiens
aaggaataaatga

SEQ ID NO: 976852 - DNA, 16 bp, Homo sapiens
aaggaatagccagaga

SEQ ID NO: 976853 - DNA, 18 bp, Homo sapiens
aaggaatagccagagagg

SEQ ID NO: 976854 - DNA, 17 bp, Homo sapiens
aaggaatatatggcaga

SEQ ID NO: 976855 - DNA, 16 bp, Homo sapiens
aaggaatcaaatctta

SEQ ID NO: 976856 - DNA, 13 bp, Homo sapiens
aaggaatcttctc

SEQ ID NO: 976857 - DNA, 16 bp, Homo sapiens
aagggaaaaaagaaag

SEQ ID NO: 976858 - DNA, 20 bp, Homo sapiens
aagggaaaaaagaaagaaaa

SEQ ID NO: 976859 - DNA, 15 bp, Homo sapiens
aagggaaaaatatat

SEQ ID NO: 976860 - DNA, 15 bp, Homo sapiens
aagggaaagaaaatg

SEQ ID NO: 976861 - DNA, 19 bp, Homo sapiens
aagggaaagcgggcagccc

SEQ ID NO: 976862 - DNA, 22 bp, Homo sapiens
aagggaaagcttcattctcctt

SEQ ID NO: 976863 - DNA, 14 bp, Homo sapiens
aagggaaatatcat

SEQ ID NO: 976864 - DNA, 14 bp, Homo sapiens
aagggaagaaactg

SEQ ID NO: 976865 - DNA, 23 bp, Homo sapiens
aagggaagcacatgatcatggga

SEQ ID NO: 976866 - DNA, 18 bp, Homo sapiens
aagggaagtgaggcccaa

SEQ ID NO: 976867 - DNA, 20 bp, Homo sapiens
aagggaagtgaggcccaagg

SEQ ID NO: 976868 - DNA, 22 bp, Homo sapiens
aagggaagtgaggcccaaggag

SEQ ID NO: 976869 - DNA, 21 bp, Homo sapiens
aagggaagttcaggctctgag

SEQ ID NO: 976870 - DNA, 19 bp, Homo sapiens
aagggaatactcacatttt

SEQ ID NO: 976871 - DNA, 18 bp, Homo sapiens
aagggacaggtgggcctg

SEQ ID NO: 976872 - DNA, 19 bp, Homo sapiens
aagggacaggtgggcctgg

SEQ ID NO: 976873 - DNA, 22 bp, Homo sapiens
aagggaccatctgctgcagtta

SEQ ID NO: 976874 - DNA, 21 bp, Homo sapiens
aagggactgagagatgcagaa

SEQ ID NO: 976875 - DNA, 23 bp, Homo sapiens
aagggactttggaaaactacttt

SEQ ID NO: 976876 - DNA, 13 bp, Homo sapiens
aagggagaaaaag

SEQ ID NO: 976877 - DNA, 15 bp, Homo sapiens
aagggagaaatgcca

SEQ ID NO: 976878 - DNA, 15 bp, Homo sapiens
aagggagaagaaagg

SEQ ID NO: 976879 - DNA, 23 bp, Homo sapiens
aagggagaataaaattcctatct

SEQ ID NO: 976880 - DNA, 16 bp, Homo sapiens
aagggagcgaggtcag

SEQ ID NO: 976881 - DNA, 20 bp, Homo sapiens
aagggagcgaggtcagagga

SEQ ID NO: 976882 - DNA, 19 bp, Homo sapiens
aagggaggaaggcctttct

SEQ ID NO: 976883 - DNA, 20 bp, Homo sapiens
aagggaggaaggcctttctt

SEQ ID NO: 976884 - DNA, 13 bp, Homo sapiens
aagggaggcagtg

SEQ ID NO: 976885 - DNA, 20 bp, Homo sapiens
aagggaggcccagccgcagg

SEQ ID NO: 976886 - DNA, 14 bp, Homo sapiens
aagggagggaaggg

SEQ ID NO: 976887 - DNA, 15 bp, Homo sapiens
aagggaggggaaggg

SEQ ID NO: 976888 - DNA, 17 bp, Homo sapiens
aagggaggggaaggggc

SEQ ID NO: 976889 - DNA, 18 bp, Homo sapiens
aagggagggtgcagccct

SEQ ID NO: 976890 - DNA, 19 bp, Homo sapiens
aagggagggtgcagccctc

SEQ ID NO: 976891 - DNA, 16 bp, Homo sapiens
aagggatattaagaat

SEQ ID NO: 976892 - DNA, 16 bp, Homo sapiens
aagggatctgagaaca

SEQ ID NO: 976893 - DNA, 15 bp, Homo sapiens
aagggatgggggaag

SEQ ID NO: 976894 - DNA, 22 bp, Homo sapiens
aagggatggtggagtgagagcc

SEQ ID NO: 976895 - DNA, 17 bp, Homo sapiens
aagggattgaggagttg

SEQ ID NO: 976896 - DNA, 21 bp, Homo sapiens
aagggcacagacactacatat

SEQ ID NO: 976897 - DNA, 14 bp, Homo sapiens
aagggcacattgcc

SEQ ID NO: 976898 - DNA, 16 bp, Homo sapiens
aagggcacattgccca

SEQ ID NO: 976899 - DNA, 18 bp, Homo sapiens
aagggcacttaatttgta

SEQ ID NO: 976900 - DNA, 13 bp, Homo sapiens
aagggcagaatga

SEQ ID NO: 976901 - DNA, 11 bp, Homo sapiens
aagggcagccc

SEQ ID NO: 976902 - DNA, 22 bp, Homo sapiens
aagggcagggcccacgtgtata

SEQ ID NO: 976903 - DNA, 17 bp, Homo sapiens
aagggcaggtcttcata

SEQ ID NO: 976904 - DNA, 18 bp, Homo sapiens
aagggcaggtcttcatat

SEQ ID NO: 976905 - DNA, 13 bp, Homo sapiens
aagggcagtgccc

SEQ ID NO: 976906 - DNA, 14 bp, Homo sapiens
aagggcattttacc

SEQ ID NO: 976907 - DNA, 15 bp, Homo sapiens
aagggcattttaccc

SEQ ID NO: 976908 - DNA, 12 bp, Homo sapiens
aagggccaaaga

SEQ ID NO: 976909 - DNA, 13 bp, Homo sapiens
aagggccaccctg

SEQ ID NO: 976910 - DNA, 22 bp, Homo sapiens
aagggccaccctgctgcactag

SEQ ID NO: 976911 - DNA, 13 bp, Homo sapiens
aagggccaggaga

SEQ ID NO: 976912 - DNA, 13 bp, Homo sapiens
aagggccaggtgc

SEQ ID NO: 976913 - DNA, 20 bp, Homo sapiens
aagggccaggtgcggcctgg

SEQ ID NO: 976914 - DNA, 14 bp, Homo sapiens
aagggccagtctgg

SEQ ID NO: 976915 - DNA, 20 bp, Homo sapiens
aagggccctgccctgtactg

SEQ ID NO: 976916 - DNA, 12 bp, Homo sapiens
aagggcctggac

SEQ ID NO: 976917 - DNA, 11 bp, Homo sapiens
aagggcctggc

SEQ ID NO: 976918 - DNA, 13 bp, Homo sapiens
aagggcctggcca

SEQ ID NO: 976919 - DNA, 12 bp, Homo sapiens
agtttcttcctg

SEQ ID NO: 976920 - DNA, 13 bp, Homo sapiens
agtttcttcctgc

SEQ ID NO: 976921 - DNA, 15 bp, Homo sapiens
agtttcttcttacac

SEQ ID NO: 976922 - DNA, 13 bp, Homo sapiens
agtttcttgcttg

SEQ ID NO: 976923 - DNA, 17 bp, Homo sapiens
agtttcttgtgtagatt

SEQ ID NO: 976924 - DNA, 18 bp, Homo sapiens
agtttcttgtgtagattt

SEQ ID NO: 976925 - DNA, 20 bp, Homo sapiens
agtttcttgtgtagatttga

SEQ ID NO: 976926 - DNA, 18 bp, Homo sapiens
agtttcttttgtgttcct

SEQ ID NO: 976927 - DNA, 15 bp, Homo sapiens
agtttgaacttcata

SEQ ID NO: 976928 - DNA, 15 bp, Homo sapiens
agtttgaagaccgcc

SEQ ID NO: 976929 - DNA, 21 bp, Homo sapiens
agtttgaattcctaaaattat

SEQ ID NO: 976930 - DNA, 17 bp, Homo sapiens
agtttgagacaagccct

SEQ ID NO: 976931 - DNA, 19 bp, Homo sapiens
agtttgagacaagccctgg

SEQ ID NO: 976932 - DNA, 21 bp, Homo sapiens
agtttgagacaagccctggca

SEQ ID NO: 976933 - DNA, 14 bp, Homo sapiens
agtttgagctgcct

SEQ ID NO: 976934 - DNA, 18 bp, Homo sapiens
agtttgattaaattcttg

SEQ ID NO: 976935 - DNA, 22 bp, Homo sapiens
agtttgattaaattcttgcaaa

SEQ ID NO: 976936 - DNA, 23 bp, Homo sapiens
agtttgattaaattcttgcaaag

SEQ ID NO: 976937 - DNA, 14 bp, Homo sapiens
agtttgattattca

SEQ ID NO: 976938 - DNA, 23 bp, Homo sapiens
agtttgattattcagtgtcactg

SEQ ID NO: 976939 - DNA, 22 bp, Homo sapiens
agtttgattgaggagctgcact

SEQ ID NO: 976940 - DNA, 23 bp, Homo sapiens
agtttgatttttgtttttgtaat

SEQ ID NO: 976941 - DNA, 16 bp, Homo sapiens
agtttgcacctgtccc

SEQ ID NO: 976942 - DNA, 20 bp, Homo sapiens
agtttgcagaaaagcacctg

SEQ ID NO: 976943 - DNA, 21 bp, Homo sapiens
agtttgcagaaaagcacctgc

SEQ ID NO: 976944 - DNA, 16 bp, Homo sapiens
agtttgcatgattctt

SEQ ID NO: 976945 - DNA, 13 bp, Homo sapiens
agtttgccagaag

SEQ ID NO: 976946 - DNA, 15 bp, Homo sapiens
agtttgcctgctgta

SEQ ID NO: 976947 - DNA, 17 bp, Homo sapiens
agtttgctaaaagaaga

SEQ ID NO: 976948 - DNA, 11 bp, Homo sapiens
agtttgcttag

SEQ ID NO: 976949 - DNA, 15 bp, Homo sapiens
agtttggaatgaaga

SEQ ID NO: 976950 - DNA, 21 bp, Homo sapiens
agtttggagagtcagatcttt

SEQ ID NO: 976951 - DNA, 14 bp, Homo sapiens
agtttggatatgta

SEQ ID NO: 976952 - DNA, 20 bp, Homo sapiens
agtttggatatttttgtact

SEQ ID NO: 976953 - DNA, 21 bp, Homo sapiens
agtttggatgttgtaaataaa

SEQ ID NO: 976954 - DNA, 15 bp, Homo sapiens
agtttggccctggag

SEQ ID NO: 976955 - DNA, 16 bp, Homo sapiens
agtttggccctggagc

SEQ ID NO: 976956 - DNA, 17 bp, Homo sapiens
agtttggccctggagcc

SEQ ID NO: 976957 - DNA, 19 bp, Homo sapiens
agtttggccctggagccag

SEQ ID NO: 976958 - DNA, 19 bp, Homo sapiens
agtttggctataagtgctc

SEQ ID NO: 976959 - DNA, 21 bp, Homo sapiens
agtttgggagacatggaccag

SEQ ID NO: 976960 - DNA, 20 bp, Homo sapiens
agtttggtattgtaaaacat

SEQ ID NO: 976961 - DNA, 20 bp, Homo sapiens
agtttggttcacttacagat

SEQ ID NO: 976962 - DNA, 17 bp, Homo sapiens
agtttgtaaatattcta

SEQ ID NO: 976963 - DNA, 17 bp, Homo sapiens
agtttgtagaactttat

SEQ ID NO: 976964 - DNA, 15 bp, Homo sapiens
agtttgtagccaggt

SEQ ID NO: 976965 - DNA, 18 bp, Homo sapiens
agtttgtagtaaaagtgg

SEQ ID NO: 976966 - DNA, 15 bp, Homo sapiens
agtttgtattttgca

SEQ ID NO: 976967 - DNA, 19 bp, Homo sapiens
agtttgtattttgcatact

SEQ ID NO: 976968 - DNA, 16 bp, Homo sapiens
agtttgtcctgtagag

SEQ ID NO: 976969 - DNA, 21 bp, Homo sapiens
agtttgtcgctcatgtgtgca

SEQ ID NO: 976970 - DNA, 13 bp, Homo sapiens
agtttgtctattt

SEQ ID NO: 976971 - DNA, 15 bp, Homo sapiens
agtttgtctatttta

SEQ ID NO: 976972 - DNA, 19 bp, Homo sapiens
agtttgtctattttaaaat

SEQ ID NO: 976973 - DNA, 20 bp, Homo sapiens
agtttgtgatatagcagagg

SEQ ID NO: 976974 - DNA, 20 bp, Homo sapiens
agtttgtggcatcttgccaa

SEQ ID NO: 976975 - DNA, 20 bp, Homo sapiens
agtttgtgtctgttgcttgt

SEQ ID NO: 976976 - DNA, 20 bp, Homo sapiens
agtttgtgtgtatttgtatt

SEQ ID NO: 976977 - DNA, 15 bp, Homo sapiens
agtttgtgtgtctta

SEQ ID NO: 976978 - DNA, 22 bp, Homo sapiens
agtttgtgtgtcttaattatta

SEQ ID NO: 976979 - DNA, 18 bp, Homo sapiens
aagtaagaaaatattttg

SEQ ID NO: 976980 - DNA, 19 bp, Homo sapiens
aagtaagaaaatattttgt

SEQ ID NO: 976981 - DNA, 13 bp, Homo sapiens
aagtaagaaattt

SEQ ID NO: 976982 - DNA, 16 bp, Homo sapiens
aagtaagcatttccag

SEQ ID NO: 976983 - DNA, 23 bp, Homo sapiens
aagtaagcccttgaagatatctt

SEQ ID NO: 976984 - DNA, 18 bp, Homo sapiens
aagtaaggtgcagttccc

SEQ ID NO: 976985 - DNA, 18 bp, Homo sapiens
aagtaagtaccactcagg

SEQ ID NO: 976986 - DNA, 20 bp, Homo sapiens
aagtaagtaccactcaggcc

SEQ ID NO: 976987 - DNA, 23 bp, Homo sapiens
aagtaagtcttttttttttccaa

SEQ ID NO: 976988 - DNA, 17 bp, Homo sapiens
aagtaagtttatccaaa

SEQ ID NO: 976989 - DNA, 17 bp, Homo sapiens
aagtaagtttcttcctg

SEQ ID NO: 976990 - DNA, 14 bp, Homo sapiens
aagtaataaaattc

SEQ ID NO: 976991 - DNA, 15 bp, Homo sapiens
aagtaataatgtgca

SEQ ID NO: 976992 - DNA, 16 bp, Homo sapiens
aagtaatacaaactaa

SEQ ID NO: 976993 - DNA, 16 bp, Homo sapiens
aagtaatatgcacaca

SEQ ID NO: 976994 - DNA, 18 bp, Homo sapiens
aagtaatatgcacacatt

SEQ ID NO: 976995 - DNA, 20 bp, Homo sapiens
aagtaatatgcacacatttt

SEQ ID NO: 976996 - DNA, 21 bp, Homo sapiens
aagtaatatgcacacattttt

SEQ ID NO: 976997 - DNA, 13 bp, Homo sapiens
aagtaatattatt

SEQ ID NO: 976998 - DNA, 16 bp, Homo sapiens
aagtaatctttaaact

SEQ ID NO: 976999 - DNA, 18 bp, Homo sapiens
aagtaatctttttacagt

SEQ ID NO: 977000 - DNA, 21 bp, Homo sapiens
aagtaatgaatttttatgata

SEQ ID NO: 977001 - DNA, 19 bp, Homo sapiens
aagtaatgacttagaaact

SEQ ID NO: 977002 - DNA, 15 bp, Homo sapiens
aagtaatgatactgt

SEQ ID NO: 977003 - DNA, 23 bp, Homo sapiens
aagtaatgccacacattgtgctt

SEQ ID NO: 977004 - DNA, 15 bp, Homo sapiens
aagtaatgtattagt

SEQ ID NO: 977005 - DNA, 13 bp, Homo sapiens
aagtaattatcgg

SEQ ID NO: 977006 - DNA, 23 bp, Homo sapiens
aagtaattatcgggaacagtgtt

SEQ ID NO: 977007 - DNA, 19 bp, Homo sapiens
aagtaattttcatattaaa

SEQ ID NO: 977008 - DNA, 22 bp, Homo sapiens
aagtaattttgtcacattattt

SEQ ID NO: 977009 - DNA, 17 bp, Homo sapiens
aagtacaaatgaagaaa

SEQ ID NO: 977010 - DNA, 16 bp, Homo sapiens
aagtacacaataagca

SEQ ID NO: 977011 - DNA, 18 bp, Homo sapiens
aagtacacaataagcaaa

SEQ ID NO: 977012 - DNA, 14 bp, Homo sapiens
aagtacacctgtgt

SEQ ID NO: 977013 - DNA, 16 bp, Homo sapiens
aagtacactctgctgt

SEQ ID NO: 977014 - DNA, 13 bp, Homo sapiens
aagtacactgttt

SEQ ID NO: 977015 - DNA, 16 bp, Homo sapiens
aagtacagaatttgaa

SEQ ID NO: 977016 - DNA, 19 bp, Homo sapiens
aagtacagcggctcccctc

SEQ ID NO: 977017 - DNA, 22 bp, Homo sapiens
aagtacagcggctcccctctgc

SEQ ID NO: 977018 - DNA, 16 bp, Homo sapiens
aagtaccaatgctgtt

SEQ ID NO: 977019 - DNA, 17 bp, Homo sapiens
aagtaccaatgggaagc

SEQ ID NO: 977020 - DNA, 18 bp, Homo sapiens
aagtaccacactgagttc

SEQ ID NO: 977021 - DNA, 15 bp, Homo sapiens
aagtaccctctttta

SEQ ID NO: 977022 - DNA, 18 bp, Homo sapiens
aagtaccctgatgccttt

SEQ ID NO: 977023 - DNA, 22 bp, Homo sapiens
aagtaccctgatgccttttgga

SEQ ID NO: 977024 - DNA, 21 bp, Homo sapiens
aagtacctatattgatttaaa

SEQ ID NO: 977025 - DNA, 16 bp, Homo sapiens
aagtactatgtatcaa

SEQ ID NO: 977026 - DNA, 14 bp, Homo sapiens
aagtactctggagc

SEQ ID NO: 977027 - DNA, 13 bp, Homo sapiens
aagtacttaaact

SEQ ID NO: 977028 - DNA, 16 bp, Homo sapiens
aagtacttttctgttc

SEQ ID NO: 977029 - DNA, 15 bp, Homo sapiens
aagtagaaatcatag

SEQ ID NO: 977030 - DNA, 11 bp, Homo sapiens
aagtagaaatg

SEQ ID NO: 977031 - DNA, 12 bp, Homo sapiens
aagtagaagagg

SEQ ID NO: 977032 - DNA, 20 bp, Homo sapiens
aagtagaagtcttagatgta

SEQ ID NO: 977033 - DNA, 16 bp, Homo sapiens
aagtagacctcttttt

SEQ ID NO: 977034 - DNA, 20 bp, Homo sapiens
aagtagagctagctgccact

SEQ ID NO: 977035 - DNA, 13 bp, Homo sapiens
aagtagatttcat

SEQ ID NO: 977036 - DNA, 19 bp, Homo sapiens
aagtagcaaaacaaattca

SEQ ID NO: 977037 - DNA, 21 bp, Homo sapiens
aagtagctagtagcaatgtgc

SEQ ID NO: 977038 - DNA, 13 bp, Homo sapiens
aagtagctgggat

SEQ ID NO: 977039 - DNA, 15 bp, Homo sapiens
aagtagctgggatta

SEQ ID NO: 977040 - DNA, 21 bp, Homo sapiens
aagtaggatgaatcatattca

SEQ ID NO: 977041 - DNA, 19 bp, Homo sapiens
aagtaggtggcttgagcta

SEQ ID NO: 977042 - DNA, 13 bp, Homo sapiens
aagtagtaaatca

SEQ ID NO: 977043 - DNA, 18 bp, Homo sapiens
aagtagtacttcttctgt

SEQ ID NO: 977044 - DNA, 15 bp, Homo sapiens
aagtagtgatgaaaa

SEQ ID NO: 977045 - DNA, 23 bp, Homo sapiens
aagtagtgtctggatcagtaaaa

SEQ ID NO: 977046 - DNA, 19 bp, Homo sapiens
aagtagttggtttgtatga

SEQ ID NO: 977047 - DNA, 20 bp, Homo sapiens
aagtagtttaagtctccttt

SEQ ID NO: 977048 - DNA, 20 bp, Homo sapiens
aagtagtttgtataacttct

SEQ ID NO: 977049 - DNA, 15 bp, Homo sapiens
aagtataaactttta

SEQ ID NO: 977050 - DNA, 23 bp, Homo sapiens
ataaaatgaacatctcttgaaac

SEQ ID NO: 977051 - DNA, 18 bp, Homo sapiens
ataaaatgaggacatgtt

SEQ ID NO: 977052 - DNA, 18 bp, Homo sapiens
ataaaatgcaaatgaatc

SEQ ID NO: 977053 - DNA, 19 bp, Homo sapiens
ataaaatgcaaatgaatca

SEQ ID NO: 977054 - DNA, 20 bp, Homo sapiens
ataaaatgcaaatgaatcat

SEQ ID NO: 977055 - DNA, 21 bp, Homo sapiens
ataaaatgcaaatgaatcatt

SEQ ID NO: 977056 - DNA, 22 bp, Homo sapiens
ataaaatgcaaatgaatcattg

SEQ ID NO: 977057 - DNA, 17 bp, Homo sapiens
ataaaatgcatactgtt

SEQ ID NO: 977058 - DNA, 14 bp, Homo sapiens
ataaaatggcacct

SEQ ID NO: 977059 - DNA, 14 bp, Homo sapiens
ataaaatgtataaa

SEQ ID NO: 977060 - DNA, 16 bp, Homo sapiens
ataaaatgtgtacagt

SEQ ID NO: 977061 - DNA, 12 bp, Homo sapiens
ataaaatgttga

SEQ ID NO: 977062 - DNA, 16 bp, Homo sapiens
ataaaatgttgaaaag

SEQ ID NO: 977063 - DNA, 19 bp, Homo sapiens
ataaaatgttgaaaagtca

SEQ ID NO: 977064 - DNA, 13 bp, Homo sapiens
ataaaattatgcc

SEQ ID NO: 977065 - DNA, 15 bp, Homo sapiens
ataaaattcctatct

SEQ ID NO: 977066 - DNA, 17 bp, Homo sapiens
ataaaattcctatctca

SEQ ID NO: 977067 - DNA, 17 bp, Homo sapiens
ataaaattcgctttcta

SEQ ID NO: 977068 - DNA, 16 bp, Homo sapiens
ataaaattttgctttt

SEQ ID NO: 977069 - DNA, 11 bp, Homo sapiens
ataaaattttt

SEQ ID NO: 977070 - DNA, 19 bp, Homo sapiens
ataaacaacttaatgttct

SEQ ID NO: 977071 - DNA, 15 bp, Homo sapiens
ataaacaagaccacg

SEQ ID NO: 977072 - DNA, 15 bp, Homo sapiens
ataaacaagcatttc

SEQ ID NO: 977073 - DNA, 17 bp, Homo sapiens
ataaacaaggtcataca

SEQ ID NO: 977074 - DNA, 14 bp, Homo sapiens
ataaacacatagat

SEQ ID NO: 977075 - DNA, 15 bp, Homo sapiens
ataaacacatagatt

SEQ ID NO: 977076 - DNA, 17 bp, Homo sapiens
ataaacacccatgaatc

SEQ ID NO: 977077 - DNA, 18 bp, Homo sapiens
ataaacactccacagtgt

SEQ ID NO: 977078 - DNA, 20 bp, Homo sapiens
ataaacactccacagtgttt

SEQ ID NO: 977079 - DNA, 23 bp, Homo sapiens
ataaacactccacagtgtttata

SEQ ID NO: 977080 - DNA, 21 bp, Homo sapiens
ataaacagtatattctttggt

SEQ ID NO: 977081 - DNA, 19 bp, Homo sapiens
ataaacagtctaaagaaga

SEQ ID NO: 977082 - DNA, 21 bp, Homo sapiens
ataaacagtgagcatatctgg

SEQ ID NO: 977083 - DNA, 12 bp, Homo sapiens
ataaacatatgt

SEQ ID NO: 977084 - DNA, 17 bp, Homo sapiens
ataaacatcacacacac

SEQ ID NO: 977085 - DNA, 14 bp, Homo sapiens
ataaacattaaaca

SEQ ID NO: 977086 - DNA, 18 bp, Homo sapiens
ataaacattaaacactgt

SEQ ID NO: 977087 - DNA, 22 bp, Homo sapiens
ataaaccaaacccagccactgc

SEQ ID NO: 977088 - DNA, 15 bp, Homo sapiens
ataaaccaataaatc

SEQ ID NO: 977089 - DNA, 15 bp, Homo sapiens
ataaaccactgtgcg

SEQ ID NO: 977090 - DNA, 18 bp, Homo sapiens
ataaaccgtttttaacac

SEQ ID NO: 977091 - DNA, 20 bp, Homo sapiens
ataaacgcgggaaaaaagat

SEQ ID NO: 977092 - DNA, 14 bp, Homo sapiens
ataaactaataatt

SEQ ID NO: 977093 - DNA, 16 bp, Homo sapiens
ataaactactctttga

SEQ ID NO: 977094 - DNA, 17 bp, Homo sapiens
ataaactactctttgat

SEQ ID NO: 977095 - DNA, 19 bp, Homo sapiens
ataaactactctttgattt

SEQ ID NO: 977096 - DNA, 15 bp, Homo sapiens
ataaactataaactt

SEQ ID NO: 977097 - DNA, 19 bp, Homo sapiens
ataaactataaacttaagg

SEQ ID NO: 977098 - DNA, 14 bp, Homo sapiens
ataaactatcagtt

SEQ ID NO: 977099 - DNA, 18 bp, Homo sapiens
ataaactattggaaagta

SEQ ID NO: 977100 - DNA, 20 bp, Homo sapiens
ataaactatttttttcttaa

SEQ ID NO: 977101 - DNA, 19 bp, Homo sapiens
aagtgacaaggccccagag

SEQ ID NO: 977102 - DNA, 21 bp, Homo sapiens
aagtgacaaggccccagagac

SEQ ID NO: 977103 - DNA, 19 bp, Homo sapiens
aagtgactgaccatgcact

SEQ ID NO: 977104 - DNA, 12 bp, Homo sapiens
aagtgactgttt

SEQ ID NO: 977105 - DNA, 23 bp, Homo sapiens
aagtgactgtttggcttataaac

SEQ ID NO: 977106 - DNA, 18 bp, Homo sapiens
aagtgacttctggagaaa

SEQ ID NO: 977107 - DNA, 18 bp, Homo sapiens
aagtgagagccagcagca

SEQ ID NO: 977108 - DNA, 15 bp, Homo sapiens
aagtgagcagaacag

SEQ ID NO: 977109 - DNA, 22 bp, Homo sapiens
aagtgagcagagatgtactgca

SEQ ID NO: 977110 - DNA, 14 bp, Homo sapiens
aagtgagccccccc

SEQ ID NO: 977111 - DNA, 18 bp, Homo sapiens
aagtgagctttgctgcta

SEQ ID NO: 977112 - DNA, 21 bp, Homo sapiens
aagtgagctttgctgctacag

SEQ ID NO: 977113 - DNA, 17 bp, Homo sapiens
aagtgagggctcactca

SEQ ID NO: 977114 - DNA, 17 bp, Homo sapiens
aagtgagtttgtaaata

SEQ ID NO: 977115 - DNA, 18 bp, Homo sapiens
aagtgagtttgtaaatat

SEQ ID NO: 977116 - DNA, 15 bp, Homo sapiens
aagtgataatttctg

SEQ ID NO: 977117 - DNA, 22 bp, Homo sapiens
aagtgatcaataaaatgtgatt

SEQ ID NO: 977118 - DNA, 23 bp, Homo sapiens
aagtgatccacccacctcggcct

SEQ ID NO: 977119 - DNA, 20 bp, Homo sapiens
aagtgatccttccacctcag

SEQ ID NO: 977120 - DNA, 13 bp, Homo sapiens
aagtgatgctgtg

SEQ ID NO: 977121 - DNA, 19 bp, Homo sapiens
aagtgatgtattttcatag

SEQ ID NO: 977122 - DNA, 13 bp, Homo sapiens
aagtgatgtcaga

SEQ ID NO: 977123 - DNA, 16 bp, Homo sapiens
aagtgatgtcatttga

SEQ ID NO: 977124 - DNA, 21 bp, Homo sapiens
aagtgattaaacgtgcagact

SEQ ID NO: 977125 - DNA, 14 bp, Homo sapiens
aagtgattctaaga

SEQ ID NO: 977126 - DNA, 19 bp, Homo sapiens
aagtgattttatttttgca

SEQ ID NO: 977127 - DNA, 16 bp, Homo sapiens
aagtgcaacatttctg

SEQ ID NO: 977128 - DNA, 17 bp, Homo sapiens
aagtgcaacatttctgt

SEQ ID NO: 977129 - DNA, 13 bp, Homo sapiens
aagtgcaggctgg

SEQ ID NO: 977130 - DNA, 18 bp, Homo sapiens
aagtgcatttaaggagat

SEQ ID NO: 977131 - DNA, 18 bp, Homo sapiens
aagtgccagaggtgggca

SEQ ID NO: 977132 - DNA, 20 bp, Homo sapiens
aagtgccagaggtgggcagg

SEQ ID NO: 977133 - DNA, 18 bp, Homo sapiens
aagtgccagggctgggcc

SEQ ID NO: 977134 - DNA, 23 bp, Homo sapiens
aagtgccagtattttaaaatagc

SEQ ID NO: 977135 - DNA, 21 bp, Homo sapiens
aagtgccagtcttgtgtctgc

SEQ ID NO: 977136 - DNA, 17 bp, Homo sapiens
aagtgccattaacaaat

SEQ ID NO: 977137 - DNA, 16 bp, Homo sapiens
aagtgcccacatttga

SEQ ID NO: 977138 - DNA, 23 bp, Homo sapiens
aagtgcctcacatttttttctac

SEQ ID NO: 977139 - DNA, 14 bp, Homo sapiens
aagtgcctcttgtt

SEQ ID NO: 977140 - DNA, 14 bp, Homo sapiens
aagtgcctgcttag

SEQ ID NO: 977141 - DNA, 18 bp, Homo sapiens
aagtgcctgcttttgatg

SEQ ID NO: 977142 - DNA, 17 bp, Homo sapiens
aagtgccttctgggctt

SEQ ID NO: 977143 - DNA, 18 bp, Homo sapiens
aagtgcctttatctcagc

SEQ ID NO: 977144 - DNA, 20 bp, Homo sapiens
aagtgcctttatctcagcca

SEQ ID NO: 977145 - DNA, 15 bp, Homo sapiens
aagtgcgtgaatgta

SEQ ID NO: 977146 - DNA, 18 bp, Homo sapiens
aagtgcgtggtataatct

SEQ ID NO: 977147 - DNA, 18 bp, Homo sapiens
aagtgcgttctcccagca

SEQ ID NO: 977148 - DNA, 22 bp, Homo sapiens
aagtgctaaagttttcttccca

SEQ ID NO: 977149 - DNA, 21 bp, Homo sapiens
aagtgctcttggctgacccct

SEQ ID NO: 977150 - DNA, 23 bp, Homo sapiens
aagtgctcttggctgacccctct

SEQ ID NO: 977151 - DNA, 17 bp, Homo sapiens
aagtgctgcacaaaagc

SEQ ID NO: 977152 - DNA, 19 bp, Homo sapiens
aagtgctggagtctcctga

SEQ ID NO: 977153 - DNA, 22 bp, Homo sapiens
aagtgctggcaaccactaagaa

SEQ ID NO: 977154 - DNA, 23 bp, Homo sapiens
aagtgctggcaaccactaagaat

SEQ ID NO: 977155 - DNA, 11 bp, Homo sapiens
aagtgctggga

SEQ ID NO: 977156 - DNA, 12 bp, Homo sapiens
aagtgctgggat

SEQ ID NO: 977157 - DNA, 20 bp, Homo sapiens
aagtgctgggatgacaggtg

SEQ ID NO: 977158 - DNA, 14 bp, Homo sapiens
aagtgctgggatta

SEQ ID NO: 977159 - DNA, 13 bp, Homo sapiens
aagtgctgtaccc

SEQ ID NO: 977160 - DNA, 22 bp, Homo sapiens
aagtgctgtacccttccacctc

SEQ ID NO: 977161 - DNA, 16 bp, Homo sapiens
aagtgctgtttattaa

SEQ ID NO: 977162 - DNA, 18 bp, Homo sapiens
aagtgctgtttattaatc

SEQ ID NO: 977163 - DNA, 20 bp, Homo sapiens
aagtgctgtttattaatctt

SEQ ID NO: 977164 - DNA, 22 bp, Homo sapiens
aagtgctgtttattaatcttag

SEQ ID NO: 977165 - DNA, 19 bp, Homo sapiens
aagtgcttacattttaata

SEQ ID NO: 977166 - DNA, 19 bp, Homo sapiens
aagtgcttattacatttta

SEQ ID NO: 977167 - DNA, 17 bp, Homo sapiens
aagtgcttgctttttgc

SEQ ID NO: 977168 - DNA, 13 bp, Homo sapiens
aagtggaaatgtt

SEQ ID NO: 977169 - DNA, 16 bp, Homo sapiens
aagtggaccaggacag

SEQ ID NO: 977170 - DNA, 20 bp, Homo sapiens
aagtggaccaggacaggacc

SEQ ID NO: 977171 - DNA, 20 bp, Homo sapiens
aagtggaccttgagaccaca

SEQ ID NO: 977172 - DNA, 23 bp, Homo sapiens
aagtggactggtgtcataaactt

SEQ ID NO: 977173 - DNA, 19 bp, Homo sapiens
aagtggatgggaatttgtc

SEQ ID NO: 977174 - DNA, 20 bp, Homo sapiens
aagtggcatactttttaaaa

SEQ ID NO: 977175 - DNA, 17 bp, Homo sapiens
aagtggcatgtgctgtg

SEQ ID NO: 977176 - DNA, 18 bp, Homo sapiens
aagtggcatgtgctgtga

SEQ ID NO: 977177 - DNA, 14 bp, Homo sapiens
aagtggcatgtttt

SEQ ID NO: 977178 - DNA, 16 bp, Homo sapiens
aagtggcatgttttgt

SEQ ID NO: 977179 - DNA, 19 bp, Homo sapiens
aagtggccaagaagcagtg

SEQ ID NO: 977180 - DNA, 12 bp, Homo sapiens
aagtggcgtgtg

SEQ ID NO: 977181 - DNA, 16 bp, Homo sapiens
aagtggctccccacct

SEQ ID NO: 977182 - DNA, 19 bp, Homo sapiens
ataactcatcataaaataa

SEQ ID NO: 977183 - DNA, 15 bp, Homo sapiens
ataactctagggata

SEQ ID NO: 977184 - DNA, 19 bp, Homo sapiens
ataactctagggatataaa

SEQ ID NO: 977185 - DNA, 19 bp, Homo sapiens
ataactctgcactactcct

SEQ ID NO: 977186 - DNA, 20 bp, Homo sapiens
ataactctgtataatagaga

SEQ ID NO: 977187 - DNA, 22 bp, Homo sapiens
ataactctgtggcattattgca

SEQ ID NO: 977188 - DNA, 12 bp, Homo sapiens
ataactctttga

SEQ ID NO: 977189 - DNA, 12 bp, Homo sapiens
ataactgaactg

SEQ ID NO: 977190 - DNA, 16 bp, Homo sapiens
ataactgaactgtttg

SEQ ID NO: 977191 - DNA, 16 bp, Homo sapiens
ataactgaaggagaag

SEQ ID NO: 977192 - DNA, 15 bp, Homo sapiens
ataactgacaagaga

SEQ ID NO: 977193 - DNA, 15 bp, Homo sapiens
ataactggaaaacag

SEQ ID NO: 977194 - DNA, 17 bp, Homo sapiens
ataactggaaaacagaa

SEQ ID NO: 977195 - DNA, 17 bp, Homo sapiens
ataactgtagctcaagt

SEQ ID NO: 977196 - DNA, 15 bp, Homo sapiens
ataactgtatttgaa

SEQ ID NO: 977197 - DNA, 18 bp, Homo sapiens
ataactgtatttgaaata

SEQ ID NO: 977198 - DNA, 13 bp, Homo sapiens
ataactgtcttgt

SEQ ID NO: 977199 - DNA, 20 bp, Homo sapiens
ataactgtcttgtttcagtg

SEQ ID NO: 977200 - DNA, 20 bp, Homo sapiens
ataactgttttagaaattgg

SEQ ID NO: 977201 - DNA, 19 bp, Homo sapiens
ataacttaaaaaaatgaca

SEQ ID NO: 977202 - DNA, 12 bp, Homo sapiens
ataacttaaaat

SEQ ID NO: 977203 - DNA, 16 bp, Homo sapiens
ataacttaatgaaaac

SEQ ID NO: 977204 - DNA, 19 bp, Homo sapiens
ataacttaatgaaaacaat

SEQ ID NO: 977205 - DNA, 23 bp, Homo sapiens
ataacttaatgaaaacaatgcag

SEQ ID NO: 977206 - DNA, 14 bp, Homo sapiens
ataacttactgtat

SEQ ID NO: 977207 - DNA, 15 bp, Homo sapiens
ataacttactgtata

SEQ ID NO: 977208 - DNA, 20 bp, Homo sapiens
ataacttatattgtaagaaa

SEQ ID NO: 977209 - DNA, 21 bp, Homo sapiens
ataacttatattgtaagaaat

SEQ ID NO: 977210 - DNA, 14 bp, Homo sapiens
ataacttctatgtt

SEQ ID NO: 977211 - DNA, 21 bp, Homo sapiens
ataacttctatgttggtttca

SEQ ID NO: 977212 - DNA, 17 bp, Homo sapiens
ataacttcttaaaagtt

SEQ ID NO: 977213 - DNA, 14 bp, Homo sapiens
ataacttcttgaaa

SEQ ID NO: 977214 - DNA, 21 bp, Homo sapiens
ataacttgctgaatttcaggc

SEQ ID NO: 977215 - DNA, 20 bp, Homo sapiens
ataacttgctttcttctttc

SEQ ID NO: 977216 - DNA, 13 bp, Homo sapiens
ataactttattgc

SEQ ID NO: 977217 - DNA, 15 bp, Homo sapiens
ataactttattgcat

SEQ ID NO: 977218 - DNA, 19 bp, Homo sapiens
ataacttttcaccaatgag

SEQ ID NO: 977219 - DNA, 12 bp, Homo sapiens
ataagaaaaact

SEQ ID NO: 977220 - DNA, 16 bp, Homo sapiens
ataagaaaaatcatgt

SEQ ID NO: 977221 - DNA, 21 bp, Homo sapiens
ataagaaaagatgtagattta

SEQ ID NO: 977222 - DNA, 22 bp, Homo sapiens
aagttgttctagtaacaataca

SEQ ID NO: 977223 - DNA, 14 bp, Homo sapiens
aagttgttgactgt

SEQ ID NO: 977224 - DNA, 17 bp, Homo sapiens
aagttgttgactgtgat

SEQ ID NO: 977225 - DNA, 18 bp, Homo sapiens
aagttgtttatcaacttc

SEQ ID NO: 977226 - DNA, 15 bp, Homo sapiens
aagttgtttcattga

SEQ ID NO: 977227 - DNA, 23 bp, Homo sapiens
aagtttaaggaatatgggagaaa

SEQ ID NO: 977228 - DNA, 14 bp, Homo sapiens
aagtttaataaatt

SEQ ID NO: 977229 - DNA, 14 bp, Homo sapiens
aagtttacaacttg

SEQ ID NO: 977230 - DNA, 23 bp, Homo sapiens
aagtttacaacttgattttttca

SEQ ID NO: 977231 - DNA, 18 bp, Homo sapiens
aagtttacaagtgtatat

SEQ ID NO: 977232 - DNA, 19 bp, Homo sapiens
aagtttacaatcaaaggaa

SEQ ID NO: 977233 - DNA, 21 bp, Homo sapiens
aagtttagcccctgaaagcca

SEQ ID NO: 977234 - DNA, 18 bp, Homo sapiens
aagtttatccaaatcttg

SEQ ID NO: 977235 - DNA, 15 bp, Homo sapiens
aagtttattgtttga

SEQ ID NO: 977236 - DNA, 16 bp, Homo sapiens
aagtttatttgagaaa

SEQ ID NO: 977237 - DNA, 17 bp, Homo sapiens
aagtttatttgagaaaa

SEQ ID NO: 977238 - DNA, 18 bp, Homo sapiens
aagtttatttgagaaaat

SEQ ID NO: 977239 - DNA, 22 bp, Homo sapiens
aagtttatttgagaaaatataa

SEQ ID NO: 977240 - DNA, 19 bp, Homo sapiens
aagtttattttttctacac

SEQ ID NO: 977241 - DNA, 22 bp, Homo sapiens
aagtttcaatgtgattctaatg

SEQ ID NO: 977242 - DNA, 19 bp, Homo sapiens
aagtttcacaggtcaataa

SEQ ID NO: 977243 - DNA, 19 bp, Homo sapiens
aagtttcaggatacatgtg

SEQ ID NO: 977244 - DNA, 12 bp, Homo sapiens
aagtttcagttg

SEQ ID NO: 977245 - DNA, 16 bp, Homo sapiens
aagtttcagttgattt

SEQ ID NO: 977246 - DNA, 12 bp, Homo sapiens
aagtttcattta

SEQ ID NO: 977247 - DNA, 12 bp, Homo sapiens
aagtttccatat

SEQ ID NO: 977248 - DNA, 21 bp, Homo sapiens
aagtttctagctagaaatatg

SEQ ID NO: 977249 - DNA, 14 bp, Homo sapiens
aagtttctattctg

SEQ ID NO: 977250 - DNA, 17 bp, Homo sapiens
aagtttctgaatatttt

SEQ ID NO: 977251 - DNA, 13 bp, Homo sapiens
aagtttctgttga

SEQ ID NO: 977252 - DNA, 14 bp, Homo sapiens
aagtttctgttgaa

SEQ ID NO: 977253 - DNA, 20 bp, Homo sapiens
aagtttgctaaaagaagaga

SEQ ID NO: 977254 - DNA, 15 bp, Homo sapiens
aagtttgcttagaaa

SEQ ID NO: 977255 - DNA, 22 bp, Homo sapiens
aagtttgggtgtattttcttta

SEQ ID NO: 977256 - DNA, 22 bp, Homo sapiens
aagtttggtattgtaaaacatt

SEQ ID NO: 977257 - DNA, 14 bp, Homo sapiens
aagtttgtttttaa

SEQ ID NO: 977258 - DNA, 16 bp, Homo sapiens
aagtttgtttttgcgt

SEQ ID NO: 977259 - DNA, 16 bp, Homo sapiens
aagttttaacttccag

SEQ ID NO: 977260 - DNA, 18 bp, Homo sapiens
aagttttaacttccagtg

SEQ ID NO: 977261 - DNA, 21 bp, Homo sapiens
aagttttaacttccagtggct

SEQ ID NO: 977262 - DNA, 14 bp, Homo sapiens
aagttttaggacaa

SEQ ID NO: 977263 - DNA, 23 bp, Homo sapiens
aagttttcagaacctcttcccca

SEQ ID NO: 977264 - DNA, 11 bp, Homo sapiens
aagttttcagg

SEQ ID NO: 977265 - DNA, 14 bp, Homo sapiens
aagttttgatataa

SEQ ID NO: 977266 - DNA, 15 bp, Homo sapiens
aagttttgcatttat

SEQ ID NO: 977267 - DNA, 23 bp, Homo sapiens
aagttttgggtatgtttaatctg

SEQ ID NO: 977268 - DNA, 20 bp, Homo sapiens
aagtttttatggcttttgtg

SEQ ID NO: 977269 - DNA, 12 bp, Homo sapiens
aagtttttttgc

SEQ ID NO: 977270 - DNA, 23 bp, Homo sapiens
aagtttttttgctgctgcctctt

SEQ ID NO: 977271 - DNA, 18 bp, Homo sapiens
aataaaaaaaagaaaaaa

SEQ ID NO: 977272 - DNA, 20 bp, Homo sapiens
aataaaaaaaagaaatgaaa

SEQ ID NO: 977273 - DNA, 16 bp, Homo sapiens
aataaaaaacagaaac

SEQ ID NO: 977274 - DNA, 12 bp, Homo sapiens
aataaaaaagat

SEQ ID NO: 977275 - DNA, 13 bp, Homo sapiens
aataaaaaagatt

SEQ ID NO: 977276 - DNA, 17 bp, Homo sapiens
aataaaaaagattctac

SEQ ID NO: 977277 - DNA, 18 bp, Homo sapiens
aataaaaaagattctact

SEQ ID NO: 977278 - DNA, 13 bp, Homo sapiens
aataaaaacaact

SEQ ID NO: 977279 - DNA, 16 bp, Homo sapiens
aataaaaagcttttgt

SEQ ID NO: 977280 - DNA, 14 bp, Homo sapiens
aataaaaagtgaac

SEQ ID NO: 977281 - DNA, 11 bp, Homo sapiens
aataaaaatat

SEQ ID NO: 977282 - DNA, 15 bp, Homo sapiens
aataaaaatatatat

SEQ ID NO: 977283 - DNA, 16 bp, Homo sapiens
aataaaaatatatatt

SEQ ID NO: 977284 - DNA, 19 bp, Homo sapiens
aataaaaatatatattact

SEQ ID NO: 977285 - DNA, 15 bp, Homo sapiens
aataaaaatatattt

SEQ ID NO: 977286 - DNA, 11 bp, Homo sapiens
aataaaacaac

SEQ ID NO: 977287 - DNA, 13 bp, Homo sapiens
aataaaacaagcc

SEQ ID NO: 977288 - DNA, 15 bp, Homo sapiens
aataaaacacacctc

SEQ ID NO: 977289 - DNA, 13 bp, Homo sapiens
aataaaacctttc

SEQ ID NO: 977290 - DNA, 21 bp, Homo sapiens
aataaaacctttcaaatttca

SEQ ID NO: 977291 - DNA, 23 bp, Homo sapiens
aataaaactaagctctttgagaa

SEQ ID NO: 977292 - DNA, 18 bp, Homo sapiens
aataaaactgatgttact

SEQ ID NO: 977293 - DNA, 17 bp, Homo sapiens
aataaaactgcacagtg

SEQ ID NO: 977294 - DNA, 22 bp, Homo sapiens
aataaaactttatgtactgctg

SEQ ID NO: 977295 - DNA, 14 bp, Homo sapiens
aataaaactttcca

SEQ ID NO: 977296 - DNA, 18 bp, Homo sapiens
aataaaactttttaaaat

SEQ ID NO: 977297 - DNA, 18 bp, Homo sapiens
aataaaagagctttatcc

SEQ ID NO: 977298 - DNA, 19 bp, Homo sapiens
aataaaagagctttatccc

SEQ ID NO: 977299 - DNA, 11 bp, Homo sapiens
aataaaagcac

SEQ ID NO: 977300 - DNA, 22 bp, Homo sapiens
aataaaagctataaagtatata

SEQ ID NO: 977301 - DNA, 13 bp, Homo sapiens
aataaaaggaaaa

SEQ ID NO: 977302 - DNA, 17 bp, Homo sapiens
aataaaagtattcttgt

SEQ ID NO: 977303 - DNA, 22 bp, Homo sapiens
aataaaagtattcttgttagaa

SEQ ID NO: 977304 - DNA, 12 bp, Homo sapiens
aataaaagtgac

SEQ ID NO: 977305 - DNA, 16 bp, Homo sapiens
aataaaagtgaccttt

SEQ ID NO: 977306 - DNA, 14 bp, Homo sapiens
aataaaagtgcaca

SEQ ID NO: 977307 - DNA, 19 bp, Homo sapiens
aataaaagtgcacacctta

SEQ ID NO: 977308 - DNA, 13 bp, Homo sapiens
aataaaatacttt

SEQ ID NO: 977309 - DNA, 14 bp, Homo sapiens
aataaaatatatat

SEQ ID NO: 977310 - DNA, 20 bp, Homo sapiens
aataaaatatatcttataaa

SEQ ID NO: 977311 - DNA, 12 bp, Homo sapiens
aataaaatatga

SEQ ID NO: 977312 - DNA, 16 bp, Homo sapiens
aataaaatcttgaaaa

SEQ ID NO: 977313 - DNA, 13 bp, Homo sapiens
aataaaatgaaaa

SEQ ID NO: 977314 - DNA, 19 bp, Homo sapiens
aataaaatgaaaattgtat

SEQ ID NO: 977315 - DNA, 15 bp, Homo sapiens
aataaaatgaacatc

SEQ ID NO: 977316 - DNA, 22 bp, Homo sapiens
aataaaatgcaaatgaatcatt

SEQ ID NO: 977317 - DNA, 20 bp, Homo sapiens
ataatgctcccatctcctga

SEQ ID NO: 977318 - DNA, 18 bp, Homo sapiens
ataatggaaaaaaagact

SEQ ID NO: 977319 - DNA, 17 bp, Homo sapiens
ataatggaaaaatagta

SEQ ID NO: 977320 - DNA, 12 bp, Homo sapiens
ataatggaaaca

SEQ ID NO: 977321 - DNA, 14 bp, Homo sapiens
ataatggaaacatt

SEQ ID NO: 977322 - DNA, 21 bp, Homo sapiens
ataatggaaacattacagttc

SEQ ID NO: 977323 - DNA, 20 bp, Homo sapiens
ataatggacagattaatatt

SEQ ID NO: 977324 - DNA, 22 bp, Homo sapiens
ataatggagaatcacttttcta

SEQ ID NO: 977325 - DNA, 15 bp, Homo sapiens
ataatgggagacagt

SEQ ID NO: 977326 - DNA, 21 bp, Homo sapiens
ataatgggattttcttttctt

SEQ ID NO: 977327 - DNA, 22 bp, Homo sapiens
ataatgggccactgaaatctgt

SEQ ID NO: 977328 - DNA, 17 bp, Homo sapiens
ataatggtcccatccag

SEQ ID NO: 977329 - DNA, 18 bp, Homo sapiens
ataatggtcccatccagg

SEQ ID NO: 977330 - DNA, 17 bp, Homo sapiens
ataatggtgatgtcata

SEQ ID NO: 977331 - DNA, 18 bp, Homo sapiens
ataatggttgactgggtt

SEQ ID NO: 977332 - DNA, 20 bp, Homo sapiens
ataatggttgtgaaatgtaa

SEQ ID NO: 977333 - DNA, 14 bp, Homo sapiens
ataatgtaagctct

SEQ ID NO: 977334 - DNA, 15 bp, Homo sapiens
ataatgtaattgtaa

SEQ ID NO: 977335 - DNA, 16 bp, Homo sapiens
ataatgtatataaagt

SEQ ID NO: 977336 - DNA, 13 bp, Homo sapiens
ataatgtatttga

SEQ ID NO: 977337 - DNA, 15 bp, Homo sapiens
ataatgtatttgaaa

SEQ ID NO: 977338 - DNA, 14 bp, Homo sapiens
ataatgtattttca

SEQ ID NO: 977339 - DNA, 16 bp, Homo sapiens
ataatgtgaaaatggt

SEQ ID NO: 977340 - DNA, 18 bp, Homo sapiens
ataatgtgaaactggatt

SEQ ID NO: 977341 - DNA, 21 bp, Homo sapiens
ataatgtgaaactggattaaa

SEQ ID NO: 977342 - DNA, 11 bp, Homo sapiens
ataatgtgaac

SEQ ID NO: 977343 - DNA, 17 bp, Homo sapiens
ataatgtgcaaattttg

SEQ ID NO: 977344 - DNA, 21 bp, Homo sapiens
ataatgtgggaagaaacaaac

SEQ ID NO: 977345 - DNA, 22 bp, Homo sapiens
atacattttgttatagaatact

SEQ ID NO: 977346 - DNA, 17 bp, Homo sapiens
ataccaaagcacatttt

SEQ ID NO: 977347 - DNA, 12 bp, Homo sapiens
ataccaaatatt

SEQ ID NO: 977348 - DNA, 16 bp, Homo sapiens
ataccaaatattttag

SEQ ID NO: 977349 - DNA, 19 bp, Homo sapiens
ataccaatgaaaaaatgta

SEQ ID NO: 977350 - DNA, 21 bp, Homo sapiens
ataccaatgaaaaaatgtata

SEQ ID NO: 977351 - DNA, 20 bp, Homo sapiens
ataccaatgcttttatcaaa

SEQ ID NO: 977352 - DNA, 17 bp, Homo sapiens
ataccaatgtgttttct

SEQ ID NO: 977353 - DNA, 19 bp, Homo sapiens
ataccaatgtgttttctgt

SEQ ID NO: 977354 - DNA, 16 bp, Homo sapiens
ataccacctttactgt

SEQ ID NO: 977355 - DNA, 17 bp, Homo sapiens
ataccacctttactgtg

SEQ ID NO: 977356 - DNA, 19 bp, Homo sapiens
ataccactctgtaattgca

SEQ ID NO: 977357 - DNA, 17 bp, Homo sapiens
ataccactctttacctt

SEQ ID NO: 977358 - DNA, 13 bp, Homo sapiens
ataccacttgaat

SEQ ID NO: 977359 - DNA, 12 bp, Homo sapiens
ataccagagacc

SEQ ID NO: 977360 - DNA, 16 bp, Homo sapiens
ataccagatgaacatt

SEQ ID NO: 977361 - DNA, 19 bp, Homo sapiens
ataccagatgaacatttca

SEQ ID NO: 977362 - DNA, 18 bp, Homo sapiens
ataccagcttaatagctg

SEQ ID NO: 977363 - DNA, 16 bp, Homo sapiens
ataccaggttgaaaga

SEQ ID NO: 977364 - DNA, 17 bp, Homo sapiens
ataccagtgaaccaaag

SEQ ID NO: 977365 - DNA, 19 bp, Homo sapiens
ataccagtgaaccaaagag

SEQ ID NO: 977366 - DNA, 11 bp, Homo sapiens
ataccagtgtt

SEQ ID NO: 977367 - DNA, 20 bp, Homo sapiens
ataccataggaagacataaa

SEQ ID NO: 977368 - DNA, 19 bp, Homo sapiens
ataccatatgtctgcttct

SEQ ID NO: 977369 - DNA, 14 bp, Homo sapiens
ataccattattatg

SEQ ID NO: 977370 - DNA, 17 bp, Homo sapiens
ataccattattatgtaa

SEQ ID NO: 977371 - DNA, 22 bp, Homo sapiens
ataccattcagatcactgaatt

SEQ ID NO: 977372 - DNA, 14 bp, Homo sapiens
ataccattgaaatc

SEQ ID NO: 977373 - DNA, 22 bp, Homo sapiens
ataccattttttaaggaaacaa

SEQ ID NO: 977374 - DNA, 17 bp, Homo sapiens
atacccaaatgtccctg

SEQ ID NO: 977375 - DNA, 21 bp, Homo sapiens
atacccacacattccagggct

SEQ ID NO: 977376 - DNA, 22 bp, Homo sapiens
atacccacacattccagggctg

SEQ ID NO: 977377 - DNA, 21 bp, Homo sapiens
atacccccgtcggaatggtaa

SEQ ID NO: 977378 - DNA, 20 bp, Homo sapiens
ataccccttattgctgccaa

SEQ ID NO: 977379 - DNA, 19 bp, Homo sapiens
ataccctggccgccccctg

SEQ ID NO: 977380 - DNA, 14 bp, Homo sapiens
ataccgaccatcgt

SEQ ID NO: 977381 - DNA, 18 bp, Homo sapiens
ataccgcaggcgggcgag

SEQ ID NO: 977382 - DNA, 18 bp, Homo sapiens
ataccgcctcgtgccagc

SEQ ID NO: 977383 - DNA, 21 bp, Homo sapiens
ataccgcctcgtgccagcagc

SEQ ID NO: 977384 - DNA, 14 bp, Homo sapiens
ataccgctcagtat

SEQ ID NO: 977385 - DNA, 15 bp, Homo sapiens
atacctaagaagtac

SEQ ID NO: 977386 - DNA, 17 bp, Homo sapiens
atacctaattgtggatg

SEQ ID NO: 977387 - DNA, 19 bp, Homo sapiens
atacctatgtcaacagtat

SEQ ID NO: 977388 - DNA, 18 bp, Homo sapiens
atacctcatcatccaccc

SEQ ID NO: 977389 - DNA, 19 bp, Homo sapiens
atacctcatcatccacccg

SEQ ID NO: 977390 - DNA, 21 bp, Homo sapiens
atacctcatcatccacccgct

SEQ ID NO: 977391 - DNA, 19 bp, Homo sapiens
atacctcctccctaatgct

SEQ ID NO: 977392 - DNA, 15 bp, Homo sapiens
atacctcttagctga

SEQ ID NO: 977393 - DNA, 11 bp, Homo sapiens
atacctgcccc

SEQ ID NO: 977394 - DNA, 12 bp, Homo sapiens
atacctgcccct

SEQ ID NO: 977395 - DNA, 13 bp, Homo sapiens
ataccttatttat

SEQ ID NO: 977396 - DNA, 17 bp, Homo sapiens
ataccttctatgtatta

SEQ ID NO: 977397 - DNA, 13 bp, Homo sapiens
ataccttcttatt

SEQ ID NO: 977398 - DNA, 12 bp, Homo sapiens
atacctttccag

SEQ ID NO: 977399 - DNA, 16 bp, Homo sapiens
atacgacagtacactg

SEQ ID NO: 977400 - DNA, 17 bp, Homo sapiens
atacgagagcagaggtc

SEQ ID NO: 977401 - DNA, 13 bp, Homo sapiens
atacgagtgaccg

SEQ ID NO: 977402 - DNA, 19 bp, Homo sapiens
atacgcaaaaacttccttt

SEQ ID NO: 977403 - DNA, 16 bp, Homo sapiens
atacgcactacatgtg

SEQ ID NO: 977404 - DNA, 21 bp, Homo sapiens
atacgcctgtagtcctagcca

SEQ ID NO: 977405 - DNA, 20 bp, Homo sapiens
atacgctactataaagagaa

SEQ ID NO: 977406 - DNA, 22 bp, Homo sapiens
atacgcttttaatgaaaaggaa

SEQ ID NO: 977407 - DNA, 21 bp, Homo sapiens
atacggaaaaaattgtattga

SEQ ID NO: 977408 - DNA, 19 bp, Homo sapiens
atacgggagtgacccagct

SEQ ID NO: 977409 - DNA, 19 bp, Homo sapiens
atacgggggttgggctaga

SEQ ID NO: 977410 - DNA, 21 bp, Homo sapiens
atacgtagttgtgcttttgtt

SEQ ID NO: 977411 - DNA, 18 bp, Homo sapiens
atacgtataaatatcagt

SEQ ID NO: 977412 - DNA, 19 bp, Homo sapiens
atacgtattacaaacaagt

SEQ ID NO: 977413 - DNA, 20 bp, Homo sapiens
atacgtccgtgtgtcccaga

SEQ ID NO: 977414 - DNA, 21 bp, Homo sapiens
atacgtgaaaattatttgaaa

SEQ ID NO: 977415 - DNA, 21 bp, Homo sapiens
atactaaaagttcttctccaa

SEQ ID NO: 977416 - DNA, 12 bp, Homo sapiens
atactaaagcaa

SEQ ID NO: 977417 - DNA, 13 bp, Homo sapiens
atactaaagcaaa

SEQ ID NO: 977418 - DNA, 21 bp, Homo sapiens
atactaaccagcagaaatgcc

SEQ ID NO: 977419 - DNA, 15 bp, Homo sapiens
atactaacttattta

SEQ ID NO: 977420 - DNA, 14 bp, Homo sapiens
atactaagaaaaga

SEQ ID NO: 977421 - DNA, 21 bp, Homo sapiens
atactaagcattgaatggcta

SEQ ID NO: 977422 - DNA, 18 bp, Homo sapiens
atactaagggaaagaatt

SEQ ID NO: 977423 - DNA, 14 bp, Homo sapiens
atactaatgatgag

SEQ ID NO: 977424 - DNA, 20 bp, Homo sapiens
atactacagtttgttagtat

SEQ ID NO: 977425 - DNA, 15 bp, Homo sapiens
atactacatctttaa

SEQ ID NO: 977426 - DNA, 19 bp, Homo sapiens
atactacctataggaaagt

SEQ ID NO: 977427 - DNA, 18 bp, Homo sapiens
atactactgaaacagatt

SEQ ID NO: 977428 - DNA, 20 bp, Homo sapiens
atactagggagccatttgag

SEQ ID NO: 977429 - DNA, 19 bp, Homo sapiens
atactatgcagtatctctt

SEQ ID NO: 977430 - DNA, 21 bp, Homo sapiens
atactatttaaagcctcctca

SEQ ID NO: 977431 - DNA, 20 bp, Homo sapiens
atactatttagtttttgtaa

SEQ ID NO: 977432 - DNA, 23 bp, Homo sapiens
atactatttagtttttgtaattt

SEQ ID NO: 977433 - DNA, 15 bp, Homo sapiens
atactcaagctgtct

SEQ ID NO: 977434 - DNA, 12 bp, Homo sapiens
atactcacattt

SEQ ID NO: 977435 - DNA, 16 bp, Homo sapiens
atactcagcctgctgc

SEQ ID NO: 977436 - DNA, 19 bp, Homo sapiens
atactcatgaatgaaaata

SEQ ID NO: 977437 - DNA, 19 bp, Homo sapiens
atactcatgaccattagaa

SEQ ID NO: 977438 - DNA, 23 bp, Homo sapiens
atactcattagaattaccatttg

SEQ ID NO: 977439 - DNA, 16 bp, Homo sapiens
atactccatacataac

SEQ ID NO: 977440 - DNA, 15 bp, Homo sapiens
atactccctttaaag

SEQ ID NO: 977441 - DNA, 16 bp, Homo sapiens
atactccctttaaaga

SEQ ID NO: 977442 - DNA, 15 bp, Homo sapiens
atactcctcctttta

SEQ ID NO: 977443 - DNA, 13 bp, Homo sapiens
atactcctgggct

SEQ ID NO: 977444 - DNA, 14 bp, Homo sapiens
atactcctgtcacc

SEQ ID NO: 977445 - DNA, 16 bp, Homo sapiens
atactcctgtcaccta

SEQ ID NO: 977446 - DNA, 21 bp, Homo sapiens
atactcctgtcacctagaacg

SEQ ID NO: 977447 - DNA, 22 bp, Homo sapiens
atactctaaaatggacattttc

SEQ ID NO: 977448 - DNA, 19 bp, Homo sapiens
atactctagaacatgcaca

SEQ ID NO: 977449 - DNA, 21 bp, Homo sapiens
atactctagaacatgcacatt

SEQ ID NO: 977450 - DNA, 17 bp, Homo sapiens
atactctagatgaagtt

SEQ ID NO: 977451 - DNA, 21 bp, Homo sapiens
atactctgccgatctaattac

SEQ ID NO: 977452 - DNA, 16 bp, Homo sapiens
atactctgcttagaat

SEQ ID NO: 977453 - DNA, 15 bp, Homo sapiens
aatacacttcttttg

SEQ ID NO: 977454 - DNA, 17 bp, Homo sapiens
aatacacttcttttgaa

SEQ ID NO: 977455 - DNA, 20 bp, Homo sapiens
aatacacttcttttgaacat

SEQ ID NO: 977456 - DNA, 15 bp, Homo sapiens
aatacagaatcttgt

SEQ ID NO: 977457 - DNA, 21 bp, Homo sapiens
aatacagaattgactgcagtt

SEQ ID NO: 977458 - DNA, 15 bp, Homo sapiens
aatacagactggatg

SEQ ID NO: 977459 - DNA, 18 bp, Homo sapiens
aatacagataattcattt

SEQ ID NO: 977460 - DNA, 15 bp, Homo sapiens
aatacagatcatctt

SEQ ID NO: 977461 - DNA, 16 bp, Homo sapiens
aatacagatcatcttg

SEQ ID NO: 977462 - DNA, 19 bp, Homo sapiens
aatacagccaaagataatc

SEQ ID NO: 977463 - DNA, 24 bp, Homo sapiens
aatacagccaaagataatctctca

SEQ ID NO: 977464 - DNA, 14 bp, Homo sapiens
aatacagctggcta

SEQ ID NO: 977465 - DNA, 18 bp, Homo sapiens
aatacaggaaacagttgc

SEQ ID NO: 977466 - DNA, 12 bp, Homo sapiens
aatacaggaaat

SEQ ID NO: 977467 - DNA, 12 bp, Homo sapiens
atagacactgga

SEQ ID NO: 977468 - DNA, 15 bp, Homo sapiens
atagacactggacat

SEQ ID NO: 977469 - DNA, 14 bp, Homo sapiens
atagacagaagaaa

SEQ ID NO: 977470 - DNA, 16 bp, Homo sapiens
atagacagaagaaaca

SEQ ID NO: 977471 - DNA, 22 bp, Homo sapiens
atagacagtagccaagttatat

SEQ ID NO: 977472 - DNA, 18 bp, Homo sapiens
atagacagtgctgccctg

SEQ ID NO: 977473 - DNA, 14 bp, Homo sapiens
atagacatcagtat

SEQ ID NO: 977474 - DNA, 21 bp, Homo sapiens
atagacatttcaaaattaata

SEQ ID NO: 977475 - DNA, 15 bp, Homo sapiens
atagactaaatgaaa

SEQ ID NO: 977476 - DNA, 21 bp, Homo sapiens
atagactgaggtataaagaca

SEQ ID NO: 977477 - DNA, 15 bp, Homo sapiens
atagacttgggatgg

SEQ ID NO: 977478 - DNA, 14 bp, Homo sapiens
atagactttgtgaa

SEQ ID NO: 977479 - DNA, 12 bp, Homo sapiens
atagagaatgtt

SEQ ID NO: 977480 - DNA, 13 bp, Homo sapiens
atagagaatgttc

SEQ ID NO: 977481 - DNA, 14 bp, Homo sapiens
atagagaatgttcc

SEQ ID NO: 977482 - DNA, 20 bp, Homo sapiens
atagagacaggacagaatgt

SEQ ID NO: 977483 - DNA, 14 bp, Homo sapiens
atagagaggcctgc

SEQ ID NO: 977484 - DNA, 15 bp, Homo sapiens
atagagatgcattca

SEQ ID NO: 977485 - DNA, 16 bp, Homo sapiens
atagagattgtacatt

SEQ ID NO: 977486 - DNA, 14 bp, Homo sapiens
atagagctgtatta

SEQ ID NO: 977487 - DNA, 14 bp, Homo sapiens
atagagctttttaa

SEQ ID NO: 977488 - DNA, 20 bp, Homo sapiens
atagaggcattacttgcttt

SEQ ID NO: 977489 - DNA, 14 bp, Homo sapiens
atagaggccaaggt

SEQ ID NO: 977490 - DNA, 12 bp, Homo sapiens
atagaggcccag

SEQ ID NO: 977491 - DNA, 17 bp, Homo sapiens
atagaggcccaggcacc

SEQ ID NO: 977492 - DNA, 20 bp, Homo sapiens
atagaggctagcttctgctt

SEQ ID NO: 977493 - DNA, 21 bp, Homo sapiens
atagaggcttctccgccagcc

SEQ ID NO: 977494 - DNA, 23 bp, Homo sapiens
atagaggcttctccgccagcctc

SEQ ID NO: 977495 - DNA, 14 bp, Homo sapiens
atagagggccaaga

SEQ ID NO: 977496 - DNA, 14 bp, Homo sapiens
atagaggtgagaaa

SEQ ID NO: 977497 - DNA, 14 bp, Homo sapiens
atagagtatatgca

SEQ ID NO: 977498 - DNA, 22 bp, Homo sapiens
atagagtgtgatgtatgtgtaa

SEQ ID NO: 977499 - DNA, 14 bp, Homo sapiens
atagagtgttatca

SEQ ID NO: 977500 - DNA, 16 bp, Homo sapiens
atagatatcctctccc

SEQ ID NO: 977501 - DNA, 16 bp, Homo sapiens
atagatcaataaatgt

SEQ ID NO: 977502 - DNA, 23 bp, Homo sapiens
atagatcctggttaccactcttt

SEQ ID NO: 977503 - DNA, 14 bp, Homo sapiens
atagatcctttaaa

SEQ ID NO: 977504 - DNA, 19 bp, Homo sapiens
atagatctccagcgtcagc

SEQ ID NO: 977505 - DNA, 13 bp, Homo sapiens
atagatcttctga

SEQ ID NO: 977506 - DNA, 21 bp, Homo sapiens
atagatcttctgaaatgaaac

SEQ ID NO: 977507 - DNA, 22 bp, Homo sapiens
atagatgatggtatgattctat

SEQ ID NO: 977508 - DNA, 19 bp, Homo sapiens
atagatgcaagatatttat

SEQ ID NO: 977509 - DNA, 21 bp, Homo sapiens
atagatgcaagatatttatat

SEQ ID NO: 977510 - DNA, 23 bp, Homo sapiens
atagatgggtctggctgagctga

SEQ ID NO: 977511 - DNA, 22 bp, Homo sapiens
atagatgtagataaactcagaa

SEQ ID NO: 977512 - DNA, 14 bp, Homo sapiens
atagatgtcttttc

SEQ ID NO: 977513 - DNA, 17 bp, Homo sapiens
atagatgtcttttccca

SEQ ID NO: 977514 - DNA, 15 bp, Homo sapiens
atagattaggtttgc

SEQ ID NO: 977515 - DNA, 15 bp, Homo sapiens
atagattattataaa

SEQ ID NO: 977516 - DNA, 15 bp, Homo sapiens
atagattatttcata

SEQ ID NO: 977517 - DNA, 14 bp, Homo sapiens
atagattgtcttaa

SEQ ID NO: 977518 - DNA, 22 bp, Homo sapiens
atagattgttttgccacttaga

SEQ ID NO: 977519 - DNA, 19 bp, Homo sapiens
atagatttaggagcagaaa

SEQ ID NO: 977520 - DNA, 18 bp, Homo sapiens
atagatttagttttgtaa

SEQ ID NO: 977521 - DNA, 14 bp, Homo sapiens
atagatttatttta

SEQ ID NO: 977522 - DNA, 15 bp, Homo sapiens
atagatttattttac

SEQ ID NO: 977523 - DNA, 22 bp, Homo sapiens
atagatttatttttcagttcca

SEQ ID NO: 977524 - DNA, 18 bp, Homo sapiens
atagattttctctggaaa

SEQ ID NO: 977525 - DNA, 21 bp, Homo sapiens
atagattttctctggaaataa

SEQ ID NO: 977526 - DNA, 16 bp, Homo sapiens
atagatttttgattca

SEQ ID NO: 977527 - DNA, 19 bp, Homo sapiens
atagatttttgattcagct

SEQ ID NO: 977528 - DNA, 17 bp, Homo sapiens
atagatttttgtttttg

SEQ ID NO: 977529 - DNA, 14 bp, Homo sapiens
atagcaaatgacat

SEQ ID NO: 977530 - DNA, 16 bp, Homo sapiens
atagcaacactctata

SEQ ID NO: 977531 - DNA, 14 bp, Homo sapiens
atagcaactaatgt

SEQ ID NO: 977532 - DNA, 16 bp, Homo sapiens
atagcaactaatgttt

SEQ ID NO: 977533 - DNA, 23 bp, Homo sapiens
atagcaactaatgtttgaacaaa

SEQ ID NO: 977534 - DNA, 16 bp, Homo sapiens
atagcaagatattgat

SEQ ID NO: 977535 - DNA, 17 bp, Homo sapiens
atagcaagattgcttaa

SEQ ID NO: 977536 - DNA, 18 bp, Homo sapiens
atagcacccctactcaca

SEQ ID NO: 977537 - DNA, 19 bp, Homo sapiens
atagcactaaccaatgcct

SEQ ID NO: 977538 - DNA, 20 bp, Homo sapiens
atagcactaaccaatgcctt

SEQ ID NO: 977539 - DNA, 22 bp, Homo sapiens
atagcagactttcccaaatgta

SEQ ID NO: 977540 - DNA, 19 bp, Homo sapiens
atagcagaggtttaaatgt

SEQ ID NO: 977541 - DNA, 21 bp, Homo sapiens
atagcagagtccttattcttc

SEQ ID NO: 977542 - DNA, 13 bp, Homo sapiens
atagcagcctttc

SEQ ID NO: 977543 - DNA, 12 bp, Homo sapiens
atagcagctttg

SEQ ID NO: 977544 - DNA, 19 bp, Homo sapiens
atagcagctttgtctctgt

SEQ ID NO: 977545 - DNA, 18 bp, Homo sapiens
atagcagtatatgttaat

SEQ ID NO: 977546 - DNA, 16 bp, Homo sapiens
atagcatactgtgtat

SEQ ID NO: 977547 - DNA, 17 bp, Homo sapiens
atagcatactgtgtatg

SEQ ID NO: 977548 - DNA, 16 bp, Homo sapiens
atagcatgaaataaaa

SEQ ID NO: 977549 - DNA, 21 bp, Homo sapiens
atagcatgcttcctttctctc

SEQ ID NO: 977550 - DNA, 22 bp, Homo sapiens
atagcatggggcccctggccca

SEQ ID NO: 977551 - DNA, 15 bp, Homo sapiens
atagcattaactaat

SEQ ID NO: 977552 - DNA, 16 bp, Homo sapiens
atagcattgataatct

SEQ ID NO: 977553 - DNA, 21 bp, Homo sapiens
atagcattgataatcttcagg

SEQ ID NO: 977554 - DNA, 15 bp, Homo sapiens
atagcattgtaaaag

SEQ ID NO: 977555 - DNA, 22 bp, Homo sapiens
atagcattgttttcttttacag

SEQ ID NO: 977556 - DNA, 14 bp, Homo sapiens
atagcatttgccac

SEQ ID NO: 977557 - DNA, 13 bp, Homo sapiens
atagccaaagcca

SEQ ID NO: 977558 - DNA, 15 bp, Homo sapiens
atagccaaagccagg

SEQ ID NO: 977559 - DNA, 22 bp, Homo sapiens
atagccaactgctaatgcaaat

SEQ ID NO: 977560 - DNA, 23 bp, Homo sapiens
atagccacatttggaatactttt

SEQ ID NO: 977561 - DNA, 11 bp, Homo sapiens
atagccagaga

SEQ ID NO: 977562 - DNA, 22 bp, Homo sapiens
atagccagagaggagcacctga

SEQ ID NO: 977563 - DNA, 19 bp, Homo sapiens
atagccagcattcagcaca

SEQ ID NO: 977564 - DNA, 23 bp, Homo sapiens
atagccatgtatcataattacca

SEQ ID NO: 977565 - DNA, 18 bp, Homo sapiens
atagccccagactgggcc

SEQ ID NO: 977566 - DNA, 18 bp, Homo sapiens
atagccctggtgctcctg

SEQ ID NO: 977567 - DNA, 21 bp, Homo sapiens
atagccctggtgctcctgccc

SEQ ID NO: 977568 - DNA, 18 bp, Homo sapiens
atagccctgtcctggtgg

SEQ ID NO: 977569 - DNA, 23 bp, Homo sapiens
atagccctgtcctggtggtattt

SEQ ID NO: 977570 - DNA, 18 bp, Homo sapiens
atagccgggcatggtggc

SEQ ID NO: 977571 - DNA, 20 bp, Homo sapiens
atagcctaagcggctgttta

SEQ ID NO: 977572 - DNA, 13 bp, Homo sapiens
atagcctcatgtt

SEQ ID NO: 977573 - DNA, 16 bp, Homo sapiens
atagcctgcctgatcc

SEQ ID NO: 977574 - DNA, 20 bp, Homo sapiens
atagcctggccaccagccat

SEQ ID NO: 977575 - DNA, 22 bp, Homo sapiens
atagcgccgtgctgtaaataag

SEQ ID NO: 977576 - DNA, 17 bp, Homo sapiens
atagcgtcctgccctgc

SEQ ID NO: 977577 - DNA, 15 bp, Homo sapiens
atagcgtgtgtagat

SEQ ID NO: 977578 - DNA, 14 bp, Homo sapiens
atagcgttcttgta

SEQ ID NO: 977579 - DNA, 15 bp, Homo sapiens
atagctaacatttta

SEQ ID NO: 977580 - DNA, 22 bp, Homo sapiens
atagctaacattttaaataaaa

SEQ ID NO: 977581 - DNA, 13 bp, Homo sapiens
atagctaagtaca

SEQ ID NO: 977582 - DNA, 18 bp, Homo sapiens
atagctaagtacacaata

SEQ ID NO: 977583 - DNA, 19 bp, Homo sapiens
atagctacaatttgttttt

SEQ ID NO: 977584 - DNA, 16 bp, Homo sapiens
atagctacaggaagca

SEQ ID NO: 977585 - DNA, 22 bp, Homo sapiens
aatatatatatatataaaataa

SEQ ID NO: 977586 - DNA, 19 bp, Homo sapiens
aatatatatgatcattgaa

SEQ ID NO: 977587 - DNA, 15 bp, Homo sapiens
aatatatatttttca

SEQ ID NO: 977588 - DNA, 19 bp, Homo sapiens
aatatatatttttcaaata

SEQ ID NO: 977589 - DNA, 22 bp, Homo sapiens
caaattgggacaacagtgcttt

SEQ ID NO: 977590 - DNA, 19 bp, Homo sapiens
caaattgtatcttattata

SEQ ID NO: 977591 - DNA, 19 bp, Homo sapiens
caaatttaaaactgttgga

SEQ ID NO: 977592 - DNA, 13 bp, Homo sapiens
caaatttaaagga

SEQ ID NO: 977593 - DNA, 19 bp, Homo sapiens
caaatttaaaggaaacact

SEQ ID NO: 977594 - DNA, 20 bp, Homo sapiens
caaatttaaaggaaacacta

SEQ ID NO: 977595 - DNA, 20 bp, Homo sapiens
caaatttaaccataaatcaa

SEQ ID NO: 977596 - DNA, 21 bp, Homo sapiens
caaatttagaaactaattgac

SEQ ID NO: 977597 - DNA, 21 bp, Homo sapiens
caaatttattttaatgtaaag

SEQ ID NO: 977598 - DNA, 14 bp, Homo sapiens
caaatttctaaatc

SEQ ID NO: 977599 - DNA, 22 bp, Homo sapiens
caaatttctaaatctccaaaat

SEQ ID NO: 977600 - DNA, 21 bp, Homo sapiens
caaatttctataaatttaaga

SEQ ID NO: 977601 - DNA, 14 bp, Homo sapiens
caaatttgattgat

SEQ ID NO: 977602 - DNA, 17 bp, Homo sapiens
caaatttgattgatttg

SEQ ID NO: 977603 - DNA, 23 bp, Homo sapiens
caaatttgccaccactagagctg

SEQ ID NO: 977604 - DNA, 16 bp, Homo sapiens
caaatttggccttaag

SEQ ID NO: 977605 - DNA, 18 bp, Homo sapiens
caaatttggccttaagaa

SEQ ID NO: 977606 - DNA, 20 bp, Homo sapiens
caaatttggccttaagaact

SEQ ID NO: 977607 - DNA, 16 bp, Homo sapiens
caaattttaaaacatt

SEQ ID NO: 977608 - DNA, 18 bp, Homo sapiens
caaattttaaaacatttt

SEQ ID NO: 977609 - DNA, 15 bp, Homo sapiens
caaattttatctgga

SEQ ID NO: 977610 - DNA, 18 bp, Homo sapiens
caaattttcactgctgct

SEQ ID NO: 977611 - DNA, 14 bp, Homo sapiens
caaattttgcattt

SEQ ID NO: 977612 - DNA, 18 bp, Homo sapiens
caaattttgcatttagtt

SEQ ID NO: 977613 - DNA, 20 bp, Homo sapiens
caaattttgcatttagtttt

SEQ ID NO: 977614 - DNA, 21 bp, Homo sapiens
caaattttggcgaatctcaaa

SEQ ID NO: 977615 - DNA, 17 bp, Homo sapiens
caacaaagtcacagtcg

SEQ ID NO: 977616 - DNA, 22 bp, Homo sapiens
caacaaatattcactggcccct

SEQ ID NO: 977617 - DNA, 13 bp, Homo sapiens
caacaacatcaga

SEQ ID NO: 977618 - DNA, 20 bp, Homo sapiens
caacaacatcagaaagaatt

SEQ ID NO: 977619 - DNA, 20 bp, Homo sapiens
caacaactattttttaagaa

SEQ ID NO: 977620 - DNA, 19 bp, Homo sapiens
caacaagaagaaatatgaa

SEQ ID NO: 977621 - DNA, 23 bp, Homo sapiens
caacaagaagaaatatgaaattc

SEQ ID NO: 977622 - DNA, 18 bp, Homo sapiens
caacaagaagaatttgaa

SEQ ID NO: 977623 - DNA, 21 bp, Homo sapiens
caacaagaagggactgagaga

SEQ ID NO: 977624 - DNA, 23 bp, Homo sapiens
aacaatcaaagcacttggactct

SEQ ID NO: 977625 - DNA, 16 bp, Homo sapiens
aacaatcactattctt

SEQ ID NO: 977626 - DNA, 15 bp, Homo sapiens
aacaatccattcaca

SEQ ID NO: 977627 - DNA, 19 bp, Homo sapiens
aacaatcccaatctttcta

SEQ ID NO: 977628 - DNA, 14 bp, Homo sapiens
aacaatcctttctg

SEQ ID NO: 977629 - DNA, 22 bp, Homo sapiens
aacaatcttaagagcttgatct

SEQ ID NO: 977630 - DNA, 14 bp, Homo sapiens
aacaatcttattcc

SEQ ID NO: 977631 - DNA, 17 bp, Homo sapiens
aacaatcttattccgag

SEQ ID NO: 977632 - DNA, 18 bp, Homo sapiens
aacaatcttattccgagc

SEQ ID NO: 977633 - DNA, 23 bp, Homo sapiens
aacaatcttattccgagcattcc

SEQ ID NO: 977634 - DNA, 12 bp, Homo sapiens
aacaatgaaaac

SEQ ID NO: 977635 - DNA, 18 bp, Homo sapiens
aacaatgaaaacaaataa

SEQ ID NO: 977636 - DNA, 18 bp, Homo sapiens
aacaatgaaattgaccta

SEQ ID NO: 977637 - DNA, 14 bp, Homo sapiens
aacaatgacatcca

SEQ ID NO: 977638 - DNA, 14 bp, Homo sapiens
aacaatgactttta

SEQ ID NO: 977639 - DNA, 19 bp, Homo sapiens
aacaatgacttttaaagat

SEQ ID NO: 977640 - DNA, 18 bp, Homo sapiens
aacaatgccagggcccag

SEQ ID NO: 977641 - DNA, 18 bp, Homo sapiens
aacaatgcctattgtaat

SEQ ID NO: 977642 - DNA, 16 bp, Homo sapiens
aacaatggtgtctctt

SEQ ID NO: 977643 - DNA, 17 bp, Homo sapiens
aacaatgtataaagatt

SEQ ID NO: 977644 - DNA, 19 bp, Homo sapiens
aacaatgtataaagattgt

SEQ ID NO: 977645 - DNA, 22 bp, Homo sapiens
aacaatgtataaagattgtact

SEQ ID NO: 977646 - DNA, 21 bp, Homo sapiens
aacaatgttgtccaacaataa

SEQ ID NO: 977647 - DNA, 22 bp, Homo sapiens
aacaatgttgtccaacaataaa

SEQ ID NO: 977648 - DNA, 23 bp, Homo sapiens
aacaatgttgtccaacaataaac

SEQ ID NO: 977649 - DNA, 17 bp, Homo sapiens
aacaattcagtaacaaa

SEQ ID NO: 977650 - DNA, 22 bp, Homo sapiens
aacaattctaaaatgattgtag

SEQ ID NO: 977651 - DNA, 23 bp, Homo sapiens
aacaattggtaaaactcactgtg

SEQ ID NO: 977652 - DNA, 20 bp, Homo sapiens
aacaattgtgtagccttttt

SEQ ID NO: 977653 - DNA, 13 bp, Homo sapiens
aacaatttatgaa

SEQ ID NO: 977654 - DNA, 13 bp, Homo sapiens
aacaatttctgtc

SEQ ID NO: 977655 - DNA, 18 bp, Homo sapiens
aacaatttggcaattttg

SEQ ID NO: 977656 - DNA, 13 bp, Homo sapiens
aacaattttcaga

SEQ ID NO: 977657 - DNA, 16 bp, Homo sapiens
aacacaaaacaacaaa

SEQ ID NO: 977658 - DNA, 18 bp, Homo sapiens
aacacaaaacaacaaaaa

SEQ ID NO: 977659 - DNA, 21 bp, Homo sapiens
aacacaaaacatttaaataaa

SEQ ID NO: 977660 - DNA, 17 bp, Homo sapiens
aacacaaatgaaaatga

SEQ ID NO: 977661 - DNA, 14 bp, Homo sapiens
aacacaagccacag

SEQ ID NO: 977662 - DNA, 17 bp, Homo sapiens
aacacaagccacagaag

SEQ ID NO: 977663 - DNA, 15 bp, Homo sapiens
aacacaagctggaag

SEQ ID NO: 977664 - DNA, 16 bp, Homo sapiens
aacacacagactttct

SEQ ID NO: 977665 - DNA, 21 bp, Homo sapiens
aacacacagactttctgtgac

SEQ ID NO: 977666 - DNA, 20 bp, Homo sapiens
aacacacagatacacacaca

SEQ ID NO: 977667 - DNA, 23 bp, Homo sapiens
aacacactaccgaatgtgtcttt

SEQ ID NO: 977668 - DNA, 21 bp, Homo sapiens
aacacactgtgtcctggtgct

SEQ ID NO: 977669 - DNA, 14 bp, Homo sapiens
aacacagatattgt

SEQ ID NO: 977670 - DNA, 14 bp, Homo sapiens
aacacagcatgtgc

SEQ ID NO: 977671 - DNA, 17 bp, Homo sapiens
aacacagcatgtgccaa

SEQ ID NO: 977672 - DNA, 16 bp, Homo sapiens
aacacagcatgtgtat

SEQ ID NO: 977673 - DNA, 24 bp, Homo sapiens
aacacagccttccttctgctccca

SEQ ID NO: 977674 - DNA, 22 bp, Homo sapiens
aacacaggcaaaatccttgctt

SEQ ID NO: 977675 - DNA, 15 bp, Homo sapiens
aacacagggttttgt

SEQ ID NO: 977676 - DNA, 14 bp, Homo sapiens
aacacagtgtctgt

SEQ ID NO: 977677 - DNA, 15 bp, Homo sapiens
aacacagtgtctgtt

SEQ ID NO: 977678 - DNA, 16 bp, Homo sapiens
aacacagtgtttcaat

SEQ ID NO: 977679 - DNA, 14 bp, Homo sapiens
aacacagttctggg

SEQ ID NO: 977680 - DNA, 17 bp, Homo sapiens
aacacagttctgggcaa

SEQ ID NO: 977681 - DNA, 20 bp, Homo sapiens
aacacagttttgaaagaaaa

SEQ ID NO: 977682 - DNA, 14 bp, Homo sapiens
aacacatacaaaag

SEQ ID NO: 977683 - DNA, 20 bp, Homo sapiens
aacacatagcgccgtgctgt

SEQ ID NO: 977684 - DNA, 13 bp, Homo sapiens
aacaccacagaca

SEQ ID NO: 977685 - DNA, 18 bp, Homo sapiens
aacaccacagacacacac

SEQ ID NO: 977686 - DNA, 23 bp, Homo sapiens
aacaccacagacacacacacgca

SEQ ID NO: 977687 - DNA, 14 bp, Homo sapiens
aacaccagccccac

SEQ ID NO: 977688 - DNA, 20 bp, Homo sapiens
aacaccataggtagaatgta

SEQ ID NO: 977689 - DNA, 15 bp, Homo sapiens
aacaccattgaaggc

SEQ ID NO: 977690 - DNA, 24 bp, Homo sapiens
aacatcccaaactttaaaatgcga

SEQ ID NO: 977691 - DNA, 22 bp, Homo sapiens
aacatcccacttagccgcaccc

SEQ ID NO: 977692 - DNA, 19 bp, Homo sapiens
aacatccctgtcttaactg

SEQ ID NO: 977693 - DNA, 15 bp, Homo sapiens
aacatcctacaagac

SEQ ID NO: 977694 - DNA, 22 bp, Homo sapiens
aacatcctatcaacaacaaggt

SEQ ID NO: 977695 - DNA, 14 bp, Homo sapiens
aacatcgatatgta

SEQ ID NO: 977696 - DNA, 16 bp, Homo sapiens
aacatcgatatgtata

SEQ ID NO: 977697 - DNA, 18 bp, Homo sapiens
aacatcgcaatagttttt

SEQ ID NO: 977698 - DNA, 15 bp, Homo sapiens
aacatcgtggatgta

SEQ ID NO: 977699 - DNA, 18 bp, Homo sapiens
aacatcgtggatgtagtg

SEQ ID NO: 977700 - DNA, 13 bp, Homo sapiens
aacatctctgaat

SEQ ID NO: 977701 - DNA, 14 bp, Homo sapiens
aacatctctgcagt

SEQ ID NO: 977702 - DNA, 15 bp, Homo sapiens
aacatctctgcagtt

SEQ ID NO: 977703 - DNA, 11 bp, Homo sapiens
aacatctttac

SEQ ID NO: 977704 - DNA, 17 bp, Homo sapiens
aacatctttgtttttaa

SEQ ID NO: 977705 - DNA, 21 bp, Homo sapiens
aacatgaaaaacaaacaaaaa

SEQ ID NO: 977706 - DNA, 14 bp, Homo sapiens
aacatgaacccaaa

SEQ ID NO: 977707 - DNA, 16 bp, Homo sapiens
aacatgaacccaaaaa

SEQ ID NO: 977708 - DNA, 18 bp, Homo sapiens
aacatgaacccaaaaaga

SEQ ID NO: 977709 - DNA, 16 bp, Homo sapiens
aacatgaagcaaacta

SEQ ID NO: 977710 - DNA, 15 bp, Homo sapiens
aacatgaagcataat

SEQ ID NO: 977711 - DNA, 18 bp, Homo sapiens
aacatgaggggacatttt

SEQ ID NO: 977712 - DNA, 23 bp, Homo sapiens
aacatgagtagataatttcaggg

SEQ ID NO: 977713 - DNA, 14 bp, Homo sapiens
aacatgatgaaacc

SEQ ID NO: 977714 - DNA, 22 bp, Homo sapiens
aacatgattttacaagtataac

SEQ ID NO: 977715 - DNA, 20 bp, Homo sapiens
aacatgcacatttatatata

SEQ ID NO: 977716 - DNA, 22 bp, Homo sapiens
aacatgcagctcttcaacatga

SEQ ID NO: 977717 - DNA, 16 bp, Homo sapiens
aacatgcagttcatta

SEQ ID NO: 977718 - DNA, 18 bp, Homo sapiens
aacatgcagttcattatt

SEQ ID NO: 977719 - DNA, 22 bp, Homo sapiens
aacatgcagttcattattttgt

SEQ ID NO: 977720 - DNA, 16 bp, Homo sapiens
aacatgcatactttat

SEQ ID NO: 977721 - DNA, 17 bp, Homo sapiens
aacatgcatactttatt

SEQ ID NO: 977722 - DNA, 17 bp, Homo sapiens
aacatgccgcagggagg

SEQ ID NO: 977723 - DNA, 15 bp, Homo sapiens
aacatgcctgccaaa

SEQ ID NO: 977724 - DNA, 22 bp, Homo sapiens
aacatgctacacactgcatgtt

SEQ ID NO: 977725 - DNA, 20 bp, Homo sapiens
aacatgctgctctggtgcac

SEQ ID NO: 977726 - DNA, 17 bp, Homo sapiens
aacatggaaaacagagt

SEQ ID NO: 977727 - DNA, 15 bp, Homo sapiens
aacatggacttgtat

SEQ ID NO: 977728 - DNA, 16 bp, Homo sapiens
aacatggacttgtata

SEQ ID NO: 977729 - DNA, 19 bp, Homo sapiens
aacatggagaaaccctgtc

SEQ ID NO: 977730 - DNA, 16 bp, Homo sapiens
aacatgggagggatca

SEQ ID NO: 977731 - DNA, 20 bp, Homo sapiens
aacatggttacaatcattgc

SEQ ID NO: 977732 - DNA, 23 bp, Homo sapiens
aacatggttaccatgtctttctc

SEQ ID NO: 977733 - DNA, 16 bp, Homo sapiens
aacatggtttaaaaga

SEQ ID NO: 977734 - DNA, 13 bp, Homo sapiens
aacatgtaaaatc

SEQ ID NO: 977735 - DNA, 17 bp, Homo sapiens
aacatgtaaatacaaat

SEQ ID NO: 977736 - DNA, 16 bp, Homo sapiens
aacatgtacacaaagt

SEQ ID NO: 977737 - DNA, 11 bp, Homo sapiens
aacatgtatgt

SEQ ID NO: 977738 - DNA, 15 bp, Homo sapiens
aacatgtcagtttta

SEQ ID NO: 977739 - DNA, 15 bp, Homo sapiens
aacatgtgtttctga

SEQ ID NO: 977740 - DNA, 19 bp, Homo sapiens
aacatgtgttttcatcatt

SEQ ID NO: 977741 - DNA, 20 bp, Homo sapiens
aacatgtttaaatagcctaa

SEQ ID NO: 977742 - DNA, 21 bp, Homo sapiens
aacatgtttaaatagcctaaa

SEQ ID NO: 977743 - DNA, 21 bp, Homo sapiens
aacatgtttacaggtttgaat

SEQ ID NO: 977744 - DNA, 20 bp, Homo sapiens
aacatgtttacttttcaggg

SEQ ID NO: 977745 - DNA, 21 bp, Homo sapiens
aacattaaaacaatattgttt

SEQ ID NO: 977746 - DNA, 16 bp, Homo sapiens
aacattaaaactcata

SEQ ID NO: 977747 - DNA, 21 bp, Homo sapiens
aacattaagattgaggcctgc

SEQ ID NO: 977748 - DNA, 19 bp, Homo sapiens
aacattaatagcagccttt

SEQ ID NO: 977749 - DNA, 20 bp, Homo sapiens
aacattaatagcagcctttc

SEQ ID NO: 977750 - DNA, 23 bp, Homo sapiens
aacattaatgcctgctttttgga

SEQ ID NO: 977751 - DNA, 17 bp, Homo sapiens
aacattaattttgtgca

SEQ ID NO: 977752 - DNA, 15 bp, Homo sapiens
aacattagatgtcat

SEQ ID NO: 977753 - DNA, 20 bp, Homo sapiens
aacattaggaattgtttata

SEQ ID NO: 977754 - DNA, 20 bp, Homo sapiens
aacattattacttttcctct

SEQ ID NO: 977755 - DNA, 16 bp, Homo sapiens
aacattatttattcag

SEQ ID NO: 977756 - DNA, 15 bp, Homo sapiens
aacattatttttaga

SEQ ID NO: 977757 - DNA, 14 bp, Homo sapiens
aacattcacagccc

SEQ ID NO: 977758 - DNA, 14 bp, Homo sapiens
aacattcacttttg

SEQ ID NO: 977759 - DNA, 14 bp, Homo sapiens
aacattcatgtaac

SEQ ID NO: 977760 - DNA, 16 bp, Homo sapiens
aacattcatgtaactc

SEQ ID NO: 977761 - DNA, 12 bp, Homo sapiens
aacattcccact

SEQ ID NO: 977762 - DNA, 18 bp, Homo sapiens
caaactatgatttatttt

SEQ ID NO: 977763 - DNA, 21 bp, Homo sapiens
caaactatgatttattttggt

SEQ ID NO: 977764 - DNA, 20 bp, Homo sapiens
caaactccccttccctgggg

SEQ ID NO: 977765 - DNA, 22 bp, Homo sapiens
caaactccccttccctggggag

SEQ ID NO: 977766 - DNA, 23 bp, Homo sapiens
caaactccccttccctggggagc

SEQ ID NO: 977767 - DNA, 11 bp, Homo sapiens
caaactcccta

SEQ ID NO: 977768 - DNA, 14 bp, Homo sapiens
caaactcctgacct

SEQ ID NO: 977769 - DNA, 22 bp, Homo sapiens
caaactcctttactgcagcctg

SEQ ID NO: 977770 - DNA, 16 bp, Homo sapiens
caaactctgccagcca

SEQ ID NO: 977771 - DNA, 13 bp, Homo sapiens
caaactctgctgt

SEQ ID NO: 977772 - DNA, 14 bp, Homo sapiens
caaactcttcagtt

SEQ ID NO: 977773 - DNA, 17 bp, Homo sapiens
caaactgaaattcagag

SEQ ID NO: 977774 - DNA, 14 bp, Homo sapiens
caaactgaagccag

SEQ ID NO: 977775 - DNA, 17 bp, Homo sapiens
caaactgagtaaattgg

SEQ ID NO: 977776 - DNA, 19 bp, Homo sapiens
caaactgagtaaattggaa

SEQ ID NO: 977777 - DNA, 14 bp, Homo sapiens
caaactgatctaaa

SEQ ID NO: 977778 - DNA, 17 bp, Homo sapiens
caaactgatctaaaatg

SEQ ID NO: 977779 - DNA, 18 bp, Homo sapiens
caaactgatctaaaatgt

SEQ ID NO: 977780 - DNA, 23 bp, Homo sapiens
caaactgattaaatatttgaaga

SEQ ID NO: 977781 - DNA, 11 bp, Homo sapiens
caaactgcaat

SEQ ID NO: 977782 - DNA, 18 bp, Homo sapiens
caaactgcacacacagct

SEQ ID NO: 977783 - DNA, 22 bp, Homo sapiens
caaactgcacacacagctcctc

SEQ ID NO: 977784 - DNA, 14 bp, Homo sapiens
caaactgcacatct

SEQ ID NO: 977785 - DNA, 12 bp, Homo sapiens
caaactgcagct

SEQ ID NO: 977786 - DNA, 19 bp, Homo sapiens
caaactgccttggcttcag

SEQ ID NO: 977787 - DNA, 16 bp, Homo sapiens
caaactggggcctcca

SEQ ID NO: 977788 - DNA, 21 bp, Homo sapiens
caaactggggcctccagaact

SEQ ID NO: 977789 - DNA, 17 bp, Homo sapiens
caaactggggcctccct

SEQ ID NO: 977790 - DNA, 17 bp, Homo sapiens
caaactggttcacctga

SEQ ID NO: 977791 - DNA, 11 bp, Homo sapiens
caaactgtgaa

SEQ ID NO: 977792 - DNA, 22 bp, Homo sapiens
caaactgtgaagcatttacaga

SEQ ID NO: 977793 - DNA, 13 bp, Homo sapiens
caaactgttgatt

SEQ ID NO: 977794 - DNA, 22 bp, Homo sapiens
caaacttatggacactgcctta

SEQ ID NO: 977795 - DNA, 13 bp, Homo sapiens
caaacttcagaaa

SEQ ID NO: 977796 - DNA, 20 bp, Homo sapiens
caaacttcagaaacccggct

SEQ ID NO: 977797 - DNA, 15 bp, Homo sapiens
caaacttcagactga

SEQ ID NO: 977798 - DNA, 22 bp, Homo sapiens
caaacttggaatttgtaacctc

SEQ ID NO: 977799 - DNA, 16 bp, Homo sapiens
caaacttgtggcctca

SEQ ID NO: 977800 - DNA, 23 bp, Homo sapiens
caaacttgtggcctcaagcaatc

SEQ ID NO: 977801 - DNA, 13 bp, Homo sapiens
caaacttgttcat

SEQ ID NO: 977802 - DNA, 14 bp, Homo sapiens
caaactttaaaatg

SEQ ID NO: 977803 - DNA, 21 bp, Homo sapiens
caaactttaaaatgcgaaatt

SEQ ID NO: 977804 - DNA, 23 bp, Homo sapiens
caaactttattgattcacctcct

SEQ ID NO: 977805 - DNA, 18 bp, Homo sapiens
caaacttttatactcttt

SEQ ID NO: 977806 - DNA, 13 bp, Homo sapiens
caaacttttttat

SEQ ID NO: 977807 - DNA, 21 bp, Homo sapiens
caaagaaaaaaaatcttataa

SEQ ID NO: 977808 - DNA, 13 bp, Homo sapiens
caaagaaaaacaa

SEQ ID NO: 977809 - DNA, 22 bp, Homo sapiens
caaagaaaaacaatgaaattga

SEQ ID NO: 977810 - DNA, 24 bp, Homo sapiens
caaagaaaaagtaaatcaaagatg

SEQ ID NO: 977811 - DNA, 13 bp, Homo sapiens
caaagaaaagtat

SEQ ID NO: 977812 - DNA, 16 bp, Homo sapiens
caaagaaaatgaaatg

SEQ ID NO: 977813 - DNA, 19 bp, Homo sapiens
caaagaaaattcctataag

SEQ ID NO: 977814 - DNA, 16 bp, Homo sapiens
caaagaaacaaagatg

SEQ ID NO: 977815 - DNA, 18 bp, Homo sapiens
caaagaaacaagctgtgc

SEQ ID NO: 977816 - DNA, 13 bp, Homo sapiens
caaagaaagtgta

SEQ ID NO: 977817 - DNA, 17 bp, Homo sapiens
caaagaaggaattctag

SEQ ID NO: 977818 - DNA, 15 bp, Homo sapiens
caaagaatattttga

SEQ ID NO: 977819 - DNA, 15 bp, Homo sapiens
caaagaatgtttata

SEQ ID NO: 977820 - DNA, 13 bp, Homo sapiens
caaagaattacag

SEQ ID NO: 977821 - DNA, 20 bp, Homo sapiens
caaagacaaaagaaacttac

SEQ ID NO: 977822 - DNA, 20 bp, Homo sapiens
caaagacaaattctgtttct

SEQ ID NO: 977823 - DNA, 14 bp, Homo sapiens
caaagacagaatgg

SEQ ID NO: 977824 - DNA, 15 bp, Homo sapiens
caaagaccaagcgct

SEQ ID NO: 977825 - DNA, 13 bp, Homo sapiens
caaagaccacctc

SEQ ID NO: 977826 - DNA, 16 bp, Homo sapiens
caaagaccacctccaa

SEQ ID NO: 977827 - DNA, 15 bp, Homo sapiens
caaagactcctctgg

SEQ ID NO: 977828 - DNA, 15 bp, Homo sapiens
caaagactctgagcc

SEQ ID NO: 977829 - DNA, 13 bp, Homo sapiens
caaagactgtact

SEQ ID NO: 977830 - DNA, 19 bp, Homo sapiens
caaagacttagtatatttt

SEQ ID NO: 977831 - DNA, 14 bp, Homo sapiens
caaagagaagatgc

SEQ ID NO: 977832 - DNA, 16 bp, Homo sapiens
caaagagaagatgcct

SEQ ID NO: 977833 - DNA, 20 bp, Homo sapiens
caaagagaagatgcctgtta

SEQ ID NO: 977834 - DNA, 17 bp, Homo sapiens
caaagagactggagcat

SEQ ID NO: 977835 - DNA, 19 bp, Homo sapiens
caaagagattcgaatgacg

SEQ ID NO: 977836 - DNA, 19 bp, Homo sapiens
caaagagcctcccaccaga

SEQ ID NO: 977837 - DNA, 19 bp, Homo sapiens
caaagagcctttccaaaga

SEQ ID NO: 977838 - DNA, 22 bp, Homo sapiens
caaagagcgagtcccctgcccg

SEQ ID NO: 977839 - DNA, 16 bp, Homo sapiens
caaagagctcccgagg

SEQ ID NO: 977840 - DNA, 15 bp, Homo sapiens
caaagaggctgcccc

SEQ ID NO: 977841 - DNA, 15 bp, Homo sapiens
caaagagggcttcct

SEQ ID NO: 977842 - DNA, 18 bp, Homo sapiens
caaagagggcttcctcta

SEQ ID NO: 977843 - DNA, 20 bp, Homo sapiens
caaagaggggcgctgtcctg

SEQ ID NO: 977844 - DNA, 21 bp, Homo sapiens
caaagaggggcgctgtcctgc

SEQ ID NO: 977845 - DNA, 16 bp, Homo sapiens
caaagaggttggagca

SEQ ID NO: 977846 - DNA, 14 bp, Homo sapiens
caaagaggttttaa

SEQ ID NO: 977847 - DNA, 21 bp, Homo sapiens
caaagaggttttaaaaaaatc

SEQ ID NO: 977848 - DNA, 15 bp, Homo sapiens
caaagagttcaagaa

SEQ ID NO: 977849 - DNA, 16 bp, Homo sapiens
caaagatattttgctt

SEQ ID NO: 977850 - DNA, 22 bp, Homo sapiens
caaagatattttgctttgtgat

SEQ ID NO: 977851 - DNA, 23 bp, Homo sapiens
caaagatattttgctttgtgatt

SEQ ID NO: 977852 - DNA, 16 bp, Homo sapiens
caaagatcaaaataaa

SEQ ID NO: 977853 - DNA, 18 bp, Homo sapiens
caaagatcaaaataaaaa

SEQ ID NO: 977854 - DNA, 12 bp, Homo sapiens
caaagatcactt

SEQ ID NO: 977855 - DNA, 15 bp, Homo sapiens
caaagatgatggaaa

SEQ ID NO: 977856 - DNA, 21 bp, Homo sapiens
caaagatgcgtttgcctcctg

SEQ ID NO: 977857 - DNA, 16 bp, Homo sapiens
caaagatggctcagag

SEQ ID NO: 977858 - DNA, 17 bp, Homo sapiens
caaagatggctcagagg

SEQ ID NO: 977859 - DNA, 18 bp, Homo sapiens
caaagatggctcagaggg

SEQ ID NO: 977860 - DNA, 13 bp, Homo sapiens
caaagatgtcctg

SEQ ID NO: 977861 - DNA, 18 bp, Homo sapiens
caaagatgtttgaaaatg

SEQ ID NO: 977862 - DNA, 16 bp, Homo sapiens
caaagattaaatgtgt

SEQ ID NO: 977863 - DNA, 18 bp, Homo sapiens
caaagattaggtcgtttt

SEQ ID NO: 977864 - DNA, 14 bp, Homo sapiens
caaagattgatttg

SEQ ID NO: 977865 - DNA, 16 bp, Homo sapiens
caaagatttaatctgc

SEQ ID NO: 977866 - DNA, 21 bp, Homo sapiens
caaagattttcaaacaaaata

SEQ ID NO: 977867 - DNA, 22 bp, Homo sapiens
caaagcaaaactcccaatggat

SEQ ID NO: 977868 - DNA, 15 bp, Homo sapiens
caaatcccatttctt

SEQ ID NO: 977869 - DNA, 16 bp, Homo sapiens
caaatccgctctcttc

SEQ ID NO: 977870 - DNA, 20 bp, Homo sapiens
caaatcctggaaggacacag

SEQ ID NO: 977871 - DNA, 14 bp, Homo sapiens
caaatccttcaaaa

SEQ ID NO: 977872 - DNA, 16 bp, Homo sapiens
caaatcctttctgccc

SEQ ID NO: 977873 - DNA, 14 bp, Homo sapiens
caaatcgaatgaaa

SEQ ID NO: 977874 - DNA, 14 bp, Homo sapiens
caaatctaatctct

SEQ ID NO: 977875 - DNA, 18 bp, Homo sapiens
caaatctaatctcttatt

SEQ ID NO: 977876 - DNA, 22 bp, Homo sapiens
caaatctaatctcttattctaa

SEQ ID NO: 977877 - DNA, 14 bp, Homo sapiens
caaatctattactt

SEQ ID NO: 977878 - DNA, 13 bp, Homo sapiens
caaatctattcag

SEQ ID NO: 977879 - DNA, 14 bp, Homo sapiens
caaatctattcaga

SEQ ID NO: 977880 - DNA, 20 bp, Homo sapiens
caaatctattcagacaagca

SEQ ID NO: 977881 - DNA, 13 bp, Homo sapiens
caaatctcagttg

SEQ ID NO: 977882 - DNA, 21 bp, Homo sapiens
caaatctcagttgtttgcttc

SEQ ID NO: 977883 - DNA, 14 bp, Homo sapiens
caaatctgaagatt

SEQ ID NO: 977884 - DNA, 20 bp, Homo sapiens
caaatctgccaccgtggggg

SEQ ID NO: 977885 - DNA, 12 bp, Homo sapiens
caaatctgtata

SEQ ID NO: 977886 - DNA, 15 bp, Homo sapiens
caaatctgtatatgt

SEQ ID NO: 977887 - DNA, 18 bp, Homo sapiens
caaatctgtgctctttca

SEQ ID NO: 977888 - DNA, 18 bp, Homo sapiens
caaatcttgaatttctgc

SEQ ID NO: 977889 - DNA, 13 bp, Homo sapiens
caaatctttaaga

SEQ ID NO: 977890 - DNA, 21 bp, Homo sapiens
caaatgaaactctttcattct

SEQ ID NO: 977891 - DNA, 16 bp, Homo sapiens
caaatgaactttaaaa

SEQ ID NO: 977892 - DNA, 17 bp, Homo sapiens
caaatgaacttttacag

SEQ ID NO: 977893 - DNA, 18 bp, Homo sapiens
caaatgaataatgccttt

SEQ ID NO: 977894 - DNA, 19 bp, Homo sapiens
caaatgacagattctgaca

SEQ ID NO: 977895 - DNA, 18 bp, Homo sapiens
caaatgacccaaagacca

SEQ ID NO: 977896 - DNA, 23 bp, Homo sapiens
caaatgactgtatctaggcattt

SEQ ID NO: 977897 - DNA, 21 bp, Homo sapiens
caaaatctgtccaaaggaggc

SEQ ID NO: 977898 - DNA, 18 bp, Homo sapiens
caaaatcttgatcagtta

SEQ ID NO: 977899 - DNA, 20 bp, Homo sapiens
caaaatcttgttaatgtcat

SEQ ID NO: 977900 - DNA, 11 bp, Homo sapiens
caaaatgaaag

SEQ ID NO: 977901 - DNA, 22 bp, Homo sapiens
caaaatgaatgcaaaattgttt

SEQ ID NO: 977902 - DNA, 14 bp, Homo sapiens
caaaatgacaatga

SEQ ID NO: 977903 - DNA, 15 bp, Homo sapiens
caaaatgacaatgat

SEQ ID NO: 977904 - DNA, 20 bp, Homo sapiens
acctctctgggacctagggg

SEQ ID NO: 977905 - DNA, 14 bp, Homo sapiens
acctctctgtagtt

SEQ ID NO: 977906 - DNA, 15 bp, Homo sapiens
acctctctgtccctt

SEQ ID NO: 977907 - DNA, 16 bp, Homo sapiens
acctctctgtcccttg

SEQ ID NO: 977908 - DNA, 22 bp, Homo sapiens
acctctctgtcccttgctgtat

SEQ ID NO: 977909 - DNA, 22 bp, Homo sapiens
acctctcttatagaatatttat

SEQ ID NO: 977910 - DNA, 23 bp, Homo sapiens
acctctcttatagaatatttatt

SEQ ID NO: 977911 - DNA, 13 bp, Homo sapiens
acctctcttccct

SEQ ID NO: 977912 - DNA, 15 bp, Homo sapiens
acctctcttttcctc

SEQ ID NO: 977913 - DNA, 21 bp, Homo sapiens
acctctgacgcaccactgcca

SEQ ID NO: 977914 - DNA, 17 bp, Homo sapiens
acctctgatttattttg

SEQ ID NO: 977915 - DNA, 20 bp, Homo sapiens
acctctgcagcaataaagca

SEQ ID NO: 977916 - DNA, 18 bp, Homo sapiens
acctctgcccttcccctc

SEQ ID NO: 977917 - DNA, 15 bp, Homo sapiens
acctctgcctcaatg

SEQ ID NO: 977918 - DNA, 14 bp, Homo sapiens
acctctgctctgag

SEQ ID NO: 977919 - DNA, 22 bp, Homo sapiens
acctctgctctgaggcttccag

SEQ ID NO: 977920 - DNA, 16 bp, Homo sapiens
acctctgctgggatgt

SEQ ID NO: 977921 - DNA, 13 bp, Homo sapiens
acctctgcttgga

SEQ ID NO: 977922 - DNA, 14 bp, Homo sapiens
acctctggactggc

SEQ ID NO: 977923 - DNA, 19 bp, Homo sapiens
acctctggccaaatatgca

SEQ ID NO: 977924 - DNA, 21 bp, Homo sapiens
acctctggccaaatatgcact

SEQ ID NO: 977925 - DNA, 13 bp, Homo sapiens
acctctggccctt

SEQ ID NO: 977926 - DNA, 12 bp, Homo sapiens
acctctgggctt

SEQ ID NO: 977927 - DNA, 23 bp, Homo sapiens
acctctggtggctcctcctagga

SEQ ID NO: 977928 - DNA, 14 bp, Homo sapiens
acctctgtatagaa

SEQ ID NO: 977929 - DNA, 23 bp, Homo sapiens
acctctgtctcatcctcctggaa

SEQ ID NO: 977930 - DNA, 22 bp, Homo sapiens
acctctgtcttggctttcatgt

SEQ ID NO: 977931 - DNA, 15 bp, Homo sapiens
acctctgtgaccaac

SEQ ID NO: 977932 - DNA, 20 bp, Homo sapiens
acctctgtgggcactggtgg

SEQ ID NO: 977933 - DNA, 14 bp, Homo sapiens
acctctgttgtcct

SEQ ID NO: 977934 - DNA, 17 bp, Homo sapiens
acctctgttgtcctccc

SEQ ID NO: 977935 - DNA, 14 bp, Homo sapiens
acctcttagctgag

SEQ ID NO: 977936 - DNA, 15 bp, Homo sapiens
acctcttcacccccc

SEQ ID NO: 977937 - DNA, 17 bp, Homo sapiens
acctcttcagaggccct

SEQ ID NO: 977938 - DNA, 22 bp, Homo sapiens
acctcttccccagaaaggagac

SEQ ID NO: 977939 - DNA, 19 bp, Homo sapiens
acctcttccggagatgtag

SEQ ID NO: 977940 - DNA, 14 bp, Homo sapiens
acctcttctggctc

SEQ ID NO: 977941 - DNA, 16 bp, Homo sapiens
acctcttctggctcaa

SEQ ID NO: 977942 - DNA, 19 bp, Homo sapiens
acctcttgagccttgaact

SEQ ID NO: 977943 - DNA, 15 bp, Homo sapiens
acctcttgctgccag

SEQ ID NO: 977944 - DNA, 12 bp, Homo sapiens
acctcttgctgt

SEQ ID NO: 977945 - DNA, 15 bp, Homo sapiens
acctcttgctgtctc

SEQ ID NO: 977946 - DNA, 22 bp, Homo sapiens
acctctttattttttgattgaa

SEQ ID NO: 977947 - DNA, 16 bp, Homo sapiens
acctcttttgttgtcc

SEQ ID NO: 977948 - DNA, 19 bp, Homo sapiens
acctcttttgttgtccttg

SEQ ID NO: 977949 - DNA, 13 bp, Homo sapiens
acctctttttcct

SEQ ID NO: 977950 - DNA, 16 bp, Homo sapiens
acctctttttcctcct

SEQ ID NO: 977951 - DNA, 18 bp, Homo sapiens
acctctttttcctcctgg

SEQ ID NO: 977952 - DNA, 17 bp, Homo sapiens
acctctttttcttacca

SEQ ID NO: 977953 - DNA, 23 bp, Homo sapiens
acctcttttttctatctgccaaa

SEQ ID NO: 977954 - DNA, 15 bp, Homo sapiens
acctgaaaaaaagtt

SEQ ID NO: 977955 - DNA, 17 bp, Homo sapiens
acctgaaacactggacc

SEQ ID NO: 977956 - DNA, 18 bp, Homo sapiens
acctgaaagaacatacat

SEQ ID NO: 977957 - DNA, 15 bp, Homo sapiens
acctgaaagcctgtc

SEQ ID NO: 977958 - DNA, 14 bp, Homo sapiens
acctgaaataatat

SEQ ID NO: 977959 - DNA, 14 bp, Homo sapiens
acctgaacctagga

SEQ ID NO: 977960 - DNA, 20 bp, Homo sapiens
acctgaagagcgctcctctg

SEQ ID NO: 977961 - DNA, 14 bp, Homo sapiens
acctgaagatgtct

SEQ ID NO: 977962 - DNA, 16 bp, Homo sapiens
acctgaagatgtctcc

SEQ ID NO: 977963 - DNA, 17 bp, Homo sapiens
acctgaagatgtctcct

SEQ ID NO: 977964 - DNA, 16 bp, Homo sapiens
acctgaatcagctgga

SEQ ID NO: 977965 - DNA, 22 bp, Homo sapiens
acctgaatcttttttttatata

SEQ ID NO: 977966 - DNA, 17 bp, Homo sapiens
acctgacaatggcagct

SEQ ID NO: 977967 - DNA, 19 bp, Homo sapiens
acctgacaatggcagctag

SEQ ID NO: 977968 - DNA, 16 bp, Homo sapiens
acctgacactcccttg

SEQ ID NO: 977969 - DNA, 17 bp, Homo sapiens
acctgacactcccttgg

SEQ ID NO: 977970 - DNA, 17 bp, Homo sapiens
acctgaccaacatggag

SEQ ID NO: 977971 - DNA, 16 bp, Homo sapiens
acctgacccctgctca

SEQ ID NO: 977972 - DNA, 14 bp, Homo sapiens
acctgacctcttgc

SEQ ID NO: 977973 - DNA, 15 bp, Homo sapiens
acctgacctcttgct

SEQ ID NO: 977974 - DNA, 16 bp, Homo sapiens
acctgacctcttgctg

SEQ ID NO: 977975 - DNA, 19 bp, Homo sapiens
acctgacctcttgctgtct

SEQ ID NO: 977976 - DNA, 17 bp, Homo sapiens
acctgactctgaaatct

SEQ ID NO: 977977 - DNA, 18 bp, Homo sapiens
acctgactctgaaatctg

SEQ ID NO: 977978 - DNA, 19 bp, Homo sapiens
acctgactctgaaatctga

SEQ ID NO: 977979 - DNA, 23 bp, Homo sapiens
acctgactctgaaatctgaagac

SEQ ID NO: 977980 - DNA, 20 bp, Homo sapiens
acctgactggttaacagcag

SEQ ID NO: 977981 - DNA, 16 bp, Homo sapiens
acctgagaccctactg

SEQ ID NO: 977982 - DNA, 19 bp, Homo sapiens
acctgagaccctgggagag

SEQ ID NO: 977983 - DNA, 22 bp, Homo sapiens
acctgagactcacactctctgc

SEQ ID NO: 977984 - DNA, 14 bp, Homo sapiens
acctgagatggagc

SEQ ID NO: 977985 - DNA, 17 bp, Homo sapiens
acctgagatggagctgc

SEQ ID NO: 977986 - DNA, 14 bp, Homo sapiens
acctgagcattcag

SEQ ID NO: 977987 - DNA, 21 bp, Homo sapiens
acctgagcccgcagcccagac

SEQ ID NO: 977988 - DNA, 21 bp, Homo sapiens
acctgagcccggatgcttctc

SEQ ID NO: 977989 - DNA, 21 bp, Homo sapiens
acctgagctattttcctctgg

SEQ ID NO: 977990 - DNA, 14 bp, Homo sapiens
acctgagctgggag

SEQ ID NO: 977991 - DNA, 21 bp, Homo sapiens
acctgaggccaggacgtctgg

SEQ ID NO: 977992 - DNA, 22 bp, Homo sapiens
acctgaggccctcactgagcct

SEQ ID NO: 977993 - DNA, 23 bp, Homo sapiens
acctgaggccctcactgagcctc

SEQ ID NO: 977994 - DNA, 12 bp, Homo sapiens
acctgaggctgt

SEQ ID NO: 977995 - DNA, 16 bp, Homo sapiens
acctgaggtgggccca

SEQ ID NO: 977996 - DNA, 17 bp, Homo sapiens
acctgaggtgggcccag

SEQ ID NO: 977997 - DNA, 18 bp, Homo sapiens
acctgaggtgggcccagg

SEQ ID NO: 977998 - DNA, 19 bp, Homo sapiens
acctgaggtgggcccagga

SEQ ID NO: 977999 - DNA, 21 bp, Homo sapiens
acctgaggtgggcccaggacc

SEQ ID NO: 978000 - DNA, 15 bp, Homo sapiens
acctgaggtgggctg

SEQ ID NO: 978001 - DNA, 15 bp, Homo sapiens
acctgagtatttttt

SEQ ID NO: 978002 - DNA, 22 bp, Homo sapiens
acctgagtcggccccacatggg

SEQ ID NO: 978003 - DNA, 21 bp, Homo sapiens
acctgagtcgtacagaaagct

SEQ ID NO: 978004 - DNA, 19 bp, Homo sapiens
acctgatgtacctgatgct

SEQ ID NO: 978005 - DNA, 20 bp, Homo sapiens
acctgattgatcacacagtg

SEQ ID NO: 978006 - DNA, 16 bp, Homo sapiens
acctgattgtattttt

SEQ ID NO: 978007 - DNA, 17 bp, Homo sapiens
acctgattttttttcct

SEQ ID NO: 978008 - DNA, 20 bp, Homo sapiens
acctgattttttttcctttt

SEQ ID NO: 978009 - DNA, 14 bp, Homo sapiens
acctgcaagcccca

SEQ ID NO: 978010 - DNA, 17 bp, Homo sapiens
acctgcaagccccaggg

SEQ ID NO: 978011 - DNA, 19 bp, Homo sapiens
acctgcaagccccagggcc

SEQ ID NO: 978012 - DNA, 21 bp, Homo sapiens
acctgcaagccccagggcctg

SEQ ID NO: 978013 - DNA, 23 bp, Homo sapiens
acctgcaagccccagggcctggg

SEQ ID NO: 978014 - DNA, 18 bp, Homo sapiens
acctgcacctccccccac

SEQ ID NO: 978015 - DNA, 19 bp, Homo sapiens
acctgcacctccccccact

SEQ ID NO: 978016 - DNA, 22 bp, Homo sapiens
acctgcacctccccccactgca

SEQ ID NO: 978017 - DNA, 23 bp, Homo sapiens
acctgcactggggagcccgtctc

SEQ ID NO: 978018 - DNA, 16 bp, Homo sapiens
caaaccttcctgggag

SEQ ID NO: 978019 - DNA, 21 bp, Homo sapiens
caaacctttcccccttagcac

SEQ ID NO: 978020 - DNA, 16 bp, Homo sapiens
caaacctttctggcct

SEQ ID NO: 978021 - DNA, 22 bp, Homo sapiens
caaacgactaacctatctatga

SEQ ID NO: 978022 - DNA, 23 bp, Homo sapiens
caaacgactaacctatctatgaa

SEQ ID NO: 978023 - DNA, 19 bp, Homo sapiens
caaacgcattaagaggttt

SEQ ID NO: 978024 - DNA, 20 bp, Homo sapiens
caaacggcaacgtagcctgg

SEQ ID NO: 978025 - DNA, 21 bp, Homo sapiens
caaacggcaacgtagcctggg

SEQ ID NO: 978026 - DNA, 22 bp, Homo sapiens
caaactactgaatgaagcagta

SEQ ID NO: 978027 - DNA, 15 bp, Homo sapiens
caaactactgtacat

SEQ ID NO: 978028 - DNA, 18 bp, Homo sapiens
caaactactgtacatttt

SEQ ID NO: 978029 - DNA, 16 bp, Homo sapiens
caaactacttcatttt

SEQ ID NO: 978030 - DNA, 15 bp, Homo sapiens
atttctgataaagtt

SEQ ID NO: 978031 - DNA, 21 bp, Homo sapiens
atttctgataaagttccttaa

SEQ ID NO: 978032 - DNA, 14 bp, Homo sapiens
atttctgatgtctc

SEQ ID NO: 978033 - DNA, 16 bp, Homo sapiens
atttctgatttcataa

SEQ ID NO: 978034 - DNA, 18 bp, Homo sapiens
atttctgcagatggaaag

SEQ ID NO: 978035 - DNA, 17 bp, Homo sapiens
atttctgccatttcatg

SEQ ID NO: 978036 - DNA, 19 bp, Homo sapiens
atttctgccatttcatgtc

SEQ ID NO: 978037 - DNA, 13 bp, Homo sapiens
atttctgctctgg

SEQ ID NO: 978038 - DNA, 15 bp, Homo sapiens
atttctgctcttcca

SEQ ID NO: 978039 - DNA, 14 bp, Homo sapiens
atttctggcctcct

SEQ ID NO: 978040 - DNA, 18 bp, Homo sapiens
atttctgggatatttaac

SEQ ID NO: 978041 - DNA, 18 bp, Homo sapiens
atttctgggtcttttgct

SEQ ID NO: 978042 - DNA, 20 bp, Homo sapiens
atttctgggtcttttgctac

SEQ ID NO: 978043 - DNA, 12 bp, Homo sapiens
atttctggttga

SEQ ID NO: 978044 - DNA, 13 bp, Homo sapiens
atttctggttgat

SEQ ID NO: 978045 - DNA, 15 bp, Homo sapiens
atttctggttgattt

SEQ ID NO: 978046 - DNA, 13 bp, Homo sapiens
atttctgtatact

SEQ ID NO: 978047 - DNA, 16 bp, Homo sapiens
atttctgtatactgta

SEQ ID NO: 978048 - DNA, 18 bp, Homo sapiens
atttctgtatactgtaaa

SEQ ID NO: 978049 - DNA, 14 bp, Homo sapiens
atttctgtatattt

SEQ ID NO: 978050 - DNA, 18 bp, Homo sapiens
atttctgtatatttgtca

SEQ ID NO: 978051 - DNA, 20 bp, Homo sapiens
atttctgtatatttgtcatg

SEQ ID NO: 978052 - DNA, 21 bp, Homo sapiens
atttctgtcacagtaaaaata

SEQ ID NO: 978053 - DNA, 23 bp, Homo sapiens
atttctgtcacagtaaaaataaa

SEQ ID NO: 978054 - DNA, 14 bp, Homo sapiens
atttctgtctctaa

SEQ ID NO: 978055 - DNA, 15 bp, Homo sapiens
atttctgtctctaac

SEQ ID NO: 978056 - DNA, 16 bp, Homo sapiens
atttctgtctctaacc

SEQ ID NO: 978057 - DNA, 15 bp, Homo sapiens
atttctgtgttgcca

SEQ ID NO: 978058 - DNA, 20 bp, Homo sapiens
atttctgttatttttaagct

SEQ ID NO: 978059 - DNA, 23 bp, Homo sapiens
atttctgttatttttaagctttt

SEQ ID NO: 978060 - DNA, 12 bp, Homo sapiens
atttctgttctc

SEQ ID NO: 978061 - DNA, 12 bp, Homo sapiens
atttctgtttag

SEQ ID NO: 978062 - DNA, 23 bp, Homo sapiens
atttcttaaataatgcttcagat

SEQ ID NO: 978063 - DNA, 13 bp, Homo sapiens
atttcttaaatta

SEQ ID NO: 978064 - DNA, 15 bp, Homo sapiens
atttcttaaattatt

SEQ ID NO: 978065 - DNA, 19 bp, Homo sapiens
atttcttaacttcttgctt

SEQ ID NO: 978066 - DNA, 18 bp, Homo sapiens
atttcttaattattataa

SEQ ID NO: 978067 - DNA, 23 bp, Homo sapiens
atttcttaattattataaaaata

SEQ ID NO: 978068 - DNA, 13 bp, Homo sapiens
atttcttatcaca

SEQ ID NO: 978069 - DNA, 13 bp, Homo sapiens
atttcttatgtga

SEQ ID NO: 978070 - DNA, 18 bp, Homo sapiens
atttcttatgtgacatta

SEQ ID NO: 978071 - DNA, 19 bp, Homo sapiens
atttcttatgtgacattaa

SEQ ID NO: 978072 - DNA, 21 bp, Homo sapiens
atttcttatgtgacattaaca

SEQ ID NO: 978073 - DNA, 19 bp, Homo sapiens
atttcttcaaatctcagca

SEQ ID NO: 978074 - DNA, 20 bp, Homo sapiens
atttcttcaaatctcagcaa

SEQ ID NO: 978075 - DNA, 22 bp, Homo sapiens
atttcttcaaatctcagcaaag

SEQ ID NO: 978076 - DNA, 17 bp, Homo sapiens
atttcttcataggtaga

SEQ ID NO: 978077 - DNA, 20 bp, Homo sapiens
atttcttcatgtgatgtcat

SEQ ID NO: 978078 - DNA, 14 bp, Homo sapiens
acccctgtgctccg

SEQ ID NO: 978079 - DNA, 22 bp, Homo sapiens
acccctgtgctccgtgcctcca

SEQ ID NO: 978080 - DNA, 13 bp, Homo sapiens
acccctgtggagc

SEQ ID NO: 978081 - DNA, 14 bp, Homo sapiens
accccttagcctcc

SEQ ID NO: 978082 - DNA, 14 bp, Homo sapiens
accccttattgctg

SEQ ID NO: 978083 - DNA, 16 bp, Homo sapiens
accccttattgctgcc

SEQ ID NO: 978084 - DNA, 15 bp, Homo sapiens
accccttccagatca

SEQ ID NO: 978085 - DNA, 18 bp, Homo sapiens
accccttccatgtggaga

SEQ ID NO: 978086 - DNA, 15 bp, Homo sapiens
accccttccccactg

SEQ ID NO: 978087 - DNA, 16 bp, Homo sapiens
accccttccccactgc

SEQ ID NO: 978088 - DNA, 20 bp, Homo sapiens
accccttccccactgcctgc

SEQ ID NO: 978089 - DNA, 22 bp, Homo sapiens
accccttccccactgcctgccc

SEQ ID NO: 978090 - DNA, 23 bp, Homo sapiens
accccttccccaggcccaccatc

SEQ ID NO: 978091 - DNA, 10 bp, Homo sapiens
accccttcct

SEQ ID NO: 978092 - DNA, 16 bp, Homo sapiens
accccttcctgtcctg

SEQ ID NO: 978093 - DNA, 20 bp, Homo sapiens
accccttcctgtcctgcctc

SEQ ID NO: 978094 - DNA, 21 bp, Homo sapiens
accccttcctgtcctgcctcc

SEQ ID NO: 978095 - DNA, 22 bp, Homo sapiens
accccttcctttcctctgcagc

SEQ ID NO: 978096 - DNA, 24 bp, Homo sapiens
accccttcctttcctctgcagcac

SEQ ID NO: 978097 - DNA, 18 bp, Homo sapiens
accccttcgacatgctgc

SEQ ID NO: 978098 - DNA, 19 bp, Homo sapiens
accccttcgacatgctgcc

SEQ ID NO: 978099 - DNA, 20 bp, Homo sapiens
accccttcgacatgctgcca

SEQ ID NO: 978100 - DNA, 12 bp, Homo sapiens
accccttctctc

SEQ ID NO: 978101 - DNA, 15 bp, Homo sapiens
accccttctctcctc

SEQ ID NO: 978102 - DNA, 23 bp, Homo sapiens
accccttctctcctccccaaatc

SEQ ID NO: 978103 - DNA, 19 bp, Homo sapiens
accccttctttgcagggct

SEQ ID NO: 978104 - DNA, 18 bp, Homo sapiens
accccttggaaatgtctg

SEQ ID NO: 978105 - DNA, 21 bp, Homo sapiens
accccttggaaatgtctgctg

SEQ ID NO: 978106 - DNA, 22 bp, Homo sapiens
accccttggaaatgtctgctgg

SEQ ID NO: 978107 - DNA, 14 bp, Homo sapiens
accccttggcccct

SEQ ID NO: 978108 - DNA, 15 bp, Homo sapiens
accccttggcccctc

SEQ ID NO: 978109 - DNA, 20 bp, Homo sapiens
accccttgttgcactgcccc

SEQ ID NO: 978110 - DNA, 21 bp, Homo sapiens
accccttgttgcactgccccc

SEQ ID NO: 978111 - DNA, 20 bp, Homo sapiens
acccctttcctccccataca

SEQ ID NO: 978112 - DNA, 22 bp, Homo sapiens
acccctttcctccccatacaca

SEQ ID NO: 978113 - DNA, 23 bp, Homo sapiens
acccctttcctccccatacacac

SEQ ID NO: 978114 - DNA, 21 bp, Homo sapiens
acccctttctagaccaataaa

SEQ ID NO: 978115 - DNA, 13 bp, Homo sapiens
acccctttcttct

SEQ ID NO: 978116 - DNA, 20 bp, Homo sapiens
acccgaaagcatcactgcct

SEQ ID NO: 978117 - DNA, 20 bp, Homo sapiens
acccgaagtcctgtcactga

SEQ ID NO: 978118 - DNA, 21 bp, Homo sapiens
acccgagcccagctacattcc

SEQ ID NO: 978119 - DNA, 13 bp, Homo sapiens
acccgaggcccag

SEQ ID NO: 978120 - DNA, 15 bp, Homo sapiens
acccgagtacctcca

SEQ ID NO: 978121 - DNA, 21 bp, Homo sapiens
acccgagtcattcgttctgtg

SEQ ID NO: 978122 - DNA, 12 bp, Homo sapiens
acccgatgctgc

SEQ ID NO: 978123 - DNA, 22 bp, Homo sapiens
acccgatgctgctttcccctgt

SEQ ID NO: 978124 - DNA, 23 bp, Homo sapiens
acccgcagcgcccccatctgtct

SEQ ID NO: 978125 - DNA, 15 bp, Homo sapiens
acccgccagccccgc

SEQ ID NO: 978126 - DNA, 16 bp, Homo sapiens
acccgccagccccgct

SEQ ID NO: 978127 - DNA, 19 bp, Homo sapiens
acccgccgcctcccacggc

SEQ ID NO: 978128 - DNA, 23 bp, Homo sapiens
acccgcctctcccgtcagggccc

SEQ ID NO: 978129 - DNA, 18 bp, Homo sapiens
acccgctcatcactggat

SEQ ID NO: 978130 - DNA, 12 bp, Homo sapiens
acccgctctgga

SEQ ID NO: 978131 - DNA, 14 bp, Homo sapiens
acccgctgcccctc

SEQ ID NO: 978132 - DNA, 23 bp, Homo sapiens
acccggacaggtggggcctcagc

SEQ ID NO: 978133 - DNA, 22 bp, Homo sapiens
acccggagctaacactggcccc

SEQ ID NO: 978134 - DNA, 16 bp, Homo sapiens
acccggccacagctgc

SEQ ID NO: 978135 - DNA, 20 bp, Homo sapiens
acccggccacagctgctgga

SEQ ID NO: 978136 - DNA, 22 bp, Homo sapiens
acccggcccagagaccccttcc

SEQ ID NO: 978137 - DNA, 16 bp, Homo sapiens
acccggcttcctgtgc

SEQ ID NO: 978138 - DNA, 14 bp, Homo sapiens
acccgggctgcctg

SEQ ID NO: 978139 - DNA, 18 bp, Homo sapiens
acccgggctgcctgcccc

SEQ ID NO: 978140 - DNA, 19 bp, Homo sapiens
acccggggccagagacata

SEQ ID NO: 978141 - DNA, 18 bp, Homo sapiens
acccgggggagcccagtg

SEQ ID NO: 978142 - DNA, 15 bp, Homo sapiens
acccggggtctcctg

SEQ ID NO: 978143 - DNA, 18 bp, Homo sapiens
acccggtgctccctctgt

SEQ ID NO: 978144 - DNA, 22 bp, Homo sapiens
acccggttattcgcccacccga

SEQ ID NO: 978145 - DNA, 15 bp, Homo sapiens
acccgtaggcagcct

SEQ ID NO: 978146 - DNA, 20 bp, Homo sapiens
acccgtaggcagcctctctg

SEQ ID NO: 978147 - DNA, 14 bp, Homo sapiens
acccgtccattcag

SEQ ID NO: 978148 - DNA, 14 bp, Homo sapiens
acccgtcctccctc

SEQ ID NO: 978149 - DNA, 19 bp, Homo sapiens
acccgtgacagtggctgac

SEQ ID NO: 978150 - DNA, 16 bp, Homo sapiens
acccgtgcctgggccc

SEQ ID NO: 978151 - DNA, 22 bp, Homo sapiens
acccgtgcctgggcccctcccc

SEQ ID NO: 978152 - DNA, 18 bp, Homo sapiens
acccgtggggtgctgccc

SEQ ID NO: 978153 - DNA, 20 bp, Homo sapiens
acccgttctgctggcctgga

SEQ ID NO: 978154 - DNA, 22 bp, Homo sapiens
accctaaagcaaatctgccacc

SEQ ID NO: 978155 - DNA, 16 bp, Homo sapiens
accctaaatcttgact

SEQ ID NO: 978156 - DNA, 14 bp, Homo sapiens
accctaagatgaag

SEQ ID NO: 978157 - DNA, 14 bp, Homo sapiens
accctaagggcagc

SEQ ID NO: 978158 - DNA, 21 bp, Homo sapiens
accctaatctttcacttgaaa

SEQ ID NO: 978159 - DNA, 18 bp, Homo sapiens
accctaattttgtacata

SEQ ID NO: 978160 - DNA, 15 bp, Homo sapiens
accctaccagctcct

SEQ ID NO: 978161 - DNA, 17 bp, Homo sapiens
accctaccagctcctcc

SEQ ID NO: 978162 - DNA, 22 bp, Homo sapiens
accctaccagctcctccagccc

SEQ ID NO: 978163 - DNA, 13 bp, Homo sapiens
accctacctgtgc

SEQ ID NO: 978164 - DNA, 16 bp, Homo sapiens
accctacctgtgcctg

SEQ ID NO: 978165 - DNA, 17 bp, Homo sapiens
accctactctggatggt

SEQ ID NO: 978166 - DNA, 20 bp, Homo sapiens
accctactttgcttccgcca

SEQ ID NO: 978167 - DNA, 13 bp, Homo sapiens
attttaaagttag

SEQ ID NO: 978168 - DNA, 23 bp, Homo sapiens
attttaaagttcttattttagta

SEQ ID NO: 978169 - DNA, 11 bp, Homo sapiens
attttaaataa

SEQ ID NO: 978170 - DNA, 19 bp, Homo sapiens
attttaaatataaatagct

SEQ ID NO: 978171 - DNA, 21 bp, Homo sapiens
attttaaatctaaatctattt

SEQ ID NO: 978172 - DNA, 13 bp, Homo sapiens
attttaaatgaaa

SEQ ID NO: 978173 - DNA, 15 bp, Homo sapiens
attttaaatgaaagt

SEQ ID NO: 978174 - DNA, 18 bp, Homo sapiens
attttaaatgaagtgatt

SEQ ID NO: 978175 - DNA, 13 bp, Homo sapiens
attttaacaaaag

SEQ ID NO: 978176 - DNA, 15 bp, Homo sapiens
attttaacaataact

SEQ ID NO: 978177 - DNA, 15 bp, Homo sapiens
attttaacactttgt

SEQ ID NO: 978178 - DNA, 18 bp, Homo sapiens
attttaacactttgtatt

SEQ ID NO: 978179 - DNA, 20 bp, Homo sapiens
attttaacctagatgtttaa

SEQ ID NO: 978180 - DNA, 16 bp, Homo sapiens
attttaactaaatttt

SEQ ID NO: 978181 - DNA, 20 bp, Homo sapiens
attttaactgccaatcctta

SEQ ID NO: 978182 - DNA, 12 bp, Homo sapiens
attttaagaaag

SEQ ID NO: 978183 - DNA, 17 bp, Homo sapiens
attttaagaaagagaat

SEQ ID NO: 978184 - DNA, 19 bp, Homo sapiens
attttaagaaagagaatga

SEQ ID NO: 978185 - DNA, 15 bp, Homo sapiens
attttaagaagacat

SEQ ID NO: 978186 - DNA, 20 bp, Homo sapiens
attttaagacgtgtttgtgt

SEQ ID NO: 978187 - DNA, 14 bp, Homo sapiens
attttaagagaaaa

SEQ ID NO: 978188 - DNA, 16 bp, Homo sapiens
attttaagggggaaaa

SEQ ID NO: 978189 - DNA, 14 bp, Homo sapiens
attttaagtattgc

SEQ ID NO: 978190 - DNA, 20 bp, Homo sapiens
attttaagtattgcatctgt

SEQ ID NO: 978191 - DNA, 11 bp, Homo sapiens
attttaagtgc

SEQ ID NO: 978192 - DNA, 13 bp, Homo sapiens
attttaagtgctt

SEQ ID NO: 978193 - DNA, 17 bp, Homo sapiens
attttaagtgctttgta

SEQ ID NO: 978194 - DNA, 18 bp, Homo sapiens
attttaagtgctttgtaa

SEQ ID NO: 978195 - DNA, 20 bp, Homo sapiens
attttaagtgctttgtaatg

SEQ ID NO: 978196 - DNA, 10 bp, Homo sapiens
attttaatac

SEQ ID NO: 978197 - DNA, 14 bp, Homo sapiens
attttaatagaatt

SEQ ID NO: 978198 - DNA, 20 bp, Homo sapiens
attttaatagggaatatatc

SEQ ID NO: 978199 - DNA, 17 bp, Homo sapiens
attttaatattaacttt

SEQ ID NO: 978200 - DNA, 16 bp, Homo sapiens
attttaatattttgta

SEQ ID NO: 978201 - DNA, 14 bp, Homo sapiens
attttaatcaagtt

SEQ ID NO: 978202 - DNA, 15 bp, Homo sapiens
attttaatcccctgc

SEQ ID NO: 978203 - DNA, 15 bp, Homo sapiens
attttaatgaatatt

SEQ ID NO: 978204 - DNA, 19 bp, Homo sapiens
attttaatgtatatttgct

SEQ ID NO: 978205 - DNA, 13 bp, Homo sapiens
attttaattctct

SEQ ID NO: 978206 - DNA, 12 bp, Homo sapiens
attttaatttat

SEQ ID NO: 978207 - DNA, 18 bp, Homo sapiens
attttaatttatgagttt

SEQ ID NO: 978208 - DNA, 14 bp, Homo sapiens
attttaatttcagg

SEQ ID NO: 978209 - DNA, 16 bp, Homo sapiens
attttaatttcaggaa

SEQ ID NO: 978210 - DNA, 18 bp, Homo sapiens
attttaatttcaggaaaa

SEQ ID NO: 978211 - DNA, 11 bp, Homo sapiens
attttacaaaa

SEQ ID NO: 978212 - DNA, 15 bp, Homo sapiens
attttacaaaagatg

SEQ ID NO: 978213 - DNA, 16 bp, Homo sapiens
attttacaaaagatgt

SEQ ID NO: 978214 - DNA, 22 bp, Homo sapiens
attttacagttaaggaatataa

SEQ ID NO: 978215 - DNA, 23 bp, Homo sapiens
attttacatgaagctgtataatt

SEQ ID NO: 978216 - DNA, 12 bp, Homo sapiens
attttacatgac

SEQ ID NO: 978217 - DNA, 14 bp, Homo sapiens
attttaccaaagca

SEQ ID NO: 978218 - DNA, 17 bp, Homo sapiens
attttaccaaagcatca

SEQ ID NO: 978219 - DNA, 21 bp, Homo sapiens
attttaccaagagtaacttta

SEQ ID NO: 978220 - DNA, 21 bp, Homo sapiens
attttaccatcacacatgttc

SEQ ID NO: 978221 - DNA, 17 bp, Homo sapiens
attttacctctctctgg

SEQ ID NO: 978222 - DNA, 18 bp, Homo sapiens
attttacctctctctggg

SEQ ID NO: 978223 - DNA, 18 bp, Homo sapiens
attttacctcttattgca

SEQ ID NO: 978224 - DNA, 13 bp, Homo sapiens
attttacttccat

SEQ ID NO: 978225 - DNA, 13 bp, Homo sapiens
attttactttgta

SEQ ID NO: 978226 - DNA, 17 bp, Homo sapiens
attttactttttcctgg

SEQ ID NO: 978227 - DNA, 24 bp, Homo sapiens
attttagaaactacaaatataggt

SEQ ID NO: 978228 - DNA, 13 bp, Homo sapiens
attttagaaatat

SEQ ID NO: 978229 - DNA, 15 bp, Homo sapiens
attttagaaatattc

SEQ ID NO: 978230 - DNA, 16 bp, Homo sapiens
attttagaataaattc

SEQ ID NO: 978231 - DNA, 23 bp, Homo sapiens
attttagagcataccagtactca

SEQ ID NO: 978232 - DNA, 15 bp, Homo sapiens
attttagatgttatt

SEQ ID NO: 978233 - DNA, 13 bp, Homo sapiens
attttagcagaga

SEQ ID NO: 978234 - DNA, 14 bp, Homo sapiens
attttagcagttct

SEQ ID NO: 978235 - DNA, 12 bp, Homo sapiens
attttagcattt

SEQ ID NO: 978236 - DNA, 18 bp, Homo sapiens
attttagcccagtgtttt

SEQ ID NO: 978237 - DNA, 18 bp, Homo sapiens
attttagccttaaatttt

SEQ ID NO: 978238 - DNA, 16 bp, Homo sapiens
attttagctgcagaac

SEQ ID NO: 978239 - DNA, 16 bp, Homo sapiens
attttagcttcagttg

SEQ ID NO: 978240 - DNA, 20 bp, Homo sapiens
attttaggaaatttaagact

SEQ ID NO: 978241 - DNA, 15 bp, Homo sapiens
attttaggaacttca

SEQ ID NO: 978242 - DNA, 18 bp, Homo sapiens
attttaggaacttcagag

SEQ ID NO: 978243 - DNA, 16 bp, Homo sapiens
attttagggctgtaga

SEQ ID NO: 978244 - DNA, 18 bp, Homo sapiens
attttagtaatttcctag

SEQ ID NO: 978245 - DNA, 19 bp, Homo sapiens
attttagtaatttcctaga

SEQ ID NO: 978246 - DNA, 13 bp, Homo sapiens
attttagtattca

SEQ ID NO: 978247 - DNA, 14 bp, Homo sapiens
attttagtattcat

SEQ ID NO: 978248 - DNA, 12 bp, Homo sapiens
attttagtgtat

SEQ ID NO: 978249 - DNA, 13 bp, Homo sapiens
attttagtgtatt

SEQ ID NO: 978250 - DNA, 18 bp, Homo sapiens
attttagtgtattaatca

SEQ ID NO: 978251 - DNA, 23 bp, Homo sapiens
attttagtttttcattaaataaa

SEQ ID NO: 978252 - DNA, 21 bp, Homo sapiens
attttataacatgttaaaatg

SEQ ID NO: 978253 - DNA, 14 bp, Homo sapiens
attttataagaaaa

SEQ ID NO: 978254 - DNA, 20 bp, Homo sapiens
attttataagaaaaactttt

SEQ ID NO: 978255 - DNA, 18 bp, Homo sapiens
attttatactgtacatgc

SEQ ID NO: 978256 - DNA, 18 bp, Homo sapiens
attttatagctcagttta

SEQ ID NO: 978257 - DNA, 18 bp, Homo sapiens
attttatagtgtgttgtg

SEQ ID NO: 978258 - DNA, 19 bp, Homo sapiens
attttatataataaagtat

SEQ ID NO: 978259 - DNA, 20 bp, Homo sapiens
attttatatgattttctcca

SEQ ID NO: 978260 - DNA, 15 bp, Homo sapiens
attttatatgcttac

SEQ ID NO: 978261 - DNA, 15 bp, Homo sapiens
attttatatgtcaaa

SEQ ID NO: 978262 - DNA, 16 bp, Homo sapiens
attttatatgtcaaag

SEQ ID NO: 978263 - DNA, 15 bp, Homo sapiens
attttatatgttcat

SEQ ID NO: 978264 - DNA, 18 bp, Homo sapiens
attttatattacactaca

SEQ ID NO: 978265 - DNA, 19 bp, Homo sapiens
attttatatttttgtacat

SEQ ID NO: 978266 - DNA, 22 bp, Homo sapiens
attttatatttttgtacatatt

SEQ ID NO: 978267 - DNA, 13 bp, Homo sapiens
attttatcattaa

SEQ ID NO: 978268 - DNA, 19 bp, Homo sapiens
attttatcattaaaaatta

SEQ ID NO: 978269 - DNA, 15 bp, Homo sapiens
attttatctgtgaat

SEQ ID NO: 978270 - DNA, 14 bp, Homo sapiens
attttatgaacatt

SEQ ID NO: 978271 - DNA, 17 bp, Homo sapiens
attttatgaacattgta

SEQ ID NO: 978272 - DNA, 18 bp, Homo sapiens
attttatgaacattgtac

SEQ ID NO: 978273 - DNA, 19 bp, Homo sapiens
attttatgaacattgtact

SEQ ID NO: 978274 - DNA, 17 bp, Homo sapiens
attttatgaatatcatt

SEQ ID NO: 978275 - DNA, 16 bp, Homo sapiens
attttatgcacagcct

SEQ ID NO: 978276 - DNA, 23 bp, Homo sapiens
attttatggttatgtttttctgt

SEQ ID NO: 978277 - DNA, 22 bp, Homo sapiens
attttatgttaagggaagaatt

SEQ ID NO: 978278 - DNA, 15 bp, Homo sapiens
attttattactgttt

SEQ ID NO: 978279 - DNA, 15 bp, Homo sapiens
attttattatgcatg

SEQ ID NO: 978280 - DNA, 17 bp, Homo sapiens
attttattatgcatgaa

SEQ ID NO: 978281 - DNA, 18 bp, Homo sapiens
attttattcaagaatgcc

SEQ ID NO: 978282 - DNA, 20 bp, Homo sapiens
attttattctttaagttcac

SEQ ID NO: 978283 - DNA, 13 bp, Homo sapiens
attttattgactg

SEQ ID NO: 978284 - DNA, 20 bp, Homo sapiens
attttattgtataaaaagtt

SEQ ID NO: 978285 - DNA, 15 bp, Homo sapiens
attttattgtgtaat

SEQ ID NO: 978286 - DNA, 17 bp, Homo sapiens
attttatttcaatgtaa

SEQ ID NO: 978287 - DNA, 18 bp, Homo sapiens
attttatttcaatgtaat

SEQ ID NO: 978288 - DNA, 15 bp, Homo sapiens
attttatttctattt

SEQ ID NO: 978289 - DNA, 14 bp, Homo sapiens
attttatttgacaa

SEQ ID NO: 978290 - DNA, 12 bp, Homo sapiens
attttatttgct

SEQ ID NO: 978291 - DNA, 15 bp, Homo sapiens
attttatttgcttat

SEQ ID NO: 978292 - DNA, 13 bp, Homo sapiens
attttatttgtat

SEQ ID NO: 978293 - DNA, 15 bp, Homo sapiens
accctagaagaaaac

SEQ ID NO: 978294 - DNA, 19 bp, Homo sapiens
accctaggttcccggtccc

SEQ ID NO: 978295 - DNA, 22 bp, Homo sapiens
accctaggttcccggtcccgag

SEQ ID NO: 978296 - DNA, 16 bp, Homo sapiens
accctaggttccctgt

SEQ ID NO: 978297 - DNA, 18 bp, Homo sapiens
accctaggttccctgttc

SEQ ID NO: 978298 - DNA, 23 bp, Homo sapiens
accctaggttccctgttcttcct

SEQ ID NO: 978299 - DNA, 17 bp, Homo sapiens
accctatatgtagtata

SEQ ID NO: 978300 - DNA, 23 bp, Homo sapiens
accctatcttctcattgtttgtt

SEQ ID NO: 978301 - DNA, 19 bp, Homo sapiens
accctatggggaggccctg

SEQ ID NO: 978302 - DNA, 20 bp, Homo sapiens
accctatggggaggccctgc

SEQ ID NO: 978303 - DNA, 14 bp, Homo sapiens
accctatgggtcta

SEQ ID NO: 978304 - DNA, 16 bp, Homo sapiens
accctatgggtctagg

SEQ ID NO: 978305 - DNA, 19 bp, Homo sapiens
accctatgggtctaggaca

SEQ ID NO: 978306 - DNA, 19 bp, Homo sapiens
accctattctatccatctc

SEQ ID NO: 978307 - DNA, 13 bp, Homo sapiens
accctattgctgc

SEQ ID NO: 978308 - DNA, 19 bp, Homo sapiens
accctattgctgcttgagg

SEQ ID NO: 978309 - DNA, 19 bp, Homo sapiens
accctatttaaatgaaagg

SEQ ID NO: 978310 - DNA, 18 bp, Homo sapiens
accctcaaaccctgtggg

SEQ ID NO: 978311 - DNA, 14 bp, Homo sapiens
accctcaaatgtca

SEQ ID NO: 978312 - DNA, 15 bp, Homo sapiens
accctcaaatgtcag

SEQ ID NO: 978313 - DNA, 20 bp, Homo sapiens
accctcaaatgtcagagcta

SEQ ID NO: 978314 - DNA, 22 bp, Homo sapiens
accctcaaatgtcagagctatg

SEQ ID NO: 978315 - DNA, 21 bp, Homo sapiens
accctcaacctcttctggctc

SEQ ID NO: 978316 - DNA, 13 bp, Homo sapiens
accctcacacaca

SEQ ID NO: 978317 - DNA, 21 bp, Homo sapiens
accctcacacacacagctggg

SEQ ID NO: 978318 - DNA, 14 bp, Homo sapiens
accctcacccactc

SEQ ID NO: 978319 - DNA, 22 bp, Homo sapiens
accctcaccccctcctggcaat

SEQ ID NO: 978320 - DNA, 22 bp, Homo sapiens
accctcactggctctcctggcc

SEQ ID NO: 978321 - DNA, 11 bp, Homo sapiens
accctcagagc

SEQ ID NO: 978322 - DNA, 18 bp, Homo sapiens
accctcagccctggcctt

SEQ ID NO: 978323 - DNA, 15 bp, Homo sapiens
accctcagctgtcac

SEQ ID NO: 978324 - DNA, 21 bp, Homo sapiens
accctcagctgtcacctgctc

SEQ ID NO: 978325 - DNA, 13 bp, Homo sapiens
accctcaggcagg

SEQ ID NO: 978326 - DNA, 15 bp, Homo sapiens
accctcaggcaggtg

SEQ ID NO: 978327 - DNA, 16 bp, Homo sapiens
accctcaggcaggtgg

SEQ ID NO: 978328 - DNA, 22 bp, Homo sapiens
accctcaggcataggcctgggt

SEQ ID NO: 978329 - DNA, 13 bp, Homo sapiens
accctcaggccac

SEQ ID NO: 978330 - DNA, 14 bp, Homo sapiens
accctcaggccacc

SEQ ID NO: 978331 - DNA, 13 bp, Homo sapiens
accctcagggagc

SEQ ID NO: 978332 - DNA, 18 bp, Homo sapiens
accctcagggagcctccc

SEQ ID NO: 978333 - DNA, 13 bp, Homo sapiens
accctcaggtgcc

SEQ ID NO: 978334 - DNA, 14 bp, Homo sapiens
accctcaggtgcct

SEQ ID NO: 978335 - DNA, 15 bp, Homo sapiens
accctcaggtgcctc

SEQ ID NO: 978336 - DNA, 22 bp, Homo sapiens
accctcaggtgtagctgagctg

SEQ ID NO: 978337 - DNA, 16 bp, Homo sapiens
accctcattgctgtct

SEQ ID NO: 978338 - DNA, 17 bp, Homo sapiens
accctcattgtgtttct

SEQ ID NO: 978339 - DNA, 22 bp, Homo sapiens
accctccaaatggagaagctgc

SEQ ID NO: 978340 - DNA, 23 bp, Homo sapiens
accctccaaatggagaagctgca

SEQ ID NO: 978341 - DNA, 13 bp, Homo sapiens
accctccaccctg

SEQ ID NO: 978342 - DNA, 15 bp, Homo sapiens
accctccaccctgtc

SEQ ID NO: 978343 - DNA, 17 bp, Homo sapiens
accctccaccctgtccc

SEQ ID NO: 978344 - DNA, 16 bp, Homo sapiens
accctccaccgagcca

SEQ ID NO: 978345 - DNA, 22 bp, Homo sapiens
accctccacctctcacgggccc

SEQ ID NO: 978346 - DNA, 14 bp, Homo sapiens
accctccacttccc

SEQ ID NO: 978347 - DNA, 15 bp, Homo sapiens
accctccagagacaa

SEQ ID NO: 978348 - DNA, 22 bp, Homo sapiens
accctccagcttttcctcaggg

SEQ ID NO: 978349 - DNA, 13 bp, Homo sapiens
accctccatgctc

SEQ ID NO: 978350 - DNA, 20 bp, Homo sapiens
accctccatgctcctcacct

SEQ ID NO: 978351 - DNA, 23 bp, Homo sapiens
accctcccacccccttctctgct

SEQ ID NO: 978352 - DNA, 19 bp, Homo sapiens
accctcccactcccatctc

SEQ ID NO: 978353 - DNA, 11 bp, Homo sapiens
accctcccagt

SEQ ID NO: 978354 - DNA, 19 bp, Homo sapiens
accctccccaaggatgacc

SEQ ID NO: 978355 - DNA, 15 bp, Homo sapiens
accctcccccgcagc

SEQ ID NO: 978356 - DNA, 18 bp, Homo sapiens
accctcccctctcttgca

SEQ ID NO: 978357 - DNA, 22 bp, Homo sapiens
accctccgccttcactccggtg

SEQ ID NO: 978358 - DNA, 21 bp, Homo sapiens
accctcctatcacctcccctc

SEQ ID NO: 978359 - DNA, 11 bp, Homo sapiens
accctcctcct

SEQ ID NO: 978360 - DNA, 15 bp, Homo sapiens
accctcctctagcca

SEQ ID NO: 978361 - DNA, 13 bp, Homo sapiens
accctcctctgct

SEQ ID NO: 978362 - DNA, 14 bp, Homo sapiens
accctcctcttgga

SEQ ID NO: 978363 - DNA, 21 bp, Homo sapiens
accctcctgtaaatggtgtac

SEQ ID NO: 978364 - DNA, 15 bp, Homo sapiens
accctcgggcccacc

SEQ ID NO: 978365 - DNA, 16 bp, Homo sapiens
accctcgggcccacct

SEQ ID NO: 978366 - DNA, 18 bp, Homo sapiens
accctcgggcccacctgg

SEQ ID NO: 978367 - DNA, 20 bp, Homo sapiens
accctcgggcccacctggcc

SEQ ID NO: 978368 - DNA, 19 bp, Homo sapiens
accctcgggccccatcctc

SEQ ID NO: 978369 - DNA, 16 bp, Homo sapiens
accctctcagctccag

SEQ ID NO: 978370 - DNA, 14 bp, Homo sapiens
accctctcctgggg

SEQ ID NO: 978371 - DNA, 12 bp, Homo sapiens
accctctcttcc

SEQ ID NO: 978372 - DNA, 22 bp, Homo sapiens
accctctgcggccactgcgcca

SEQ ID NO: 978373 - DNA, 11 bp, Homo sapiens
accctctggga

SEQ ID NO: 978374 - DNA, 12 bp, Homo sapiens
accctctgggaa

SEQ ID NO: 978375 - DNA, 14 bp, Homo sapiens
accctctgtcccca

SEQ ID NO: 978376 - DNA, 16 bp, Homo sapiens
accctctgtccccacg

SEQ ID NO: 978377 - DNA, 17 bp, Homo sapiens
accctctgtccccaggc

SEQ ID NO: 978378 - DNA, 18 bp, Homo sapiens
accctctgtccccaggcc

SEQ ID NO: 978379 - DNA, 19 bp, Homo sapiens
accctctgtccccaggcct

SEQ ID NO: 978380 - DNA, 20 bp, Homo sapiens
accctctgtccccaggcctg

SEQ ID NO: 978381 - DNA, 22 bp, Homo sapiens
accctctgtccccaggcctggc

SEQ ID NO: 978382 - DNA, 17 bp, Homo sapiens
accctcttcctgtgatc

SEQ ID NO: 978383 - DNA, 14 bp, Homo sapiens
accctcttgccatc

SEQ ID NO: 978384 - DNA, 18 bp, Homo sapiens
accctcttgccatcctga

SEQ ID NO: 978385 - DNA, 15 bp, Homo sapiens
accctctttgctgca

SEQ ID NO: 978386 - DNA, 18 bp, Homo sapiens
accctcttttaccaactt

SEQ ID NO: 978387 - DNA, 22 bp, Homo sapiens
accctgaatggttccatgcctg

SEQ ID NO: 978388 - DNA, 21 bp, Homo sapiens
accctgaatttggcctgcact

SEQ ID NO: 978389 - DNA, 16 bp, Homo sapiens
accctgagccccttcc

SEQ ID NO: 978390 - DNA, 17 bp, Homo sapiens
accctgagctgaggcag

SEQ ID NO: 978391 - DNA, 23 bp, Homo sapiens
accctgagctgaggcagcagtgt

SEQ ID NO: 978392 - DNA, 15 bp, Homo sapiens
accctgaggccctgg

SEQ ID NO: 978393 - DNA, 16 bp, Homo sapiens
accctgagttgctttt

SEQ ID NO: 978394 - DNA, 22 bp, Homo sapiens
accctgattcatactccttttg

SEQ ID NO: 978395 - DNA, 22 bp, Homo sapiens
accctgattcttgattcctggc

SEQ ID NO: 978396 - DNA, 23 bp, Homo sapiens
accctgattcttgattcctggct

SEQ ID NO: 978397 - DNA, 23 bp, Homo sapiens
accctgcaaacagaacagggtca

SEQ ID NO: 978398 - DNA, 18 bp, Homo sapiens
accctgcaaaggactgtt

SEQ ID NO: 978399 - DNA, 22 bp, Homo sapiens
accctgcacctgctgcgtcccc

SEQ ID NO: 978400 - DNA, 21 bp, Homo sapiens
accctgcattttcctcttgtc

SEQ ID NO: 978401 - DNA, 13 bp, Homo sapiens
accctgccacagc

SEQ ID NO: 978402 - DNA, 18 bp, Homo sapiens
accctgccagtgccaggg

SEQ ID NO: 978403 - DNA, 12 bp, Homo sapiens
accctgccccta

SEQ ID NO: 978404 - DNA, 17 bp, Homo sapiens
accctgcccctaagtta

SEQ ID NO: 978405 - DNA, 23 bp, Homo sapiens
accctgcccctccccaaaagaaa

SEQ ID NO: 978406 - DNA, 13 bp, Homo sapiens
accctgcccctgc

SEQ ID NO: 978407 - DNA, 21 bp, Homo sapiens
accctgccctcatgggacctg

SEQ ID NO: 978408 - DNA, 22 bp, Homo sapiens
accctgccgagggggctgtcat

SEQ ID NO: 978409 - DNA, 15 bp, Homo sapiens
accctgcctgagccc

SEQ ID NO: 978410 - DNA, 19 bp, Homo sapiens
accctgcctgagcccagga

SEQ ID NO: 978411 - DNA, 23 bp, Homo sapiens
accctgcctgagcccaggagctg

SEQ ID NO: 978412 - DNA, 14 bp, Homo sapiens
accctgcctgcacc

SEQ ID NO: 978413 - DNA, 16 bp, Homo sapiens
accctgcctgcacctc

SEQ ID NO: 978414 - DNA, 15 bp, Homo sapiens
accctgcctgccgct

SEQ ID NO: 978415 - DNA, 21 bp, Homo sapiens
accctgcctgtcacctgggag

SEQ ID NO: 978416 - DNA, 18 bp, Homo sapiens
accctgcgaaggggccct

SEQ ID NO: 978417 - DNA, 17 bp, Homo sapiens
attttatttgtttttca

SEQ ID NO: 978418 - DNA, 19 bp, Homo sapiens
attttattttaaaatttca

SEQ ID NO: 978419 - DNA, 15 bp, Homo sapiens
attttattttagcag

SEQ ID NO: 978420 - DNA, 14 bp, Homo sapiens
attttattttgctg

SEQ ID NO: 978421 - DNA, 21 bp, Homo sapiens
attttattttggcttcatttc

SEQ ID NO: 978422 - DNA, 15 bp, Homo sapiens
attttatttttgcaa

SEQ ID NO: 978423 - DNA, 19 bp, Homo sapiens
attttcaaaagataatatt

SEQ ID NO: 978424 - DNA, 15 bp, Homo sapiens
attttcaaagaaaat

SEQ ID NO: 978425 - DNA, 15 bp, Homo sapiens
attttcaaagactta

SEQ ID NO: 978426 - DNA, 16 bp, Homo sapiens
attttcaaagacttaa

SEQ ID NO: 978427 - DNA, 17 bp, Homo sapiens
attttcaaagacttaag

SEQ ID NO: 978428 - DNA, 13 bp, Homo sapiens
attttcaaagaga

SEQ ID NO: 978429 - DNA, 22 bp, Homo sapiens
attttcaaatccttattgttca

SEQ ID NO: 978430 - DNA, 13 bp, Homo sapiens
attttcaagaaac

SEQ ID NO: 978431 - DNA, 22 bp, Homo sapiens
attttcaagaaactgaggaatt

SEQ ID NO: 978432 - DNA, 23 bp, Homo sapiens
attttcaagattctaaagctcaa

SEQ ID NO: 978433 - DNA, 17 bp, Homo sapiens
attttcaaggccttcag

SEQ ID NO: 978434 - DNA, 20 bp, Homo sapiens
attttcaaggccttcagttt

SEQ ID NO: 978435 - DNA, 22 bp, Homo sapiens
attttcaaggccttcagtttat

SEQ ID NO: 978436 - DNA, 19 bp, Homo sapiens
attttcaagtaattgtgaa

SEQ ID NO: 978437 - DNA, 16 bp, Homo sapiens
attttcaagtttacac

SEQ ID NO: 978438 - DNA, 17 bp, Homo sapiens
attttcaatagccacta

SEQ ID NO: 978439 - DNA, 21 bp, Homo sapiens
attttcacactggtaaatgtt

SEQ ID NO: 978440 - DNA, 20 bp, Homo sapiens
attttcacattcttggctta

SEQ ID NO: 978441 - DNA, 21 bp, Homo sapiens
attttcacctgtttttaagct

SEQ ID NO: 978442 - DNA, 16 bp, Homo sapiens
attttcactagggctg

SEQ ID NO: 978443 - DNA, 13 bp, Homo sapiens
attttcagagccg

SEQ ID NO: 978444 - DNA, 15 bp, Homo sapiens
attttcagatgaaat

SEQ ID NO: 978445 - DNA, 20 bp, Homo sapiens
attttcagcattaagctgtt

SEQ ID NO: 978446 - DNA, 20 bp, Homo sapiens
attttcaggtagtctgagta

SEQ ID NO: 978447 - DNA, 21 bp, Homo sapiens
attttcagtagggctacaaaa

SEQ ID NO: 978448 - DNA, 22 bp, Homo sapiens
attttcagtagggctacaaaac

SEQ ID NO: 978449 - DNA, 17 bp, Homo sapiens
attttcagtatactgtg

SEQ ID NO: 978450 - DNA, 20 bp, Homo sapiens
attttcagtcaaaactttaa

SEQ ID NO: 978451 - DNA, 21 bp, Homo sapiens
attttcagtcccctctctctg

SEQ ID NO: 978452 - DNA, 22 bp, Homo sapiens
attttcagttacaagattgtaa

SEQ ID NO: 978453 - DNA, 22 bp, Homo sapiens
attttcagttccctcctgccca

SEQ ID NO: 978454 - DNA, 16 bp, Homo sapiens
attttcataatcagta

SEQ ID NO: 978455 - DNA, 23 bp, Homo sapiens
attttcatagtgacctgtgtttc

SEQ ID NO: 978456 - DNA, 15 bp, Homo sapiens
attttcattaaaagc

SEQ ID NO: 978457 - DNA, 14 bp, Homo sapiens
attttcatttcatg

SEQ ID NO: 978458 - DNA, 12 bp, Homo sapiens
attttcatttgt

SEQ ID NO: 978459 - DNA, 17 bp, Homo sapiens
attttccaagtaaagtg

SEQ ID NO: 978460 - DNA, 21 bp, Homo sapiens
attttccacaagattcccaga

SEQ ID NO: 978461 - DNA, 21 bp, Homo sapiens
attttccagccttatgtgtta

SEQ ID NO: 978462 - DNA, 17 bp, Homo sapiens
attttccataaatttgg

SEQ ID NO: 978463 - DNA, 20 bp, Homo sapiens
attttcccatcatcctttgt

SEQ ID NO: 978464 - DNA, 23 bp, Homo sapiens
attttcccatcatcctttgttct

SEQ ID NO: 978465 - DNA, 20 bp, Homo sapiens
attttcccccactactgcag

SEQ ID NO: 978466 - DNA, 21 bp, Homo sapiens
attttcccccactactgcagc

SEQ ID NO: 978467 - DNA, 14 bp, Homo sapiens
attttccccccact

SEQ ID NO: 978468 - DNA, 15 bp, Homo sapiens
attttccccccactc

SEQ ID NO: 978469 - DNA, 14 bp, Homo sapiens
attttccccttcct

SEQ ID NO: 978470 - DNA, 16 bp, Homo sapiens
attttccccttcctca

SEQ ID NO: 978471 - DNA, 21 bp, Homo sapiens
attttccctcttggtgtgatt

SEQ ID NO: 978472 - DNA, 20 bp, Homo sapiens
attttccctttttaaaaaat

SEQ ID NO: 978473 - DNA, 22 bp, Homo sapiens
attttccctttttaaaaaatac

SEQ ID NO: 978474 - DNA, 21 bp, Homo sapiens
attttcctaataaagttctgt

SEQ ID NO: 978475 - DNA, 20 bp, Homo sapiens
attttcctatattacggttt

SEQ ID NO: 978476 - DNA, 12 bp, Homo sapiens
attttcctcccc

SEQ ID NO: 978477 - DNA, 13 bp, Homo sapiens
attttcctcccca

SEQ ID NO: 978478 - DNA, 14 bp, Homo sapiens
attttcctccccag

SEQ ID NO: 978479 - DNA, 15 bp, Homo sapiens
attttcctccccagc

SEQ ID NO: 978480 - DNA, 16 bp, Homo sapiens
attttcctccccagca

SEQ ID NO: 978481 - DNA, 14 bp, Homo sapiens
attttcctcctctg

SEQ ID NO: 978482 - DNA, 18 bp, Homo sapiens
attttcctcctctgccta

SEQ ID NO: 978483 - DNA, 20 bp, Homo sapiens
attttcctcgcctaggcctg

SEQ ID NO: 978484 - DNA, 11 bp, Homo sapiens
attttcctctt

SEQ ID NO: 978485 - DNA, 21 bp, Homo sapiens
attttcctcttgtcctggccc

SEQ ID NO: 978486 - DNA, 15 bp, Homo sapiens
attttcctcttgtga

SEQ ID NO: 978487 - DNA, 15 bp, Homo sapiens
attttcctgttcagt

SEQ ID NO: 978488 - DNA, 19 bp, Homo sapiens
attttctaaaagctttcat

SEQ ID NO: 978489 - DNA, 15 bp, Homo sapiens
attttctaaagactt

SEQ ID NO: 978490 - DNA, 14 bp, Homo sapiens
attttctacagtgg

SEQ ID NO: 978491 - DNA, 16 bp, Homo sapiens
attttctagactttct

SEQ ID NO: 978492 - DNA, 18 bp, Homo sapiens
attttctagactttctgt

SEQ ID NO: 978493 - DNA, 18 bp, Homo sapiens
attttctagatacaataa

SEQ ID NO: 978494 - DNA, 21 bp, Homo sapiens
attttctatttctctgtgtat

SEQ ID NO: 978495 - DNA, 23 bp, Homo sapiens
attttctattttaagactgattt

SEQ ID NO: 978496 - DNA, 18 bp, Homo sapiens
attttctcactgaactcc

SEQ ID NO: 978497 - DNA, 21 bp, Homo sapiens
attttctcactgaactccacc

SEQ ID NO: 978498 - DNA, 14 bp, Homo sapiens
attttctccagctc

SEQ ID NO: 978499 - DNA, 21 bp, Homo sapiens
attttctccctttatgtatct

SEQ ID NO: 978500 - DNA, 13 bp, Homo sapiens
attttctccttgg

SEQ ID NO: 978501 - DNA, 14 bp, Homo sapiens
attttctctgtact

SEQ ID NO: 978502 - DNA, 16 bp, Homo sapiens
attttctctgtacttt

SEQ ID NO: 978503 - DNA, 18 bp, Homo sapiens
attttctctgtgtttgtt

SEQ ID NO: 978504 - DNA, 22 bp, Homo sapiens
attttctctgtgtttgttccta

SEQ ID NO: 978505 - DNA, 19 bp, Homo sapiens
attttctggaatacatgaa

SEQ ID NO: 978506 - DNA, 13 bp, Homo sapiens
attttctggattc

SEQ ID NO: 978507 - DNA, 20 bp, Homo sapiens
attttctggtagatagaaat

SEQ ID NO: 978508 - DNA, 21 bp, Homo sapiens
attttctggtagatagaaata

SEQ ID NO: 978509 - DNA, 22 bp, Homo sapiens
attttctgtcagatgagaacaa

SEQ ID NO: 978510 - DNA, 20 bp, Homo sapiens
attttcttaaggaattttgt

SEQ ID NO: 978511 - DNA, 14 bp, Homo sapiens
attttcttactttt

SEQ ID NO: 978512 - DNA, 15 bp, Homo sapiens
attttcttactttta

SEQ ID NO: 978513 - DNA, 21 bp, Homo sapiens
attttcttatccacaaagtac

SEQ ID NO: 978514 - DNA, 13 bp, Homo sapiens
attttcttcagaa

SEQ ID NO: 978515 - DNA, 15 bp, Homo sapiens
attttcttcagaatt

SEQ ID NO: 978516 - DNA, 14 bp, Homo sapiens
attttcttcatgca

SEQ ID NO: 978517 - DNA, 12 bp, Homo sapiens
attttcttctct

SEQ ID NO: 978518 - DNA, 22 bp, Homo sapiens
attttctttaaccagtctgaag

SEQ ID NO: 978519 - DNA, 18 bp, Homo sapiens
attttctttatcattgct

SEQ ID NO: 978520 - DNA, 16 bp, Homo sapiens
attttctttctgtaac

SEQ ID NO: 978521 - DNA, 15 bp, Homo sapiens
attttctttgaaatt

SEQ ID NO: 978522 - DNA, 19 bp, Homo sapiens
attttcttttaagcatttg

SEQ ID NO: 978523 - DNA, 13 bp, Homo sapiens
attttcttttctt

SEQ ID NO: 978524 - DNA, 17 bp, Homo sapiens
attttcttttgtaaatg

SEQ ID NO: 978525 - DNA, 13 bp, Homo sapiens
attttctttttcg

SEQ ID NO: 978526 - DNA, 15 bp, Homo sapiens
attttgaaaagtatt

SEQ ID NO: 978527 - DNA, 15 bp, Homo sapiens
attttgaaagtctgt

SEQ ID NO: 978528 - DNA, 22 bp, Homo sapiens
attttgaacgcttaagtcatca

SEQ ID NO: 978529 - DNA, 19 bp, Homo sapiens
attttgaagtgctgtttat

SEQ ID NO: 978530 - DNA, 20 bp, Homo sapiens
attttgaataaataaatgta

SEQ ID NO: 978531 - DNA, 11 bp, Homo sapiens
attttgaatac

SEQ ID NO: 978532 - DNA, 12 bp, Homo sapiens
attttgaatacc

SEQ ID NO: 978533 - DNA, 13 bp, Homo sapiens
attttgaatcaat

SEQ ID NO: 978534 - DNA, 17 bp, Homo sapiens
attttgaatcaataata

SEQ ID NO: 978535 - DNA, 18 bp, Homo sapiens
attttgaatcaataatat

SEQ ID NO: 978536 - DNA, 14 bp, Homo sapiens
attttgaatctgtg

SEQ ID NO: 978537 - DNA, 15 bp, Homo sapiens
attttgaatctgtgt

SEQ ID NO: 978538 - DNA, 22 bp, Homo sapiens
attttgaatctgtgtgcatatt

SEQ ID NO: 978539 - DNA, 23 bp, Homo sapiens
attttgaatctgtgtgcatattt

SEQ ID NO: 978540 - DNA, 21 bp, Homo sapiens
attttgaattagattatttct

SEQ ID NO: 978541 - DNA, 20 bp, Homo sapiens
accctgcgaaggggccctgg

SEQ ID NO: 978542 - DNA, 15 bp, Homo sapiens
accctgcgcctccag

SEQ ID NO: 978543 - DNA, 17 bp, Homo sapiens
accctgcgcctccagag

SEQ ID NO: 978544 - DNA, 13 bp, Homo sapiens
accctgcgggcca

SEQ ID NO: 978545 - DNA, 16 bp, Homo sapiens
accctgctcacaggca

SEQ ID NO: 978546 - DNA, 21 bp, Homo sapiens
accctgctcctcctgccctgt

SEQ ID NO: 978547 - DNA, 11 bp, Homo sapiens
accctgctgac

SEQ ID NO: 978548 - DNA, 13 bp, Homo sapiens
accctgcttcacc

SEQ ID NO: 978549 - DNA, 15 bp, Homo sapiens
accctgcttctcccg

SEQ ID NO: 978550 - DNA, 19 bp, Homo sapiens
accctgcttctcccgggga

SEQ ID NO: 978551 - DNA, 23 bp, Homo sapiens
accctgcttctcccggggacgct

SEQ ID NO: 978552 - DNA, 10 bp, Homo sapiens
accctggaat

SEQ ID NO: 978553 - DNA, 22 bp, Homo sapiens
accctggaattcagcaccctgg

SEQ ID NO: 978554 - DNA, 21 bp, Homo sapiens
accctggaggccccaaccctg

SEQ ID NO: 978555 - DNA, 15 bp, Homo sapiens
accctggagttcttg

SEQ ID NO: 978556 - DNA, 21 bp, Homo sapiens
accctggcccgcccctcgctg

SEQ ID NO: 978557 - DNA, 22 bp, Homo sapiens
accctggccgagtccaagctgg

SEQ ID NO: 978558 - DNA, 16 bp, Homo sapiens
accctggccgccccct

SEQ ID NO: 978559 - DNA, 12 bp, Homo sapiens
accgccctgggc

SEQ ID NO: 978560 - DNA, 17 bp, Homo sapiens
accgccctgggctggac

SEQ ID NO: 978561 - DNA, 21 bp, Homo sapiens
accgccgagttaaagaggaga

SEQ ID NO: 978562 - DNA, 15 bp, Homo sapiens
accgccgatcccagg

SEQ ID NO: 978563 - DNA, 21 bp, Homo sapiens
accgccgcagaagcagcccct

SEQ ID NO: 978564 - DNA, 15 bp, Homo sapiens
accgcctcgtgccag

SEQ ID NO: 978565 - DNA, 19 bp, Homo sapiens
accgcctcgtgccagcagc

SEQ ID NO: 978566 - DNA, 23 bp, Homo sapiens
accgcctcgtgccagcagcctcg

SEQ ID NO: 978567 - DNA, 23 bp, Homo sapiens
accgcctgccctcccgcaccttc

SEQ ID NO: 978568 - DNA, 19 bp, Homo sapiens
accgcctgccctgcctggg

SEQ ID NO: 978569 - DNA, 16 bp, Homo sapiens
accgcctggccctccc

SEQ ID NO: 978570 - DNA, 23 bp, Homo sapiens
accgcctggccctccctccctag

SEQ ID NO: 978571 - DNA, 20 bp, Homo sapiens
accgcgagactgagaggcag

SEQ ID NO: 978572 - DNA, 18 bp, Homo sapiens
accgcgccctcctgccca

SEQ ID NO: 978573 - DNA, 18 bp, Homo sapiens
accgcgggtgtgggaaag

SEQ ID NO: 978574 - DNA, 19 bp, Homo sapiens
accgcgggtgtgggaaagc

SEQ ID NO: 978575 - DNA, 19 bp, Homo sapiens
accgcgtagagagccgggc

SEQ ID NO: 978576 - DNA, 13 bp, Homo sapiens
accgcgttgtaaa

SEQ ID NO: 978577 - DNA, 15 bp, Homo sapiens
accgcgttgtaaaat

SEQ ID NO: 978578 - DNA, 19 bp, Homo sapiens
accgcgttgtaaaatatag

SEQ ID NO: 978579 - DNA, 15 bp, Homo sapiens
accgctaaaagaaac

SEQ ID NO: 978580 - DNA, 19 bp, Homo sapiens
accgctcacctagagccag

SEQ ID NO: 978581 - DNA, 16 bp, Homo sapiens
accgctcagtattact

SEQ ID NO: 978582 - DNA, 14 bp, Homo sapiens
accgctcagtgtca

SEQ ID NO: 978583 - DNA, 14 bp, Homo sapiens
accgctccccacag

SEQ ID NO: 978584 - DNA, 15 bp, Homo sapiens
accgctccccagccc

SEQ ID NO: 978585 - DNA, 20 bp, Homo sapiens
accgctccccagcccagggt

SEQ ID NO: 978586 - DNA, 21 bp, Homo sapiens
accgctcccctctcctccgcc

SEQ ID NO: 978587 - DNA, 13 bp, Homo sapiens
accgctggccctt

SEQ ID NO: 978588 - DNA, 14 bp, Homo sapiens
accgcttcacccct

SEQ ID NO: 978589 - DNA, 18 bp, Homo sapiens
accgcttcacccctgcac

SEQ ID NO: 978590 - DNA, 17 bp, Homo sapiens
accgcttctgccttttc

SEQ ID NO: 978591 - DNA, 21 bp, Homo sapiens
accgcttgtggggacccaggc

SEQ ID NO: 978592 - DNA, 22 bp, Homo sapiens
accgcttgtggggacccaggct

SEQ ID NO: 978593 - DNA, 14 bp, Homo sapiens
accgcttttggttt

SEQ ID NO: 978594 - DNA, 15 bp, Homo sapiens
accggaaggaggcca

SEQ ID NO: 978595 - DNA, 23 bp, Homo sapiens
accggaaggaggccaaccagccc

SEQ ID NO: 978596 - DNA, 19 bp, Homo sapiens
accggacacacctctgctc

SEQ ID NO: 978597 - DNA, 13 bp, Homo sapiens
accggagagagaa

SEQ ID NO: 978598 - DNA, 24 bp, Homo sapiens
accggagtgtctggaattgtggct

SEQ ID NO: 978599 - DNA, 14 bp, Homo sapiens
accggattctctct

SEQ ID NO: 978600 - DNA, 15 bp, Homo sapiens
accggcgctgcaggt

SEQ ID NO: 978601 - DNA, 23 bp, Homo sapiens
accggcggaccccagccatccag

SEQ ID NO: 978602 - DNA, 18 bp, Homo sapiens
accgggaataaccttcca

SEQ ID NO: 978603 - DNA, 15 bp, Homo sapiens
accgggagcctcccc

SEQ ID NO: 978604 - DNA, 22 bp, Homo sapiens
accgggccagtatctatatatg

SEQ ID NO: 978605 - DNA, 15 bp, Homo sapiens
accgggccctgggtt

SEQ ID NO: 978606 - DNA, 11 bp, Homo sapiens
accgggctgca

SEQ ID NO: 978607 - DNA, 15 bp, Homo sapiens
accgggctggctgct

SEQ ID NO: 978608 - DNA, 21 bp, Homo sapiens
accgggctgggagctctgcag

SEQ ID NO: 978609 - DNA, 18 bp, Homo sapiens
accggggcaagagggaag

SEQ ID NO: 978610 - DNA, 14 bp, Homo sapiens
accgggggctgctg

SEQ ID NO: 978611 - DNA, 16 bp, Homo sapiens
accgggggctgctggg

SEQ ID NO: 978612 - DNA, 17 bp, Homo sapiens
accgggggtggctctgt

SEQ ID NO: 978613 - DNA, 16 bp, Homo sapiens
accgggtgggcctggc

SEQ ID NO: 978614 - DNA, 20 bp, Homo sapiens
accgggtgggcctggcctga

SEQ ID NO: 978615 - DNA, 13 bp, Homo sapiens
accggtacagaaa

SEQ ID NO: 978616 - DNA, 15 bp, Homo sapiens
accggtcagtgcctt

SEQ ID NO: 978617 - DNA, 22 bp, Homo sapiens
accggtcagtgccttttggaac

SEQ ID NO: 978618 - DNA, 17 bp, Homo sapiens
accggtccagctggcct

SEQ ID NO: 978619 - DNA, 23 bp, Homo sapiens
accggtccagctggcctggacag

SEQ ID NO: 978620 - DNA, 17 bp, Homo sapiens
accggtgctgcaggagt

SEQ ID NO: 978621 - DNA, 14 bp, Homo sapiens
accggtggggctgg

SEQ ID NO: 978622 - DNA, 13 bp, Homo sapiens
accgtactctcac

SEQ ID NO: 978623 - DNA, 22 bp, Homo sapiens
accgtcccagggctctgcaggc

SEQ ID NO: 978624 - DNA, 12 bp, Homo sapiens
accgtccctcag

SEQ ID NO: 978625 - DNA, 14 bp, Homo sapiens
accgtccctcagtg

SEQ ID NO: 978626 - DNA, 19 bp, Homo sapiens
accgtcctgctgtccctgt

SEQ ID NO: 978627 - DNA, 18 bp, Homo sapiens
accgtcgacaagaatgtc

SEQ ID NO: 978628 - DNA, 16 bp, Homo sapiens
accgtgaaccagaggg

SEQ ID NO: 978629 - DNA, 22 bp, Homo sapiens
accgtgacagcccgcaggatca

SEQ ID NO: 978630 - DNA, 18 bp, Homo sapiens
accgtgaccgtttgctat

SEQ ID NO: 978631 - DNA, 19 bp, Homo sapiens
accgtgagtgacatagcct

SEQ ID NO: 978632 - DNA, 21 bp, Homo sapiens
accgtgccaaccccacccagc

SEQ ID NO: 978633 - DNA, 13 bp, Homo sapiens
accgtgccattgt

SEQ ID NO: 978634 - DNA, 16 bp, Homo sapiens
accgtgccccacctcc

SEQ ID NO: 978635 - DNA, 18 bp, Homo sapiens
accgtgccccacctcccc

SEQ ID NO: 978636 - DNA, 20 bp, Homo sapiens
accgtgccccacctccccac

SEQ ID NO: 978637 - DNA, 16 bp, Homo sapiens
accgtgcctggccaga

SEQ ID NO: 978638 - DNA, 17 bp, Homo sapiens
accgtggaccttcctgc

SEQ ID NO: 978639 - DNA, 18 bp, Homo sapiens
accgtggaccttcctgcc

SEQ ID NO: 978640 - DNA, 18 bp, Homo sapiens
accgtggaggaggaaggc

SEQ ID NO: 978641 - DNA, 15 bp, Homo sapiens
accgtggcctgggct

SEQ ID NO: 978642 - DNA, 16 bp, Homo sapiens
accgtgggcagggagc

SEQ ID NO: 978643 - DNA, 16 bp, Homo sapiens
accgtggggaaggggt

SEQ ID NO: 978644 - DNA, 23 bp, Homo sapiens
accgtgggggaactgacgctgga

SEQ ID NO: 978645 - DNA, 16 bp, Homo sapiens
accgtggtatgtctgc

SEQ ID NO: 978646 - DNA, 19 bp, Homo sapiens
accgtgtacatagccctgg

SEQ ID NO: 978647 - DNA, 17 bp, Homo sapiens
accgtgtcaagctgctc

SEQ ID NO: 978648 - DNA, 20 bp, Homo sapiens
accgtgtcccaaggagctga

SEQ ID NO: 978649 - DNA, 20 bp, Homo sapiens
accgtgtcctcctctgagga

SEQ ID NO: 978650 - DNA, 17 bp, Homo sapiens
accgtgtctgtctggca

SEQ ID NO: 978651 - DNA, 23 bp, Homo sapiens
accgtgtgtccagcattgaagag

SEQ ID NO: 978652 - DNA, 14 bp, Homo sapiens
accgttcaagaggc

SEQ ID NO: 978653 - DNA, 15 bp, Homo sapiens
accgttcagtcattt

SEQ ID NO: 978654 - DNA, 19 bp, Homo sapiens
accgttcagtgtcccaggc

SEQ ID NO: 978655 - DNA, 22 bp, Homo sapiens
accgttcagtgtcccaggcagc

SEQ ID NO: 978656 - DNA, 16 bp, Homo sapiens
accgttgcttgaaatt

SEQ ID NO: 978657 - DNA, 18 bp, Homo sapiens
accgttggggattgggga

SEQ ID NO: 978658 - DNA, 16 bp, Homo sapiens
accgttggggccctta

SEQ ID NO: 978659 - DNA, 12 bp, Homo sapiens
accgtttcttcc

SEQ ID NO: 978660 - DNA, 14 bp, Homo sapiens
accgtttcttccct

SEQ ID NO: 978661 - DNA, 20 bp, Homo sapiens
accgttttcacttgtctcct

SEQ ID NO: 978662 - DNA, 19 bp, Homo sapiens
accgtttttatattacttt

SEQ ID NO: 978663 - DNA, 16 bp, Homo sapiens
acctaaaaaagatata

SEQ ID NO: 978664 - DNA, 20 bp, Homo sapiens
acctaaaggtgtatttaaac

SEQ ID NO: 978665 - DNA, 23 bp, Homo sapiens
acctaaattcgtagcaaattctg

SEQ ID NO: 978666 - DNA, 11 bp, Homo sapiens
acctaacattc

SEQ ID NO: 978667 - DNA, 19 bp, Homo sapiens
acctaacattcgatctcat

SEQ ID NO: 978668 - DNA, 18 bp, Homo sapiens
attttgacataagtaact

SEQ ID NO: 978669 - DNA, 17 bp, Homo sapiens
attttgacctactctca

SEQ ID NO: 978670 - DNA, 16 bp, Homo sapiens
attttgagtattccat

SEQ ID NO: 978671 - DNA, 18 bp, Homo sapiens
attttgagtattccatga

SEQ ID NO: 978672 - DNA, 14 bp, Homo sapiens
attttgagtgactc

SEQ ID NO: 978673 - DNA, 14 bp, Homo sapiens
attttgagttgcca

SEQ ID NO: 978674 - DNA, 17 bp, Homo sapiens
attttgatatacattgt

SEQ ID NO: 978675 - DNA, 17 bp, Homo sapiens
attttgatgtaaagatg

SEQ ID NO: 978676 - DNA, 17 bp, Homo sapiens
attttgatgttttaagg

SEQ ID NO: 978677 - DNA, 23 bp, Homo sapiens
attttgatttttaatggaaagtt

SEQ ID NO: 978678 - DNA, 12 bp, Homo sapiens
attttgcatact

SEQ ID NO: 978679 - DNA, 18 bp, Homo sapiens
attttgcatactgaaaat

SEQ ID NO: 978680 - DNA, 22 bp, Homo sapiens
attttgcccttccatagcctaa

SEQ ID NO: 978681 - DNA, 18 bp, Homo sapiens
acctacagtgtacagtct

SEQ ID NO: 978682 - DNA, 16 bp, Homo sapiens
acctacagttttaact

SEQ ID NO: 978683 - DNA, 22 bp, Homo sapiens
acctacatatgctgatctttta

SEQ ID NO: 978684 - DNA, 23 bp, Homo sapiens
acctacattccctctcctgccca

SEQ ID NO: 978685 - DNA, 14 bp, Homo sapiens
acctaccaaaatgg

SEQ ID NO: 978686 - DNA, 18 bp, Homo sapiens
acctaccaccccttcctg

SEQ ID NO: 978687 - DNA, 19 bp, Homo sapiens
acctaccaccccttcctgt

SEQ ID NO: 978688 - DNA, 16 bp, Homo sapiens
acctaccaggacagaa

SEQ ID NO: 978689 - DNA, 15 bp, Homo sapiens
acctaccatgctgct

SEQ ID NO: 978690 - DNA, 15 bp, Homo sapiens
acctacctccctccc

SEQ ID NO: 978691 - DNA, 20 bp, Homo sapiens
acctacgcacataccttcat

SEQ ID NO: 978692 - DNA, 20 bp, Homo sapiens
acctacgttcctggccccct

SEQ ID NO: 978693 - DNA, 21 bp, Homo sapiens
acctacgttcctggccccctc

SEQ ID NO: 978694 - DNA, 16 bp, Homo sapiens
acctactgcactttcc

SEQ ID NO: 978695 - DNA, 12 bp, Homo sapiens
acctactgccca

SEQ ID NO: 978696 - DNA, 18 bp, Homo sapiens
acctactgttcctttcag

SEQ ID NO: 978697 - DNA, 20 bp, Homo sapiens
acctacttgtgactgaaggg

SEQ ID NO: 978698 - DNA, 22 bp, Homo sapiens
acctagaaattgacacaagtgg

SEQ ID NO: 978699 - DNA, 21 bp, Homo sapiens
acctagaacgtgcatccttgt

SEQ ID NO: 978700 - DNA, 19 bp, Homo sapiens
acctagaccagtttgcatg

SEQ ID NO: 978701 - DNA, 22 bp, Homo sapiens
acctagagaacaggtggttttt

SEQ ID NO: 978702 - DNA, 22 bp, Homo sapiens
acctagcagcaccgttctgtgc

SEQ ID NO: 978703 - DNA, 17 bp, Homo sapiens
acctagccaacatggtg

SEQ ID NO: 978704 - DNA, 13 bp, Homo sapiens
acctagcctggat

SEQ ID NO: 978705 - DNA, 20 bp, Homo sapiens
acctagcctggatggcccct

SEQ ID NO: 978706 - DNA, 23 bp, Homo sapiens
acctagcctggatggcccctcct

SEQ ID NO: 978707 - DNA, 17 bp, Homo sapiens
acctagctacactgagc

SEQ ID NO: 978708 - DNA, 23 bp, Homo sapiens
acctagctgtgccccctctggtt

SEQ ID NO: 978709 - DNA, 17 bp, Homo sapiens
acctagctgttgtaaag

SEQ ID NO: 978710 - DNA, 14 bp, Homo sapiens
acctagcttttaaa

SEQ ID NO: 978711 - DNA, 18 bp, Homo sapiens
acctaggccactcctcca

SEQ ID NO: 978712 - DNA, 22 bp, Homo sapiens
acctaggctgaggttagagaga

SEQ ID NO: 978713 - DNA, 23 bp, Homo sapiens
acctaggctgaggttagagagat

SEQ ID NO: 978714 - DNA, 18 bp, Homo sapiens
acctagtactctctgctc

SEQ ID NO: 978715 - DNA, 19 bp, Homo sapiens
acctagtgaaacttttcta

SEQ ID NO: 978716 - DNA, 15 bp, Homo sapiens
acctagtgccccaga

SEQ ID NO: 978717 - DNA, 16 bp, Homo sapiens
acctagtgccccagac

SEQ ID NO: 978718 - DNA, 16 bp, Homo sapiens
acctataaagtaaagc

SEQ ID NO: 978719 - DNA, 13 bp, Homo sapiens
acctatactgaaa

SEQ ID NO: 978720 - DNA, 19 bp, Homo sapiens
acctatactgaaagatctc

SEQ ID NO: 978721 - DNA, 22 bp, Homo sapiens
acctatactgaaagatctctgt

SEQ ID NO: 978722 - DNA, 22 bp, Homo sapiens
acctataggaaagtctgtcagg

SEQ ID NO: 978723 - DNA, 22 bp, Homo sapiens
acctatagtcccagctactcag

SEQ ID NO: 978724 - DNA, 22 bp, Homo sapiens
acctatataataaagctactga

SEQ ID NO: 978725 - DNA, 16 bp, Homo sapiens
acctatattgatttaa

SEQ ID NO: 978726 - DNA, 18 bp, Homo sapiens
acctatattgatttaaaa

SEQ ID NO: 978727 - DNA, 15 bp, Homo sapiens
acctatcctcactgc

SEQ ID NO: 978728 - DNA, 14 bp, Homo sapiens
acctatgacttttt

SEQ ID NO: 978729 - DNA, 15 bp, Homo sapiens
acctatgcctgtggt

SEQ ID NO: 978730 - DNA, 18 bp, Homo sapiens
acctatgtcaacagtata

SEQ ID NO: 978731 - DNA, 17 bp, Homo sapiens
acctatgtcctaaggac

SEQ ID NO: 978732 - DNA, 19 bp, Homo sapiens
acctatgtcctaaggacac

SEQ ID NO: 978733 - DNA, 23 bp, Homo sapiens
acctatgtcctaaggacacacta

SEQ ID NO: 978734 - DNA, 18 bp, Homo sapiens
acctattaggtggaaatt

SEQ ID NO: 978735 - DNA, 14 bp, Homo sapiens
acctattcaccctc

SEQ ID NO: 978736 - DNA, 19 bp, Homo sapiens
acctattcaccctccactt

SEQ ID NO: 978737 - DNA, 23 bp, Homo sapiens
acctattcaccctccacttcccg

SEQ ID NO: 978738 - DNA, 14 bp, Homo sapiens
acctattgaattac

SEQ ID NO: 978739 - DNA, 16 bp, Homo sapiens
acctattgaattacca

SEQ ID NO: 978740 - DNA, 14 bp, Homo sapiens
acctatttcctcag

SEQ ID NO: 978741 - DNA, 15 bp, Homo sapiens
acctattttcatttg

SEQ ID NO: 978742 - DNA, 19 bp, Homo sapiens
acctcaaagtaaaaattga

SEQ ID NO: 978743 - DNA, 22 bp, Homo sapiens
acctcaacccccatttctattt

SEQ ID NO: 978744 - DNA, 20 bp, Homo sapiens
acctcaagccccatttcctc

SEQ ID NO: 978745 - DNA, 22 bp, Homo sapiens
acctcaagtaataggcatttta

SEQ ID NO: 978746 - DNA, 14 bp, Homo sapiens
acctcaagttcttg

SEQ ID NO: 978747 - DNA, 16 bp, Homo sapiens
acctcaagttcttgga

SEQ ID NO: 978748 - DNA, 19 bp, Homo sapiens
acctcaatcagtctcagaa

SEQ ID NO: 978749 - DNA, 21 bp, Homo sapiens
acctcaatcagtctcagaatg

SEQ ID NO: 978750 - DNA, 16 bp, Homo sapiens
acctcaatgccctgcc

SEQ ID NO: 978751 - DNA, 17 bp, Homo sapiens
acctcaatgccctgcca

SEQ ID NO: 978752 - DNA, 16 bp, Homo sapiens
acctcaatggaggttt

SEQ ID NO: 978753 - DNA, 13 bp, Homo sapiens
acctcaatgtccc

SEQ ID NO: 978754 - DNA, 12 bp, Homo sapiens
acctcaccaaac

SEQ ID NO: 978755 - DNA, 22 bp, Homo sapiens
acctcaccattgtgaagcacct

SEQ ID NO: 978756 - DNA, 14 bp, Homo sapiens
acctcacctagaaa

SEQ ID NO: 978757 - DNA, 21 bp, Homo sapiens
acctcacctcccgaagccacc

SEQ ID NO: 978758 - DNA, 23 bp, Homo sapiens
acctcactatggtatgctggcca

SEQ ID NO: 978759 - DNA, 13 bp, Homo sapiens
acctcactcctgt

SEQ ID NO: 978760 - DNA, 14 bp, Homo sapiens
acctcactgccctc

SEQ ID NO: 978761 - DNA, 16 bp, Homo sapiens
acctcactgccctccc

SEQ ID NO: 978762 - DNA, 21 bp, Homo sapiens
acctcactggggtcctggggc

SEQ ID NO: 978763 - DNA, 14 bp, Homo sapiens
acctcagaacataa

SEQ ID NO: 978764 - DNA, 18 bp, Homo sapiens
acctcagaacataaaaag

SEQ ID NO: 978765 - DNA, 22 bp, Homo sapiens
acctcagacttaccaggaagca

SEQ ID NO: 978766 - DNA, 17 bp, Homo sapiens
acctcagagtccaggcc

SEQ ID NO: 978767 - DNA, 20 bp, Homo sapiens
acctcagagtccaggcccca

SEQ ID NO: 978768 - DNA, 23 bp, Homo sapiens
acctcagagtggagttgaaactg

SEQ ID NO: 978769 - DNA, 13 bp, Homo sapiens
acctcagcctaga

SEQ ID NO: 978770 - DNA, 12 bp, Homo sapiens
acctcagcctcc

SEQ ID NO: 978771 - DNA, 11 bp, Homo sapiens
acctcagcctg

SEQ ID NO: 978772 - DNA, 13 bp, Homo sapiens
acctcagcctgga

SEQ ID NO: 978773 - DNA, 15 bp, Homo sapiens
acctcagcctggaga

SEQ ID NO: 978774 - DNA, 17 bp, Homo sapiens
acctcagcctgtgctgc

SEQ ID NO: 978775 - DNA, 18 bp, Homo sapiens
acctcagctctgggagag

SEQ ID NO: 978776 - DNA, 22 bp, Homo sapiens
acctcagctctgggagaggatt

SEQ ID NO: 978777 - DNA, 23 bp, Homo sapiens
acctcagctctgggagaggattt

SEQ ID NO: 978778 - DNA, 14 bp, Homo sapiens
acctcaggagggca

SEQ ID NO: 978779 - DNA, 19 bp, Homo sapiens
acctcaggagggcaggctg

SEQ ID NO: 978780 - DNA, 17 bp, Homo sapiens
acctcaggcagctcaag

SEQ ID NO: 978781 - DNA, 12 bp, Homo sapiens
acctcaggcagg

SEQ ID NO: 978782 - DNA, 15 bp, Homo sapiens
acctcaggcaggaag

SEQ ID NO: 978783 - DNA, 20 bp, Homo sapiens
acctcaggccaggtgcagtg

SEQ ID NO: 978784 - DNA, 10 bp, Homo sapiens
acctcagggc

SEQ ID NO: 978785 - DNA, 17 bp, Homo sapiens
acctcagggctcccagg

SEQ ID NO: 978786 - DNA, 12 bp, Homo sapiens
acctcagggctg

SEQ ID NO: 978787 - DNA, 17 bp, Homo sapiens
acctcagggctgtccca

SEQ ID NO: 978788 - DNA, 20 bp, Homo sapiens
acctcagggctgtcccagcc

SEQ ID NO: 978789 - DNA, 16 bp, Homo sapiens
acctcaggggcacctc

SEQ ID NO: 978790 - DNA, 21 bp, Homo sapiens
acctcagtatttatgtaattt

SEQ ID NO: 978791 - DNA, 20 bp, Homo sapiens
acctcagtcaggcactggct

SEQ ID NO: 978792 - DNA, 19 bp, Homo sapiens
acctcagtggatcttcaga

SEQ ID NO: 978793 - DNA, 12 bp, Homo sapiens
acctcagtggga

SEQ ID NO: 978794 - DNA, 14 bp, Homo sapiens
acctcagtgggaag

SEQ ID NO: 978795 - DNA, 16 bp, Homo sapiens
atttttataaatactg

SEQ ID NO: 978796 - DNA, 15 bp, Homo sapiens
atttttataaattac

SEQ ID NO: 978797 - DNA, 11 bp, Homo sapiens
atttttataat

SEQ ID NO: 978798 - DNA, 16 bp, Homo sapiens
atttttataattaaag

SEQ ID NO: 978799 - DNA, 20 bp, Homo sapiens
atttttatacaaacctacca

SEQ ID NO: 978800 - DNA, 21 bp, Homo sapiens
atttttatactcagaactgtc

SEQ ID NO: 978801 - DNA, 15 bp, Homo sapiens
atttttatactgaca

SEQ ID NO: 978802 - DNA, 13 bp, Homo sapiens
atttttatagcaa

SEQ ID NO: 978803 - DNA, 21 bp, Homo sapiens
acctcatctgtggagctgcca

SEQ ID NO: 978804 - DNA, 17 bp, Homo sapiens
acctcatgaggaccagg

SEQ ID NO: 978805 - DNA, 19 bp, Homo sapiens
acctcatgccatggtcttt

SEQ ID NO: 978806 - DNA, 16 bp, Homo sapiens
acctcatgcccacccc

SEQ ID NO: 978807 - DNA, 20 bp, Homo sapiens
acctcatgcccaccccctgc

SEQ ID NO: 978808 - DNA, 22 bp, Homo sapiens
acctcatgcccagctctctgac

SEQ ID NO: 978809 - DNA, 18 bp, Homo sapiens
acctcatggattgccaca

SEQ ID NO: 978810 - DNA, 21 bp, Homo sapiens
acctcatggattgccacagct

SEQ ID NO: 978811 - DNA, 17 bp, Homo sapiens
acctcattgacaagaac

SEQ ID NO: 978812 - DNA, 22 bp, Homo sapiens
acctccaaccctgccgtcacca

SEQ ID NO: 978813 - DNA, 16 bp, Homo sapiens
acctccaactggatgt

SEQ ID NO: 978814 - DNA, 12 bp, Homo sapiens
acctccaagcat

SEQ ID NO: 978815 - DNA, 21 bp, Homo sapiens
acctccaataaagtgccttct

SEQ ID NO: 978816 - DNA, 16 bp, Homo sapiens
acctccacatcctcca

SEQ ID NO: 978817 - DNA, 17 bp, Homo sapiens
acctccaccacatctgc

SEQ ID NO: 978818 - DNA, 18 bp, Homo sapiens
acctccaccacatctgcc

SEQ ID NO: 978819 - DNA, 22 bp, Homo sapiens
acctccaccacatctgccagac

SEQ ID NO: 978820 - DNA, 23 bp, Homo sapiens
acctccaccacatctgccagacc

SEQ ID NO: 978821 - DNA, 13 bp, Homo sapiens
acctccacccagc

SEQ ID NO: 978822 - DNA, 15 bp, Homo sapiens
acctccacccagccc

SEQ ID NO: 978823 - DNA, 13 bp, Homo sapiens
acctccaccctgc

SEQ ID NO: 978824 - DNA, 21 bp, Homo sapiens
acctccaccctgcattttcct

SEQ ID NO: 978825 - DNA, 16 bp, Homo sapiens
acctccacgccactgc

SEQ ID NO: 978826 - DNA, 21 bp, Homo sapiens
acctccagaaacggccattca

SEQ ID NO: 978827 - DNA, 21 bp, Homo sapiens
acctccagcccgggagcctag

SEQ ID NO: 978828 - DNA, 20 bp, Homo sapiens
acctccagcctccctgtctc

SEQ ID NO: 978829 - DNA, 13 bp, Homo sapiens
acctccagcctga

SEQ ID NO: 978830 - DNA, 17 bp, Homo sapiens
acctccaggggctcctg

SEQ ID NO: 978831 - DNA, 19 bp, Homo sapiens
acctccaggggctcctggg

SEQ ID NO: 978832 - DNA, 20 bp, Homo sapiens
acctccaggggctcctgggt

SEQ ID NO: 978833 - DNA, 18 bp, Homo sapiens
acctccaggttcaagtga

SEQ ID NO: 978834 - DNA, 23 bp, Homo sapiens
acctccatactcaagctgtctct

SEQ ID NO: 978835 - DNA, 16 bp, Homo sapiens
acctccatatgctgta

SEQ ID NO: 978836 - DNA, 18 bp, Homo sapiens
acctccattaaagtctga

SEQ ID NO: 978837 - DNA, 20 bp, Homo sapiens
acctcccacaaaggagagct

SEQ ID NO: 978838 - DNA, 22 bp, Homo sapiens
acctcccactttgtctgtacat

SEQ ID NO: 978839 - DNA, 23 bp, Homo sapiens
acctcccactttgtctgtacata

SEQ ID NO: 978840 - DNA, 16 bp, Homo sapiens
acctcccagaggtcca

SEQ ID NO: 978841 - DNA, 17 bp, Homo sapiens
acctcccagaggtccag

SEQ ID NO: 978842 - DNA, 19 bp, Homo sapiens
acctcccagaggtccagcc

SEQ ID NO: 978843 - DNA, 16 bp, Homo sapiens
acctcccaggggactg

SEQ ID NO: 978844 - DNA, 16 bp, Homo sapiens
acctccccacacacag

SEQ ID NO: 978845 - DNA, 23 bp, Homo sapiens
acctccccacacacaggccttct

SEQ ID NO: 978846 - DNA, 18 bp, Homo sapiens
acctccccccactgcagg

SEQ ID NO: 978847 - DNA, 12 bp, Homo sapiens
acctccccctac

SEQ ID NO: 978848 - DNA, 14 bp, Homo sapiens
acctccccctaccc

SEQ ID NO: 978849 - DNA, 17 bp, Homo sapiens
acctccccctacccata

SEQ ID NO: 978850 - DNA, 13 bp, Homo sapiens
acctccccctcac

SEQ ID NO: 978851 - DNA, 15 bp, Homo sapiens
acctccccgctggga

SEQ ID NO: 978852 - DNA, 19 bp, Homo sapiens
acctcccctccttgcctcc

SEQ ID NO: 978853 - DNA, 20 bp, Homo sapiens
acctcccctccttgcctcct

SEQ ID NO: 978854 - DNA, 15 bp, Homo sapiens
acctcccctgaggct

SEQ ID NO: 978855 - DNA, 15 bp, Homo sapiens
acctccctccctctc

SEQ ID NO: 978856 - DNA, 11 bp, Homo sapiens
acctccctcct

SEQ ID NO: 978857 - DNA, 13 bp, Homo sapiens
acctccctcctca

SEQ ID NO: 978858 - DNA, 15 bp, Homo sapiens
acctccctcctcagg

SEQ ID NO: 978859 - DNA, 20 bp, Homo sapiens
acctccctgaaccatccctg

SEQ ID NO: 978860 - DNA, 14 bp, Homo sapiens
acctccctgcctcc

SEQ ID NO: 978861 - DNA, 18 bp, Homo sapiens
acctccctgctcagtgct

SEQ ID NO: 978862 - DNA, 22 bp, Homo sapiens
acctccgagaggcagccagacc

SEQ ID NO: 978863 - DNA, 23 bp, Homo sapiens
acctccgcccctgcccccgctcc

SEQ ID NO: 978864 - DNA, 18 bp, Homo sapiens
acctcctaccccttcctg

SEQ ID NO: 978865 - DNA, 14 bp, Homo sapiens
acctcctaccctcc

SEQ ID NO: 978866 - DNA, 18 bp, Homo sapiens
acctcctaccctcccacc

SEQ ID NO: 978867 - DNA, 16 bp, Homo sapiens
acctcctatccttgga

SEQ ID NO: 978868 - DNA, 12 bp, Homo sapiens
acctcctccact

SEQ ID NO: 978869 - DNA, 20 bp, Homo sapiens
acctcctccactcactccag

SEQ ID NO: 978870 - DNA, 14 bp, Homo sapiens
acctcctccccctg

SEQ ID NO: 978871 - DNA, 14 bp, Homo sapiens
acctcctccctcat

SEQ ID NO: 978872 - DNA, 16 bp, Homo sapiens
acctcctctcagtgtt

SEQ ID NO: 978873 - DNA, 22 bp, Homo sapiens
acctcctgacaacgtctcttca

SEQ ID NO: 978874 - DNA, 13 bp, Homo sapiens
acctcctgcccag

SEQ ID NO: 978875 - DNA, 14 bp, Homo sapiens
acctcctgcctccc

SEQ ID NO: 978876 - DNA, 15 bp, Homo sapiens
acctcctgcggctca

SEQ ID NO: 978877 - DNA, 18 bp, Homo sapiens
acctcctgtcactcactg

SEQ ID NO: 978878 - DNA, 18 bp, Homo sapiens
acctccttagccctgtct

SEQ ID NO: 978879 - DNA, 19 bp, Homo sapiens
acctcgaggaactccagga

SEQ ID NO: 978880 - DNA, 14 bp, Homo sapiens
acctcgctcccctc

SEQ ID NO: 978881 - DNA, 18 bp, Homo sapiens
acctcgctggactctcag

SEQ ID NO: 978882 - DNA, 18 bp, Homo sapiens
acctcggccgaggcctgc

SEQ ID NO: 978883 - DNA, 21 bp, Homo sapiens
acctcggcttgtgggctggtg

SEQ ID NO: 978884 - DNA, 20 bp, Homo sapiens
acctcggggacaccagagct

SEQ ID NO: 978885 - DNA, 18 bp, Homo sapiens
acctcggtcactccaact

SEQ ID NO: 978886 - DNA, 18 bp, Homo sapiens
acctcggtgaccactctt

SEQ ID NO: 978887 - DNA, 14 bp, Homo sapiens
acctcgtcaagagc

SEQ ID NO: 978888 - DNA, 19 bp, Homo sapiens
acctcgtcaagagcatgca

SEQ ID NO: 978889 - DNA, 15 bp, Homo sapiens
acctcgtcctccccc

SEQ ID NO: 978890 - DNA, 18 bp, Homo sapiens
acctcgtcctccccctgc

SEQ ID NO: 978891 - DNA, 20 bp, Homo sapiens
acctcgtcctccccctgcca

SEQ ID NO: 978892 - DNA, 15 bp, Homo sapiens
acctcgtctccctgg

SEQ ID NO: 978893 - DNA, 19 bp, Homo sapiens
acctcgtgccaccccgagg

SEQ ID NO: 978894 - DNA, 18 bp, Homo sapiens
acctctaatagaggcagt

SEQ ID NO: 978895 - DNA, 22 bp, Homo sapiens
acctctactaaaaagaaggaaa

SEQ ID NO: 978896 - DNA, 15 bp, Homo sapiens
acctctactgtctcc

SEQ ID NO: 978897 - DNA, 15 bp, Homo sapiens
acctctagagctgga

SEQ ID NO: 978898 - DNA, 16 bp, Homo sapiens
acctctattttaatta

SEQ ID NO: 978899 - DNA, 15 bp, Homo sapiens
acctctcaagctagt

SEQ ID NO: 978900 - DNA, 17 bp, Homo sapiens
acctctcacgggccctg

SEQ ID NO: 978901 - DNA, 18 bp, Homo sapiens
acctctcacgggccctgc

SEQ ID NO: 978902 - DNA, 20 bp, Homo sapiens
acctctcacgggccctgccc

SEQ ID NO: 978903 - DNA, 22 bp, Homo sapiens
acctctcacgggccctgcccca

SEQ ID NO: 978904 - DNA, 12 bp, Homo sapiens
acctctcactcc

SEQ ID NO: 978905 - DNA, 13 bp, Homo sapiens
acctctcactccc

SEQ ID NO: 978906 - DNA, 22 bp, Homo sapiens
acctctcagcatagcctgcctg

SEQ ID NO: 978907 - DNA, 14 bp, Homo sapiens
acctctcatgcgtg

SEQ ID NO: 978908 - DNA, 18 bp, Homo sapiens
acctctccaagtctctct

SEQ ID NO: 978909 - DNA, 13 bp, Homo sapiens
acctctcccaggg

SEQ ID NO: 978910 - DNA, 14 bp, Homo sapiens
acctctcctgaccc

SEQ ID NO: 978911 - DNA, 21 bp, Homo sapiens
acctctcctgacccctgcctg

SEQ ID NO: 978912 - DNA, 22 bp, Homo sapiens
acctctcgcaagagggtctctt

SEQ ID NO: 978913 - DNA, 23 bp, Homo sapiens
acctctcgcaagagggtctcttt

SEQ ID NO: 978914 - DNA, 21 bp, Homo sapiens
acctctcgccatgatcagaca

SEQ ID NO: 978915 - DNA, 23 bp, Homo sapiens
acctctcgcttcctcagcctcca

SEQ ID NO: 978916 - DNA, 20 bp, Homo sapiens
acctctctaagccacagctt

SEQ ID NO: 978917 - DNA, 14 bp, Homo sapiens
acctctctcctctc

SEQ ID NO: 978918 - DNA, 14 bp, Homo sapiens
acctctctctggga

SEQ ID NO: 978919 - DNA, 14 bp, Homo sapiens
acctctctgcctct

SEQ ID NO: 978920 - DNA, 16 bp, Homo sapiens
acctctctgcctctct

SEQ ID NO: 978921 - DNA, 19 bp, Homo sapiens
acctctctgcctctcttct

SEQ ID NO: 978922 - DNA, 22 bp, Homo sapiens
attttttttaaaatagaaattt

SEQ ID NO: 978923 - DNA, 19 bp, Homo sapiens
attttttttaacaaatcta

SEQ ID NO: 978924 - DNA, 21 bp, Homo sapiens
caaaactacttttctaaaatc

SEQ ID NO: 978925 - DNA, 18 bp, Homo sapiens
atttataggcgttttttg

SEQ ID NO: 978926 - DNA, 16 bp, Homo sapiens
atttatagtatgtgac

SEQ ID NO: 978927 - DNA, 18 bp, Homo sapiens
atttatagtatgtgactt

SEQ ID NO: 978928 - DNA, 22 bp, Homo sapiens
atttatagtttgtacatgcatt

SEQ ID NO: 978929 - DNA, 15 bp, Homo sapiens
atttatataaatttt

SEQ ID NO: 978930 - DNA, 17 bp, Homo sapiens
atttatataagtctgtt

SEQ ID NO: 978931 - DNA, 14 bp, Homo sapiens
atttatatactttt

SEQ ID NO: 978932 - DNA, 11 bp, Homo sapiens
atttatatata

SEQ ID NO: 978933 - DNA, 15 bp, Homo sapiens
atttatatatatatg

SEQ ID NO: 978934 - DNA, 18 bp, Homo sapiens
atttatatatatatgtat

SEQ ID NO: 978935 - DNA, 19 bp, Homo sapiens
atttatatatatatgtata

SEQ ID NO: 978936 - DNA, 16 bp, Homo sapiens
atttatatatatgtgt

SEQ ID NO: 978937 - DNA, 16 bp, Homo sapiens
atttatatatggcata

SEQ ID NO: 978938 - DNA, 14 bp, Homo sapiens
atttatatatgtat

SEQ ID NO: 978939 - DNA, 14 bp, Homo sapiens
atttatatatttat

SEQ ID NO: 978940 - DNA, 16 bp, Homo sapiens
atttatatatttataa

SEQ ID NO: 978941 - DNA, 18 bp, Homo sapiens
atttatatcttgttatta

SEQ ID NO: 978942 - DNA, 11 bp, Homo sapiens
atttatatgaa

SEQ ID NO: 978943 - DNA, 22 bp, Homo sapiens
atttatatgcttcacatagcat

SEQ ID NO: 978944 - DNA, 19 bp, Homo sapiens
atttatatggtgttaaaat

SEQ ID NO: 978945 - DNA, 12 bp, Homo sapiens
atttatattccg

SEQ ID NO: 978946 - DNA, 23 bp, Homo sapiens
atttatatttcctgtattgcttt

SEQ ID NO: 978947 - DNA, 12 bp, Homo sapiens
atttatatttgg

SEQ ID NO: 978948 - DNA, 16 bp, Homo sapiens
atttatatttggaaag

SEQ ID NO: 978949 - DNA, 18 bp, Homo sapiens
atttatatttgtgtattt

SEQ ID NO: 978950 - DNA, 18 bp, Homo sapiens
atttatatttttatttta

SEQ ID NO: 978951 - DNA, 15 bp, Homo sapiens
atttatcaaaatgta

SEQ ID NO: 978952 - DNA, 16 bp, Homo sapiens
atttatcaaaatgtag

SEQ ID NO: 978953 - DNA, 16 bp, Homo sapiens
atttatcacacttctg

SEQ ID NO: 978954 - DNA, 18 bp, Homo sapiens
atttatcagtgacagagt

SEQ ID NO: 978955 - DNA, 21 bp, Homo sapiens
atttatccaattttgatcttt

SEQ ID NO: 978956 - DNA, 17 bp, Homo sapiens
atttatccctttcctgg

SEQ ID NO: 978957 - DNA, 18 bp, Homo sapiens
atttatcctcacataaaa

SEQ ID NO: 978958 - DNA, 23 bp, Homo sapiens
atttatctcccttagaagagagc

SEQ ID NO: 978959 - DNA, 22 bp, Homo sapiens
atttatctctatttaatattta

SEQ ID NO: 978960 - DNA, 23 bp, Homo sapiens
atttatctgagcaataacttcta

SEQ ID NO: 978961 - DNA, 16 bp, Homo sapiens
atttatctgtgcaaat

SEQ ID NO: 978962 - DNA, 12 bp, Homo sapiens
atttatctttac

SEQ ID NO: 978963 - DNA, 23 bp, Homo sapiens
atttatctttaccaaaaaccatg

SEQ ID NO: 978964 - DNA, 24 bp, Homo sapiens
atttatctttaccaaaaaccatgt

SEQ ID NO: 978965 - DNA, 19 bp, Homo sapiens
atttatctttatacagatt

SEQ ID NO: 978966 - DNA, 16 bp, Homo sapiens
atttatctttcaaaga

SEQ ID NO: 978967 - DNA, 18 bp, Homo sapiens
atttatgaaaaaatatga

SEQ ID NO: 978968 - DNA, 14 bp, Homo sapiens
atttatgaagcaga

SEQ ID NO: 978969 - DNA, 18 bp, Homo sapiens
atttatgaagcagattta

SEQ ID NO: 978970 - DNA, 23 bp, Homo sapiens
atttatgaataaagaatgccatt

SEQ ID NO: 978971 - DNA, 23 bp, Homo sapiens
atttatgaattgaattatcttgg

SEQ ID NO: 978972 - DNA, 18 bp, Homo sapiens
atttatgacctaagtcag

SEQ ID NO: 978973 - DNA, 12 bp, Homo sapiens
atttatgagatt

SEQ ID NO: 978974 - DNA, 17 bp, Homo sapiens
atttatgagatttactg

SEQ ID NO: 978975 - DNA, 19 bp, Homo sapiens
atttatgagtttttgatag

SEQ ID NO: 978976 - DNA, 16 bp, Homo sapiens
atttatgatgcagttt

SEQ ID NO: 978977 - DNA, 16 bp, Homo sapiens
atttatgcaaggtatt

SEQ ID NO: 978978 - DNA, 19 bp, Homo sapiens
atttatggaattaaccatt

SEQ ID NO: 978979 - DNA, 18 bp, Homo sapiens
atttatggattaaaaact

SEQ ID NO: 978980 - DNA, 16 bp, Homo sapiens
atttatgtaacttgaa

SEQ ID NO: 978981 - DNA, 15 bp, Homo sapiens
atttatgtaatttgt

SEQ ID NO: 978982 - DNA, 18 bp, Homo sapiens
atttatgtaatttgtaca

SEQ ID NO: 978983 - DNA, 20 bp, Homo sapiens
atttatgtaatttgtacagg

SEQ ID NO: 978984 - DNA, 15 bp, Homo sapiens
atttatgtattttga

SEQ ID NO: 978985 - DNA, 16 bp, Homo sapiens
atttatgtctcatgta

SEQ ID NO: 978986 - DNA, 16 bp, Homo sapiens
atttatgtgtatatgg

SEQ ID NO: 978987 - DNA, 18 bp, Homo sapiens
atttatgtgtgaggagct

SEQ ID NO: 978988 - DNA, 19 bp, Homo sapiens
atttatgtgtgaggagctg

SEQ ID NO: 978989 - DNA, 19 bp, Homo sapiens
atttattaaaatgattgta

SEQ ID NO: 978990 - DNA, 22 bp, Homo sapiens
atttattaaacagatttttaca

SEQ ID NO: 978991 - DNA, 22 bp, Homo sapiens
atttattaaattgtgattgttt

SEQ ID NO: 978992 - DNA, 21 bp, Homo sapiens
atttattaagatggattctca

SEQ ID NO: 978993 - DNA, 23 bp, Homo sapiens
atttattaagatggattctcaga

SEQ ID NO: 978994 - DNA, 18 bp, Homo sapiens
atttattaattgctttga

SEQ ID NO: 978995 - DNA, 12 bp, Homo sapiens
atttattacata

SEQ ID NO: 978996 - DNA, 15 bp, Homo sapiens
atttattacctctga

SEQ ID NO: 978997 - DNA, 15 bp, Homo sapiens
atttattacttgtgc

SEQ ID NO: 978998 - DNA, 16 bp, Homo sapiens
atttattagttaatat

SEQ ID NO: 978999 - DNA, 21 bp, Homo sapiens
atttattagtttaaaatgcag

SEQ ID NO: 979000 - DNA, 14 bp, Homo sapiens
atttattattaatt

SEQ ID NO: 979001 - DNA, 19 bp, Homo sapiens
atttattatttatttatta

SEQ ID NO: 979002 - DNA, 14 bp, Homo sapiens
atttattattttca

SEQ ID NO: 979003 - DNA, 21 bp, Homo sapiens
atttattattttttttatatt

SEQ ID NO: 979004 - DNA, 12 bp, Homo sapiens
atttattcaaga

SEQ ID NO: 979005 - DNA, 19 bp, Homo sapiens
atttattcaattcctctgg

SEQ ID NO: 979006 - DNA, 18 bp, Homo sapiens
atttattcactgtaagtt

SEQ ID NO: 979007 - DNA, 13 bp, Homo sapiens
atttattcataga

SEQ ID NO: 979008 - DNA, 21 bp, Homo sapiens
atttattcattatttgtcaaa

SEQ ID NO: 979009 - DNA, 17 bp, Homo sapiens
atttattgactttgaca

SEQ ID NO: 979010 - DNA, 17 bp, Homo sapiens
atttattgcacattgtt

SEQ ID NO: 979011 - DNA, 24 bp, Homo sapiens
atttattgcagaggatgttcataa

SEQ ID NO: 979012 - DNA, 21 bp, Homo sapiens
atttattgcaggatggtgtct

SEQ ID NO: 979013 - DNA, 20 bp, Homo sapiens
atttattggcagccaaggaa

SEQ ID NO: 979014 - DNA, 23 bp, Homo sapiens
atttattggcagccaaggaatgt

SEQ ID NO: 979015 - DNA, 13 bp, Homo sapiens
atttattgttaaa

SEQ ID NO: 979016 - DNA, 21 bp, Homo sapiens
atttattgttaaattacattt

SEQ ID NO: 979017 - DNA, 23 bp, Homo sapiens
atttattgttagaaaatgactta

SEQ ID NO: 979018 - DNA, 19 bp, Homo sapiens
atttattgtttatttatca

SEQ ID NO: 979019 - DNA, 14 bp, Homo sapiens
atttattgtttgaa

SEQ ID NO: 979020 - DNA, 18 bp, Homo sapiens
atttattgtttgaaatgt

SEQ ID NO: 979021 - DNA, 19 bp, Homo sapiens
atttatttaaaactctggt

SEQ ID NO: 979022 - DNA, 14 bp, Homo sapiens
atttatttaaaata

SEQ ID NO: 979023 - DNA, 16 bp, Homo sapiens
atttatttaaaatagc

SEQ ID NO: 979024 - DNA, 14 bp, Homo sapiens
atttatttaaattt

SEQ ID NO: 979025 - DNA, 17 bp, Homo sapiens
atttatttaatgtgagt

SEQ ID NO: 979026 - DNA, 13 bp, Homo sapiens
atttatttacaaa

SEQ ID NO: 979027 - DNA, 18 bp, Homo sapiens
atttatttacaaatgttt

SEQ ID NO: 979028 - DNA, 23 bp, Homo sapiens
atttatttacagatgaatgtatt

SEQ ID NO: 979029 - DNA, 14 bp, Homo sapiens
atttatttatgtgt

SEQ ID NO: 979030 - DNA, 16 bp, Homo sapiens
atttatttattaagat

SEQ ID NO: 979031 - DNA, 14 bp, Homo sapiens
atttatttatttaa

SEQ ID NO: 979032 - DNA, 14 bp, Homo sapiens
atttatttcagatg

SEQ ID NO: 979033 - DNA, 16 bp, Homo sapiens
atttatttcatccagt

SEQ ID NO: 979034 - DNA, 12 bp, Homo sapiens
atttatttcctc

SEQ ID NO: 979035 - DNA, 17 bp, Homo sapiens
atttatttcctccctct

SEQ ID NO: 979036 - DNA, 13 bp, Homo sapiens
atttatttgcttc

SEQ ID NO: 979037 - DNA, 16 bp, Homo sapiens
atttatttgcttcttc

SEQ ID NO: 979038 - DNA, 13 bp, Homo sapiens
atttatttgtttc

SEQ ID NO: 979039 - DNA, 20 bp, Homo sapiens
atttattttataacatgtta

SEQ ID NO: 979040 - DNA, 16 bp, Homo sapiens
atttattttataagaa

SEQ ID NO: 979041 - DNA, 22 bp, Homo sapiens
atttattttcagtatactgtgt

SEQ ID NO: 979042 - DNA, 14 bp, Homo sapiens
atttattttgacat

SEQ ID NO: 979043 - DNA, 21 bp, Homo sapiens
atttattttgacataaagttg

SEQ ID NO: 979044 - DNA, 16 bp, Homo sapiens
atttattttgtatgaa

SEQ ID NO: 979045 - DNA, 15 bp, Homo sapiens
atttatttttcagtt

SEQ ID NO: 979046 - DNA, 16 bp, Homo sapiens
atttatttttcagttc

SEQ ID NO: 979047 - DNA, 12 bp, Homo sapiens
atttatttttgt

SEQ ID NO: 979048 - DNA, 17 bp, Homo sapiens
atttattttttcttttc

SEQ ID NO: 979049 - DNA, 18 bp, Homo sapiens
atttcaaaaatataactt

SEQ ID NO: 979050 - DNA, 14 bp, Homo sapiens
atttcaaaatacat

SEQ ID NO: 979051 - DNA, 19 bp, Homo sapiens
atttcaaaatacatttgta

SEQ ID NO: 979052 - DNA, 22 bp, Homo sapiens
atttcaaaatacatttgtaagt

SEQ ID NO: 979053 - DNA, 13 bp, Homo sapiens
atttcaaaatata

SEQ ID NO: 979054 - DNA, 14 bp, Homo sapiens
atttcaaaatgctt

SEQ ID NO: 979055 - DNA, 16 bp, Homo sapiens
atttcaaaatgctttt

SEQ ID NO: 979056 - DNA, 16 bp, Homo sapiens
atttcaaaattaatag

SEQ ID NO: 979057 - DNA, 20 bp, Homo sapiens
atttcaaaattaatagcttt

SEQ ID NO: 979058 - DNA, 13 bp, Homo sapiens
atttcaaaattta

SEQ ID NO: 979059 - DNA, 21 bp, Homo sapiens
atttcaaagccctgcctctgt

SEQ ID NO: 979060 - DNA, 23 bp, Homo sapiens
atttcaaagccctgcctctgtgt

SEQ ID NO: 979061 - DNA, 13 bp, Homo sapiens
atttcaaatgcag

SEQ ID NO: 979062 - DNA, 17 bp, Homo sapiens
atttcaaattggagctt

SEQ ID NO: 979063 - DNA, 18 bp, Homo sapiens
atttcaacatgagtgtat

SEQ ID NO: 979064 - DNA, 23 bp, Homo sapiens
atttcaagttccaagttgctaat

SEQ ID NO: 979065 - DNA, 14 bp, Homo sapiens
atttcaatcattga

SEQ ID NO: 979066 - DNA, 19 bp, Homo sapiens
atttcaatcattgaagtat

SEQ ID NO: 979067 - DNA, 21 bp, Homo sapiens
atttcaatgcgttttgttgta

SEQ ID NO: 979068 - DNA, 16 bp, Homo sapiens
atttcaatgtaattaa

SEQ ID NO: 979069 - DNA, 17 bp, Homo sapiens
atttcaattcctggccc

SEQ ID NO: 979070 - DNA, 20 bp, Homo sapiens
atttcacagagcacgcctgc

SEQ ID NO: 979071 - DNA, 23 bp, Homo sapiens
atttcacagtgtgtttgtgattg

SEQ ID NO: 979072 - DNA, 18 bp, Homo sapiens
atttcaccagaagttaca

SEQ ID NO: 979073 - DNA, 14 bp, Homo sapiens
atttcacctgtaaa

SEQ ID NO: 979074 - DNA, 18 bp, Homo sapiens
atttcacctgtaaacctg

SEQ ID NO: 979075 - DNA, 22 bp, Homo sapiens
atttcacctgtgacaaaggatg

SEQ ID NO: 979076 - DNA, 16 bp, Homo sapiens
atttcacgattcattt

SEQ ID NO: 979077 - DNA, 15 bp, Homo sapiens
atttcactaggactc

SEQ ID NO: 979078 - DNA, 14 bp, Homo sapiens
atttcactattttt

SEQ ID NO: 979079 - DNA, 13 bp, Homo sapiens
atttcactgtctt

SEQ ID NO: 979080 - DNA, 12 bp, Homo sapiens
atttcacttgat

SEQ ID NO: 979081 - DNA, 18 bp, Homo sapiens
atttcacttttgttctgc

SEQ ID NO: 979082 - DNA, 19 bp, Homo sapiens
atttcagaaggagaaggaa

SEQ ID NO: 979083 - DNA, 16 bp, Homo sapiens
atttcagagaggcctt

SEQ ID NO: 979084 - DNA, 22 bp, Homo sapiens
atttcagagaggccttttggaa

SEQ ID NO: 979085 - DNA, 23 bp, Homo sapiens
atttcagagtgactacacacagt

SEQ ID NO: 979086 - DNA, 14 bp, Homo sapiens
atttcagatgcttt

SEQ ID NO: 979087 - DNA, 13 bp, Homo sapiens
atttcagatgtaa

SEQ ID NO: 979088 - DNA, 14 bp, Homo sapiens
atttcagcctcctg

SEQ ID NO: 979089 - DNA, 12 bp, Homo sapiens
atttcaggaaaa

SEQ ID NO: 979090 - DNA, 19 bp, Homo sapiens
atttcaggatactctgtca

SEQ ID NO: 979091 - DNA, 19 bp, Homo sapiens
atttcaggcattttgttct

SEQ ID NO: 979092 - DNA, 15 bp, Homo sapiens
atttcagggacctca

SEQ ID NO: 979093 - DNA, 16 bp, Homo sapiens
atttcagggacctcag

SEQ ID NO: 979094 - DNA, 17 bp, Homo sapiens
atttcagggacctcagg

SEQ ID NO: 979095 - DNA, 21 bp, Homo sapiens
atttcagggacctcaggggca

SEQ ID NO: 979096 - DNA, 12 bp, Homo sapiens
atttcagggtgc

SEQ ID NO: 979097 - DNA, 19 bp, Homo sapiens
atttcagtagaattttagt

SEQ ID NO: 979098 - DNA, 22 bp, Homo sapiens
atttcagtagaattttagtcct

SEQ ID NO: 979099 - DNA, 18 bp, Homo sapiens
atttcagtatcatctcca

SEQ ID NO: 979100 - DNA, 15 bp, Homo sapiens
atttcagtattttcc

SEQ ID NO: 979101 - DNA, 14 bp, Homo sapiens
atttcagtggcttc

SEQ ID NO: 979102 - DNA, 17 bp, Homo sapiens
atttcagtgtaaagtgt

SEQ ID NO: 979103 - DNA, 16 bp, Homo sapiens
atttcagtttttcatt

SEQ ID NO: 979104 - DNA, 18 bp, Homo sapiens
atttcataaacaacttaa

SEQ ID NO: 979105 - DNA, 12 bp, Homo sapiens
atttcataaaga

SEQ ID NO: 979106 - DNA, 15 bp, Homo sapiens
atttcataattcaga

SEQ ID NO: 979107 - DNA, 16 bp, Homo sapiens
atttcataattctgaa

SEQ ID NO: 979108 - DNA, 21 bp, Homo sapiens
atttcataccattattatgta

SEQ ID NO: 979109 - DNA, 23 bp, Homo sapiens
atttcatactgtaacattcagga

SEQ ID NO: 979110 - DNA, 13 bp, Homo sapiens
atttcatagttca

SEQ ID NO: 979111 - DNA, 19 bp, Homo sapiens
atttcatagttcagaattt

SEQ ID NO: 979112 - DNA, 18 bp, Homo sapiens
atttcatatactataatt

SEQ ID NO: 979113 - DNA, 17 bp, Homo sapiens
atttcatcattgtttct

SEQ ID NO: 979114 - DNA, 13 bp, Homo sapiens
atttcatctattt

SEQ ID NO: 979115 - DNA, 15 bp, Homo sapiens
atttcatctatttct

SEQ ID NO: 979116 - DNA, 19 bp, Homo sapiens
atttcatctatttctgaga

SEQ ID NO: 979117 - DNA, 14 bp, Homo sapiens
atttcatctcattt

SEQ ID NO: 979118 - DNA, 15 bp, Homo sapiens
atttcatctcattta

SEQ ID NO: 979119 - DNA, 21 bp, Homo sapiens
atttcatctcatttaagggaa

SEQ ID NO: 979120 - DNA, 19 bp, Homo sapiens
atttcatctgggtggtctg

SEQ ID NO: 979121 - DNA, 22 bp, Homo sapiens
atttcatctgggtggtctgaat

SEQ ID NO: 979122 - DNA, 14 bp, Homo sapiens
atttcatgaaaaag

SEQ ID NO: 979123 - DNA, 15 bp, Homo sapiens
atttcatgaaaatga

SEQ ID NO: 979124 - DNA, 20 bp, Homo sapiens
atttcatgattcaacctgat

SEQ ID NO: 979125 - DNA, 13 bp, Homo sapiens
atttcatgtccat

SEQ ID NO: 979126 - DNA, 21 bp, Homo sapiens
atttcatgtccataaaagaga

SEQ ID NO: 979127 - DNA, 14 bp, Homo sapiens
atttcatgtggctg

SEQ ID NO: 979128 - DNA, 16 bp, Homo sapiens
atttcatgtggctgta

SEQ ID NO: 979129 - DNA, 16 bp, Homo sapiens
atttcatgtttttgat

SEQ ID NO: 979130 - DNA, 15 bp, Homo sapiens
atttcattatgcttt

SEQ ID NO: 979131 - DNA, 15 bp, Homo sapiens
atttcattcaaatca

SEQ ID NO: 979132 - DNA, 11 bp, Homo sapiens
atttcattcca

SEQ ID NO: 979133 - DNA, 19 bp, Homo sapiens
atttcattggttaattttt

SEQ ID NO: 979134 - DNA, 12 bp, Homo sapiens
atttcattgtat

SEQ ID NO: 979135 - DNA, 14 bp, Homo sapiens
atttcattgtatga

SEQ ID NO: 979136 - DNA, 15 bp, Homo sapiens
atttcattgtatgat

SEQ ID NO: 979137 - DNA, 19 bp, Homo sapiens
atttcattgtatgatgtgt

SEQ ID NO: 979138 - DNA, 12 bp, Homo sapiens
atttcatttagc

SEQ ID NO: 979139 - DNA, 18 bp, Homo sapiens
atttcatttcaactgttt

SEQ ID NO: 979140 - DNA, 19 bp, Homo sapiens
atttcattttaacatgatt

SEQ ID NO: 979141 - DNA, 17 bp, Homo sapiens
atttccaaaataatcta

SEQ ID NO: 979142 - DNA, 22 bp, Homo sapiens
atttccaaaataatctatatta

SEQ ID NO: 979143 - DNA, 21 bp, Homo sapiens
atttccaacaccacagacaca

SEQ ID NO: 979144 - DNA, 19 bp, Homo sapiens
atttccaactcgaatctgt

SEQ ID NO: 979145 - DNA, 18 bp, Homo sapiens
atttccaccaggccgtgc

SEQ ID NO: 979146 - DNA, 21 bp, Homo sapiens
atttccactaaaaatattgtt

SEQ ID NO: 979147 - DNA, 16 bp, Homo sapiens
atttccactgaacaaa

SEQ ID NO: 979148 - DNA, 17 bp, Homo sapiens
atttccactgaacaaaa

SEQ ID NO: 979149 - DNA, 15 bp, Homo sapiens
atttccactgtatat

SEQ ID NO: 979150 - DNA, 18 bp, Homo sapiens
atttccactgtatatttt

SEQ ID NO: 979151 - DNA, 14 bp, Homo sapiens
atttccagacaaat

SEQ ID NO: 979152 - DNA, 10 bp, Homo sapiens
atttccagag

SEQ ID NO: 979153 - DNA, 12 bp, Homo sapiens
atttccagagtc

SEQ ID NO: 979154 - DNA, 21 bp, Homo sapiens
atttccagagtccggaggcag

SEQ ID NO: 979155 - DNA, 15 bp, Homo sapiens
atttccaggaaaaaa

SEQ ID NO: 979156 - DNA, 18 bp, Homo sapiens
atttccaggaaaaaataa

SEQ ID NO: 979157 - DNA, 23 bp, Homo sapiens
atttccaggaaaaaataaaaaga

SEQ ID NO: 979158 - DNA, 11 bp, Homo sapiens
atttccaggcc

SEQ ID NO: 979159 - DNA, 19 bp, Homo sapiens
atttccagggcagcagccg

SEQ ID NO: 979160 - DNA, 21 bp, Homo sapiens
atttccagtgagtgtaaataa

SEQ ID NO: 979161 - DNA, 22 bp, Homo sapiens
atttccagtgttctatgaacaa

SEQ ID NO: 979162 - DNA, 20 bp, Homo sapiens
atttccatcttaatgttact

SEQ ID NO: 979163 - DNA, 18 bp, Homo sapiens
atttccattgtgtggcct

SEQ ID NO: 979164 - DNA, 21 bp, Homo sapiens
atttccattgtgtggcctggt

SEQ ID NO: 979165 - DNA, 20 bp, Homo sapiens
atttccatttacttaagact

SEQ ID NO: 979166 - DNA, 17 bp, Homo sapiens
atttcccaattaggaag

SEQ ID NO: 979167 - DNA, 18 bp, Homo sapiens
atttcccaattaggaagt

SEQ ID NO: 979168 - DNA, 14 bp, Homo sapiens
atttcccacatctt

SEQ ID NO: 979169 - DNA, 15 bp, Homo sapiens
atttcccacatcttt

SEQ ID NO: 979170 - DNA, 16 bp, Homo sapiens
atttcccagttaaaga

SEQ ID NO: 979171 - DNA, 18 bp, Homo sapiens
atttcccagttaaagatt

SEQ ID NO: 979172 - DNA, 21 bp, Homo sapiens
atttcccagttaaagattatt

SEQ ID NO: 979173 - DNA, 15 bp, Homo sapiens
atttcccatctgcac

SEQ ID NO: 979174 - DNA, 21 bp, Homo sapiens
atttcccatttgtgccagagg

SEQ ID NO: 979175 - DNA, 22 bp, Homo sapiens
atttcccatttgtgccagagga

SEQ ID NO: 979176 - DNA, 20 bp, Homo sapiens
atttccccacccccctctct

SEQ ID NO: 979177 - DNA, 23 bp, Homo sapiens
atttcccccctccgcctccagga

SEQ ID NO: 979178 - DNA, 15 bp, Homo sapiens
atttccccctcctca

SEQ ID NO: 979179 - DNA, 16 bp, Homo sapiens
atttccccctcctcag

SEQ ID NO: 979180 - DNA, 19 bp, Homo sapiens
atttccccgatgtcccctg

SEQ ID NO: 979181 - DNA, 22 bp, Homo sapiens
atttccccgatgtcccctgcgg

SEQ ID NO: 979182 - DNA, 15 bp, Homo sapiens
atttcccctccttcc

SEQ ID NO: 979183 - DNA, 23 bp, Homo sapiens
atttcccctctgcacccagaaca

SEQ ID NO: 979184 - DNA, 13 bp, Homo sapiens
atttcccctgtca

SEQ ID NO: 979185 - DNA, 21 bp, Homo sapiens
atttcccggagccatcaccct

SEQ ID NO: 979186 - DNA, 17 bp, Homo sapiens
atttccctatcttctcc

SEQ ID NO: 979187 - DNA, 14 bp, Homo sapiens
atttcccttccaaa

SEQ ID NO: 979188 - DNA, 15 bp, Homo sapiens
atttcccttccaaag

SEQ ID NO: 979189 - DNA, 20 bp, Homo sapiens
atttccgtccccccccaggc

SEQ ID NO: 979190 - DNA, 22 bp, Homo sapiens
atttccgtccccccccaggccc

SEQ ID NO: 979191 - DNA, 16 bp, Homo sapiens
atttccgttaaaatac

SEQ ID NO: 979192 - DNA, 17 bp, Homo sapiens
atttccgttaaaatacc

SEQ ID NO: 979193 - DNA, 21 bp, Homo sapiens
atttcctaatactgtcatcct

SEQ ID NO: 979194 - DNA, 21 bp, Homo sapiens
atttcctcagcttatctcttt

SEQ ID NO: 979195 - DNA, 16 bp, Homo sapiens
atttcctccatggtgg

SEQ ID NO: 979196 - DNA, 13 bp, Homo sapiens
atttcctcccaat

SEQ ID NO: 979197 - DNA, 16 bp, Homo sapiens
atttcctctaaagaaa

SEQ ID NO: 979198 - DNA, 17 bp, Homo sapiens
atttcctctaaagaaac

SEQ ID NO: 979199 - DNA, 16 bp, Homo sapiens
atttcctctccactgc

SEQ ID NO: 979200 - DNA, 15 bp, Homo sapiens
atttcctctgttctt

SEQ ID NO: 979201 - DNA, 18 bp, Homo sapiens
atttcctctgttcttttc

SEQ ID NO: 979202 - DNA, 18 bp, Homo sapiens
atttcctgaaataaatgt

SEQ ID NO: 979203 - DNA, 20 bp, Homo sapiens
atttcctgaaataaatgttt

SEQ ID NO: 979204 - DNA, 15 bp, Homo sapiens
atttcctgacttgag

SEQ ID NO: 979205 - DNA, 16 bp, Homo sapiens
atttcctgacttgagt

SEQ ID NO: 979206 - DNA, 19 bp, Homo sapiens
atttcctgatacattaaaa

SEQ ID NO: 979207 - DNA, 11 bp, Homo sapiens
atttcctgatc

SEQ ID NO: 979208 - DNA, 16 bp, Homo sapiens
atttcctgatctagca

SEQ ID NO: 979209 - DNA, 20 bp, Homo sapiens
atttcctgcccttcctcagt

SEQ ID NO: 979210 - DNA, 13 bp, Homo sapiens
atttcctgctgaa

SEQ ID NO: 979211 - DNA, 21 bp, Homo sapiens
atttcctgtacaatcatgaac

SEQ ID NO: 979212 - DNA, 18 bp, Homo sapiens
atttcctgtattgcttta

SEQ ID NO: 979213 - DNA, 19 bp, Homo sapiens
atttcctgtgtttgtcctg

SEQ ID NO: 979214 - DNA, 13 bp, Homo sapiens
atttccttaaaat

SEQ ID NO: 979215 - DNA, 19 bp, Homo sapiens
atttccttcaatgtgcata

SEQ ID NO: 979216 - DNA, 16 bp, Homo sapiens
atttccttcaggtttt

SEQ ID NO: 979217 - DNA, 22 bp, Homo sapiens
atttccttccaaggtcactctt

SEQ ID NO: 979218 - DNA, 14 bp, Homo sapiens
atttccttccactg

SEQ ID NO: 979219 - DNA, 16 bp, Homo sapiens
atttccttctgttaag

SEQ ID NO: 979220 - DNA, 23 bp, Homo sapiens
atttccttctgttaagaaaggat

SEQ ID NO: 979221 - DNA, 14 bp, Homo sapiens
atttcctttatgtg

SEQ ID NO: 979222 - DNA, 20 bp, Homo sapiens
atttcctttttgacactgaa

SEQ ID NO: 979223 - DNA, 19 bp, Homo sapiens
atttccttttttgttatta

SEQ ID NO: 979224 - DNA, 14 bp, Homo sapiens
atttcgaaactgcc

SEQ ID NO: 979225 - DNA, 21 bp, Homo sapiens
atttcgccgttgaagaggaag

SEQ ID NO: 979226 - DNA, 13 bp, Homo sapiens
atttcgccttaaa

SEQ ID NO: 979227 - DNA, 15 bp, Homo sapiens
atttcgccttaaact

SEQ ID NO: 979228 - DNA, 20 bp, Homo sapiens
atttcggattttttccaaaa

SEQ ID NO: 979229 - DNA, 17 bp, Homo sapiens
atttctaaaatataaga

SEQ ID NO: 979230 - DNA, 12 bp, Homo sapiens
atttctaaagta

SEQ ID NO: 979231 - DNA, 21 bp, Homo sapiens
atttctaaatctccaaaataa

SEQ ID NO: 979232 - DNA, 19 bp, Homo sapiens
atttctaacagtccttgct

SEQ ID NO: 979233 - DNA, 21 bp, Homo sapiens
atttctaacagtccttgcttt

SEQ ID NO: 979234 - DNA, 20 bp, Homo sapiens
atttctaacatatgtattaa

SEQ ID NO: 979235 - DNA, 17 bp, Homo sapiens
atttctaagaagttact

SEQ ID NO: 979236 - DNA, 16 bp, Homo sapiens
atttctaagaagttgt

SEQ ID NO: 979237 - DNA, 16 bp, Homo sapiens
atttctaattccacag

SEQ ID NO: 979238 - DNA, 14 bp, Homo sapiens
atttctacaaaata

SEQ ID NO: 979239 - DNA, 17 bp, Homo sapiens
atttctacagagaaaat

SEQ ID NO: 979240 - DNA, 15 bp, Homo sapiens
atttctaccagatgt

SEQ ID NO: 979241 - DNA, 20 bp, Homo sapiens
atttctaccagatgtgcttt

SEQ ID NO: 979242 - DNA, 18 bp, Homo sapiens
atttctactatatacata

SEQ ID NO: 979243 - DNA, 21 bp, Homo sapiens
atttctactgtcaaatgatgt

SEQ ID NO: 979244 - DNA, 15 bp, Homo sapiens
atttctactgtgact

SEQ ID NO: 979245 - DNA, 16 bp, Homo sapiens
atttctactgtgactg

SEQ ID NO: 979246 - DNA, 17 bp, Homo sapiens
atttctactgtgactga

SEQ ID NO: 979247 - DNA, 21 bp, Homo sapiens
atttctactttttgcacctta

SEQ ID NO: 979248 - DNA, 20 bp, Homo sapiens
atttctagaagcacatgtgt

SEQ ID NO: 979249 - DNA, 20 bp, Homo sapiens
atttctagacagtattgcca

SEQ ID NO: 979250 - DNA, 23 bp, Homo sapiens
atttctagacagtattgccacct

SEQ ID NO: 979251 - DNA, 14 bp, Homo sapiens
atttctagcagagt

SEQ ID NO: 979252 - DNA, 18 bp, Homo sapiens
atttctagctttttaatt

SEQ ID NO: 979253 - DNA, 18 bp, Homo sapiens
atttctaggcacaaggtt

SEQ ID NO: 979254 - DNA, 18 bp, Homo sapiens
atttctagggaaattttt

SEQ ID NO: 979255 - DNA, 20 bp, Homo sapiens
atttctaggtaggaaatgtg

SEQ ID NO: 979256 - DNA, 20 bp, Homo sapiens
atttctagtccaaaattaca

SEQ ID NO: 979257 - DNA, 21 bp, Homo sapiens
atttctagtgtatactctgta

SEQ ID NO: 979258 - DNA, 20 bp, Homo sapiens
atttctataaatttaagaaa

SEQ ID NO: 979259 - DNA, 21 bp, Homo sapiens
atttctataaatttaagaaaa

SEQ ID NO: 979260 - DNA, 18 bp, Homo sapiens
atttctatactttacagg

SEQ ID NO: 979261 - DNA, 20 bp, Homo sapiens
atttctatactttacaggaa

SEQ ID NO: 979262 - DNA, 16 bp, Homo sapiens
atttctatgacaaatt

SEQ ID NO: 979263 - DNA, 14 bp, Homo sapiens
atttctatgagaaa

SEQ ID NO: 979264 - DNA, 16 bp, Homo sapiens
atttctatgtaaatta

SEQ ID NO: 979265 - DNA, 21 bp, Homo sapiens
atttctatgtcatttttaatg

SEQ ID NO: 979266 - DNA, 22 bp, Homo sapiens
atttctatgtcatttttaatgt

SEQ ID NO: 979267 - DNA, 13 bp, Homo sapiens
atttctattaata

SEQ ID NO: 979268 - DNA, 14 bp, Homo sapiens
atttctattattaa

SEQ ID NO: 979269 - DNA, 13 bp, Homo sapiens
atttctattcctt

SEQ ID NO: 979270 - DNA, 17 bp, Homo sapiens
atttctatttatttact

SEQ ID NO: 979271 - DNA, 15 bp, Homo sapiens
atttctattttttgt

SEQ ID NO: 979272 - DNA, 21 bp, Homo sapiens
atttctcagcctggttcagaa

SEQ ID NO: 979273 - DNA, 14 bp, Homo sapiens
atttctcagtgatt

SEQ ID NO: 979274 - DNA, 20 bp, Homo sapiens
atttctcatgcttcttctca

SEQ ID NO: 979275 - DNA, 14 bp, Homo sapiens
atttctcatgtttt

SEQ ID NO: 979276 - DNA, 13 bp, Homo sapiens
atttctccagacc

SEQ ID NO: 979277 - DNA, 14 bp, Homo sapiens
atttctccagaccc

SEQ ID NO: 979278 - DNA, 18 bp, Homo sapiens
atttctccagttgggact

SEQ ID NO: 979279 - DNA, 20 bp, Homo sapiens
atttctccatgggccaccgc

SEQ ID NO: 979280 - DNA, 17 bp, Homo sapiens
atttctcctcccttcct

SEQ ID NO: 979281 - DNA, 19 bp, Homo sapiens
atttctcctcccttccttt

SEQ ID NO: 979282 - DNA, 18 bp, Homo sapiens
atttctctacttgtcata

SEQ ID NO: 979283 - DNA, 19 bp, Homo sapiens
atttctctatgtttattct

SEQ ID NO: 979284 - DNA, 16 bp, Homo sapiens
atttctctctcctggt

SEQ ID NO: 979285 - DNA, 23 bp, Homo sapiens
atttctctctcctggtgtgggta

SEQ ID NO: 979286 - DNA, 13 bp, Homo sapiens
atttctctgagca

SEQ ID NO: 979287 - DNA, 19 bp, Homo sapiens
atttctctgatttgcaaaa

SEQ ID NO: 979288 - DNA, 16 bp, Homo sapiens
atttctctggcaaact

SEQ ID NO: 979289 - DNA, 13 bp, Homo sapiens
atttctctgtgta

SEQ ID NO: 979290 - DNA, 22 bp, Homo sapiens
atttctctgtgtatttatataa

SEQ ID NO: 979291 - DNA, 13 bp, Homo sapiens
atttctcttctca

SEQ ID NO: 979292 - DNA, 19 bp, Homo sapiens
atttctcttctcagctctt

SEQ ID NO: 979293 - DNA, 22 bp, Homo sapiens
atttctcttctcagctcttcca

SEQ ID NO: 979294 - DNA, 23 bp, Homo sapiens
atttctcttctcagctcttccat

SEQ ID NO: 979295 - DNA, 18 bp, Homo sapiens
atttctcttgggcaggca

SEQ ID NO: 979296 - DNA, 19 bp, Homo sapiens
atttctcttttattctgtt

SEQ ID NO: 979297 - DNA, 15 bp, Homo sapiens
atttctgaattgttg

SEQ ID NO: 979298 - DNA, 17 bp, Homo sapiens
atttctgagaaggtcct

SEQ ID NO: 979299 - DNA, 19 bp, Homo sapiens
attgtcagttttgttcact

SEQ ID NO: 979300 - DNA, 13 bp, Homo sapiens
attgtcattaaag

SEQ ID NO: 979301 - DNA, 18 bp, Homo sapiens
attgtccaatcctatgtt

SEQ ID NO: 979302 - DNA, 13 bp, Homo sapiens
attgtccagctgg

SEQ ID NO: 979303 - DNA, 23 bp, Homo sapiens
attgtccagctgggacctaatgc

SEQ ID NO: 979304 - DNA, 20 bp, Homo sapiens
attgtccaggtgaggcccaa

SEQ ID NO: 979305 - DNA, 14 bp, Homo sapiens
attgtccagtttgt

SEQ ID NO: 979306 - DNA, 12 bp, Homo sapiens
attgtccctctg

SEQ ID NO: 979307 - DNA, 19 bp, Homo sapiens
attgtcctccttttcactt

SEQ ID NO: 979308 - DNA, 20 bp, Homo sapiens
attgtcctccttttcacttt

SEQ ID NO: 979309 - DNA, 22 bp, Homo sapiens
attgtcctgtgaaatattctta

SEQ ID NO: 979310 - DNA, 17 bp, Homo sapiens
attgtccttcagagctc

SEQ ID NO: 979311 - DNA, 18 bp, Homo sapiens
attgtccttcagagctct

SEQ ID NO: 979312 - DNA, 21 bp, Homo sapiens
attgtccttttctcccatttc

SEQ ID NO: 979313 - DNA, 15 bp, Homo sapiens
attgtccttttgcaa

SEQ ID NO: 979314 - DNA, 17 bp, Homo sapiens
attgtccttttgcaaag

SEQ ID NO: 979315 - DNA, 18 bp, Homo sapiens
attgtccttttgcaaaga

SEQ ID NO: 979316 - DNA, 17 bp, Homo sapiens
attgtcgctatgtgact

SEQ ID NO: 979317 - DNA, 15 bp, Homo sapiens
attgtcgctattgat

SEQ ID NO: 979318 - DNA, 22 bp, Homo sapiens
attgtctaaagttactactgat

SEQ ID NO: 979319 - DNA, 16 bp, Homo sapiens
attgtctactctgaag

SEQ ID NO: 979320 - DNA, 13 bp, Homo sapiens
attgtctatttat

SEQ ID NO: 979321 - DNA, 18 bp, Homo sapiens
attgtctcccgcccccca

SEQ ID NO: 979322 - DNA, 16 bp, Homo sapiens
attgtctgaacttgca

SEQ ID NO: 979323 - DNA, 12 bp, Homo sapiens
attgtctgtaaa

SEQ ID NO: 979324 - DNA, 11 bp, Homo sapiens
attgtcttaaa

SEQ ID NO: 979325 - DNA, 16 bp, Homo sapiens
attgtcttaatattgt

SEQ ID NO: 979326 - DNA, 17 bp, Homo sapiens
attgtcttgcaacttca

SEQ ID NO: 979327 - DNA, 13 bp, Homo sapiens
attgtctttgctg

SEQ ID NO: 979328 - DNA, 22 bp, Homo sapiens
attgtcttttagacaactagat

SEQ ID NO: 979329 - DNA, 23 bp, Homo sapiens
attgtcttttagacaactagatt

SEQ ID NO: 979330 - DNA, 21 bp, Homo sapiens
attgtgacagcgatggcaggc

SEQ ID NO: 979331 - DNA, 15 bp, Homo sapiens
attgtgaccaagtta

SEQ ID NO: 979332 - DNA, 16 bp, Homo sapiens
attgtgaccaagttat

SEQ ID NO: 979333 - DNA, 17 bp, Homo sapiens
attgtgaccaagttata

SEQ ID NO: 979334 - DNA, 14 bp, Homo sapiens
attgtgacttcact

SEQ ID NO: 979335 - DNA, 22 bp, Homo sapiens
attgtgacttcactgtatataa

SEQ ID NO: 979336 - DNA, 19 bp, Homo sapiens
attgtgagttttctatttc

SEQ ID NO: 979337 - DNA, 19 bp, Homo sapiens
attgtgatgtatattcctt

SEQ ID NO: 979338 - DNA, 22 bp, Homo sapiens
attgtgattagacagaacacct

SEQ ID NO: 979339 - DNA, 23 bp, Homo sapiens
attgtgattagacagaacaccta

SEQ ID NO: 979340 - DNA, 18 bp, Homo sapiens
attgtgcaatgtaaatat

SEQ ID NO: 979341 - DNA, 15 bp, Homo sapiens
attgtgccaagcctt

SEQ ID NO: 979342 - DNA, 18 bp, Homo sapiens
attgtgccaagccttctg

SEQ ID NO: 979343 - DNA, 22 bp, Homo sapiens
attgtgccatgtcaaacaaata

SEQ ID NO: 979344 - DNA, 12 bp, Homo sapiens
attgtgctgcca

SEQ ID NO: 979345 - DNA, 21 bp, Homo sapiens
attgtgctttcaccagaattt

SEQ ID NO: 979346 - DNA, 16 bp, Homo sapiens
attgtgctttggttaa

SEQ ID NO: 979347 - DNA, 18 bp, Homo sapiens
attgtgctttggttaata

SEQ ID NO: 979348 - DNA, 23 bp, Homo sapiens
attgtgctttggttaatacatct

SEQ ID NO: 979349 - DNA, 11 bp, Homo sapiens
attgtggaaaa

SEQ ID NO: 979350 - DNA, 16 bp, Homo sapiens
attgtggaaaaccagg

SEQ ID NO: 979351 - DNA, 16 bp, Homo sapiens
attgtggaataaatcc

SEQ ID NO: 979352 - DNA, 14 bp, Homo sapiens
attgtggaatgttg

SEQ ID NO: 979353 - DNA, 17 bp, Homo sapiens
attgtggaatgttggat

SEQ ID NO: 979354 - DNA, 20 bp, Homo sapiens
attgtggaatgttggataag

SEQ ID NO: 979355 - DNA, 22 bp, Homo sapiens
attgtggatgtgttcattcaag

SEQ ID NO: 979356 - DNA, 22 bp, Homo sapiens
attgtggattataaaaaatgta

SEQ ID NO: 979357 - DNA, 12 bp, Homo sapiens
attgtggggtgc

SEQ ID NO: 979358 - DNA, 18 bp, Homo sapiens
attgtgggtaacgtgaga

SEQ ID NO: 979359 - DNA, 18 bp, Homo sapiens
attgtggtacaatctcaa

SEQ ID NO: 979360 - DNA, 17 bp, Homo sapiens
attgtgtaaaaaatgga

SEQ ID NO: 979361 - DNA, 19 bp, Homo sapiens
attgtgtaaaaaatggaaa

SEQ ID NO: 979362 - DNA, 18 bp, Homo sapiens
attgtgtagcaattgaca

SEQ ID NO: 979363 - DNA, 15 bp, Homo sapiens
attgtgtatatatct

SEQ ID NO: 979364 - DNA, 15 bp, Homo sapiens
attgtgtatattcat

SEQ ID NO: 979365 - DNA, 14 bp, Homo sapiens
attgtgtatctgtg

SEQ ID NO: 979366 - DNA, 18 bp, Homo sapiens
attgtgtattgatgcaat

SEQ ID NO: 979367 - DNA, 14 bp, Homo sapiens
attgtgtctgcatt

SEQ ID NO: 979368 - DNA, 19 bp, Homo sapiens
attgtgtgaaaaaagaaaa

SEQ ID NO: 979369 - DNA, 14 bp, Homo sapiens
attgtgtgaatact

SEQ ID NO: 979370 - DNA, 19 bp, Homo sapiens
attgtgtggattctttaaa

SEQ ID NO: 979371 - DNA, 16 bp, Homo sapiens
attgtgtggcctggtg

SEQ ID NO: 979372 - DNA, 17 bp, Homo sapiens
attgtgtggcctggtgg

SEQ ID NO: 979373 - DNA, 18 bp, Homo sapiens
attgtgtgttgattgtat

SEQ ID NO: 979374 - DNA, 20 bp, Homo sapiens
attgtgttacctgtagattc

SEQ ID NO: 979375 - DNA, 15 bp, Homo sapiens
attgtgttcccattt

SEQ ID NO: 979376 - DNA, 15 bp, Homo sapiens
attgtgttgaagaag

SEQ ID NO: 979377 - DNA, 22 bp, Homo sapiens
attgtgttgactttataaattt

SEQ ID NO: 979378 - DNA, 18 bp, Homo sapiens
attgtgtttgttcataat

SEQ ID NO: 979379 - DNA, 13 bp, Homo sapiens
attgttaaaataa

SEQ ID NO: 979380 - DNA, 16 bp, Homo sapiens
attgttaaattacatt

SEQ ID NO: 979381 - DNA, 17 bp, Homo sapiens
attgttaaattacattt

SEQ ID NO: 979382 - DNA, 22 bp, Homo sapiens
attgttaagtctaaatatttcc

SEQ ID NO: 979383 - DNA, 17 bp, Homo sapiens
attgttaatttttccta

SEQ ID NO: 979384 - DNA, 20 bp, Homo sapiens
attgttacattatgtggaaa

SEQ ID NO: 979385 - DNA, 18 bp, Homo sapiens
attgttagggtcagccat

SEQ ID NO: 979386 - DNA, 22 bp, Homo sapiens
attgttattgtggaagatttac

SEQ ID NO: 979387 - DNA, 12 bp, Homo sapiens
attgttcatttt

SEQ ID NO: 979388 - DNA, 20 bp, Homo sapiens
attgttcattttgagctgaa

SEQ ID NO: 979389 - DNA, 18 bp, Homo sapiens
attgttccaaatgaatgt

SEQ ID NO: 979390 - DNA, 14 bp, Homo sapiens
attgttccaagaca

SEQ ID NO: 979391 - DNA, 17 bp, Homo sapiens
attgttccaagacattg

SEQ ID NO: 979392 - DNA, 19 bp, Homo sapiens
attgttcccagtgacactt

SEQ ID NO: 979393 - DNA, 21 bp, Homo sapiens
attgttctcacttattattaa

SEQ ID NO: 979394 - DNA, 14 bp, Homo sapiens
attgttctcagaat

SEQ ID NO: 979395 - DNA, 17 bp, Homo sapiens
attgttgaaaaagtttg

SEQ ID NO: 979396 - DNA, 18 bp, Homo sapiens
attgttgacaactgtgac

SEQ ID NO: 979397 - DNA, 19 bp, Homo sapiens
attgttgacaactgtgact

SEQ ID NO: 979398 - DNA, 19 bp, Homo sapiens
attgttgagctattgctgt

SEQ ID NO: 979399 - DNA, 23 bp, Homo sapiens
attgttgaggtggtctgaatgtt

SEQ ID NO: 979400 - DNA, 21 bp, Homo sapiens
attgttggtgaattttcaagg

SEQ ID NO: 979401 - DNA, 15 bp, Homo sapiens
attgttgtcaaatgc

SEQ ID NO: 979402 - DNA, 15 bp, Homo sapiens
attgttgtgggcttt

SEQ ID NO: 979403 - DNA, 24 bp, Homo sapiens
attgttgttactttttcttgtatt

SEQ ID NO: 979404 - DNA, 13 bp, Homo sapiens
attgttgttctgt

SEQ ID NO: 979405 - DNA, 19 bp, Homo sapiens
attgttgtttgccatactt

SEQ ID NO: 979406 - DNA, 14 bp, Homo sapiens
attgtttaaaattc

SEQ ID NO: 979407 - DNA, 18 bp, Homo sapiens
attgtttaaaattcagtt

SEQ ID NO: 979408 - DNA, 21 bp, Homo sapiens
attgtttaagtgttgtaaata

SEQ ID NO: 979409 - DNA, 20 bp, Homo sapiens
attgtttacgtttgatacaa

SEQ ID NO: 979410 - DNA, 17 bp, Homo sapiens
attgtttatttatcagt

SEQ ID NO: 979411 - DNA, 21 bp, Homo sapiens
attgtttatttatcagtgaca

SEQ ID NO: 979412 - DNA, 13 bp, Homo sapiens
attgtttcaattg

SEQ ID NO: 979413 - DNA, 13 bp, Homo sapiens
attgtttccaact

SEQ ID NO: 979414 - DNA, 20 bp, Homo sapiens
attgtttcctcttccaaagt

SEQ ID NO: 979415 - DNA, 19 bp, Homo sapiens
attgtttcttcttcatgct

SEQ ID NO: 979416 - DNA, 19 bp, Homo sapiens
attgtttctttaagaaagt

SEQ ID NO: 979417 - DNA, 18 bp, Homo sapiens
attgtttgaaacaaagaa

SEQ ID NO: 979418 - DNA, 20 bp, Homo sapiens
attgtttgaaatgtcgatca

SEQ ID NO: 979419 - DNA, 12 bp, Homo sapiens
attgtttgctgc

SEQ ID NO: 979420 - DNA, 15 bp, Homo sapiens
attgtttgctgctat

SEQ ID NO: 979421 - DNA, 13 bp, Homo sapiens
attgtttgctgtt

SEQ ID NO: 979422 - DNA, 23 bp, Homo sapiens
attgtttgctgttgggtttttgc

SEQ ID NO: 979423 - DNA, 13 bp, Homo sapiens
attgtttgcttat

SEQ ID NO: 979424 - DNA, 23 bp, Homo sapiens
attgtttgcttattgttccaaga

SEQ ID NO: 979425 - DNA, 20 bp, Homo sapiens
attgtttgtctgtcttcata

SEQ ID NO: 979426 - DNA, 15 bp, Homo sapiens
attgttttacaatag

SEQ ID NO: 979427 - DNA, 19 bp, Homo sapiens
attgttttacaatagttct

SEQ ID NO: 979428 - DNA, 17 bp, Homo sapiens
attgttttaccagctcc

SEQ ID NO: 979429 - DNA, 18 bp, Homo sapiens
attgttttatcatgacat

SEQ ID NO: 979430 - DNA, 21 bp, Homo sapiens
attgttttattttggaattgg

SEQ ID NO: 979431 - DNA, 16 bp, Homo sapiens
attgttttcacttgta

SEQ ID NO: 979432 - DNA, 20 bp, Homo sapiens
attgttttctgtaaataacc

SEQ ID NO: 979433 - DNA, 21 bp, Homo sapiens
attgttttctgtaaataacct

SEQ ID NO: 979434 - DNA, 20 bp, Homo sapiens
attgtttttgaatttaaata

SEQ ID NO: 979435 - DNA, 22 bp, Homo sapiens
attgtttttgaatttaaataaa

SEQ ID NO: 979436 - DNA, 16 bp, Homo sapiens
atttaaaaaaatcaca

SEQ ID NO: 979437 - DNA, 22 bp, Homo sapiens
atttaaaaaactaaaaactaga

SEQ ID NO: 979438 - DNA, 22 bp, Homo sapiens
atttaaaaacaaccaacagaaa

SEQ ID NO: 979439 - DNA, 14 bp, Homo sapiens
atttaaaaactgga

SEQ ID NO: 979440 - DNA, 16 bp, Homo sapiens
atttaaaaactggaac

SEQ ID NO: 979441 - DNA, 21 bp, Homo sapiens
atttaaaaagaaacagaaatg

SEQ ID NO: 979442 - DNA, 21 bp, Homo sapiens
atttaaaaagctcactgctga

SEQ ID NO: 979443 - DNA, 12 bp, Homo sapiens
atttaaaaataa

SEQ ID NO: 979444 - DNA, 19 bp, Homo sapiens
atttaaaaataagtcaaca

SEQ ID NO: 979445 - DNA, 22 bp, Homo sapiens
atttaaaaataagtcaacagta

SEQ ID NO: 979446 - DNA, 13 bp, Homo sapiens
atttaaaaatatt

SEQ ID NO: 979447 - DNA, 15 bp, Homo sapiens
atttaaaaatatttc

SEQ ID NO: 979448 - DNA, 18 bp, Homo sapiens
atttaaaaatatttcaga

SEQ ID NO: 979449 - DNA, 19 bp, Homo sapiens
atttaaaaatatttcagat

SEQ ID NO: 979450 - DNA, 22 bp, Homo sapiens
atttaaaaatatttcagatatc

SEQ ID NO: 979451 - DNA, 18 bp, Homo sapiens
atttaaaaatatttttgg

SEQ ID NO: 979452 - DNA, 15 bp, Homo sapiens
atttaaaaatgccaa

SEQ ID NO: 979453 - DNA, 12 bp, Homo sapiens
atttaaaaatgt

SEQ ID NO: 979454 - DNA, 13 bp, Homo sapiens
atttaaaaatgtc

SEQ ID NO: 979455 - DNA, 18 bp, Homo sapiens
atttaaaaattgtttctt

SEQ ID NO: 979456 - DNA, 20 bp, Homo sapiens
atttaaaaattgtttcttga

SEQ ID NO: 979457 - DNA, 20 bp, Homo sapiens
atttaaaacattaaaatata

SEQ ID NO: 979458 - DNA, 21 bp, Homo sapiens
atttaaaacattaaaatataa

SEQ ID NO: 979459 - DNA, 14 bp, Homo sapiens
atttaaaactctgg

SEQ ID NO: 979460 - DNA, 17 bp, Homo sapiens
atttaaaagagcaggcc

SEQ ID NO: 979461 - DNA, 17 bp, Homo sapiens
atttaaaagatacagtt

SEQ ID NO: 979462 - DNA, 15 bp, Homo sapiens
atttaaaagcctgct

SEQ ID NO: 979463 - DNA, 17 bp, Homo sapiens
atttaaaagcctgctca

SEQ ID NO: 979464 - DNA, 20 bp, Homo sapiens
atttaaaagtaaaatgtctt

SEQ ID NO: 979465 - DNA, 20 bp, Homo sapiens
atttaaaagtgtattttatt

SEQ ID NO: 979466 - DNA, 23 bp, Homo sapiens
atttaaaataaagaggagtgtta

SEQ ID NO: 979467 - DNA, 13 bp, Homo sapiens
atttaaaatgatt

SEQ ID NO: 979468 - DNA, 23 bp, Homo sapiens
atttaaaatgctcaatttcagca

SEQ ID NO: 979469 - DNA, 20 bp, Homo sapiens
atttaaaatggaaaattttc

SEQ ID NO: 979470 - DNA, 10 bp, Homo sapiens
atttaaaatt

SEQ ID NO: 979471 - DNA, 11 bp, Homo sapiens
atttaaaatta

SEQ ID NO: 979472 - DNA, 15 bp, Homo sapiens
atttaaaattaagta

SEQ ID NO: 979473 - DNA, 21 bp, Homo sapiens
atttaaaattaagtagaacaa

SEQ ID NO: 979474 - DNA, 16 bp, Homo sapiens
atttaaaattacgttt

SEQ ID NO: 979475 - DNA, 16 bp, Homo sapiens
atttaaacagcagtgt

SEQ ID NO: 979476 - DNA, 15 bp, Homo sapiens
atttaaacaggccca

SEQ ID NO: 979477 - DNA, 17 bp, Homo sapiens
atttaaacaggcccagc

SEQ ID NO: 979478 - DNA, 19 bp, Homo sapiens
atttaaacatttgttcctg

SEQ ID NO: 979479 - DNA, 20 bp, Homo sapiens
atttaaacatttgttcctgg

SEQ ID NO: 979480 - DNA, 16 bp, Homo sapiens
atttaaacccaatcag

SEQ ID NO: 979481 - DNA, 18 bp, Homo sapiens
atttaaaccgctaaaaga

SEQ ID NO: 979482 - DNA, 19 bp, Homo sapiens
atttaaaccgctaaaagaa

SEQ ID NO: 979483 - DNA, 23 bp, Homo sapiens
atttaaaccgctaaaagaaactt

SEQ ID NO: 979484 - DNA, 19 bp, Homo sapiens
atttaaacctttttcttga

SEQ ID NO: 979485 - DNA, 12 bp, Homo sapiens
atttaaactaaa

SEQ ID NO: 979486 - DNA, 12 bp, Homo sapiens
atttaaactata

SEQ ID NO: 979487 - DNA, 19 bp, Homo sapiens
atttaaactataagcaaga

SEQ ID NO: 979488 - DNA, 18 bp, Homo sapiens
atttaaactcaagacaat

SEQ ID NO: 979489 - DNA, 12 bp, Homo sapiens
atttaaactctg

SEQ ID NO: 979490 - DNA, 20 bp, Homo sapiens
atttaaactttttaaaatac

SEQ ID NO: 979491 - DNA, 16 bp, Homo sapiens
atttaaagacaaagac

SEQ ID NO: 979492 - DNA, 21 bp, Homo sapiens
atttaaagacagggaagagca

SEQ ID NO: 979493 - DNA, 16 bp, Homo sapiens
atttaaagatctttta

SEQ ID NO: 979494 - DNA, 11 bp, Homo sapiens
atttaaagcag

SEQ ID NO: 979495 - DNA, 21 bp, Homo sapiens
atttaaagctaaattttgtta

SEQ ID NO: 979496 - DNA, 20 bp, Homo sapiens
atttaaaggggagatactct

SEQ ID NO: 979497 - DNA, 22 bp, Homo sapiens
atttaaagttgtttgtgccttt

SEQ ID NO: 979498 - DNA, 11 bp, Homo sapiens
atttaaataaa

SEQ ID NO: 979499 - DNA, 21 bp, Homo sapiens
atttaaataaaactttccaaa

SEQ ID NO: 979500 - DNA, 20 bp, Homo sapiens
atttaaatataattctgtaa

SEQ ID NO: 979501 - DNA, 16 bp, Homo sapiens
atttaaatattaaata

SEQ ID NO: 979502 - DNA, 12 bp, Homo sapiens
atttaaatgaaa

SEQ ID NO: 979503 - DNA, 17 bp, Homo sapiens
atttaaatgatatttag

SEQ ID NO: 979504 - DNA, 18 bp, Homo sapiens
atttaaatgatatttagg

SEQ ID NO: 979505 - DNA, 13 bp, Homo sapiens
atttaaatgattt

SEQ ID NO: 979506 - DNA, 16 bp, Homo sapiens
atttaaatggcttttg

SEQ ID NO: 979507 - DNA, 16 bp, Homo sapiens
atttaaatgtgtacaa

SEQ ID NO: 979508 - DNA, 14 bp, Homo sapiens
atttaaattccaca

SEQ ID NO: 979509 - DNA, 22 bp, Homo sapiens
atttaaattccacagattatca

SEQ ID NO: 979510 - DNA, 18 bp, Homo sapiens
atttaacaaaaaatgtaa

SEQ ID NO: 979511 - DNA, 13 bp, Homo sapiens
atttaacaagatc

SEQ ID NO: 979512 - DNA, 21 bp, Homo sapiens
atttaacactttttgtgaatt

SEQ ID NO: 979513 - DNA, 14 bp, Homo sapiens
atttaacagaaatg

SEQ ID NO: 979514 - DNA, 18 bp, Homo sapiens
atttaacagaaattgtat

SEQ ID NO: 979515 - DNA, 17 bp, Homo sapiens
atttaacagggagggga

SEQ ID NO: 979516 - DNA, 15 bp, Homo sapiens
atttaacataatggt

SEQ ID NO: 979517 - DNA, 22 bp, Homo sapiens
atttaacataatggttgtgaaa

SEQ ID NO: 979518 - DNA, 17 bp, Homo sapiens
atttaacattatttata

SEQ ID NO: 979519 - DNA, 21 bp, Homo sapiens
atttaaccataaatcaattca

SEQ ID NO: 979520 - DNA, 18 bp, Homo sapiens
atttaacccccctgtaca

SEQ ID NO: 979521 - DNA, 19 bp, Homo sapiens
atttaacccccctgtacac

SEQ ID NO: 979522 - DNA, 21 bp, Homo sapiens
atttaacccccctgtacacaa

SEQ ID NO: 979523 - DNA, 22 bp, Homo sapiens
atttaaccccttggtactgaaa

SEQ ID NO: 979524 - DNA, 18 bp, Homo sapiens
atttaactgattaaaaat

SEQ ID NO: 979525 - DNA, 13 bp, Homo sapiens
atttaactgcctt

SEQ ID NO: 979526 - DNA, 20 bp, Homo sapiens
atttaacttaacattctgta

SEQ ID NO: 979527 - DNA, 21 bp, Homo sapiens
atttaacttaacattctgtaa

SEQ ID NO: 979528 - DNA, 16 bp, Homo sapiens
atttaacttacatttg

SEQ ID NO: 979529 - DNA, 17 bp, Homo sapiens
atttaacttcttcataa

SEQ ID NO: 979530 - DNA, 13 bp, Homo sapiens
atttaactttttt

SEQ ID NO: 979531 - DNA, 17 bp, Homo sapiens
atttaagaaaatacaat

SEQ ID NO: 979532 - DNA, 15 bp, Homo sapiens
atttaagacactgaa

SEQ ID NO: 979533 - DNA, 12 bp, Homo sapiens
atttaagactga

SEQ ID NO: 979534 - DNA, 22 bp, Homo sapiens
atttaagactgataattttaca

SEQ ID NO: 979535 - DNA, 17 bp, Homo sapiens
atttaagatgtacattt

SEQ ID NO: 979536 - DNA, 20 bp, Homo sapiens
atttaagatgtacatttaat

SEQ ID NO: 979537 - DNA, 15 bp, Homo sapiens
atttaagcaaacgtc

SEQ ID NO: 979538 - DNA, 18 bp, Homo sapiens
atttaagcaaacgtctat

SEQ ID NO: 979539 - DNA, 13 bp, Homo sapiens
atttaagcattgt

SEQ ID NO: 979540 - DNA, 15 bp, Homo sapiens
atttaagcattgttt

SEQ ID NO: 979541 - DNA, 17 bp, Homo sapiens
atttaagcctcatattt

SEQ ID NO: 979542 - DNA, 21 bp, Homo sapiens
atttaagcctcatatttaaag

SEQ ID NO: 979543 - DNA, 17 bp, Homo sapiens
atttaagccttttgtgt

SEQ ID NO: 979544 - DNA, 16 bp, Homo sapiens
atttaaggagattggg

SEQ ID NO: 979545 - DNA, 12 bp, Homo sapiens
atttaaggcaaa

SEQ ID NO: 979546 - DNA, 14 bp, Homo sapiens
atttaaggcaaaaa

SEQ ID NO: 979547 - DNA, 16 bp, Homo sapiens
atttaagggaaaaata

SEQ ID NO: 979548 - DNA, 19 bp, Homo sapiens
atttaagggaaagaaaatg

SEQ ID NO: 979549 - DNA, 18 bp, Homo sapiens
atttaagtaaatacagta

SEQ ID NO: 979550 - DNA, 21 bp, Homo sapiens
atttaagtatggaatattcat

SEQ ID NO: 979551 - DNA, 19 bp, Homo sapiens
atttaagttcatattccat

SEQ ID NO: 979552 - DNA, 20 bp, Homo sapiens
atttaagtttcaaacttact

SEQ ID NO: 979553 - DNA, 14 bp, Homo sapiens
atttaataaaactg

SEQ ID NO: 979554 - DNA, 11 bp, Homo sapiens
atttaataaag

SEQ ID NO: 979555 - DNA, 18 bp, Homo sapiens
atttaataaagaaatatt

SEQ ID NO: 979556 - DNA, 19 bp, Homo sapiens
atttaataaagaaatattt

SEQ ID NO: 979557 - DNA, 20 bp, Homo sapiens
atttaataaagaaatattta

SEQ ID NO: 979558 - DNA, 13 bp, Homo sapiens
atttaataatatc

SEQ ID NO: 979559 - DNA, 18 bp, Homo sapiens
atttaatacttttgctga

SEQ ID NO: 979560 - DNA, 17 bp, Homo sapiens
atttaatagcaaagaat

SEQ ID NO: 979561 - DNA, 18 bp, Homo sapiens
atttaatagcaaagaatt

SEQ ID NO: 979562 - DNA, 15 bp, Homo sapiens
atttaatatgcaaag

SEQ ID NO: 979563 - DNA, 21 bp, Homo sapiens
atttaatgaaagactgtacaa

SEQ ID NO: 979564 - DNA, 19 bp, Homo sapiens
atttaatgcattaaacctg

SEQ ID NO: 979565 - DNA, 12 bp, Homo sapiens
atttaatgctgc

SEQ ID NO: 979566 - DNA, 14 bp, Homo sapiens
atttaatgctgtgg

SEQ ID NO: 979567 - DNA, 19 bp, Homo sapiens
atttaatggactgtgaatt

SEQ ID NO: 979568 - DNA, 17 bp, Homo sapiens
atttaatggggaggaca

SEQ ID NO: 979569 - DNA, 20 bp, Homo sapiens
atttaatggtttttatttct

SEQ ID NO: 979570 - DNA, 15 bp, Homo sapiens
atttaatgtgagttt

SEQ ID NO: 979571 - DNA, 13 bp, Homo sapiens
atttaatgtttga

SEQ ID NO: 979572 - DNA, 14 bp, Homo sapiens
atttaatgtttgat

SEQ ID NO: 979573 - DNA, 19 bp, Homo sapiens
atttaatgtttgatttagt

SEQ ID NO: 979574 - DNA, 12 bp, Homo sapiens
atttaatgtttt

SEQ ID NO: 979575 - DNA, 13 bp, Homo sapiens
atttaatgttttc

SEQ ID NO: 979576 - DNA, 15 bp, Homo sapiens
atttaatgttttctg

SEQ ID NO: 979577 - DNA, 15 bp, Homo sapiens
atttaattaaatgta

SEQ ID NO: 979578 - DNA, 18 bp, Homo sapiens
atttaattcttcaccttt

SEQ ID NO: 979579 - DNA, 13 bp, Homo sapiens
atttaattgaaac

SEQ ID NO: 979580 - DNA, 12 bp, Homo sapiens
atttaatttcca

SEQ ID NO: 979581 - DNA, 18 bp, Homo sapiens
atttaatttgtatgctaa

SEQ ID NO: 979582 - DNA, 23 bp, Homo sapiens
atttacaaaaatataaaatatga

SEQ ID NO: 979583 - DNA, 15 bp, Homo sapiens
atttacaaaatttat

SEQ ID NO: 979584 - DNA, 13 bp, Homo sapiens
atttacaaagtgt

SEQ ID NO: 979585 - DNA, 15 bp, Homo sapiens
atttacaaatgtttt

SEQ ID NO: 979586 - DNA, 22 bp, Homo sapiens
atttacaactgggggagggtga

SEQ ID NO: 979587 - DNA, 21 bp, Homo sapiens
atttacaataaatattctgca

SEQ ID NO: 979588 - DNA, 17 bp, Homo sapiens
atttacaatgtattaag

SEQ ID NO: 979589 - DNA, 21 bp, Homo sapiens
atttacactatgataaagttg

SEQ ID NO: 979590 - DNA, 14 bp, Homo sapiens
atttacactgggag

SEQ ID NO: 979591 - DNA, 23 bp, Homo sapiens
atttacagccagtgggagatgtt

SEQ ID NO: 979592 - DNA, 15 bp, Homo sapiens
atttacaggaacttc

SEQ ID NO: 979593 - DNA, 16 bp, Homo sapiens
atttacaggaacttca

SEQ ID NO: 979594 - DNA, 17 bp, Homo sapiens
atttacagtctctttct

SEQ ID NO: 979595 - DNA, 20 bp, Homo sapiens
atttacatgaattgcatttt

SEQ ID NO: 979596 - DNA, 15 bp, Homo sapiens
atttacatttaatag

SEQ ID NO: 979597 - DNA, 16 bp, Homo sapiens
atttaccaaattgctt

SEQ ID NO: 979598 - DNA, 18 bp, Homo sapiens
atttaccacagcagctga

SEQ ID NO: 979599 - DNA, 20 bp, Homo sapiens
atttaccctttggccccact

SEQ ID NO: 979600 - DNA, 18 bp, Homo sapiens
atttaccgttgcttgaaa

SEQ ID NO: 979601 - DNA, 15 bp, Homo sapiens
atttacctaagatta

SEQ ID NO: 979602 - DNA, 23 bp, Homo sapiens
atttacctccccttttctatgtt

SEQ ID NO: 979603 - DNA, 15 bp, Homo sapiens
atttactacagtagt

SEQ ID NO: 979604 - DNA, 15 bp, Homo sapiens
atttactacttttgc

SEQ ID NO: 979605 - DNA, 16 bp, Homo sapiens
atttactctttgcaaa

SEQ ID NO: 979606 - DNA, 19 bp, Homo sapiens
atttactgttagaattctt

SEQ ID NO: 979607 - DNA, 19 bp, Homo sapiens
atttacttcttatacattt

SEQ ID NO: 979608 - DNA, 17 bp, Homo sapiens
atttactttattaactt

SEQ ID NO: 979609 - DNA, 18 bp, Homo sapiens
atttagaaaaaagtttac

SEQ ID NO: 979610 - DNA, 15 bp, Homo sapiens
atttagaaaaagtca

SEQ ID NO: 979611 - DNA, 17 bp, Homo sapiens
atttagaaaactttaaa

SEQ ID NO: 979612 - DNA, 21 bp, Homo sapiens
atttagaaaagtgaattgaag

SEQ ID NO: 979613 - DNA, 22 bp, Homo sapiens
atttagaaaatagagcttttaa

SEQ ID NO: 979614 - DNA, 22 bp, Homo sapiens
atttagaaactaattgacttta

SEQ ID NO: 979615 - DNA, 16 bp, Homo sapiens
atttagaaactgattt

SEQ ID NO: 979616 - DNA, 17 bp, Homo sapiens
atttagaaactgatttc

SEQ ID NO: 979617 - DNA, 22 bp, Homo sapiens
atttagaaagaagcccaatatt

SEQ ID NO: 979618 - DNA, 18 bp, Homo sapiens
atttagaagaaagatgtt

SEQ ID NO: 979619 - DNA, 12 bp, Homo sapiens
atttagaagcca

SEQ ID NO: 979620 - DNA, 13 bp, Homo sapiens
atttagaagccaa

SEQ ID NO: 979621 - DNA, 14 bp, Homo sapiens
atttagacaagaga

SEQ ID NO: 979622 - DNA, 16 bp, Homo sapiens
atttagacaagagatg

SEQ ID NO: 979623 - DNA, 23 bp, Homo sapiens
atttagacttggattctttccat

SEQ ID NO: 979624 - DNA, 20 bp, Homo sapiens
atttagagaactgtggccgt

SEQ ID NO: 979625 - DNA, 23 bp, Homo sapiens
atttagagatgaattaaatttaa

SEQ ID NO: 979626 - DNA, 23 bp, Homo sapiens
atttagagcgtttggttaaagta

SEQ ID NO: 979627 - DNA, 19 bp, Homo sapiens
atttagaggtaaaagtaca

SEQ ID NO: 979628 - DNA, 15 bp, Homo sapiens
atttagagtcaattt

SEQ ID NO: 979629 - DNA, 18 bp, Homo sapiens
atttagagtcaatttgct

SEQ ID NO: 979630 - DNA, 17 bp, Homo sapiens
atttagataatttgaaa

SEQ ID NO: 979631 - DNA, 15 bp, Homo sapiens
atttagcaaactgat

SEQ ID NO: 979632 - DNA, 20 bp, Homo sapiens
atttagcaaactgatgctga

SEQ ID NO: 979633 - DNA, 23 bp, Homo sapiens
atttagcacaatttgagactgaa

SEQ ID NO: 979634 - DNA, 22 bp, Homo sapiens
atttagcatgacaagccccagg

SEQ ID NO: 979635 - DNA, 14 bp, Homo sapiens
atttagccctttaa

SEQ ID NO: 979636 - DNA, 14 bp, Homo sapiens
atttagctctgaag

SEQ ID NO: 979637 - DNA, 16 bp, Homo sapiens
atttaggaagttgact

SEQ ID NO: 979638 - DNA, 15 bp, Homo sapiens
atttaggagcagaaa

SEQ ID NO: 979639 - DNA, 19 bp, Homo sapiens
atttagggccttttctgtg

SEQ ID NO: 979640 - DNA, 22 bp, Homo sapiens
atttagggtgattttaaagaac

SEQ ID NO: 979641 - DNA, 22 bp, Homo sapiens
atttagtaatagtccaatattt

SEQ ID NO: 979642 - DNA, 14 bp, Homo sapiens
atttagtacactat

SEQ ID NO: 979643 - DNA, 15 bp, Homo sapiens
atttagtgctcttaa

SEQ ID NO: 979644 - DNA, 18 bp, Homo sapiens
atttagtggatggaatat

SEQ ID NO: 979645 - DNA, 15 bp, Homo sapiens
atttagtgtatccat

SEQ ID NO: 979646 - DNA, 14 bp, Homo sapiens
atttagtgtgaata

SEQ ID NO: 979647 - DNA, 21 bp, Homo sapiens
atttagttacgtataatgctt

SEQ ID NO: 979648 - DNA, 17 bp, Homo sapiens
atttagttctttgttat

SEQ ID NO: 979649 - DNA, 17 bp, Homo sapiens
atttagttgtttctaga

SEQ ID NO: 979650 - DNA, 20 bp, Homo sapiens
atttagtttcagtagattgc

SEQ ID NO: 979651 - DNA, 14 bp, Homo sapiens
atttagttttatgg

SEQ ID NO: 979652 - DNA, 22 bp, Homo sapiens
atttagttttatggcatgattt

SEQ ID NO: 979653 - DNA, 21 bp, Homo sapiens
atttagttttgtaacttagct

SEQ ID NO: 979654 - DNA, 16 bp, Homo sapiens
atttataaaaaggtgt

SEQ ID NO: 979655 - DNA, 23 bp, Homo sapiens
atttataaatatattcaggagtt

SEQ ID NO: 979656 - DNA, 22 bp, Homo sapiens
atttataaatatatttaagata

SEQ ID NO: 979657 - DNA, 16 bp, Homo sapiens
atttataaatgctatt

SEQ ID NO: 979658 - DNA, 20 bp, Homo sapiens
atttataacgtgttcaatat

SEQ ID NO: 979659 - DNA, 13 bp, Homo sapiens
atttataactcat

SEQ ID NO: 979660 - DNA, 16 bp, Homo sapiens
atttataactcatcat

SEQ ID NO: 979661 - DNA, 23 bp, Homo sapiens
atttataactcatcataaaataa

SEQ ID NO: 979662 - DNA, 15 bp, Homo sapiens
atttataatacagaa

SEQ ID NO: 979663 - DNA, 17 bp, Homo sapiens
atttataatgtatttga

SEQ ID NO: 979664 - DNA, 20 bp, Homo sapiens
atttataatgttagtagaaa

SEQ ID NO: 979665 - DNA, 14 bp, Homo sapiens
atttataatgtttg

SEQ ID NO: 979666 - DNA, 14 bp, Homo sapiens
atttataattccta

SEQ ID NO: 979667 - DNA, 19 bp, Homo sapiens
atttatacccccaggaaac

SEQ ID NO: 979668 - DNA, 16 bp, Homo sapiens
atttatacctttgaaa

SEQ ID NO: 979669 - DNA, 16 bp, Homo sapiens
atttatagaagaaatg

SEQ ID NO: 979670 - DNA, 17 bp, Homo sapiens
atttataggccagggca

SEQ ID NO: 979671 - DNA, 23 bp, Homo sapiens
atttataggccagggcatgtgta

SEQ ID NO: 979672 - DNA, 14 bp, Homo sapiens
atatgtataaatta

SEQ ID NO: 979673 - DNA, 14 bp, Homo sapiens
atatgtatatatat

SEQ ID NO: 979674 - DNA, 21 bp, Homo sapiens
atatgtatatgacatttaaat

SEQ ID NO: 979675 - DNA, 13 bp, Homo sapiens
atatgtatatttt

SEQ ID NO: 979676 - DNA, 18 bp, Homo sapiens
atatgtatctacaataca

SEQ ID NO: 979677 - DNA, 20 bp, Homo sapiens
atatgtatctacaatacata

SEQ ID NO: 979678 - DNA, 17 bp, Homo sapiens
atatgtattatttataa

SEQ ID NO: 979679 - DNA, 17 bp, Homo sapiens
atatgtattcccttgta

SEQ ID NO: 979680 - DNA, 19 bp, Homo sapiens
atatgtattcccttgtatt

SEQ ID NO: 979681 - DNA, 21 bp, Homo sapiens
atatgtattgtaaacatgtgt

SEQ ID NO: 979682 - DNA, 11 bp, Homo sapiens
atatgtatttt

SEQ ID NO: 979683 - DNA, 15 bp, Homo sapiens
atatgtattttccta

SEQ ID NO: 979684 - DNA, 22 bp, Homo sapiens
atatgtcacctggcacattcat

SEQ ID NO: 979685 - DNA, 18 bp, Homo sapiens
atatgtcagtcactaaaa

SEQ ID NO: 979686 - DNA, 18 bp, Homo sapiens
atatgtcattatttattg

SEQ ID NO: 979687 - DNA, 18 bp, Homo sapiens
atatgtccagtcatcctg

SEQ ID NO: 979688 - DNA, 16 bp, Homo sapiens
atatgtcgtagaattc

SEQ ID NO: 979689 - DNA, 15 bp, Homo sapiens
atatgtctgataatg

SEQ ID NO: 979690 - DNA, 15 bp, Homo sapiens
atatgtctgcttctg

SEQ ID NO: 979691 - DNA, 18 bp, Homo sapiens
atatgtgaagaaaaagac

SEQ ID NO: 979692 - DNA, 14 bp, Homo sapiens
atatgtgagaaatc

SEQ ID NO: 979693 - DNA, 20 bp, Homo sapiens
atatgtgagtgccttttgca

SEQ ID NO: 979694 - DNA, 19 bp, Homo sapiens
atatgtgctggaattctaa

SEQ ID NO: 979695 - DNA, 15 bp, Homo sapiens
atatgtgtatacata

SEQ ID NO: 979696 - DNA, 17 bp, Homo sapiens
atatgtgtgtgtatata

SEQ ID NO: 979697 - DNA, 16 bp, Homo sapiens
atatgtgtgtgtatgt

SEQ ID NO: 979698 - DNA, 19 bp, Homo sapiens
atatgtgtgtttaaataaa

SEQ ID NO: 979699 - DNA, 20 bp, Homo sapiens
atatgtgtgtttaaataaag

SEQ ID NO: 979700 - DNA, 16 bp, Homo sapiens
atatgttaatttgtgt

SEQ ID NO: 979701 - DNA, 12 bp, Homo sapiens
atatgttcaact

SEQ ID NO: 979702 - DNA, 16 bp, Homo sapiens
atatgttcatattgga

SEQ ID NO: 979703 - DNA, 13 bp, Homo sapiens
atatgttctgcaa

SEQ ID NO: 979704 - DNA, 19 bp, Homo sapiens
atatgttctgcaagaatta

SEQ ID NO: 979705 - DNA, 22 bp, Homo sapiens
atatgttctgcaagaattaaaa

SEQ ID NO: 979706 - DNA, 21 bp, Homo sapiens
atatgtttaaaataaaatgaa

SEQ ID NO: 979707 - DNA, 13 bp, Homo sapiens
atatgtttacaca

SEQ ID NO: 979708 - DNA, 20 bp, Homo sapiens
atatgtttagttttacattt

SEQ ID NO: 979709 - DNA, 22 bp, Homo sapiens
atatgtttagttttacatttta

SEQ ID NO: 979710 - DNA, 13 bp, Homo sapiens
atatgtttgtgcc

SEQ ID NO: 979711 - DNA, 17 bp, Homo sapiens
atattaaaaaacttcat

SEQ ID NO: 979712 - DNA, 24 bp, Homo sapiens
atattaaaaaacttcatgtaattt

SEQ ID NO: 979713 - DNA, 14 bp, Homo sapiens
atattaaaaagtct

SEQ ID NO: 979714 - DNA, 18 bp, Homo sapiens
atattaaaatagcatact

SEQ ID NO: 979715 - DNA, 20 bp, Homo sapiens
atattaaaatagcatactgt

SEQ ID NO: 979716 - DNA, 21 bp, Homo sapiens
atattaaaatttggtgcttat

SEQ ID NO: 979717 - DNA, 15 bp, Homo sapiens
atattaaacgtgtaa

SEQ ID NO: 979718 - DNA, 13 bp, Homo sapiens
atattaaagattt

SEQ ID NO: 979719 - DNA, 13 bp, Homo sapiens
atattaaatacag

SEQ ID NO: 979720 - DNA, 17 bp, Homo sapiens
atattaaatacagacac

SEQ ID NO: 979721 - DNA, 20 bp, Homo sapiens
atattaaatacagacactaa

SEQ ID NO: 979722 - DNA, 13 bp, Homo sapiens
atattaaatctgc

SEQ ID NO: 979723 - DNA, 15 bp, Homo sapiens
atattaacatcatct

SEQ ID NO: 979724 - DNA, 16 bp, Homo sapiens
atattaagaaagacta

SEQ ID NO: 979725 - DNA, 17 bp, Homo sapiens
atattaagaaagactat

SEQ ID NO: 979726 - DNA, 22 bp, Homo sapiens
atattaagaaagactatctaaa

SEQ ID NO: 979727 - DNA, 14 bp, Homo sapiens
atattaagacagtg

SEQ ID NO: 979728 - DNA, 22 bp, Homo sapiens
atattaaggaagacaatgtgaa

SEQ ID NO: 979729 - DNA, 14 bp, Homo sapiens
atattaatcagcat

SEQ ID NO: 979730 - DNA, 12 bp, Homo sapiens
atattaatgtac

SEQ ID NO: 979731 - DNA, 18 bp, Homo sapiens
atattaatgtacttgttt

SEQ ID NO: 979732 - DNA, 14 bp, Homo sapiens
atattacaaaaaca

SEQ ID NO: 979733 - DNA, 12 bp, Homo sapiens
atattacaatga

SEQ ID NO: 979734 - DNA, 22 bp, Homo sapiens
atattacacaggaggcttcgga

SEQ ID NO: 979735 - DNA, 16 bp, Homo sapiens
atattaccaactacat

SEQ ID NO: 979736 - DNA, 17 bp, Homo sapiens
atattaccacagacata

SEQ ID NO: 979737 - DNA, 22 bp, Homo sapiens
atattaccacagacatactaac

SEQ ID NO: 979738 - DNA, 15 bp, Homo sapiens
atattaccagcaaga

SEQ ID NO: 979739 - DNA, 16 bp, Homo sapiens
atattactactccttt

SEQ ID NO: 979740 - DNA, 18 bp, Homo sapiens
atattactaggtgacatg

SEQ ID NO: 979741 - DNA, 23 bp, Homo sapiens
atattactaggtgacatgtctac

SEQ ID NO: 979742 - DNA, 23 bp, Homo sapiens
atattactctcattctttgaaca

SEQ ID NO: 979743 - DNA, 14 bp, Homo sapiens
atattactgtcttt

SEQ ID NO: 979744 - DNA, 20 bp, Homo sapiens
atattactgttgcatttact

SEQ ID NO: 979745 - DNA, 17 bp, Homo sapiens
atattacttttgtaaat

SEQ ID NO: 979746 - DNA, 23 bp, Homo sapiens
atattacttttgtaaatattctt

SEQ ID NO: 979747 - DNA, 16 bp, Homo sapiens
atattagcaaagaagc

SEQ ID NO: 979748 - DNA, 22 bp, Homo sapiens
atattaggatctgcaaacaatg

SEQ ID NO: 979749 - DNA, 17 bp, Homo sapiens
atattaggggggaaagt

SEQ ID NO: 979750 - DNA, 21 bp, Homo sapiens
atattaggtccattcattaat

SEQ ID NO: 979751 - DNA, 19 bp, Homo sapiens
atattagtattatcttgtt

SEQ ID NO: 979752 - DNA, 21 bp, Homo sapiens
atattagtgattctgatttca

SEQ ID NO: 979753 - DNA, 23 bp, Homo sapiens
atattataaaggataaagaagga

SEQ ID NO: 979754 - DNA, 20 bp, Homo sapiens
atattataactctgtataat

SEQ ID NO: 979755 - DNA, 17 bp, Homo sapiens
atattataacttaaaaa

SEQ ID NO: 979756 - DNA, 22 bp, Homo sapiens
atattataagggagagctgagc

SEQ ID NO: 979757 - DNA, 14 bp, Homo sapiens
atattataattgga

SEQ ID NO: 979758 - DNA, 17 bp, Homo sapiens
atattataattggaagt

SEQ ID NO: 979759 - DNA, 21 bp, Homo sapiens
atattataccagatgaacatt

SEQ ID NO: 979760 - DNA, 12 bp, Homo sapiens
atattatagaaa

SEQ ID NO: 979761 - DNA, 12 bp, Homo sapiens
atattatatatg

SEQ ID NO: 979762 - DNA, 14 bp, Homo sapiens
atattatctacctg

SEQ ID NO: 979763 - DNA, 22 bp, Homo sapiens
atattatctacctgttctgtag

SEQ ID NO: 979764 - DNA, 21 bp, Homo sapiens
atattatgtatttatattttg

SEQ ID NO: 979765 - DNA, 19 bp, Homo sapiens
atattattataatcttata

SEQ ID NO: 979766 - DNA, 16 bp, Homo sapiens
atattattatatatat

SEQ ID NO: 979767 - DNA, 20 bp, Homo sapiens
atcttggttgatgccaaaaa

SEQ ID NO: 979768 - DNA, 23 bp, Homo sapiens
atcttgtccctaagtaagtttct

SEQ ID NO: 979769 - DNA, 10 bp, Homo sapiens
atcttgtctt

SEQ ID NO: 979770 - DNA, 22 bp, Homo sapiens
atcttgtgagtggataatcagg

SEQ ID NO: 979771 - DNA, 19 bp, Homo sapiens
atcttgtgctagaatactt

SEQ ID NO: 979772 - DNA, 22 bp, Homo sapiens
atcttgtgtgattaacttattt

SEQ ID NO: 979773 - DNA, 20 bp, Homo sapiens
atcttgttaatgtcattgct

SEQ ID NO: 979774 - DNA, 19 bp, Homo sapiens
atcttgttattaatgtttc

SEQ ID NO: 979775 - DNA, 14 bp, Homo sapiens
atcttgttcaggaa

SEQ ID NO: 979776 - DNA, 13 bp, Homo sapiens
atcttgttcttcc

SEQ ID NO: 979777 - DNA, 14 bp, Homo sapiens
atcttgttcttccc

SEQ ID NO: 979778 - DNA, 22 bp, Homo sapiens
atcttgtttacaataaagaatt

SEQ ID NO: 979779 - DNA, 23 bp, Homo sapiens
atcttgtttacaataaagaattc

SEQ ID NO: 979780 - DNA, 23 bp, Homo sapiens
atcttgtttttccactactgcta

SEQ ID NO: 979781 - DNA, 13 bp, Homo sapiens
atctttaaacatt

SEQ ID NO: 979782 - DNA, 21 bp, Homo sapiens
atctttaaagccgtgctcttt

SEQ ID NO: 979783 - DNA, 15 bp, Homo sapiens
atctttaacaattgt

SEQ ID NO: 979784 - DNA, 14 bp, Homo sapiens
atctttaagaaaaa

SEQ ID NO: 979785 - DNA, 21 bp, Homo sapiens
atctttacaaaactacatgag

SEQ ID NO: 979786 - DNA, 16 bp, Homo sapiens
atctttacgtactgta

SEQ ID NO: 979787 - DNA, 17 bp, Homo sapiens
atctttacgtactgtaa

SEQ ID NO: 979788 - DNA, 21 bp, Homo sapiens
atctttatagaaggaatttgt

SEQ ID NO: 979789 - DNA, 11 bp, Homo sapiens
atctttatgct

SEQ ID NO: 979790 - DNA, 22 bp, Homo sapiens
atctttatgctgtattttaaca

SEQ ID NO: 979791 - DNA, 13 bp, Homo sapiens
atctttattgaaa

SEQ ID NO: 979792 - DNA, 17 bp, Homo sapiens
atctttattgagaaaga

SEQ ID NO: 979793 - DNA, 14 bp, Homo sapiens
atctttcatgtctt

SEQ ID NO: 979794 - DNA, 15 bp, Homo sapiens
atctttcatgtcttg

SEQ ID NO: 979795 - DNA, 17 bp, Homo sapiens
atctttcatgtcttgtc

SEQ ID NO: 979796 - DNA, 12 bp, Homo sapiens
atctttccaaat

SEQ ID NO: 979797 - DNA, 23 bp, Homo sapiens
atctttccaggcttccctgactt

SEQ ID NO: 979798 - DNA, 22 bp, Homo sapiens
atctttcctcaagtatcttcta

SEQ ID NO: 979799 - DNA, 11 bp, Homo sapiens
atctttcctgt

SEQ ID NO: 979800 - DNA, 17 bp, Homo sapiens
atctttcgataaacaac

SEQ ID NO: 979801 - DNA, 15 bp, Homo sapiens
atctttctacagaga

SEQ ID NO: 979802 - DNA, 12 bp, Homo sapiens
atctttctctta

SEQ ID NO: 979803 - DNA, 14 bp, Homo sapiens
atctttctgcacac

SEQ ID NO: 979804 - DNA, 21 bp, Homo sapiens
atctttctgcacacaaatatt

SEQ ID NO: 979805 - DNA, 13 bp, Homo sapiens
atctttctgggag

SEQ ID NO: 979806 - DNA, 23 bp, Homo sapiens
atctttctttccaaaacatttct

SEQ ID NO: 979807 - DNA, 15 bp, Homo sapiens
atctttctttcttcc

SEQ ID NO: 979808 - DNA, 20 bp, Homo sapiens
atctttctttggatgggact

SEQ ID NO: 979809 - DNA, 21 bp, Homo sapiens
atctttcttttgattcttcct

SEQ ID NO: 979810 - DNA, 21 bp, Homo sapiens
atctttgaaaggttagagaat

SEQ ID NO: 979811 - DNA, 12 bp, Homo sapiens
atctttgaaata

SEQ ID NO: 979812 - DNA, 21 bp, Homo sapiens
atctttgacatggtgccttag

SEQ ID NO: 979813 - DNA, 12 bp, Homo sapiens
atctttgagccc

SEQ ID NO: 979814 - DNA, 16 bp, Homo sapiens
atctttgccaacatgg

SEQ ID NO: 979815 - DNA, 17 bp, Homo sapiens
atctttgcgaaaagata

SEQ ID NO: 979816 - DNA, 23 bp, Homo sapiens
atctttgcgaaaagataaacctg

SEQ ID NO: 979817 - DNA, 21 bp, Homo sapiens
atctttgtgacaggaaagccc

SEQ ID NO: 979818 - DNA, 15 bp, Homo sapiens
atctttgtggccaag

SEQ ID NO: 979819 - DNA, 16 bp, Homo sapiens
atctttgtggccaagg

SEQ ID NO: 979820 - DNA, 12 bp, Homo sapiens
atctttgtgtaa

SEQ ID NO: 979821 - DNA, 18 bp, Homo sapiens
atctttgttgaagtttga

SEQ ID NO: 979822 - DNA, 17 bp, Homo sapiens
atcttttaaagtgttac

SEQ ID NO: 979823 - DNA, 13 bp, Homo sapiens
atcttttaaatac

SEQ ID NO: 979824 - DNA, 22 bp, Homo sapiens
atcttttacaactgcctcgaaa

SEQ ID NO: 979825 - DNA, 13 bp, Homo sapiens
atcttttataatg

SEQ ID NO: 979826 - DNA, 19 bp, Homo sapiens
atcttttatagacgctctt

SEQ ID NO: 979827 - DNA, 22 bp, Homo sapiens
atcttttcataaagggttgaaa

SEQ ID NO: 979828 - DNA, 13 bp, Homo sapiens
atcttttctttaa

SEQ ID NO: 979829 - DNA, 17 bp, Homo sapiens
atcttttgaagctttct

SEQ ID NO: 979830 - DNA, 13 bp, Homo sapiens
atcttttgtatta

SEQ ID NO: 979831 - DNA, 16 bp, Homo sapiens
atcttttgtattaaga

SEQ ID NO: 979832 - DNA, 22 bp, Homo sapiens
atcttttgtattaagaaaggaa

SEQ ID NO: 979833 - DNA, 14 bp, Homo sapiens
atcttttgtgagat

SEQ ID NO: 979834 - DNA, 16 bp, Homo sapiens
atcttttgtttccttt

SEQ ID NO: 979835 - DNA, 22 bp, Homo sapiens
atcttttgtttccttttttccc

SEQ ID NO: 979836 - DNA, 13 bp, Homo sapiens
atctttttaaaaa

SEQ ID NO: 979837 - DNA, 18 bp, Homo sapiens
atctttttacagttgcat

SEQ ID NO: 979838 - DNA, 18 bp, Homo sapiens
atctttttacctttcata

SEQ ID NO: 979839 - DNA, 13 bp, Homo sapiens
atctttttataca

SEQ ID NO: 979840 - DNA, 15 bp, Homo sapiens
atctttttatacaca

SEQ ID NO: 979841 - DNA, 14 bp, Homo sapiens
atctttttatattc

SEQ ID NO: 979842 - DNA, 14 bp, Homo sapiens
atctttttctccac

SEQ ID NO: 979843 - DNA, 22 bp, Homo sapiens
atctttttgcttctactttcat

SEQ ID NO: 979844 - DNA, 21 bp, Homo sapiens
atcttttttggaactaaagca

SEQ ID NO: 979845 - DNA, 20 bp, Homo sapiens
atcttttttttatataaata

SEQ ID NO: 979846 - DNA, 22 bp, Homo sapiens
atcttttttttatataaatata

SEQ ID NO: 979847 - DNA, 18 bp, Homo sapiens
atgaaaaacaaaaagcta

SEQ ID NO: 979848 - DNA, 19 bp, Homo sapiens
atgaaaaacacggcagctg

SEQ ID NO: 979849 - DNA, 20 bp, Homo sapiens
atgaaaaacacggcagctgt

SEQ ID NO: 979850 - DNA, 22 bp, Homo sapiens
atgaaaaacatcccaaacttta

SEQ ID NO: 979851 - DNA, 23 bp, Homo sapiens
atgaaaaacatcccaaactttaa

SEQ ID NO: 979852 - DNA, 17 bp, Homo sapiens
atgaaaaactatgtcag

SEQ ID NO: 979853 - DNA, 14 bp, Homo sapiens
atgaaaaagaagaa

SEQ ID NO: 979854 - DNA, 16 bp, Homo sapiens
atgaaaaagaagaatc

SEQ ID NO: 979855 - DNA, 11 bp, Homo sapiens
atgaaaaagat

SEQ ID NO: 979856 - DNA, 17 bp, Homo sapiens
atgaaaaagattatttg

SEQ ID NO: 979857 - DNA, 20 bp, Homo sapiens
atgaaaaatagtgtctttgt

SEQ ID NO: 979858 - DNA, 18 bp, Homo sapiens
atgaaaaatgtaaatact

SEQ ID NO: 979859 - DNA, 18 bp, Homo sapiens
atgaaaaatttaagcatt

SEQ ID NO: 979860 - DNA, 16 bp, Homo sapiens
atgaaaacacattttt

SEQ ID NO: 979861 - DNA, 19 bp, Homo sapiens
atgaaaacgttttattgtg

SEQ ID NO: 979862 - DNA, 14 bp, Homo sapiens
atgaaaagaggaac

SEQ ID NO: 979863 - DNA, 11 bp, Homo sapiens
atgaaaagcaa

SEQ ID NO: 979864 - DNA, 18 bp, Homo sapiens
atgaaaaggtgattgtca

SEQ ID NO: 979865 - DNA, 22 bp, Homo sapiens
atgaaaagtacatgttgatact

SEQ ID NO: 979866 - DNA, 13 bp, Homo sapiens
atgaaaagtgcat

SEQ ID NO: 979867 - DNA, 19 bp, Homo sapiens
atgaaaataatctctgatt

SEQ ID NO: 979868 - DNA, 16 bp, Homo sapiens
atgaaaataattttcc

SEQ ID NO: 979869 - DNA, 18 bp, Homo sapiens
atgaaaataattttccaa

SEQ ID NO: 979870 - DNA, 17 bp, Homo sapiens
atgaaaatacaacttaa

SEQ ID NO: 979871 - DNA, 18 bp, Homo sapiens
atgaaaataccataggaa

SEQ ID NO: 979872 - DNA, 20 bp, Homo sapiens
atgaaaataccataggaaga

SEQ ID NO: 979873 - DNA, 23 bp, Homo sapiens
atgaaaataccataggaagacat

SEQ ID NO: 979874 - DNA, 19 bp, Homo sapiens
atgaaaatcctatatctgt

SEQ ID NO: 979875 - DNA, 16 bp, Homo sapiens
atgaaaatccttttaa

SEQ ID NO: 979876 - DNA, 17 bp, Homo sapiens
atgaaaatgaatagctt

SEQ ID NO: 979877 - DNA, 12 bp, Homo sapiens
atgaaaatgtca

SEQ ID NO: 979878 - DNA, 15 bp, Homo sapiens
atgaaaatgtcagaa

SEQ ID NO: 979879 - DNA, 19 bp, Homo sapiens
atgaaaatgttacaagcta

SEQ ID NO: 979880 - DNA, 15 bp, Homo sapiens
atgaaaattgtatta

SEQ ID NO: 979881 - DNA, 17 bp, Homo sapiens
atgaaaattttaaaaat

SEQ ID NO: 979882 - DNA, 16 bp, Homo sapiens
atgaaacaatgaaatt

SEQ ID NO: 979883 - DNA, 16 bp, Homo sapiens
atgaaacaccttctct

SEQ ID NO: 979884 - DNA, 18 bp, Homo sapiens
atgaaacagaaacaaaaa

SEQ ID NO: 979885 - DNA, 22 bp, Homo sapiens
atgaaacagatgataaatattt

SEQ ID NO: 979886 - DNA, 14 bp, Homo sapiens
atgaaacatatcat

SEQ ID NO: 979887 - DNA, 22 bp, Homo sapiens
atgaaaccttattttttcccaa

SEQ ID NO: 979888 - DNA, 14 bp, Homo sapiens
acaataacttttat

SEQ ID NO: 979889 - DNA, 12 bp, Homo sapiens
atgaatatcatt

SEQ ID NO: 979890 - DNA, 22 bp, Homo sapiens
atgaatatcattgattttataa

SEQ ID NO: 979891 - DNA, 18 bp, Homo sapiens
atgaatatctattaatat

SEQ ID NO: 979892 - DNA, 19 bp, Homo sapiens
atgaatatctattaatata

SEQ ID NO: 979893 - DNA, 14 bp, Homo sapiens
acaatttggcaatt

SEQ ID NO: 979894 - DNA, 20 bp, Homo sapiens
acaatttggcaattttgtgg

SEQ ID NO: 979895 - DNA, 22 bp, Homo sapiens
acaatttggcaattttgtggtt

SEQ ID NO: 979896 - DNA, 14 bp, Homo sapiens
acaatttgttaatt

SEQ ID NO: 979897 - DNA, 16 bp, Homo sapiens
acaatttgttaattcc

SEQ ID NO: 979898 - DNA, 22 bp, Homo sapiens
acaatttgttaattcctatgaa

SEQ ID NO: 979899 - DNA, 18 bp, Homo sapiens
acaattttaaagttctta

SEQ ID NO: 979900 - DNA, 20 bp, Homo sapiens
acaattttgcttcactttgc

SEQ ID NO: 979901 - DNA, 10 bp, Homo sapiens
acaattttgt

SEQ ID NO: 979902 - DNA, 10 bp, Homo sapiens
acaattttta

SEQ ID NO: 979903 - DNA, 17 bp, Homo sapiens
acaatttttaataaatt

SEQ ID NO: 979904 - DNA, 22 bp, Homo sapiens
acaattttttatcatgcatgtc

SEQ ID NO: 979905 - DNA, 23 bp, Homo sapiens
acaattttttttaattggccatg

SEQ ID NO: 979906 - DNA, 18 bp, Homo sapiens
acaattttttttattagt

SEQ ID NO: 979907 - DNA, 16 bp, Homo sapiens
acacaaaacattcatg

SEQ ID NO: 979908 - DNA, 13 bp, Homo sapiens
acacaaaacattt

SEQ ID NO: 979909 - DNA, 21 bp, Homo sapiens
acacaaaactccgcccccagc

SEQ ID NO: 979910 - DNA, 15 bp, Homo sapiens
acacaaaacttgaaa

SEQ ID NO: 979911 - DNA, 22 bp, Homo sapiens
acacaaaatccattccaggtag

SEQ ID NO: 979912 - DNA, 18 bp, Homo sapiens
acacaaacctactgccca

SEQ ID NO: 979913 - DNA, 13 bp, Homo sapiens
acacaaactatgg

SEQ ID NO: 979914 - DNA, 14 bp, Homo sapiens
acacaaactatggg

SEQ ID NO: 979915 - DNA, 15 bp, Homo sapiens
acacaaactgtaaat

SEQ ID NO: 979916 - DNA, 22 bp, Homo sapiens
acacaaagagaaaaagaaatgc

SEQ ID NO: 979917 - DNA, 12 bp, Homo sapiens
acacaaatgata

SEQ ID NO: 979918 - DNA, 18 bp, Homo sapiens
acacaaatttgggagggt

SEQ ID NO: 979919 - DNA, 19 bp, Homo sapiens
acacaagccacagaagcca

SEQ ID NO: 979920 - DNA, 14 bp, Homo sapiens
acacaagctcctta

SEQ ID NO: 979921 - DNA, 14 bp, Homo sapiens
acacaagtaaacat

SEQ ID NO: 979922 - DNA, 15 bp, Homo sapiens
acacaagtcctgtga

SEQ ID NO: 979923 - DNA, 15 bp, Homo sapiens
acacaataaagcagt

SEQ ID NO: 979924 - DNA, 13 bp, Homo sapiens
acacaataagcaa

SEQ ID NO: 979925 - DNA, 14 bp, Homo sapiens
acacaatatgaata

SEQ ID NO: 979926 - DNA, 16 bp, Homo sapiens
acacaatatgtatgct

SEQ ID NO: 979927 - DNA, 13 bp, Homo sapiens
acacaatggcacc

SEQ ID NO: 979928 - DNA, 14 bp, Homo sapiens
acacaatggcacct

SEQ ID NO: 979929 - DNA, 21 bp, Homo sapiens
acacaatggcacctctgccct

SEQ ID NO: 979930 - DNA, 11 bp, Homo sapiens
acacaatgtgg

SEQ ID NO: 979931 - DNA, 23 bp, Homo sapiens
acacaattgatacttcaggtgct

SEQ ID NO: 979932 - DNA, 17 bp, Homo sapiens
acacaattggaagtcta

SEQ ID NO: 979933 - DNA, 14 bp, Homo sapiens
acacaattgtttta

SEQ ID NO: 979934 - DNA, 10 bp, Homo sapiens
acacacacaa

SEQ ID NO: 979935 - DNA, 15 bp, Homo sapiens
acacacacacacaaa

SEQ ID NO: 979936 - DNA, 14 bp, Homo sapiens
acacacacacacac

SEQ ID NO: 979937 - DNA, 17 bp, Homo sapiens
acacacacacacacgat

SEQ ID NO: 979938 - DNA, 14 bp, Homo sapiens
acacacacacagga

SEQ ID NO: 979939 - DNA, 16 bp, Homo sapiens
acacacacacgcacgc

SEQ ID NO: 979940 - DNA, 13 bp, Homo sapiens
acacacacataca

SEQ ID NO: 979941 - DNA, 14 bp, Homo sapiens
acacacacatacag

SEQ ID NO: 979942 - DNA, 14 bp, Homo sapiens
acacacacatatac

SEQ ID NO: 979943 - DNA, 15 bp, Homo sapiens
acacacaccccccca

SEQ ID NO: 979944 - DNA, 22 bp, Homo sapiens
acacacacgatgcatttaataa

SEQ ID NO: 979945 - DNA, 21 bp, Homo sapiens
acacacacgccagctcctctc

SEQ ID NO: 979946 - DNA, 13 bp, Homo sapiens
acacacagaggaa

SEQ ID NO: 979947 - DNA, 15 bp, Homo sapiens
acacacagctgggca

SEQ ID NO: 979948 - DNA, 17 bp, Homo sapiens
acacacaggcaactgag

SEQ ID NO: 979949 - DNA, 21 bp, Homo sapiens
acacacatataaacatcacac

SEQ ID NO: 979950 - DNA, 13 bp, Homo sapiens
acacacatataca

SEQ ID NO: 979951 - DNA, 16 bp, Homo sapiens
acacacatatacacga

SEQ ID NO: 979952 - DNA, 19 bp, Homo sapiens
acacacatatacatatata

SEQ ID NO: 979953 - DNA, 21 bp, Homo sapiens
acacacatatacatatatata

SEQ ID NO: 979954 - DNA, 13 bp, Homo sapiens
acacaccagcact

SEQ ID NO: 979955 - DNA, 14 bp, Homo sapiens
acacaccagcactt

SEQ ID NO: 979956 - DNA, 16 bp, Homo sapiens
acacaccaggctgtgg

SEQ ID NO: 979957 - DNA, 18 bp, Homo sapiens
acacaccaggctgtgggc

SEQ ID NO: 979958 - DNA, 16 bp, Homo sapiens
acacaccccaacatgc

SEQ ID NO: 979959 - DNA, 14 bp, Homo sapiens
acacacccccagag

SEQ ID NO: 979960 - DNA, 11 bp, Homo sapiens
acacacctgta

SEQ ID NO: 979961 - DNA, 14 bp, Homo sapiens
acacacgagcaaac

SEQ ID NO: 979962 - DNA, 13 bp, Homo sapiens
acacacgatgcat

SEQ ID NO: 979963 - DNA, 14 bp, Homo sapiens
acacacgatgcatt

SEQ ID NO: 979964 - DNA, 15 bp, Homo sapiens
acacacgatgcattt

SEQ ID NO: 979965 - DNA, 19 bp, Homo sapiens
acacacgatgcatttaata

SEQ ID NO: 979966 - DNA, 21 bp, Homo sapiens
acacacgatgcatttaataaa

SEQ ID NO: 979967 - DNA, 14 bp, Homo sapiens
acacacgcacgcac

SEQ ID NO: 979968 - DNA, 16 bp, Homo sapiens
acacacgcacgcacac

SEQ ID NO: 979969 - DNA, 17 bp, Homo sapiens
acacacgcacgcacaca

SEQ ID NO: 979970 - DNA, 16 bp, Homo sapiens
acacacgcaggaactc

SEQ ID NO: 979971 - DNA, 20 bp, Homo sapiens
acacacgcaggaactcccag

SEQ ID NO: 979972 - DNA, 18 bp, Homo sapiens
acacacgccagctcctct

SEQ ID NO: 979973 - DNA, 17 bp, Homo sapiens
acacacggctgtccctc

SEQ ID NO: 979974 - DNA, 13 bp, Homo sapiens
acacacggggctc

SEQ ID NO: 979975 - DNA, 21 bp, Homo sapiens
acacacggttttggcagctga

SEQ ID NO: 979976 - DNA, 22 bp, Homo sapiens
acacacgtgcgtgcgagcacac

SEQ ID NO: 979977 - DNA, 17 bp, Homo sapiens
acacacgttgacgggcc

SEQ ID NO: 979978 - DNA, 20 bp, Homo sapiens
acacactaccgaatgtgtct

SEQ ID NO: 979979 - DNA, 22 bp, Homo sapiens
acacactcacaatttaaaatat

SEQ ID NO: 979980 - DNA, 22 bp, Homo sapiens
acacactctcatgtccccttcc

SEQ ID NO: 979981 - DNA, 13 bp, Homo sapiens
acacactgatgct

SEQ ID NO: 979982 - DNA, 17 bp, Homo sapiens
acacactgatgcttaga

SEQ ID NO: 979983 - DNA, 12 bp, Homo sapiens
acacactggacc

SEQ ID NO: 979984 - DNA, 18 bp, Homo sapiens
acacactggaccccactg

SEQ ID NO: 979985 - DNA, 22 bp, Homo sapiens
acacactgtcatgcttcatcat

SEQ ID NO: 979986 - DNA, 12 bp, Homo sapiens
acacactgtgcc

SEQ ID NO: 979987 - DNA, 15 bp, Homo sapiens
acacacttacagagc

SEQ ID NO: 979988 - DNA, 15 bp, Homo sapiens
acacactttctcttc

SEQ ID NO: 979989 - DNA, 16 bp, Homo sapiens
acacactttctcttca

SEQ ID NO: 979990 - DNA, 14 bp, Homo sapiens
acacagaaaccaat

SEQ ID NO: 979991 - DNA, 20 bp, Homo sapiens
acacagaaatgctgctggcc

SEQ ID NO: 979992 - DNA, 23 bp, Homo sapiens
acacagacatgctctttttttaa

SEQ ID NO: 979993 - DNA, 12 bp, Homo sapiens
acacagacggcc

SEQ ID NO: 979994 - DNA, 17 bp, Homo sapiens
acacagacggcctaggg

SEQ ID NO: 979995 - DNA, 18 bp, Homo sapiens
acacagactggcaataaa

SEQ ID NO: 979996 - DNA, 10 bp, Homo sapiens
acacagagaa

SEQ ID NO: 979997 - DNA, 15 bp, Homo sapiens
acacagagaaggcta

SEQ ID NO: 979998 - DNA, 16 bp, Homo sapiens
acacagagatttgaga

SEQ ID NO: 979999 - DNA, 12 bp, Homo sapiens
acacagaggaag

SEQ ID NO: 980000 - DNA, 23 bp, Homo sapiens
acacagagtggtctttctggaga

SEQ ID NO: 980001 - DNA, 16 bp, Homo sapiens
acacagatagaccttt

SEQ ID NO: 980002 - DNA, 19 bp, Homo sapiens
acacagatcccactggaag

SEQ ID NO: 980003 - DNA, 17 bp, Homo sapiens
acacagatttgagctca

SEQ ID NO: 980004 - DNA, 11 bp, Homo sapiens
acacagatttt

SEQ ID NO: 980005 - DNA, 15 bp, Homo sapiens
acacagatttttaca

SEQ ID NO: 980006 - DNA, 19 bp, Homo sapiens
acacagatttttacactaa

SEQ ID NO: 980007 - DNA, 14 bp, Homo sapiens
acacagcagcagtt

SEQ ID NO: 980008 - DNA, 14 bp, Homo sapiens
acacagcagtattg

SEQ ID NO: 980009 - DNA, 13 bp, Homo sapiens
acacagcatgtgc

SEQ ID NO: 980010 - DNA, 22 bp, Homo sapiens
acacagcctcccccgccagccc

SEQ ID NO: 980011 - DNA, 21 bp, Homo sapiens
acacagcctccctgagcctgc

SEQ ID NO: 980012 - DNA, 19 bp, Homo sapiens
acacagctgggcaaagcca

SEQ ID NO: 980013 - DNA, 20 bp, Homo sapiens
acaccattaccaaaataata

SEQ ID NO: 980014 - DNA, 11 bp, Homo sapiens
acacccaccct

SEQ ID NO: 980015 - DNA, 17 bp, Homo sapiens
acacccaccgtccgccc

SEQ ID NO: 980016 - DNA, 21 bp, Homo sapiens
acacccaccgtccgccctgct

SEQ ID NO: 980017 - DNA, 22 bp, Homo sapiens
acacccaccgtccgccctgctc

SEQ ID NO: 980018 - DNA, 22 bp, Homo sapiens
acacccaggggaaggccctgag

SEQ ID NO: 980019 - DNA, 18 bp, Homo sapiens
acacccaggtctcttcct

SEQ ID NO: 980020 - DNA, 18 bp, Homo sapiens
acacccaggtgatttcct

SEQ ID NO: 980021 - DNA, 15 bp, Homo sapiens
acacccagttctgaa

SEQ ID NO: 980022 - DNA, 17 bp, Homo sapiens
acacccagttctgaata

SEQ ID NO: 980023 - DNA, 14 bp, Homo sapiens
acacccatgccaga

SEQ ID NO: 980024 - DNA, 16 bp, Homo sapiens
acacccatgccagaga

SEQ ID NO: 980025 - DNA, 19 bp, Homo sapiens
acaccccaacttggcagct

SEQ ID NO: 980026 - DNA, 14 bp, Homo sapiens
atgacttcagtgaa

SEQ ID NO: 980027 - DNA, 23 bp, Homo sapiens
atgacttcagtgaaattttcagg

SEQ ID NO: 980028 - DNA, 20 bp, Homo sapiens
atgacttctttactaacact

SEQ ID NO: 980029 - DNA, 23 bp, Homo sapiens
atgacttgattgtacttggagta

SEQ ID NO: 980030 - DNA, 16 bp, Homo sapiens
atgacttgctactttt

SEQ ID NO: 980031 - DNA, 18 bp, Homo sapiens
atgacttgggtttaacaa

SEQ ID NO: 980032 - DNA, 14 bp, Homo sapiens
atgactttagaata

SEQ ID NO: 980033 - DNA, 22 bp, Homo sapiens
atgactttagaataatattgtg

SEQ ID NO: 980034 - DNA, 20 bp, Homo sapiens
atgactttatttttctaagt

SEQ ID NO: 980035 - DNA, 12 bp, Homo sapiens
atgactttgaac

SEQ ID NO: 980036 - DNA, 14 bp, Homo sapiens
atgactttgaactg

SEQ ID NO: 980037 - DNA, 16 bp, Homo sapiens
atgacttttctgccct

SEQ ID NO: 980038 - DNA, 15 bp, Homo sapiens
atgactttttataaa

SEQ ID NO: 980039 - DNA, 18 bp, Homo sapiens
atgactttttataaaatg

SEQ ID NO: 980040 - DNA, 13 bp, Homo sapiens
atgacttttttaa

SEQ ID NO: 980041 - DNA, 14 bp, Homo sapiens
atgacttttttaaa

SEQ ID NO: 980042 - DNA, 19 bp, Homo sapiens
atgacttttttaaactaag

SEQ ID NO: 980043 - DNA, 11 bp, Homo sapiens
atgagaaaaaa

SEQ ID NO: 980044 - DNA, 18 bp, Homo sapiens
atgagaaaaaaatatata

SEQ ID NO: 980045 - DNA, 13 bp, Homo sapiens
atgagaaagggag

SEQ ID NO: 980046 - DNA, 20 bp, Homo sapiens
atgagaaagggagaggaaga

SEQ ID NO: 980047 - DNA, 14 bp, Homo sapiens
atgagaacaaagct

SEQ ID NO: 980048 - DNA, 16 bp, Homo sapiens
atgagaacaaagctgt

SEQ ID NO: 980049 - DNA, 20 bp, Homo sapiens
atgagaacaaagctgttaaa

SEQ ID NO: 980050 - DNA, 13 bp, Homo sapiens
atgagaagccaag

SEQ ID NO: 980051 - DNA, 14 bp, Homo sapiens
atgagaagccaagc

SEQ ID NO: 980052 - DNA, 12 bp, Homo sapiens
atgagaagccag

SEQ ID NO: 980053 - DNA, 13 bp, Homo sapiens
atgagaagggaag

SEQ ID NO: 980054 - DNA, 14 bp, Homo sapiens
atgagaagtacttg

SEQ ID NO: 980055 - DNA, 17 bp, Homo sapiens
atgagaatataccttat

SEQ ID NO: 980056 - DNA, 11 bp, Homo sapiens
atgagaatcta

SEQ ID NO: 980057 - DNA, 23 bp, Homo sapiens
atgagaatctacccccagatcca

SEQ ID NO: 980058 - DNA, 22 bp, Homo sapiens
atgagacataggccatgaaaaa

SEQ ID NO: 980059 - DNA, 18 bp, Homo sapiens
atgagaccactgttatca

SEQ ID NO: 980060 - DNA, 22 bp, Homo sapiens
atgagaccagtggtctggaaac

SEQ ID NO: 980061 - DNA, 15 bp, Homo sapiens
atgagactctagggt

SEQ ID NO: 980062 - DNA, 17 bp, Homo sapiens
atgagactgatccctgg

SEQ ID NO: 980063 - DNA, 15 bp, Homo sapiens
atgagactttctgct

SEQ ID NO: 980064 - DNA, 17 bp, Homo sapiens
atgagactttctgctgg

SEQ ID NO: 980065 - DNA, 16 bp, Homo sapiens
atgagactttttcagt

SEQ ID NO: 980066 - DNA, 17 bp, Homo sapiens
atgagagcgacacagac

SEQ ID NO: 980067 - DNA, 19 bp, Homo sapiens
atgagagctcagactggga

SEQ ID NO: 980068 - DNA, 20 bp, Homo sapiens
atgagaggagaacagtagga

SEQ ID NO: 980069 - DNA, 19 bp, Homo sapiens
atgagagggcagtgtttcc

SEQ ID NO: 980070 - DNA, 18 bp, Homo sapiens
atgagagggccctgcctg

SEQ ID NO: 980071 - DNA, 15 bp, Homo sapiens
atgagagttccttct

SEQ ID NO: 980072 - DNA, 15 bp, Homo sapiens
atgagatactttgca

SEQ ID NO: 980073 - DNA, 22 bp, Homo sapiens
atgagatactttgcattgtctg

SEQ ID NO: 980074 - DNA, 19 bp, Homo sapiens
atgagatcccgcctcttct

SEQ ID NO: 980075 - DNA, 22 bp, Homo sapiens
atgagatctaagcctttccata

SEQ ID NO: 980076 - DNA, 23 bp, Homo sapiens
atgagatgatacatccaaagcag

SEQ ID NO: 980077 - DNA, 17 bp, Homo sapiens
atgagatggccatgctc

SEQ ID NO: 980078 - DNA, 19 bp, Homo sapiens
atgagattttggaagaagt

SEQ ID NO: 980079 - DNA, 17 bp, Homo sapiens
atgagcacatctctctg

SEQ ID NO: 980080 - DNA, 19 bp, Homo sapiens
atgagcacatctctctgcc

SEQ ID NO: 980081 - DNA, 20 bp, Homo sapiens
atgagcacatctctctgccc

SEQ ID NO: 980082 - DNA, 20 bp, Homo sapiens
atgagcatcctgagccccgc

SEQ ID NO: 980083 - DNA, 21 bp, Homo sapiens
atgagccaccgcgcccagcct

SEQ ID NO: 980084 - DNA, 23 bp, Homo sapiens
atgagccactgcacctgcccagc

SEQ ID NO: 980085 - DNA, 21 bp, Homo sapiens
atgagccatattaattgcctg

SEQ ID NO: 980086 - DNA, 22 bp, Homo sapiens
atgagccatattaattgcctgt

SEQ ID NO: 980087 - DNA, 16 bp, Homo sapiens
atgagccatcactaga

SEQ ID NO: 980088 - DNA, 20 bp, Homo sapiens
atgagccatcactagaagaa

SEQ ID NO: 980089 - DNA, 12 bp, Homo sapiens
atgagcccagag

SEQ ID NO: 980090 - DNA, 14 bp, Homo sapiens
atgagcccagagaa

SEQ ID NO: 980091 - DNA, 16 bp, Homo sapiens
atgagcccagagaaca

SEQ ID NO: 980092 - DNA, 17 bp, Homo sapiens
atgagcccagagaacag

SEQ ID NO: 980093 - DNA, 15 bp, Homo sapiens
atgagccctggctcc

SEQ ID NO: 980094 - DNA, 23 bp, Homo sapiens
atgagcctacgctgaagatggca

SEQ ID NO: 980095 - DNA, 10 bp, Homo sapiens
atgagcctgc

SEQ ID NO: 980096 - DNA, 13 bp, Homo sapiens
atgagcctgcccg

SEQ ID NO: 980097 - DNA, 19 bp, Homo sapiens
atgagcgaaattgtcttta

SEQ ID NO: 980098 - DNA, 17 bp, Homo sapiens
atgagctacaacaaaag

SEQ ID NO: 980099 - DNA, 14 bp, Homo sapiens
atgagctccagacc

SEQ ID NO: 980100 - DNA, 16 bp, Homo sapiens
atgagctccagacccc

SEQ ID NO: 980101 - DNA, 20 bp, Homo sapiens
atgagctccagacccccagc

SEQ ID NO: 980102 - DNA, 19 bp, Homo sapiens
atgagctgctgtgcccagc

SEQ ID NO: 980103 - DNA, 21 bp, Homo sapiens
atgagctggaaggagtgagag

SEQ ID NO: 980104 - DNA, 14 bp, Homo sapiens
atgagctgtatctg

SEQ ID NO: 980105 - DNA, 15 bp, Homo sapiens
atgagctgtatctgt

SEQ ID NO: 980106 - DNA, 15 bp, Homo sapiens
atgagcttgattaaa

SEQ ID NO: 980107 - DNA, 15 bp, Homo sapiens
atgaggaaaccaaga

SEQ ID NO: 980108 - DNA, 16 bp, Homo sapiens
atgaggaaactactga

SEQ ID NO: 980109 - DNA, 23 bp, Homo sapiens
atgaggaaactactgaactagca

SEQ ID NO: 980110 - DNA, 14 bp, Homo sapiens
atgaggaataatta

SEQ ID NO: 980111 - DNA, 15 bp, Homo sapiens
atgaggacgtgtctg

SEQ ID NO: 980112 - DNA, 14 bp, Homo sapiens
atgaggaggggagc

SEQ ID NO: 980113 - DNA, 23 bp, Homo sapiens
atgaggaggggagcgtctgggaa

SEQ ID NO: 980114 - DNA, 15 bp, Homo sapiens
atgaggaggggaggg

SEQ ID NO: 980115 - DNA, 12 bp, Homo sapiens
atgaggagggtg

SEQ ID NO: 980116 - DNA, 14 bp, Homo sapiens
atgaggagggtggg

SEQ ID NO: 980117 - DNA, 19 bp, Homo sapiens
atgaggagtaaaattcagt

SEQ ID NO: 980118 - DNA, 17 bp, Homo sapiens
atgaggatataatgtgt

SEQ ID NO: 980119 - DNA, 15 bp, Homo sapiens
atgaggcaaacagca

SEQ ID NO: 980120 - DNA, 21 bp, Homo sapiens
atgaggcaatgtcaggaacag

SEQ ID NO: 980121 - DNA, 15 bp, Homo sapiens
atgaggcacttctgt

SEQ ID NO: 980122 - DNA, 12 bp, Homo sapiens
atgaggccagac

SEQ ID NO: 980123 - DNA, 13 bp, Homo sapiens
atgaggccagacc

SEQ ID NO: 980124 - DNA, 16 bp, Homo sapiens
atgaggccatctcagg

SEQ ID NO: 980125 - DNA, 17 bp, Homo sapiens
atgaggctattaaaaga

SEQ ID NO: 980126 - DNA, 16 bp, Homo sapiens
atgagggatcacaggg

SEQ ID NO: 980127 - DNA, 16 bp, Homo sapiens
atgaggggaaagggag

SEQ ID NO: 980128 - DNA, 22 bp, Homo sapiens
atgaggggaaagggagaagggt

SEQ ID NO: 980129 - DNA, 11 bp, Homo sapiens
atgaggggaga

SEQ ID NO: 980130 - DNA, 14 bp, Homo sapiens
atgaggtcctcagg

SEQ ID NO: 980131 - DNA, 15 bp, Homo sapiens
atgaggtcctcaggt

SEQ ID NO: 980132 - DNA, 18 bp, Homo sapiens
atgaggtcctcaggtcag

SEQ ID NO: 980133 - DNA, 19 bp, Homo sapiens
atgaggtcctcaggtcagc

SEQ ID NO: 980134 - DNA, 14 bp, Homo sapiens
atgaggtctgaaat

SEQ ID NO: 980135 - DNA, 15 bp, Homo sapiens
atgaggtctgaaatg

SEQ ID NO: 980136 - DNA, 16 bp, Homo sapiens
acacttaaaattgtaa

SEQ ID NO: 980137 - DNA, 23 bp, Homo sapiens
acacttaaaattgtaacctgcat

SEQ ID NO: 980138 - DNA, 14 bp, Homo sapiens
acacttaaattatg

SEQ ID NO: 980139 - DNA, 20 bp, Homo sapiens
acacttaagggttttagaaa

SEQ ID NO: 980140 - DNA, 14 bp, Homo sapiens
acacttaatactac

SEQ ID NO: 980141 - DNA, 13 bp, Homo sapiens
acacttaatagca

SEQ ID NO: 980142 - DNA, 14 bp, Homo sapiens
acacttacagagca

SEQ ID NO: 980143 - DNA, 17 bp, Homo sapiens
acacttactttttctgg

SEQ ID NO: 980144 - DNA, 19 bp, Homo sapiens
acacttagggtttggagct

SEQ ID NO: 980145 - DNA, 21 bp, Homo sapiens
acacttatattttatgaacat

SEQ ID NO: 980146 - DNA, 14 bp, Homo sapiens
acacttatttatga

SEQ ID NO: 980147 - DNA, 18 bp, Homo sapiens
acacttatttatgaattg

SEQ ID NO: 980148 - DNA, 13 bp, Homo sapiens
acacttcagagag

SEQ ID NO: 980149 - DNA, 16 bp, Homo sapiens
acacttcagagagctg

SEQ ID NO: 980150 - DNA, 17 bp, Homo sapiens
acacttcagagagctgg

SEQ ID NO: 980151 - DNA, 15 bp, Homo sapiens
acacttcaggctctt

SEQ ID NO: 980152 - DNA, 20 bp, Homo sapiens
acacttccagtctggagagc

SEQ ID NO: 980153 - DNA, 13 bp, Homo sapiens
acacttccccttg

SEQ ID NO: 980154 - DNA, 13 bp, Homo sapiens
acacttccctggc

SEQ ID NO: 980155 - DNA, 14 bp, Homo sapiens
acacttcctgtcca

SEQ ID NO: 980156 - DNA, 16 bp, Homo sapiens
acacttcctgtccaga

SEQ ID NO: 980157 - DNA, 19 bp, Homo sapiens
acacttcctgtccagagag

SEQ ID NO: 980158 - DNA, 14 bp, Homo sapiens
acacttcctgtcct

SEQ ID NO: 980159 - DNA, 16 bp, Homo sapiens
acacttcgttcgcaga

SEQ ID NO: 980160 - DNA, 21 bp, Homo sapiens
atgattctagtacataattga

SEQ ID NO: 980161 - DNA, 22 bp, Homo sapiens
atgattctatttatatgtacat

SEQ ID NO: 980162 - DNA, 19 bp, Homo sapiens
atgattcttctcttgtgat

SEQ ID NO: 980163 - DNA, 20 bp, Homo sapiens
atgattctttgttacaggca

SEQ ID NO: 980164 - DNA, 14 bp, Homo sapiens
atgattggattatt

SEQ ID NO: 980165 - DNA, 21 bp, Homo sapiens
atgattggattattcatttaa

SEQ ID NO: 980166 - DNA, 22 bp, Homo sapiens
atgattggcttaaagtgaagga

SEQ ID NO: 980167 - DNA, 20 bp, Homo sapiens
atgattggttaaaatgtgat

SEQ ID NO: 980168 - DNA, 13 bp, Homo sapiens
atgattggttcag

SEQ ID NO: 980169 - DNA, 16 bp, Homo sapiens
atgatttaaaaacaac

SEQ ID NO: 980170 - DNA, 17 bp, Homo sapiens
atgatttaatttgaaat

SEQ ID NO: 980171 - DNA, 20 bp, Homo sapiens
atgatttagggaagcaggga

SEQ ID NO: 980172 - DNA, 13 bp, Homo sapiens
atgatttatagtt

SEQ ID NO: 980173 - DNA, 15 bp, Homo sapiens
atgatttatatatgg

SEQ ID NO: 980174 - DNA, 14 bp, Homo sapiens
atgatttcccccct

SEQ ID NO: 980175 - DNA, 15 bp, Homo sapiens
atgatttccttcaat

SEQ ID NO: 980176 - DNA, 20 bp, Homo sapiens
atgatttccttcaatgtgca

SEQ ID NO: 980177 - DNA, 13 bp, Homo sapiens
atgatttggggga

SEQ ID NO: 980178 - DNA, 14 bp, Homo sapiens
atgatttgttttga

SEQ ID NO: 980179 - DNA, 19 bp, Homo sapiens
atgatttgttttgaatttt

SEQ ID NO: 980180 - DNA, 21 bp, Homo sapiens
atgatttgttttgaattttgt

SEQ ID NO: 980181 - DNA, 22 bp, Homo sapiens
atgattttacaagtataacagt

SEQ ID NO: 980182 - DNA, 11 bp, Homo sapiens
atgattttatt

SEQ ID NO: 980183 - DNA, 18 bp, Homo sapiens
atgattttattacagaaa

SEQ ID NO: 980184 - DNA, 22 bp, Homo sapiens
atgattttattacagaaatgtt

SEQ ID NO: 980185 - DNA, 23 bp, Homo sapiens
atgattttatttgacaaaatttg

SEQ ID NO: 980186 - DNA, 22 bp, Homo sapiens
atgattttcatttcatgaaaat

SEQ ID NO: 980187 - DNA, 18 bp, Homo sapiens
atgattttcctccctggt

SEQ ID NO: 980188 - DNA, 14 bp, Homo sapiens
atgattttgtaatt

SEQ ID NO: 980189 - DNA, 17 bp, Homo sapiens
atgatttttctttacaa

SEQ ID NO: 980190 - DNA, 17 bp, Homo sapiens
atgattttttgaaagtt

SEQ ID NO: 980191 - DNA, 21 bp, Homo sapiens
atgatttttttttcatacact

SEQ ID NO: 980192 - DNA, 15 bp, Homo sapiens
atgatttttttttcc

SEQ ID NO: 980193 - DNA, 16 bp, Homo sapiens
atgatttttttttcca

SEQ ID NO: 980194 - DNA, 17 bp, Homo sapiens
atgcaaaaaattcttta

SEQ ID NO: 980195 - DNA, 23 bp, Homo sapiens
atgcaaaaactctttgagagggt

SEQ ID NO: 980196 - DNA, 12 bp, Homo sapiens
atgcaaaaagaa

SEQ ID NO: 980197 - DNA, 19 bp, Homo sapiens
atgcaaaaattagccgggc

SEQ ID NO: 980198 - DNA, 21 bp, Homo sapiens
atgcaaaaccttgtgaactga

SEQ ID NO: 980199 - DNA, 17 bp, Homo sapiens
atgcaaaagcagctaaa

SEQ ID NO: 980200 - DNA, 15 bp, Homo sapiens
atgcaaaagttctca

SEQ ID NO: 980201 - DNA, 21 bp, Homo sapiens
atgcaaaagttctgacttgac

SEQ ID NO: 980202 - DNA, 14 bp, Homo sapiens
atgcaaaataaaga

SEQ ID NO: 980203 - DNA, 15 bp, Homo sapiens
atgcaaaataaagaa

SEQ ID NO: 980204 - DNA, 17 bp, Homo sapiens
atgcaaaatatgtttaa

SEQ ID NO: 980205 - DNA, 23 bp, Homo sapiens
atgcaaaattgttttcacttgta

SEQ ID NO: 980206 - DNA, 16 bp, Homo sapiens
atgcaaactgctttat

SEQ ID NO: 980207 - DNA, 17 bp, Homo sapiens
atgcaaagcacacctcg

SEQ ID NO: 980208 - DNA, 17 bp, Homo sapiens
atgcaaagcactctctg

SEQ ID NO: 980209 - DNA, 13 bp, Homo sapiens
atgcaaatacatt

SEQ ID NO: 980210 - DNA, 18 bp, Homo sapiens
atgcaaatcaattactgg

SEQ ID NO: 980211 - DNA, 13 bp, Homo sapiens
atgcaaatgaatc

SEQ ID NO: 980212 - DNA, 14 bp, Homo sapiens
atgcaaatgaatca

SEQ ID NO: 980213 - DNA, 16 bp, Homo sapiens
atgcaaatgaatcatt

SEQ ID NO: 980214 - DNA, 16 bp, Homo sapiens
atgcaaatgtcttcca

SEQ ID NO: 980215 - DNA, 15 bp, Homo sapiens
atgcaaatgttttga

SEQ ID NO: 980216 - DNA, 20 bp, Homo sapiens
atgcaaatgttttgaaatga

SEQ ID NO: 980217 - DNA, 16 bp, Homo sapiens
atgcaaattaaaacat

SEQ ID NO: 980218 - DNA, 18 bp, Homo sapiens
atgcaaattaaaacatat

SEQ ID NO: 980219 - DNA, 19 bp, Homo sapiens
atgcaaatttctataaatt

SEQ ID NO: 980220 - DNA, 20 bp, Homo sapiens
atgcaaccagaattgtcctc

SEQ ID NO: 980221 - DNA, 15 bp, Homo sapiens
atgcaaccatttgaa

SEQ ID NO: 980222 - DNA, 23 bp, Homo sapiens
atgcaacgggattgaagggtcct

SEQ ID NO: 980223 - DNA, 20 bp, Homo sapiens
atgcaagagtgattgcagct

SEQ ID NO: 980224 - DNA, 22 bp, Homo sapiens
atgcaagcaaagtatcaaagaa

SEQ ID NO: 980225 - DNA, 15 bp, Homo sapiens
atgcaagcagctttt

SEQ ID NO: 980226 - DNA, 16 bp, Homo sapiens
atgcaagcagcttttt

SEQ ID NO: 980227 - DNA, 23 bp, Homo sapiens
atgcaagctagtggcttcaaaat

SEQ ID NO: 980228 - DNA, 16 bp, Homo sapiens
atgcaagcttggtcaa

SEQ ID NO: 980229 - DNA, 17 bp, Homo sapiens
atgcaagcttggtcaaa

SEQ ID NO: 980230 - DNA, 18 bp, Homo sapiens
atgcaaggaaggaaagaa

SEQ ID NO: 980231 - DNA, 20 bp, Homo sapiens
atgcaaggaaggaaagaaag

SEQ ID NO: 980232 - DNA, 15 bp, Homo sapiens
atgcaaggaccagga

SEQ ID NO: 980233 - DNA, 14 bp, Homo sapiens
atgcaaggtcattt

SEQ ID NO: 980234 - DNA, 16 bp, Homo sapiens
atgcaaggtcattttt

SEQ ID NO: 980235 - DNA, 22 bp, Homo sapiens
atgcaaggtcattttttttaag

SEQ ID NO: 980236 - DNA, 12 bp, Homo sapiens
atgcaagttatt

SEQ ID NO: 980237 - DNA, 15 bp, Homo sapiens
atgcaagttatttta

SEQ ID NO: 980238 - DNA, 21 bp, Homo sapiens
atgcaagttattttatttgct

SEQ ID NO: 980239 - DNA, 22 bp, Homo sapiens
atgcaagttattttatttgctt

SEQ ID NO: 980240 - DNA, 16 bp, Homo sapiens
atgcaataatccaccc

SEQ ID NO: 980241 - DNA, 14 bp, Homo sapiens
atgcaataatttta

SEQ ID NO: 980242 - DNA, 9 bp, Homo sapiens
atgcaatat

SEQ ID NO: 980243 - DNA, 21 bp, Homo sapiens
atgcaatataagcataaaaga

SEQ ID NO: 980244 - DNA, 22 bp, Homo sapiens
atgcaatattggatgaaaagag

SEQ ID NO: 980245 - DNA, 16 bp, Homo sapiens
atgcaatcagacaagt

SEQ ID NO: 980246 - DNA, 15 bp, Homo sapiens
atgcaatgaaacaga

SEQ ID NO: 980247 - DNA, 19 bp, Homo sapiens
atgcaatgacatcttcaaa

SEQ ID NO: 980248 - DNA, 18 bp, Homo sapiens
atgcaatgtatagtgtct

SEQ ID NO: 980249 - DNA, 16 bp, Homo sapiens
atgcaatgtcttaaat

SEQ ID NO: 980250 - DNA, 16 bp, Homo sapiens
atgcaatgtgctactg

SEQ ID NO: 980251 - DNA, 16 bp, Homo sapiens
atgcaatttaaaatta

SEQ ID NO: 980252 - DNA, 20 bp, Homo sapiens
atgcaatttaatggatattt

SEQ ID NO: 980253 - DNA, 17 bp, Homo sapiens
atgcaatttcctttttt

SEQ ID NO: 980254 - DNA, 17 bp, Homo sapiens
atgcaatttgattgact

SEQ ID NO: 980255 - DNA, 15 bp, Homo sapiens
atgcaatttgggatt

SEQ ID NO: 980256 - DNA, 16 bp, Homo sapiens
atgcacacacatatat

SEQ ID NO: 980257 - DNA, 13 bp, Homo sapiens
atgcacacagaga

SEQ ID NO: 980258 - DNA, 19 bp, Homo sapiens
acagatacctccaaccctg

SEQ ID NO: 980259 - DNA, 21 bp, Homo sapiens
acagatactggaagttttgca

SEQ ID NO: 980260 - DNA, 19 bp, Homo sapiens
acagatagacagtgctgcc

SEQ ID NO: 980261 - DNA, 19 bp, Homo sapiens
acagatattgttataaata

SEQ ID NO: 980262 - DNA, 20 bp, Homo sapiens
acagatatttagctctgtgg

SEQ ID NO: 980263 - DNA, 14 bp, Homo sapiens
acagatattttatc

SEQ ID NO: 980264 - DNA, 21 bp, Homo sapiens
acagatcaacaataccttttt

SEQ ID NO: 980265 - DNA, 14 bp, Homo sapiens
acagatcaagaaaa

SEQ ID NO: 980266 - DNA, 15 bp, Homo sapiens
acagatcactcctgg

SEQ ID NO: 980267 - DNA, 17 bp, Homo sapiens
acagatcactcctggag

SEQ ID NO: 980268 - DNA, 22 bp, Homo sapiens
acagatcatcttggaactgcat

SEQ ID NO: 980269 - DNA, 17 bp, Homo sapiens
acagatccccaagcctg

SEQ ID NO: 980270 - DNA, 18 bp, Homo sapiens
acagatgaccataatttt

SEQ ID NO: 980271 - DNA, 18 bp, Homo sapiens
acagatgaccgtgtacaa

SEQ ID NO: 980272 - DNA, 20 bp, Homo sapiens
acagatgaccgtgtacaata

SEQ ID NO: 980273 - DNA, 13 bp, Homo sapiens
acagatgagtcac

SEQ ID NO: 980274 - DNA, 19 bp, Homo sapiens
acagatgataaatatttat

SEQ ID NO: 980275 - DNA, 14 bp, Homo sapiens
acagatgccaactt

SEQ ID NO: 980276 - DNA, 16 bp, Homo sapiens
acagatgccccagagc

SEQ ID NO: 980277 - DNA, 18 bp, Homo sapiens
acagatgccccagagctg

SEQ ID NO: 980278 - DNA, 18 bp, Homo sapiens
acagatgctgagccatag

SEQ ID NO: 980279 - DNA, 19 bp, Homo sapiens
acagatggaaaaactgagg

SEQ ID NO: 980280 - DNA, 20 bp, Homo sapiens
acagatggacgcaggccctg

SEQ ID NO: 980281 - DNA, 16 bp, Homo sapiens
acagatggatttgcct

SEQ ID NO: 980282 - DNA, 14 bp, Homo sapiens
acagatggcccaag

SEQ ID NO: 980283 - DNA, 17 bp, Homo sapiens
acagatggcccaaggga

SEQ ID NO: 980284 - DNA, 22 bp, Homo sapiens
acagatggggtctgtgactgga

SEQ ID NO: 980285 - DNA, 14 bp, Homo sapiens
acagatgtctctgg

SEQ ID NO: 980286 - DNA, 12 bp, Homo sapiens
acagatgttgaa

SEQ ID NO: 980287 - DNA, 22 bp, Homo sapiens
acagatgtttttaattctagta

SEQ ID NO: 980288 - DNA, 13 bp, Homo sapiens
acagattaatatt

SEQ ID NO: 980289 - DNA, 17 bp, Homo sapiens
acagattcataaagtaa

SEQ ID NO: 980290 - DNA, 14 bp, Homo sapiens
acagattgaagaat

SEQ ID NO: 980291 - DNA, 17 bp, Homo sapiens
acagattgctgcttctg

SEQ ID NO: 980292 - DNA, 13 bp, Homo sapiens
atgccactgccag

SEQ ID NO: 980293 - DNA, 16 bp, Homo sapiens
atgccactgccaggca

SEQ ID NO: 980294 - DNA, 20 bp, Homo sapiens
atgccactgccaggcacctg

SEQ ID NO: 980295 - DNA, 15 bp, Homo sapiens
atgccactgccttcg

SEQ ID NO: 980296 - DNA, 12 bp, Homo sapiens
atgccacttcct

SEQ ID NO: 980297 - DNA, 17 bp, Homo sapiens
atgccagaaacagttcc

SEQ ID NO: 980298 - DNA, 21 bp, Homo sapiens
atgccagaaggaatcttctca

SEQ ID NO: 980299 - DNA, 12 bp, Homo sapiens
atgccagagagg

SEQ ID NO: 980300 - DNA, 14 bp, Homo sapiens
atgccagagggcca

SEQ ID NO: 980301 - DNA, 22 bp, Homo sapiens
atgccagagggccagcaggctc

SEQ ID NO: 980302 - DNA, 17 bp, Homo sapiens
atgccagattctgcctc

SEQ ID NO: 980303 - DNA, 18 bp, Homo sapiens
atgccagctcagtcccat

SEQ ID NO: 980304 - DNA, 13 bp, Homo sapiens
atgccagctggcc

SEQ ID NO: 980305 - DNA, 13 bp, Homo sapiens
atgccagcttctc

SEQ ID NO: 980306 - DNA, 20 bp, Homo sapiens
atgccagcttctctctccag

SEQ ID NO: 980307 - DNA, 21 bp, Homo sapiens
atgccagcttctctctccagg

SEQ ID NO: 980308 - DNA, 12 bp, Homo sapiens
atgccaggacac

SEQ ID NO: 980309 - DNA, 20 bp, Homo sapiens
atgccaggacccgccagccc

SEQ ID NO: 980310 - DNA, 22 bp, Homo sapiens
atgccaggacccgccagccccg

SEQ ID NO: 980311 - DNA, 19 bp, Homo sapiens
atgccaggcggacaaagtt

SEQ ID NO: 980312 - DNA, 20 bp, Homo sapiens
atgccaggctgcgtccctcc

SEQ ID NO: 980313 - DNA, 23 bp, Homo sapiens
atgccagggccatgtcagacaca

SEQ ID NO: 980314 - DNA, 12 bp, Homo sapiens
atgccaggtgca

SEQ ID NO: 980315 - DNA, 17 bp, Homo sapiens
atgccaggttaggaagg

SEQ ID NO: 980316 - DNA, 23 bp, Homo sapiens
atgccaggttaggaaggcagcat

SEQ ID NO: 980317 - DNA, 18 bp, Homo sapiens
atgccagtttttaaaatg

SEQ ID NO: 980318 - DNA, 21 bp, Homo sapiens
atgccatgatttttggtattt

SEQ ID NO: 980319 - DNA, 22 bp, Homo sapiens
atgccatgtttagattccagga

SEQ ID NO: 980320 - DNA, 13 bp, Homo sapiens
atgccatttcttc

SEQ ID NO: 980321 - DNA, 14 bp, Homo sapiens
atgcccaaaactta

SEQ ID NO: 980322 - DNA, 12 bp, Homo sapiens
atgcccaccccc

SEQ ID NO: 980323 - DNA, 15 bp, Homo sapiens
atgcccaccccctgc

SEQ ID NO: 980324 - DNA, 21 bp, Homo sapiens
atgcccacctgcccatcacag

SEQ ID NO: 980325 - DNA, 22 bp, Homo sapiens
atgcccagagggcccaggcagg

SEQ ID NO: 980326 - DNA, 12 bp, Homo sapiens
atgcccagccag

SEQ ID NO: 980327 - DNA, 16 bp, Homo sapiens
atgcccagccagccac

SEQ ID NO: 980328 - DNA, 17 bp, Homo sapiens
atgcccagccagccacc

SEQ ID NO: 980329 - DNA, 22 bp, Homo sapiens
atgcccagccagccacccctgc

SEQ ID NO: 980330 - DNA, 21 bp, Homo sapiens
atgcccagctagtttttgtat

SEQ ID NO: 980331 - DNA, 13 bp, Homo sapiens
atgccccaccccc

SEQ ID NO: 980332 - DNA, 14 bp, Homo sapiens
atgccccagctctg

SEQ ID NO: 980333 - DNA, 16 bp, Homo sapiens
atgccccattccttgc

SEQ ID NO: 980334 - DNA, 13 bp, Homo sapiens
atgcccccagctg

SEQ ID NO: 980335 - DNA, 18 bp, Homo sapiens
atgcccccattctcccag

SEQ ID NO: 980336 - DNA, 23 bp, Homo sapiens
atgcccccattctcccagtctct

SEQ ID NO: 980337 - DNA, 16 bp, Homo sapiens
atgcccccttcgctcc

SEQ ID NO: 980338 - DNA, 23 bp, Homo sapiens
atgcccccttcgctcctcctctc

SEQ ID NO: 980339 - DNA, 21 bp, Homo sapiens
atgccccctttcagatgtctt

SEQ ID NO: 980340 - DNA, 17 bp, Homo sapiens
atgccccgagcccaggc

SEQ ID NO: 980341 - DNA, 18 bp, Homo sapiens
atgccccgtccccctctg

SEQ ID NO: 980342 - DNA, 21 bp, Homo sapiens
atgccccgtccccctctggct

SEQ ID NO: 980343 - DNA, 17 bp, Homo sapiens
atgcccctcccccagct

SEQ ID NO: 980344 - DNA, 20 bp, Homo sapiens
atgcccctcccccagctgcg

SEQ ID NO: 980345 - DNA, 23 bp, Homo sapiens
atgcccctgcagtttggccctgg

SEQ ID NO: 980346 - DNA, 20 bp, Homo sapiens
atgcccgagtccgcccatcc

SEQ ID NO: 980347 - DNA, 17 bp, Homo sapiens
atgcccggcgccgggca

SEQ ID NO: 980348 - DNA, 17 bp, Homo sapiens
atgcccggctaattttt

SEQ ID NO: 980349 - DNA, 23 bp, Homo sapiens
atgcccgggggacgcctgccctg

SEQ ID NO: 980350 - DNA, 13 bp, Homo sapiens
atgccctccaatc

SEQ ID NO: 980351 - DNA, 19 bp, Homo sapiens
atgccctccaatcctttcc

SEQ ID NO: 980352 - DNA, 19 bp, Homo sapiens
atgccctcccaggaccctc

SEQ ID NO: 980353 - DNA, 15 bp, Homo sapiens
atgccctcccctcag

SEQ ID NO: 980354 - DNA, 20 bp, Homo sapiens
atgccctcccctcagcgcag

SEQ ID NO: 980355 - DNA, 16 bp, Homo sapiens
atgccctcccttctcc

SEQ ID NO: 980356 - DNA, 20 bp, Homo sapiens
atgccctcccttctccctgg

SEQ ID NO: 980357 - DNA, 21 bp, Homo sapiens
atgccctcccttctccctgga

SEQ ID NO: 980358 - DNA, 22 bp, Homo sapiens
atgccctcccttctccctggat

SEQ ID NO: 980359 - DNA, 23 bp, Homo sapiens
atgccctcctctcccattgtccc

SEQ ID NO: 980360 - DNA, 16 bp, Homo sapiens
atgccctgcagagcaa

SEQ ID NO: 980361 - DNA, 19 bp, Homo sapiens
atgccctgcagagcaataa

SEQ ID NO: 980362 - DNA, 16 bp, Homo sapiens
atgccctgctggcctg

SEQ ID NO: 980363 - DNA, 18 bp, Homo sapiens
atgccctgggatgcctca

SEQ ID NO: 980364 - DNA, 12 bp, Homo sapiens
atgccctgtgca

SEQ ID NO: 980365 - DNA, 15 bp, Homo sapiens
atgcccttaaatcat

SEQ ID NO: 980366 - DNA, 12 bp, Homo sapiens
atgcccttcact

SEQ ID NO: 980367 - DNA, 21 bp, Homo sapiens
atgccgaatgccctcagggga

SEQ ID NO: 980368 - DNA, 18 bp, Homo sapiens
atgccgcggtaggtaagg

SEQ ID NO: 980369 - DNA, 15 bp, Homo sapiens
atgccggatgtgctt

SEQ ID NO: 980370 - DNA, 19 bp, Homo sapiens
atgccgggcgccaggacag

SEQ ID NO: 980371 - DNA, 22 bp, Homo sapiens
atgccgggcgccaggacagcag

SEQ ID NO: 980372 - DNA, 23 bp, Homo sapiens
atgccgtataggatgtcagacaa

SEQ ID NO: 980373 - DNA, 19 bp, Homo sapiens
atgcctaaaaattcccttc

SEQ ID NO: 980374 - DNA, 18 bp, Homo sapiens
atgcctaggtcccttccc

SEQ ID NO: 980375 - DNA, 16 bp, Homo sapiens
atgcctatggtggatc

SEQ ID NO: 980376 - DNA, 19 bp, Homo sapiens
atgcctatggtggatccaa

SEQ ID NO: 980377 - DNA, 21 bp, Homo sapiens
atgcctatggtggatccaaac

SEQ ID NO: 980378 - DNA, 19 bp, Homo sapiens
atgcctatgtagtgtcttt

SEQ ID NO: 980379 - DNA, 14 bp, Homo sapiens
acaggaaggagggg

SEQ ID NO: 980380 - DNA, 16 bp, Homo sapiens
acaggaagtagttcta

SEQ ID NO: 980381 - DNA, 13 bp, Homo sapiens
acaggaatttaga

SEQ ID NO: 980382 - DNA, 18 bp, Homo sapiens
acaggaattttattttgc

SEQ ID NO: 980383 - DNA, 15 bp, Homo sapiens
acaggacacgaaggc

SEQ ID NO: 980384 - DNA, 14 bp, Homo sapiens
acaggacagcggga

SEQ ID NO: 980385 - DNA, 15 bp, Homo sapiens
acaggacatggatga

SEQ ID NO: 980386 - DNA, 14 bp, Homo sapiens
acaggaccagattt

SEQ ID NO: 980387 - DNA, 19 bp, Homo sapiens
acaggaccccagctctgcg

SEQ ID NO: 980388 - DNA, 24 bp, Homo sapiens
acaggactgagccctctcactcca

SEQ ID NO: 980389 - DNA, 13 bp, Homo sapiens
acaggagacatta

SEQ ID NO: 980390 - DNA, 14 bp, Homo sapiens
acaggagaggcagc

SEQ ID NO: 980391 - DNA, 17 bp, Homo sapiens
acaggagcaatcacagg

SEQ ID NO: 980392 - DNA, 19 bp, Homo sapiens
acaggagcaatcacaggaa

SEQ ID NO: 980393 - DNA, 17 bp, Homo sapiens
acaggagcctagcggag

SEQ ID NO: 980394 - DNA, 18 bp, Homo sapiens
acaggaggaggagatggc

SEQ ID NO: 980395 - DNA, 19 bp, Homo sapiens
acaggaggaggagatggcc

SEQ ID NO: 980396 - DNA, 14 bp, Homo sapiens
acaggagggcccgg

SEQ ID NO: 980397 - DNA, 21 bp, Homo sapiens
acaggagtcttcagacccaga

SEQ ID NO: 980398 - DNA, 22 bp, Homo sapiens
acaggagtcttcagacccagag

SEQ ID NO: 980399 - DNA, 21 bp, Homo sapiens
acaggagtgtcctcttccctc

SEQ ID NO: 980400 - DNA, 20 bp, Homo sapiens
acaggagttgtgagccctct

SEQ ID NO: 980401 - DNA, 19 bp, Homo sapiens
acaggataaagatatcaat

SEQ ID NO: 980402 - DNA, 20 bp, Homo sapiens
acaggatattaaacgtgtaa

SEQ ID NO: 980403 - DNA, 23 bp, Homo sapiens
acaggatattaaacgtgtaaatt

SEQ ID NO: 980404 - DNA, 14 bp, Homo sapiens
acaggatgctgtgt

SEQ ID NO: 980405 - DNA, 19 bp, Homo sapiens
acaggatgggggctggcct

SEQ ID NO: 980406 - DNA, 16 bp, Homo sapiens
acaggcaactgaggca

SEQ ID NO: 980407 - DNA, 22 bp, Homo sapiens
acaggcaactgaggcagacagc

SEQ ID NO: 980408 - DNA, 17 bp, Homo sapiens
acaggcacacagggccc

SEQ ID NO: 980409 - DNA, 14 bp, Homo sapiens
acaggcaccgagaa

SEQ ID NO: 980410 - DNA, 20 bp, Homo sapiens
acaggcaccgagaatgttgt

SEQ ID NO: 980411 - DNA, 21 bp, Homo sapiens
acaggcactccaaacctgtct

SEQ ID NO: 980412 - DNA, 14 bp, Homo sapiens
acaggcagcccagc

SEQ ID NO: 980413 - DNA, 16 bp, Homo sapiens
acaggcagcccagcag

SEQ ID NO: 980414 - DNA, 17 bp, Homo sapiens
acaggcagcctcctttg

SEQ ID NO: 980415 - DNA, 20 bp, Homo sapiens
acaggcagcctcctttgtgt

SEQ ID NO: 980416 - DNA, 22 bp, Homo sapiens
acaggcagcctcctttgtgtgt

SEQ ID NO: 980417 - DNA, 14 bp, Homo sapiens
acaggcagtgcatg

SEQ ID NO: 980418 - DNA, 15 bp, Homo sapiens
acaggcagtgcatgt

SEQ ID NO: 980419 - DNA, 21 bp, Homo sapiens
acaggcataaaatagagtaaa

SEQ ID NO: 980420 - DNA, 15 bp, Homo sapiens
acaggcatgtgccac

SEQ ID NO: 980421 - DNA, 16 bp, Homo sapiens
acaggcatgtgtcacc

SEQ ID NO: 980422 - DNA, 18 bp, Homo sapiens
acaggcccaagagatgaa

SEQ ID NO: 980423 - DNA, 13 bp, Homo sapiens
acaggcccagcat

SEQ ID NO: 980424 - DNA, 14 bp, Homo sapiens
atgctggagaggtt

SEQ ID NO: 980425 - DNA, 15 bp, Homo sapiens
atgctggagggaggc

SEQ ID NO: 980426 - DNA, 14 bp, Homo sapiens
atgctggccagcac

SEQ ID NO: 980427 - DNA, 15 bp, Homo sapiens
atgctggccagcacc

SEQ ID NO: 980428 - DNA, 16 bp, Homo sapiens
atgctggccagcaccc

SEQ ID NO: 980429 - DNA, 20 bp, Homo sapiens
atgctggccagcaccctctc

SEQ ID NO: 980430 - DNA, 21 bp, Homo sapiens
atgctggccagcaccctctcc

SEQ ID NO: 980431 - DNA, 22 bp, Homo sapiens
atgctggcctgactggttgtca

SEQ ID NO: 980432 - DNA, 17 bp, Homo sapiens
atgctggcctttgctct

SEQ ID NO: 980433 - DNA, 21 bp, Homo sapiens
atgctggcggcgcagagggaa

SEQ ID NO: 980434 - DNA, 16 bp, Homo sapiens
atgctggctgagctga

SEQ ID NO: 980435 - DNA, 22 bp, Homo sapiens
atgctgggcccccagcctggcc

SEQ ID NO: 980436 - DNA, 14 bp, Homo sapiens
atgctgggctgggc

SEQ ID NO: 980437 - DNA, 18 bp, Homo sapiens
atgctgggctgggccctc

SEQ ID NO: 980438 - DNA, 17 bp, Homo sapiens
atgctggggtacacagt

SEQ ID NO: 980439 - DNA, 21 bp, Homo sapiens
atgctggggtacacagtgaga

SEQ ID NO: 980440 - DNA, 21 bp, Homo sapiens
atgctggtatatggcttcaag

SEQ ID NO: 980441 - DNA, 14 bp, Homo sapiens
atgctggtggctgg

SEQ ID NO: 980442 - DNA, 17 bp, Homo sapiens
atgctggtggctggtga

SEQ ID NO: 980443 - DNA, 21 bp, Homo sapiens
atgctggtggttaaggccagg

SEQ ID NO: 980444 - DNA, 20 bp, Homo sapiens
atgctggttacctgttccat

SEQ ID NO: 980445 - DNA, 22 bp, Homo sapiens
atgctggttacctgttccattg

SEQ ID NO: 980446 - DNA, 16 bp, Homo sapiens
atgctgtacatctatt

SEQ ID NO: 980447 - DNA, 22 bp, Homo sapiens
atgctgtacatctattttggat

SEQ ID NO: 980448 - DNA, 18 bp, Homo sapiens
atgctgtacgtactgcat

SEQ ID NO: 980449 - DNA, 20 bp, Homo sapiens
atgctgtagacatctgtcct

SEQ ID NO: 980450 - DNA, 14 bp, Homo sapiens
atgctgtatctgtg

SEQ ID NO: 980451 - DNA, 19 bp, Homo sapiens
atgctgtattcttctttgg

SEQ ID NO: 980452 - DNA, 14 bp, Homo sapiens
atgctgtatttgct

SEQ ID NO: 980453 - DNA, 20 bp, Homo sapiens
atgctgtcaactatgatatg

SEQ ID NO: 980454 - DNA, 19 bp, Homo sapiens
atgctgtcactggcagagc

SEQ ID NO: 980455 - DNA, 20 bp, Homo sapiens
atgctgtcactggcagagca

SEQ ID NO: 980456 - DNA, 20 bp, Homo sapiens
atgctgtctttgtggactgt

SEQ ID NO: 980457 - DNA, 21 bp, Homo sapiens
atgctgtgacaataagtttga

SEQ ID NO: 980458 - DNA, 14 bp, Homo sapiens
atgctgtgatacct

SEQ ID NO: 980459 - DNA, 14 bp, Homo sapiens
atgctgtgcctggc

SEQ ID NO: 980460 - DNA, 18 bp, Homo sapiens
atgctgtgctatgaattt

SEQ ID NO: 980461 - DNA, 15 bp, Homo sapiens
atgctgtgctctttg

SEQ ID NO: 980462 - DNA, 15 bp, Homo sapiens
atgctgttgcctcat

SEQ ID NO: 980463 - DNA, 13 bp, Homo sapiens
atgctgttgctgc

SEQ ID NO: 980464 - DNA, 17 bp, Homo sapiens
atgctgttgtgaagcta

SEQ ID NO: 980465 - DNA, 14 bp, Homo sapiens
atgctgtttctaag

SEQ ID NO: 980466 - DNA, 11 bp, Homo sapiens
atgctgtttgt

SEQ ID NO: 980467 - DNA, 15 bp, Homo sapiens
atgcttaaaaggttg

SEQ ID NO: 980468 - DNA, 15 bp, Homo sapiens
atgcttaaaatatgt

SEQ ID NO: 980469 - DNA, 16 bp, Homo sapiens
atgcttaaaatatgta

SEQ ID NO: 980470 - DNA, 17 bp, Homo sapiens
atgcttaaaatatgtat

SEQ ID NO: 980471 - DNA, 18 bp, Homo sapiens
atgcttaaaatatgtatg

SEQ ID NO: 980472 - DNA, 21 bp, Homo sapiens
atgcttaaaatatgtatgtct

SEQ ID NO: 980473 - DNA, 23 bp, Homo sapiens
atgcttaaaatatgtatgtctaa

SEQ ID NO: 980474 - DNA, 17 bp, Homo sapiens
atgcttaaactaaataa

SEQ ID NO: 980475 - DNA, 19 bp, Homo sapiens
atgcttaaactaaataatg

SEQ ID NO: 980476 - DNA, 20 bp, Homo sapiens
atgcttaacatacccgccta

SEQ ID NO: 980477 - DNA, 23 bp, Homo sapiens
atgcttaagcatccgtgtatttg

SEQ ID NO: 980478 - DNA, 15 bp, Homo sapiens
atgcttaataaaaga

SEQ ID NO: 980479 - DNA, 18 bp, Homo sapiens
atgcttaataaaagaaca

SEQ ID NO: 980480 - DNA, 19 bp, Homo sapiens
atgcttaataaacatgtca

SEQ ID NO: 980481 - DNA, 15 bp, Homo sapiens
atgcttacaaaaaag

SEQ ID NO: 980482 - DNA, 22 bp, Homo sapiens
atgcttacaggaaaacctgcag

SEQ ID NO: 980483 - DNA, 14 bp, Homo sapiens
atgcttacttttta

SEQ ID NO: 980484 - DNA, 15 bp, Homo sapiens
atgcttagcttatct

SEQ ID NO: 980485 - DNA, 23 bp, Homo sapiens
atgcttagtccctcatgcaaatc

SEQ ID NO: 980486 - DNA, 19 bp, Homo sapiens
atgcttatcatctaaagat

SEQ ID NO: 980487 - DNA, 13 bp, Homo sapiens
atgcttatgttaa

SEQ ID NO: 980488 - DNA, 17 bp, Homo sapiens
atgcttatgttaaactc

SEQ ID NO: 980489 - DNA, 20 bp, Homo sapiens
atgcttatgttaaactctgt

SEQ ID NO: 980490 - DNA, 18 bp, Homo sapiens
atgcttcacatagcatgt

SEQ ID NO: 980491 - DNA, 15 bp, Homo sapiens
atgcttcctcccagc

SEQ ID NO: 980492 - DNA, 16 bp, Homo sapiens
atgcttcctgacaatc

SEQ ID NO: 980493 - DNA, 20 bp, Homo sapiens
atgcttcctgacaatcaact

SEQ ID NO: 980494 - DNA, 17 bp, Homo sapiens
atgcttcctttctctcc

SEQ ID NO: 980495 - DNA, 19 bp, Homo sapiens
atgcttcctttctctcctg

SEQ ID NO: 980496 - DNA, 23 bp, Homo sapiens
atgcttcctttctctcctggctc

SEQ ID NO: 980497 - DNA, 15 bp, Homo sapiens
atgcttctaagtaaa

SEQ ID NO: 980498 - DNA, 23 bp, Homo sapiens
atgcttctaagtaaatacaattt

SEQ ID NO: 980499 - DNA, 20 bp, Homo sapiens
atgcttctataattttgcct

SEQ ID NO: 980500 - DNA, 20 bp, Homo sapiens
atggcgtaatgggcctgccc

SEQ ID NO: 980501 - DNA, 17 bp, Homo sapiens
atggcgtctgctctggt

SEQ ID NO: 980502 - DNA, 20 bp, Homo sapiens
atggcgtgtccctctcggaa

SEQ ID NO: 980503 - DNA, 15 bp, Homo sapiens
atggctaataaactg

SEQ ID NO: 980504 - DNA, 18 bp, Homo sapiens
atggctaatgtactgcat

SEQ ID NO: 980505 - DNA, 13 bp, Homo sapiens
atggctataaata

SEQ ID NO: 980506 - DNA, 21 bp, Homo sapiens
atggctataaatatataaaaa

SEQ ID NO: 980507 - DNA, 22 bp, Homo sapiens
atggctatctatacctgccttt

SEQ ID NO: 980508 - DNA, 15 bp, Homo sapiens
atggctatgaacaga

SEQ ID NO: 980509 - DNA, 19 bp, Homo sapiens
atggctatgtttttaatgt

SEQ ID NO: 980510 - DNA, 16 bp, Homo sapiens
atggctcaagtagaaa

SEQ ID NO: 980511 - DNA, 21 bp, Homo sapiens
atggctcagagcttgaagatt

SEQ ID NO: 980512 - DNA, 12 bp, Homo sapiens
atggctcagagg

SEQ ID NO: 980513 - DNA, 12 bp, Homo sapiens
atggctcaggca

SEQ ID NO: 980514 - DNA, 16 bp, Homo sapiens
atggctcaggcaagcc

SEQ ID NO: 980515 - DNA, 20 bp, Homo sapiens
atggctccagtctgctgccc

SEQ ID NO: 980516 - DNA, 23 bp, Homo sapiens
atggctccagtctgctgccctcc

SEQ ID NO: 980517 - DNA, 12 bp, Homo sapiens
atggctcctctc

SEQ ID NO: 980518 - DNA, 23 bp, Homo sapiens
atggctctgcacccctctgccct

SEQ ID NO: 980519 - DNA, 13 bp, Homo sapiens
atggctgcccagg

SEQ ID NO: 980520 - DNA, 14 bp, Homo sapiens
atggctgcccagga

SEQ ID NO: 980521 - DNA, 15 bp, Homo sapiens
atggctgctagattt

SEQ ID NO: 980522 - DNA, 16 bp, Homo sapiens
atggctgtatttgctg

SEQ ID NO: 980523 - DNA, 18 bp, Homo sapiens
atggctgtctgcacagag

SEQ ID NO: 980524 - DNA, 21 bp, Homo sapiens
atggctgtctgcacagagggt

SEQ ID NO: 980525 - DNA, 16 bp, Homo sapiens
atggctgtgcctctgc

SEQ ID NO: 980526 - DNA, 20 bp, Homo sapiens
atggctgtgtttgcagcctg

SEQ ID NO: 980527 - DNA, 14 bp, Homo sapiens
atggcttaatctta

SEQ ID NO: 980528 - DNA, 14 bp, Homo sapiens
atggcttaatgttt

SEQ ID NO: 980529 - DNA, 15 bp, Homo sapiens
atggcttatttctat

SEQ ID NO: 980530 - DNA, 22 bp, Homo sapiens
atggcttatttctatgacaaat

SEQ ID NO: 980531 - DNA, 17 bp, Homo sapiens
atggcttcggagggccg

SEQ ID NO: 980532 - DNA, 21 bp, Homo sapiens
atggcttcggagggccgcagg

SEQ ID NO: 980533 - DNA, 13 bp, Homo sapiens
atggcttgacatg

SEQ ID NO: 980534 - DNA, 15 bp, Homo sapiens
atggcttgacatgtg

SEQ ID NO: 980535 - DNA, 18 bp, Homo sapiens
atggcttgacatgtgcaa

SEQ ID NO: 980536 - DNA, 18 bp, Homo sapiens
atggcttgttctctggaa

SEQ ID NO: 980537 - DNA, 18 bp, Homo sapiens
atggctttcatcctgtgt

SEQ ID NO: 980538 - DNA, 17 bp, Homo sapiens
atggcttttgtgcatta

SEQ ID NO: 980539 - DNA, 22 bp, Homo sapiens
atgggaaaaaaacaaacaaaaa

SEQ ID NO: 980540 - DNA, 18 bp, Homo sapiens
atgggaaagccacctctc

SEQ ID NO: 980541 - DNA, 23 bp, Homo sapiens
atgggaaagccacctctccctca

SEQ ID NO: 980542 - DNA, 21 bp, Homo sapiens
atgggaacaaattagaggaga

SEQ ID NO: 980543 - DNA, 23 bp, Homo sapiens
atgggaacagtaaagaaagcaga

SEQ ID NO: 980544 - DNA, 14 bp, Homo sapiens
atgggaagactcag

SEQ ID NO: 980545 - DNA, 19 bp, Homo sapiens
atgggaagatgtctcagag

SEQ ID NO: 980546 - DNA, 19 bp, Homo sapiens
atgggaagcagctcaaggg

SEQ ID NO: 980547 - DNA, 15 bp, Homo sapiens
atgggaagcaggacc

SEQ ID NO: 980548 - DNA, 22 bp, Homo sapiens
atgggaagccatattcacacct

SEQ ID NO: 980549 - DNA, 16 bp, Homo sapiens
atgggaaggaggggag

SEQ ID NO: 980550 - DNA, 17 bp, Homo sapiens
atgggaataattgcttt

SEQ ID NO: 980551 - DNA, 14 bp, Homo sapiens
atgggaatttgtca

SEQ ID NO: 980552 - DNA, 13 bp, Homo sapiens
atgggacaagcag

SEQ ID NO: 980553 - DNA, 18 bp, Homo sapiens
atgggacaagcagtccct

SEQ ID NO: 980554 - DNA, 13 bp, Homo sapiens
atgggaccaggga

SEQ ID NO: 980555 - DNA, 20 bp, Homo sapiens
atgggaccgtgccccacctc

SEQ ID NO: 980556 - DNA, 16 bp, Homo sapiens
atgggacctcctccct

SEQ ID NO: 980557 - DNA, 17 bp, Homo sapiens
atgggagccagctgctt

SEQ ID NO: 980558 - DNA, 18 bp, Homo sapiens
atgggagccaggcccaga

SEQ ID NO: 980559 - DNA, 17 bp, Homo sapiens
atgggagccgggtctgc

SEQ ID NO: 980560 - DNA, 15 bp, Homo sapiens
atgggaggagagcca

SEQ ID NO: 980561 - DNA, 20 bp, Homo sapiens
atgggaggagagccactggg

SEQ ID NO: 980562 - DNA, 18 bp, Homo sapiens
atgggaggtggggcctca

SEQ ID NO: 980563 - DNA, 16 bp, Homo sapiens
atgggagtgagacaga

SEQ ID NO: 980564 - DNA, 22 bp, Homo sapiens
acagtgatctccatatgttaca

SEQ ID NO: 980565 - DNA, 24 bp, Homo sapiens
acagtgatgctgtgctatgaattt

SEQ ID NO: 980566 - DNA, 10 bp, Homo sapiens
acagtgattt

SEQ ID NO: 980567 - DNA, 13 bp, Homo sapiens
acagtgcagacag

SEQ ID NO: 980568 - DNA, 19 bp, Homo sapiens
acagtgcagagccttctca

SEQ ID NO: 980569 - DNA, 14 bp, Homo sapiens
acagtgcagaggct

SEQ ID NO: 980570 - DNA, 19 bp, Homo sapiens
acagtgcagttgaggtctg

SEQ ID NO: 980571 - DNA, 15 bp, Homo sapiens
acagtgcatctcagc

SEQ ID NO: 980572 - DNA, 18 bp, Homo sapiens
acagtgccaactcctcac

SEQ ID NO: 980573 - DNA, 12 bp, Homo sapiens
acagtgcccacc

SEQ ID NO: 980574 - DNA, 14 bp, Homo sapiens
acagtgcccaccgc

SEQ ID NO: 980575 - DNA, 17 bp, Homo sapiens
acagtgcccaccgccct

SEQ ID NO: 980576 - DNA, 19 bp, Homo sapiens
acagtgcccaccgccctcc

SEQ ID NO: 980577 - DNA, 23 bp, Homo sapiens
acagtgcccaccgccctcctcca

SEQ ID NO: 980578 - DNA, 10 bp, Homo sapiens
acagtgcccc

SEQ ID NO: 980579 - DNA, 12 bp, Homo sapiens
acagtgcctctt

SEQ ID NO: 980580 - DNA, 13 bp, Homo sapiens
acagtgcctcttc

SEQ ID NO: 980581 - DNA, 22 bp, Homo sapiens
acagtgcctcttccagtgaaca

SEQ ID NO: 980582 - DNA, 13 bp, Homo sapiens
acagtgcctgctg

SEQ ID NO: 980583 - DNA, 14 bp, Homo sapiens
acagtgcctgctga

SEQ ID NO: 980584 - DNA, 18 bp, Homo sapiens
acagtgcctgggaatgta

SEQ ID NO: 980585 - DNA, 20 bp, Homo sapiens
acagtgcctgggaatgtatt

SEQ ID NO: 980586 - DNA, 14 bp, Homo sapiens
acagtgccttctct

SEQ ID NO: 980587 - DNA, 15 bp, Homo sapiens
acagtgctgcccctt

SEQ ID NO: 980588 - DNA, 19 bp, Homo sapiens
acagtgctgccccttgcaa

SEQ ID NO: 980589 - DNA, 20 bp, Homo sapiens
acagtgctgccccttgcaag

SEQ ID NO: 980590 - DNA, 22 bp, Homo sapiens
acagtgctgccccttgcaagcc

SEQ ID NO: 980591 - DNA, 15 bp, Homo sapiens
acagtgctgcttctc

SEQ ID NO: 980592 - DNA, 15 bp, Homo sapiens
acagtgctgttggtg

SEQ ID NO: 980593 - DNA, 20 bp, Homo sapiens
acagtgcttcagcctgaggc

SEQ ID NO: 980594 - DNA, 18 bp, Homo sapiens
acagtggacggaggtccc

SEQ ID NO: 980595 - DNA, 15 bp, Homo sapiens
acagtggatcacaaa

SEQ ID NO: 980596 - DNA, 17 bp, Homo sapiens
acagtggatcacaaagt

SEQ ID NO: 980597 - DNA, 17 bp, Homo sapiens
acagtggattgcatttc

SEQ ID NO: 980598 - DNA, 20 bp, Homo sapiens
acagtggcaaaacaaaagta

SEQ ID NO: 980599 - DNA, 19 bp, Homo sapiens
acagtggcacggagagaag

SEQ ID NO: 980600 - DNA, 22 bp, Homo sapiens
acagtggcacggagagaaggcc

SEQ ID NO: 980601 - DNA, 12 bp, Homo sapiens
acagtggcctct

SEQ ID NO: 980602 - DNA, 12 bp, Homo sapiens
acagtggctggg

SEQ ID NO: 980603 - DNA, 13 bp, Homo sapiens
acagtggctgggt

SEQ ID NO: 980604 - DNA, 18 bp, Homo sapiens
acagtggctgggtgggcc

SEQ ID NO: 980605 - DNA, 14 bp, Homo sapiens
acagtgggagccct

SEQ ID NO: 980606 - DNA, 17 bp, Homo sapiens
acagtgggagctgagct

SEQ ID NO: 980607 - DNA, 19 bp, Homo sapiens
acagtgggcgttgggagcc

SEQ ID NO: 980608 - DNA, 23 bp, Homo sapiens
acagtgggcgttgggagcctagc

SEQ ID NO: 980609 - DNA, 18 bp, Homo sapiens
acagtggggctgcaggca

SEQ ID NO: 980610 - DNA, 21 bp, Homo sapiens
acagtgggtgccccccttgcc

SEQ ID NO: 980611 - DNA, 16 bp, Homo sapiens
acagtgggtggcacct

SEQ ID NO: 980612 - DNA, 17 bp, Homo sapiens
acagtggtgggcgggga

SEQ ID NO: 980613 - DNA, 18 bp, Homo sapiens
acagtggttttatactga

SEQ ID NO: 980614 - DNA, 20 bp, Homo sapiens
acagtggttttatactgaag

SEQ ID NO: 980615 - DNA, 21 bp, Homo sapiens
acagtgtaatccaggggtgta

SEQ ID NO: 980616 - DNA, 15 bp, Homo sapiens
acagtgtacaaaact

SEQ ID NO: 980617 - DNA, 18 bp, Homo sapiens
acagtgtacagtcttgta

SEQ ID NO: 980618 - DNA, 16 bp, Homo sapiens
acagtgtagcttgccc

SEQ ID NO: 980619 - DNA, 17 bp, Homo sapiens
acagtgtcactggtcag

SEQ ID NO: 980620 - DNA, 16 bp, Homo sapiens
acagtgtctgtgccat

SEQ ID NO: 980621 - DNA, 12 bp, Homo sapiens
acagtgtctgtt

SEQ ID NO: 980622 - DNA, 21 bp, Homo sapiens
acagtgtctgttcagcaaact

SEQ ID NO: 980623 - DNA, 19 bp, Homo sapiens
acagtgtctttctagccat

SEQ ID NO: 980624 - DNA, 14 bp, Homo sapiens
acagtgtctttttt

SEQ ID NO: 980625 - DNA, 22 bp, Homo sapiens
acagtgtgtgtgggtgaaatgg

SEQ ID NO: 980626 - DNA, 14 bp, Homo sapiens
acagtgttaaatga

SEQ ID NO: 980627 - DNA, 20 bp, Homo sapiens
acagtgttattttctttgaa

SEQ ID NO: 980628 - DNA, 12 bp, Homo sapiens
acagtgttcatt

SEQ ID NO: 980629 - DNA, 16 bp, Homo sapiens
acagtgttcatttgaa

SEQ ID NO: 980630 - DNA, 19 bp, Homo sapiens
acagtgttgaaaatgttca

SEQ ID NO: 980631 - DNA, 21 bp, Homo sapiens
acagtgttgaaaatgttcaga

SEQ ID NO: 980632 - DNA, 21 bp, Homo sapiens
acagtgttgcatatgagcctg

SEQ ID NO: 980633 - DNA, 17 bp, Homo sapiens
atggttaccatgtcttt

SEQ ID NO: 980634 - DNA, 22 bp, Homo sapiens
atggttaccatgtctttctctc

SEQ ID NO: 980635 - DNA, 19 bp, Homo sapiens
atggttccttccctgggaa

SEQ ID NO: 980636 - DNA, 17 bp, Homo sapiens
atggttctcagatcttg

SEQ ID NO: 980637 - DNA, 20 bp, Homo sapiens
atggttctccaagaaactga

SEQ ID NO: 980638 - DNA, 19 bp, Homo sapiens
atggttctggctgtttgag

SEQ ID NO: 980639 - DNA, 14 bp, Homo sapiens
atggttcttcacct

SEQ ID NO: 980640 - DNA, 13 bp, Homo sapiens
atggttgccaccc

SEQ ID NO: 980641 - DNA, 16 bp, Homo sapiens
atggttggagagccct

SEQ ID NO: 980642 - DNA, 17 bp, Homo sapiens
atggttggagagccctg

SEQ ID NO: 980643 - DNA, 20 bp, Homo sapiens
atggttggagagccctggat

SEQ ID NO: 980644 - DNA, 23 bp, Homo sapiens
atggttggtaacacaaattttca

SEQ ID NO: 980645 - DNA, 19 bp, Homo sapiens
atggttgtatacacatgct

SEQ ID NO: 980646 - DNA, 21 bp, Homo sapiens
atggttgtgaaatgtaacatg

SEQ ID NO: 980647 - DNA, 15 bp, Homo sapiens
atggtttattcccaa

SEQ ID NO: 980648 - DNA, 16 bp, Homo sapiens
atggtttattcccaag

SEQ ID NO: 980649 - DNA, 22 bp, Homo sapiens
atggtttcctccatttgagaaa

SEQ ID NO: 980650 - DNA, 15 bp, Homo sapiens
atggtttctgaaaat

SEQ ID NO: 980651 - DNA, 13 bp, Homo sapiens
atggtttgaaatt

SEQ ID NO: 980652 - DNA, 12 bp, Homo sapiens
atggtttggaaa

SEQ ID NO: 980653 - DNA, 16 bp, Homo sapiens
atggttttcaaaataa

SEQ ID NO: 980654 - DNA, 14 bp, Homo sapiens
atggttttctccaa

SEQ ID NO: 980655 - DNA, 13 bp, Homo sapiens
atggttttggctc

SEQ ID NO: 980656 - DNA, 22 bp, Homo sapiens
atggttttggctctcccacccc

SEQ ID NO: 980657 - DNA, 23 bp, Homo sapiens
atggttttggctctcccaccccg

SEQ ID NO: 980658 - DNA, 20 bp, Homo sapiens
atggtttttatttctcgggt

SEQ ID NO: 980659 - DNA, 19 bp, Homo sapiens
atgtaaaaaagaaaaacac

SEQ ID NO: 980660 - DNA, 21 bp, Homo sapiens
atgtaaaaatccttttgaatg

SEQ ID NO: 980661 - DNA, 22 bp, Homo sapiens
atgtaaaaatccttttgaatga

SEQ ID NO: 980662 - DNA, 23 bp, Homo sapiens
atgtaaaacacatacaaaagaat

SEQ ID NO: 980663 - DNA, 17 bp, Homo sapiens
atgtaaaacagaaaaaa

SEQ ID NO: 980664 - DNA, 13 bp, Homo sapiens
atgtaaaacattt

SEQ ID NO: 980665 - DNA, 19 bp, Homo sapiens
atgtaaaagaacttactga

SEQ ID NO: 980666 - DNA, 23 bp, Homo sapiens
atgtaaaagaacttactgattat

SEQ ID NO: 980667 - DNA, 17 bp, Homo sapiens
atgtaaaagactttttt

SEQ ID NO: 980668 - DNA, 13 bp, Homo sapiens
atgtaaaatatgt

SEQ ID NO: 980669 - DNA, 21 bp, Homo sapiens
atgtaaacaaaccacagcagg

SEQ ID NO: 980670 - DNA, 18 bp, Homo sapiens
atgtaaacaatgtaaagt

SEQ ID NO: 980671 - DNA, 15 bp, Homo sapiens
atgtaaacagtgcct

SEQ ID NO: 980672 - DNA, 20 bp, Homo sapiens
atgtaaacagtgcctgctga

SEQ ID NO: 980673 - DNA, 13 bp, Homo sapiens
atgtaaactcggg

SEQ ID NO: 980674 - DNA, 21 bp, Homo sapiens
atgtaaactcgggggtgctgg

SEQ ID NO: 980675 - DNA, 15 bp, Homo sapiens
atgtaaactgccata

SEQ ID NO: 980676 - DNA, 15 bp, Homo sapiens
atgtaaactttgtca

SEQ ID NO: 980677 - DNA, 17 bp, Homo sapiens
atgtaaagaacttaaat

SEQ ID NO: 980678 - DNA, 21 bp, Homo sapiens
atgtaaagatatttttatctt

SEQ ID NO: 980679 - DNA, 12 bp, Homo sapiens
atgtaaagtatg

SEQ ID NO: 980680 - DNA, 18 bp, Homo sapiens
atgtaaagtatgtaaaca

SEQ ID NO: 980681 - DNA, 18 bp, Homo sapiens
atgtaaagtatgttttta

SEQ ID NO: 980682 - DNA, 20 bp, Homo sapiens
atgtaaagtatgtttttaca

SEQ ID NO: 980683 - DNA, 20 bp, Homo sapiens
atgtaaatactcatgaatga

SEQ ID NO: 980684 - DNA, 17 bp, Homo sapiens
atgtaaatagtgcagaa

SEQ ID NO: 980685 - DNA, 15 bp, Homo sapiens
atgtaaatattttaa

SEQ ID NO: 980686 - DNA, 14 bp, Homo sapiens
acatatctctgccg

SEQ ID NO: 980687 - DNA, 22 bp, Homo sapiens
acatatctctgccgtctctcct

SEQ ID NO: 980688 - DNA, 14 bp, Homo sapiens
acatatgacttgat

SEQ ID NO: 980689 - DNA, 21 bp, Homo sapiens
acatatgagaatataccttat

SEQ ID NO: 980690 - DNA, 21 bp, Homo sapiens
acatatgagtgtggaagccgg

SEQ ID NO: 980691 - DNA, 19 bp, Homo sapiens
acatatgctgatcttttaa

SEQ ID NO: 980692 - DNA, 23 bp, Homo sapiens
acatatgctgatcttttaaaatc

SEQ ID NO: 980693 - DNA, 17 bp, Homo sapiens
acatatggaattttgca

SEQ ID NO: 980694 - DNA, 15 bp, Homo sapiens
acatatggatgttac

SEQ ID NO: 980695 - DNA, 19 bp, Homo sapiens
acatatggtctccatttta

SEQ ID NO: 980696 - DNA, 13 bp, Homo sapiens
acatatgtaaaat

SEQ ID NO: 980697 - DNA, 14 bp, Homo sapiens
acatatgtaaaata

SEQ ID NO: 980698 - DNA, 18 bp, Homo sapiens
acatatgtaacagtcaaa

SEQ ID NO: 980699 - DNA, 21 bp, Homo sapiens
acatatgtaacagtcaaatat

SEQ ID NO: 980700 - DNA, 13 bp, Homo sapiens
acatatgtagata

SEQ ID NO: 980701 - DNA, 21 bp, Homo sapiens
acatatgtgctggaattctaa

SEQ ID NO: 980702 - DNA, 20 bp, Homo sapiens
acatattcaaagcagcagcc

SEQ ID NO: 980703 - DNA, 16 bp, Homo sapiens
acatattcaagtgata

SEQ ID NO: 980704 - DNA, 13 bp, Homo sapiens
acatattcctttg

SEQ ID NO: 980705 - DNA, 14 bp, Homo sapiens
acatattgatttcc

SEQ ID NO: 980706 - DNA, 18 bp, Homo sapiens
acatattgatttccgtta

SEQ ID NO: 980707 - DNA, 23 bp, Homo sapiens
acatattgttagggtcagccatt

SEQ ID NO: 980708 - DNA, 14 bp, Homo sapiens
acatatttaactgg

SEQ ID NO: 980709 - DNA, 13 bp, Homo sapiens
acatatttaatgt

SEQ ID NO: 980710 - DNA, 16 bp, Homo sapiens
acatatttaatgtttt

SEQ ID NO: 980711 - DNA, 20 bp, Homo sapiens
acatatttaatgttttaaat

SEQ ID NO: 980712 - DNA, 21 bp, Homo sapiens
acatatttaatgttttaaatg

SEQ ID NO: 980713 - DNA, 12 bp, Homo sapiens
acatatttcatt

SEQ ID NO: 980714 - DNA, 23 bp, Homo sapiens
acatatttcattttaacatgatt

SEQ ID NO: 980715 - DNA, 19 bp, Homo sapiens
acatatttgtggaataatg

SEQ ID NO: 980716 - DNA, 14 bp, Homo sapiens
acatattttaaaat

SEQ ID NO: 980717 - DNA, 15 bp, Homo sapiens
acatatttttatact

SEQ ID NO: 980718 - DNA, 14 bp, Homo sapiens
acatcaaaacttaa

SEQ ID NO: 980719 - DNA, 13 bp, Homo sapiens
acatcaaaatgag

SEQ ID NO: 980720 - DNA, 14 bp, Homo sapiens
acatcaaataaatt

SEQ ID NO: 980721 - DNA, 23 bp, Homo sapiens
acatcaaataaatttctgggata

SEQ ID NO: 980722 - DNA, 22 bp, Homo sapiens
acatcaagactatctacaaaaa

SEQ ID NO: 980723 - DNA, 11 bp, Homo sapiens
acatcaagata

SEQ ID NO: 980724 - DNA, 12 bp, Homo sapiens
acatcaagatac

SEQ ID NO: 980725 - DNA, 17 bp, Homo sapiens
acatcaagcatgcaata

SEQ ID NO: 980726 - DNA, 18 bp, Homo sapiens
acatcaagcttttctgta

SEQ ID NO: 980727 - DNA, 18 bp, Homo sapiens
acatcaagtccatctgac

SEQ ID NO: 980728 - DNA, 19 bp, Homo sapiens
acatcaagtccatctgaca

SEQ ID NO: 980729 - DNA, 20 bp, Homo sapiens
acatcaagtccatctgacaa

SEQ ID NO: 980730 - DNA, 13 bp, Homo sapiens
acatcacacacac

SEQ ID NO: 980731 - DNA, 17 bp, Homo sapiens
acatcacacagtatact

SEQ ID NO: 980732 - DNA, 14 bp, Homo sapiens
acatcacagcccag

SEQ ID NO: 980733 - DNA, 13 bp, Homo sapiens
acatcaccagtcc

SEQ ID NO: 980734 - DNA, 21 bp, Homo sapiens
acatcaccgacgcgtctcctg

SEQ ID NO: 980735 - DNA, 16 bp, Homo sapiens
acatcactctgctgct

SEQ ID NO: 980736 - DNA, 15 bp, Homo sapiens
acatcacttgtacaa

SEQ ID NO: 980737 - DNA, 13 bp, Homo sapiens
acatcactttgtg

SEQ ID NO: 980738 - DNA, 21 bp, Homo sapiens
acatcactttgtgaattaaca

SEQ ID NO: 980739 - DNA, 13 bp, Homo sapiens
acatcagaaagga

SEQ ID NO: 980740 - DNA, 15 bp, Homo sapiens
acatcagaaaggaat

SEQ ID NO: 980741 - DNA, 19 bp, Homo sapiens
acatcagacctgtcttcca

SEQ ID NO: 980742 - DNA, 20 bp, Homo sapiens
acatcagacctgtcttccaa

SEQ ID NO: 980743 - DNA, 15 bp, Homo sapiens
acatcagattgttaa

SEQ ID NO: 980744 - DNA, 16 bp, Homo sapiens
acatcagattgttaag

SEQ ID NO: 980745 - DNA, 17 bp, Homo sapiens
acatcagcacgatttct

SEQ ID NO: 980746 - DNA, 15 bp, Homo sapiens
acatcagttactctg

SEQ ID NO: 980747 - DNA, 11 bp, Homo sapiens
acatcagttcc

SEQ ID NO: 980748 - DNA, 13 bp, Homo sapiens
acatcataaatct

SEQ ID NO: 980749 - DNA, 19 bp, Homo sapiens
acatcataattacattcct

SEQ ID NO: 980750 - DNA, 20 bp, Homo sapiens
acatcataattacattccta

SEQ ID NO: 980751 - DNA, 21 bp, Homo sapiens
acatcataattacattcctaa

SEQ ID NO: 980752 - DNA, 18 bp, Homo sapiens
acatcatataaaaagcag

SEQ ID NO: 980753 - DNA, 23 bp, Homo sapiens
acatcatataaaaagcagcagag

SEQ ID NO: 980754 - DNA, 20 bp, Homo sapiens
acatcatattctattgttta

SEQ ID NO: 980755 - DNA, 22 bp, Homo sapiens
acatcatggactgagctggggg

SEQ ID NO: 980756 - DNA, 16 bp, Homo sapiens
acatcatgttatttta

SEQ ID NO: 980757 - DNA, 19 bp, Homo sapiens
acatcattacagattctgc

SEQ ID NO: 980758 - DNA, 14 bp, Homo sapiens
acatcattctgtgt

SEQ ID NO: 980759 - DNA, 21 bp, Homo sapiens
acatccaaaatagttaagaca

SEQ ID NO: 980760 - DNA, 19 bp, Homo sapiens
acatccaaagcagacagct

SEQ ID NO: 980761 - DNA, 13 bp, Homo sapiens
acatccaaatcta

SEQ ID NO: 980762 - DNA, 16 bp, Homo sapiens
acatccaactccagca

SEQ ID NO: 980763 - DNA, 18 bp, Homo sapiens
acatccaactccagcaac

SEQ ID NO: 980764 - DNA, 14 bp, Homo sapiens
acatccaactggaa

SEQ ID NO: 980765 - DNA, 23 bp, Homo sapiens
acatccaaggagaaacagagaca

SEQ ID NO: 980766 - DNA, 19 bp, Homo sapiens
acatccacttaagttcttt

SEQ ID NO: 980767 - DNA, 16 bp, Homo sapiens
atgtattcccttgtat

SEQ ID NO: 980768 - DNA, 21 bp, Homo sapiens
atgtattcccttgtattttgt

SEQ ID NO: 980769 - DNA, 12 bp, Homo sapiens
atgtattgattc

SEQ ID NO: 980770 - DNA, 16 bp, Homo sapiens
atgtattgcacattgt

SEQ ID NO: 980771 - DNA, 17 bp, Homo sapiens
atgtattgcacattgta

SEQ ID NO: 980772 - DNA, 13 bp, Homo sapiens
atgtattggcctg

SEQ ID NO: 980773 - DNA, 11 bp, Homo sapiens
atgtattgtaa

SEQ ID NO: 980774 - DNA, 17 bp, Homo sapiens
atgtattgtaatctttc

SEQ ID NO: 980775 - DNA, 19 bp, Homo sapiens
atgtattgtaatctttcat

SEQ ID NO: 980776 - DNA, 16 bp, Homo sapiens
atgtatttaactcaga

SEQ ID NO: 980777 - DNA, 21 bp, Homo sapiens
atgtatttgaaaattacatgt

SEQ ID NO: 980778 - DNA, 23 bp, Homo sapiens
atgtatttgaaaattacatgttt

SEQ ID NO: 980779 - DNA, 15 bp, Homo sapiens
atgtatttgctgaca

SEQ ID NO: 980780 - DNA, 16 bp, Homo sapiens
atgtattttaaaataa

SEQ ID NO: 980781 - DNA, 13 bp, Homo sapiens
atgtattttatga

SEQ ID NO: 980782 - DNA, 13 bp, Homo sapiens
atgtattttcata

SEQ ID NO: 980783 - DNA, 13 bp, Homo sapiens
atgtattttgaaa

SEQ ID NO: 980784 - DNA, 16 bp, Homo sapiens
atgtattttgacactg

SEQ ID NO: 980785 - DNA, 18 bp, Homo sapiens
atgtatttttcttgctgt

SEQ ID NO: 980786 - DNA, 22 bp, Homo sapiens
atgtatttttcttgctgttcag

SEQ ID NO: 980787 - DNA, 16 bp, Homo sapiens
atgtcaaaaagggctt

SEQ ID NO: 980788 - DNA, 20 bp, Homo sapiens
atgtcaaatggagctgaatt

SEQ ID NO: 980789 - DNA, 13 bp, Homo sapiens
atgtcaacagtat

SEQ ID NO: 980790 - DNA, 14 bp, Homo sapiens
atgtcaacttctgg

SEQ ID NO: 980791 - DNA, 17 bp, Homo sapiens
atgtcaacttctggctc

SEQ ID NO: 980792 - DNA, 19 bp, Homo sapiens
atgtcaacttctggctcct

SEQ ID NO: 980793 - DNA, 19 bp, Homo sapiens
atgtcaataaacaacagct

SEQ ID NO: 980794 - DNA, 23 bp, Homo sapiens
atgtcaataaacaacagctgaag

SEQ ID NO: 980795 - DNA, 20 bp, Homo sapiens
atgtcaatttgtatatcatg

SEQ ID NO: 980796 - DNA, 14 bp, Homo sapiens
atgtcacaacctct

SEQ ID NO: 980797 - DNA, 22 bp, Homo sapiens
atgtcacaacctctctgatctt

SEQ ID NO: 980798 - DNA, 12 bp, Homo sapiens
atgtcacagggc

SEQ ID NO: 980799 - DNA, 13 bp, Homo sapiens
atgtcacagggcc

SEQ ID NO: 980800 - DNA, 19 bp, Homo sapiens
atgtcacagtccaaccaga

SEQ ID NO: 980801 - DNA, 23 bp, Homo sapiens
atgtcacagtccaaccagaaaca

SEQ ID NO: 980802 - DNA, 13 bp, Homo sapiens
atgtcaccacctt

SEQ ID NO: 980803 - DNA, 16 bp, Homo sapiens
atgtcaccaccttccc

SEQ ID NO: 980804 - DNA, 20 bp, Homo sapiens
atgtcaccgtggaccttcct

SEQ ID NO: 980805 - DNA, 21 bp, Homo sapiens
atgtcaccgtggaccttcctg

SEQ ID NO: 980806 - DNA, 23 bp, Homo sapiens
atgtcaccgtggaccttcctgcc

SEQ ID NO: 980807 - DNA, 16 bp, Homo sapiens
atgtcacctacatatg

SEQ ID NO: 980808 - DNA, 13 bp, Homo sapiens
atgtcttccctgg

SEQ ID NO: 980809 - DNA, 14 bp, Homo sapiens
atgtcttctgcctg

SEQ ID NO: 980810 - DNA, 17 bp, Homo sapiens
atgtcttctgcctgtta

SEQ ID NO: 980811 - DNA, 19 bp, Homo sapiens
atgtcttctgcctgttata

SEQ ID NO: 980812 - DNA, 12 bp, Homo sapiens
atgtcttctgct

SEQ ID NO: 980813 - DNA, 20 bp, Homo sapiens
atgtcttctgctgttcttca

SEQ ID NO: 980814 - DNA, 21 bp, Homo sapiens
atgtcttctgctgttcttcac

SEQ ID NO: 980815 - DNA, 16 bp, Homo sapiens
atgtcttctggtgtca

SEQ ID NO: 980816 - DNA, 10 bp, Homo sapiens
atgtcttgtg

SEQ ID NO: 980817 - DNA, 14 bp, Homo sapiens
atgtcttgtgcata

SEQ ID NO: 980818 - DNA, 11 bp, Homo sapiens
atgtcttgtgt

SEQ ID NO: 980819 - DNA, 18 bp, Homo sapiens
atgtctttccaaattatt

SEQ ID NO: 980820 - DNA, 13 bp, Homo sapiens
atgtgaaaaatct

SEQ ID NO: 980821 - DNA, 14 bp, Homo sapiens
atgtgaaaaatctg

SEQ ID NO: 980822 - DNA, 19 bp, Homo sapiens
atgtgaaaaatctgctgtt

SEQ ID NO: 980823 - DNA, 15 bp, Homo sapiens
atgtgaaaaattaac

SEQ ID NO: 980824 - DNA, 22 bp, Homo sapiens
atgtgaaaatggtccaggagaa

SEQ ID NO: 980825 - DNA, 17 bp, Homo sapiens
atgtgaaacacatgcca

SEQ ID NO: 980826 - DNA, 17 bp, Homo sapiens
atgtgaaacatcttctc

SEQ ID NO: 980827 - DNA, 18 bp, Homo sapiens
atgtgaaaggatatgaat

SEQ ID NO: 980828 - DNA, 17 bp, Homo sapiens
atgtgaaatgtaactgt

SEQ ID NO: 980829 - DNA, 18 bp, Homo sapiens
atgtgaaatttaaataat

SEQ ID NO: 980830 - DNA, 16 bp, Homo sapiens
atgtgaacagcataag

SEQ ID NO: 980831 - DNA, 17 bp, Homo sapiens
atgtgaacgtccttcct

SEQ ID NO: 980832 - DNA, 15 bp, Homo sapiens
atgtgaagacatttt

SEQ ID NO: 980833 - DNA, 21 bp, Homo sapiens
atgtgaagacattttttgcta

SEQ ID NO: 980834 - DNA, 22 bp, Homo sapiens
atgtgaagcatgctttgctgct

SEQ ID NO: 980835 - DNA, 21 bp, Homo sapiens
atgtgaagccaattcagacag

SEQ ID NO: 980836 - DNA, 22 bp, Homo sapiens
atgtgaagccaattcagacagg

SEQ ID NO: 980837 - DNA, 14 bp, Homo sapiens
atgtgaagctattt

SEQ ID NO: 980838 - DNA, 23 bp, Homo sapiens
atgtgaagctatttgatatgcac

SEQ ID NO: 980839 - DNA, 14 bp, Homo sapiens
atgtgaaggcccaa

SEQ ID NO: 980840 - DNA, 20 bp, Homo sapiens
atgtgaatcgcagctgtggg

SEQ ID NO: 980841 - DNA, 10 bp, Homo sapiens
atgtgaattt

SEQ ID NO: 980842 - DNA, 18 bp, Homo sapiens
atgtgaatttcaactttt

SEQ ID NO: 980843 - DNA, 14 bp, Homo sapiens
atgtgaatttttaa

SEQ ID NO: 980844 - DNA, 15 bp, Homo sapiens
atgtgaatttttaag

SEQ ID NO: 980845 - DNA, 17 bp, Homo sapiens
atgtgaatttttaagct

SEQ ID NO: 980846 - DNA, 15 bp, Homo sapiens
atgtgaatttttgcc

SEQ ID NO: 980847 - DNA, 21 bp, Homo sapiens
atgtgacaattttgtacaaat

SEQ ID NO: 980848 - DNA, 13 bp, Homo sapiens
atgtgacatttat

SEQ ID NO: 980849 - DNA, 18 bp, Homo sapiens
atgtgaccacatacgtgt

SEQ ID NO: 980850 - DNA, 19 bp, Homo sapiens
atgtgaccactctgtcttg

SEQ ID NO: 980851 - DNA, 14 bp, Homo sapiens
atgtgaccattctg

SEQ ID NO: 980852 - DNA, 16 bp, Homo sapiens
atgtgaccattctgcc

SEQ ID NO: 980853 - DNA, 17 bp, Homo sapiens
atgtgaccattctgcct

SEQ ID NO: 980854 - DNA, 20 bp, Homo sapiens
atgtgacccagatcctcaca

SEQ ID NO: 980855 - DNA, 20 bp, Homo sapiens
atgtgactagcgcctggcct

SEQ ID NO: 980856 - DNA, 14 bp, Homo sapiens
atgtgactcctgaa

SEQ ID NO: 980857 - DNA, 16 bp, Homo sapiens
atgtgactttttttgg

SEQ ID NO: 980858 - DNA, 18 bp, Homo sapiens
atgtgactttttttggta

SEQ ID NO: 980859 - DNA, 15 bp, Homo sapiens
atgtgagaaatgtct

SEQ ID NO: 980860 - DNA, 16 bp, Homo sapiens
atgtgagaggtttgac

SEQ ID NO: 980861 - DNA, 16 bp, Homo sapiens
atgtgagcacatgcgt

SEQ ID NO: 980862 - DNA, 19 bp, Homo sapiens
atgtgagcacatgcgtata

SEQ ID NO: 980863 - DNA, 21 bp, Homo sapiens
atgtgaggaagaactacagct

SEQ ID NO: 980864 - DNA, 15 bp, Homo sapiens
atgtgaggaggaaaa

SEQ ID NO: 980865 - DNA, 20 bp, Homo sapiens
atgtgagtcctgttgaagac

SEQ ID NO: 980866 - DNA, 23 bp, Homo sapiens
atgtgagtttggtctggactgac

SEQ ID NO: 980867 - DNA, 20 bp, Homo sapiens
atgtgataaggatcagaaca

SEQ ID NO: 980868 - DNA, 16 bp, Homo sapiens
atgtgatatataagtg

SEQ ID NO: 980869 - DNA, 17 bp, Homo sapiens
atgtgatatataagtgt

SEQ ID NO: 980870 - DNA, 22 bp, Homo sapiens
atgtgatattctgttgctttac

SEQ ID NO: 980871 - DNA, 17 bp, Homo sapiens
atgtgatcaactgttca

SEQ ID NO: 980872 - DNA, 18 bp, Homo sapiens
atgtgatcacgcctggct

SEQ ID NO: 980873 - DNA, 14 bp, Homo sapiens
atgtgatcatatga

SEQ ID NO: 980874 - DNA, 19 bp, Homo sapiens
atgtgatcatgtgtggaag

SEQ ID NO: 980875 - DNA, 22 bp, Homo sapiens
atgtgatctgggcattttcctc

SEQ ID NO: 980876 - DNA, 17 bp, Homo sapiens
atgtgatgccaaagatg

SEQ ID NO: 980877 - DNA, 18 bp, Homo sapiens
atgtgatgccaaagatgt

SEQ ID NO: 980878 - DNA, 22 bp, Homo sapiens
atgtgatggactggggagcaca

SEQ ID NO: 980879 - DNA, 16 bp, Homo sapiens
atgtgatggatggcac

SEQ ID NO: 980880 - DNA, 21 bp, Homo sapiens
atgtgatggatggcacaatga

SEQ ID NO: 980881 - DNA, 23 bp, Homo sapiens
atgtgatggatggcacaatgaat

SEQ ID NO: 980882 - DNA, 14 bp, Homo sapiens
atgtgatgtcatga

SEQ ID NO: 980883 - DNA, 11 bp, Homo sapiens
atgtgattaat

SEQ ID NO: 980884 - DNA, 21 bp, Homo sapiens
atgtgattaatgttttcatta

SEQ ID NO: 980885 - DNA, 15 bp, Homo sapiens
atgtgattccttttg

SEQ ID NO: 980886 - DNA, 22 bp, Homo sapiens
atgtgattgtggaatggagatt

SEQ ID NO: 980887 - DNA, 15 bp, Homo sapiens
atgtgcaacctgtgg

SEQ ID NO: 980888 - DNA, 18 bp, Homo sapiens
atgtgcaacctgtggctc

SEQ ID NO: 980889 - DNA, 22 bp, Homo sapiens
atgtgcaacctgtggctcaggg

SEQ ID NO: 980890 - DNA, 19 bp, Homo sapiens
atgtgcaaggattgtacac

SEQ ID NO: 980891 - DNA, 18 bp, Homo sapiens
atgtgcaataatttgtac

SEQ ID NO: 980892 - DNA, 18 bp, Homo sapiens
atgtgcaatagaaggtga

SEQ ID NO: 980893 - DNA, 18 bp, Homo sapiens
atgtgcagcgacccttgg

SEQ ID NO: 980894 - DNA, 20 bp, Homo sapiens
atgtgcagcgacccttggtg

SEQ ID NO: 980895 - DNA, 12 bp, Homo sapiens
atgtgcagggat

SEQ ID NO: 980896 - DNA, 15 bp, Homo sapiens
atgtgcagggatatt

SEQ ID NO: 980897 - DNA, 20 bp, Homo sapiens
atgtgcagggatattgcctt

SEQ ID NO: 980898 - DNA, 20 bp, Homo sapiens
acatgaggactctattcttt

SEQ ID NO: 980899 - DNA, 19 bp, Homo sapiens
acatgaggccatctcagga

SEQ ID NO: 980900 - DNA, 22 bp, Homo sapiens
acatgaggccatctcaggagat

SEQ ID NO: 980901 - DNA, 17 bp, Homo sapiens
acatgaggggacatttt

SEQ ID NO: 980902 - DNA, 16 bp, Homo sapiens
acatgagtctgtagga

SEQ ID NO: 980903 - DNA, 15 bp, Homo sapiens
acatgatgttaactt

SEQ ID NO: 980904 - DNA, 18 bp, Homo sapiens
acatgcaagatacaggaa

SEQ ID NO: 980905 - DNA, 18 bp, Homo sapiens
acatgcaaggtcattttt

SEQ ID NO: 980906 - DNA, 14 bp, Homo sapiens
acatgcacatttat

SEQ ID NO: 980907 - DNA, 17 bp, Homo sapiens
acatgcactatgaggaa

SEQ ID NO: 980908 - DNA, 17 bp, Homo sapiens
acatgcactcagctctt

SEQ ID NO: 980909 - DNA, 18 bp, Homo sapiens
acatgcactcagctcttg

SEQ ID NO: 980910 - DNA, 18 bp, Homo sapiens
acatgcacttttgggcct

SEQ ID NO: 980911 - DNA, 22 bp, Homo sapiens
acatgcagcccatgcccacctg

SEQ ID NO: 980912 - DNA, 21 bp, Homo sapiens
acatgcagctcttcaacatga

SEQ ID NO: 980913 - DNA, 23 bp, Homo sapiens
acatgcagctgcaccctccctcc

SEQ ID NO: 980914 - DNA, 16 bp, Homo sapiens
acatgcatactttatt

SEQ ID NO: 980915 - DNA, 13 bp, Homo sapiens
acatgcatataat

SEQ ID NO: 980916 - DNA, 16 bp, Homo sapiens
acatgcatataatgaa

SEQ ID NO: 980917 - DNA, 23 bp, Homo sapiens
acatgcatataatgaataaatca

SEQ ID NO: 980918 - DNA, 23 bp, Homo sapiens
acatgccccctcccttcacaggg

SEQ ID NO: 980919 - DNA, 19 bp, Homo sapiens
acatgccctcccttctccc

SEQ ID NO: 980920 - DNA, 22 bp, Homo sapiens
acatgccctcccttctccctgg

SEQ ID NO: 980921 - DNA, 14 bp, Homo sapiens
acatgccctcctgg

SEQ ID NO: 980922 - DNA, 16 bp, Homo sapiens
acatgccctgtgtggc

SEQ ID NO: 980923 - DNA, 21 bp, Homo sapiens
acatgcctgccccaaacaaat

SEQ ID NO: 980924 - DNA, 22 bp, Homo sapiens
acatgcctgccccaaacaaata

SEQ ID NO: 980925 - DNA, 14 bp, Homo sapiens
acatgcctgcgcct

SEQ ID NO: 980926 - DNA, 16 bp, Homo sapiens
acatgcgggctcgccc

SEQ ID NO: 980927 - DNA, 20 bp, Homo sapiens
acatgcggtagccagcacac

SEQ ID NO: 980928 - DNA, 16 bp, Homo sapiens
acatgctaaagccagg

SEQ ID NO: 980929 - DNA, 20 bp, Homo sapiens
acatgctaacctctctgaac

SEQ ID NO: 980930 - DNA, 22 bp, Homo sapiens
acatttagaaaagtgaattgaa

SEQ ID NO: 980931 - DNA, 14 bp, Homo sapiens
acatttagaacttt

SEQ ID NO: 980932 - DNA, 15 bp, Homo sapiens
acatttagaagaaag

SEQ ID NO: 980933 - DNA, 21 bp, Homo sapiens
acatttagagaactgtggccg

SEQ ID NO: 980934 - DNA, 13 bp, Homo sapiens
acatttagagtat

SEQ ID NO: 980935 - DNA, 14 bp, Homo sapiens
acatttagagtatt

SEQ ID NO: 980936 - DNA, 16 bp, Homo sapiens
acatttagagtattta

SEQ ID NO: 980937 - DNA, 13 bp, Homo sapiens
acatttagatcct

SEQ ID NO: 980938 - DNA, 23 bp, Homo sapiens
acatttagatcctggtttcataa

SEQ ID NO: 980939 - DNA, 19 bp, Homo sapiens
acatttagccaaagttgag

SEQ ID NO: 980940 - DNA, 15 bp, Homo sapiens
acatttataatgttt

SEQ ID NO: 980941 - DNA, 13 bp, Homo sapiens
acatttatacatc

SEQ ID NO: 980942 - DNA, 17 bp, Homo sapiens
acatttatatatatatg

SEQ ID NO: 980943 - DNA, 16 bp, Homo sapiens
acatttatatttgtgt

SEQ ID NO: 980944 - DNA, 12 bp, Homo sapiens
acatttatgacc

SEQ ID NO: 980945 - DNA, 18 bp, Homo sapiens
acatttattgagatctaa

SEQ ID NO: 980946 - DNA, 21 bp, Homo sapiens
acatttatttattactgtccc

SEQ ID NO: 980947 - DNA, 14 bp, Homo sapiens
acatttcaaaatta

SEQ ID NO: 980948 - DNA, 16 bp, Homo sapiens
acatttcaaaattaat

SEQ ID NO: 980949 - DNA, 17 bp, Homo sapiens
acatttcaaaattaata

SEQ ID NO: 980950 - DNA, 12 bp, Homo sapiens
acatttcagaaa

SEQ ID NO: 980951 - DNA, 18 bp, Homo sapiens
acatttcatacaacagaa

SEQ ID NO: 980952 - DNA, 21 bp, Homo sapiens
acatttcatagcctacatttt

SEQ ID NO: 980953 - DNA, 23 bp, Homo sapiens
acatttcatagtttcaaatctgt

SEQ ID NO: 980954 - DNA, 15 bp, Homo sapiens
acatttcatctgggt

SEQ ID NO: 980955 - DNA, 15 bp, Homo sapiens
acatttcattgtaca

SEQ ID NO: 980956 - DNA, 19 bp, Homo sapiens
acatttccatttattgttt

SEQ ID NO: 980957 - DNA, 15 bp, Homo sapiens
acatttcctttgaac

SEQ ID NO: 980958 - DNA, 16 bp, Homo sapiens
acatttcgttttttac

SEQ ID NO: 980959 - DNA, 17 bp, Homo sapiens
acatttctaacatatgt

SEQ ID NO: 980960 - DNA, 21 bp, Homo sapiens
acatttctaacatatgtatta

SEQ ID NO: 980961 - DNA, 15 bp, Homo sapiens
acatttctctgagca

SEQ ID NO: 980962 - DNA, 13 bp, Homo sapiens
acatttctgaatt

SEQ ID NO: 980963 - DNA, 14 bp, Homo sapiens
acatttctgacacc

SEQ ID NO: 980964 - DNA, 14 bp, Homo sapiens
acatttctggattg

SEQ ID NO: 980965 - DNA, 12 bp, Homo sapiens
acatttctgtat

SEQ ID NO: 980966 - DNA, 14 bp, Homo sapiens
acatttctgttctc

SEQ ID NO: 980967 - DNA, 15 bp, Homo sapiens
acatttctgttctca

SEQ ID NO: 980968 - DNA, 15 bp, Homo sapiens
acatttcttaaatta

SEQ ID NO: 980969 - DNA, 17 bp, Homo sapiens
acatttcttaaattatt

SEQ ID NO: 980970 - DNA, 21 bp, Homo sapiens
acatttcttaaattattttat

SEQ ID NO: 980971 - DNA, 22 bp, Homo sapiens
acatttcttaaattattttata

SEQ ID NO: 980972 - DNA, 21 bp, Homo sapiens
acatttctttcttgctggctc

SEQ ID NO: 980973 - DNA, 13 bp, Homo sapiens
acatttgaattct

SEQ ID NO: 980974 - DNA, 13 bp, Homo sapiens
acatttgatattt

SEQ ID NO: 980975 - DNA, 22 bp, Homo sapiens
acatttgatgcatgtcttttaa

SEQ ID NO: 980976 - DNA, 16 bp, Homo sapiens
acatttgatgtacatg

SEQ ID NO: 980977 - DNA, 17 bp, Homo sapiens
acatttgatgtacatgt

SEQ ID NO: 980978 - DNA, 19 bp, Homo sapiens
acatttgatgtacatgtgt

SEQ ID NO: 980979 - DNA, 15 bp, Homo sapiens
acatttgccaagtga

SEQ ID NO: 980980 - DNA, 19 bp, Homo sapiens
acatttgcccaattccagg

SEQ ID NO: 980981 - DNA, 20 bp, Homo sapiens
acatttgccttgcagaactg

SEQ ID NO: 980982 - DNA, 15 bp, Homo sapiens
acatttgccttgctg

SEQ ID NO: 980983 - DNA, 19 bp, Homo sapiens
acatttgctgaactcagca

SEQ ID NO: 980984 - DNA, 15 bp, Homo sapiens
acatttggaatactt

SEQ ID NO: 980985 - DNA, 16 bp, Homo sapiens
acatttggaatacttt

SEQ ID NO: 980986 - DNA, 15 bp, Homo sapiens
acatttggagtgttc

SEQ ID NO: 980987 - DNA, 17 bp, Homo sapiens
acatttgggagacatgt

SEQ ID NO: 980988 - DNA, 20 bp, Homo sapiens
acatttgggagtttttatga

SEQ ID NO: 980989 - DNA, 21 bp, Homo sapiens
acatttgggttggttccaagt

SEQ ID NO: 980990 - DNA, 23 bp, Homo sapiens
acatttgtaagtgtaaaaaatgt

SEQ ID NO: 980991 - DNA, 15 bp, Homo sapiens
acatttgtcacagaa

SEQ ID NO: 980992 - DNA, 20 bp, Homo sapiens
acatttgtgtaatatgaaat

SEQ ID NO: 980993 - DNA, 14 bp, Homo sapiens
acatttgttcctgg

SEQ ID NO: 980994 - DNA, 15 bp, Homo sapiens
acatttgttcctgga

SEQ ID NO: 980995 - DNA, 23 bp, Homo sapiens
acattttaaaatgtttaaattct

SEQ ID NO: 980996 - DNA, 13 bp, Homo sapiens
acattttaagtgc

SEQ ID NO: 980997 - DNA, 13 bp, Homo sapiens
acattttaattca

SEQ ID NO: 980998 - DNA, 14 bp, Homo sapiens
acattttacattaa

SEQ ID NO: 980999 - DNA, 18 bp, Homo sapiens
acattttagtttctaaag

SEQ ID NO: 981000 - DNA, 10 bp, Homo sapiens
acattttata

SEQ ID NO: 981001 - DNA, 20 bp, Homo sapiens
acattttatatttttgtaca

SEQ ID NO: 981002 - DNA, 19 bp, Homo sapiens
acattttatcattaaaaat

SEQ ID NO: 981003 - DNA, 22 bp, Homo sapiens
acattttatcattaaaaattac

SEQ ID NO: 981004 - DNA, 23 bp, Homo sapiens
acattttcaaggactattttaga

SEQ ID NO: 981005 - DNA, 21 bp, Homo sapiens
acattttccacggaaacagaa

SEQ ID NO: 981006 - DNA, 19 bp, Homo sapiens
acattttccttttcaaata

SEQ ID NO: 981007 - DNA, 23 bp, Homo sapiens
acattttcgtcctgtagcacgct

SEQ ID NO: 981008 - DNA, 16 bp, Homo sapiens
acattttctaaataaa

SEQ ID NO: 981009 - DNA, 19 bp, Homo sapiens
acattttctaaataaaaat

SEQ ID NO: 981010 - DNA, 12 bp, Homo sapiens
acattttcttaa

SEQ ID NO: 981011 - DNA, 13 bp, Homo sapiens
acattttcttaat

SEQ ID NO: 981012 - DNA, 20 bp, Homo sapiens
acattttcttttattatcag

SEQ ID NO: 981013 - DNA, 22 bp, Homo sapiens
acattttcttttattatcagtt

SEQ ID NO: 981014 - DNA, 13 bp, Homo sapiens
acattttgaaagt

SEQ ID NO: 981015 - DNA, 21 bp, Homo sapiens
acattttgaaagtctgtcctt

SEQ ID NO: 981016 - DNA, 13 bp, Homo sapiens
acattttgaagtg

SEQ ID NO: 981017 - DNA, 16 bp, Homo sapiens
acattttgcctgattg

SEQ ID NO: 981018 - DNA, 13 bp, Homo sapiens
acattttgccttt

SEQ ID NO: 981019 - DNA, 21 bp, Homo sapiens
acatttttaagtgctgcattt

SEQ ID NO: 981020 - DNA, 22 bp, Homo sapiens
acatttttaagtgctgcattta

SEQ ID NO: 981021 - DNA, 13 bp, Homo sapiens
acatttttcttag

SEQ ID NO: 981022 - DNA, 16 bp, Homo sapiens
acatttttgaggaagt

SEQ ID NO: 981023 - DNA, 18 bp, Homo sapiens
acatttttggggggagag

SEQ ID NO: 981024 - DNA, 16 bp, Homo sapiens
acatttttgtgccatt

SEQ ID NO: 981025 - DNA, 16 bp, Homo sapiens
acattttttaactttc

SEQ ID NO: 981026 - DNA, 23 bp, Homo sapiens
acatttttttctgatttgtcctg

SEQ ID NO: 981027 - DNA, 17 bp, Homo sapiens
acattttttttcaagtg

SEQ ID NO: 981028 - DNA, 18 bp, Homo sapiens
accaaaaaaaaaaaagga

SEQ ID NO: 981029 - DNA, 17 bp, Homo sapiens
accaaaaattgccaagt

SEQ ID NO: 981030 - DNA, 12 bp, Homo sapiens
accaaaacatcc

SEQ ID NO: 981031 - DNA, 22 bp, Homo sapiens
accaaaacatccacttaagttc

SEQ ID NO: 981032 - DNA, 15 bp, Homo sapiens
accaaaacttccaag

SEQ ID NO: 981033 - DNA, 21 bp, Homo sapiens
accaaaagaagtaaaagcaaa

SEQ ID NO: 981034 - DNA, 23 bp, Homo sapiens
atgttctgtcttcccaaacccag

SEQ ID NO: 981035 - DNA, 16 bp, Homo sapiens
atgttctgtgactgaa

SEQ ID NO: 981036 - DNA, 12 bp, Homo sapiens
atgttcttgggt

SEQ ID NO: 981037 - DNA, 22 bp, Homo sapiens
atgttcttgggtggttcctaag

SEQ ID NO: 981038 - DNA, 17 bp, Homo sapiens
atgttcttgtcataaaa

SEQ ID NO: 981039 - DNA, 16 bp, Homo sapiens
atgttctttggaaagt

SEQ ID NO: 981040 - DNA, 19 bp, Homo sapiens
atgttctttggaaagtaca

SEQ ID NO: 981041 - DNA, 19 bp, Homo sapiens
atgttgaaaagtcaaactg

SEQ ID NO: 981042 - DNA, 12 bp, Homo sapiens
atgttgaacttt

SEQ ID NO: 981043 - DNA, 14 bp, Homo sapiens
atgttgaatgtatt

SEQ ID NO: 981044 - DNA, 11 bp, Homo sapiens
atgttgagaag

SEQ ID NO: 981045 - DNA, 21 bp, Homo sapiens
atgttgaggggaggaggccag

SEQ ID NO: 981046 - DNA, 21 bp, Homo sapiens
atgttgagtgttcattttagt

SEQ ID NO: 981047 - DNA, 15 bp, Homo sapiens
atgttgataatttca

SEQ ID NO: 981048 - DNA, 17 bp, Homo sapiens
atgttgataatttcagg

SEQ ID NO: 981049 - DNA, 17 bp, Homo sapiens
atgttgctataataaag

SEQ ID NO: 981050 - DNA, 22 bp, Homo sapiens
atgttgctatgtgccttatgtt

SEQ ID NO: 981051 - DNA, 12 bp, Homo sapiens
atgttgctattg

SEQ ID NO: 981052 - DNA, 12 bp, Homo sapiens
accacagacaca

SEQ ID NO: 981053 - DNA, 22 bp, Homo sapiens
accacagacacaatatgtatgc

SEQ ID NO: 981054 - DNA, 14 bp, Homo sapiens
accacagacacaca

SEQ ID NO: 981055 - DNA, 16 bp, Homo sapiens
accacagacacacaca

SEQ ID NO: 981056 - DNA, 20 bp, Homo sapiens
accacagacacacacacgca

SEQ ID NO: 981057 - DNA, 22 bp, Homo sapiens
accacagacatactaaccagca

SEQ ID NO: 981058 - DNA, 23 bp, Homo sapiens
accacagatgtgtctgggagagc

SEQ ID NO: 981059 - DNA, 16 bp, Homo sapiens
accacagcagctgaac

SEQ ID NO: 981060 - DNA, 12 bp, Homo sapiens
accacagcagga

SEQ ID NO: 981061 - DNA, 12 bp, Homo sapiens
accacagcatcg

SEQ ID NO: 981062 - DNA, 23 bp, Homo sapiens
accacagcatcgggagcacccag

SEQ ID NO: 981063 - DNA, 17 bp, Homo sapiens
accacagccagcacctg

SEQ ID NO: 981064 - DNA, 13 bp, Homo sapiens
accacagctgggc

SEQ ID NO: 981065 - DNA, 16 bp, Homo sapiens
accacaggcttgttac

SEQ ID NO: 981066 - DNA, 17 bp, Homo sapiens
accacagggttcaaaat

SEQ ID NO: 981067 - DNA, 23 bp, Homo sapiens
accacagggttcaaaatgtctgt

SEQ ID NO: 981068 - DNA, 16 bp, Homo sapiens
accacagtgggtggca

SEQ ID NO: 981069 - DNA, 21 bp, Homo sapiens
accacagtgggtggcacctcc

SEQ ID NO: 981070 - DNA, 12 bp, Homo sapiens
accacagtgtct

SEQ ID NO: 981071 - DNA, 13 bp, Homo sapiens
accacagtgtctg

SEQ ID NO: 981072 - DNA, 17 bp, Homo sapiens
accacataccatgtgga

SEQ ID NO: 981073 - DNA, 21 bp, Homo sapiens
accacatagcatgcttccttt

SEQ ID NO: 981074 - DNA, 22 bp, Homo sapiens
accacatataacacttaacttc

SEQ ID NO: 981075 - DNA, 23 bp, Homo sapiens
accacatccacacacgcaggaac

SEQ ID NO: 981076 - DNA, 14 bp, Homo sapiens
accacatcctccgt

SEQ ID NO: 981077 - DNA, 22 bp, Homo sapiens
accacatcctccgtccagccgc

SEQ ID NO: 981078 - DNA, 16 bp, Homo sapiens
accacatctaagcctg

SEQ ID NO: 981079 - DNA, 18 bp, Homo sapiens
accacatctgccagacct

SEQ ID NO: 981080 - DNA, 15 bp, Homo sapiens
accacatctgctcta

SEQ ID NO: 981081 - DNA, 19 bp, Homo sapiens
accacatctgctctaggga

SEQ ID NO: 981082 - DNA, 19 bp, Homo sapiens
accacatctgtcctcaccc

SEQ ID NO: 981083 - DNA, 21 bp, Homo sapiens
accacatctgtcctcaccctg

SEQ ID NO: 981084 - DNA, 17 bp, Homo sapiens
accacatctttatctgt

SEQ ID NO: 981085 - DNA, 15 bp, Homo sapiens
accacatgggctggg

SEQ ID NO: 981086 - DNA, 18 bp, Homo sapiens
accacatgggctgggggc

SEQ ID NO: 981087 - DNA, 19 bp, Homo sapiens
accacatgggctgggggcc

SEQ ID NO: 981088 - DNA, 15 bp, Homo sapiens
accacattgcctcat

SEQ ID NO: 981089 - DNA, 11 bp, Homo sapiens
accaccaaagt

SEQ ID NO: 981090 - DNA, 12 bp, Homo sapiens
accaccacccct

SEQ ID NO: 981091 - DNA, 16 bp, Homo sapiens
accaccacccctacca

SEQ ID NO: 981092 - DNA, 16 bp, Homo sapiens
accaccactggccacc

SEQ ID NO: 981093 - DNA, 23 bp, Homo sapiens
accaccactggccaccaggctgg

SEQ ID NO: 981094 - DNA, 24 bp, Homo sapiens
accaccactggccaccaggctggc

SEQ ID NO: 981095 - DNA, 16 bp, Homo sapiens
accaccagccccagca

SEQ ID NO: 981096 - DNA, 21 bp, Homo sapiens
accaccagcgttcccttctcc

SEQ ID NO: 981097 - DNA, 16 bp, Homo sapiens
accaccaggagcagca

SEQ ID NO: 981098 - DNA, 18 bp, Homo sapiens
accaccaggagcagcagc

SEQ ID NO: 981099 - DNA, 23 bp, Homo sapiens
accaccaggagcagcagccagca

SEQ ID NO: 981100 - DNA, 18 bp, Homo sapiens
accaccagggtcccagga

SEQ ID NO: 981101 - DNA, 12 bp, Homo sapiens
accaccagggtg

SEQ ID NO: 981102 - DNA, 13 bp, Homo sapiens
accacccacaatc

SEQ ID NO: 981103 - DNA, 12 bp, Homo sapiens
accacccagccc

SEQ ID NO: 981104 - DNA, 15 bp, Homo sapiens
accacccagcccttc

SEQ ID NO: 981105 - DNA, 14 bp, Homo sapiens
accacccatatcat

SEQ ID NO: 981106 - DNA, 15 bp, Homo sapiens
accacccatatcatg

SEQ ID NO: 981107 - DNA, 17 bp, Homo sapiens
accacccccaaacacaa

SEQ ID NO: 981108 - DNA, 19 bp, Homo sapiens
accacccccactggtgaga

SEQ ID NO: 981109 - DNA, 20 bp, Homo sapiens
accaccctcactggctctcc

SEQ ID NO: 981110 - DNA, 17 bp, Homo sapiens
accaccctcaggtgcct

SEQ ID NO: 981111 - DNA, 18 bp, Homo sapiens
accaccctcaggtgcctc

SEQ ID NO: 981112 - DNA, 15 bp, Homo sapiens
accaccctcccctct

SEQ ID NO: 981113 - DNA, 21 bp, Homo sapiens
accaccctcccctctcttgca

SEQ ID NO: 981114 - DNA, 12 bp, Homo sapiens
accaccctctgg

SEQ ID NO: 981115 - DNA, 16 bp, Homo sapiens
accaccctctggggac

SEQ ID NO: 981116 - DNA, 13 bp, Homo sapiens
accaccctgagcc

SEQ ID NO: 981117 - DNA, 21 bp, Homo sapiens
accaccctgagccggccccag

SEQ ID NO: 981118 - DNA, 14 bp, Homo sapiens
accaccgctcccca

SEQ ID NO: 981119 - DNA, 17 bp, Homo sapiens
accaccgctccccagcc

SEQ ID NO: 981120 - DNA, 15 bp, Homo sapiens
accacctacacagga

SEQ ID NO: 981121 - DNA, 18 bp, Homo sapiens
accacctaggccactcct

SEQ ID NO: 981122 - DNA, 12 bp, Homo sapiens
accacctctgtg

SEQ ID NO: 981123 - DNA, 15 bp, Homo sapiens
accaccttcccagct

SEQ ID NO: 981124 - DNA, 24 bp, Homo sapiens
accacgactggccagggccacgct

SEQ ID NO: 981125 - DNA, 18 bp, Homo sapiens
accacgatgtggccctgg

SEQ ID NO: 981126 - DNA, 21 bp, Homo sapiens
accacgatgtggccctggcct

SEQ ID NO: 981127 - DNA, 15 bp, Homo sapiens
accacgcacctccac

SEQ ID NO: 981128 - DNA, 18 bp, Homo sapiens
accacgcccgtcctgcct

SEQ ID NO: 981129 - DNA, 23 bp, Homo sapiens
accacgcccgtcctgcctgtggc

SEQ ID NO: 981130 - DNA, 22 bp, Homo sapiens
accacgcctcttgaccaggctg

SEQ ID NO: 981131 - DNA, 18 bp, Homo sapiens
accacggccaccactgca

SEQ ID NO: 981132 - DNA, 18 bp, Homo sapiens
accacggcgtttttttac

SEQ ID NO: 981133 - DNA, 19 bp, Homo sapiens
accacggcgtttttttaca

SEQ ID NO: 981134 - DNA, 13 bp, Homo sapiens
accacgtctgcca

SEQ ID NO: 981135 - DNA, 22 bp, Homo sapiens
accacgtctgccaggcccatct

SEQ ID NO: 981136 - DNA, 15 bp, Homo sapiens
accacgtctggctcc

SEQ ID NO: 981137 - DNA, 20 bp, Homo sapiens
accacgtctggctccctgcc

SEQ ID NO: 981138 - DNA, 16 bp, Homo sapiens
accacgtgaaactgct

SEQ ID NO: 981139 - DNA, 18 bp, Homo sapiens
accacgtgaaactgctgt

SEQ ID NO: 981140 - DNA, 23 bp, Homo sapiens
accacgtgaaatttgcctctgtc

SEQ ID NO: 981141 - DNA, 14 bp, Homo sapiens
accacgtttctaaa

SEQ ID NO: 981142 - DNA, 18 bp, Homo sapiens
accactaaccatccccaa

SEQ ID NO: 981143 - DNA, 17 bp, Homo sapiens
accactacatgcagccc

SEQ ID NO: 981144 - DNA, 14 bp, Homo sapiens
accactacattctg

SEQ ID NO: 981145 - DNA, 14 bp, Homo sapiens
accactagagctga

SEQ ID NO: 981146 - DNA, 20 bp, Homo sapiens
accactaggaatcccagagg

SEQ ID NO: 981147 - DNA, 17 bp, Homo sapiens
accactaggactctgag

SEQ ID NO: 981148 - DNA, 20 bp, Homo sapiens
accactcaaattaatctttc

SEQ ID NO: 981149 - DNA, 14 bp, Homo sapiens
accactcagcccct

SEQ ID NO: 981150 - DNA, 17 bp, Homo sapiens
accactcagcccctagg

SEQ ID NO: 981151 - DNA, 22 bp, Homo sapiens
accactcctgtccctgtagctc

SEQ ID NO: 981152 - DNA, 16 bp, Homo sapiens
accactcgaggcctgc

SEQ ID NO: 981153 - DNA, 12 bp, Homo sapiens
accactctgtaa

SEQ ID NO: 981154 - DNA, 22 bp, Homo sapiens
accactcttctttaagccatag

SEQ ID NO: 981155 - DNA, 16 bp, Homo sapiens
accactgaaaaaatat

SEQ ID NO: 981156 - DNA, 13 bp, Homo sapiens
accactgatatca

SEQ ID NO: 981157 - DNA, 15 bp, Homo sapiens
accactgccctgcct

SEQ ID NO: 981158 - DNA, 16 bp, Homo sapiens
accactgccctgcctg

SEQ ID NO: 981159 - DNA, 22 bp, Homo sapiens
accactgccctgcctgcccact

SEQ ID NO: 981160 - DNA, 13 bp, Homo sapiens
accactgcctgac

SEQ ID NO: 981161 - DNA, 18 bp, Homo sapiens
accactgctatgccattt

SEQ ID NO: 981162 - DNA, 15 bp, Homo sapiens
accactgcttctctt

SEQ ID NO: 981163 - DNA, 19 bp, Homo sapiens
accactggccaccaggctg

SEQ ID NO: 981164 - DNA, 20 bp, Homo sapiens
accactggccaccaggctgg

SEQ ID NO: 981165 - DNA, 21 bp, Homo sapiens
accactggccaccaggctggc

SEQ ID NO: 981166 - DNA, 14 bp, Homo sapiens
attaagaaagacta

SEQ ID NO: 981167 - DNA, 12 bp, Homo sapiens
attaagaaagga

SEQ ID NO: 981168 - DNA, 23 bp, Homo sapiens
attaagaaaggaagcattgtaaa

SEQ ID NO: 981169 - DNA, 11 bp, Homo sapiens
attaagaaata

SEQ ID NO: 981170 - DNA, 15 bp, Homo sapiens
attaagaaggcaaaa

SEQ ID NO: 981171 - DNA, 22 bp, Homo sapiens
attaagaaggcaaaaatgtaaa

SEQ ID NO: 981172 - DNA, 14 bp, Homo sapiens
attaagacaaaaag

SEQ ID NO: 981173 - DNA, 19 bp, Homo sapiens
attaagacaaaaagccttg

SEQ ID NO: 981174 - DNA, 23 bp, Homo sapiens
attaggaattgtttatacacaac

SEQ ID NO: 981175 - DNA, 16 bp, Homo sapiens
accaggcacctcttcc

SEQ ID NO: 981176 - DNA, 17 bp, Homo sapiens
accaggcacctcttcct

SEQ ID NO: 981177 - DNA, 20 bp, Homo sapiens
accaggcacgaacccacctg

SEQ ID NO: 981178 - DNA, 23 bp, Homo sapiens
accaggcacgaacccacctgctg

SEQ ID NO: 981179 - DNA, 14 bp, Homo sapiens
accaggcagctgag

SEQ ID NO: 981180 - DNA, 23 bp, Homo sapiens
accaggcagctgagaccagggtc

SEQ ID NO: 981181 - DNA, 23 bp, Homo sapiens
accaggcccacgaggagcagcag

SEQ ID NO: 981182 - DNA, 16 bp, Homo sapiens
accaggccccagcctc

SEQ ID NO: 981183 - DNA, 21 bp, Homo sapiens
accaggccccagcctccaggc

SEQ ID NO: 981184 - DNA, 16 bp, Homo sapiens
accaggccgtcctccc

SEQ ID NO: 981185 - DNA, 14 bp, Homo sapiens
accaggcctcactg

SEQ ID NO: 981186 - DNA, 16 bp, Homo sapiens
accaggcctcactggc

SEQ ID NO: 981187 - DNA, 12 bp, Homo sapiens
accaggcctgga

SEQ ID NO: 981188 - DNA, 13 bp, Homo sapiens
accaggcctggag

SEQ ID NO: 981189 - DNA, 16 bp, Homo sapiens
accaggcctggagggc

SEQ ID NO: 981190 - DNA, 22 bp, Homo sapiens
accaggctggcgcagccaaggc

SEQ ID NO: 981191 - DNA, 12 bp, Homo sapiens
accagggaagtg

SEQ ID NO: 981192 - DNA, 14 bp, Homo sapiens
accagggactgcag

SEQ ID NO: 981193 - DNA, 17 bp, Homo sapiens
accagggagcttcctgg

SEQ ID NO: 981194 - DNA, 15 bp, Homo sapiens
accagggatgctggg

SEQ ID NO: 981195 - DNA, 19 bp, Homo sapiens
accagggatgctgggctgg

SEQ ID NO: 981196 - DNA, 20 bp, Homo sapiens
accagggatgctgggctggg

SEQ ID NO: 981197 - DNA, 21 bp, Homo sapiens
accagggatgctgggctgggc

SEQ ID NO: 981198 - DNA, 16 bp, Homo sapiens
accagggccctgggca

SEQ ID NO: 981199 - DNA, 22 bp, Homo sapiens
accagggcctccctgttcacgg

SEQ ID NO: 981200 - DNA, 18 bp, Homo sapiens
accaggggaaggaaggag

SEQ ID NO: 981201 - DNA, 20 bp, Homo sapiens
accaggggaaggaaggaggg

SEQ ID NO: 981202 - DNA, 23 bp, Homo sapiens
accaggggaaggaaggagggcac

SEQ ID NO: 981203 - DNA, 16 bp, Homo sapiens
accaggggtttctcgc

SEQ ID NO: 981204 - DNA, 14 bp, Homo sapiens
accagggtggacca

SEQ ID NO: 981205 - DNA, 18 bp, Homo sapiens
accagggtggaccaggcc

SEQ ID NO: 981206 - DNA, 20 bp, Homo sapiens
accagggtggaccaggcctg

SEQ ID NO: 981207 - DNA, 20 bp, Homo sapiens
accagggttgaccccagagg

SEQ ID NO: 981208 - DNA, 21 bp, Homo sapiens
accagggttgaccccagagga

SEQ ID NO: 981209 - DNA, 17 bp, Homo sapiens
accaggtcaccatcctc

SEQ ID NO: 981210 - DNA, 22 bp, Homo sapiens
accaggtcttggagctgagcct

SEQ ID NO: 981211 - DNA, 14 bp, Homo sapiens
accaggtgggagcg

SEQ ID NO: 981212 - DNA, 19 bp, Homo sapiens
accaggtgttctacactca

SEQ ID NO: 981213 - DNA, 20 bp, Homo sapiens
accaggtgttctacactcat

SEQ ID NO: 981214 - DNA, 23 bp, Homo sapiens
accaggtgttctacactcatctt

SEQ ID NO: 981215 - DNA, 14 bp, Homo sapiens
accaggttgaaaga

SEQ ID NO: 981216 - DNA, 20 bp, Homo sapiens
accagtatcgctcatagatc

SEQ ID NO: 981217 - DNA, 14 bp, Homo sapiens
accagtatttagaa

SEQ ID NO: 981218 - DNA, 19 bp, Homo sapiens
accagtatttagaagccaa

SEQ ID NO: 981219 - DNA, 17 bp, Homo sapiens
accagtctcctcactct

SEQ ID NO: 981220 - DNA, 23 bp, Homo sapiens
accagtctcctcactctgtccct

SEQ ID NO: 981221 - DNA, 14 bp, Homo sapiens
accagtctcctccc

SEQ ID NO: 981222 - DNA, 17 bp, Homo sapiens
accagtctctcaagtga

SEQ ID NO: 981223 - DNA, 14 bp, Homo sapiens
accagtctgaagtt

SEQ ID NO: 981224 - DNA, 21 bp, Homo sapiens
accagtctgaagtttcattta

SEQ ID NO: 981225 - DNA, 14 bp, Homo sapiens
accagtctgaccct

SEQ ID NO: 981226 - DNA, 15 bp, Homo sapiens
accagtctgtctact

SEQ ID NO: 981227 - DNA, 19 bp, Homo sapiens
accagtctttaaaggccca

SEQ ID NO: 981228 - DNA, 20 bp, Homo sapiens
accagtctttaaaggcccag

SEQ ID NO: 981229 - DNA, 16 bp, Homo sapiens
accagtgaaccaaaga

SEQ ID NO: 981230 - DNA, 18 bp, Homo sapiens
accagtgcaacagcactg

SEQ ID NO: 981231 - DNA, 18 bp, Homo sapiens
accagtggacctagcctg

SEQ ID NO: 981232 - DNA, 20 bp, Homo sapiens
accagtggacctagcctgga

SEQ ID NO: 981233 - DNA, 12 bp, Homo sapiens
accagtggcctt

SEQ ID NO: 981234 - DNA, 21 bp, Homo sapiens
accagtggcgttgttgcatgt

SEQ ID NO: 981235 - DNA, 17 bp, Homo sapiens
accagtgggatgggctc

SEQ ID NO: 981236 - DNA, 22 bp, Homo sapiens
accagtgggatgggctctacct

SEQ ID NO: 981237 - DNA, 19 bp, Homo sapiens
accagtggtctggaaacag

SEQ ID NO: 981238 - DNA, 13 bp, Homo sapiens
accagtgtcccct

SEQ ID NO: 981239 - DNA, 20 bp, Homo sapiens
accagtgtcccctccactgt

SEQ ID NO: 981240 - DNA, 22 bp, Homo sapiens
accagtgttagggaagggcctg

SEQ ID NO: 981241 - DNA, 20 bp, Homo sapiens
accagtgttcctgaagctgc

SEQ ID NO: 981242 - DNA, 23 bp, Homo sapiens
accagtgttcctgaagctgctgt

SEQ ID NO: 981243 - DNA, 15 bp, Homo sapiens
accagtgttgtggat

SEQ ID NO: 981244 - DNA, 14 bp, Homo sapiens
accagttaaaagca

SEQ ID NO: 981245 - DNA, 18 bp, Homo sapiens
accagttaaagccacaga

SEQ ID NO: 981246 - DNA, 12 bp, Homo sapiens
accagttaattt

SEQ ID NO: 981247 - DNA, 13 bp, Homo sapiens
accagttaatttt

SEQ ID NO: 981248 - DNA, 17 bp, Homo sapiens
accagttatgtgaatga

SEQ ID NO: 981249 - DNA, 16 bp, Homo sapiens
accagttctcatgggt

SEQ ID NO: 981250 - DNA, 21 bp, Homo sapiens
accagttctcatgggtggcac

SEQ ID NO: 981251 - DNA, 15 bp, Homo sapiens
accagttctgggcaa

SEQ ID NO: 981252 - DNA, 13 bp, Homo sapiens
accagttgccttt

SEQ ID NO: 981253 - DNA, 18 bp, Homo sapiens
accagttgggagcactgg

SEQ ID NO: 981254 - DNA, 19 bp, Homo sapiens
accagttgtatttaatttt

SEQ ID NO: 981255 - DNA, 16 bp, Homo sapiens
accagtttatacagaa

SEQ ID NO: 981256 - DNA, 17 bp, Homo sapiens
accagtttatacagaac

SEQ ID NO: 981257 - DNA, 15 bp, Homo sapiens
accagtttgcatgat

SEQ ID NO: 981258 - DNA, 20 bp, Homo sapiens
accagttttgagtgtactgt

SEQ ID NO: 981259 - DNA, 24 bp, Homo sapiens
accagtttttggataaagaatact

SEQ ID NO: 981260 - DNA, 15 bp, Homo sapiens
accataaagccttta

SEQ ID NO: 981261 - DNA, 18 bp, Homo sapiens
accataaatgaatcatca

SEQ ID NO: 981262 - DNA, 22 bp, Homo sapiens
accataatgtactgatttcagt

SEQ ID NO: 981263 - DNA, 18 bp, Homo sapiens
accataattttttttaaa

SEQ ID NO: 981264 - DNA, 13 bp, Homo sapiens
accatactaatta

SEQ ID NO: 981265 - DNA, 14 bp, Homo sapiens
accatagaaaaatg

SEQ ID NO: 981266 - DNA, 22 bp, Homo sapiens
accatagcacaggctaattttt

SEQ ID NO: 981267 - DNA, 21 bp, Homo sapiens
accataggaagacataaaact

SEQ ID NO: 981268 - DNA, 20 bp, Homo sapiens
accatagtaccatttataca

SEQ ID NO: 981269 - DNA, 23 bp, Homo sapiens
accatagtaccatttatacaaat

SEQ ID NO: 981270 - DNA, 19 bp, Homo sapiens
accatattcagtgctgtgg

SEQ ID NO: 981271 - DNA, 13 bp, Homo sapiens
accatattctaag

SEQ ID NO: 981272 - DNA, 23 bp, Homo sapiens
accatattctaagttagactctt

SEQ ID NO: 981273 - DNA, 14 bp, Homo sapiens
accatcaccaccgc

SEQ ID NO: 981274 - DNA, 19 bp, Homo sapiens
accatcaccaccgcctctg

SEQ ID NO: 981275 - DNA, 15 bp, Homo sapiens
accatcactcactca

SEQ ID NO: 981276 - DNA, 20 bp, Homo sapiens
accatcactcactcactccc

SEQ ID NO: 981277 - DNA, 22 bp, Homo sapiens
accatcactgagagtcaggagt

SEQ ID NO: 981278 - DNA, 16 bp, Homo sapiens
accatcagctgctttt

SEQ ID NO: 981279 - DNA, 15 bp, Homo sapiens
accatcagggacagg

SEQ ID NO: 981280 - DNA, 22 bp, Homo sapiens
accatccactctaccctcccac

SEQ ID NO: 981281 - DNA, 13 bp, Homo sapiens
accatccatccct

SEQ ID NO: 981282 - DNA, 14 bp, Homo sapiens
accatccccaactc

SEQ ID NO: 981283 - DNA, 20 bp, Homo sapiens
accatccctttttgaagtgt

SEQ ID NO: 981284 - DNA, 24 bp, Homo sapiens
accatcctcagaggctgagccctg

SEQ ID NO: 981285 - DNA, 14 bp, Homo sapiens
accatcctggcccc

SEQ ID NO: 981286 - DNA, 19 bp, Homo sapiens
accatcctggcccctccag

SEQ ID NO: 981287 - DNA, 13 bp, Homo sapiens
accatcctggcta

SEQ ID NO: 981288 - DNA, 18 bp, Homo sapiens
accatcctgtattcttca

SEQ ID NO: 981289 - DNA, 15 bp, Homo sapiens
accatcgctttattg

SEQ ID NO: 981290 - DNA, 16 bp, Homo sapiens
accatcgtccagccct

SEQ ID NO: 981291 - DNA, 17 bp, Homo sapiens
accatcgtccagccctc

SEQ ID NO: 981292 - DNA, 20 bp, Homo sapiens
accatcgtgtttgcaaaggt

SEQ ID NO: 981293 - DNA, 13 bp, Homo sapiens
accatctaatagc

SEQ ID NO: 981294 - DNA, 18 bp, Homo sapiens
accatctcacaccagtcc

SEQ ID NO: 981295 - DNA, 13 bp, Homo sapiens
acccaatccaaat

SEQ ID NO: 981296 - DNA, 14 bp, Homo sapiens
acccaatccaaatg

SEQ ID NO: 981297 - DNA, 14 bp, Homo sapiens
acccaatccctctc

SEQ ID NO: 981298 - DNA, 17 bp, Homo sapiens
acccaatgcctgtgaag

SEQ ID NO: 981299 - DNA, 15 bp, Homo sapiens
acccaatgtctccca

SEQ ID NO: 981300 - DNA, 16 bp, Homo sapiens
acccaatgtctcccac

SEQ ID NO: 981301 - DNA, 22 bp, Homo sapiens
acccaattaagtcctactttac

SEQ ID NO: 981302 - DNA, 23 bp, Homo sapiens
acccaattggcccaacactgtct

SEQ ID NO: 981303 - DNA, 18 bp, Homo sapiens
attatcttgttcaggaaa

SEQ ID NO: 981304 - DNA, 14 bp, Homo sapiens
attatgaaaaacat

SEQ ID NO: 981305 - DNA, 18 bp, Homo sapiens
attatgaaaaagattatt

SEQ ID NO: 981306 - DNA, 20 bp, Homo sapiens
attatgaaagcaacaaagaa

SEQ ID NO: 981307 - DNA, 22 bp, Homo sapiens
attatgaaagcaacaaagaaat

SEQ ID NO: 981308 - DNA, 13 bp, Homo sapiens
attatgaaggaat

SEQ ID NO: 981309 - DNA, 17 bp, Homo sapiens
attatgaaggaatttga

SEQ ID NO: 981310 - DNA, 22 bp, Homo sapiens
attatgaaggaatttgattgct

SEQ ID NO: 981311 - DNA, 16 bp, Homo sapiens
attatgacagttatac

SEQ ID NO: 981312 - DNA, 14 bp, Homo sapiens
attatgatttcatt

SEQ ID NO: 981313 - DNA, 17 bp, Homo sapiens
attatgcaaaagcagct

SEQ ID NO: 981314 - DNA, 20 bp, Homo sapiens
attatgctttgaactttagt

SEQ ID NO: 981315 - DNA, 19 bp, Homo sapiens
attatggaaaaataaaact

SEQ ID NO: 981316 - DNA, 17 bp, Homo sapiens
attatggcatttctatt

SEQ ID NO: 981317 - DNA, 19 bp, Homo sapiens
attatgtaatatattgtac

SEQ ID NO: 981318 - DNA, 14 bp, Homo sapiens
attatgtaatgcaa

SEQ ID NO: 981319 - DNA, 16 bp, Homo sapiens
attatgtatttataat

SEQ ID NO: 981320 - DNA, 22 bp, Homo sapiens
attatgtcctgtgagatgtgta

SEQ ID NO: 981321 - DNA, 12 bp, Homo sapiens
attatgtctctt

SEQ ID NO: 981322 - DNA, 12 bp, Homo sapiens
attatgtgaaat

SEQ ID NO: 981323 - DNA, 13 bp, Homo sapiens
attatgtgacatt

SEQ ID NO: 981324 - DNA, 20 bp, Homo sapiens
attatgtgaccataatgtac

SEQ ID NO: 981325 - DNA, 20 bp, Homo sapiens
attatgttatacaaggcaag

SEQ ID NO: 981326 - DNA, 19 bp, Homo sapiens
attatgttcatgtaagaag

SEQ ID NO: 981327 - DNA, 16 bp, Homo sapiens
attatgtttattacaa

SEQ ID NO: 981328 - DNA, 20 bp, Homo sapiens
attatgtttattacaatttt

SEQ ID NO: 981329 - DNA, 18 bp, Homo sapiens
attatgtttgatttctct

SEQ ID NO: 981330 - DNA, 16 bp, Homo sapiens
attatgttttttaaaa

SEQ ID NO: 981331 - DNA, 13 bp, Homo sapiens
attattaaacgat

SEQ ID NO: 981332 - DNA, 19 bp, Homo sapiens
attattaaagaaaaatgca

SEQ ID NO: 981333 - DNA, 18 bp, Homo sapiens
attattaataccaaatat

SEQ ID NO: 981334 - DNA, 16 bp, Homo sapiens
attattaattgtcctg

SEQ ID NO: 981335 - DNA, 15 bp, Homo sapiens
attattacagtgttt

SEQ ID NO: 981336 - DNA, 20 bp, Homo sapiens
attattaccagcatttgtcc

SEQ ID NO: 981337 - DNA, 20 bp, Homo sapiens
attattactctacactgaaa

SEQ ID NO: 981338 - DNA, 20 bp, Homo sapiens
attattacttatttttgaca

SEQ ID NO: 981339 - DNA, 20 bp, Homo sapiens
attattactttatgaacaat

SEQ ID NO: 981340 - DNA, 12 bp, Homo sapiens
attattactttt

SEQ ID NO: 981341 - DNA, 12 bp, Homo sapiens
attattagaaca

SEQ ID NO: 981342 - DNA, 14 bp, Homo sapiens
attattagaacatt

SEQ ID NO: 981343 - DNA, 23 bp, Homo sapiens
attattagaacattcacttttgt

SEQ ID NO: 981344 - DNA, 14 bp, Homo sapiens
attattataaaaat

SEQ ID NO: 981345 - DNA, 16 bp, Homo sapiens
attattataaaaatat

SEQ ID NO: 981346 - DNA, 19 bp, Homo sapiens
attattataaaagggggtc

SEQ ID NO: 981347 - DNA, 13 bp, Homo sapiens
attattataaact

SEQ ID NO: 981348 - DNA, 17 bp, Homo sapiens
attattataaactataa

SEQ ID NO: 981349 - DNA, 22 bp, Homo sapiens
attattatcaggggagaaaaat

SEQ ID NO: 981350 - DNA, 14 bp, Homo sapiens
attattatgtaaat

SEQ ID NO: 981351 - DNA, 12 bp, Homo sapiens
attattatgttt

SEQ ID NO: 981352 - DNA, 22 bp, Homo sapiens
attattatgtttattacaattt

SEQ ID NO: 981353 - DNA, 12 bp, Homo sapiens
attattattaaa

SEQ ID NO: 981354 - DNA, 14 bp, Homo sapiens
attattatttgctt

SEQ ID NO: 981355 - DNA, 16 bp, Homo sapiens
attattcaagaatgaa

SEQ ID NO: 981356 - DNA, 23 bp, Homo sapiens
attattcaagaatgaaaaatata

SEQ ID NO: 981357 - DNA, 21 bp, Homo sapiens
attattcaagtgcctcttgtt

SEQ ID NO: 981358 - DNA, 18 bp, Homo sapiens
attattcagtgaatttgt

SEQ ID NO: 981359 - DNA, 13 bp, Homo sapiens
attattcatttaa

SEQ ID NO: 981360 - DNA, 19 bp, Homo sapiens
attattcatttaaaatgat

SEQ ID NO: 981361 - DNA, 20 bp, Homo sapiens
attattcatttaaaatgatt

SEQ ID NO: 981362 - DNA, 21 bp, Homo sapiens
attattcatttaaaatgatta

SEQ ID NO: 981363 - DNA, 18 bp, Homo sapiens
attattcctcagattgct

SEQ ID NO: 981364 - DNA, 22 bp, Homo sapiens
attattcctcagattgctgaat

SEQ ID NO: 981365 - DNA, 13 bp, Homo sapiens
attattctccact

SEQ ID NO: 981366 - DNA, 21 bp, Homo sapiens
attattctccactttttctta

SEQ ID NO: 981367 - DNA, 12 bp, Homo sapiens
attattctctgc

SEQ ID NO: 981368 - DNA, 17 bp, Homo sapiens
attattctgcctacgtt

SEQ ID NO: 981369 - DNA, 15 bp, Homo sapiens
attattctgttttgc

SEQ ID NO: 981370 - DNA, 12 bp, Homo sapiens
attattcttcag

SEQ ID NO: 981371 - DNA, 15 bp, Homo sapiens
attattctttgaaaa

SEQ ID NO: 981372 - DNA, 17 bp, Homo sapiens
attattctttgaaaaca

SEQ ID NO: 981373 - DNA, 23 bp, Homo sapiens
attattctttgaaaacagatgac

SEQ ID NO: 981374 - DNA, 12 bp, Homo sapiens
attattgaaatt

SEQ ID NO: 981375 - DNA, 15 bp, Homo sapiens
attattgacactgaa

SEQ ID NO: 981376 - DNA, 17 bp, Homo sapiens
attattgatagtactct

SEQ ID NO: 981377 - DNA, 14 bp, Homo sapiens
attattggaattaa

SEQ ID NO: 981378 - DNA, 18 bp, Homo sapiens
attattggaattaacctg

SEQ ID NO: 981379 - DNA, 19 bp, Homo sapiens
attattgtaaactttttca

SEQ ID NO: 981380 - DNA, 16 bp, Homo sapiens
attattgtagacatgc

SEQ ID NO: 981381 - DNA, 17 bp, Homo sapiens
attattgtgacttcact

SEQ ID NO: 981382 - DNA, 20 bp, Homo sapiens
attattgtgacttcactgta

SEQ ID NO: 981383 - DNA, 21 bp, Homo sapiens
attattgtgacttcactgtat

SEQ ID NO: 981384 - DNA, 23 bp, Homo sapiens
attattgtgacttcactgtatat

SEQ ID NO: 981385 - DNA, 20 bp, Homo sapiens
attatttaaataaaatcacc

SEQ ID NO: 981386 - DNA, 21 bp, Homo sapiens
attatttaataaaaaaacaat

SEQ ID NO: 981387 - DNA, 15 bp, Homo sapiens
attatttacatcact

SEQ ID NO: 981388 - DNA, 14 bp, Homo sapiens
attatttagagcca

SEQ ID NO: 981389 - DNA, 20 bp, Homo sapiens
attatttattaaaaatgttc

SEQ ID NO: 981390 - DNA, 13 bp, Homo sapiens
attatttattaca

SEQ ID NO: 981391 - DNA, 13 bp, Homo sapiens
attatttattact

SEQ ID NO: 981392 - DNA, 12 bp, Homo sapiens
attatttattgt

SEQ ID NO: 981393 - DNA, 14 bp, Homo sapiens
attatttattgtta

SEQ ID NO: 981394 - DNA, 15 bp, Homo sapiens
attatttattgttaa

SEQ ID NO: 981395 - DNA, 18 bp, Homo sapiens
attatttcactttagatg

SEQ ID NO: 981396 - DNA, 13 bp, Homo sapiens
attatttcagtgt

SEQ ID NO: 981397 - DNA, 19 bp, Homo sapiens
attatttcatatactataa

SEQ ID NO: 981398 - DNA, 22 bp, Homo sapiens
attatttcatatactataattg

SEQ ID NO: 981399 - DNA, 11 bp, Homo sapiens
attatttctgt

SEQ ID NO: 981400 - DNA, 22 bp, Homo sapiens
attatttctgtcacagtaaaaa

SEQ ID NO: 981401 - DNA, 14 bp, Homo sapiens
attatttgaaaaca

SEQ ID NO: 981402 - DNA, 18 bp, Homo sapiens
attatttgattatttaag

SEQ ID NO: 981403 - DNA, 11 bp, Homo sapiens
attatttgcat

SEQ ID NO: 981404 - DNA, 12 bp, Homo sapiens
attatttgcatg

SEQ ID NO: 981405 - DNA, 17 bp, Homo sapiens
attatttgcatgttatg

SEQ ID NO: 981406 - DNA, 12 bp, Homo sapiens
attatttgctat

SEQ ID NO: 981407 - DNA, 12 bp, Homo sapiens
attatttgcttt

SEQ ID NO: 981408 - DNA, 20 bp, Homo sapiens
attatttgggagggaaaagg

SEQ ID NO: 981409 - DNA, 21 bp, Homo sapiens
attatttgggggaactggaca

SEQ ID NO: 981410 - DNA, 17 bp, Homo sapiens
attatttgtcaaattgt

SEQ ID NO: 981411 - DNA, 23 bp, Homo sapiens
attatttgtgcattttattgact

SEQ ID NO: 981412 - DNA, 23 bp, Homo sapiens
attatttgtgtaatagaaaactg

SEQ ID NO: 981413 - DNA, 12 bp, Homo sapiens
attatttgtgtt

SEQ ID NO: 981414 - DNA, 15 bp, Homo sapiens
attatttgtgtttta

SEQ ID NO: 981415 - DNA, 16 bp, Homo sapiens
attattttaatatttt

SEQ ID NO: 981416 - DNA, 15 bp, Homo sapiens
attattttactgctt

SEQ ID NO: 981417 - DNA, 20 bp, Homo sapiens
attattttagcttcagttgt

SEQ ID NO: 981418 - DNA, 21 bp, Homo sapiens
accccataccccttattgctg

SEQ ID NO: 981419 - DNA, 16 bp, Homo sapiens
accccatccagccaga

SEQ ID NO: 981420 - DNA, 15 bp, Homo sapiens
accccatcccacacc

SEQ ID NO: 981421 - DNA, 17 bp, Homo sapiens
accccatccctccccag

SEQ ID NO: 981422 - DNA, 20 bp, Homo sapiens
accccatgcacctcagggcc

SEQ ID NO: 981423 - DNA, 14 bp, Homo sapiens
accccatgtgcctt

SEQ ID NO: 981424 - DNA, 15 bp, Homo sapiens
accccatgtgccttt

SEQ ID NO: 981425 - DNA, 16 bp, Homo sapiens
acccccaaattttctt

SEQ ID NO: 981426 - DNA, 17 bp, Homo sapiens
acccccaacccccagag

SEQ ID NO: 981427 - DNA, 22 bp, Homo sapiens
acccccaccatgcagcccctgg

SEQ ID NO: 981428 - DNA, 18 bp, Homo sapiens
acccccacccccagctca

SEQ ID NO: 981429 - DNA, 15 bp, Homo sapiens
acccccaccccttcc

SEQ ID NO: 981430 - DNA, 20 bp, Homo sapiens
acccccaccccttccccact

SEQ ID NO: 981431 - DNA, 18 bp, Homo sapiens
acccccactctcattccc

SEQ ID NO: 981432 - DNA, 13 bp, Homo sapiens
acccccagcaacc

SEQ ID NO: 981433 - DNA, 11 bp, Homo sapiens
acccccagcca

SEQ ID NO: 981434 - DNA, 13 bp, Homo sapiens
acccccagccagg

SEQ ID NO: 981435 - DNA, 13 bp, Homo sapiens
acccccagcccac

SEQ ID NO: 981436 - DNA, 17 bp, Homo sapiens
acccccagcccacagag

SEQ ID NO: 981437 - DNA, 20 bp, Homo sapiens
attcaggacgtccttccata

SEQ ID NO: 981438 - DNA, 21 bp, Homo sapiens
attcaggacttaacggctcca

SEQ ID NO: 981439 - DNA, 18 bp, Homo sapiens
attcaggacttgaaagaa

SEQ ID NO: 981440 - DNA, 19 bp, Homo sapiens
attcaggacttgaaagaaa

SEQ ID NO: 981441 - DNA, 12 bp, Homo sapiens
attcaggcactg

SEQ ID NO: 981442 - DNA, 13 bp, Homo sapiens
attcaggcactga

SEQ ID NO: 981443 - DNA, 15 bp, Homo sapiens
attcaggccagccca

SEQ ID NO: 981444 - DNA, 17 bp, Homo sapiens
attcaggccagcccagc

SEQ ID NO: 981445 - DNA, 18 bp, Homo sapiens
attcaggccagcccagcc

SEQ ID NO: 981446 - DNA, 13 bp, Homo sapiens
attcaggctgctt

SEQ ID NO: 981447 - DNA, 16 bp, Homo sapiens
attcaggctgcttggg

SEQ ID NO: 981448 - DNA, 14 bp, Homo sapiens
attcaggggaaggg

SEQ ID NO: 981449 - DNA, 18 bp, Homo sapiens
attcaggggctttgggcc

SEQ ID NO: 981450 - DNA, 20 bp, Homo sapiens
attcaggggctttgggccca

SEQ ID NO: 981451 - DNA, 15 bp, Homo sapiens
attcaggtaatacaa

SEQ ID NO: 981452 - DNA, 16 bp, Homo sapiens
attcaggtaatacaaa

SEQ ID NO: 981453 - DNA, 14 bp, Homo sapiens
attcaggtacagaa

SEQ ID NO: 981454 - DNA, 17 bp, Homo sapiens
attcaggtatgttgcct

SEQ ID NO: 981455 - DNA, 14 bp, Homo sapiens
attcaggtttttcc

SEQ ID NO: 981456 - DNA, 15 bp, Homo sapiens
attcagtaataactc

SEQ ID NO: 981457 - DNA, 13 bp, Homo sapiens
attcagtagtttg

SEQ ID NO: 981458 - DNA, 14 bp, Homo sapiens
attcagtgaatttg

SEQ ID NO: 981459 - DNA, 22 bp, Homo sapiens
attcagtgacaaaatgggagga

SEQ ID NO: 981460 - DNA, 21 bp, Homo sapiens
attcagtgagggtcttcttac

SEQ ID NO: 981461 - DNA, 15 bp, Homo sapiens
attcagtgattactg

SEQ ID NO: 981462 - DNA, 22 bp, Homo sapiens
attcagtgcacctgcctcagct

SEQ ID NO: 981463 - DNA, 20 bp, Homo sapiens
attcagtgctgtggcctggg

SEQ ID NO: 981464 - DNA, 14 bp, Homo sapiens
attcagtgcttctt

SEQ ID NO: 981465 - DNA, 19 bp, Homo sapiens
attcagtggcgagaaataa

SEQ ID NO: 981466 - DNA, 14 bp, Homo sapiens
attcagtgtcactg

SEQ ID NO: 981467 - DNA, 19 bp, Homo sapiens
attcagtgttaaatgtgat

SEQ ID NO: 981468 - DNA, 23 bp, Homo sapiens
attcagttcccaccatctgatta

SEQ ID NO: 981469 - DNA, 13 bp, Homo sapiens
attcagtttcata

SEQ ID NO: 981470 - DNA, 14 bp, Homo sapiens
attcagtttcataa

SEQ ID NO: 981471 - DNA, 14 bp, Homo sapiens
attcagttttcatt

SEQ ID NO: 981472 - DNA, 13 bp, Homo sapiens
attcagttttttt

SEQ ID NO: 981473 - DNA, 15 bp, Homo sapiens
attcataaaaactgc

SEQ ID NO: 981474 - DNA, 11 bp, Homo sapiens
attcataataa

SEQ ID NO: 981475 - DNA, 15 bp, Homo sapiens
attcataatgaatta

SEQ ID NO: 981476 - DNA, 19 bp, Homo sapiens
attcataatgaattataac

SEQ ID NO: 981477 - DNA, 22 bp, Homo sapiens
attcatacaaagtactgtcctc

SEQ ID NO: 981478 - DNA, 15 bp, Homo sapiens
attcatactcctttt

SEQ ID NO: 981479 - DNA, 16 bp, Homo sapiens
attcatactccttttg

SEQ ID NO: 981480 - DNA, 21 bp, Homo sapiens
attcatacttaaaaatttatt

SEQ ID NO: 981481 - DNA, 21 bp, Homo sapiens
attcatagggaaaggttttgt

SEQ ID NO: 981482 - DNA, 17 bp, Homo sapiens
attcatagtaacttctt

SEQ ID NO: 981483 - DNA, 19 bp, Homo sapiens
attcatagtaacttcttat

SEQ ID NO: 981484 - DNA, 17 bp, Homo sapiens
attcatagttttatatc

SEQ ID NO: 981485 - DNA, 15 bp, Homo sapiens
attcatataaaagtt

SEQ ID NO: 981486 - DNA, 16 bp, Homo sapiens
attcatataaaagttg

SEQ ID NO: 981487 - DNA, 17 bp, Homo sapiens
attcatattgaatataa

SEQ ID NO: 981488 - DNA, 14 bp, Homo sapiens
attcatatttactt

SEQ ID NO: 981489 - DNA, 20 bp, Homo sapiens
attcatatttgtctttgaat

SEQ ID NO: 981490 - DNA, 22 bp, Homo sapiens
attcatcagaatccttggctga

SEQ ID NO: 981491 - DNA, 16 bp, Homo sapiens
attcatcagaatgtta

SEQ ID NO: 981492 - DNA, 18 bp, Homo sapiens
attcatccaggactgaga

SEQ ID NO: 981493 - DNA, 21 bp, Homo sapiens
attcatccaggactgagatgc

SEQ ID NO: 981494 - DNA, 16 bp, Homo sapiens
attcatcctcttacca

SEQ ID NO: 981495 - DNA, 15 bp, Homo sapiens
attcatctaatgtat

SEQ ID NO: 981496 - DNA, 16 bp, Homo sapiens
attcatgaggagggtg

SEQ ID NO: 981497 - DNA, 18 bp, Homo sapiens
attcatgtaacagttgtg

SEQ ID NO: 981498 - DNA, 17 bp, Homo sapiens
attcatgtattttgttt

SEQ ID NO: 981499 - DNA, 17 bp, Homo sapiens
attcatgttatatttaa

SEQ ID NO: 981500 - DNA, 22 bp, Homo sapiens
attcatgtttaacgtttctcat

SEQ ID NO: 981501 - DNA, 12 bp, Homo sapiens
attcatgtttct

SEQ ID NO: 981502 - DNA, 20 bp, Homo sapiens
attcattaagtaatcttttt

SEQ ID NO: 981503 - DNA, 14 bp, Homo sapiens
attcattacagctt

SEQ ID NO: 981504 - DNA, 16 bp, Homo sapiens
attcattagtcatgtt

SEQ ID NO: 981505 - DNA, 14 bp, Homo sapiens
attcattattcctc

SEQ ID NO: 981506 - DNA, 20 bp, Homo sapiens
attcattatttttccacttt

SEQ ID NO: 981507 - DNA, 16 bp, Homo sapiens
attcattcatacttaa

SEQ ID NO: 981508 - DNA, 12 bp, Homo sapiens
attcattctcat

SEQ ID NO: 981509 - DNA, 19 bp, Homo sapiens
attcattcttagctcttaa

SEQ ID NO: 981510 - DNA, 10 bp, Homo sapiens
attcatttaa

SEQ ID NO: 981511 - DNA, 14 bp, Homo sapiens
attcatttaaaatg

SEQ ID NO: 981512 - DNA, 14 bp, Homo sapiens
attcatttcctgcc

SEQ ID NO: 981513 - DNA, 15 bp, Homo sapiens
attcatttcctgccc

SEQ ID NO: 981514 - DNA, 19 bp, Homo sapiens
attcatttctagactcaaa

SEQ ID NO: 981515 - DNA, 11 bp, Homo sapiens
attcatttgta

SEQ ID NO: 981516 - DNA, 14 bp, Homo sapiens
attcatttgtattg

SEQ ID NO: 981517 - DNA, 15 bp, Homo sapiens
attcattttattctt

SEQ ID NO: 981518 - DNA, 18 bp, Homo sapiens
attcattttcatcactgg

SEQ ID NO: 981519 - DNA, 13 bp, Homo sapiens
attcattttcctg

SEQ ID NO: 981520 - DNA, 17 bp, Homo sapiens
attcattttcctgttca

SEQ ID NO: 981521 - DNA, 13 bp, Homo sapiens
attcattttctag

SEQ ID NO: 981522 - DNA, 15 bp, Homo sapiens
attcattttctagat

SEQ ID NO: 981523 - DNA, 15 bp, Homo sapiens
attcattttctctaa

SEQ ID NO: 981524 - DNA, 22 bp, Homo sapiens
attcatttttgaaactgcattt

SEQ ID NO: 981525 - DNA, 13 bp, Homo sapiens
attccaaaaacat

SEQ ID NO: 981526 - DNA, 21 bp, Homo sapiens
attccaaaatacaatgttatc

SEQ ID NO: 981527 - DNA, 21 bp, Homo sapiens
attccaaaccaaattttaatt

SEQ ID NO: 981528 - DNA, 20 bp, Homo sapiens
attccaaagcaaaaccagaa

SEQ ID NO: 981529 - DNA, 21 bp, Homo sapiens
attccaaagctttattaccag

SEQ ID NO: 981530 - DNA, 23 bp, Homo sapiens
attccaaataaaacttgagccca

SEQ ID NO: 981531 - DNA, 13 bp, Homo sapiens
attccaaattcat

SEQ ID NO: 981532 - DNA, 20 bp, Homo sapiens
attccaaatttttttcttag

SEQ ID NO: 981533 - DNA, 20 bp, Homo sapiens
attccaacagctcaagtctt

SEQ ID NO: 981534 - DNA, 14 bp, Homo sapiens
attccaacccagcc

SEQ ID NO: 981535 - DNA, 14 bp, Homo sapiens
attccaactcctga

SEQ ID NO: 981536 - DNA, 22 bp, Homo sapiens
attccaagacatgtctgttcta

SEQ ID NO: 981537 - DNA, 19 bp, Homo sapiens
attccaagccttattttga

SEQ ID NO: 981538 - DNA, 18 bp, Homo sapiens
attccaaggaaaattgaa

SEQ ID NO: 981539 - DNA, 21 bp, Homo sapiens
attccaagtcaacactcttct

SEQ ID NO: 981540 - DNA, 14 bp, Homo sapiens
attccaagtctcca

SEQ ID NO: 981541 - DNA, 20 bp, Homo sapiens
attctctttaaaaaagactg

SEQ ID NO: 981542 - DNA, 17 bp, Homo sapiens
attctctttaactgtgt

SEQ ID NO: 981543 - DNA, 19 bp, Homo sapiens
attctctttaactgtgtga

SEQ ID NO: 981544 - DNA, 15 bp, Homo sapiens
attctgaaatacttt

SEQ ID NO: 981545 - DNA, 16 bp, Homo sapiens
attctgacatgtaaga

SEQ ID NO: 981546 - DNA, 18 bp, Homo sapiens
attctgactcggtttctc

SEQ ID NO: 981547 - DNA, 17 bp, Homo sapiens
attctgaggaagtctta

SEQ ID NO: 981548 - DNA, 15 bp, Homo sapiens
attctgaggccctgc

SEQ ID NO: 981549 - DNA, 18 bp, Homo sapiens
attctgaggccctgccca

SEQ ID NO: 981550 - DNA, 13 bp, Homo sapiens
attctgaggcctg

SEQ ID NO: 981551 - DNA, 22 bp, Homo sapiens
attctgataatttaaaatccat

SEQ ID NO: 981552 - DNA, 15 bp, Homo sapiens
attctgataggaggg

SEQ ID NO: 981553 - DNA, 17 bp, Homo sapiens
attctgataggaggggg

SEQ ID NO: 981554 - DNA, 15 bp, Homo sapiens
attctgatcctcagc

SEQ ID NO: 981555 - DNA, 23 bp, Homo sapiens
attctgatcctcagcccctccag

SEQ ID NO: 981556 - DNA, 12 bp, Homo sapiens
attctgattcag

SEQ ID NO: 981557 - DNA, 21 bp, Homo sapiens
attctgattcgaatgacactg

SEQ ID NO: 981558 - DNA, 13 bp, Homo sapiens
attctgattcttt

SEQ ID NO: 981559 - DNA, 12 bp, Homo sapiens
attctgatttca

SEQ ID NO: 981560 - DNA, 23 bp, Homo sapiens
attctgatttcagtttttcattt

SEQ ID NO: 981561 - DNA, 14 bp, Homo sapiens
attctgcaagtttc

SEQ ID NO: 981562 - DNA, 18 bp, Homo sapiens
attctgcaagtttctgtt

SEQ ID NO: 981563 - DNA, 11 bp, Homo sapiens
attctgcacca

SEQ ID NO: 981564 - DNA, 15 bp, Homo sapiens
attctgcatgtacta

SEQ ID NO: 981565 - DNA, 22 bp, Homo sapiens
attctgccgccccctcctgaac

SEQ ID NO: 981566 - DNA, 17 bp, Homo sapiens
attctgcctagagtgta

SEQ ID NO: 981567 - DNA, 15 bp, Homo sapiens
attctgcctctctgg

SEQ ID NO: 981568 - DNA, 17 bp, Homo sapiens
attctgcctctctggaa

SEQ ID NO: 981569 - DNA, 20 bp, Homo sapiens
attctgcctgcctcctccct

SEQ ID NO: 981570 - DNA, 22 bp, Homo sapiens
attctgccttggttctggccac

SEQ ID NO: 981571 - DNA, 19 bp, Homo sapiens
attctgctacctcactggg

SEQ ID NO: 981572 - DNA, 17 bp, Homo sapiens
attctgctgcttctcca

SEQ ID NO: 981573 - DNA, 13 bp, Homo sapiens
attctggaagctg

SEQ ID NO: 981574 - DNA, 13 bp, Homo sapiens
attctggaaggaa

SEQ ID NO: 981575 - DNA, 20 bp, Homo sapiens
attctggaggggagagcttt

SEQ ID NO: 981576 - DNA, 18 bp, Homo sapiens
attctggatctcctgctg

SEQ ID NO: 981577 - DNA, 22 bp, Homo sapiens
attctggatggatttgaagcaa

SEQ ID NO: 981578 - DNA, 22 bp, Homo sapiens
attctggcggagatgggtcctg

SEQ ID NO: 981579 - DNA, 19 bp, Homo sapiens
attctgggaggcaagaaaa

SEQ ID NO: 981580 - DNA, 21 bp, Homo sapiens
attctgggaggcaagaaaagg

SEQ ID NO: 981581 - DNA, 22 bp, Homo sapiens
attctgggaggcaagaaaagga

SEQ ID NO: 981582 - DNA, 24 bp, Homo sapiens
attctgggcaccacaaaatataca

SEQ ID NO: 981583 - DNA, 19 bp, Homo sapiens
attctgggctcctggaacc

SEQ ID NO: 981584 - DNA, 21 bp, Homo sapiens
attctgggctcctggaaccaa

SEQ ID NO: 981585 - DNA, 23 bp, Homo sapiens
attctgggctcctggaaccaatc

SEQ ID NO: 981586 - DNA, 23 bp, Homo sapiens
attctgggggcccgacaggtggg

SEQ ID NO: 981587 - DNA, 21 bp, Homo sapiens
attctgggtttgcccagtcct

SEQ ID NO: 981588 - DNA, 16 bp, Homo sapiens
attctggtatacattg

SEQ ID NO: 981589 - DNA, 19 bp, Homo sapiens
attctggtgaccagacttt

SEQ ID NO: 981590 - DNA, 14 bp, Homo sapiens
attctggtgtttac

SEQ ID NO: 981591 - DNA, 20 bp, Homo sapiens
attctgtaaaatgtctgtta

SEQ ID NO: 981592 - DNA, 14 bp, Homo sapiens
attctgtaattaca

SEQ ID NO: 981593 - DNA, 15 bp, Homo sapiens
attctgtatccttaa

SEQ ID NO: 981594 - DNA, 15 bp, Homo sapiens
attctgtcttgttca

SEQ ID NO: 981595 - DNA, 20 bp, Homo sapiens
attctgtgaccaaaatacct

SEQ ID NO: 981596 - DNA, 20 bp, Homo sapiens
attctgtgccttgttttttg

SEQ ID NO: 981597 - DNA, 16 bp, Homo sapiens
attctgtggttctata

SEQ ID NO: 981598 - DNA, 10 bp, Homo sapiens
attctgtgtc

SEQ ID NO: 981599 - DNA, 11 bp, Homo sapiens
attctgtgttg

SEQ ID NO: 981600 - DNA, 13 bp, Homo sapiens
attctgtgttgaa

SEQ ID NO: 981601 - DNA, 19 bp, Homo sapiens
attctgttaaaaaaataaa

SEQ ID NO: 981602 - DNA, 15 bp, Homo sapiens
attctgttgctttac

SEQ ID NO: 981603 - DNA, 13 bp, Homo sapiens
attctgttggaag

SEQ ID NO: 981604 - DNA, 14 bp, Homo sapiens
attctgttgttcca

SEQ ID NO: 981605 - DNA, 23 bp, Homo sapiens
attctgttgttccattttatgca

SEQ ID NO: 981606 - DNA, 12 bp, Homo sapiens
attctgtttctt

SEQ ID NO: 981607 - DNA, 19 bp, Homo sapiens
attctgttttcccccagca

SEQ ID NO: 981608 - DNA, 13 bp, Homo sapiens
attctgttttctt

SEQ ID NO: 981609 - DNA, 13 bp, Homo sapiens
attctgttttgca

SEQ ID NO: 981610 - DNA, 14 bp, Homo sapiens
attctgttttgtta

SEQ ID NO: 981611 - DNA, 19 bp, Homo sapiens
attctgttttgttaatata

SEQ ID NO: 981612 - DNA, 23 bp, Homo sapiens
attcttaacacagccttccttct

SEQ ID NO: 981613 - DNA, 24 bp, Homo sapiens
attcttaacacagccttccttctg

SEQ ID NO: 981614 - DNA, 14 bp, Homo sapiens
attcttaagcactt

SEQ ID NO: 981615 - DNA, 18 bp, Homo sapiens
attcttacaattgcactg

SEQ ID NO: 981616 - DNA, 22 bp, Homo sapiens
attcttacaattgcactgctgt

SEQ ID NO: 981617 - DNA, 13 bp, Homo sapiens
attcttactaaaa

SEQ ID NO: 981618 - DNA, 17 bp, Homo sapiens
attcttactaaaaagta

SEQ ID NO: 981619 - DNA, 22 bp, Homo sapiens
attcttactaaaaagtataaaa

SEQ ID NO: 981620 - DNA, 20 bp, Homo sapiens
attcttagctgtaacttaac

SEQ ID NO: 981621 - DNA, 13 bp, Homo sapiens
attcttaggcaga

SEQ ID NO: 981622 - DNA, 13 bp, Homo sapiens
attcttatgctta

SEQ ID NO: 981623 - DNA, 14 bp, Homo sapiens
attcttatgcttat

SEQ ID NO: 981624 - DNA, 14 bp, Homo sapiens
attcttattggaaa

SEQ ID NO: 981625 - DNA, 14 bp, Homo sapiens
attcttatttaatg

SEQ ID NO: 981626 - DNA, 16 bp, Homo sapiens
attcttattttttaaa

SEQ ID NO: 981627 - DNA, 17 bp, Homo sapiens
attcttcacctgttatg

SEQ ID NO: 981628 - DNA, 16 bp, Homo sapiens
attcttcacctttgta

SEQ ID NO: 981629 - DNA, 19 bp, Homo sapiens
attcttcacctttgtaaga

SEQ ID NO: 981630 - DNA, 13 bp, Homo sapiens
attcttcagcttg

SEQ ID NO: 981631 - DNA, 17 bp, Homo sapiens
attcttcagtgtctctg

SEQ ID NO: 981632 - DNA, 13 bp, Homo sapiens
attcttccagaat

SEQ ID NO: 981633 - DNA, 17 bp, Homo sapiens
attcttccatcatcact

SEQ ID NO: 981634 - DNA, 18 bp, Homo sapiens
attcttccatcatcactg

SEQ ID NO: 981635 - DNA, 19 bp, Homo sapiens
attcttccatcatcactgt

SEQ ID NO: 981636 - DNA, 22 bp, Homo sapiens
attcttccatcatcactgtaaa

SEQ ID NO: 981637 - DNA, 13 bp, Homo sapiens
attcttcctctcc

SEQ ID NO: 981638 - DNA, 20 bp, Homo sapiens
attcttcctctccttcccac

SEQ ID NO: 981639 - DNA, 21 bp, Homo sapiens
attcttctaggggtagctggt

SEQ ID NO: 981640 - DNA, 22 bp, Homo sapiens
attcttctaggggtagctggtg

SEQ ID NO: 981641 - DNA, 13 bp, Homo sapiens
attcttctgaact

SEQ ID NO: 981642 - DNA, 14 bp, Homo sapiens
attcttctgtattt

SEQ ID NO: 981643 - DNA, 17 bp, Homo sapiens
attcttctgtatttcta

SEQ ID NO: 981644 - DNA, 16 bp, Homo sapiens
attcttgagacccaaa

SEQ ID NO: 981645 - DNA, 14 bp, Homo sapiens
attcttgagttttg

SEQ ID NO: 981646 - DNA, 18 bp, Homo sapiens
attcttgagttttgataa

SEQ ID NO: 981647 - DNA, 15 bp, Homo sapiens
attcttgagtttttg

SEQ ID NO: 981648 - DNA, 15 bp, Homo sapiens
attcttgattcctgg

SEQ ID NO: 981649 - DNA, 19 bp, Homo sapiens
attcttgatttatttgctt

SEQ ID NO: 981650 - DNA, 21 bp, Homo sapiens
attcttgatttatttgcttct

SEQ ID NO: 981651 - DNA, 17 bp, Homo sapiens
attcttggaccatgcca

SEQ ID NO: 981652 - DNA, 15 bp, Homo sapiens
attcttgggaaacac

SEQ ID NO: 981653 - DNA, 16 bp, Homo sapiens
attcttggttcttatt

SEQ ID NO: 981654 - DNA, 19 bp, Homo sapiens
attcttggttcttatttaa

SEQ ID NO: 981655 - DNA, 18 bp, Homo sapiens
attcttggttgaggaaac

SEQ ID NO: 981656 - DNA, 13 bp, Homo sapiens
attcttgtaaatc

SEQ ID NO: 981657 - DNA, 14 bp, Homo sapiens
attcttgtaaatct

SEQ ID NO: 981658 - DNA, 15 bp, Homo sapiens
attcttgtaaatctt

SEQ ID NO: 981659 - DNA, 19 bp, Homo sapiens
attcttgtaaatctttttg

SEQ ID NO: 981660 - DNA, 21 bp, Homo sapiens
attcttgtaaatctttttgct

SEQ ID NO: 981661 - DNA, 18 bp, Homo sapiens
attcttgtcacaataaat

SEQ ID NO: 981662 - DNA, 15 bp, Homo sapiens
attcttgtccacatt

SEQ ID NO: 981663 - DNA, 14 bp, Homo sapiens
attgctgccaaaac

SEQ ID NO: 981664 - DNA, 17 bp, Homo sapiens
attgctgccaaaaccac

SEQ ID NO: 981665 - DNA, 19 bp, Homo sapiens
attgctgccaaaaccacat

SEQ ID NO: 981666 - DNA, 23 bp, Homo sapiens
attgctgccaaaaccacatgggc

SEQ ID NO: 981667 - DNA, 20 bp, Homo sapiens
attgctgccccatcagtgct

SEQ ID NO: 981668 - DNA, 14 bp, Homo sapiens
attgctgcttggat

SEQ ID NO: 981669 - DNA, 18 bp, Homo sapiens
attgctggaaaccaagtc

SEQ ID NO: 981670 - DNA, 20 bp, Homo sapiens
attgctggaacccaggaggt

SEQ ID NO: 981671 - DNA, 16 bp, Homo sapiens
attgctggtgcaaaga

SEQ ID NO: 981672 - DNA, 14 bp, Homo sapiens
attgctggttctat

SEQ ID NO: 981673 - DNA, 14 bp, Homo sapiens
attgctgtgtctcc

SEQ ID NO: 981674 - DNA, 21 bp, Homo sapiens
attgctgttgtccctctgcta

SEQ ID NO: 981675 - DNA, 17 bp, Homo sapiens
attgcttaaaatagcaa

SEQ ID NO: 981676 - DNA, 21 bp, Homo sapiens
attgcttacaagcctaagaat

SEQ ID NO: 981677 - DNA, 13 bp, Homo sapiens
attgcttacattt

SEQ ID NO: 981678 - DNA, 16 bp, Homo sapiens
attgcttacattttta

SEQ ID NO: 981679 - DNA, 18 bp, Homo sapiens
attgcttatctgaaatgc

SEQ ID NO: 981680 - DNA, 17 bp, Homo sapiens
attgcttcaattaaaat

SEQ ID NO: 981681 - DNA, 22 bp, Homo sapiens
attgcttctgtagtactcctta

SEQ ID NO: 981682 - DNA, 22 bp, Homo sapiens
attgcttcttctcctatgtgta

SEQ ID NO: 981683 - DNA, 17 bp, Homo sapiens
attgcttgagcccagga

SEQ ID NO: 981684 - DNA, 21 bp, Homo sapiens
attgctttaatttgatgggaa

SEQ ID NO: 981685 - DNA, 14 bp, Homo sapiens
attgctttccactg

SEQ ID NO: 981686 - DNA, 11 bp, Homo sapiens
attgctttctg

SEQ ID NO: 981687 - DNA, 15 bp, Homo sapiens
attgctttctgaaat

SEQ ID NO: 981688 - DNA, 16 bp, Homo sapiens
attgctttctgaaatt

SEQ ID NO: 981689 - DNA, 23 bp, Homo sapiens
attgctttgaagcagttgtgtca

SEQ ID NO: 981690 - DNA, 22 bp, Homo sapiens
attgctttgctgcacagcagga

SEQ ID NO: 981691 - DNA, 21 bp, Homo sapiens
attgcttttgttgtgactttt

SEQ ID NO: 981692 - DNA, 23 bp, Homo sapiens
attgcttttttccaaaacaaaaa

SEQ ID NO: 981693 - DNA, 15 bp, Homo sapiens
attggaaaagggcac

SEQ ID NO: 981694 - DNA, 14 bp, Homo sapiens
attggaaatgtact

SEQ ID NO: 981695 - DNA, 16 bp, Homo sapiens
attggaacagaatgtt

SEQ ID NO: 981696 - DNA, 22 bp, Homo sapiens
attggaactctactcaacccat

SEQ ID NO: 981697 - DNA, 23 bp, Homo sapiens
attggaactctactcaacccatt

SEQ ID NO: 981698 - DNA, 14 bp, Homo sapiens
attggaagaaattc

SEQ ID NO: 981699 - DNA, 14 bp, Homo sapiens
attggaagacttgg

SEQ ID NO: 981700 - DNA, 14 bp, Homo sapiens
attggaagagcccg

SEQ ID NO: 981701 - DNA, 20 bp, Homo sapiens
attggaatcttcacctcaga

SEQ ID NO: 981702 - DNA, 18 bp, Homo sapiens
attggaatgcagaggtct

SEQ ID NO: 981703 - DNA, 14 bp, Homo sapiens
attggaatgccttg

SEQ ID NO: 981704 - DNA, 19 bp, Homo sapiens
attggaatggaactactgt

SEQ ID NO: 981705 - DNA, 14 bp, Homo sapiens
attggaattaacct

SEQ ID NO: 981706 - DNA, 19 bp, Homo sapiens
attggaattaacctggtgc

SEQ ID NO: 981707 - DNA, 20 bp, Homo sapiens
attggacggtttctagcctc

SEQ ID NO: 981708 - DNA, 23 bp, Homo sapiens
attggagaatactttgcttcata

SEQ ID NO: 981709 - DNA, 22 bp, Homo sapiens
attggagcacctgggccccact

SEQ ID NO: 981710 - DNA, 13 bp, Homo sapiens
attggagggaaga

SEQ ID NO: 981711 - DNA, 23 bp, Homo sapiens
attggagggtgggagagcccagc

SEQ ID NO: 981712 - DNA, 11 bp, Homo sapiens
attggatattt

SEQ ID NO: 981713 - DNA, 16 bp, Homo sapiens
attggatcaagtatta

SEQ ID NO: 981714 - DNA, 21 bp, Homo sapiens
attggattattcatttaaaat

SEQ ID NO: 981715 - DNA, 21 bp, Homo sapiens
attggattgcgcctttgtatt

SEQ ID NO: 981716 - DNA, 23 bp, Homo sapiens
attggcaatgggccgtcccctct

SEQ ID NO: 981717 - DNA, 15 bp, Homo sapiens
attggcaccatgtgc

SEQ ID NO: 981718 - DNA, 18 bp, Homo sapiens
attggcacccctttctag

SEQ ID NO: 981719 - DNA, 21 bp, Homo sapiens
attggcagccaaggaatgtgt

SEQ ID NO: 981720 - DNA, 22 bp, Homo sapiens
attggcagctcaaagacttcca

SEQ ID NO: 981721 - DNA, 23 bp, Homo sapiens
attggcatggctttatttgtttt

SEQ ID NO: 981722 - DNA, 13 bp, Homo sapiens
attggccactggg

SEQ ID NO: 981723 - DNA, 14 bp, Homo sapiens
attggccagcaaaa

SEQ ID NO: 981724 - DNA, 12 bp, Homo sapiens
attggcctgttc

SEQ ID NO: 981725 - DNA, 18 bp, Homo sapiens
attggctatttaaaactt

SEQ ID NO: 981726 - DNA, 21 bp, Homo sapiens
attggctcacccaagcaaggc

SEQ ID NO: 981727 - DNA, 23 bp, Homo sapiens
attggctgatctatgcctttcaa

SEQ ID NO: 981728 - DNA, 23 bp, Homo sapiens
attggctttaaacacccttcaca

SEQ ID NO: 981729 - DNA, 18 bp, Homo sapiens
attgggaagctgggggaa

SEQ ID NO: 981730 - DNA, 15 bp, Homo sapiens
attgggacaacagtg

SEQ ID NO: 981731 - DNA, 15 bp, Homo sapiens
attgggagacaatta

SEQ ID NO: 981732 - DNA, 21 bp, Homo sapiens
attgggagcttgggaatggat

SEQ ID NO: 981733 - DNA, 15 bp, Homo sapiens
attgggattgggggg

SEQ ID NO: 981734 - DNA, 18 bp, Homo sapiens
attgggcaagtgattgaa

SEQ ID NO: 981735 - DNA, 17 bp, Homo sapiens
attgggcacagtccaga

SEQ ID NO: 981736 - DNA, 21 bp, Homo sapiens
attgggcactatttatttaca

SEQ ID NO: 981737 - DNA, 16 bp, Homo sapiens
attgggccagcttttc

SEQ ID NO: 981738 - DNA, 19 bp, Homo sapiens
attgggccttttggatatg

SEQ ID NO: 981739 - DNA, 15 bp, Homo sapiens
attgggctgcaggct

SEQ ID NO: 981740 - DNA, 19 bp, Homo sapiens
attggggaattaaatagtg

SEQ ID NO: 981741 - DNA, 13 bp, Homo sapiens
attggggagggag

SEQ ID NO: 981742 - DNA, 22 bp, Homo sapiens
attgggggctggtgccagcctt

SEQ ID NO: 981743 - DNA, 20 bp, Homo sapiens
attggggttgagagggaaaa

SEQ ID NO: 981744 - DNA, 13 bp, Homo sapiens
attgggttcatta

SEQ ID NO: 981745 - DNA, 20 bp, Homo sapiens
attggtaaggcctctggact

SEQ ID NO: 981746 - DNA, 15 bp, Homo sapiens
attggtaattaaaag

SEQ ID NO: 981747 - DNA, 23 bp, Homo sapiens
attggtaattaaaagactccaca

SEQ ID NO: 981748 - DNA, 17 bp, Homo sapiens
attggtagtgtgggaat

SEQ ID NO: 981749 - DNA, 17 bp, Homo sapiens
attggtatcaagaaagt

SEQ ID NO: 981750 - DNA, 17 bp, Homo sapiens
attggtccagcttgctc

SEQ ID NO: 981751 - DNA, 18 bp, Homo sapiens
attggtcttaatgttgaa

SEQ ID NO: 981752 - DNA, 15 bp, Homo sapiens
attggtgactcactt

SEQ ID NO: 981753 - DNA, 16 bp, Homo sapiens
attggtgctatttgaa

SEQ ID NO: 981754 - DNA, 17 bp, Homo sapiens
attggtgctatttgaag

SEQ ID NO: 981755 - DNA, 13 bp, Homo sapiens
attggtgcttcag

SEQ ID NO: 981756 - DNA, 18 bp, Homo sapiens
attggtgggattttttgt

SEQ ID NO: 981757 - DNA, 13 bp, Homo sapiens
attggtgtatatc

SEQ ID NO: 981758 - DNA, 13 bp, Homo sapiens
attggtgtatatt

SEQ ID NO: 981759 - DNA, 20 bp, Homo sapiens
attggtgttcgtttccatca

SEQ ID NO: 981760 - DNA, 23 bp, Homo sapiens
attggtgttcgtttccatcatgt

SEQ ID NO: 981761 - DNA, 13 bp, Homo sapiens
attggttcttccc

SEQ ID NO: 981762 - DNA, 16 bp, Homo sapiens
attggttggtgtgaag

SEQ ID NO: 981763 - DNA, 18 bp, Homo sapiens
attggttggtgtgaagaa

SEQ ID NO: 981764 - DNA, 15 bp, Homo sapiens
attggtttaaagaaa

SEQ ID NO: 981765 - DNA, 22 bp, Homo sapiens
attggttttccaatcatttgac

SEQ ID NO: 981766 - DNA, 15 bp, Homo sapiens
attgtaaaaatggca

SEQ ID NO: 981767 - DNA, 13 bp, Homo sapiens
attgtaaaacatt

SEQ ID NO: 981768 - DNA, 23 bp, Homo sapiens
attgtaaaaccccatctctacta

SEQ ID NO: 981769 - DNA, 21 bp, Homo sapiens
attgtaaaacctgtcaatgat

SEQ ID NO: 981770 - DNA, 13 bp, Homo sapiens
attgtaaaagcat

SEQ ID NO: 981771 - DNA, 20 bp, Homo sapiens
attgtaaaagcattttgtaa

SEQ ID NO: 981772 - DNA, 17 bp, Homo sapiens
attgtaaaataattctg

SEQ ID NO: 981773 - DNA, 22 bp, Homo sapiens
attgtaaaatagcttgtatagt

SEQ ID NO: 981774 - DNA, 14 bp, Homo sapiens
attgtaaacaaact

SEQ ID NO: 981775 - DNA, 17 bp, Homo sapiens
attgtaaacaaactctt

SEQ ID NO: 981776 - DNA, 15 bp, Homo sapiens
attgtaaactttttc

SEQ ID NO: 981777 - DNA, 19 bp, Homo sapiens
attgtaaagtatgtgagta

SEQ ID NO: 981778 - DNA, 13 bp, Homo sapiens
attgtaaatactg

SEQ ID NO: 981779 - DNA, 15 bp, Homo sapiens
attgtaaatactgga

SEQ ID NO: 981780 - DNA, 14 bp, Homo sapiens
attgtaaatatttt

SEQ ID NO: 981781 - DNA, 15 bp, Homo sapiens
attgtaaatattttg

SEQ ID NO: 981782 - DNA, 16 bp, Homo sapiens
attgtaaatattttga

SEQ ID NO: 981783 - DNA, 23 bp, Homo sapiens
attgtaaatgtggattttgtaga

SEQ ID NO: 981784 - DNA, 12 bp, Homo sapiens
aaaaaacaagta

SEQ ID NO: 981785 - DNA, 19 bp, Homo sapiens
aaaaaacatacttacattt

SEQ ID NO: 981786 - DNA, 15 bp, Homo sapiens
aaaaaaccttgtaaa

SEQ ID NO: 981787 - DNA, 12 bp, Homo sapiens
aaaaaactgaag

SEQ ID NO: 981788 - DNA, 22 bp, Homo sapiens
aaaaaactgctgactgttttct

SEQ ID NO: 981789 - DNA, 11 bp, Homo sapiens
aaaaaactttt

SEQ ID NO: 981790 - DNA, 9 bp, Homo sapiens
aaaaaagaa

SEQ ID NO: 981791 - DNA, 11 bp, Homo sapiens
aaaaaagaaac

SEQ ID NO: 981792 - DNA, 13 bp, Homo sapiens
aaaaaagaaacga

SEQ ID NO: 981793 - DNA, 13 bp, Homo sapiens
aaaaaagaaccaa

SEQ ID NO: 981794 - DNA, 12 bp, Homo sapiens
aaaaaagactgt

SEQ ID NO: 981795 - DNA, 12 bp, Homo sapiens
aaaaaagagaca

SEQ ID NO: 981796 - DNA, 11 bp, Homo sapiens
aaaaaagatga

SEQ ID NO: 981797 - DNA, 12 bp, Homo sapiens
aaaaaagattct

SEQ ID NO: 981798 - DNA, 12 bp, Homo sapiens
aaaaaagcaaaa

SEQ ID NO: 981799 - DNA, 14 bp, Homo sapiens
aaaaaagcacaaag

SEQ ID NO: 981800 - DNA, 21 bp, Homo sapiens
aaaaaagcacaaagttctcag

SEQ ID NO: 981801 - DNA, 13 bp, Homo sapiens
aaaaaagcctcca

SEQ ID NO: 981802 - DNA, 13 bp, Homo sapiens
aaaaaaggaaaaa

SEQ ID NO: 981803 - DNA, 19 bp, Homo sapiens
aaaaaagggacagcatgcc

SEQ ID NO: 981804 - DNA, 20 bp, Homo sapiens
aaaaaagttgcagctgtttt

SEQ ID NO: 981805 - DNA, 12 bp, Homo sapiens
aaaaaagtttta

SEQ ID NO: 981806 - DNA, 10 bp, Homo sapiens
aaaaaataca

SEQ ID NO: 981807 - DNA, 11 bp, Homo sapiens
aaaaaatactt

SEQ ID NO: 981808 - DNA, 11 bp, Homo sapiens
aaaaaatatgt

SEQ ID NO: 981809 - DNA, 14 bp, Homo sapiens
aaaaaatattttaa

SEQ ID NO: 981810 - DNA, 12 bp, Homo sapiens
aaaaaatggaaa

SEQ ID NO: 981811 - DNA, 13 bp, Homo sapiens
aaaaaatgtaaca

SEQ ID NO: 981812 - DNA, 11 bp, Homo sapiens
aaaaaatgtcc

SEQ ID NO: 981813 - DNA, 11 bp, Homo sapiens
aaaaacaaaaa

SEQ ID NO: 981814 - DNA, 17 bp, Homo sapiens
aaaaacaatatctgcag

SEQ ID NO: 981815 - DNA, 15 bp, Homo sapiens
aaaaacaatcttatt

SEQ ID NO: 981816 - DNA, 20 bp, Homo sapiens
aaaaacagattctgattccc

SEQ ID NO: 981817 - DNA, 17 bp, Homo sapiens
aaaaacagcagctcata

SEQ ID NO: 981818 - DNA, 19 bp, Homo sapiens
aaaaacaggtatatacttt

SEQ ID NO: 981819 - DNA, 18 bp, Homo sapiens
aaaaacatacttacattt

SEQ ID NO: 981820 - DNA, 14 bp, Homo sapiens
aaaaacccaaaata

SEQ ID NO: 981821 - DNA, 21 bp, Homo sapiens
aaaaaccctaattttgtacat

SEQ ID NO: 981822 - DNA, 22 bp, Homo sapiens
aaaaaccctaattttgtacata

SEQ ID NO: 981823 - DNA, 16 bp, Homo sapiens
aaaaaccgaataaatg

SEQ ID NO: 981824 - DNA, 14 bp, Homo sapiens
aaaaacctcactgg

SEQ ID NO: 981825 - DNA, 22 bp, Homo sapiens
aaaaaccttgtaaaaaaagcaa

SEQ ID NO: 981826 - DNA, 11 bp, Homo sapiens
aaaaactattt

SEQ ID NO: 981827 - DNA, 16 bp, Homo sapiens
aaaaactcctgtgtcg

SEQ ID NO: 981828 - DNA, 14 bp, Homo sapiens
aaaaactcttcagt

SEQ ID NO: 981829 - DNA, 11 bp, Homo sapiens
aaaaactgaag

SEQ ID NO: 981830 - DNA, 14 bp, Homo sapiens
aaaaactgaagatg

SEQ ID NO: 981831 - DNA, 14 bp, Homo sapiens
aaaaactgtactgt

SEQ ID NO: 981832 - DNA, 20 bp, Homo sapiens
aaaaactgtctttaaaagag

SEQ ID NO: 981833 - DNA, 19 bp, Homo sapiens
aaaaacttcagtaagtacg

SEQ ID NO: 981834 - DNA, 18 bp, Homo sapiens
aaaaacttgtaaatgctg

SEQ ID NO: 981835 - DNA, 22 bp, Homo sapiens
aaaaacttgtactatgttaata

SEQ ID NO: 981836 - DNA, 17 bp, Homo sapiens
aaaaacttttataaatt

SEQ ID NO: 981837 - DNA, 18 bp, Homo sapiens
aaaaacttttataaatta

SEQ ID NO: 981838 - DNA, 10 bp, Homo sapiens
aaaaagaaaa

SEQ ID NO: 981839 - DNA, 15 bp, Homo sapiens
aaaaagaaaaaaaga

SEQ ID NO: 981840 - DNA, 13 bp, Homo sapiens
aaaaagaaaaaag

SEQ ID NO: 981841 - DNA, 14 bp, Homo sapiens
aaaaagaaaagata

SEQ ID NO: 981842 - DNA, 16 bp, Homo sapiens
aaaaagaaagagaaga

SEQ ID NO: 981843 - DNA, 12 bp, Homo sapiens
aaaaagaaatct

SEQ ID NO: 981844 - DNA, 16 bp, Homo sapiens
aaaaagaaggactgaa

SEQ ID NO: 981845 - DNA, 14 bp, Homo sapiens
aaaaagaagtaggg

SEQ ID NO: 981846 - DNA, 15 bp, Homo sapiens
aaaaagactgtcaaa

SEQ ID NO: 981847 - DNA, 22 bp, Homo sapiens
aaaaagactgtcaaatgaactt

SEQ ID NO: 981848 - DNA, 11 bp, Homo sapiens
aaaaagagact

SEQ ID NO: 981849 - DNA, 11 bp, Homo sapiens
aaaaagcaaat

SEQ ID NO: 981850 - DNA, 15 bp, Homo sapiens
aaaaagcaaatggaa

SEQ ID NO: 981851 - DNA, 15 bp, Homo sapiens
aaaaagcaagggaga

SEQ ID NO: 981852 - DNA, 23 bp, Homo sapiens
aaaaagcacaaagttctcagagc

SEQ ID NO: 981853 - DNA, 17 bp, Homo sapiens
aaaaagcactagtataa

SEQ ID NO: 981854 - DNA, 22 bp, Homo sapiens
aaaaagcagaattttaatgtga

SEQ ID NO: 981855 - DNA, 17 bp, Homo sapiens
aaaaagccagggctgga

SEQ ID NO: 981856 - DNA, 23 bp, Homo sapiens
aaaaagccagtttgggtaaaata

SEQ ID NO: 981857 - DNA, 23 bp, Homo sapiens
aaaaagcctaacaaatgggatta

SEQ ID NO: 981858 - DNA, 20 bp, Homo sapiens
aaaaagcctccaagggtttc

SEQ ID NO: 981859 - DNA, 15 bp, Homo sapiens
aaaaagcctggtttt

SEQ ID NO: 981860 - DNA, 12 bp, Homo sapiens
aaaaagccttcc

SEQ ID NO: 981861 - DNA, 13 bp, Homo sapiens
aaaaagctaacat

SEQ ID NO: 981862 - DNA, 16 bp, Homo sapiens
aaaaagctaacatctt

SEQ ID NO: 981863 - DNA, 17 bp, Homo sapiens
aaaaagctaatgtgcag

SEQ ID NO: 981864 - DNA, 19 bp, Homo sapiens
aaaaagctcaatgcattgt

SEQ ID NO: 981865 - DNA, 14 bp, Homo sapiens
aaaaagctcactgc

SEQ ID NO: 981866 - DNA, 18 bp, Homo sapiens
aaaaagctcatattttgt

SEQ ID NO: 981867 - DNA, 15 bp, Homo sapiens
aaaaagctctgaaaa

SEQ ID NO: 981868 - DNA, 15 bp, Homo sapiens
aaaaagcttaaaact

SEQ ID NO: 981869 - DNA, 19 bp, Homo sapiens
aaaaagcttaaaactttga

SEQ ID NO: 981870 - DNA, 9 bp, Homo sapiens
aaaaaggaa

SEQ ID NO: 981871 - DNA, 11 bp, Homo sapiens
aaaaaggaaaa

SEQ ID NO: 981872 - DNA, 13 bp, Homo sapiens
aaaaaggaaaaat

SEQ ID NO: 981873 - DNA, 15 bp, Homo sapiens
aaaaaggaaacttcc

SEQ ID NO: 981874 - DNA, 14 bp, Homo sapiens
aaaaaggaaatatt

SEQ ID NO: 981875 - DNA, 15 bp, Homo sapiens
aaaaaggaaattagt

SEQ ID NO: 981876 - DNA, 20 bp, Homo sapiens
aaaaaggaaatttgtttgta

SEQ ID NO: 981877 - DNA, 23 bp, Homo sapiens
aaaaaggaagtggggacagattc

SEQ ID NO: 981878 - DNA, 17 bp, Homo sapiens
aaaaaggatacataatg

SEQ ID NO: 981879 - DNA, 22 bp, Homo sapiens
aaaaaggctgctcacaagttct

SEQ ID NO: 981880 - DNA, 15 bp, Homo sapiens
aaaaagggagaaaga

SEQ ID NO: 981881 - DNA, 22 bp, Homo sapiens
aaaaagggcttgaggtgaattt

SEQ ID NO: 981882 - DNA, 14 bp, Homo sapiens
aaaaagtaacacag

SEQ ID NO: 981883 - DNA, 19 bp, Homo sapiens
aaaaagtaagttaataatg

SEQ ID NO: 981884 - DNA, 19 bp, Homo sapiens
aaaacagctgcattagaaa

SEQ ID NO: 981885 - DNA, 22 bp, Homo sapiens
aaaacaggagcaaatggcgttt

SEQ ID NO: 981886 - DNA, 22 bp, Homo sapiens
aaaacaggtagaattatctaat

SEQ ID NO: 981887 - DNA, 20 bp, Homo sapiens
aaaacatacttacatttcag

SEQ ID NO: 981888 - DNA, 16 bp, Homo sapiens
aaaacatacttcaaaa

SEQ ID NO: 981889 - DNA, 19 bp, Homo sapiens
aaaacatattcttgtgctt

SEQ ID NO: 981890 - DNA, 20 bp, Homo sapiens
aaaacatccacttaagttct

SEQ ID NO: 981891 - DNA, 21 bp, Homo sapiens
aaaacatccacttaagttctt

SEQ ID NO: 981892 - DNA, 17 bp, Homo sapiens
aaaacatcccaaacttt

SEQ ID NO: 981893 - DNA, 13 bp, Homo sapiens
aaaacatctcatc

SEQ ID NO: 981894 - DNA, 14 bp, Homo sapiens
aaaacatgctacac

SEQ ID NO: 981895 - DNA, 21 bp, Homo sapiens
aaaacatgcttgaataactga

SEQ ID NO: 981896 - DNA, 16 bp, Homo sapiens
aaaacatggtagaatt

SEQ ID NO: 981897 - DNA, 15 bp, Homo sapiens
aaaacatgtttattt

SEQ ID NO: 981898 - DNA, 19 bp, Homo sapiens
aaaacatgtttatttttct

SEQ ID NO: 981899 - DNA, 17 bp, Homo sapiens
aaaagactgtcaaatga

SEQ ID NO: 981900 - DNA, 21 bp, Homo sapiens
aaaagactgtcaaatgaactt

SEQ ID NO: 981901 - DNA, 15 bp, Homo sapiens
aaaagacttttgttg

SEQ ID NO: 981902 - DNA, 14 bp, Homo sapiens
aaaagagaaaagaa

SEQ ID NO: 981903 - DNA, 15 bp, Homo sapiens
aaaagagaacagaaa

SEQ ID NO: 981904 - DNA, 21 bp, Homo sapiens
aaaagagaccacccatatcat

SEQ ID NO: 981905 - DNA, 11 bp, Homo sapiens
aaaagagactg

SEQ ID NO: 981906 - DNA, 17 bp, Homo sapiens
aaaagagacttctctgt

SEQ ID NO: 981907 - DNA, 15 bp, Homo sapiens
aaaagagataataag

SEQ ID NO: 981908 - DNA, 21 bp, Homo sapiens
aaaagagatattttaaaatga

SEQ ID NO: 981909 - DNA, 14 bp, Homo sapiens
aaaagagccctggc

SEQ ID NO: 981910 - DNA, 16 bp, Homo sapiens
aaaatattatttgata

SEQ ID NO: 981911 - DNA, 21 bp, Homo sapiens
aaaatattgagcagaattcat

SEQ ID NO: 981912 - DNA, 14 bp, Homo sapiens
aaaatattgctaaa

SEQ ID NO: 981913 - DNA, 15 bp, Homo sapiens
aaaatattgctaaaa

SEQ ID NO: 981914 - DNA, 11 bp, Homo sapiens
aaaatattgtt

SEQ ID NO: 981915 - DNA, 14 bp, Homo sapiens
aaaatattgtttct

SEQ ID NO: 981916 - DNA, 16 bp, Homo sapiens
aaaatatttaaaaatg

SEQ ID NO: 981917 - DNA, 14 bp, Homo sapiens
aaaatatttaactt

SEQ ID NO: 981918 - DNA, 15 bp, Homo sapiens
aaaatatttaacttt

SEQ ID NO: 981919 - DNA, 14 bp, Homo sapiens
aaaatatttaagtg

SEQ ID NO: 981920 - DNA, 11 bp, Homo sapiens
aaaatatttat

SEQ ID NO: 981921 - DNA, 13 bp, Homo sapiens
aaaatatttataa

SEQ ID NO: 981922 - DNA, 14 bp, Homo sapiens
aaaatatttcagat

SEQ ID NO: 981923 - DNA, 20 bp, Homo sapiens
aaaatatttcagatatcaaa

SEQ ID NO: 981924 - DNA, 11 bp, Homo sapiens
aaaatatttcc

SEQ ID NO: 981925 - DNA, 20 bp, Homo sapiens
aaaatatttcccctagtttt

SEQ ID NO: 981926 - DNA, 21 bp, Homo sapiens
aaaatatttcctgacttgagt

SEQ ID NO: 981927 - DNA, 18 bp, Homo sapiens
aaaatattttaagaaaga

SEQ ID NO: 981928 - DNA, 19 bp, Homo sapiens
aaaatattttaagaaagag

SEQ ID NO: 981929 - DNA, 21 bp, Homo sapiens
aaaatattttaagaaagagaa

SEQ ID NO: 981930 - DNA, 12 bp, Homo sapiens
aaaatattttga

SEQ ID NO: 981931 - DNA, 20 bp, Homo sapiens
aaaatattttggaataagca

SEQ ID NO: 981932 - DNA, 12 bp, Homo sapiens
aaaatattttgt

SEQ ID NO: 981933 - DNA, 16 bp, Homo sapiens
aaaatattttgtctaa

SEQ ID NO: 981934 - DNA, 20 bp, Homo sapiens
aaaatattttgtctaaaatg

SEQ ID NO: 981935 - DNA, 13 bp, Homo sapiens
aaaatattttttg

SEQ ID NO: 981936 - DNA, 12 bp, Homo sapiens
aaaatcaagagt

SEQ ID NO: 981937 - DNA, 18 bp, Homo sapiens
aaaatcaatatgcagaat

SEQ ID NO: 981938 - DNA, 15 bp, Homo sapiens
aaaatcacaaaaaca

SEQ ID NO: 981939 - DNA, 18 bp, Homo sapiens
aaaatcacattttaagtg

SEQ ID NO: 981940 - DNA, 13 bp, Homo sapiens
aaaatcacttcag

SEQ ID NO: 981941 - DNA, 22 bp, Homo sapiens
aaaatcagaacagggctatttg

SEQ ID NO: 981942 - DNA, 18 bp, Homo sapiens
aaaatcatattgcttctt

SEQ ID NO: 981943 - DNA, 20 bp, Homo sapiens
aaaatcatcaagaagggctg

SEQ ID NO: 981944 - DNA, 23 bp, Homo sapiens
aaaatcatcaagaagggctgcat

SEQ ID NO: 981945 - DNA, 17 bp, Homo sapiens
aaaatcatgccagtatt

SEQ ID NO: 981946 - DNA, 14 bp, Homo sapiens
aaaatcatgtgaca

SEQ ID NO: 981947 - DNA, 22 bp, Homo sapiens
aaaatcatgtgctcagaagagg

SEQ ID NO: 981948 - DNA, 20 bp, Homo sapiens
aaaatcattttatatgtcaa

SEQ ID NO: 981949 - DNA, 13 bp, Homo sapiens
aaaatccacagct

SEQ ID NO: 981950 - DNA, 22 bp, Homo sapiens
aaaatccccttcgctgaaattg

SEQ ID NO: 981951 - DNA, 22 bp, Homo sapiens
aaaatcccttacctcggtgcct

SEQ ID NO: 981952 - DNA, 18 bp, Homo sapiens
aaaatcctatatctgttt

SEQ ID NO: 981953 - DNA, 20 bp, Homo sapiens
aaaatcctcaacactattgt

SEQ ID NO: 981954 - DNA, 13 bp, Homo sapiens
aaaatccttgctt

SEQ ID NO: 981955 - DNA, 20 bp, Homo sapiens
aaaatccttgcttatgacat

SEQ ID NO: 981956 - DNA, 18 bp, Homo sapiens
aaaatctaaaatttcata

SEQ ID NO: 981957 - DNA, 23 bp, Homo sapiens
aaaatctaatattaaaaatatgg

SEQ ID NO: 981958 - DNA, 19 bp, Homo sapiens
aaaatctagttttttttgt

SEQ ID NO: 981959 - DNA, 21 bp, Homo sapiens
aaaatctatatttgtcttccg

SEQ ID NO: 981960 - DNA, 23 bp, Homo sapiens
aaaatctatatttgtcttccgat

SEQ ID NO: 981961 - DNA, 19 bp, Homo sapiens
aaaatctcaaatttctaaa

SEQ ID NO: 981962 - DNA, 22 bp, Homo sapiens
aaaatctcaaatttctaaatct

SEQ ID NO: 981963 - DNA, 11 bp, Homo sapiens
aaaatctccta

SEQ ID NO: 981964 - DNA, 16 bp, Homo sapiens
aaaatctcttgattat

SEQ ID NO: 981965 - DNA, 21 bp, Homo sapiens
aaaatctcttgattataaatg

SEQ ID NO: 981966 - DNA, 18 bp, Homo sapiens
aaaatctgaactctcaaa

SEQ ID NO: 981967 - DNA, 16 bp, Homo sapiens
aaaatctgagaaactc

SEQ ID NO: 981968 - DNA, 21 bp, Homo sapiens
aaaatctgagggaaatgtttt

SEQ ID NO: 981969 - DNA, 16 bp, Homo sapiens
aaaatctgattagaag

SEQ ID NO: 981970 - DNA, 14 bp, Homo sapiens
aaaatctgatttaa

SEQ ID NO: 981971 - DNA, 15 bp, Homo sapiens
aaaatctgatttaat

SEQ ID NO: 981972 - DNA, 17 bp, Homo sapiens
aaaatctgatttaatgt

SEQ ID NO: 981973 - DNA, 17 bp, Homo sapiens
aaaatctgctgttaact

SEQ ID NO: 981974 - DNA, 13 bp, Homo sapiens
aaaatctggaaat

SEQ ID NO: 981975 - DNA, 20 bp, Homo sapiens
aaaatctgtcacgtagaact

SEQ ID NO: 981976 - DNA, 13 bp, Homo sapiens
aaaatctgttggt

SEQ ID NO: 981977 - DNA, 15 bp, Homo sapiens
aaaatcttcatggaa

SEQ ID NO: 981978 - DNA, 18 bp, Homo sapiens
aaaatcttgatcagttaa

SEQ ID NO: 981979 - DNA, 18 bp, Homo sapiens
aaaatcttgcagttttgt

SEQ ID NO: 981980 - DNA, 19 bp, Homo sapiens
aaaatcttgcagttttgta

SEQ ID NO: 981981 - DNA, 20 bp, Homo sapiens
aaaatcttgcagttttgtaa

SEQ ID NO: 981982 - DNA, 20 bp, Homo sapiens
aaaatcttggagaccctgca

SEQ ID NO: 981983 - DNA, 17 bp, Homo sapiens
aaaatcttggcacagaa

SEQ ID NO: 981984 - DNA, 22 bp, Homo sapiens
aaaatcttgtgctagaatactt

SEQ ID NO: 981985 - DNA, 14 bp, Homo sapiens
aaaatcttgttaat

SEQ ID NO: 981986 - DNA, 20 bp, Homo sapiens
aaaatcttgttaatgtcatt

SEQ ID NO: 981987 - DNA, 15 bp, Homo sapiens
aaaatgaaaactttt

SEQ ID NO: 981988 - DNA, 19 bp, Homo sapiens
aaaatgaaaacttttgtaa

SEQ ID NO: 981989 - DNA, 19 bp, Homo sapiens
aaaatgaaaagcaatacaa

SEQ ID NO: 981990 - DNA, 13 bp, Homo sapiens
aaaatgaaaatta

SEQ ID NO: 981991 - DNA, 22 bp, Homo sapiens
aaaatgaaagcatgtctcaata

SEQ ID NO: 981992 - DNA, 18 bp, Homo sapiens
aaaatgaaatgcatattt

SEQ ID NO: 981993 - DNA, 20 bp, Homo sapiens
aaaatgaacatctcttgaaa

SEQ ID NO: 981994 - DNA, 15 bp, Homo sapiens
aaaatgaatttggga

SEQ ID NO: 981995 - DNA, 16 bp, Homo sapiens
aaaatgaattttttcc

SEQ ID NO: 981996 - DNA, 18 bp, Homo sapiens
aaaatgacagatgttgaa

SEQ ID NO: 981997 - DNA, 17 bp, Homo sapiens
aaaatgactttatacaa

SEQ ID NO: 981998 - DNA, 13 bp, Homo sapiens
aaaatgactttga

SEQ ID NO: 981999 - DNA, 20 bp, Homo sapiens
aaaatgactttgaactgaaa

SEQ ID NO: 982000 - DNA, 13 bp, Homo sapiens
aaaatgagaattt

SEQ ID NO: 982001 - DNA, 22 bp, Homo sapiens
aaaatgagactttctaaatcaa

SEQ ID NO: 982002 - DNA, 14 bp, Homo sapiens
aaaatgagactttt

SEQ ID NO: 982003 - DNA, 23 bp, Homo sapiens
aaaatgagagggcagtgtttcct

SEQ ID NO: 982004 - DNA, 11 bp, Homo sapiens
aaaatgagccc

SEQ ID NO: 982005 - DNA, 15 bp, Homo sapiens
aaaatgagccctggc

SEQ ID NO: 982006 - DNA, 23 bp, Homo sapiens
aaaatgagctcgcatttgtcaat

SEQ ID NO: 982007 - DNA, 16 bp, Homo sapiens
aaaatgaggaatgtat

SEQ ID NO: 982008 - DNA, 17 bp, Homo sapiens
aaaatgatgcagctgtt

SEQ ID NO: 982009 - DNA, 14 bp, Homo sapiens
aaaatgattttatc

SEQ ID NO: 982010 - DNA, 16 bp, Homo sapiens
aaaatgcaatcaggat

SEQ ID NO: 982011 - DNA, 23 bp, Homo sapiens
aaaatgcatactgttgatacaaa

SEQ ID NO: 982012 - DNA, 16 bp, Homo sapiens
aaaatgccatgaatta

SEQ ID NO: 982013 - DNA, 17 bp, Homo sapiens
aaaatgcccttaaatca

SEQ ID NO: 982014 - DNA, 19 bp, Homo sapiens
aaaatgcctcaattcacat

SEQ ID NO: 982015 - DNA, 16 bp, Homo sapiens
aaaatgcgaaattatt

SEQ ID NO: 982016 - DNA, 19 bp, Homo sapiens
aaaatgctcaatttcagca

SEQ ID NO: 982017 - DNA, 16 bp, Homo sapiens
aaaatgctgaacattg

SEQ ID NO: 982018 - DNA, 12 bp, Homo sapiens
aaaatgctgctc

SEQ ID NO: 982019 - DNA, 14 bp, Homo sapiens
aaaatgcttctgtt

SEQ ID NO: 982020 - DNA, 19 bp, Homo sapiens
aaaatgcttctgttgtaat

SEQ ID NO: 982021 - DNA, 18 bp, Homo sapiens
aaaatgctttttatttct

SEQ ID NO: 982022 - DNA, 22 bp, Homo sapiens
aaaatgctttttatttctgcat

SEQ ID NO: 982023 - DNA, 16 bp, Homo sapiens
aaaatggaaaaaaaca

SEQ ID NO: 982024 - DNA, 20 bp, Homo sapiens
aaaatggaaaaaaacataaa

SEQ ID NO: 982025 - DNA, 13 bp, Homo sapiens
aaaatggaaagaa

SEQ ID NO: 982026 - DNA, 14 bp, Homo sapiens
aaaatggaaagaat

SEQ ID NO: 982027 - DNA, 19 bp, Homo sapiens
aaaatggacacaaattttc

SEQ ID NO: 982028 - DNA, 22 bp, Homo sapiens
aaaatggagctcagtaacataa

SEQ ID NO: 982029 - DNA, 22 bp, Homo sapiens
aaaatggatattattagaaatt

SEQ ID NO: 982030 - DNA, 19 bp, Homo sapiens
aaaatggccatttgctttt

SEQ ID NO: 982031 - DNA, 12 bp, Homo sapiens
aaagcctttaaa

SEQ ID NO: 982032 - DNA, 13 bp, Homo sapiens
aaagcgacagatt

SEQ ID NO: 982033 - DNA, 18 bp, Homo sapiens
aaagcggccgatgggagt

SEQ ID NO: 982034 - DNA, 16 bp, Homo sapiens
aaagcgggaaccctgg

SEQ ID NO: 982035 - DNA, 17 bp, Homo sapiens
aaagcgtttctttactt

SEQ ID NO: 982036 - DNA, 14 bp, Homo sapiens
aaagctaaactgaa

SEQ ID NO: 982037 - DNA, 20 bp, Homo sapiens
aaagctagtgtacctcctct

SEQ ID NO: 982038 - DNA, 22 bp, Homo sapiens
aaagctagtgtacctcctctca

SEQ ID NO: 982039 - DNA, 23 bp, Homo sapiens
aaagctagtgtacctcctctcag

SEQ ID NO: 982040 - DNA, 17 bp, Homo sapiens
aaagctatataagacaa

SEQ ID NO: 982041 - DNA, 15 bp, Homo sapiens
aaagctatggtgaga

SEQ ID NO: 982042 - DNA, 24 bp, Homo sapiens
aaagctcactgctgatcgtagaaa

SEQ ID NO: 982043 - DNA, 14 bp, Homo sapiens
aaagctcaggaggg

SEQ ID NO: 982044 - DNA, 15 bp, Homo sapiens
aaagctcaggagggt

SEQ ID NO: 982045 - DNA, 13 bp, Homo sapiens
aaagctcatattt

SEQ ID NO: 982046 - DNA, 21 bp, Homo sapiens
aaagctcatattttgtatata

SEQ ID NO: 982047 - DNA, 16 bp, Homo sapiens
aaagctcctgtcctcc

SEQ ID NO: 982048 - DNA, 13 bp, Homo sapiens
aaagctctgaaaa

SEQ ID NO: 982049 - DNA, 18 bp, Homo sapiens
aaagctgacattgccaaa

SEQ ID NO: 982050 - DNA, 15 bp, Homo sapiens
aaagctgactgtttt

SEQ ID NO: 982051 - DNA, 23 bp, Homo sapiens
aaagctgactgttttttttgcag

SEQ ID NO: 982052 - DNA, 18 bp, Homo sapiens
aaagctgagagaccctgg

SEQ ID NO: 982053 - DNA, 19 bp, Homo sapiens
aaagctgattactgtcaat

SEQ ID NO: 982054 - DNA, 22 bp, Homo sapiens
aaagctgattactgtcaataaa

SEQ ID NO: 982055 - DNA, 24 bp, Homo sapiens
aaagctgcccactgtttctcttga

SEQ ID NO: 982056 - DNA, 15 bp, Homo sapiens
aaagctgcctgtagt

SEQ ID NO: 982057 - DNA, 21 bp, Homo sapiens
aaagctgcctgtagttaggaa

SEQ ID NO: 982058 - DNA, 23 bp, Homo sapiens
aaagctgcctgtagttaggaaat

SEQ ID NO: 982059 - DNA, 18 bp, Homo sapiens
aaagctggaacatttgat

SEQ ID NO: 982060 - DNA, 23 bp, Homo sapiens
aaagctggaacatttgatatttt

SEQ ID NO: 982061 - DNA, 12 bp, Homo sapiens
aaagctgtacac

SEQ ID NO: 982062 - DNA, 18 bp, Homo sapiens
aaagctgttaaactgtta

SEQ ID NO: 982063 - DNA, 15 bp, Homo sapiens
aaagcttaaaaaaat

SEQ ID NO: 982064 - DNA, 13 bp, Homo sapiens
aaagcttaaactg

SEQ ID NO: 982065 - DNA, 17 bp, Homo sapiens
aaagcttatttttatgt

SEQ ID NO: 982066 - DNA, 20 bp, Homo sapiens
aaagcttcaaattatagaaa

SEQ ID NO: 982067 - DNA, 22 bp, Homo sapiens
aaagcttcaaattatagaaaca

SEQ ID NO: 982068 - DNA, 13 bp, Homo sapiens
aaagcttctaaag

SEQ ID NO: 982069 - DNA, 19 bp, Homo sapiens
aaagcttgatttgatcttt

SEQ ID NO: 982070 - DNA, 15 bp, Homo sapiens
aaagcttgttaagat

SEQ ID NO: 982071 - DNA, 16 bp, Homo sapiens
aaagctttatctttgt

SEQ ID NO: 982072 - DNA, 17 bp, Homo sapiens
aaagctttatctttgtg

SEQ ID NO: 982073 - DNA, 12 bp, Homo sapiens
aaagctttctgc

SEQ ID NO: 982074 - DNA, 14 bp, Homo sapiens
aaagctttgctaca

SEQ ID NO: 982075 - DNA, 18 bp, Homo sapiens
aaagctttgctacaaatt

SEQ ID NO: 982076 - DNA, 24 bp, Homo sapiens
aaagctttgctacaaatttatgca

SEQ ID NO: 982077 - DNA, 19 bp, Homo sapiens
aaagctttggctgagacct

SEQ ID NO: 982078 - DNA, 20 bp, Homo sapiens
aaagctttggctgagacctg

SEQ ID NO: 982079 - DNA, 14 bp, Homo sapiens
aaagcttttctttt

SEQ ID NO: 982080 - DNA, 17 bp, Homo sapiens
aaaggaaaaaaaacaca

SEQ ID NO: 982081 - DNA, 13 bp, Homo sapiens
aaaggaaaagaag

SEQ ID NO: 982082 - DNA, 16 bp, Homo sapiens
aaaggaaaagttaaac

SEQ ID NO: 982083 - DNA, 12 bp, Homo sapiens
aaaggaaacctt

SEQ ID NO: 982084 - DNA, 14 bp, Homo sapiens
aaaggaaacctttt

SEQ ID NO: 982085 - DNA, 15 bp, Homo sapiens
aaaggaaagctgtgt

SEQ ID NO: 982086 - DNA, 20 bp, Homo sapiens
aaaggaaagtcaagaagaat

SEQ ID NO: 982087 - DNA, 19 bp, Homo sapiens
aaaggaaatttgtttgtat

SEQ ID NO: 982088 - DNA, 16 bp, Homo sapiens
aaaggaacactggctt

SEQ ID NO: 982089 - DNA, 13 bp, Homo sapiens
aaaggaacatttt

SEQ ID NO: 982090 - DNA, 16 bp, Homo sapiens
aaaggaagacagttct

SEQ ID NO: 982091 - DNA, 12 bp, Homo sapiens
aaaggaagacta

SEQ ID NO: 982092 - DNA, 19 bp, Homo sapiens
aaaggaagagctaataaat

SEQ ID NO: 982093 - DNA, 22 bp, Homo sapiens
aaaggaagcattgtaaaataat

SEQ ID NO: 982094 - DNA, 12 bp, Homo sapiens
aaaggaagccaa

SEQ ID NO: 982095 - DNA, 14 bp, Homo sapiens
aaaggaagccaaag

SEQ ID NO: 982096 - DNA, 15 bp, Homo sapiens
aaaggaagccaaaga

SEQ ID NO: 982097 - DNA, 12 bp, Homo sapiens
aaaggaaggaaa

SEQ ID NO: 982098 - DNA, 14 bp, Homo sapiens
aaaggaagtgggga

SEQ ID NO: 982099 - DNA, 20 bp, Homo sapiens
aaaggaataacctttctgga

SEQ ID NO: 982100 - DNA, 24 bp, Homo sapiens
aaaggacaggaggaggagatggcc

SEQ ID NO: 982101 - DNA, 16 bp, Homo sapiens
aaaggacatcagcaaa

SEQ ID NO: 982102 - DNA, 20 bp, Homo sapiens
aaaggacatgaacagacact

SEQ ID NO: 982103 - DNA, 19 bp, Homo sapiens
aaaggaccagctttgagct

SEQ ID NO: 982104 - DNA, 16 bp, Homo sapiens
aaaggaccctgtttct

SEQ ID NO: 982105 - DNA, 17 bp, Homo sapiens
aaaggaccctgtttctg

SEQ ID NO: 982106 - DNA, 22 bp, Homo sapiens
aaaggaccctgtttctgtagaa

SEQ ID NO: 982107 - DNA, 22 bp, Homo sapiens
aaaggaccgttttgtattgctt

SEQ ID NO: 982108 - DNA, 21 bp, Homo sapiens
aaaggacgtaaaatttacagt

SEQ ID NO: 982109 - DNA, 13 bp, Homo sapiens
aaaggactcagtg

SEQ ID NO: 982110 - DNA, 22 bp, Homo sapiens
aaaggactgttttttcctgagc

SEQ ID NO: 982111 - DNA, 20 bp, Homo sapiens
aaaggacttcaggaacaagt

SEQ ID NO: 982112 - DNA, 14 bp, Homo sapiens
aaaggagaaaaaaa

SEQ ID NO: 982113 - DNA, 13 bp, Homo sapiens
aaaggagccttga

SEQ ID NO: 982114 - DNA, 21 bp, Homo sapiens
aaaggaggccctgttccctgg

SEQ ID NO: 982115 - DNA, 19 bp, Homo sapiens
aaaggagtttaaaaacatt

SEQ ID NO: 982116 - DNA, 21 bp, Homo sapiens
aaaggatatttaagaaaatac

SEQ ID NO: 982117 - DNA, 12 bp, Homo sapiens
aaaggatatttt

SEQ ID NO: 982118 - DNA, 24 bp, Homo sapiens
aaaggatctaagggaagatcactg

SEQ ID NO: 982119 - DNA, 18 bp, Homo sapiens
aaaggatctttgtggcca

SEQ ID NO: 982120 - DNA, 21 bp, Homo sapiens
aaaggatggtggttattttaa

SEQ ID NO: 982121 - DNA, 13 bp, Homo sapiens
aaaggatgtgatt

SEQ ID NO: 982122 - DNA, 17 bp, Homo sapiens
aaaggatgttacaagtt

SEQ ID NO: 982123 - DNA, 16 bp, Homo sapiens
aaaggatgttggtgtt

SEQ ID NO: 982124 - DNA, 18 bp, Homo sapiens
aaaggattttaccaaagc

SEQ ID NO: 982125 - DNA, 20 bp, Homo sapiens
aaaggattttaccaaagcat

SEQ ID NO: 982126 - DNA, 13 bp, Homo sapiens
aaaggcaaaagac

SEQ ID NO: 982127 - DNA, 15 bp, Homo sapiens
aaaggcaaatattga

SEQ ID NO: 982128 - DNA, 17 bp, Homo sapiens
aaaggcaaatattgaag

SEQ ID NO: 982129 - DNA, 20 bp, Homo sapiens
aaaggcaaatattgaagttg

SEQ ID NO: 982130 - DNA, 20 bp, Homo sapiens
aaaggcaattatatctatta

SEQ ID NO: 982131 - DNA, 20 bp, Homo sapiens
aaaggcagccctcacctctg

SEQ ID NO: 982132 - DNA, 23 bp, Homo sapiens
aaaggcagccctcacctctgagg

SEQ ID NO: 982133 - DNA, 11 bp, Homo sapiens
aaaggcagctg

SEQ ID NO: 982134 - DNA, 18 bp, Homo sapiens
aaaggcagctgcctctgc

SEQ ID NO: 982135 - DNA, 21 bp, Homo sapiens
aaaggcagctgcctctgctcc

SEQ ID NO: 982136 - DNA, 23 bp, Homo sapiens
aaaggcagtttgcaaaaaatgtt

SEQ ID NO: 982137 - DNA, 21 bp, Homo sapiens
aaaggcataagaccctaagcc

SEQ ID NO: 982138 - DNA, 17 bp, Homo sapiens
aaaggcatattgctttt

SEQ ID NO: 982139 - DNA, 17 bp, Homo sapiens
aaaggccaaagataaaa

SEQ ID NO: 982140 - DNA, 16 bp, Homo sapiens
aaaggccacaggagac

SEQ ID NO: 982141 - DNA, 14 bp, Homo sapiens
aaaggcccagcccc

SEQ ID NO: 982142 - DNA, 14 bp, Homo sapiens
aaaggcccagggag

SEQ ID NO: 982143 - DNA, 13 bp, Homo sapiens
aaaggccctgtgg

SEQ ID NO: 982144 - DNA, 15 bp, Homo sapiens
aaaggccctgtggtc

SEQ ID NO: 982145 - DNA, 17 bp, Homo sapiens
aaaggccgccgtgacct

SEQ ID NO: 982146 - DNA, 16 bp, Homo sapiens
aaaggcctcatctcct

SEQ ID NO: 982147 - DNA, 12 bp, Homo sapiens
aaaggcctggaa

SEQ ID NO: 982148 - DNA, 21 bp, Homo sapiens
aaaggccttcagacacatgct

SEQ ID NO: 982149 - DNA, 21 bp, Homo sapiens
aaaggcgcagtgcttctctac

SEQ ID NO: 982150 - DNA, 14 bp, Homo sapiens
aaaggctaaacata

SEQ ID NO: 982151 - DNA, 22 bp, Homo sapiens
aaaggctattttcagatgaaat

SEQ ID NO: 982152 - DNA, 12 bp, Homo sapiens
aaaggctcattt

SEQ ID NO: 982153 - DNA, 17 bp, Homo sapiens
aaaggctcatttaaaac

SEQ ID NO: 982154 - DNA, 19 bp, Homo sapiens
aaaggctcgattttgtatc

SEQ ID NO: 982155 - DNA, 23 bp, Homo sapiens
aaaggctcgattttgtatctgca

SEQ ID NO: 982156 - DNA, 16 bp, Homo sapiens
aactgtgcaacttttt

SEQ ID NO: 982157 - DNA, 13 bp, Homo sapiens
aactgtggaatat

SEQ ID NO: 982158 - DNA, 16 bp, Homo sapiens
aactgtggaatataaa

SEQ ID NO: 982159 - DNA, 12 bp, Homo sapiens
aactgtggaatt

SEQ ID NO: 982160 - DNA, 15 bp, Homo sapiens
aactgtggaatttat

SEQ ID NO: 982161 - DNA, 16 bp, Homo sapiens
aactgtggaatttatt

SEQ ID NO: 982162 - DNA, 23 bp, Homo sapiens
aactgtggaatttattggcagcc

SEQ ID NO: 982163 - DNA, 11 bp, Homo sapiens
aactgtggata

SEQ ID NO: 982164 - DNA, 13 bp, Homo sapiens
aactgtggatatt

SEQ ID NO: 982165 - DNA, 18 bp, Homo sapiens
aactgtggatattgttac

SEQ ID NO: 982166 - DNA, 21 bp, Homo sapiens
aactgtggggcttacagaaat

SEQ ID NO: 982167 - DNA, 23 bp, Homo sapiens
aactgtggggcttacagaaatga

SEQ ID NO: 982168 - DNA, 21 bp, Homo sapiens
aactgtgtacataactgaaaa

SEQ ID NO: 982169 - DNA, 23 bp, Homo sapiens
aactgtgtacataactgaaaatg

SEQ ID NO: 982170 - DNA, 14 bp, Homo sapiens
aactgtgtactgtt

SEQ ID NO: 982171 - DNA, 19 bp, Homo sapiens
aactgtgtatcattaaaat

SEQ ID NO: 982172 - DNA, 19 bp, Homo sapiens
aactgtgtgaccagcggaa

SEQ ID NO: 982173 - DNA, 15 bp, Homo sapiens
aactgtgtgattaaa

SEQ ID NO: 982174 - DNA, 18 bp, Homo sapiens
aactgtgtggactgtgat

SEQ ID NO: 982175 - DNA, 22 bp, Homo sapiens
aactgtgtgtaattgttccttt

SEQ ID NO: 982176 - DNA, 14 bp, Homo sapiens
aactgttagatgct

SEQ ID NO: 982177 - DNA, 16 bp, Homo sapiens
aactgttagatgctga

SEQ ID NO: 982178 - DNA, 14 bp, Homo sapiens
aactgttatgaaat

SEQ ID NO: 982179 - DNA, 15 bp, Homo sapiens
aactgttcccacctg

SEQ ID NO: 982180 - DNA, 19 bp, Homo sapiens
aactgttctctttaaaata

SEQ ID NO: 982181 - DNA, 14 bp, Homo sapiens
aactgttgattgca

SEQ ID NO: 982182 - DNA, 13 bp, Homo sapiens
aactgttgtataa

SEQ ID NO: 982183 - DNA, 22 bp, Homo sapiens
aactgttgtgggcgctgcttcc

SEQ ID NO: 982184 - DNA, 13 bp, Homo sapiens
aactgttttttaa

SEQ ID NO: 982185 - DNA, 13 bp, Homo sapiens
aacttaaaatatt

SEQ ID NO: 982186 - DNA, 17 bp, Homo sapiens
aacttaaagcaaaatag

SEQ ID NO: 982187 - DNA, 15 bp, Homo sapiens
aacttaaatgccccc

SEQ ID NO: 982188 - DNA, 21 bp, Homo sapiens
aacttaaatgcccccctccca

SEQ ID NO: 982189 - DNA, 14 bp, Homo sapiens
aacttaaattatgt

SEQ ID NO: 982190 - DNA, 19 bp, Homo sapiens
aacttaaattttaatttat

SEQ ID NO: 982191 - DNA, 13 bp, Homo sapiens
aacttaacatgaa

SEQ ID NO: 982192 - DNA, 15 bp, Homo sapiens
aacttaagaaacact

SEQ ID NO: 982193 - DNA, 21 bp, Homo sapiens
aacttaagcaaaggggacagc

SEQ ID NO: 982194 - DNA, 21 bp, Homo sapiens
aacttaagttggtcctttaca

SEQ ID NO: 982195 - DNA, 18 bp, Homo sapiens
aacttaatctaaatggaa

SEQ ID NO: 982196 - DNA, 20 bp, Homo sapiens
aacttaatgttctgaataat

SEQ ID NO: 982197 - DNA, 23 bp, Homo sapiens
aacttaatttgggaatttgttgt

SEQ ID NO: 982198 - DNA, 12 bp, Homo sapiens
aacttacaaaaa

SEQ ID NO: 982199 - DNA, 12 bp, Homo sapiens
aacttacacaca

SEQ ID NO: 982200 - DNA, 19 bp, Homo sapiens
aacttacacttggagcccg

SEQ ID NO: 982201 - DNA, 19 bp, Homo sapiens
aacttacattgttcaatta

SEQ ID NO: 982202 - DNA, 12 bp, Homo sapiens
aacttacatttg

SEQ ID NO: 982203 - DNA, 17 bp, Homo sapiens
aacttaccaattgatgt

SEQ ID NO: 982204 - DNA, 18 bp, Homo sapiens
aacttaccaattgatgtt

SEQ ID NO: 982205 - DNA, 21 bp, Homo sapiens
aacttaccaattgatgtttta

SEQ ID NO: 982206 - DNA, 21 bp, Homo sapiens
aacttaccaggcaccaaaaga

SEQ ID NO: 982207 - DNA, 19 bp, Homo sapiens
aacttacctgggcattctt

SEQ ID NO: 982208 - DNA, 23 bp, Homo sapiens
aacttacggatttattatataaa

SEQ ID NO: 982209 - DNA, 23 bp, Homo sapiens
aacttactgtccaccagtttata

SEQ ID NO: 982210 - DNA, 19 bp, Homo sapiens
aacttagatgttaaatgtt

SEQ ID NO: 982211 - DNA, 20 bp, Homo sapiens
aacttagatgttaaatgtta

SEQ ID NO: 982212 - DNA, 15 bp, Homo sapiens
aacttagccagagtt

SEQ ID NO: 982213 - DNA, 13 bp, Homo sapiens
aacttagctcagg

SEQ ID NO: 982214 - DNA, 13 bp, Homo sapiens
aacttagctttat

SEQ ID NO: 982215 - DNA, 23 bp, Homo sapiens
aacttagctttatttttcttttc

SEQ ID NO: 982216 - DNA, 20 bp, Homo sapiens
aacttatattgtaagaaata

SEQ ID NO: 982217 - DNA, 21 bp, Homo sapiens
aacttatattgtaagaaatac

SEQ ID NO: 982218 - DNA, 21 bp, Homo sapiens
aacttatctagaaagaaaaga

SEQ ID NO: 982219 - DNA, 21 bp, Homo sapiens
aacttatgacctcttccttta

SEQ ID NO: 982220 - DNA, 14 bp, Homo sapiens
aacttattagaaac

SEQ ID NO: 982221 - DNA, 19 bp, Homo sapiens
aactttggaaccagactct

SEQ ID NO: 982222 - DNA, 16 bp, Homo sapiens
aactttggaggcaaat

SEQ ID NO: 982223 - DNA, 15 bp, Homo sapiens
aactttggcctttgt

SEQ ID NO: 982224 - DNA, 21 bp, Homo sapiens
aactttgtctcgttcctgttg

SEQ ID NO: 982225 - DNA, 19 bp, Homo sapiens
aactttgtggatgtcttcc

SEQ ID NO: 982226 - DNA, 20 bp, Homo sapiens
aactttgtggatgtcttcct

SEQ ID NO: 982227 - DNA, 17 bp, Homo sapiens
aacttttaaaatttgtc

SEQ ID NO: 982228 - DNA, 14 bp, Homo sapiens
aacttttaaagaaa

SEQ ID NO: 982229 - DNA, 15 bp, Homo sapiens
aacttttacagaatg

SEQ ID NO: 982230 - DNA, 17 bp, Homo sapiens
aacttttacagaatgca

SEQ ID NO: 982231 - DNA, 16 bp, Homo sapiens
aacttttataaacttt

SEQ ID NO: 982232 - DNA, 17 bp, Homo sapiens
aacttttataaattaaa

SEQ ID NO: 982233 - DNA, 18 bp, Homo sapiens
aacttttataaattaaat

SEQ ID NO: 982234 - DNA, 19 bp, Homo sapiens
aacttttataaattaaata

SEQ ID NO: 982235 - DNA, 17 bp, Homo sapiens
aacttttcaatgtgatt

SEQ ID NO: 982236 - DNA, 20 bp, Homo sapiens
aacttttcaatgtgattctt

SEQ ID NO: 982237 - DNA, 13 bp, Homo sapiens
aacttttctaaga

SEQ ID NO: 982238 - DNA, 12 bp, Homo sapiens
aacttttctaga

SEQ ID NO: 982239 - DNA, 18 bp, Homo sapiens
aacttttcttaaggtttt

SEQ ID NO: 982240 - DNA, 22 bp, Homo sapiens
aacttttgactaagaattttgt

SEQ ID NO: 982241 - DNA, 15 bp, Homo sapiens
aacttttggaatcat

SEQ ID NO: 982242 - DNA, 17 bp, Homo sapiens
aacttttgtactgaatt

SEQ ID NO: 982243 - DNA, 18 bp, Homo sapiens
aacttttgtactgaattt

SEQ ID NO: 982244 - DNA, 13 bp, Homo sapiens
aacttttgtggac

SEQ ID NO: 982245 - DNA, 13 bp, Homo sapiens
aacttttgttttc

SEQ ID NO: 982246 - DNA, 14 bp, Homo sapiens
aacttttgtttttt

SEQ ID NO: 982247 - DNA, 18 bp, Homo sapiens
aacttttgttttttgggg

SEQ ID NO: 982248 - DNA, 23 bp, Homo sapiens
aactttttgttctggtccttttt

SEQ ID NO: 982249 - DNA, 18 bp, Homo sapiens
aacttttttaaattaaga

SEQ ID NO: 982250 - DNA, 16 bp, Homo sapiens
aacttttttgtggcaa

SEQ ID NO: 982251 - DNA, 21 bp, Homo sapiens
aacttttttgtggcaattagt

SEQ ID NO: 982252 - DNA, 15 bp, Homo sapiens
aacttttttgtgtat

SEQ ID NO: 982253 - DNA, 18 bp, Homo sapiens
aacttttttgtgtatgta

SEQ ID NO: 982254 - DNA, 20 bp, Homo sapiens
aacttttttgtgtatgtact

SEQ ID NO: 982255 - DNA, 22 bp, Homo sapiens
aactttttttctgtaccagtta

SEQ ID NO: 982256 - DNA, 14 bp, Homo sapiens
aacttttttttaag

SEQ ID NO: 982257 - DNA, 23 bp, Homo sapiens
aacttttttttttttaacatctt

SEQ ID NO: 982258 - DNA, 15 bp, Homo sapiens
aagaaaaaaaaaaga

SEQ ID NO: 982259 - DNA, 16 bp, Homo sapiens
aagaaaaaaaaaatat

SEQ ID NO: 982260 - DNA, 15 bp, Homo sapiens
aagaaaaaaaaagaa

SEQ ID NO: 982261 - DNA, 17 bp, Homo sapiens
aagaaaaaaaagaaagc

SEQ ID NO: 982262 - DNA, 18 bp, Homo sapiens
aagaaaaaaaataacaca

SEQ ID NO: 982263 - DNA, 15 bp, Homo sapiens
aagaaaaaaaatgta

SEQ ID NO: 982264 - DNA, 14 bp, Homo sapiens
aagaaaaaaagaaa

SEQ ID NO: 982265 - DNA, 17 bp, Homo sapiens
aagaaaaaaattgaaat

SEQ ID NO: 982266 - DNA, 20 bp, Homo sapiens
aagaaaaaaattgaaatgta

SEQ ID NO: 982267 - DNA, 12 bp, Homo sapiens
aagaaaaaacaa

SEQ ID NO: 982268 - DNA, 13 bp, Homo sapiens
aagaaaaaacaac

SEQ ID NO: 982269 - DNA, 11 bp, Homo sapiens
aagaaaaaagt

SEQ ID NO: 982270 - DNA, 14 bp, Homo sapiens
aagaaaaaatcaga

SEQ ID NO: 982271 - DNA, 12 bp, Homo sapiens
aagaaaaacaaa

SEQ ID NO: 982272 - DNA, 20 bp, Homo sapiens
aagaaaaacaaactcgtttt

SEQ ID NO: 982273 - DNA, 12 bp, Homo sapiens
aagaaaaacttt

SEQ ID NO: 982274 - DNA, 15 bp, Homo sapiens
aagaaaaagaagtac

SEQ ID NO: 982275 - DNA, 19 bp, Homo sapiens
aagaaaaaggatgcacaga

SEQ ID NO: 982276 - DNA, 20 bp, Homo sapiens
aagaaaaaggatgcacagag

SEQ ID NO: 982277 - DNA, 9 bp, Homo sapiens
aagaaaaat

SEQ ID NO: 982278 - DNA, 14 bp, Homo sapiens
aagaaaaatatgat

SEQ ID NO: 982279 - DNA, 13 bp, Homo sapiens
aagaaaaatcatg

SEQ ID NO: 982280 - DNA, 14 bp, Homo sapiens
aagaaaaatcatgt

SEQ ID NO: 982281 - DNA, 17 bp, Homo sapiens
aagaaaaatcatgtttg

SEQ ID NO: 982282 - DNA, 18 bp, Homo sapiens
aagaaaaatgagcctggc

SEQ ID NO: 982283 - DNA, 11 bp, Homo sapiens
aagaaaacaaa

SEQ ID NO: 982284 - DNA, 12 bp, Homo sapiens
aagaaaacagta

SEQ ID NO: 982285 - DNA, 15 bp, Homo sapiens
aagaaaacagtacag

SEQ ID NO: 982286 - DNA, 20 bp, Homo sapiens
aacatgtcctgcctattatc

SEQ ID NO: 982287 - DNA, 13 bp, Homo sapiens
aacatgtctccta

SEQ ID NO: 982288 - DNA, 19 bp, Homo sapiens
aacatgtctcctatcctgg

SEQ ID NO: 982289 - DNA, 13 bp, Homo sapiens
aacatgtgtttta

SEQ ID NO: 982290 - DNA, 20 bp, Homo sapiens
aacatgttatttgtaataga

SEQ ID NO: 982291 - DNA, 13 bp, Homo sapiens
aacatgttcctga

SEQ ID NO: 982292 - DNA, 22 bp, Homo sapiens
aacatgttgtacatttcaccat

SEQ ID NO: 982293 - DNA, 16 bp, Homo sapiens
aacatgtttacaggtt

SEQ ID NO: 982294 - DNA, 15 bp, Homo sapiens
aacattaaaactcat

SEQ ID NO: 982295 - DNA, 11 bp, Homo sapiens
aacattaaaca

SEQ ID NO: 982296 - DNA, 15 bp, Homo sapiens
aacattaaacactgt

SEQ ID NO: 982297 - DNA, 13 bp, Homo sapiens
aacattaagaaaa

SEQ ID NO: 982298 - DNA, 19 bp, Homo sapiens
aacattaagaaaatcatat

SEQ ID NO: 982299 - DNA, 17 bp, Homo sapiens
aacattaaggaatttga

SEQ ID NO: 982300 - DNA, 19 bp, Homo sapiens
aacattaatccacatgttt

SEQ ID NO: 982301 - DNA, 18 bp, Homo sapiens
aacattaattttgtgcat

SEQ ID NO: 982302 - DNA, 19 bp, Homo sapiens
aacattaattttgtgcatt

SEQ ID NO: 982303 - DNA, 15 bp, Homo sapiens
aacattacttattta

SEQ ID NO: 982304 - DNA, 17 bp, Homo sapiens
aacattaggaattgttt

SEQ ID NO: 982305 - DNA, 17 bp, Homo sapiens
aacattattacttttcc

SEQ ID NO: 982306 - DNA, 17 bp, Homo sapiens
aacattattcatctctc

SEQ ID NO: 982307 - DNA, 23 bp, Homo sapiens
aacattatttattcagcttcatt

SEQ ID NO: 982308 - DNA, 12 bp, Homo sapiens
aacattattttt

SEQ ID NO: 982309 - DNA, 15 bp, Homo sapiens
aacattattttttat

SEQ ID NO: 982310 - DNA, 15 bp, Homo sapiens
aacattcacagccca

SEQ ID NO: 982311 - DNA, 15 bp, Homo sapiens
aacattcatgtaact

SEQ ID NO: 982312 - DNA, 21 bp, Homo sapiens
aacattcatgtaactctccag

SEQ ID NO: 982313 - DNA, 16 bp, Homo sapiens
aacattcctccagcct

SEQ ID NO: 982314 - DNA, 19 bp, Homo sapiens
aacattcctccagcctccc

SEQ ID NO: 982315 - DNA, 22 bp, Homo sapiens
aacattctattgactttcttaa

SEQ ID NO: 982316 - DNA, 16 bp, Homo sapiens
aacattctgatttgga

SEQ ID NO: 982317 - DNA, 18 bp, Homo sapiens
aacattctgatttggaaa

SEQ ID NO: 982318 - DNA, 23 bp, Homo sapiens
aacattctggatctgaccctccc

SEQ ID NO: 982319 - DNA, 18 bp, Homo sapiens
aacattgaccaagaactg

SEQ ID NO: 982320 - DNA, 21 bp, Homo sapiens
aacattgaccaagaactgcat

SEQ ID NO: 982321 - DNA, 17 bp, Homo sapiens
aacattgacttcttggt

SEQ ID NO: 982322 - DNA, 23 bp, Homo sapiens
aacattgcactttataaacactg

SEQ ID NO: 982323 - DNA, 20 bp, Homo sapiens
aacattgcatataacttata

SEQ ID NO: 982324 - DNA, 17 bp, Homo sapiens
aacattgctgcctttgt

SEQ ID NO: 982325 - DNA, 12 bp, Homo sapiens
aacattgtaaag

SEQ ID NO: 982326 - DNA, 20 bp, Homo sapiens
aacattgtactgttgcttta

SEQ ID NO: 982327 - DNA, 14 bp, Homo sapiens
aacattgtagcctc

SEQ ID NO: 982328 - DNA, 14 bp, Homo sapiens
aacattgttctgaa

SEQ ID NO: 982329 - DNA, 12 bp, Homo sapiens
aacatttaaatt

SEQ ID NO: 982330 - DNA, 15 bp, Homo sapiens
aacatttaacataat

SEQ ID NO: 982331 - DNA, 20 bp, Homo sapiens
aacatttacaataaatattc

SEQ ID NO: 982332 - DNA, 22 bp, Homo sapiens
aacatttacaataaatattctg

SEQ ID NO: 982333 - DNA, 23 bp, Homo sapiens
aacatttcaatgtcagcctttgt

SEQ ID NO: 982334 - DNA, 18 bp, Homo sapiens
aacatttctaactctatt

SEQ ID NO: 982335 - DNA, 16 bp, Homo sapiens
aacatttctgtatact

SEQ ID NO: 982336 - DNA, 21 bp, Homo sapiens
aacatttctgtatactgtaaa

SEQ ID NO: 982337 - DNA, 18 bp, Homo sapiens
aacatttcttatgatttt

SEQ ID NO: 982338 - DNA, 16 bp, Homo sapiens
aacatttgatattttt

SEQ ID NO: 982339 - DNA, 13 bp, Homo sapiens
aacatttgccaag

SEQ ID NO: 982340 - DNA, 22 bp, Homo sapiens
aacatttgccaagtgagttgaa

SEQ ID NO: 982341 - DNA, 14 bp, Homo sapiens
aacatttgccttgc

SEQ ID NO: 982342 - DNA, 17 bp, Homo sapiens
aacatttgccttgcaga

SEQ ID NO: 982343 - DNA, 21 bp, Homo sapiens
aacatttgtgtaatatgaaat

SEQ ID NO: 982344 - DNA, 23 bp, Homo sapiens
aacatttgtttcccccacagttt

SEQ ID NO: 982345 - DNA, 19 bp, Homo sapiens
aacattttaaataaaagaa

SEQ ID NO: 982346 - DNA, 15 bp, Homo sapiens
aacattttacccaca

SEQ ID NO: 982347 - DNA, 19 bp, Homo sapiens
aacattttatcattaaaaa

SEQ ID NO: 982348 - DNA, 23 bp, Homo sapiens
aacattttatcattaaaaattac

SEQ ID NO: 982349 - DNA, 16 bp, Homo sapiens
aacattttctggccag

SEQ ID NO: 982350 - DNA, 17 bp, Homo sapiens
aacattttttaaggact

SEQ ID NO: 982351 - DNA, 13 bp, Homo sapiens
aaccaaaaaaaaa

SEQ ID NO: 982352 - DNA, 22 bp, Homo sapiens
aaccaaaacttccaaggccctg

SEQ ID NO: 982353 - DNA, 15 bp, Homo sapiens
aaccaaacccagcca

SEQ ID NO: 982354 - DNA, 19 bp, Homo sapiens
aaccaaacttgttcattta

SEQ ID NO: 982355 - DNA, 16 bp, Homo sapiens
aaccaaagcctcttca

SEQ ID NO: 982356 - DNA, 15 bp, Homo sapiens
aaccaaagctgcctg

SEQ ID NO: 982357 - DNA, 16 bp, Homo sapiens
aaccaaagctgcctgt

SEQ ID NO: 982358 - DNA, 16 bp, Homo sapiens
aaccaaaggaaaatgt

SEQ ID NO: 982359 - DNA, 10 bp, Homo sapiens
aaccaaaggt

SEQ ID NO: 982360 - DNA, 20 bp, Homo sapiens
aaccaaaggtgaaggaatat

SEQ ID NO: 982361 - DNA, 23 bp, Homo sapiens
aaccaaagtaaccttttgcacct

SEQ ID NO: 982362 - DNA, 16 bp, Homo sapiens
aaccaaagtctgccgc

SEQ ID NO: 982363 - DNA, 21 bp, Homo sapiens
aaccaacaggtttatctgaag

SEQ ID NO: 982364 - DNA, 15 bp, Homo sapiens
aaccaactgccccag

SEQ ID NO: 982365 - DNA, 21 bp, Homo sapiens
aaccaacttggttctgcttca

SEQ ID NO: 982366 - DNA, 17 bp, Homo sapiens
aaccaagaggctggttt

SEQ ID NO: 982367 - DNA, 17 bp, Homo sapiens
aaccaagatgtaaaaca

SEQ ID NO: 982368 - DNA, 22 bp, Homo sapiens
aaccaagcatcagggggaagaa

SEQ ID NO: 982369 - DNA, 16 bp, Homo sapiens
aaccaagccgtggctt

SEQ ID NO: 982370 - DNA, 13 bp, Homo sapiens
aaccaagccttgg

SEQ ID NO: 982371 - DNA, 15 bp, Homo sapiens
aaccaagccttggct

SEQ ID NO: 982372 - DNA, 20 bp, Homo sapiens
aaccaagctattcctttccc

SEQ ID NO: 982373 - DNA, 17 bp, Homo sapiens
aaccaagctctctgcat

SEQ ID NO: 982374 - DNA, 18 bp, Homo sapiens
aaccaagctgagtttcct

SEQ ID NO: 982375 - DNA, 14 bp, Homo sapiens
aaccaaggcagcct

SEQ ID NO: 982376 - DNA, 15 bp, Homo sapiens
aaccaagtcaagtga

SEQ ID NO: 982377 - DNA, 18 bp, Homo sapiens
aaccaagtcaggccaggt

SEQ ID NO: 982378 - DNA, 22 bp, Homo sapiens
aaccaagtgtagatgtagcatt

SEQ ID NO: 982379 - DNA, 14 bp, Homo sapiens
aaccaagtgtgctc

SEQ ID NO: 982380 - DNA, 14 bp, Homo sapiens
aaccaatacagaat

SEQ ID NO: 982381 - DNA, 18 bp, Homo sapiens
aaccaatcattttaagaa

SEQ ID NO: 982382 - DNA, 23 bp, Homo sapiens
aaccaatgagctgtatctgtaat

SEQ ID NO: 982383 - DNA, 22 bp, Homo sapiens
aaccaatgcctttttagatgta

SEQ ID NO: 982384 - DNA, 22 bp, Homo sapiens
aaccaatggtgatcctctattt

SEQ ID NO: 982385 - DNA, 17 bp, Homo sapiens
aactatggttcccaata

SEQ ID NO: 982386 - DNA, 22 bp, Homo sapiens
aactatggttcccaataaaagt

SEQ ID NO: 982387 - DNA, 14 bp, Homo sapiens
aactatgtgctatc

SEQ ID NO: 982388 - DNA, 22 bp, Homo sapiens
aactatgttcctaacaaaatga

SEQ ID NO: 982389 - DNA, 12 bp, Homo sapiens
aactattaacct

SEQ ID NO: 982390 - DNA, 21 bp, Homo sapiens
aactattagagtatttccctt

SEQ ID NO: 982391 - DNA, 22 bp, Homo sapiens
aactattagagtatttcccttc

SEQ ID NO: 982392 - DNA, 17 bp, Homo sapiens
aactattgagccttgca

SEQ ID NO: 982393 - DNA, 21 bp, Homo sapiens
aactattgagccttgcatgta

SEQ ID NO: 982394 - DNA, 15 bp, Homo sapiens
aactattgcatttat

SEQ ID NO: 982395 - DNA, 15 bp, Homo sapiens
aactattgggtgaat

SEQ ID NO: 982396 - DNA, 14 bp, Homo sapiens
aactatttaaaata

SEQ ID NO: 982397 - DNA, 13 bp, Homo sapiens
aactatttatctg

SEQ ID NO: 982398 - DNA, 16 bp, Homo sapiens
aactatttattgtgct

SEQ ID NO: 982399 - DNA, 17 bp, Homo sapiens
aactatttattgtgctg

SEQ ID NO: 982400 - DNA, 18 bp, Homo sapiens
aactatttgtctttcagg

SEQ ID NO: 982401 - DNA, 14 bp, Homo sapiens
aactattttatgtt

SEQ ID NO: 982402 - DNA, 22 bp, Homo sapiens
aactattttgttttaatctact

SEQ ID NO: 982403 - DNA, 12 bp, Homo sapiens
aactcaaccaga

SEQ ID NO: 982404 - DNA, 16 bp, Homo sapiens
aactcaagacaatgca

SEQ ID NO: 982405 - DNA, 15 bp, Homo sapiens
aactcacagagcttt

SEQ ID NO: 982406 - DNA, 14 bp, Homo sapiens
aactcacagcttct

SEQ ID NO: 982407 - DNA, 15 bp, Homo sapiens
aactcaccatgtaaa

SEQ ID NO: 982408 - DNA, 23 bp, Homo sapiens
aactcaccctgggagccagtcct

SEQ ID NO: 982409 - DNA, 17 bp, Homo sapiens
aactcactaacagggag

SEQ ID NO: 982410 - DNA, 16 bp, Homo sapiens
aactcactccttttaa

SEQ ID NO: 982411 - DNA, 22 bp, Homo sapiens
aactcactgctcaagaagacat

SEQ ID NO: 982412 - DNA, 15 bp, Homo sapiens
aactcactggaatgt

SEQ ID NO: 982413 - DNA, 14 bp, Homo sapiens
aactcactttcctc

SEQ ID NO: 982414 - DNA, 21 bp, Homo sapiens
aactcagaaacatcagttact

SEQ ID NO: 982415 - DNA, 14 bp, Homo sapiens
aactcagaatgggg

SEQ ID NO: 982416 - DNA, 16 bp, Homo sapiens
aactcagatgtccaaa

SEQ ID NO: 982417 - DNA, 20 bp, Homo sapiens
aactcagattgactaaataa

SEQ ID NO: 982418 - DNA, 21 bp, Homo sapiens
aactcagctattaagaaaatc

SEQ ID NO: 982419 - DNA, 15 bp, Homo sapiens
aactcaggcaaagaa

SEQ ID NO: 982420 - DNA, 17 bp, Homo sapiens
aactcaggcaaagaaaa

SEQ ID NO: 982421 - DNA, 16 bp, Homo sapiens
aactcagggacagagc

SEQ ID NO: 982422 - DNA, 17 bp, Homo sapiens
aactcagggacagagcc

SEQ ID NO: 982423 - DNA, 18 bp, Homo sapiens
aactcagggacagagcca

SEQ ID NO: 982424 - DNA, 15 bp, Homo sapiens
aactcagttttaact

SEQ ID NO: 982425 - DNA, 15 bp, Homo sapiens
aactcatcataaaat

SEQ ID NO: 982426 - DNA, 17 bp, Homo sapiens
aactcatcataaaataa

SEQ ID NO: 982427 - DNA, 15 bp, Homo sapiens
aactcattagactgg

SEQ ID NO: 982428 - DNA, 16 bp, Homo sapiens
aactccacatctgcct

SEQ ID NO: 982429 - DNA, 15 bp, Homo sapiens
aactccaccaaccca

SEQ ID NO: 982430 - DNA, 23 bp, Homo sapiens
aactccaccaacccatcagaagg

SEQ ID NO: 982431 - DNA, 16 bp, Homo sapiens
aactccactctccttc

SEQ ID NO: 982432 - DNA, 20 bp, Homo sapiens
aagaacttactgattatttt

SEQ ID NO: 982433 - DNA, 15 bp, Homo sapiens
aagaacttgcatgga

SEQ ID NO: 982434 - DNA, 21 bp, Homo sapiens
aagaactttaaagctcaggag

SEQ ID NO: 982435 - DNA, 17 bp, Homo sapiens
aagaactttaaattgtg

SEQ ID NO: 982436 - DNA, 21 bp, Homo sapiens
aagaagaaaattgctgtgcct

SEQ ID NO: 982437 - DNA, 18 bp, Homo sapiens
aagaagaaccagcccagc

SEQ ID NO: 982438 - DNA, 21 bp, Homo sapiens
aagaagaactcaccagggttt

SEQ ID NO: 982439 - DNA, 13 bp, Homo sapiens
aagaagaagggca

SEQ ID NO: 982440 - DNA, 18 bp, Homo sapiens
aagaagacaaatgacaga

SEQ ID NO: 982441 - DNA, 16 bp, Homo sapiens
aagaagacatgaacca

SEQ ID NO: 982442 - DNA, 14 bp, Homo sapiens
aagaagacatgaca

SEQ ID NO: 982443 - DNA, 21 bp, Homo sapiens
aagaagaccagactgtggaga

SEQ ID NO: 982444 - DNA, 19 bp, Homo sapiens
aagaagagaagctgctgac

SEQ ID NO: 982445 - DNA, 20 bp, Homo sapiens
aagaagaggaagaaattcag

SEQ ID NO: 982446 - DNA, 14 bp, Homo sapiens
aagaagcaaatttt

SEQ ID NO: 982447 - DNA, 21 bp, Homo sapiens
aagaagcaacctcagtaattt

SEQ ID NO: 982448 - DNA, 16 bp, Homo sapiens
aagaagcaataactat

SEQ ID NO: 982449 - DNA, 21 bp, Homo sapiens
aagaagcaattatttaaagaa

SEQ ID NO: 982450 - DNA, 13 bp, Homo sapiens
aagaagcagagag

SEQ ID NO: 982451 - DNA, 12 bp, Homo sapiens
aagaagcatttc

SEQ ID NO: 982452 - DNA, 22 bp, Homo sapiens
aagaagcattttgtaagttgaa

SEQ ID NO: 982453 - DNA, 19 bp, Homo sapiens
aagaagccacagacctagg

SEQ ID NO: 982454 - DNA, 22 bp, Homo sapiens
aagaagccatttagggcagcaa

SEQ ID NO: 982455 - DNA, 22 bp, Homo sapiens
aagaagccccttatttttagcc

SEQ ID NO: 982456 - DNA, 18 bp, Homo sapiens
aagaagcgcggctaactt

SEQ ID NO: 982457 - DNA, 16 bp, Homo sapiens
aagaagctacagattg

SEQ ID NO: 982458 - DNA, 14 bp, Homo sapiens
aagaagcttccaca

SEQ ID NO: 982459 - DNA, 16 bp, Homo sapiens
aagaagcttccacaaa

SEQ ID NO: 982460 - DNA, 18 bp, Homo sapiens
aagaagcttccacaaaat

SEQ ID NO: 982461 - DNA, 23 bp, Homo sapiens
aagaaggaaaatgatctgagtcc

SEQ ID NO: 982462 - DNA, 14 bp, Homo sapiens
aagaaggaaagatg

SEQ ID NO: 982463 - DNA, 11 bp, Homo sapiens
aagaaggaagt

SEQ ID NO: 982464 - DNA, 12 bp, Homo sapiens
aagaaggaatcc

SEQ ID NO: 982465 - DNA, 11 bp, Homo sapiens
aagaaggagac

SEQ ID NO: 982466 - DNA, 14 bp, Homo sapiens
aagaaggatgatgt

SEQ ID NO: 982467 - DNA, 16 bp, Homo sapiens
aagaaggcaaaaatgt

SEQ ID NO: 982468 - DNA, 20 bp, Homo sapiens
aagaaggcaattttagtgta

SEQ ID NO: 982469 - DNA, 22 bp, Homo sapiens
aagaaggcagggaatgcctgga

SEQ ID NO: 982470 - DNA, 15 bp, Homo sapiens
aagaagggagaagaa

SEQ ID NO: 982471 - DNA, 20 bp, Homo sapiens
aagaagggctgcatgatgtt

SEQ ID NO: 982472 - DNA, 22 bp, Homo sapiens
aagaagggctgcatgatgtttg

SEQ ID NO: 982473 - DNA, 17 bp, Homo sapiens
aagaaggggagaagtca

SEQ ID NO: 982474 - DNA, 21 bp, Homo sapiens
aagaagggggagtgaaacaga

SEQ ID NO: 982475 - DNA, 22 bp, Homo sapiens
aagaagtaaaagcaaaaaagaa

SEQ ID NO: 982476 - DNA, 20 bp, Homo sapiens
aagaagtaggggaagacatg

SEQ ID NO: 982477 - DNA, 17 bp, Homo sapiens
aagaagtgggagcagct

SEQ ID NO: 982478 - DNA, 16 bp, Homo sapiens
aagaagtgtccgagaa

SEQ ID NO: 982479 - DNA, 14 bp, Homo sapiens
aagaagtgtgagaa

SEQ ID NO: 982480 - DNA, 18 bp, Homo sapiens
aagaagtttgtgtctttg

SEQ ID NO: 982481 - DNA, 19 bp, Homo sapiens
aagaagtttgtgtctttgt

SEQ ID NO: 982482 - DNA, 13 bp, Homo sapiens
aagaagttttaaa

SEQ ID NO: 982483 - DNA, 13 bp, Homo sapiens
aagaccccaccca

SEQ ID NO: 982484 - DNA, 22 bp, Homo sapiens
aagaccccacccaagcttggca

SEQ ID NO: 982485 - DNA, 13 bp, Homo sapiens
aagacccccagca

SEQ ID NO: 982486 - DNA, 21 bp, Homo sapiens
aagacccggttattcgcccac

SEQ ID NO: 982487 - DNA, 21 bp, Homo sapiens
aagaccctcttgcccatcctg

SEQ ID NO: 982488 - DNA, 19 bp, Homo sapiens
aagaccgccccagggctat

SEQ ID NO: 982489 - DNA, 15 bp, Homo sapiens
aagaccgccccccgc

SEQ ID NO: 982490 - DNA, 19 bp, Homo sapiens
aagacctacattccctctc

SEQ ID NO: 982491 - DNA, 19 bp, Homo sapiens
aagacctcatctgtggagc

SEQ ID NO: 982492 - DNA, 14 bp, Homo sapiens
aagacctgaatccc

SEQ ID NO: 982493 - DNA, 12 bp, Homo sapiens
aagacctgagta

SEQ ID NO: 982494 - DNA, 15 bp, Homo sapiens
aagacctgagtattt

SEQ ID NO: 982495 - DNA, 22 bp, Homo sapiens
aagaccttctagtgagcctggg

SEQ ID NO: 982496 - DNA, 21 bp, Homo sapiens
aagaccttctccaaatgagat

SEQ ID NO: 982497 - DNA, 19 bp, Homo sapiens
aagacgagcatccccctcc

SEQ ID NO: 982498 - DNA, 15 bp, Homo sapiens
aagacgcctgagctc

SEQ ID NO: 982499 - DNA, 23 bp, Homo sapiens
aagacggtattaaaatggagcga

SEQ ID NO: 982500 - DNA, 22 bp, Homo sapiens
aagacgtgattttgctgtagaa

SEQ ID NO: 982501 - DNA, 23 bp, Homo sapiens
aagacgtgattttgctgtagaag

SEQ ID NO: 982502 - DNA, 23 bp, Homo sapiens
aagacgtgtttgtgtttgtgtgt

SEQ ID NO: 982503 - DNA, 12 bp, Homo sapiens
aagacgtttttg

SEQ ID NO: 982504 - DNA, 21 bp, Homo sapiens
aagactagactactcaatatt

SEQ ID NO: 982505 - DNA, 13 bp, Homo sapiens
aagactagcccct

SEQ ID NO: 982506 - DNA, 20 bp, Homo sapiens
aagactatccaacttaacat

SEQ ID NO: 982507 - DNA, 17 bp, Homo sapiens
aagactatctaaatgtt

SEQ ID NO: 982508 - DNA, 18 bp, Homo sapiens
aagactatctaaatgttg

SEQ ID NO: 982509 - DNA, 15 bp, Homo sapiens
aagactatgaaaatg

SEQ ID NO: 982510 - DNA, 21 bp, Homo sapiens
aagactcccgccccgggctgg

SEQ ID NO: 982511 - DNA, 13 bp, Homo sapiens
aagactcctcctg

SEQ ID NO: 982512 - DNA, 14 bp, Homo sapiens
aagactcctctggg

SEQ ID NO: 982513 - DNA, 12 bp, Homo sapiens
aagactctgagc

SEQ ID NO: 982514 - DNA, 14 bp, Homo sapiens
aagactctgagcca

SEQ ID NO: 982515 - DNA, 23 bp, Homo sapiens
aagactctttgggtccattcaga

SEQ ID NO: 982516 - DNA, 19 bp, Homo sapiens
aagactgaacatgtttaca

SEQ ID NO: 982517 - DNA, 12 bp, Homo sapiens
aagactgaagac

SEQ ID NO: 982518 - DNA, 15 bp, Homo sapiens
aagactgagaacttt

SEQ ID NO: 982519 - DNA, 17 bp, Homo sapiens
aagactgagtacgttgt

SEQ ID NO: 982520 - DNA, 21 bp, Homo sapiens
aagactgagtacgttgtgcat

SEQ ID NO: 982521 - DNA, 12 bp, Homo sapiens
aagactgcagct

SEQ ID NO: 982522 - DNA, 16 bp, Homo sapiens
aagactgcagctgctg

SEQ ID NO: 982523 - DNA, 13 bp, Homo sapiens
aagactgcctccc

SEQ ID NO: 982524 - DNA, 20 bp, Homo sapiens
aagactggaagctaatttgc

SEQ ID NO: 982525 - DNA, 17 bp, Homo sapiens
aagactggtttgtttgc

SEQ ID NO: 982526 - DNA, 21 bp, Homo sapiens
aagactggtttgtttgcttaa

SEQ ID NO: 982527 - DNA, 16 bp, Homo sapiens
aagactggttttctgc

SEQ ID NO: 982528 - DNA, 20 bp, Homo sapiens
aagactgtcaaatgaacttt

SEQ ID NO: 982529 - DNA, 17 bp, Homo sapiens
aagactgtgctgagaag

SEQ ID NO: 982530 - DNA, 12 bp, Homo sapiens
aagactgtggct

SEQ ID NO: 982531 - DNA, 18 bp, Homo sapiens
aagactgtggctgctagc

SEQ ID NO: 982532 - DNA, 20 bp, Homo sapiens
aagactgtgggtggggaggc

SEQ ID NO: 982533 - DNA, 24 bp, Homo sapiens
aagacttaaagggcccaatgaatt

SEQ ID NO: 982534 - DNA, 12 bp, Homo sapiens
aagacttcaaaa

SEQ ID NO: 982535 - DNA, 15 bp, Homo sapiens
aagacttgagacaat

SEQ ID NO: 982536 - DNA, 18 bp, Homo sapiens
aagacttggcaacagaag

SEQ ID NO: 982537 - DNA, 20 bp, Homo sapiens
aagacttggcaacagaagca

SEQ ID NO: 982538 - DNA, 12 bp, Homo sapiens
aagacttgtttt

SEQ ID NO: 982539 - DNA, 14 bp, Homo sapiens
aagactttaattat

SEQ ID NO: 982540 - DNA, 20 bp, Homo sapiens
aagactttgatccttggaaa

SEQ ID NO: 982541 - DNA, 20 bp, Homo sapiens
aagactttgggataggaaaa

SEQ ID NO: 982542 - DNA, 16 bp, Homo sapiens
aagacttttatgtgag

SEQ ID NO: 982543 - DNA, 17 bp, Homo sapiens
aagagaaaaagaaatgc

SEQ ID NO: 982544 - DNA, 11 bp, Homo sapiens
aagagaaaaga

SEQ ID NO: 982545 - DNA, 15 bp, Homo sapiens
aagagaaaagaaaaa

SEQ ID NO: 982546 - DNA, 20 bp, Homo sapiens
aagagaaaagggaaaaaaga

SEQ ID NO: 982547 - DNA, 19 bp, Homo sapiens
aagagaaaggactcagtgt

SEQ ID NO: 982548 - DNA, 19 bp, Homo sapiens
aagagaaatacagctggct

SEQ ID NO: 982549 - DNA, 16 bp, Homo sapiens
aagagaaccgagcaaa

SEQ ID NO: 982550 - DNA, 22 bp, Homo sapiens
aagagaaccgagcaaagatcaa

SEQ ID NO: 982551 - DNA, 16 bp, Homo sapiens
aagagaagacaaaacg

SEQ ID NO: 982552 - DNA, 20 bp, Homo sapiens
aagagaagagggcccagccc

SEQ ID NO: 982553 - DNA, 13 bp, Homo sapiens
aagagaagctgct

SEQ ID NO: 982554 - DNA, 15 bp, Homo sapiens
aagagaagctgctga

SEQ ID NO: 982555 - DNA, 14 bp, Homo sapiens
aagagaaggcacac

SEQ ID NO: 982556 - DNA, 18 bp, Homo sapiens
aagagaagtctcattcgc

SEQ ID NO: 982557 - DNA, 14 bp, Homo sapiens
aagagaagttattt

SEQ ID NO: 982558 - DNA, 21 bp, Homo sapiens
aagagaagttattttctacag

SEQ ID NO: 982559 - DNA, 22 bp, Homo sapiens
aagagaatattttaagtattgc

SEQ ID NO: 982560 - DNA, 19 bp, Homo sapiens
aagagaatcaacagatgat

SEQ ID NO: 982561 - DNA, 20 bp, Homo sapiens
aagagaatcaacagatgata

SEQ ID NO: 982562 - DNA, 15 bp, Homo sapiens
aagagaatgaactgt

SEQ ID NO: 982563 - DNA, 13 bp, Homo sapiens
aagagaattcagt

SEQ ID NO: 982564 - DNA, 13 bp, Homo sapiens
aagagacactcca

SEQ ID NO: 982565 - DNA, 22 bp, Homo sapiens
aagagacagagacaagtaattt

SEQ ID NO: 982566 - DNA, 22 bp, Homo sapiens
aagagacaggagggcaagggcc

SEQ ID NO: 982567 - DNA, 19 bp, Homo sapiens
aagagacatgagaaaggga

SEQ ID NO: 982568 - DNA, 15 bp, Homo sapiens
aagagacatggaaga

SEQ ID NO: 982569 - DNA, 16 bp, Homo sapiens
aagagacatggaagag

SEQ ID NO: 982570 - DNA, 20 bp, Homo sapiens
aagagacttaaaggacagga

SEQ ID NO: 982571 - DNA, 19 bp, Homo sapiens
aagagacttctctgtaagt

SEQ ID NO: 982572 - DNA, 20 bp, Homo sapiens
aagagagagagagaaaaaaa

SEQ ID NO: 982573 - DNA, 22 bp, Homo sapiens
aagagagagccatgaagcatta

SEQ ID NO: 982574 - DNA, 16 bp, Homo sapiens
aagagagattggattt

SEQ ID NO: 982575 - DNA, 16 bp, Homo sapiens
aagagagctctaacca

SEQ ID NO: 982576 - DNA, 16 bp, Homo sapiens
aagagaggcacctgct

SEQ ID NO: 982577 - DNA, 15 bp, Homo sapiens
aagagagggacaggc

SEQ ID NO: 982578 - DNA, 14 bp, Homo sapiens
aagagaggtttctg

SEQ ID NO: 982579 - DNA, 17 bp, Homo sapiens
aagagagtaccatgctg

SEQ ID NO: 982580 - DNA, 16 bp, Homo sapiens
aagagagtttgccact

SEQ ID NO: 982581 - DNA, 20 bp, Homo sapiens
aagagatacttacatttcca

SEQ ID NO: 982582 - DNA, 15 bp, Homo sapiens
aagagatagttctaa

SEQ ID NO: 982583 - DNA, 21 bp, Homo sapiens
aagagatatgtagaaggcaca

SEQ ID NO: 982584 - DNA, 18 bp, Homo sapiens
aagagatcacccactcct

SEQ ID NO: 982585 - DNA, 15 bp, Homo sapiens
aagagatctgggcat

SEQ ID NO: 982586 - DNA, 16 bp, Homo sapiens
aagagatgacaaacca

SEQ ID NO: 982587 - DNA, 21 bp, Homo sapiens
aagagatttcccttcatttaa

SEQ ID NO: 982588 - DNA, 15 bp, Homo sapiens
aagagcaaaagaatg

SEQ ID NO: 982589 - DNA, 20 bp, Homo sapiens
aagagcaaaagaatggcaga

SEQ ID NO: 982590 - DNA, 15 bp, Homo sapiens
aagagcaagtctgga

SEQ ID NO: 982591 - DNA, 10 bp, Homo sapiens
aagagcacaa

SEQ ID NO: 982592 - DNA, 21 bp, Homo sapiens
aagagcacagagccctgaggg

SEQ ID NO: 982593 - DNA, 15 bp, Homo sapiens
aagagcagagtctgg

SEQ ID NO: 982594 - DNA, 18 bp, Homo sapiens
aagagcagagtctgggcc

SEQ ID NO: 982595 - DNA, 19 bp, Homo sapiens
aagagcagagtctgggcct

SEQ ID NO: 982596 - DNA, 14 bp, Homo sapiens
aagagcagcctgtg

SEQ ID NO: 982597 - DNA, 17 bp, Homo sapiens
aagagcagcctgtggca

SEQ ID NO: 982598 - DNA, 18 bp, Homo sapiens
aagagcagcctgtggcat

SEQ ID NO: 982599 - DNA, 20 bp, Homo sapiens
aagataacaagatctttcag

SEQ ID NO: 982600 - DNA, 19 bp, Homo sapiens
aagataacttactgtatat

SEQ ID NO: 982601 - DNA, 16 bp, Homo sapiens
aagataagtctacatt

SEQ ID NO: 982602 - DNA, 21 bp, Homo sapiens
aagataatattaaggaagaca

SEQ ID NO: 982603 - DNA, 18 bp, Homo sapiens
aagataatattttacata

SEQ ID NO: 982604 - DNA, 22 bp, Homo sapiens
aagataatctcagtgctttcct

SEQ ID NO: 982605 - DNA, 23 bp, Homo sapiens
aagataatctcagtgctttcctc

SEQ ID NO: 982606 - DNA, 12 bp, Homo sapiens
aagataatgttc

SEQ ID NO: 982607 - DNA, 20 bp, Homo sapiens
aagataatgttctttaatgt

SEQ ID NO: 982608 - DNA, 13 bp, Homo sapiens
aagataattgcta

SEQ ID NO: 982609 - DNA, 17 bp, Homo sapiens
aagataattgctattta

SEQ ID NO: 982610 - DNA, 21 bp, Homo sapiens
aagatacactcaagcatgaag

SEQ ID NO: 982611 - DNA, 20 bp, Homo sapiens
aagatacactgcactttgtt

SEQ ID NO: 982612 - DNA, 17 bp, Homo sapiens
aagatacagttactcag

SEQ ID NO: 982613 - DNA, 14 bp, Homo sapiens
aagatacgacttta

SEQ ID NO: 982614 - DNA, 21 bp, Homo sapiens
aagatacgactttattttctg

SEQ ID NO: 982615 - DNA, 20 bp, Homo sapiens
aagatactaaggacgttgtt

SEQ ID NO: 982616 - DNA, 16 bp, Homo sapiens
aagatagatcctttta

SEQ ID NO: 982617 - DNA, 17 bp, Homo sapiens
aagataggagttctctg

SEQ ID NO: 982618 - DNA, 13 bp, Homo sapiens
aagataggctctg

SEQ ID NO: 982619 - DNA, 17 bp, Homo sapiens
aagataggctctgcaca

SEQ ID NO: 982620 - DNA, 18 bp, Homo sapiens
aagataggctctgcacag

SEQ ID NO: 982621 - DNA, 15 bp, Homo sapiens
aagatagggaacact

SEQ ID NO: 982622 - DNA, 14 bp, Homo sapiens
aagatagtgtaact

SEQ ID NO: 982623 - DNA, 14 bp, Homo sapiens
aagatatacatgaa

SEQ ID NO: 982624 - DNA, 20 bp, Homo sapiens
aagatatcagagctcttaat

SEQ ID NO: 982625 - DNA, 15 bp, Homo sapiens
aagatatccatcttt

SEQ ID NO: 982626 - DNA, 20 bp, Homo sapiens
aagatattttgctttgtgat

SEQ ID NO: 982627 - DNA, 13 bp, Homo sapiens
aagatatttttga

SEQ ID NO: 982628 - DNA, 22 bp, Homo sapiens
aagatatttttgaagtaaatta

SEQ ID NO: 982629 - DNA, 23 bp, Homo sapiens
aagatcaaaaggttaataaagta

SEQ ID NO: 982630 - DNA, 21 bp, Homo sapiens
aagatcaaaataaaaagtgac

SEQ ID NO: 982631 - DNA, 22 bp, Homo sapiens
aagatcacccgttgtattcacc

SEQ ID NO: 982632 - DNA, 19 bp, Homo sapiens
aagatcacttgttgtttta

SEQ ID NO: 982633 - DNA, 17 bp, Homo sapiens
aagatcactttctcagt

SEQ ID NO: 982634 - DNA, 19 bp, Homo sapiens
aagatccacatcctctaca

SEQ ID NO: 982635 - DNA, 15 bp, Homo sapiens
aagatccaccctcaa

SEQ ID NO: 982636 - DNA, 18 bp, Homo sapiens
aagatcccctctcctgcc

SEQ ID NO: 982637 - DNA, 22 bp, Homo sapiens
aagatccttcgggtgctggaag

SEQ ID NO: 982638 - DNA, 16 bp, Homo sapiens
aagatctcaaattgta

SEQ ID NO: 982639 - DNA, 19 bp, Homo sapiens
aagatctctgtcacatcca

SEQ ID NO: 982640 - DNA, 19 bp, Homo sapiens
aagatctctttctaaagac

SEQ ID NO: 982641 - DNA, 21 bp, Homo sapiens
aagatcttgatggtgtttctt

SEQ ID NO: 982642 - DNA, 21 bp, Homo sapiens
aagatcttttcgaagctgtta

SEQ ID NO: 982643 - DNA, 21 bp, Homo sapiens
aagatgaaaggcaggcctatt

SEQ ID NO: 982644 - DNA, 14 bp, Homo sapiens
aagatgaagaggat

SEQ ID NO: 982645 - DNA, 14 bp, Homo sapiens
aagatgaagtttta

SEQ ID NO: 982646 - DNA, 21 bp, Homo sapiens
aagatgaattttatcagccat

SEQ ID NO: 982647 - DNA, 13 bp, Homo sapiens
aagatgacacaag

SEQ ID NO: 982648 - DNA, 22 bp, Homo sapiens
aagatgagattggcatggcttt

SEQ ID NO: 982649 - DNA, 16 bp, Homo sapiens
aagatgagctctgaac

SEQ ID NO: 982650 - DNA, 18 bp, Homo sapiens
aagatgagctgtgcgctg

SEQ ID NO: 982651 - DNA, 18 bp, Homo sapiens
aagatgatctactcagaa

SEQ ID NO: 982652 - DNA, 14 bp, Homo sapiens
aagatgatggaaac

SEQ ID NO: 982653 - DNA, 14 bp, Homo sapiens
aagatgcattttta

SEQ ID NO: 982654 - DNA, 15 bp, Homo sapiens
aagatgccacattca

SEQ ID NO: 982655 - DNA, 22 bp, Homo sapiens
aagatgccacattcaaaatagg

SEQ ID NO: 982656 - DNA, 24 bp, Homo sapiens
aagatgcccactgaggaatgatga

SEQ ID NO: 982657 - DNA, 15 bp, Homo sapiens
aagatgcccctgctc

SEQ ID NO: 982658 - DNA, 17 bp, Homo sapiens
aagatgcccctgctccc

SEQ ID NO: 982659 - DNA, 18 bp, Homo sapiens
aagatgcctgttaattta

SEQ ID NO: 982660 - DNA, 17 bp, Homo sapiens
aagatgctcttctgtgg

SEQ ID NO: 982661 - DNA, 10 bp, Homo sapiens
aagatgctgg

SEQ ID NO: 982662 - DNA, 20 bp, Homo sapiens
aagatgctgggttggtgcac

SEQ ID NO: 982663 - DNA, 16 bp, Homo sapiens
aagatgcttctcactg

SEQ ID NO: 982664 - DNA, 21 bp, Homo sapiens
aagatggacacgagccacaag

SEQ ID NO: 982665 - DNA, 15 bp, Homo sapiens
aagatggatgtgctt

SEQ ID NO: 982666 - DNA, 18 bp, Homo sapiens
aagatggattaaactcag

SEQ ID NO: 982667 - DNA, 16 bp, Homo sapiens
aagatggattctcaga

SEQ ID NO: 982668 - DNA, 22 bp, Homo sapiens
aagatggcccagctccccaaga

SEQ ID NO: 982669 - DNA, 19 bp, Homo sapiens
aagatggcgaccaccaaag

SEQ ID NO: 982670 - DNA, 20 bp, Homo sapiens
aagatggcgaccaccaaagt

SEQ ID NO: 982671 - DNA, 17 bp, Homo sapiens
aagatggctcagagggg

SEQ ID NO: 982672 - DNA, 20 bp, Homo sapiens
aagatggctgtgcctctgcc

SEQ ID NO: 982673 - DNA, 21 bp, Homo sapiens
aagatggctgtgcctctgcct

SEQ ID NO: 982674 - DNA, 18 bp, Homo sapiens
aagatgggggcagggctg

SEQ ID NO: 982675 - DNA, 23 bp, Homo sapiens
aagatgggggcagggctgtgctt

SEQ ID NO: 982676 - DNA, 23 bp, Homo sapiens
aagatggtccgtgcccaggccct

SEQ ID NO: 982677 - DNA, 21 bp, Homo sapiens
aagatggtggccacagactga

SEQ ID NO: 982678 - DNA, 15 bp, Homo sapiens
aagatggtggctgtg

SEQ ID NO: 982679 - DNA, 15 bp, Homo sapiens
aagatgtacatttaa

SEQ ID NO: 982680 - DNA, 20 bp, Homo sapiens
aagatgtacatttaataata

SEQ ID NO: 982681 - DNA, 17 bp, Homo sapiens
aagatgtacttctctgt

SEQ ID NO: 982682 - DNA, 16 bp, Homo sapiens
aagatgtagatttatt

SEQ ID NO: 982683 - DNA, 14 bp, Homo sapiens
aagatgtatatagg

SEQ ID NO: 982684 - DNA, 16 bp, Homo sapiens
aagatgtcagactggc

SEQ ID NO: 982685 - DNA, 12 bp, Homo sapiens
aagatgtctcct

SEQ ID NO: 982686 - DNA, 13 bp, Homo sapiens
aagatgtctcctc

SEQ ID NO: 982687 - DNA, 21 bp, Homo sapiens
aagatgtctcctcaagcctgt

SEQ ID NO: 982688 - DNA, 12 bp, Homo sapiens
aagatgtgaatt

SEQ ID NO: 982689 - DNA, 17 bp, Homo sapiens
aagcctaagggatcctg

SEQ ID NO: 982690 - DNA, 20 bp, Homo sapiens
aagcctagaagagcttctga

SEQ ID NO: 982691 - DNA, 20 bp, Homo sapiens
aagcctatacgtttctgtgg

SEQ ID NO: 982692 - DNA, 15 bp, Homo sapiens
aagcctcaaaacaaa

SEQ ID NO: 982693 - DNA, 16 bp, Homo sapiens
aagcctcaaaacaaag

SEQ ID NO: 982694 - DNA, 19 bp, Homo sapiens
aagcctccaagcctgcctc

SEQ ID NO: 982695 - DNA, 19 bp, Homo sapiens
aagcctccaagggtttcga

SEQ ID NO: 982696 - DNA, 15 bp, Homo sapiens
aagcctccacagcga

SEQ ID NO: 982697 - DNA, 19 bp, Homo sapiens
aagcctccatttagttctt

SEQ ID NO: 982698 - DNA, 20 bp, Homo sapiens
aagcctccatttagttcttt

SEQ ID NO: 982699 - DNA, 19 bp, Homo sapiens
aagcctcctccagccgcca

SEQ ID NO: 982700 - DNA, 19 bp, Homo sapiens
aagcctccttagaaaaaaa

SEQ ID NO: 982701 - DNA, 17 bp, Homo sapiens
aagcctctctccttggc

SEQ ID NO: 982702 - DNA, 16 bp, Homo sapiens
aagctcccaggaacaa

SEQ ID NO: 982703 - DNA, 11 bp, Homo sapiens
aagctccctgc

SEQ ID NO: 982704 - DNA, 16 bp, Homo sapiens
aagctccctggagccc

SEQ ID NO: 982705 - DNA, 16 bp, Homo sapiens
aagctcctacttttgc

SEQ ID NO: 982706 - DNA, 19 bp, Homo sapiens
aagctcctcctccctgcat

SEQ ID NO: 982707 - DNA, 14 bp, Homo sapiens
aagctcctcctcgg

SEQ ID NO: 982708 - DNA, 17 bp, Homo sapiens
aagctcctcctcggaac

SEQ ID NO: 982709 - DNA, 14 bp, Homo sapiens
aagctccttcctgt

SEQ ID NO: 982710 - DNA, 19 bp, Homo sapiens
aagctcgcatccagacagt

SEQ ID NO: 982711 - DNA, 21 bp, Homo sapiens
aagctctactgaggtgctatg

SEQ ID NO: 982712 - DNA, 15 bp, Homo sapiens
aagctctctgcatct

SEQ ID NO: 982713 - DNA, 12 bp, Homo sapiens
aagctctcttaa

SEQ ID NO: 982714 - DNA, 14 bp, Homo sapiens
aagctctgaaaaca

SEQ ID NO: 982715 - DNA, 15 bp, Homo sapiens
aagctctgaagaact

SEQ ID NO: 982716 - DNA, 22 bp, Homo sapiens
aagctctgaagtcacatcacag

SEQ ID NO: 982717 - DNA, 15 bp, Homo sapiens
aagctctggctgaac

SEQ ID NO: 982718 - DNA, 21 bp, Homo sapiens
aagctctggctgaaccctgtg

SEQ ID NO: 982719 - DNA, 24 bp, Homo sapiens
aagctctggctgaaccctgtgctg

SEQ ID NO: 982720 - DNA, 12 bp, Homo sapiens
aagctctgggga

SEQ ID NO: 982721 - DNA, 20 bp, Homo sapiens
aagctctggggatgggtggg

SEQ ID NO: 982722 - DNA, 16 bp, Homo sapiens
aagctcttactctttc

SEQ ID NO: 982723 - DNA, 21 bp, Homo sapiens
aagctcttggacaacagctct

SEQ ID NO: 982724 - DNA, 15 bp, Homo sapiens
aagctctttgagaac

SEQ ID NO: 982725 - DNA, 22 bp, Homo sapiens
aagctgaagaggttgaagctaa

SEQ ID NO: 982726 - DNA, 17 bp, Homo sapiens
aagctgaagcccccctt

SEQ ID NO: 982727 - DNA, 12 bp, Homo sapiens
aagctgaagcta

SEQ ID NO: 982728 - DNA, 23 bp, Homo sapiens
aagctgaatacattctgctttca

SEQ ID NO: 982729 - DNA, 13 bp, Homo sapiens
aagctgaatattt

SEQ ID NO: 982730 - DNA, 23 bp, Homo sapiens
aagctgaatattttttatttcta

SEQ ID NO: 982731 - DNA, 14 bp, Homo sapiens
aagctgagaaaagt

SEQ ID NO: 982732 - DNA, 15 bp, Homo sapiens
aagctgagaaaagta

SEQ ID NO: 982733 - DNA, 18 bp, Homo sapiens
aagctgagagaccctggc

SEQ ID NO: 982734 - DNA, 19 bp, Homo sapiens
aagctgagagaccctggcc

SEQ ID NO: 982735 - DNA, 22 bp, Homo sapiens
aagctgagagaccctggcctca

SEQ ID NO: 982736 - DNA, 11 bp, Homo sapiens
aagctgagcca

SEQ ID NO: 982737 - DNA, 23 bp, Homo sapiens
aagctgagttacttgtctgaggc

SEQ ID NO: 982738 - DNA, 23 bp, Homo sapiens
aagctgagttaggtgtctgtcct

SEQ ID NO: 982739 - DNA, 19 bp, Homo sapiens
aagctgattactgtcaata

SEQ ID NO: 982740 - DNA, 15 bp, Homo sapiens
aagctgcaaatctga

SEQ ID NO: 982741 - DNA, 19 bp, Homo sapiens
aagctgcaaatctgatggc

SEQ ID NO: 982742 - DNA, 18 bp, Homo sapiens
aagctgccacccctcttc

SEQ ID NO: 982743 - DNA, 19 bp, Homo sapiens
aagctgccacccctcttct

SEQ ID NO: 982744 - DNA, 19 bp, Homo sapiens
aagctgcctctgacagcag

SEQ ID NO: 982745 - DNA, 14 bp, Homo sapiens
aagctgcctgtagt

SEQ ID NO: 982746 - DNA, 15 bp, Homo sapiens
aagctgcctgtagtt

SEQ ID NO: 982747 - DNA, 16 bp, Homo sapiens
aagctgcctgtgccat

SEQ ID NO: 982748 - DNA, 22 bp, Homo sapiens
aagctgcctgtgccatgcccaa

SEQ ID NO: 982749 - DNA, 12 bp, Homo sapiens
aagctgctctga

SEQ ID NO: 982750 - DNA, 16 bp, Homo sapiens
aagctgctctgagcca

SEQ ID NO: 982751 - DNA, 21 bp, Homo sapiens
aagctgctgaccaattgtgct

SEQ ID NO: 982752 - DNA, 15 bp, Homo sapiens
aagctgctgaggccc

SEQ ID NO: 982753 - DNA, 15 bp, Homo sapiens
aagctggaacatttg

SEQ ID NO: 982754 - DNA, 16 bp, Homo sapiens
aagctggaacatttga

SEQ ID NO: 982755 - DNA, 14 bp, Homo sapiens
aagctggactagtg

SEQ ID NO: 982756 - DNA, 13 bp, Homo sapiens
aagctggagcagc

SEQ ID NO: 982757 - DNA, 16 bp, Homo sapiens
aagctggagcagcgga

SEQ ID NO: 982758 - DNA, 21 bp, Homo sapiens
aagctggagcagcggattgct

SEQ ID NO: 982759 - DNA, 17 bp, Homo sapiens
aagctggagtgctgctt

SEQ ID NO: 982760 - DNA, 21 bp, Homo sapiens
aagctggccgagggtcctggc

SEQ ID NO: 982761 - DNA, 21 bp, Homo sapiens
aagctggctgtacctgttcct

SEQ ID NO: 982762 - DNA, 21 bp, Homo sapiens
aagctggctttgaaacctcag

SEQ ID NO: 982763 - DNA, 22 bp, Homo sapiens
aagctgggaaaaaagttttgat

SEQ ID NO: 982764 - DNA, 19 bp, Homo sapiens
aagctggtcttaaactcct

SEQ ID NO: 982765 - DNA, 18 bp, Homo sapiens
aagctggtggcctctgca

SEQ ID NO: 982766 - DNA, 16 bp, Homo sapiens
aagctggtttaatgtt

SEQ ID NO: 982767 - DNA, 16 bp, Homo sapiens
aagctgtaaattacta

SEQ ID NO: 982768 - DNA, 20 bp, Homo sapiens
aagctgtactcagagcagag

SEQ ID NO: 982769 - DNA, 16 bp, Homo sapiens
aagctgtcaggctggg

SEQ ID NO: 982770 - DNA, 13 bp, Homo sapiens
aagctgtctactg

SEQ ID NO: 982771 - DNA, 13 bp, Homo sapiens
aagctgtgcaggc

SEQ ID NO: 982772 - DNA, 22 bp, Homo sapiens
aagctgtggcagccgtcccagg

SEQ ID NO: 982773 - DNA, 20 bp, Homo sapiens
aagctgtgtccttgcacctg

SEQ ID NO: 982774 - DNA, 18 bp, Homo sapiens
aagctgttaaactgttag

SEQ ID NO: 982775 - DNA, 19 bp, Homo sapiens
aagctgttggcctctgcaa

SEQ ID NO: 982776 - DNA, 13 bp, Homo sapiens
aagcttaaaaaga

SEQ ID NO: 982777 - DNA, 13 bp, Homo sapiens
aagcttaaaactt

SEQ ID NO: 982778 - DNA, 17 bp, Homo sapiens
aagcttaaaactttgaa

SEQ ID NO: 982779 - DNA, 15 bp, Homo sapiens
aagcttaaactgaat

SEQ ID NO: 982780 - DNA, 21 bp, Homo sapiens
aagcttaatggctgataattt

SEQ ID NO: 982781 - DNA, 14 bp, Homo sapiens
aagcttcaaattaa

SEQ ID NO: 982782 - DNA, 18 bp, Homo sapiens
aagcttcaaattaaaaca

SEQ ID NO: 982783 - DNA, 12 bp, Homo sapiens
aagcttcagact

SEQ ID NO: 982784 - DNA, 18 bp, Homo sapiens
aagcttcccaagtagctg

SEQ ID NO: 982785 - DNA, 22 bp, Homo sapiens
aagcttccgggaaaacagctat

SEQ ID NO: 982786 - DNA, 11 bp, Homo sapiens
aagcttcctgt

SEQ ID NO: 982787 - DNA, 23 bp, Homo sapiens
aagcttcgtcttgtgtttgctgc

SEQ ID NO: 982788 - DNA, 13 bp, Homo sapiens
aagcttctaaagc

SEQ ID NO: 982789 - DNA, 13 bp, Homo sapiens
aagcttctaatta

SEQ ID NO: 982790 - DNA, 17 bp, Homo sapiens
aagcttgactcccaagt

SEQ ID NO: 982791 - DNA, 20 bp, Homo sapiens
aagcttgatttgatctttgt

SEQ ID NO: 982792 - DNA, 17 bp, Homo sapiens
aagcttgcaccttttca

SEQ ID NO: 982793 - DNA, 21 bp, Homo sapiens
aagcttggtcaaactttttcc

SEQ ID NO: 982794 - DNA, 15 bp, Homo sapiens
aagcttgttttccag

SEQ ID NO: 982795 - DNA, 14 bp, Homo sapiens
aagctttaaattat

SEQ ID NO: 982796 - DNA, 17 bp, Homo sapiens
aagctttaaattatgtg

SEQ ID NO: 982797 - DNA, 17 bp, Homo sapiens
aagctttactactgtgg

SEQ ID NO: 982798 - DNA, 14 bp, Homo sapiens
aagctttaggcaga

SEQ ID NO: 982799 - DNA, 14 bp, Homo sapiens
aagctttatctttg

SEQ ID NO: 982800 - DNA, 16 bp, Homo sapiens
aagctttattaccagt

SEQ ID NO: 982801 - DNA, 15 bp, Homo sapiens
aagctttcaacatgt

SEQ ID NO: 982802 - DNA, 12 bp, Homo sapiens
aagctttcctgc

SEQ ID NO: 982803 - DNA, 11 bp, Homo sapiens
aagctttctca

SEQ ID NO: 982804 - DNA, 16 bp, Homo sapiens
aagctttctctcagaa

SEQ ID NO: 982805 - DNA, 20 bp, Homo sapiens
aagctttgaatactgtgaaa

SEQ ID NO: 982806 - DNA, 21 bp, Homo sapiens
aagctttgaggctctgtcact

SEQ ID NO: 982807 - DNA, 11 bp, Homo sapiens
aagctttgcta

SEQ ID NO: 982808 - DNA, 21 bp, Homo sapiens
aagctttgctacaaatttatg

SEQ ID NO: 982809 - DNA, 16 bp, Homo sapiens
aagcttttaagaaaaa

SEQ ID NO: 982810 - DNA, 13 bp, Homo sapiens
aagcttttagaaa

SEQ ID NO: 982811 - DNA, 18 bp, Homo sapiens
aagcttttagaaatactg

SEQ ID NO: 982812 - DNA, 13 bp, Homo sapiens
aagcttttattcg

SEQ ID NO: 982813 - DNA, 13 bp, Homo sapiens
aagcttttatttc

SEQ ID NO: 982814 - DNA, 22 bp, Homo sapiens
aagcttttgtctacacaccctg

SEQ ID NO: 982815 - DNA, 13 bp, Homo sapiens
aagctttttggaa

SEQ ID NO: 982816 - DNA, 16 bp, Homo sapiens
aaggaaaaaaaacaca

SEQ ID NO: 982817 - DNA, 15 bp, Homo sapiens
aaggaaaaatgtgta

SEQ ID NO: 982818 - DNA, 23 bp, Homo sapiens
aaggaaaacaattcaagctgaga

SEQ ID NO: 982819 - DNA, 19 bp, Homo sapiens
aaggaaaagcaagaaacag

SEQ ID NO: 982820 - DNA, 18 bp, Homo sapiens
aagcacattttaaaagtg

SEQ ID NO: 982821 - DNA, 21 bp, Homo sapiens
aagcaccaaaataagaaaaga

SEQ ID NO: 982822 - DNA, 20 bp, Homo sapiens
aagcaccagcttctccaggc

SEQ ID NO: 982823 - DNA, 14 bp, Homo sapiens
aagcaccccatgcc

SEQ ID NO: 982824 - DNA, 12 bp, Homo sapiens
aagcacccttga

SEQ ID NO: 982825 - DNA, 19 bp, Homo sapiens
aagcaccgcctccaaatgc

SEQ ID NO: 982826 - DNA, 20 bp, Homo sapiens
aagcacctgccgacctcgtc

SEQ ID NO: 982827 - DNA, 15 bp, Homo sapiens
aagcactacaatcat

SEQ ID NO: 982828 - DNA, 16 bp, Homo sapiens
aagcactacaatcatg

SEQ ID NO: 982829 - DNA, 23 bp, Homo sapiens
aagcactacataaactgacttta

SEQ ID NO: 982830 - DNA, 19 bp, Homo sapiens
aagcactattttatattta

SEQ ID NO: 982831 - DNA, 16 bp, Homo sapiens
aagcactgacctgtca

SEQ ID NO: 982832 - DNA, 21 bp, Homo sapiens
aagcactgacctgtcatgccc

SEQ ID NO: 982833 - DNA, 18 bp, Homo sapiens
aagcacttgcctggaata

SEQ ID NO: 982834 - DNA, 19 bp, Homo sapiens
aagcacttggactcttgct

SEQ ID NO: 982835 - DNA, 18 bp, Homo sapiens
aagcactttaatggcctg

SEQ ID NO: 982836 - DNA, 21 bp, Homo sapiens
aagcactttaatggcctggag

SEQ ID NO: 982837 - DNA, 15 bp, Homo sapiens
aagcactttgaaaat

SEQ ID NO: 982838 - DNA, 22 bp, Homo sapiens
aagcactttgaaaatatttcta

SEQ ID NO: 982839 - DNA, 15 bp, Homo sapiens
aagcactttgcactt

SEQ ID NO: 982840 - DNA, 18 bp, Homo sapiens
aagcactttgggattctt

SEQ ID NO: 982841 - DNA, 17 bp, Homo sapiens
aagcagaacaaatgtgt

SEQ ID NO: 982842 - DNA, 14 bp, Homo sapiens
aacaactttcagtg

SEQ ID NO: 982843 - DNA, 15 bp, Homo sapiens
aacaactttgtgctt

SEQ ID NO: 982844 - DNA, 13 bp, Homo sapiens
aacaagaaaacat

SEQ ID NO: 982845 - DNA, 14 bp, Homo sapiens
aacaagaagaaata

SEQ ID NO: 982846 - DNA, 15 bp, Homo sapiens
aacaagaagaaatat

SEQ ID NO: 982847 - DNA, 14 bp, Homo sapiens
aacaagacagcctt

SEQ ID NO: 982848 - DNA, 16 bp, Homo sapiens
aacaagaccacgtttc

SEQ ID NO: 982849 - DNA, 20 bp, Homo sapiens
aacaagaccacgtttctaaa

SEQ ID NO: 982850 - DNA, 23 bp, Homo sapiens
aacaagacctcagtgccttcctg

SEQ ID NO: 982851 - DNA, 15 bp, Homo sapiens
aacaagactgccagg

SEQ ID NO: 982852 - DNA, 19 bp, Homo sapiens
aacaagagcgaaactccgt

SEQ ID NO: 982853 - DNA, 20 bp, Homo sapiens
aacaagagtttgttctgttc

SEQ ID NO: 982854 - DNA, 19 bp, Homo sapiens
aacaagcaaggatatcaga

SEQ ID NO: 982855 - DNA, 15 bp, Homo sapiens
aacaagcatttcaaa

SEQ ID NO: 982856 - DNA, 23 bp, Homo sapiens
aacaagctaattgggagtccagg

SEQ ID NO: 982857 - DNA, 16 bp, Homo sapiens
aacaagctggcttctg

SEQ ID NO: 982858 - DNA, 12 bp, Homo sapiens
aacaagctgtgc

SEQ ID NO: 982859 - DNA, 22 bp, Homo sapiens
aacaaggaaaaatgccactccc

SEQ ID NO: 982860 - DNA, 15 bp, Homo sapiens
aacaaggaagccaaa

SEQ ID NO: 982861 - DNA, 12 bp, Homo sapiens
aacaaggaatgc

SEQ ID NO: 982862 - DNA, 22 bp, Homo sapiens
aacaagggaaggggcctccctc

SEQ ID NO: 982863 - DNA, 20 bp, Homo sapiens
aacaagggagagacctcatc

SEQ ID NO: 982864 - DNA, 21 bp, Homo sapiens
aacaagggagagacctcatca

SEQ ID NO: 982865 - DNA, 13 bp, Homo sapiens
aacaagtaatgta

SEQ ID NO: 982866 - DNA, 14 bp, Homo sapiens
aacaagtaatgtat

SEQ ID NO: 982867 - DNA, 15 bp, Homo sapiens
aacaagtaatgtatt

SEQ ID NO: 982868 - DNA, 14 bp, Homo sapiens
aacaagtatataat

SEQ ID NO: 982869 - DNA, 12 bp, Homo sapiens
aacaagtatttg

SEQ ID NO: 982870 - DNA, 23 bp, Homo sapiens
aacaagtatttgttaatttagaa

SEQ ID NO: 982871 - DNA, 17 bp, Homo sapiens
aacaagtcacagctgca

SEQ ID NO: 982872 - DNA, 20 bp, Homo sapiens
aacaagtcacagctgcagct

SEQ ID NO: 982873 - DNA, 16 bp, Homo sapiens
aacaagtccctgtaat

SEQ ID NO: 982874 - DNA, 20 bp, Homo sapiens
aacaagtgaccccagggcct

SEQ ID NO: 982875 - DNA, 16 bp, Homo sapiens
aacaagtggatgtttt

SEQ ID NO: 982876 - DNA, 17 bp, Homo sapiens
aacaagttttaatgtat

SEQ ID NO: 982877 - DNA, 20 bp, Homo sapiens
aacaagttttaatgtatagt

SEQ ID NO: 982878 - DNA, 13 bp, Homo sapiens
aacaataaaaaca

SEQ ID NO: 982879 - DNA, 22 bp, Homo sapiens
aacaataaaaacaactttcact

SEQ ID NO: 982880 - DNA, 12 bp, Homo sapiens
aacaataaacag

SEQ ID NO: 982881 - DNA, 18 bp, Homo sapiens
aacaataactactgtgtt

SEQ ID NO: 982882 - DNA, 16 bp, Homo sapiens
aacaataacttttata

SEQ ID NO: 982883 - DNA, 14 bp, Homo sapiens
aacaatacaaatgg

SEQ ID NO: 982884 - DNA, 21 bp, Homo sapiens
aacaatatgtttgcaaacttg

SEQ ID NO: 982885 - DNA, 16 bp, Homo sapiens
aacaatattgtctgaa

SEQ ID NO: 982886 - DNA, 15 bp, Homo sapiens
aacaatcactattct

SEQ ID NO: 982887 - DNA, 22 bp, Homo sapiens
aacaatccatgtgattaatgtt

SEQ ID NO: 982888 - DNA, 20 bp, Homo sapiens
aacaatctggaagaaaaaaa

SEQ ID NO: 982889 - DNA, 22 bp, Homo sapiens
aacaatcttattccgagcattc

SEQ ID NO: 982890 - DNA, 18 bp, Homo sapiens
aacaatgaaaactctttg

SEQ ID NO: 982891 - DNA, 19 bp, Homo sapiens
aacaatgaatcagaacaga

SEQ ID NO: 982892 - DNA, 19 bp, Homo sapiens
aacaatgacatccagaaag

SEQ ID NO: 982893 - DNA, 20 bp, Homo sapiens
aacaatggtaacatttttca

SEQ ID NO: 982894 - DNA, 21 bp, Homo sapiens
aacaatgtataaagattgtac

SEQ ID NO: 982895 - DNA, 17 bp, Homo sapiens
aacaatgttgtccaaca

SEQ ID NO: 982896 - DNA, 20 bp, Homo sapiens
aacaatgttgttttaagact

SEQ ID NO: 982897 - DNA, 22 bp, Homo sapiens
aacaatgtttgggggaaaaaaa

SEQ ID NO: 982898 - DNA, 15 bp, Homo sapiens
aacaattaattgtct

SEQ ID NO: 982899 - DNA, 16 bp, Homo sapiens
aacaattcaagctgag

SEQ ID NO: 982900 - DNA, 20 bp, Homo sapiens
aacaattcaagctgagaaaa

SEQ ID NO: 982901 - DNA, 13 bp, Homo sapiens
aacaattcagtgg

SEQ ID NO: 982902 - DNA, 12 bp, Homo sapiens
aacaattctaaa

SEQ ID NO: 982903 - DNA, 17 bp, Homo sapiens
aacaattgaagtaaact

SEQ ID NO: 982904 - DNA, 18 bp, Homo sapiens
aacaattgtgtagccttt

SEQ ID NO: 982905 - DNA, 22 bp, Homo sapiens
aacaatttattttattttagca

SEQ ID NO: 982906 - DNA, 20 bp, Homo sapiens
aacaatttcctttatattta

SEQ ID NO: 982907 - DNA, 21 bp, Homo sapiens
aacaatttcctttatatttag

SEQ ID NO: 982908 - DNA, 22 bp, Homo sapiens
aacaattttcagacctgttggt

SEQ ID NO: 982909 - DNA, 14 bp, Homo sapiens
aacaattttctgca

SEQ ID NO: 982910 - DNA, 17 bp, Homo sapiens
aacaattttttttttcc

SEQ ID NO: 982911 - DNA, 17 bp, Homo sapiens
aacacaaaacattcatg

SEQ ID NO: 982912 - DNA, 18 bp, Homo sapiens
aacacaaaacattcatgt

SEQ ID NO: 982913 - DNA, 19 bp, Homo sapiens
aacacaaacgggctcagca

SEQ ID NO: 982914 - DNA, 12 bp, Homo sapiens
aacacaagcaaa

SEQ ID NO: 982915 - DNA, 13 bp, Homo sapiens
aacacaagcaaaa

SEQ ID NO: 982916 - DNA, 16 bp, Homo sapiens
aacacaagcaaaaaaa

SEQ ID NO: 982917 - DNA, 16 bp, Homo sapiens
aacacaagccacagaa

SEQ ID NO: 982918 - DNA, 23 bp, Homo sapiens
aacacaagtagatgcctgaactt

SEQ ID NO: 982919 - DNA, 22 bp, Homo sapiens
aacacacacgccagctcctctc

SEQ ID NO: 982920 - DNA, 17 bp, Homo sapiens
aacacacataaaccaaa

SEQ ID NO: 982921 - DNA, 16 bp, Homo sapiens
aacacaccaggctgtg

SEQ ID NO: 982922 - DNA, 10 bp, Homo sapiens
aacacacctc

SEQ ID NO: 982923 - DNA, 19 bp, Homo sapiens
aacacactaccgaatgtgt

SEQ ID NO: 982924 - DNA, 13 bp, Homo sapiens
aacacactgtgtc

SEQ ID NO: 982925 - DNA, 19 bp, Homo sapiens
aacacagataattttttct

SEQ ID NO: 982926 - DNA, 18 bp, Homo sapiens
aacacagcaattcctcag

SEQ ID NO: 982927 - DNA, 14 bp, Homo sapiens
aacacagcctccct

SEQ ID NO: 982928 - DNA, 16 bp, Homo sapiens
aacacagcctccctga

SEQ ID NO: 982929 - DNA, 15 bp, Homo sapiens
aacacagccttcctt

SEQ ID NO: 982930 - DNA, 19 bp, Homo sapiens
aacacagctgagagacttt

SEQ ID NO: 982931 - DNA, 16 bp, Homo sapiens
aacacagtcaaaataa

SEQ ID NO: 982932 - DNA, 19 bp, Homo sapiens
aacacagtcaaaataattc

SEQ ID NO: 982933 - DNA, 22 bp, Homo sapiens
aacacagtgtctgttcagcaaa

SEQ ID NO: 982934 - DNA, 15 bp, Homo sapiens
aacacagtgtttcaa

SEQ ID NO: 982935 - DNA, 14 bp, Homo sapiens
aacacagttttgaa

SEQ ID NO: 982936 - DNA, 21 bp, Homo sapiens
aacacatacaggaaggtagaa

SEQ ID NO: 982937 - DNA, 20 bp, Homo sapiens
aacacatagattcacctgta

SEQ ID NO: 982938 - DNA, 21 bp, Homo sapiens
aacacatagcgccgtgctgta

SEQ ID NO: 982939 - DNA, 18 bp, Homo sapiens
aacacatctggctgcaca

SEQ ID NO: 982940 - DNA, 21 bp, Homo sapiens
aacacattatcgggagcagtg

SEQ ID NO: 982941 - DNA, 21 bp, Homo sapiens
aacacattctttataaaatgt

SEQ ID NO: 982942 - DNA, 18 bp, Homo sapiens
aacacattgaatgcgctt

SEQ ID NO: 982943 - DNA, 19 bp, Homo sapiens
aacacattgaatgcgcttt

SEQ ID NO: 982944 - DNA, 23 bp, Homo sapiens
aacacattgaatgcgctttattg

SEQ ID NO: 982945 - DNA, 20 bp, Homo sapiens
aacacatttgattctgtgtg

SEQ ID NO: 982946 - DNA, 22 bp, Homo sapiens
aacacatttgggatgttccttt

SEQ ID NO: 982947 - DNA, 19 bp, Homo sapiens
aacacatttttcttaggga

SEQ ID NO: 982948 - DNA, 16 bp, Homo sapiens
aacaccaacccaggaa

SEQ ID NO: 982949 - DNA, 17 bp, Homo sapiens
aacaccaagcacagcag

SEQ ID NO: 982950 - DNA, 19 bp, Homo sapiens
aacaccaagcacagcagcc

SEQ ID NO: 982951 - DNA, 15 bp, Homo sapiens
aacaccacagacaca

SEQ ID NO: 982952 - DNA, 21 bp, Homo sapiens
aacaccagccccacttctggg

SEQ ID NO: 982953 - DNA, 17 bp, Homo sapiens
aacaccattgaaggctt

SEQ ID NO: 982954 - DNA, 20 bp, Homo sapiens
aacagcgaagtagcttgctc

SEQ ID NO: 982955 - DNA, 21 bp, Homo sapiens
aacagcgggagacctgtgcta

SEQ ID NO: 982956 - DNA, 18 bp, Homo sapiens
aacagctatgggagcccc

SEQ ID NO: 982957 - DNA, 21 bp, Homo sapiens
aacagctattatatcagcttt

SEQ ID NO: 982958 - DNA, 14 bp, Homo sapiens
aacagctctgagat

SEQ ID NO: 982959 - DNA, 21 bp, Homo sapiens
aacagctgaggtctcttgagg

SEQ ID NO: 982960 - DNA, 20 bp, Homo sapiens
aacagctgcttctcccccca

SEQ ID NO: 982961 - DNA, 22 bp, Homo sapiens
aacagctggaggaatacatttt

SEQ ID NO: 982962 - DNA, 23 bp, Homo sapiens
aacagctggaggaatacatttta

SEQ ID NO: 982963 - DNA, 21 bp, Homo sapiens
aacagctggtcctccactttg

SEQ ID NO: 982964 - DNA, 18 bp, Homo sapiens
aacagctgtcacaacttg

SEQ ID NO: 982965 - DNA, 16 bp, Homo sapiens
aacagctgtgtctgcc

SEQ ID NO: 982966 - DNA, 22 bp, Homo sapiens
aacagcttcatgcctttgtaag

SEQ ID NO: 982967 - DNA, 21 bp, Homo sapiens
aacagcttttcccaggagacc

SEQ ID NO: 982968 - DNA, 15 bp, Homo sapiens
aacaggaaaaaaact

SEQ ID NO: 982969 - DNA, 17 bp, Homo sapiens
aaatgtgaatttttatt

SEQ ID NO: 982970 - DNA, 13 bp, Homo sapiens
aaatgtgagaaat

SEQ ID NO: 982971 - DNA, 17 bp, Homo sapiens
aaatgtgagaaatgtct

SEQ ID NO: 982972 - DNA, 14 bp, Homo sapiens
aaatgtgcattttg

SEQ ID NO: 982973 - DNA, 16 bp, Homo sapiens
aaatgtgccatactaa

SEQ ID NO: 982974 - DNA, 19 bp, Homo sapiens
aaatgtggttgcttaattc

SEQ ID NO: 982975 - DNA, 10 bp, Homo sapiens
aaatgtgtaa

SEQ ID NO: 982976 - DNA, 23 bp, Homo sapiens
aaatgtgtacaatgtacacactg

SEQ ID NO: 982977 - DNA, 22 bp, Homo sapiens
aaatgtgtatatttttgtatgt

SEQ ID NO: 982978 - DNA, 20 bp, Homo sapiens
aaatgtgtatcggatgcttt

SEQ ID NO: 982979 - DNA, 13 bp, Homo sapiens
aaatgtgtatttt

SEQ ID NO: 982980 - DNA, 21 bp, Homo sapiens
aaatgtgtcagaataggaaaa

SEQ ID NO: 982981 - DNA, 23 bp, Homo sapiens
aaatgtgtgggatcattgcattt

SEQ ID NO: 982982 - DNA, 14 bp, Homo sapiens
aaatgtgtgtatgt

SEQ ID NO: 982983 - DNA, 14 bp, Homo sapiens
aaatgtgtttctgt

SEQ ID NO: 982984 - DNA, 13 bp, Homo sapiens
aaatgtgtttgct

SEQ ID NO: 982985 - DNA, 23 bp, Homo sapiens
aaatgtgttttgtttattaaata

SEQ ID NO: 982986 - DNA, 19 bp, Homo sapiens
aaatgtgtttttctatata

SEQ ID NO: 982987 - DNA, 14 bp, Homo sapiens
aaatgttaagaaat

SEQ ID NO: 982988 - DNA, 22 bp, Homo sapiens
aaatgttacgtgaagaaataaa

SEQ ID NO: 982989 - DNA, 20 bp, Homo sapiens
aaatgttatcttatactgta

SEQ ID NO: 982990 - DNA, 23 bp, Homo sapiens
aaatgttatcttatactgtacaa

SEQ ID NO: 982991 - DNA, 20 bp, Homo sapiens
aaatgttcccttgaccattg

SEQ ID NO: 982992 - DNA, 17 bp, Homo sapiens
aaatgttctatttaaca

SEQ ID NO: 982993 - DNA, 11 bp, Homo sapiens
aaatgttcttt

SEQ ID NO: 982994 - DNA, 23 bp, Homo sapiens
aaatgttgaaatatgatgttaaa

SEQ ID NO: 982995 - DNA, 12 bp, Homo sapiens
aaatgttgaata

SEQ ID NO: 982996 - DNA, 12 bp, Homo sapiens
aaatgttgagaa

SEQ ID NO: 982997 - DNA, 18 bp, Homo sapiens
aaatgttggatttataaa

SEQ ID NO: 982998 - DNA, 20 bp, Homo sapiens
aaatgttggatttataaatg

SEQ ID NO: 982999 - DNA, 21 bp, Homo sapiens
aaatgttggatttataaatgc

SEQ ID NO: 983000 - DNA, 22 bp, Homo sapiens
aaatgttggatttataaatgct

SEQ ID NO: 983001 - DNA, 12 bp, Homo sapiens
aaatgtttaaag

SEQ ID NO: 983002 - DNA, 14 bp, Homo sapiens
aaatgtttatttaa

SEQ ID NO: 983003 - DNA, 15 bp, Homo sapiens
aaatgtttatttaaa

SEQ ID NO: 983004 - DNA, 12 bp, Homo sapiens
aaatgtttcatt

SEQ ID NO: 983005 - DNA, 17 bp, Homo sapiens
aaatgtttccttaaaca

SEQ ID NO: 983006 - DNA, 20 bp, Homo sapiens
aaatgtttccttaaacatga

SEQ ID NO: 983007 - DNA, 10 bp, Homo sapiens
aaatgtttct

SEQ ID NO: 983008 - DNA, 15 bp, Homo sapiens
aaatgtttctgcagt

SEQ ID NO: 983009 - DNA, 11 bp, Homo sapiens
aaatgttttgc

SEQ ID NO: 983010 - DNA, 13 bp, Homo sapiens
aaatgttttgtaa

SEQ ID NO: 983011 - DNA, 20 bp, Homo sapiens
aaatgttttgtaaacattta

SEQ ID NO: 983012 - DNA, 21 bp, Homo sapiens
aaatgttttttaaaatggtta

SEQ ID NO: 983013 - DNA, 12 bp, Homo sapiens
aaattaaaaaaa

SEQ ID NO: 983014 - DNA, 22 bp, Homo sapiens
aaattaaaaaaaaattgtatct

SEQ ID NO: 983015 - DNA, 18 bp, Homo sapiens
aaattaaaaaatgaaatt

SEQ ID NO: 983016 - DNA, 14 bp, Homo sapiens
aaattaaaacaaat

SEQ ID NO: 983017 - DNA, 15 bp, Homo sapiens
aaattaaaacaaata

SEQ ID NO: 983018 - DNA, 22 bp, Homo sapiens
aaattaaaacatatttcatttt

SEQ ID NO: 983019 - DNA, 13 bp, Homo sapiens
aaattaaaacgaa

SEQ ID NO: 983020 - DNA, 21 bp, Homo sapiens
aaattaaaagtttgaaaagca

SEQ ID NO: 983021 - DNA, 16 bp, Homo sapiens
aaattaaaataggcat

SEQ ID NO: 983022 - DNA, 12 bp, Homo sapiens
aaattaaacaat

SEQ ID NO: 983023 - DNA, 13 bp, Homo sapiens
aaattaaacaatt

SEQ ID NO: 983024 - DNA, 14 bp, Homo sapiens
aaattaaagaaatg

SEQ ID NO: 983025 - DNA, 15 bp, Homo sapiens
aaattaaagaaatga

SEQ ID NO: 983026 - DNA, 13 bp, Homo sapiens
aaattaaagtatg

SEQ ID NO: 983027 - DNA, 15 bp, Homo sapiens
aaattaaagtatgca

SEQ ID NO: 983028 - DNA, 15 bp, Homo sapiens
aaattaaataaaata

SEQ ID NO: 983029 - DNA, 14 bp, Homo sapiens
aaattaaataaact

SEQ ID NO: 983030 - DNA, 17 bp, Homo sapiens
aaattaaataaactgtt

SEQ ID NO: 983031 - DNA, 21 bp, Homo sapiens
aaattaaataaactgttttca

SEQ ID NO: 983032 - DNA, 12 bp, Homo sapiens
aaattaaatcta

SEQ ID NO: 983033 - DNA, 23 bp, Homo sapiens
aaattaaatgccttgtataaaat

SEQ ID NO: 983034 - DNA, 17 bp, Homo sapiens
aaattaacagtcctaac

SEQ ID NO: 983035 - DNA, 16 bp, Homo sapiens
aaattaacatcagtgt

SEQ ID NO: 983036 - DNA, 13 bp, Homo sapiens
aaattaactgctc

SEQ ID NO: 983037 - DNA, 19 bp, Homo sapiens
aaattaactgtatgtgtgt

SEQ ID NO: 983038 - DNA, 12 bp, Homo sapiens
aaattaactttt

SEQ ID NO: 983039 - DNA, 15 bp, Homo sapiens
aaattaagaagaaac

SEQ ID NO: 983040 - DNA, 14 bp, Homo sapiens
aaattaagaaggca

SEQ ID NO: 983041 - DNA, 13 bp, Homo sapiens
aaattaagacaaa

SEQ ID NO: 983042 - DNA, 15 bp, Homo sapiens
aaattaagtagaaca

SEQ ID NO: 983043 - DNA, 13 bp, Homo sapiens
aaattaataatct

SEQ ID NO: 983044 - DNA, 11 bp, Homo sapiens
aaattaatatc

SEQ ID NO: 983045 - DNA, 14 bp, Homo sapiens
aaattaatttgtga

SEQ ID NO: 983046 - DNA, 16 bp, Homo sapiens
aaattacaattttatc

SEQ ID NO: 983047 - DNA, 19 bp, Homo sapiens
aaattacacaataaagcag

SEQ ID NO: 983048 - DNA, 14 bp, Homo sapiens
aaattacatatact

SEQ ID NO: 983049 - DNA, 13 bp, Homo sapiens
aaattacatgttt

SEQ ID NO: 983050 - DNA, 22 bp, Homo sapiens
aaattacatgttttttcatttg

SEQ ID NO: 983051 - DNA, 20 bp, Homo sapiens
aaattacctttaattttaat

SEQ ID NO: 983052 - DNA, 13 bp, Homo sapiens
aaattactccaag

SEQ ID NO: 983053 - DNA, 18 bp, Homo sapiens
aaattactccaaggttta

SEQ ID NO: 983054 - DNA, 14 bp, Homo sapiens
aaattactctttct

SEQ ID NO: 983055 - DNA, 22 bp, Homo sapiens
aaattactgtgtaaatatatgt

SEQ ID NO: 983056 - DNA, 13 bp, Homo sapiens
aaattagaaaata

SEQ ID NO: 983057 - DNA, 15 bp, Homo sapiens
aaattagaaaatatt

SEQ ID NO: 983058 - DNA, 15 bp, Homo sapiens
aaattaggaataaat

SEQ ID NO: 983059 - DNA, 18 bp, Homo sapiens
aaattaggaataaataaa

SEQ ID NO: 983060 - DNA, 18 bp, Homo sapiens
aaattagtacctcaaagt

SEQ ID NO: 983061 - DNA, 14 bp, Homo sapiens
aaattagtcttttt

SEQ ID NO: 983062 - DNA, 21 bp, Homo sapiens
aaattagtgaccattattcac

SEQ ID NO: 983063 - DNA, 13 bp, Homo sapiens
aaattagttatat

SEQ ID NO: 983064 - DNA, 16 bp, Homo sapiens
aaattataacttaaaa

SEQ ID NO: 983065 - DNA, 17 bp, Homo sapiens
aaattataacttaaaat

SEQ ID NO: 983066 - DNA, 16 bp, Homo sapiens
aaattatactgtagct

SEQ ID NO: 983067 - DNA, 13 bp, Homo sapiens
aaattatatccgt

SEQ ID NO: 983068 - DNA, 19 bp, Homo sapiens
aaattatatccgtgagttg

SEQ ID NO: 983069 - DNA, 13 bp, Homo sapiens
aaattatcaaaaa

SEQ ID NO: 983070 - DNA, 16 bp, Homo sapiens
aaattatctatagcta

SEQ ID NO: 983071 - DNA, 17 bp, Homo sapiens
aaattatcttgatacat

SEQ ID NO: 983072 - DNA, 21 bp, Homo sapiens
aaattatcttgatacattcaa

SEQ ID NO: 983073 - DNA, 12 bp, Homo sapiens
aaattatgcaaa

SEQ ID NO: 983074 - DNA, 14 bp, Homo sapiens
aaattatggaaaca

SEQ ID NO: 983075 - DNA, 17 bp, Homo sapiens
aaattatgtatgtttac

SEQ ID NO: 983076 - DNA, 14 bp, Homo sapiens
aaattatgttttaa

SEQ ID NO: 983077 - DNA, 22 bp, Homo sapiens
aaattattaattgtcctgtgtc

SEQ ID NO: 983078 - DNA, 13 bp, Homo sapiens
aaattattcagaa

SEQ ID NO: 983079 - DNA, 17 bp, Homo sapiens
aaatttagaaactaatt

SEQ ID NO: 983080 - DNA, 18 bp, Homo sapiens
aaatttagccctttaaaa

SEQ ID NO: 983081 - DNA, 22 bp, Homo sapiens
aaatttataaactaattttgta

SEQ ID NO: 983082 - DNA, 19 bp, Homo sapiens
aaatttatatactttttga

SEQ ID NO: 983083 - DNA, 11 bp, Homo sapiens
aaatttatgca

SEQ ID NO: 983084 - DNA, 13 bp, Homo sapiens
aaatttatgcatt

SEQ ID NO: 983085 - DNA, 18 bp, Homo sapiens
aaatttatgcatttcatt

SEQ ID NO: 983086 - DNA, 21 bp, Homo sapiens
aaatttatgcatttcattcaa

SEQ ID NO: 983087 - DNA, 19 bp, Homo sapiens
aaatttatttactgctagt

SEQ ID NO: 983088 - DNA, 18 bp, Homo sapiens
aaatttatttatattccg

SEQ ID NO: 983089 - DNA, 15 bp, Homo sapiens
aaatttatttccaat

SEQ ID NO: 983090 - DNA, 22 bp, Homo sapiens
aaatttattttataagaaaaac

SEQ ID NO: 983091 - DNA, 14 bp, Homo sapiens
aaatttcaaatgca

SEQ ID NO: 983092 - DNA, 17 bp, Homo sapiens
aaatttcacgattcatt

SEQ ID NO: 983093 - DNA, 19 bp, Homo sapiens
aaatttcataattctgaaa

SEQ ID NO: 983094 - DNA, 14 bp, Homo sapiens
aaatttcatgattg

SEQ ID NO: 983095 - DNA, 17 bp, Homo sapiens
aaatttcatgattggct

SEQ ID NO: 983096 - DNA, 23 bp, Homo sapiens
aaatttcccagttaaagattatt

SEQ ID NO: 983097 - DNA, 18 bp, Homo sapiens
aaatttccttcaggtttt

SEQ ID NO: 983098 - DNA, 13 bp, Homo sapiens
aaatttctaaatc

SEQ ID NO: 983099 - DNA, 16 bp, Homo sapiens
aaatttctaagagagc

SEQ ID NO: 983100 - DNA, 15 bp, Homo sapiens
aaatttctcattagt

SEQ ID NO: 983101 - DNA, 15 bp, Homo sapiens
aaatttcttatgtga

SEQ ID NO: 983102 - DNA, 20 bp, Homo sapiens
aaatttgactaattttacat

SEQ ID NO: 983103 - DNA, 16 bp, Homo sapiens
aaatttgacttttctg

SEQ ID NO: 983104 - DNA, 17 bp, Homo sapiens
aaatttgagaatacata

SEQ ID NO: 983105 - DNA, 15 bp, Homo sapiens
aaatttgatttccat

SEQ ID NO: 983106 - DNA, 14 bp, Homo sapiens
aaatttgatttcta

SEQ ID NO: 983107 - DNA, 13 bp, Homo sapiens
aaatttgatttga

SEQ ID NO: 983108 - DNA, 21 bp, Homo sapiens
aaatttgccatgacatttcat

SEQ ID NO: 983109 - DNA, 24 bp, Homo sapiens
aaatttgccatgacatttcatctg

SEQ ID NO: 983110 - DNA, 14 bp, Homo sapiens
aaatttggagtaaa

SEQ ID NO: 983111 - DNA, 17 bp, Homo sapiens
aaatttggccttaagaa

SEQ ID NO: 983112 - DNA, 18 bp, Homo sapiens
aaatttggccttaagaac

SEQ ID NO: 983113 - DNA, 22 bp, Homo sapiens
aaatttggccttaagaactgtg

SEQ ID NO: 983114 - DNA, 23 bp, Homo sapiens
aaatttggccttaagaactgtgt

SEQ ID NO: 983115 - DNA, 18 bp, Homo sapiens
aaatttgtctgaaacatt

SEQ ID NO: 983116 - DNA, 19 bp, Homo sapiens
aaatttgtctgaaacattt

SEQ ID NO: 983117 - DNA, 21 bp, Homo sapiens
aaatttgtctgaaacatttca

SEQ ID NO: 983118 - DNA, 15 bp, Homo sapiens
aaatttgtcttaaaa

SEQ ID NO: 983119 - DNA, 16 bp, Homo sapiens
aaatttgtcttaaaaa

SEQ ID NO: 983120 - DNA, 16 bp, Homo sapiens
aaatttgtgctgggtt

SEQ ID NO: 983121 - DNA, 19 bp, Homo sapiens
aaatttgttatacttcaaa

SEQ ID NO: 983122 - DNA, 20 bp, Homo sapiens
aaatttgttatacttcaaaa

SEQ ID NO: 983123 - DNA, 22 bp, Homo sapiens
aaatttgttttgacggatgatt

SEQ ID NO: 983124 - DNA, 10 bp, Homo sapiens
aaattttaaa

SEQ ID NO: 983125 - DNA, 14 bp, Homo sapiens
aaattttaaaaaag

SEQ ID NO: 983126 - DNA, 22 bp, Homo sapiens
aaattttaaagccattctgatt

SEQ ID NO: 983127 - DNA, 23 bp, Homo sapiens
aaattttaaggccacggccttgt

SEQ ID NO: 983128 - DNA, 12 bp, Homo sapiens
aaattttatatg

SEQ ID NO: 983129 - DNA, 19 bp, Homo sapiens
aaattttattaaacaattt

SEQ ID NO: 983130 - DNA, 12 bp, Homo sapiens
aaattttattcc

SEQ ID NO: 983131 - DNA, 14 bp, Homo sapiens
aaattttcaagttt

SEQ ID NO: 983132 - DNA, 21 bp, Homo sapiens
aaattttcttttaagcatttg

SEQ ID NO: 983133 - DNA, 18 bp, Homo sapiens
aaattttggccaaagtgt

SEQ ID NO: 983134 - DNA, 12 bp, Homo sapiens
aaattttgtaag

SEQ ID NO: 983135 - DNA, 12 bp, Homo sapiens
aaattttgtaat

SEQ ID NO: 983136 - DNA, 14 bp, Homo sapiens
aaattttgtaatga

SEQ ID NO: 983137 - DNA, 14 bp, Homo sapiens
aaattttgttttct

SEQ ID NO: 983138 - DNA, 15 bp, Homo sapiens
aaatttttaatgttt

SEQ ID NO: 983139 - DNA, 15 bp, Homo sapiens
aaatttttatttttc

SEQ ID NO: 983140 - DNA, 13 bp, Homo sapiens
aaatttttgaaaa

SEQ ID NO: 983141 - DNA, 14 bp, Homo sapiens
aaatttttgaaaaa

SEQ ID NO: 983142 - DNA, 17 bp, Homo sapiens
aaatttttgaaaaatat

SEQ ID NO: 983143 - DNA, 17 bp, Homo sapiens
aaatttttgacactttt

SEQ ID NO: 983144 - DNA, 17 bp, Homo sapiens
aaatttttgtagtagcg

SEQ ID NO: 983145 - DNA, 12 bp, Homo sapiens
aaatttttgtca

SEQ ID NO: 983146 - DNA, 17 bp, Homo sapiens
aaattttttaaaagttt

SEQ ID NO: 983147 - DNA, 20 bp, Homo sapiens
aaattttttgatgtcagcct

SEQ ID NO: 983148 - DNA, 11 bp, Homo sapiens
aaattttttgt

SEQ ID NO: 983149 - DNA, 14 bp, Homo sapiens
aaatttttttccta

SEQ ID NO: 983150 - DNA, 17 bp, Homo sapiens
aaattttttttacattt

SEQ ID NO: 983151 - DNA, 17 bp, Homo sapiens
aaatttttttttctctt

SEQ ID NO: 983152 - DNA, 17 bp, Homo sapiens
aaattttttttttaata

SEQ ID NO: 983153 - DNA, 16 bp, Homo sapiens
aacaaaaaaaaaatga

SEQ ID NO: 983154 - DNA, 12 bp, Homo sapiens
aacaaaaaaact

SEQ ID NO: 983155 - DNA, 13 bp, Homo sapiens
aacaaaaaacaga

SEQ ID NO: 983156 - DNA, 15 bp, Homo sapiens
aacaaaaaacagatt

SEQ ID NO: 983157 - DNA, 19 bp, Homo sapiens
aacaaaaacactaaaaata

SEQ ID NO: 983158 - DNA, 16 bp, Homo sapiens
aacaaaaagaaatctt

SEQ ID NO: 983159 - DNA, 13 bp, Homo sapiens
aacaaaaagaaca

SEQ ID NO: 983160 - DNA, 16 bp, Homo sapiens
aacaaaaagctaacat

SEQ ID NO: 983161 - DNA, 14 bp, Homo sapiens
aacaaaaagcttcc

SEQ ID NO: 983162 - DNA, 15 bp, Homo sapiens
aacaaaacaaacttc

SEQ ID NO: 983163 - DNA, 21 bp, Homo sapiens
aacaaaaggacttcaggaaca

SEQ ID NO: 983164 - DNA, 17 bp, Homo sapiens
aacaaaagggtgtatag

SEQ ID NO: 983165 - DNA, 11 bp, Homo sapiens
aacaaaagttt

SEQ ID NO: 983166 - DNA, 12 bp, Homo sapiens
aacaaaatagaa

SEQ ID NO: 983167 - DNA, 20 bp, Homo sapiens
aacaaaatagcttattatag

SEQ ID NO: 983168 - DNA, 15 bp, Homo sapiens
aacaaaatgaaaata

SEQ ID NO: 983169 - DNA, 17 bp, Homo sapiens
aacaaaatggcttcagt

SEQ ID NO: 983170 - DNA, 14 bp, Homo sapiens
aacaaaatgtatgt

SEQ ID NO: 983171 - DNA, 11 bp, Homo sapiens
aacaaaatttg

SEQ ID NO: 983172 - DNA, 24 bp, Homo sapiens
aacaaaatttgactaattttacat

SEQ ID NO: 983173 - DNA, 12 bp, Homo sapiens
aacaaaattttt

SEQ ID NO: 983174 - DNA, 15 bp, Homo sapiens
aacaaacaaaactta

SEQ ID NO: 983175 - DNA, 15 bp, Homo sapiens
aacaaaccaacatct

SEQ ID NO: 983176 - DNA, 22 bp, Homo sapiens
aacaaaccccgaaacagtaaga

SEQ ID NO: 983177 - DNA, 16 bp, Homo sapiens
aacaaactcgtttttt

SEQ ID NO: 983178 - DNA, 16 bp, Homo sapiens
aacaaactctctgaac

SEQ ID NO: 983179 - DNA, 14 bp, Homo sapiens
aacaaactcttcag

SEQ ID NO: 983180 - DNA, 19 bp, Homo sapiens
aacaaacttccaaacagtg

SEQ ID NO: 983181 - DNA, 23 bp, Homo sapiens
aacaaagagttcaagaaataagt

SEQ ID NO: 983182 - DNA, 15 bp, Homo sapiens
aacaaagcacagtgt

SEQ ID NO: 983183 - DNA, 16 bp, Homo sapiens
aacaaagcacagtgtt

SEQ ID NO: 983184 - DNA, 18 bp, Homo sapiens
aacaaagcagtatataat

SEQ ID NO: 983185 - DNA, 19 bp, Homo sapiens
aacaaagcagtatataata

SEQ ID NO: 983186 - DNA, 12 bp, Homo sapiens
aacaaagctgtt

SEQ ID NO: 983187 - DNA, 22 bp, Homo sapiens
aacaaagctgttaaactgttag

SEQ ID NO: 983188 - DNA, 14 bp, Homo sapiens
aacaaaggaactaa

SEQ ID NO: 983189 - DNA, 15 bp, Homo sapiens
aacaaagtactcttt

SEQ ID NO: 983190 - DNA, 23 bp, Homo sapiens
aacaaagttactaggtaacttca

SEQ ID NO: 983191 - DNA, 16 bp, Homo sapiens
aacaaataaaagttga

SEQ ID NO: 983192 - DNA, 15 bp, Homo sapiens
aacaaatcactgtat

SEQ ID NO: 983193 - DNA, 19 bp, Homo sapiens
aacaaatgtaaaattatga

SEQ ID NO: 983194 - DNA, 19 bp, Homo sapiens
aacaaattgggatctgtct

SEQ ID NO: 983195 - DNA, 21 bp, Homo sapiens
aacaaattgggatctgtcttg

SEQ ID NO: 983196 - DNA, 19 bp, Homo sapiens
aacaaatttttcaaatcat

SEQ ID NO: 983197 - DNA, 19 bp, Homo sapiens
aacaacaattggtaaaact

SEQ ID NO: 983198 - DNA, 12 bp, Homo sapiens
aaagacagaatg

SEQ ID NO: 983199 - DNA, 13 bp, Homo sapiens
aaagacagaatgt

SEQ ID NO: 983200 - DNA, 21 bp, Homo sapiens
aaagacagagcggaactatga

SEQ ID NO: 983201 - DNA, 22 bp, Homo sapiens
aaagacagcagacaaaatgaaa

SEQ ID NO: 983202 - DNA, 22 bp, Homo sapiens
aaagacagggctgataagctaa

SEQ ID NO: 983203 - DNA, 18 bp, Homo sapiens
aaagacagggtcttgcta

SEQ ID NO: 983204 - DNA, 22 bp, Homo sapiens
aaagacagtgactgtacagtta

SEQ ID NO: 983205 - DNA, 21 bp, Homo sapiens
aaagacatcagtctccaacat

SEQ ID NO: 983206 - DNA, 18 bp, Homo sapiens
aaagacatccataaagaa

SEQ ID NO: 983207 - DNA, 16 bp, Homo sapiens
aaagacatctgcctgt

SEQ ID NO: 983208 - DNA, 20 bp, Homo sapiens
aaagacatctgcctgtaatt

SEQ ID NO: 983209 - DNA, 20 bp, Homo sapiens
aaagacattgattcagcctg

SEQ ID NO: 983210 - DNA, 12 bp, Homo sapiens
aaagaccacctc

SEQ ID NO: 983211 - DNA, 14 bp, Homo sapiens
aaagaccagaaatt

SEQ ID NO: 983212 - DNA, 16 bp, Homo sapiens
aaagacccagggggag

SEQ ID NO: 983213 - DNA, 20 bp, Homo sapiens
aaagacctacattccctctc

SEQ ID NO: 983214 - DNA, 23 bp, Homo sapiens
aaagactaatttaaaaaataact

SEQ ID NO: 983215 - DNA, 15 bp, Homo sapiens
aaagactcagtgttc

SEQ ID NO: 983216 - DNA, 22 bp, Homo sapiens
aaagactccacataagtccatt

SEQ ID NO: 983217 - DNA, 15 bp, Homo sapiens
aaagactctgagcca

SEQ ID NO: 983218 - DNA, 18 bp, Homo sapiens
aaagactctgagccaagg

SEQ ID NO: 983219 - DNA, 14 bp, Homo sapiens
aaagactgaacatg

SEQ ID NO: 983220 - DNA, 15 bp, Homo sapiens
aaagactgaacatgt

SEQ ID NO: 983221 - DNA, 20 bp, Homo sapiens
aaagactgaacatgtttaca

SEQ ID NO: 983222 - DNA, 19 bp, Homo sapiens
aaagactgaccaatattgt

SEQ ID NO: 983223 - DNA, 17 bp, Homo sapiens
aaagactggttttctgc

SEQ ID NO: 983224 - DNA, 12 bp, Homo sapiens
aaagactgtact

SEQ ID NO: 983225 - DNA, 14 bp, Homo sapiens
aaagactgtactgg

SEQ ID NO: 983226 - DNA, 23 bp, Homo sapiens
aaagactgtcaaatgaactttta

SEQ ID NO: 983227 - DNA, 22 bp, Homo sapiens
aaagactgtgaacagcttgctg

SEQ ID NO: 983228 - DNA, 16 bp, Homo sapiens
aaagactgtgctgaga

SEQ ID NO: 983229 - DNA, 20 bp, Homo sapiens
aaagactgtggaaatgccaa

SEQ ID NO: 983230 - DNA, 12 bp, Homo sapiens
aaagacttaagc

SEQ ID NO: 983231 - DNA, 16 bp, Homo sapiens
aaagacttgagacaat

SEQ ID NO: 983232 - DNA, 18 bp, Homo sapiens
aaagagaaaacatctcat

SEQ ID NO: 983233 - DNA, 12 bp, Homo sapiens
aaagagaaacac

SEQ ID NO: 983234 - DNA, 19 bp, Homo sapiens
aaagagaaacagttggtaa

SEQ ID NO: 983235 - DNA, 15 bp, Homo sapiens
aaagagaaaccgagg

SEQ ID NO: 983236 - DNA, 20 bp, Homo sapiens
aaagagaaaccgaggtgcaa

SEQ ID NO: 983237 - DNA, 21 bp, Homo sapiens
aaagagaaaccgcttttggtt

SEQ ID NO: 983238 - DNA, 16 bp, Homo sapiens
aaagagaaaccgggag

SEQ ID NO: 983239 - DNA, 21 bp, Homo sapiens
aaagagaattgggggcttagg

SEQ ID NO: 983240 - DNA, 15 bp, Homo sapiens
aaagagacagtgata

SEQ ID NO: 983241 - DNA, 14 bp, Homo sapiens
aaagagaccagcac

SEQ ID NO: 983242 - DNA, 11 bp, Homo sapiens
aaagagaggtt

SEQ ID NO: 983243 - DNA, 15 bp, Homo sapiens
aaagagataataaga

SEQ ID NO: 983244 - DNA, 16 bp, Homo sapiens
aaagagataataagat

SEQ ID NO: 983245 - DNA, 16 bp, Homo sapiens
aaagagatattttaaa

SEQ ID NO: 983246 - DNA, 15 bp, Homo sapiens
aaagagatctgggca

SEQ ID NO: 983247 - DNA, 19 bp, Homo sapiens
aaagagatgggccttttct

SEQ ID NO: 983248 - DNA, 20 bp, Homo sapiens
aaagagcacttaagagaata

SEQ ID NO: 983249 - DNA, 18 bp, Homo sapiens
aaagagccctggctctgc

SEQ ID NO: 983250 - DNA, 19 bp, Homo sapiens
aaagagctactcagaaatg

SEQ ID NO: 983251 - DNA, 16 bp, Homo sapiens
aaagagctgcacagca

SEQ ID NO: 983252 - DNA, 14 bp, Homo sapiens
aaagagctgtctga

SEQ ID NO: 983253 - DNA, 19 bp, Homo sapiens
aaagaggagaaaatttata

SEQ ID NO: 983254 - DNA, 14 bp, Homo sapiens
aaagaggagtgctt

SEQ ID NO: 983255 - DNA, 16 bp, Homo sapiens
aaagaggagtgttatt

SEQ ID NO: 983256 - DNA, 14 bp, Homo sapiens
aaagaggatgattt

SEQ ID NO: 983257 - DNA, 20 bp, Homo sapiens
aaagaggcgtctgtatattt

SEQ ID NO: 983258 - DNA, 19 bp, Homo sapiens
aaagaggctgaggcctgga

SEQ ID NO: 983259 - DNA, 22 bp, Homo sapiens
aaagaggctgcccctctcacca

SEQ ID NO: 983260 - DNA, 13 bp, Homo sapiens
aaagaggctgtgt

SEQ ID NO: 983261 - DNA, 14 bp, Homo sapiens
aaagaggctgtgtg

SEQ ID NO: 983262 - DNA, 15 bp, Homo sapiens
aaagaggctgtgtgg

SEQ ID NO: 983263 - DNA, 19 bp, Homo sapiens
aaagagggaaaaagagctg

SEQ ID NO: 983264 - DNA, 12 bp, Homo sapiens
aaagagggacag

SEQ ID NO: 983265 - DNA, 19 bp, Homo sapiens
aaagagggcttcctctaga

SEQ ID NO: 983266 - DNA, 15 bp, Homo sapiens
aaagaggggcgctgt

SEQ ID NO: 983267 - DNA, 15 bp, Homo sapiens
aaagaggtgaacatt

SEQ ID NO: 983268 - DNA, 11 bp, Homo sapiens
aaagaggtttt

SEQ ID NO: 983269 - DNA, 13 bp, Homo sapiens
aaagagtagaatt

SEQ ID NO: 983270 - DNA, 22 bp, Homo sapiens
aaagagtgggctgcatctggga

SEQ ID NO: 983271 - DNA, 13 bp, Homo sapiens
aaagagttaagaa

SEQ ID NO: 983272 - DNA, 12 bp, Homo sapiens
aaagagttagaa

SEQ ID NO: 983273 - DNA, 19 bp, Homo sapiens
aaagagttattcaaatgaa

SEQ ID NO: 983274 - DNA, 15 bp, Homo sapiens
aaagataaagaccag

SEQ ID NO: 983275 - DNA, 20 bp, Homo sapiens
aaagataattgctatttatt

SEQ ID NO: 983276 - DNA, 20 bp, Homo sapiens
aaagatacgactttattttc

SEQ ID NO: 983277 - DNA, 20 bp, Homo sapiens
aaagatatatgaatatgaca

SEQ ID NO: 983278 - DNA, 19 bp, Homo sapiens
aaagatatattaaaaatat

SEQ ID NO: 983279 - DNA, 12 bp, Homo sapiens
aaagatattttg

SEQ ID NO: 983280 - DNA, 16 bp, Homo sapiens
aaagatatttttatct

SEQ ID NO: 983281 - DNA, 16 bp, Homo sapiens
aaagatcaaaataaaa

SEQ ID NO: 983282 - DNA, 20 bp, Homo sapiens
aaagatcaaaataaaaagtg

SEQ ID NO: 983283 - DNA, 13 bp, Homo sapiens
aaagatcacacat

SEQ ID NO: 983284 - DNA, 16 bp, Homo sapiens
aaagatctctgtcaca

SEQ ID NO: 983285 - DNA, 14 bp, Homo sapiens
aaaatttttataaa

SEQ ID NO: 983286 - DNA, 17 bp, Homo sapiens
aaaatttttttttctct

SEQ ID NO: 983287 - DNA, 18 bp, Homo sapiens
aaacaaaaaaaatgttaa

SEQ ID NO: 983288 - DNA, 15 bp, Homo sapiens
aaacaaaaaaagaca

SEQ ID NO: 983289 - DNA, 13 bp, Homo sapiens
aaacaaaaacact

SEQ ID NO: 983290 - DNA, 18 bp, Homo sapiens
aaacaaaaacagaatttg

SEQ ID NO: 983291 - DNA, 11 bp, Homo sapiens
aaacaaaaaga

SEQ ID NO: 983292 - DNA, 12 bp, Homo sapiens
aaacaaaaagaa

SEQ ID NO: 983293 - DNA, 16 bp, Homo sapiens
aaacaaaaagatgtct

SEQ ID NO: 983294 - DNA, 14 bp, Homo sapiens
aaacaaaaccaagc

SEQ ID NO: 983295 - DNA, 16 bp, Homo sapiens
aaacaaaaccaagcct

SEQ ID NO: 983296 - DNA, 14 bp, Homo sapiens
aaacaaaagagaga

SEQ ID NO: 983297 - DNA, 16 bp, Homo sapiens
aaacaaaagagagaat

SEQ ID NO: 983298 - DNA, 18 bp, Homo sapiens
aaacaaaagggtgtatag

SEQ ID NO: 983299 - DNA, 12 bp, Homo sapiens
aaacaaaataga

SEQ ID NO: 983300 - DNA, 14 bp, Homo sapiens
aaacaaaatctgaa

SEQ ID NO: 983301 - DNA, 17 bp, Homo sapiens
aaacaaaatggcttcag

SEQ ID NO: 983302 - DNA, 18 bp, Homo sapiens
aaacaaaatggcttcagt

SEQ ID NO: 983303 - DNA, 20 bp, Homo sapiens
aaacaaactcgttttttaca

SEQ ID NO: 983304 - DNA, 21 bp, Homo sapiens
aaacaaacttccaaacagtgt

SEQ ID NO: 983305 - DNA, 23 bp, Homo sapiens
aaacaaaggagcattaagcccaa

SEQ ID NO: 983306 - DNA, 16 bp, Homo sapiens
aaacaaagtgactgtt

SEQ ID NO: 983307 - DNA, 15 bp, Homo sapiens
aaacaaagtttcaga

SEQ ID NO: 983308 - DNA, 12 bp, Homo sapiens
aaacaaataaaa

SEQ ID NO: 983309 - DNA, 15 bp, Homo sapiens
aaacaaataatcaca

SEQ ID NO: 983310 - DNA, 12 bp, Homo sapiens
aaacaacaaaaa

SEQ ID NO: 983311 - DNA, 22 bp, Homo sapiens
aaacaacattaggggattcttc

SEQ ID NO: 983312 - DNA, 17 bp, Homo sapiens
aaacaacatttatatgt

SEQ ID NO: 983313 - DNA, 14 bp, Homo sapiens
aaacaaccgtcctg

SEQ ID NO: 983314 - DNA, 15 bp, Homo sapiens
aaacaacctgaatct

SEQ ID NO: 983315 - DNA, 18 bp, Homo sapiens
aaacaacctgaatctttt

SEQ ID NO: 983316 - DNA, 19 bp, Homo sapiens
aaacaactaaaaaaatttt

SEQ ID NO: 983317 - DNA, 22 bp, Homo sapiens
aaacaactaaaaaaatttttga

SEQ ID NO: 983318 - DNA, 17 bp, Homo sapiens
aaacaactctttgagaa

SEQ ID NO: 983319 - DNA, 15 bp, Homo sapiens
aaacaacttcagaaa

SEQ ID NO: 983320 - DNA, 14 bp, Homo sapiens
aaacaacttggcat

SEQ ID NO: 983321 - DNA, 20 bp, Homo sapiens
aaacaacttggcatttctat

SEQ ID NO: 983322 - DNA, 13 bp, Homo sapiens
aaacaactttcac

SEQ ID NO: 983323 - DNA, 19 bp, Homo sapiens
aaacaactttcacttcttc

SEQ ID NO: 983324 - DNA, 20 bp, Homo sapiens
aaacaagaggacacaatggc

SEQ ID NO: 983325 - DNA, 16 bp, Homo sapiens
aaacaaggttttcagt

SEQ ID NO: 983326 - DNA, 22 bp, Homo sapiens
aaacaagtatataatttacttt

SEQ ID NO: 983327 - DNA, 12 bp, Homo sapiens
aaacaagtattt

SEQ ID NO: 983328 - DNA, 13 bp, Homo sapiens
aaacaagtatttg

SEQ ID NO: 983329 - DNA, 23 bp, Homo sapiens
aaacaagtatttgttaatttaga

SEQ ID NO: 983330 - DNA, 19 bp, Homo sapiens
aaacaagtctagtcttctg

SEQ ID NO: 983331 - DNA, 17 bp, Homo sapiens
aaacaagtgaccccagg

SEQ ID NO: 983332 - DNA, 18 bp, Homo sapiens
aaacaagtttagaaagct

SEQ ID NO: 983333 - DNA, 17 bp, Homo sapiens
aaacaagttttagaaat

SEQ ID NO: 983334 - DNA, 13 bp, Homo sapiens
aaacaataagaca

SEQ ID NO: 983335 - DNA, 15 bp, Homo sapiens
aaacaatattgtttc

SEQ ID NO: 983336 - DNA, 16 bp, Homo sapiens
aaacaatattgtttct

SEQ ID NO: 983337 - DNA, 15 bp, Homo sapiens
aaacaatcccaatct

SEQ ID NO: 983338 - DNA, 18 bp, Homo sapiens
aaacaatctggaagaaaa

SEQ ID NO: 983339 - DNA, 12 bp, Homo sapiens
aaacaatcttat

SEQ ID NO: 983340 - DNA, 20 bp, Homo sapiens
aaacaatctttcatgtcttg

SEQ ID NO: 983341 - DNA, 13 bp, Homo sapiens
aaacaatgaaaac

SEQ ID NO: 983342 - DNA, 21 bp, Homo sapiens
aaacaatgaagaattatgtaa

SEQ ID NO: 983343 - DNA, 14 bp, Homo sapiens
aaacaatgtataaa

SEQ ID NO: 983344 - DNA, 20 bp, Homo sapiens
aaacaatgtataaagattgt

SEQ ID NO: 983345 - DNA, 20 bp, Homo sapiens
aaacaatgttgtccaacaat

SEQ ID NO: 983346 - DNA, 14 bp, Homo sapiens
aaacaatgtttaaa

SEQ ID NO: 983347 - DNA, 21 bp, Homo sapiens
aaacaattcaagctgagaaaa

SEQ ID NO: 983348 - DNA, 13 bp, Homo sapiens
aaacaatttattt

SEQ ID NO: 983349 - DNA, 14 bp, Homo sapiens
aaacaatttctttt

SEQ ID NO: 983350 - DNA, 22 bp, Homo sapiens
aaacaattttaatgatggtgtt

SEQ ID NO: 983351 - DNA, 13 bp, Homo sapiens
aaacacaaaacat

SEQ ID NO: 983352 - DNA, 19 bp, Homo sapiens
aaacacaaacgggctcagc

SEQ ID NO: 983353 - DNA, 17 bp, Homo sapiens
aaacacaccaggctgtg

SEQ ID NO: 983354 - DNA, 18 bp, Homo sapiens
aaacacaccaggctgtgg

SEQ ID NO: 983355 - DNA, 14 bp, Homo sapiens
aaacacacgagcaa

SEQ ID NO: 983356 - DNA, 16 bp, Homo sapiens
aaacacagttacactt

SEQ ID NO: 983357 - DNA, 15 bp, Homo sapiens
aaacacatacaaaag

SEQ ID NO: 983358 - DNA, 14 bp, Homo sapiens
aaacacatcttccc

SEQ ID NO: 983359 - DNA, 15 bp, Homo sapiens
aaacaccaacataaa

SEQ ID NO: 983360 - DNA, 22 bp, Homo sapiens
aaacaccagtcacctcgtctcc

SEQ ID NO: 983361 - DNA, 16 bp, Homo sapiens
aaacacccctctgtct

SEQ ID NO: 983362 - DNA, 14 bp, Homo sapiens
aaacacctagcttt

SEQ ID NO: 983363 - DNA, 15 bp, Homo sapiens
aaacacctagcttta

SEQ ID NO: 983364 - DNA, 22 bp, Homo sapiens
aaacaccttccagctcctgtaa

SEQ ID NO: 983365 - DNA, 14 bp, Homo sapiens
aaacaccttctctg

SEQ ID NO: 983366 - DNA, 16 bp, Homo sapiens
aaacacgaaacttgtt

SEQ ID NO: 983367 - DNA, 18 bp, Homo sapiens
aaacacgaaacttgttat

SEQ ID NO: 983368 - DNA, 14 bp, Homo sapiens
aaacactaaaagca

SEQ ID NO: 983369 - DNA, 20 bp, Homo sapiens
aaacactcggcatttcaaat

SEQ ID NO: 983370 - DNA, 21 bp, Homo sapiens
aaacactcggcatttcaaatg

SEQ ID NO: 983371 - DNA, 16 bp, Homo sapiens
aaacactgaaaagaag

SEQ ID NO: 983372 - DNA, 13 bp, Homo sapiens
aaacactgaatca

SEQ ID NO: 983373 - DNA, 13 bp, Homo sapiens
aaacactgccatc

SEQ ID NO: 983374 - DNA, 23 bp, Homo sapiens
aaacactgccatcttagtttgga

SEQ ID NO: 983375 - DNA, 21 bp, Homo sapiens
aaacactgtaatcttaaaagt

SEQ ID NO: 983376 - DNA, 16 bp, Homo sapiens
aaacactgtattgtaa

SEQ ID NO: 983377 - DNA, 22 bp, Homo sapiens
aaacactgtattgtaagtggaa

SEQ ID NO: 983378 - DNA, 22 bp, Homo sapiens
aaacactgtggaactaataaat

SEQ ID NO: 983379 - DNA, 23 bp, Homo sapiens
aaacactgtggaactaataaata

SEQ ID NO: 983380 - DNA, 16 bp, Homo sapiens
aaacacttccagtctg

SEQ ID NO: 983381 - DNA, 21 bp, Homo sapiens
aaacacttcgttcgcagagct

SEQ ID NO: 983382 - DNA, 18 bp, Homo sapiens
aaacacttctcatcatat

SEQ ID NO: 983383 - DNA, 21 bp, Homo sapiens
aaacacttctcatcatattgt

SEQ ID NO: 983384 - DNA, 14 bp, Homo sapiens
aaacacttctgctt

SEQ ID NO: 983385 - DNA, 16 bp, Homo sapiens
aaacacttctgctttc

SEQ ID NO: 983386 - DNA, 21 bp, Homo sapiens
aaacacttggcatacaaaata

SEQ ID NO: 983387 - DNA, 23 bp, Homo sapiens
aaacacttggcatacaaaatatt

SEQ ID NO: 983388 - DNA, 19 bp, Homo sapiens
aaacagaaacaaaaacact

SEQ ID NO: 983389 - DNA, 21 bp, Homo sapiens
aaacagaaacaaaaacactaa

SEQ ID NO: 983390 - DNA, 21 bp, Homo sapiens
aaacagaaatcaggtgtttta

SEQ ID NO: 983391 - DNA, 22 bp, Homo sapiens
aaacagaaatcaggtgttttaa

SEQ ID NO: 983392 - DNA, 13 bp, Homo sapiens
aaacagaacactt

SEQ ID NO: 983393 - DNA, 14 bp, Homo sapiens
aaacagaacactta

SEQ ID NO: 983394 - DNA, 12 bp, Homo sapiens
aaacagaacagg

SEQ ID NO: 983395 - DNA, 13 bp, Homo sapiens
aaacagaacatca

SEQ ID NO: 983396 - DNA, 21 bp, Homo sapiens
aaacagaacatcattagaaca

SEQ ID NO: 983397 - DNA, 21 bp, Homo sapiens
aaacagaactcgatgcactga

SEQ ID NO: 983398 - DNA, 18 bp, Homo sapiens
aaactgtctttaaaagag

SEQ ID NO: 983399 - DNA, 20 bp, Homo sapiens
aaactgtctttaaaagagag

SEQ ID NO: 983400 - DNA, 21 bp, Homo sapiens
aaactgtgactaggcatacac

SEQ ID NO: 983401 - DNA, 12 bp, Homo sapiens
aaactgtgcacc

SEQ ID NO: 983402 - DNA, 20 bp, Homo sapiens
aaactgtgtacataactgaa

SEQ ID NO: 983403 - DNA, 21 bp, Homo sapiens
aaactgtgtacataactgaaa

SEQ ID NO: 983404 - DNA, 16 bp, Homo sapiens
aaactgtgtatcatta

SEQ ID NO: 983405 - DNA, 18 bp, Homo sapiens
aaactgtgtatcattaaa

SEQ ID NO: 983406 - DNA, 14 bp, Homo sapiens
aaactgtgttgcca

SEQ ID NO: 983407 - DNA, 16 bp, Homo sapiens
aaactgttagcactgt

SEQ ID NO: 983408 - DNA, 14 bp, Homo sapiens
aaactgttctctat

SEQ ID NO: 983409 - DNA, 20 bp, Homo sapiens
aaactgttctctttaaaata

SEQ ID NO: 983410 - DNA, 21 bp, Homo sapiens
aaacttaaaagtattcataca

SEQ ID NO: 983411 - DNA, 14 bp, Homo sapiens
aaacttaaagcaaa

SEQ ID NO: 983412 - DNA, 17 bp, Homo sapiens
aaacttaacatatttac

SEQ ID NO: 983413 - DNA, 14 bp, Homo sapiens
aaacttaagggcaa

SEQ ID NO: 983414 - DNA, 16 bp, Homo sapiens
aaacttaatctaaatg

SEQ ID NO: 983415 - DNA, 16 bp, Homo sapiens
aaacttaccaattgat

SEQ ID NO: 983416 - DNA, 18 bp, Homo sapiens
aaacttaccaattgatgt

SEQ ID NO: 983417 - DNA, 17 bp, Homo sapiens
aaacttagaggaaaagg

SEQ ID NO: 983418 - DNA, 16 bp, Homo sapiens
aaacttagaggaaaat

SEQ ID NO: 983419 - DNA, 23 bp, Homo sapiens
aaacttatgctagtttattggaa

SEQ ID NO: 983420 - DNA, 20 bp, Homo sapiens
aaacttatgctgatttattt

SEQ ID NO: 983421 - DNA, 22 bp, Homo sapiens
aaacttcagtttcacagaaaat

SEQ ID NO: 983422 - DNA, 17 bp, Homo sapiens
aaacttcattctcgtga

SEQ ID NO: 983423 - DNA, 17 bp, Homo sapiens
aaacttccaaagaaagt

SEQ ID NO: 983424 - DNA, 14 bp, Homo sapiens
aaacttccaaagct

SEQ ID NO: 983425 - DNA, 20 bp, Homo sapiens
aaacttccacaagagtgaat

SEQ ID NO: 983426 - DNA, 18 bp, Homo sapiens
aaatcatgccagtatttt

SEQ ID NO: 983427 - DNA, 14 bp, Homo sapiens
aaatcatgtttatt

SEQ ID NO: 983428 - DNA, 20 bp, Homo sapiens
aaatcattgtagaaacacag

SEQ ID NO: 983429 - DNA, 21 bp, Homo sapiens
aaatcatttggcttgctgttt

SEQ ID NO: 983430 - DNA, 21 bp, Homo sapiens
aaatcattttatatgtcaaag

SEQ ID NO: 983431 - DNA, 14 bp, Homo sapiens
aaatcattttgcaa

SEQ ID NO: 983432 - DNA, 20 bp, Homo sapiens
aaatccaaaaagctctgaaa

SEQ ID NO: 983433 - DNA, 22 bp, Homo sapiens
aaatccaaaaagctctgaaaac

SEQ ID NO: 983434 - DNA, 15 bp, Homo sapiens
aaatccaaaacttct

SEQ ID NO: 983435 - DNA, 18 bp, Homo sapiens
aaatccaaaacttctctt

SEQ ID NO: 983436 - DNA, 15 bp, Homo sapiens
aaatccaaatttctc

SEQ ID NO: 983437 - DNA, 17 bp, Homo sapiens
aaatccaataatcagaa

SEQ ID NO: 983438 - DNA, 17 bp, Homo sapiens
aaatccagaagttttaa

SEQ ID NO: 983439 - DNA, 16 bp, Homo sapiens
aaatccagtttcccac

SEQ ID NO: 983440 - DNA, 17 bp, Homo sapiens
aaatccagtttcccacc

SEQ ID NO: 983441 - DNA, 21 bp, Homo sapiens
aaatccatgtgaccattctgc

SEQ ID NO: 983442 - DNA, 19 bp, Homo sapiens
aaatccattccaggtagct

SEQ ID NO: 983443 - DNA, 13 bp, Homo sapiens
aaatccattgttt

SEQ ID NO: 983444 - DNA, 18 bp, Homo sapiens
aaatccccccttcagaac

SEQ ID NO: 983445 - DNA, 20 bp, Homo sapiens
aaatccccttcgctgaaatt

SEQ ID NO: 983446 - DNA, 18 bp, Homo sapiens
aaatccctttcatgtctt

SEQ ID NO: 983447 - DNA, 15 bp, Homo sapiens
aaatcctactgaatg

SEQ ID NO: 983448 - DNA, 17 bp, Homo sapiens
aaatcctagacttgaaa

SEQ ID NO: 983449 - DNA, 19 bp, Homo sapiens
aaatcctagacttgaaagt

SEQ ID NO: 983450 - DNA, 21 bp, Homo sapiens
aaatcctagtttcctctcctt

SEQ ID NO: 983451 - DNA, 14 bp, Homo sapiens
aaatcctatatctg

SEQ ID NO: 983452 - DNA, 13 bp, Homo sapiens
aaatcctcttcct

SEQ ID NO: 983453 - DNA, 15 bp, Homo sapiens
aaatcctcttcctct

SEQ ID NO: 983454 - DNA, 21 bp, Homo sapiens
aaatcctcttcctctgaggct

SEQ ID NO: 983455 - DNA, 17 bp, Homo sapiens
aaatcctttctgccccc

SEQ ID NO: 983456 - DNA, 15 bp, Homo sapiens
aaatcgatattagaa

SEQ ID NO: 983457 - DNA, 20 bp, Homo sapiens
aaatcgatgagcgccacctc

SEQ ID NO: 983458 - DNA, 21 bp, Homo sapiens
aaatcgatgagcgccacctct

SEQ ID NO: 983459 - DNA, 13 bp, Homo sapiens
aaatcgatgcagt

SEQ ID NO: 983460 - DNA, 14 bp, Homo sapiens
aaatcgattggctt

SEQ ID NO: 983461 - DNA, 14 bp, Homo sapiens
aaatcgccataggc

SEQ ID NO: 983462 - DNA, 16 bp, Homo sapiens
aaatcgccataggcca

SEQ ID NO: 983463 - DNA, 23 bp, Homo sapiens
aaatcgccataggccaaggtgca

SEQ ID NO: 983464 - DNA, 22 bp, Homo sapiens
aaatcggatctggggctctggg

SEQ ID NO: 983465 - DNA, 23 bp, Homo sapiens
aaatcggatctggggctctggga

SEQ ID NO: 983466 - DNA, 15 bp, Homo sapiens
aaatcgttggaaaat

SEQ ID NO: 983467 - DNA, 13 bp, Homo sapiens
aaatctaaaagaa

SEQ ID NO: 983468 - DNA, 18 bp, Homo sapiens
aaatctaaaatttcataa

SEQ ID NO: 983469 - DNA, 12 bp, Homo sapiens
aaatctaaacaa

SEQ ID NO: 983470 - DNA, 13 bp, Homo sapiens
aaatctacttttc

SEQ ID NO: 983471 - DNA, 15 bp, Homo sapiens
aaatctagacattct

SEQ ID NO: 983472 - DNA, 16 bp, Homo sapiens
aaatctagacattctt

SEQ ID NO: 983473 - DNA, 23 bp, Homo sapiens
aaatctagacattcttttaatgc

SEQ ID NO: 983474 - DNA, 22 bp, Homo sapiens
aaatctaggaaaattattctat

SEQ ID NO: 983475 - DNA, 17 bp, Homo sapiens
aaatctaggatgtgatg

SEQ ID NO: 983476 - DNA, 18 bp, Homo sapiens
aaatctatatttgtcttc

SEQ ID NO: 983477 - DNA, 17 bp, Homo sapiens
aaatctattacttttgc

SEQ ID NO: 983478 - DNA, 16 bp, Homo sapiens
aaatctatttattaat

SEQ ID NO: 983479 - DNA, 15 bp, Homo sapiens
aaatctcaaatttct

SEQ ID NO: 983480 - DNA, 15 bp, Homo sapiens
aaatctcagaacctt

SEQ ID NO: 983481 - DNA, 20 bp, Homo sapiens
aaatctcagaatttatctcc

SEQ ID NO: 983482 - DNA, 19 bp, Homo sapiens
aaatctccaaaataaaact

SEQ ID NO: 983483 - DNA, 22 bp, Homo sapiens
aaatctccaaaataaaactttt

SEQ ID NO: 983484 - DNA, 18 bp, Homo sapiens
aaatctcccattttggaa

SEQ ID NO: 983485 - DNA, 17 bp, Homo sapiens
aaatctcctcttttgta

SEQ ID NO: 983486 - DNA, 13 bp, Homo sapiens
aaatctctaatat

SEQ ID NO: 983487 - DNA, 21 bp, Homo sapiens
aaatctcttgattataaatgt

SEQ ID NO: 983488 - DNA, 12 bp, Homo sapiens
aaatctctttaa

SEQ ID NO: 983489 - DNA, 20 bp, Homo sapiens
aaatctgaactctcaaaagt

SEQ ID NO: 983490 - DNA, 11 bp, Homo sapiens
aaatctgaaga

SEQ ID NO: 983491 - DNA, 12 bp, Homo sapiens
aaatctgaagaa

SEQ ID NO: 983492 - DNA, 13 bp, Homo sapiens
aaatctgaagaaa

SEQ ID NO: 983493 - DNA, 13 bp, Homo sapiens
aaatctgaagacc

SEQ ID NO: 983494 - DNA, 17 bp, Homo sapiens
aaatctgacaatataca

SEQ ID NO: 983495 - DNA, 17 bp, Homo sapiens
aaatctgaccaaaacaa

SEQ ID NO: 983496 - DNA, 15 bp, Homo sapiens
aaatctgatttaatg

SEQ ID NO: 983497 - DNA, 19 bp, Homo sapiens
aaatctgccacaaaaacag

SEQ ID NO: 983498 - DNA, 20 bp, Homo sapiens
aaatctgctggagtttcatg

SEQ ID NO: 983499 - DNA, 12 bp, Homo sapiens
aaatctggaagc

SEQ ID NO: 983500 - DNA, 18 bp, Homo sapiens
aaatctggggaagaggtt

SEQ ID NO: 983501 - DNA, 22 bp, Homo sapiens
aaatctggggaagaggttttat

SEQ ID NO: 983502 - DNA, 19 bp, Homo sapiens
aaatctgggtatctttcca

SEQ ID NO: 983503 - DNA, 15 bp, Homo sapiens
aaatctggtcttgtt

SEQ ID NO: 983504 - DNA, 20 bp, Homo sapiens
aaatctggtcttgttagaaa

SEQ ID NO: 983505 - DNA, 17 bp, Homo sapiens
aaatctgtcctctgtag

SEQ ID NO: 983506 - DNA, 20 bp, Homo sapiens
aaatctgtgaattaaaaaag

SEQ ID NO: 983507 - DNA, 19 bp, Homo sapiens
aaatctgtttgatccctgt

SEQ ID NO: 983508 - DNA, 13 bp, Homo sapiens
aaatctgttttgt

SEQ ID NO: 983509 - DNA, 13 bp, Homo sapiens
aaatcttaaacaa

SEQ ID NO: 983510 - DNA, 22 bp, Homo sapiens
aaatcttaaacaatgtataaag

SEQ ID NO: 983511 - DNA, 23 bp, Homo sapiens
aaatcttaatgttcctcaaagct

SEQ ID NO: 983512 - DNA, 13 bp, Homo sapiens
aaatcttacaaaa

SEQ ID NO: 983513 - DNA, 23 bp, Homo sapiens
aaatcttacaaaatcctggaaga

SEQ ID NO: 983514 - DNA, 20 bp, Homo sapiens
aaatcttagtgttcaaaaca

SEQ ID NO: 983515 - DNA, 15 bp, Homo sapiens
aaatcttgaatttct

SEQ ID NO: 983516 - DNA, 18 bp, Homo sapiens
aaatcttgcagttttgta

SEQ ID NO: 983517 - DNA, 12 bp, Homo sapiens
aaagatttcagt

SEQ ID NO: 983518 - DNA, 13 bp, Homo sapiens
aaagatttcagta

SEQ ID NO: 983519 - DNA, 23 bp, Homo sapiens
aaagatttcagtagaattttagt

SEQ ID NO: 983520 - DNA, 20 bp, Homo sapiens
aaagatttgttactgtattt

SEQ ID NO: 983521 - DNA, 15 bp, Homo sapiens
aaagatttgttgaca

SEQ ID NO: 983522 - DNA, 14 bp, Homo sapiens
aaagattttttaat

SEQ ID NO: 983523 - DNA, 19 bp, Homo sapiens
aaagattttttaataattt

SEQ ID NO: 983524 - DNA, 15 bp, Homo sapiens
aaagcaaaaagatgt

SEQ ID NO: 983525 - DNA, 17 bp, Homo sapiens
aaagcaaaaagatgtat

SEQ ID NO: 983526 - DNA, 18 bp, Homo sapiens
aaagcaaaattgcaatct

SEQ ID NO: 983527 - DNA, 13 bp, Homo sapiens
aaagcaaagaaaa

SEQ ID NO: 983528 - DNA, 13 bp, Homo sapiens
aaagcaaaggcag

SEQ ID NO: 983529 - DNA, 14 bp, Homo sapiens
aaagcaaaggcagt

SEQ ID NO: 983530 - DNA, 14 bp, Homo sapiens
aaagcaaatataga

SEQ ID NO: 983531 - DNA, 13 bp, Homo sapiens
aaagcaaatggaa

SEQ ID NO: 983532 - DNA, 21 bp, Homo sapiens
aaagcaacccgctggagccca

SEQ ID NO: 983533 - DNA, 14 bp, Homo sapiens
aaagcaagactgtt

SEQ ID NO: 983534 - DNA, 22 bp, Homo sapiens
aaagcaagcattcagaagaaaa

SEQ ID NO: 983535 - DNA, 15 bp, Homo sapiens
aaagcaagggagaaa

SEQ ID NO: 983536 - DNA, 17 bp, Homo sapiens
aaagcaagggagaaaag

SEQ ID NO: 983537 - DNA, 13 bp, Homo sapiens
aaagcaagggcca

SEQ ID NO: 983538 - DNA, 11 bp, Homo sapiens
aaagcaagtgt

SEQ ID NO: 983539 - DNA, 14 bp, Homo sapiens
aaagcaataatggt

SEQ ID NO: 983540 - DNA, 22 bp, Homo sapiens
aaagcaataatggtcccatcca

SEQ ID NO: 983541 - DNA, 23 bp, Homo sapiens
aaagcaataatggtcccatccag

SEQ ID NO: 983542 - DNA, 20 bp, Homo sapiens
aaagcaatacaactttacca

SEQ ID NO: 983543 - DNA, 23 bp, Homo sapiens
aaagcacaaagttctcagagctc

SEQ ID NO: 983544 - DNA, 13 bp, Homo sapiens
aaagcacaataac

SEQ ID NO: 983545 - DNA, 20 bp, Homo sapiens
aaagcacactcatcccctca

SEQ ID NO: 983546 - DNA, 21 bp, Homo sapiens
aaagcacagtgttaaatgaaa

SEQ ID NO: 983547 - DNA, 15 bp, Homo sapiens
aaagcacatgcttag

SEQ ID NO: 983548 - DNA, 19 bp, Homo sapiens
aaagcaccaaaataagaaa

SEQ ID NO: 983549 - DNA, 14 bp, Homo sapiens
aaagcactatacag

SEQ ID NO: 983550 - DNA, 22 bp, Homo sapiens
aaagcactggtttcaagaatat

SEQ ID NO: 983551 - DNA, 16 bp, Homo sapiens
aaagcacttggactct

SEQ ID NO: 983552 - DNA, 21 bp, Homo sapiens
aaagcacttggactcttgctc

SEQ ID NO: 983553 - DNA, 16 bp, Homo sapiens
aaagcagaattttaat

SEQ ID NO: 983554 - DNA, 16 bp, Homo sapiens
aaagcagagccaaggc

SEQ ID NO: 983555 - DNA, 20 bp, Homo sapiens
aaagcagagccaaggccacc

SEQ ID NO: 983556 - DNA, 16 bp, Homo sapiens
aaagcagagcctcctg

SEQ ID NO: 983557 - DNA, 19 bp, Homo sapiens
aaagcagagcctcctggga

SEQ ID NO: 983558 - DNA, 16 bp, Homo sapiens
aaagcagagtgggact

SEQ ID NO: 983559 - DNA, 21 bp, Homo sapiens
aaagcagcagctaggactgag

SEQ ID NO: 983560 - DNA, 13 bp, Homo sapiens
aaagcagcatctg

SEQ ID NO: 983561 - DNA, 21 bp, Homo sapiens
aaagcagcctcattctgaggc

SEQ ID NO: 983562 - DNA, 16 bp, Homo sapiens
aaagcagcgtttctat

SEQ ID NO: 983563 - DNA, 18 bp, Homo sapiens
aaagcagcgtttctatga

SEQ ID NO: 983564 - DNA, 21 bp, Homo sapiens
aaagcagctaaatgtaactta

SEQ ID NO: 983565 - DNA, 22 bp, Homo sapiens
aaagcaggcttgcccagtacat

SEQ ID NO: 983566 - DNA, 21 bp, Homo sapiens
aaagcaggggagtatgcaaaa

SEQ ID NO: 983567 - DNA, 17 bp, Homo sapiens
aaagcaggtggcatctc

SEQ ID NO: 983568 - DNA, 22 bp, Homo sapiens
aaagcagtagaaataatatgca

SEQ ID NO: 983569 - DNA, 16 bp, Homo sapiens
aaagcagttaaactga

SEQ ID NO: 983570 - DNA, 17 bp, Homo sapiens
aaagcagttaaactgat

SEQ ID NO: 983571 - DNA, 14 bp, Homo sapiens
aaagcagttaattt

SEQ ID NO: 983572 - DNA, 17 bp, Homo sapiens
aaagcagttaatttata

SEQ ID NO: 983573 - DNA, 18 bp, Homo sapiens
aaagcagttaatttatat

SEQ ID NO: 983574 - DNA, 16 bp, Homo sapiens
aaagcataaaaacatt

SEQ ID NO: 983575 - DNA, 16 bp, Homo sapiens
aaagcatcacctcagg

SEQ ID NO: 983576 - DNA, 13 bp, Homo sapiens
aaagcatgaaaca

SEQ ID NO: 983577 - DNA, 16 bp, Homo sapiens
aaagcatgatgggaaa

SEQ ID NO: 983578 - DNA, 18 bp, Homo sapiens
aaagcatgatgggaaaat

SEQ ID NO: 983579 - DNA, 13 bp, Homo sapiens
aaagcatgtctca

SEQ ID NO: 983580 - DNA, 18 bp, Homo sapiens
aaagcatgtctctgcttc

SEQ ID NO: 983581 - DNA, 19 bp, Homo sapiens
aaagcatgtctctgcttcc

SEQ ID NO: 983582 - DNA, 21 bp, Homo sapiens
aaagcatgtctctgcttccat

SEQ ID NO: 983583 - DNA, 17 bp, Homo sapiens
aaagcatttcaggccag

SEQ ID NO: 983584 - DNA, 13 bp, Homo sapiens
aaagcattttgta

SEQ ID NO: 983585 - DNA, 16 bp, Homo sapiens
aaagcatttttcaata

SEQ ID NO: 983586 - DNA, 16 bp, Homo sapiens
aaagccaaacaaaact

SEQ ID NO: 983587 - DNA, 17 bp, Homo sapiens
aaagccaaactctgcca

SEQ ID NO: 983588 - DNA, 23 bp, Homo sapiens
aaagccaacagtcaaaacagaga

SEQ ID NO: 983589 - DNA, 23 bp, Homo sapiens
aaagccaagtttatatacaatta

SEQ ID NO: 983590 - DNA, 15 bp, Homo sapiens
aaagccacacggaga

SEQ ID NO: 983591 - DNA, 12 bp, Homo sapiens
aaagccacatct

SEQ ID NO: 983592 - DNA, 18 bp, Homo sapiens
aaagccacatcttgctct

SEQ ID NO: 983593 - DNA, 17 bp, Homo sapiens
aaagccacctctccctc

SEQ ID NO: 983594 - DNA, 14 bp, Homo sapiens
aaagccacttctgg

SEQ ID NO: 983595 - DNA, 15 bp, Homo sapiens
aaagccagacaactt

SEQ ID NO: 983596 - DNA, 23 bp, Homo sapiens
aaagccagacaacttctgtttct

SEQ ID NO: 983597 - DNA, 21 bp, Homo sapiens
aaagccagcgtcctcctctgt

SEQ ID NO: 983598 - DNA, 17 bp, Homo sapiens
acgtatttctccagacc

SEQ ID NO: 983599 - DNA, 18 bp, Homo sapiens
acgtatttctccagaccc

SEQ ID NO: 983600 - DNA, 17 bp, Homo sapiens
acgtcaagtctccttcc

SEQ ID NO: 983601 - DNA, 13 bp, Homo sapiens
acgtcaatgcata

SEQ ID NO: 983602 - DNA, 17 bp, Homo sapiens
acgtcacgctccctgac

SEQ ID NO: 983603 - DNA, 17 bp, Homo sapiens
acgtcagcgcaccaaaa

SEQ ID NO: 983604 - DNA, 18 bp, Homo sapiens
acgtcaggccctgactcc

SEQ ID NO: 983605 - DNA, 21 bp, Homo sapiens
acgtcatcggaggctgggccc

SEQ ID NO: 983606 - DNA, 16 bp, Homo sapiens
acgtccaaggtggcag

SEQ ID NO: 983607 - DNA, 20 bp, Homo sapiens
acgtccatcacgttagctgt

SEQ ID NO: 983608 - DNA, 18 bp, Homo sapiens
acgtcccaccccacctct

SEQ ID NO: 983609 - DNA, 18 bp, Homo sapiens
acgtcccagcggcctcag

SEQ ID NO: 983610 - DNA, 14 bp, Homo sapiens
acgtcccgctgcct

SEQ ID NO: 983611 - DNA, 21 bp, Homo sapiens
acgtcctggtctttgtttgag

SEQ ID NO: 983612 - DNA, 12 bp, Homo sapiens
acgtccttccat

SEQ ID NO: 983613 - DNA, 21 bp, Homo sapiens
acgtccttccatatccctgcc

SEQ ID NO: 983614 - DNA, 12 bp, Homo sapiens
acgtccttcctt

SEQ ID NO: 983615 - DNA, 13 bp, Homo sapiens
acgtccttccttg

SEQ ID NO: 983616 - DNA, 22 bp, Homo sapiens
acgtcgcccgctgagctgagtg

SEQ ID NO: 983617 - DNA, 20 bp, Homo sapiens
acgtctgaagcttgactccc

SEQ ID NO: 983618 - DNA, 22 bp, Homo sapiens
acgtctgaagcttgactcccaa

SEQ ID NO: 983619 - DNA, 13 bp, Homo sapiens
acgtctgccaggc

SEQ ID NO: 983620 - DNA, 19 bp, Homo sapiens
acgtctgccaggcccatct

SEQ ID NO: 983621 - DNA, 20 bp, Homo sapiens
acgtctgccaggcccatctc

SEQ ID NO: 983622 - DNA, 17 bp, Homo sapiens
acgtctggctccctgcc

SEQ ID NO: 983623 - DNA, 18 bp, Homo sapiens
acgtctggctccctgccc

SEQ ID NO: 983624 - DNA, 20 bp, Homo sapiens
acgtctggctccctgcccct

SEQ ID NO: 983625 - DNA, 23 bp, Homo sapiens
acgtctgggagaaattgacagat

SEQ ID NO: 983626 - DNA, 13 bp, Homo sapiens
acgtcttcagagt

SEQ ID NO: 983627 - DNA, 17 bp, Homo sapiens
acgtctttcctgctaca

SEQ ID NO: 983628 - DNA, 21 bp, Homo sapiens
acgtgaaatgctcaagaatgt

SEQ ID NO: 983629 - DNA, 19 bp, Homo sapiens
acgtgaacgttttaataat

SEQ ID NO: 983630 - DNA, 18 bp, Homo sapiens
acgtgaagaaataaatga

SEQ ID NO: 983631 - DNA, 13 bp, Homo sapiens
acgtgacaggctc

SEQ ID NO: 983632 - DNA, 14 bp, Homo sapiens
acgtgacaggctcg

SEQ ID NO: 983633 - DNA, 14 bp, Homo sapiens
acgtgactgcccca

SEQ ID NO: 983634 - DNA, 20 bp, Homo sapiens
acgtgactgccccaactcct

SEQ ID NO: 983635 - DNA, 16 bp, Homo sapiens
acgtgagagaatctgc

SEQ ID NO: 983636 - DNA, 14 bp, Homo sapiens
acgtgagccaggta

SEQ ID NO: 983637 - DNA, 23 bp, Homo sapiens
acgtgagccaggtaatgagggac

SEQ ID NO: 983638 - DNA, 22 bp, Homo sapiens
acgtgaggggggggtgggtgag

SEQ ID NO: 983639 - DNA, 17 bp, Homo sapiens
acgtgattgattcagta

SEQ ID NO: 983640 - DNA, 19 bp, Homo sapiens
acgtgattgattcagtatc

SEQ ID NO: 983641 - DNA, 12 bp, Homo sapiens
acgtgcaaacaa

SEQ ID NO: 983642 - DNA, 21 bp, Homo sapiens
acgtgcacctgtactcaggag

SEQ ID NO: 983643 - DNA, 15 bp, Homo sapiens
acgtgcactgtgaat

SEQ ID NO: 983644 - DNA, 19 bp, Homo sapiens
acgtgcaggacagctcttg

SEQ ID NO: 983645 - DNA, 18 bp, Homo sapiens
acgtgcatttaaactctg

SEQ ID NO: 983646 - DNA, 20 bp, Homo sapiens
acgtgcatttaaactctgcc

SEQ ID NO: 983647 - DNA, 13 bp, Homo sapiens
acgtgccaggccc

SEQ ID NO: 983648 - DNA, 14 bp, Homo sapiens
acgtgccaggcccg

SEQ ID NO: 983649 - DNA, 14 bp, Homo sapiens
acgtgcccccagag

SEQ ID NO: 983650 - DNA, 17 bp, Homo sapiens
acgtgcccccagagtgt

SEQ ID NO: 983651 - DNA, 23 bp, Homo sapiens
acgtgcctgtagtcccagctact

SEQ ID NO: 983652 - DNA, 14 bp, Homo sapiens
acgtgctgctcaag

SEQ ID NO: 983653 - DNA, 18 bp, Homo sapiens
acgtggaacctctgtctc

SEQ ID NO: 983654 - DNA, 15 bp, Homo sapiens
acgtggactcctctt

SEQ ID NO: 983655 - DNA, 18 bp, Homo sapiens
acgtggactcctcttggt

SEQ ID NO: 983656 - DNA, 19 bp, Homo sapiens
acgtggagatagtgccagg

SEQ ID NO: 983657 - DNA, 13 bp, Homo sapiens
acgtggcactggt

SEQ ID NO: 983658 - DNA, 15 bp, Homo sapiens
acgtggcatgtggcc

SEQ ID NO: 983659 - DNA, 20 bp, Homo sapiens
acgtggcctccgcagtgtct

SEQ ID NO: 983660 - DNA, 16 bp, Homo sapiens
acgtggcctcttgagc

SEQ ID NO: 983661 - DNA, 14 bp, Homo sapiens
acgtggctcagcca

SEQ ID NO: 983662 - DNA, 14 bp, Homo sapiens
acgtggctctgctg

SEQ ID NO: 983663 - DNA, 15 bp, Homo sapiens
acgtggctctgctgg

SEQ ID NO: 983664 - DNA, 11 bp, Homo sapiens
acgtgggagac

SEQ ID NO: 983665 - DNA, 16 bp, Homo sapiens
acgtgggagacaagaa

SEQ ID NO: 983666 - DNA, 21 bp, Homo sapiens
acgtgggagttcagctgcttc

SEQ ID NO: 983667 - DNA, 16 bp, Homo sapiens
acgtgggcaaacaggc

SEQ ID NO: 983668 - DNA, 17 bp, Homo sapiens
acgtgggctcccctctt

SEQ ID NO: 983669 - DNA, 13 bp, Homo sapiens
acgtgtacagcac

SEQ ID NO: 983670 - DNA, 16 bp, Homo sapiens
acgtgtatgtttcttc

SEQ ID NO: 983671 - DNA, 17 bp, Homo sapiens
acgtgtccgtccaccct

SEQ ID NO: 983672 - DNA, 22 bp, Homo sapiens
acgtgtccgtccacccttccat

SEQ ID NO: 983673 - DNA, 13 bp, Homo sapiens
acgtgtctgttat

SEQ ID NO: 983674 - DNA, 19 bp, Homo sapiens
acgtgtcttccactttgca

SEQ ID NO: 983675 - DNA, 19 bp, Homo sapiens
acgtgtgctgtggccaggc

SEQ ID NO: 983676 - DNA, 23 bp, Homo sapiens
acgtgtgtgactcagatgtctct

SEQ ID NO: 983677 - DNA, 22 bp, Homo sapiens
acgtgttcattttattttcatg

SEQ ID NO: 983678 - DNA, 21 bp, Homo sapiens
acgttaaaagcaaaaagatgt

SEQ ID NO: 983679 - DNA, 19 bp, Homo sapiens
acgttactcagggctcctc

SEQ ID NO: 983680 - DNA, 20 bp, Homo sapiens
acgttagaggaaaaatattt

SEQ ID NO: 983681 - DNA, 19 bp, Homo sapiens
acgttaggcatttcctgct

SEQ ID NO: 983682 - DNA, 21 bp, Homo sapiens
acgttaggcatttcctgctga

SEQ ID NO: 983683 - DNA, 16 bp, Homo sapiens
acgttcctattgtcat

SEQ ID NO: 983684 - DNA, 21 bp, Homo sapiens
acgttcctattgtcattaaag

SEQ ID NO: 983685 - DNA, 14 bp, Homo sapiens
acgttcctggcccc

SEQ ID NO: 983686 - DNA, 24 bp, Homo sapiens
acgttcctggccccctcattcaga

SEQ ID NO: 983687 - DNA, 18 bp, Homo sapiens
acgttccttactgcagaa

SEQ ID NO: 983688 - DNA, 21 bp, Homo sapiens
acgttccttactgcagaatag

SEQ ID NO: 983689 - DNA, 14 bp, Homo sapiens
acgttcggggcatg

SEQ ID NO: 983690 - DNA, 23 bp, Homo sapiens
acgttcttacaagcttaaagctt

SEQ ID NO: 983691 - DNA, 18 bp, Homo sapiens
acgttgacgggccgcagg

SEQ ID NO: 983692 - DNA, 15 bp, Homo sapiens
acgttgccaggggct

SEQ ID NO: 983693 - DNA, 23 bp, Homo sapiens
acgttggacttttcgttaacatt

SEQ ID NO: 983694 - DNA, 13 bp, Homo sapiens
acgttgttgtcat

SEQ ID NO: 983695 - DNA, 16 bp, Homo sapiens
acgtttctaaaggcta

SEQ ID NO: 983696 - DNA, 18 bp, Homo sapiens
acgtttcttctttctaga

SEQ ID NO: 983697 - DNA, 15 bp, Homo sapiens
acgtttgcaccgcct

SEQ ID NO: 983698 - DNA, 17 bp, Homo sapiens
acgtttgttcgcttcct

SEQ ID NO: 983699 - DNA, 14 bp, Homo sapiens
acgttttaataatt

SEQ ID NO: 983700 - DNA, 13 bp, Homo sapiens
acgttttcttctt

SEQ ID NO: 983701 - DNA, 15 bp, Homo sapiens
acgttttcttctttc

SEQ ID NO: 983702 - DNA, 17 bp, Homo sapiens
acgttttttcctcagtg

SEQ ID NO: 983703 - DNA, 17 bp, Homo sapiens
actaaaaaaaaaaaggc

SEQ ID NO: 983704 - DNA, 23 bp, Homo sapiens
actaaaaaaatttttgacacttt

SEQ ID NO: 983705 - DNA, 17 bp, Homo sapiens
actaaaaagaaggaaaa

SEQ ID NO: 983706 - DNA, 15 bp, Homo sapiens
actaaaaataaatta

SEQ ID NO: 983707 - DNA, 15 bp, Homo sapiens
actaaaaataagaaa

SEQ ID NO: 983708 - DNA, 12 bp, Homo sapiens
actaaaaataca

SEQ ID NO: 983709 - DNA, 13 bp, Homo sapiens
actaaaaatatta

SEQ ID NO: 983710 - DNA, 14 bp, Homo sapiens
actaaaaattttta

SEQ ID NO: 983711 - DNA, 21 bp, Homo sapiens
actaaaagcagcgtcactcta

SEQ ID NO: 983712 - DNA, 20 bp, Homo sapiens
actaaaagttcttctccaat

SEQ ID NO: 983713 - DNA, 22 bp, Homo sapiens
actaaaataaattaagttactg

SEQ ID NO: 983714 - DNA, 14 bp, Homo sapiens
actaaaataatttt

SEQ ID NO: 983715 - DNA, 20 bp, Homo sapiens
actaaaataattttgtaatg

SEQ ID NO: 983716 - DNA, 15 bp, Homo sapiens
actaaacagaaaact

SEQ ID NO: 983717 - DNA, 20 bp, Homo sapiens
actaaaccacttctctgctg

SEQ ID NO: 983718 - DNA, 20 bp, Homo sapiens
actaaactacattgttctta

SEQ ID NO: 983719 - DNA, 16 bp, Homo sapiens
actaaactctctttgg

SEQ ID NO: 983720 - DNA, 17 bp, Homo sapiens
actaaactcttaccata

SEQ ID NO: 983721 - DNA, 23 bp, Homo sapiens
actaaactggtttgttgcagcca

SEQ ID NO: 983722 - DNA, 18 bp, Homo sapiens
actaaacttggtgcttat

SEQ ID NO: 983723 - DNA, 22 bp, Homo sapiens
actaaacttggtgcttattgat

SEQ ID NO: 983724 - DNA, 17 bp, Homo sapiens
actaaactttttttctg

SEQ ID NO: 983725 - DNA, 18 bp, Homo sapiens
actaaactttttttctgt

SEQ ID NO: 983726 - DNA, 19 bp, Homo sapiens
actaaactttttttctgta

SEQ ID NO: 983727 - DNA, 20 bp, Homo sapiens
actaaactttttttctgtac

SEQ ID NO: 983728 - DNA, 22 bp, Homo sapiens
actaaactttttttctgtacca

SEQ ID NO: 983729 - DNA, 17 bp, Homo sapiens
actaaagaaagattact

SEQ ID NO: 983730 - DNA, 22 bp, Homo sapiens
actaaagatatcagagctctta

SEQ ID NO: 983731 - DNA, 13 bp, Homo sapiens
actaaagccaagg

SEQ ID NO: 983732 - DNA, 21 bp, Homo sapiens
actaaagctatgttacatgga

SEQ ID NO: 983733 - DNA, 14 bp, Homo sapiens
actaaagcttcaga

SEQ ID NO: 983734 - DNA, 20 bp, Homo sapiens
actaaagcttcagactcaag

SEQ ID NO: 983735 - DNA, 22 bp, Homo sapiens
actaaagtatgtaaagtatgta

SEQ ID NO: 983736 - DNA, 16 bp, Homo sapiens
actaaataaacacgat

SEQ ID NO: 983737 - DNA, 19 bp, Homo sapiens
actaaataagaaaataaca

SEQ ID NO: 983738 - DNA, 15 bp, Homo sapiens
actaaataatgaata

SEQ ID NO: 983739 - DNA, 21 bp, Homo sapiens
actaaataatgaataaactga

SEQ ID NO: 983740 - DNA, 18 bp, Homo sapiens
actaaatatatgtctgtg

SEQ ID NO: 983741 - DNA, 19 bp, Homo sapiens
actaaatcagagacaaaat

SEQ ID NO: 983742 - DNA, 16 bp, Homo sapiens
actaaatctctaatat

SEQ ID NO: 983743 - DNA, 15 bp, Homo sapiens
actaaatcttttata

SEQ ID NO: 983744 - DNA, 21 bp, Homo sapiens
actaaatgctcatacacagtt

SEQ ID NO: 983745 - DNA, 11 bp, Homo sapiens
actaaatgctg

SEQ ID NO: 983746 - DNA, 15 bp, Homo sapiens
actaaattttaaagc

SEQ ID NO: 983747 - DNA, 12 bp, Homo sapiens
actaaattttct

SEQ ID NO: 983748 - DNA, 16 bp, Homo sapiens
actaaattttctttta

SEQ ID NO: 983749 - DNA, 16 bp, Homo sapiens
actaacaaatgtaaaa

SEQ ID NO: 983750 - DNA, 21 bp, Homo sapiens
actaacaaatgtaaaattatg

SEQ ID NO: 983751 - DNA, 17 bp, Homo sapiens
actaacagataagcaag

SEQ ID NO: 983752 - DNA, 17 bp, Homo sapiens
actaacctatctatgaa

SEQ ID NO: 983753 - DNA, 15 bp, Homo sapiens
actaaccttgcctgg

SEQ ID NO: 983754 - DNA, 18 bp, Homo sapiens
actaacgttgagcccctg

SEQ ID NO: 983755 - DNA, 19 bp, Homo sapiens
actaactcaagataatcct

SEQ ID NO: 983756 - DNA, 20 bp, Homo sapiens
actaactcatagattgcaaa

SEQ ID NO: 983757 - DNA, 21 bp, Homo sapiens
actaactcctgagaaatgtta

SEQ ID NO: 983758 - DNA, 23 bp, Homo sapiens
actaacttcagtaggatttatgt

SEQ ID NO: 983759 - DNA, 17 bp, Homo sapiens
actaagaaatattccaa

SEQ ID NO: 983760 - DNA, 18 bp, Homo sapiens
actaagaattcaaactgg

SEQ ID NO: 983761 - DNA, 20 bp, Homo sapiens
actaagagacagttctctgt

SEQ ID NO: 983762 - DNA, 21 bp, Homo sapiens
actaagatgaaatgcactgta

SEQ ID NO: 983763 - DNA, 17 bp, Homo sapiens
actaagatgaaattgcc

SEQ ID NO: 983764 - DNA, 17 bp, Homo sapiens
actaagattcttttaaa

SEQ ID NO: 983765 - DNA, 15 bp, Homo sapiens
actaagcaatttccc

SEQ ID NO: 983766 - DNA, 13 bp, Homo sapiens
actaagcagagga

SEQ ID NO: 983767 - DNA, 22 bp, Homo sapiens
actaagcagaggaggggccgct

SEQ ID NO: 983768 - DNA, 11 bp, Homo sapiens
actaagcattg

SEQ ID NO: 983769 - DNA, 16 bp, Homo sapiens
actaagccaggcctgg

SEQ ID NO: 983770 - DNA, 13 bp, Homo sapiens
actaagccctgtc

SEQ ID NO: 983771 - DNA, 18 bp, Homo sapiens
actaagccctgtcgagac

SEQ ID NO: 983772 - DNA, 20 bp, Homo sapiens
actaagctttgccagctgct

SEQ ID NO: 983773 - DNA, 12 bp, Homo sapiens
actaaggacaaa

SEQ ID NO: 983774 - DNA, 16 bp, Homo sapiens
actaaggacaaattag

SEQ ID NO: 983775 - DNA, 15 bp, Homo sapiens
actaaggctgcttca

SEQ ID NO: 983776 - DNA, 23 bp, Homo sapiens
actaaggctgcttcaaagattat

SEQ ID NO: 983777 - DNA, 17 bp, Homo sapiens
actaaggcttttatttc

SEQ ID NO: 983778 - DNA, 22 bp, Homo sapiens
actaaggggcccggccagccat

SEQ ID NO: 983779 - DNA, 14 bp, Homo sapiens
actaagtgatgctg

SEQ ID NO: 983780 - DNA, 22 bp, Homo sapiens
actaagtgatgctgtgatacct

SEQ ID NO: 983781 - DNA, 22 bp, Homo sapiens
actaataaaagcataaatgcaa

SEQ ID NO: 983782 - DNA, 19 bp, Homo sapiens
actaataaactaataattg

SEQ ID NO: 983783 - DNA, 13 bp, Homo sapiens
actaataattgca

SEQ ID NO: 983784 - DNA, 16 bp, Homo sapiens
actaatagaaaagtat

SEQ ID NO: 983785 - DNA, 16 bp, Homo sapiens
actaatagaataaagg

SEQ ID NO: 983786 - DNA, 17 bp, Homo sapiens
actaatagaataaaggc

SEQ ID NO: 983787 - DNA, 20 bp, Homo sapiens
actaatagaataaaggcagt

SEQ ID NO: 983788 - DNA, 15 bp, Homo sapiens
actaatagacaattt

SEQ ID NO: 983789 - DNA, 16 bp, Homo sapiens
actaatatatggacct

SEQ ID NO: 983790 - DNA, 19 bp, Homo sapiens
actaatatatttaaaaata

SEQ ID NO: 983791 - DNA, 19 bp, Homo sapiens
actaatcgaactatgaact

SEQ ID NO: 983792 - DNA, 15 bp, Homo sapiens
actaatgaacaaata

SEQ ID NO: 983793 - DNA, 22 bp, Homo sapiens
actaatgaacaaatatgctttg

SEQ ID NO: 983794 - DNA, 21 bp, Homo sapiens
actaatgagggaaatctgtaa

SEQ ID NO: 983795 - DNA, 23 bp, Homo sapiens
actaatgccttactcttcttgaa

SEQ ID NO: 983796 - DNA, 16 bp, Homo sapiens
actaatgctaagaaat

SEQ ID NO: 983797 - DNA, 23 bp, Homo sapiens
actaatgctaagaaatgctgaaa

SEQ ID NO: 983798 - DNA, 13 bp, Homo sapiens
actaatgcttttt

SEQ ID NO: 983799 - DNA, 17 bp, Homo sapiens
actaatgctttttagaa

SEQ ID NO: 983800 - DNA, 23 bp, Homo sapiens
actaatgctttttagaaagcatt

SEQ ID NO: 983801 - DNA, 17 bp, Homo sapiens
actaattaaaatctgga

SEQ ID NO: 983802 - DNA, 21 bp, Homo sapiens
actaattatactactttgtta

SEQ ID NO: 983803 - DNA, 16 bp, Homo sapiens
actaatttcaaaatgc

SEQ ID NO: 983804 - DNA, 19 bp, Homo sapiens
actaatttcaaaatgcttt

SEQ ID NO: 983805 - DNA, 21 bp, Homo sapiens
actaattttagtattcattct

SEQ ID NO: 983806 - DNA, 14 bp, Homo sapiens
actaattttgttga

SEQ ID NO: 983807 - DNA, 14 bp, Homo sapiens
actaatttttgctt

SEQ ID NO: 983808 - DNA, 19 bp, Homo sapiens
actaatttttgtattattt

SEQ ID NO: 983809 - DNA, 18 bp, Homo sapiens
actacaaaatttgaaatt

SEQ ID NO: 983810 - DNA, 11 bp, Homo sapiens
actacaaagta

SEQ ID NO: 983811 - DNA, 17 bp, Homo sapiens
actacaaagtaaaatga

SEQ ID NO: 983812 - DNA, 13 bp, Homo sapiens
actacaaatcaag

SEQ ID NO: 983813 - DNA, 23 bp, Homo sapiens
actacaacttttgttttctgatg

SEQ ID NO: 983814 - DNA, 22 bp, Homo sapiens
actacaataccctaccctatgg

SEQ ID NO: 983815 - DNA, 13 bp, Homo sapiens
actacacccagca

SEQ ID NO: 983816 - DNA, 13 bp, Homo sapiens
actacacctggct

SEQ ID NO: 983817 - DNA, 14 bp, Homo sapiens
actacacctggctg

SEQ ID NO: 983818 - DNA, 14 bp, Homo sapiens
actacactgaggag

SEQ ID NO: 983819 - DNA, 15 bp, Homo sapiens
actacagaagtggaa

SEQ ID NO: 983820 - DNA, 15 bp, Homo sapiens
actacagaataatgt

SEQ ID NO: 983821 - DNA, 19 bp, Homo sapiens
actacagctcttaaatgta

SEQ ID NO: 983822 - DNA, 21 bp, Homo sapiens
actacaggtgtttgactttca

SEQ ID NO: 983823 - DNA, 16 bp, Homo sapiens
actacagtctaaagct

SEQ ID NO: 983824 - DNA, 13 bp, Homo sapiens
actacataaactg

SEQ ID NO: 983825 - DNA, 13 bp, Homo sapiens
actacatgatgac

SEQ ID NO: 983826 - DNA, 15 bp, Homo sapiens
actacatgtggttta

SEQ ID NO: 983827 - DNA, 19 bp, Homo sapiens
actacatgtggtttataga

SEQ ID NO: 983828 - DNA, 15 bp, Homo sapiens
actacattctgttaa

SEQ ID NO: 983829 - DNA, 22 bp, Homo sapiens
actacattggaagcctgagcag

SEQ ID NO: 983830 - DNA, 23 bp, Homo sapiens
actacatttccaacttgatgtca

SEQ ID NO: 983831 - DNA, 23 bp, Homo sapiens
actacatttctactatgatcaga

SEQ ID NO: 983832 - DNA, 16 bp, Homo sapiens
actaccaaacactcag

SEQ ID NO: 983833 - DNA, 13 bp, Homo sapiens
actaccacaagga

SEQ ID NO: 983834 - DNA, 15 bp, Homo sapiens
actaccagaagggct

SEQ ID NO: 983835 - DNA, 18 bp, Homo sapiens
actaccagaagggcttca

SEQ ID NO: 983836 - DNA, 19 bp, Homo sapiens
actaccagaagggcttcaa

SEQ ID NO: 983837 - DNA, 14 bp, Homo sapiens
actaccagccagcc

SEQ ID NO: 983838 - DNA, 22 bp, Homo sapiens
actacccattgttcccttcctc

SEQ ID NO: 983839 - DNA, 12 bp, Homo sapiens
actccggaggac

SEQ ID NO: 983840 - DNA, 14 bp, Homo sapiens
actccggaggactg

SEQ ID NO: 983841 - DNA, 18 bp, Homo sapiens
actccggaggactgagcc

SEQ ID NO: 983842 - DNA, 21 bp, Homo sapiens
actccggaggactgagccccc

SEQ ID NO: 983843 - DNA, 19 bp, Homo sapiens
actccggcctgatgacaga

SEQ ID NO: 983844 - DNA, 17 bp, Homo sapiens
actccggcctgtaatca

SEQ ID NO: 983845 - DNA, 18 bp, Homo sapiens
actccgggaccattgacc

SEQ ID NO: 983846 - DNA, 20 bp, Homo sapiens
actccgggaccattgacctc

SEQ ID NO: 983847 - DNA, 19 bp, Homo sapiens
actccgtaacagattttgt

SEQ ID NO: 983848 - DNA, 13 bp, Homo sapiens
actcctagaagaa

SEQ ID NO: 983849 - DNA, 20 bp, Homo sapiens
actcctagaagaaccaaata

SEQ ID NO: 983850 - DNA, 15 bp, Homo sapiens
actcctaggagagcc

SEQ ID NO: 983851 - DNA, 16 bp, Homo sapiens
actcctaggagagcca

SEQ ID NO: 983852 - DNA, 17 bp, Homo sapiens
actcctcaagactttga

SEQ ID NO: 983853 - DNA, 18 bp, Homo sapiens
actcctcaagactttgat

SEQ ID NO: 983854 - DNA, 13 bp, Homo sapiens
actcctcacacag

SEQ ID NO: 983855 - DNA, 23 bp, Homo sapiens
actcctcccctcttctcttttgc

SEQ ID NO: 983856 - DNA, 12 bp, Homo sapiens
actcctccctcc

SEQ ID NO: 983857 - DNA, 19 bp, Homo sapiens
actcctcctctttctctcc

SEQ ID NO: 983858 - DNA, 21 bp, Homo sapiens
actcctcctctttctctcccc

SEQ ID NO: 983859 - DNA, 20 bp, Homo sapiens
actcctcctgctcctcaccc

SEQ ID NO: 983860 - DNA, 13 bp, Homo sapiens
actcctcctgggg

SEQ ID NO: 983861 - DNA, 18 bp, Homo sapiens
actcctcggtactcccat

SEQ ID NO: 983862 - DNA, 23 bp, Homo sapiens
actcctctactcttacagagcct

SEQ ID NO: 983863 - DNA, 22 bp, Homo sapiens
actcctctccttcaaagaatga

SEQ ID NO: 983864 - DNA, 17 bp, Homo sapiens
actcctctgaccctcct

SEQ ID NO: 983865 - DNA, 19 bp, Homo sapiens
actcctctgaccctccttc

SEQ ID NO: 983866 - DNA, 14 bp, Homo sapiens
actcctctgactca

SEQ ID NO: 983867 - DNA, 13 bp, Homo sapiens
actcctctgctga

SEQ ID NO: 983868 - DNA, 19 bp, Homo sapiens
actcctctggctttcccag

SEQ ID NO: 983869 - DNA, 14 bp, Homo sapiens
actcctctgtccag

SEQ ID NO: 983870 - DNA, 14 bp, Homo sapiens
actcctgaaattca

SEQ ID NO: 983871 - DNA, 19 bp, Homo sapiens
actcctgacagtcttgtgc

SEQ ID NO: 983872 - DNA, 18 bp, Homo sapiens
actcctgacctcaagtga

SEQ ID NO: 983873 - DNA, 17 bp, Homo sapiens
actcctgacctcaggtg

SEQ ID NO: 983874 - DNA, 21 bp, Homo sapiens
actcctgacgtctgaagcttg

SEQ ID NO: 983875 - DNA, 16 bp, Homo sapiens
actcctgaggacagct

SEQ ID NO: 983876 - DNA, 20 bp, Homo sapiens
actcctgaggacagctgtcc

SEQ ID NO: 983877 - DNA, 15 bp, Homo sapiens
actcctgatgccctc

SEQ ID NO: 983878 - DNA, 15 bp, Homo sapiens
actcctgattttgta

SEQ ID NO: 983879 - DNA, 18 bp, Homo sapiens
actcctgcaaaattttat

SEQ ID NO: 983880 - DNA, 20 bp, Homo sapiens
actcctgccaccagcatcca

SEQ ID NO: 983881 - DNA, 16 bp, Homo sapiens
actcctgccaggcaca

SEQ ID NO: 983882 - DNA, 15 bp, Homo sapiens
actcctgccaggccg

SEQ ID NO: 983883 - DNA, 22 bp, Homo sapiens
actcctgccctgttgtgtatag

SEQ ID NO: 983884 - DNA, 20 bp, Homo sapiens
actcctgcctgagtttccag

SEQ ID NO: 983885 - DNA, 15 bp, Homo sapiens
actcctgcttctctc

SEQ ID NO: 983886 - DNA, 19 bp, Homo sapiens
actcctgcttctctcagcc

SEQ ID NO: 983887 - DNA, 13 bp, Homo sapiens
actcctggcaggg

SEQ ID NO: 983888 - DNA, 22 bp, Homo sapiens
actcctggcagggccacctgca

SEQ ID NO: 983889 - DNA, 12 bp, Homo sapiens
actcctggcctc

SEQ ID NO: 983890 - DNA, 13 bp, Homo sapiens
actcctggcctcg

SEQ ID NO: 983891 - DNA, 23 bp, Homo sapiens
actgctccatttataaccccagc

SEQ ID NO: 983892 - DNA, 18 bp, Homo sapiens
actgctcccatcattcct

SEQ ID NO: 983893 - DNA, 20 bp, Homo sapiens
actgctccctaagccagcct

SEQ ID NO: 983894 - DNA, 13 bp, Homo sapiens
actgctccgtgga

SEQ ID NO: 983895 - DNA, 14 bp, Homo sapiens
actgctccgtggag

SEQ ID NO: 983896 - DNA, 13 bp, Homo sapiens
actgctcctcctc

SEQ ID NO: 983897 - DNA, 17 bp, Homo sapiens
actgctcctgtggcagg

SEQ ID NO: 983898 - DNA, 19 bp, Homo sapiens
actgctcctgtggcaggag

SEQ ID NO: 983899 - DNA, 22 bp, Homo sapiens
actgctctactttgagaagatg

SEQ ID NO: 983900 - DNA, 12 bp, Homo sapiens
actgctctgaat

SEQ ID NO: 983901 - DNA, 21 bp, Homo sapiens
actgctctgaatattttgtaa

SEQ ID NO: 983902 - DNA, 12 bp, Homo sapiens
actgctctgaga

SEQ ID NO: 983903 - DNA, 15 bp, Homo sapiens
actgctcttgtttct

SEQ ID NO: 983904 - DNA, 13 bp, Homo sapiens
actgctgagccac

SEQ ID NO: 983905 - DNA, 12 bp, Homo sapiens
actgctgagctg

SEQ ID NO: 983906 - DNA, 18 bp, Homo sapiens
actgctgatcgtagaaaa

SEQ ID NO: 983907 - DNA, 13 bp, Homo sapiens
actgctgattttt

SEQ ID NO: 983908 - DNA, 12 bp, Homo sapiens
actgctgcacca

SEQ ID NO: 983909 - DNA, 16 bp, Homo sapiens
actgctgcccagcctc

SEQ ID NO: 983910 - DNA, 22 bp, Homo sapiens
actgctgctactgcccctctcc

SEQ ID NO: 983911 - DNA, 10 bp, Homo sapiens
actgctgctc

SEQ ID NO: 983912 - DNA, 15 bp, Homo sapiens
actgctgctccccac

SEQ ID NO: 983913 - DNA, 16 bp, Homo sapiens
actgctgctccccacc

SEQ ID NO: 983914 - DNA, 14 bp, Homo sapiens
actgctgctcctct

SEQ ID NO: 983915 - DNA, 18 bp, Homo sapiens
actgctgctgcctggcca

SEQ ID NO: 983916 - DNA, 19 bp, Homo sapiens
actgctgctgcctggccac

SEQ ID NO: 983917 - DNA, 14 bp, Homo sapiens
actgctgctgtgct

SEQ ID NO: 983918 - DNA, 15 bp, Homo sapiens
actgctgctgtgctt

SEQ ID NO: 983919 - DNA, 17 bp, Homo sapiens
actgctggacatgagat

SEQ ID NO: 983920 - DNA, 20 bp, Homo sapiens
actgctggagtccagtgctt

SEQ ID NO: 983921 - DNA, 15 bp, Homo sapiens
actgctggctgcctt

SEQ ID NO: 983922 - DNA, 13 bp, Homo sapiens
actgctgggactg

SEQ ID NO: 983923 - DNA, 18 bp, Homo sapiens
actgctgggactggccag

SEQ ID NO: 983924 - DNA, 22 bp, Homo sapiens
actgctggggaggagaggactg

SEQ ID NO: 983925 - DNA, 17 bp, Homo sapiens
actgctggggagtccct

SEQ ID NO: 983926 - DNA, 12 bp, Homo sapiens
actgctgtcaat

SEQ ID NO: 983927 - DNA, 22 bp, Homo sapiens
actgctgtccacatgacctcca

SEQ ID NO: 983928 - DNA, 22 bp, Homo sapiens
actgctgtcctctcccccttca

SEQ ID NO: 983929 - DNA, 16 bp, Homo sapiens
actgctgtcttccaag

SEQ ID NO: 983930 - DNA, 13 bp, Homo sapiens
actgctgttcctg

SEQ ID NO: 983931 - DNA, 20 bp, Homo sapiens
actgcttaacttcacatatt

SEQ ID NO: 983932 - DNA, 15 bp, Homo sapiens
actctgtaattgcaa

SEQ ID NO: 983933 - DNA, 15 bp, Homo sapiens
actctgtataataga

SEQ ID NO: 983934 - DNA, 19 bp, Homo sapiens
actctgtccaggccactgt

SEQ ID NO: 983935 - DNA, 22 bp, Homo sapiens
actctgtccctgtccttccctg

SEQ ID NO: 983936 - DNA, 17 bp, Homo sapiens
actctgtctcccaggct

SEQ ID NO: 983937 - DNA, 16 bp, Homo sapiens
actctgtggggccttg

SEQ ID NO: 983938 - DNA, 17 bp, Homo sapiens
actctgtggggccttgg

SEQ ID NO: 983939 - DNA, 13 bp, Homo sapiens
actctgtgtaaat

SEQ ID NO: 983940 - DNA, 16 bp, Homo sapiens
actctgttatttagac

SEQ ID NO: 983941 - DNA, 11 bp, Homo sapiens
actcttaaaac

SEQ ID NO: 983942 - DNA, 15 bp, Homo sapiens
actcttaatctgtgt

SEQ ID NO: 983943 - DNA, 16 bp, Homo sapiens
actcttacctaaactg

SEQ ID NO: 983944 - DNA, 17 bp, Homo sapiens
actcttaggaagagaaa

SEQ ID NO: 983945 - DNA, 11 bp, Homo sapiens
actcttcagaa

SEQ ID NO: 983946 - DNA, 15 bp, Homo sapiens
actcttcagggtcta

SEQ ID NO: 983947 - DNA, 21 bp, Homo sapiens
actcttcagttaattcttaga

SEQ ID NO: 983948 - DNA, 20 bp, Homo sapiens
actcttccgaaaaatcctct

SEQ ID NO: 983949 - DNA, 21 bp, Homo sapiens
actcttccgaaaaatcctctt

SEQ ID NO: 983950 - DNA, 15 bp, Homo sapiens
actcttcctcatcct

SEQ ID NO: 983951 - DNA, 20 bp, Homo sapiens
actcttcctcatcctgcttc

SEQ ID NO: 983952 - DNA, 13 bp, Homo sapiens
actcttcctcccc

SEQ ID NO: 983953 - DNA, 11 bp, Homo sapiens
actcttcctgc

SEQ ID NO: 983954 - DNA, 14 bp, Homo sapiens
actcttcctgtcct

SEQ ID NO: 983955 - DNA, 17 bp, Homo sapiens
actcttctctcctttct

SEQ ID NO: 983956 - DNA, 22 bp, Homo sapiens
actcttctctcctttctccctg

SEQ ID NO: 983957 - DNA, 23 bp, Homo sapiens
actcttctctcctttctccctgc

SEQ ID NO: 983958 - DNA, 16 bp, Homo sapiens
actcttcttgaaattt

SEQ ID NO: 983959 - DNA, 10 bp, Homo sapiens
actcttgatg

SEQ ID NO: 983960 - DNA, 13 bp, Homo sapiens
actcttgatgtga

SEQ ID NO: 983961 - DNA, 22 bp, Homo sapiens
actcttggagcctctttttcct

SEQ ID NO: 983962 - DNA, 20 bp, Homo sapiens
actcttggtcagcttttgtt

SEQ ID NO: 983963 - DNA, 16 bp, Homo sapiens
actcttgtactgcctg

SEQ ID NO: 983964 - DNA, 19 bp, Homo sapiens
actcttgtcatttttaata

SEQ ID NO: 983965 - DNA, 13 bp, Homo sapiens
actctttaataaa

SEQ ID NO: 983966 - DNA, 20 bp, Homo sapiens
actctttaataaattgctta

SEQ ID NO: 983967 - DNA, 21 bp, Homo sapiens
actctttagacacacaaaaca

SEQ ID NO: 983968 - DNA, 16 bp, Homo sapiens
actctttattgtctgt

SEQ ID NO: 983969 - DNA, 18 bp, Homo sapiens
actctttatttttctctt

SEQ ID NO: 983970 - DNA, 11 bp, Homo sapiens
actctttcaaa

SEQ ID NO: 983971 - DNA, 19 bp, Homo sapiens
actctttcctaaagccaaa

SEQ ID NO: 983972 - DNA, 14 bp, Homo sapiens
actctttctcccta

SEQ ID NO: 983973 - DNA, 18 bp, Homo sapiens
actctttctgaaggaaga

SEQ ID NO: 983974 - DNA, 19 bp, Homo sapiens
actctttctgaaggaagag

SEQ ID NO: 983975 - DNA, 21 bp, Homo sapiens
actctttctgtatatactttt

SEQ ID NO: 983976 - DNA, 22 bp, Homo sapiens
actctttctgtatatacttttt

SEQ ID NO: 983977 - DNA, 12 bp, Homo sapiens
actctttgaaat

SEQ ID NO: 983978 - DNA, 23 bp, Homo sapiens
actctttgaagaaaagaaaaaac

SEQ ID NO: 983979 - DNA, 13 bp, Homo sapiens
actctttgagaaa

SEQ ID NO: 983980 - DNA, 22 bp, Homo sapiens
actctttgagatagaagaactg

SEQ ID NO: 983981 - DNA, 23 bp, Homo sapiens
actctttgtggggaagaggggct

SEQ ID NO: 983982 - DNA, 15 bp, Homo sapiens
actcttttaagtgcc

SEQ ID NO: 983983 - DNA, 21 bp, Homo sapiens
actcttttgctttattccaga

SEQ ID NO: 983984 - DNA, 14 bp, Homo sapiens
actctttttagggc

SEQ ID NO: 983985 - DNA, 20 bp, Homo sapiens
actctttttagggccaggca

SEQ ID NO: 983986 - DNA, 22 bp, Homo sapiens
actctttttttgagtgacagct

SEQ ID NO: 983987 - DNA, 14 bp, Homo sapiens
actgaaaaaatact

SEQ ID NO: 983988 - DNA, 17 bp, Homo sapiens
actgaaaaaatactacc

SEQ ID NO: 983989 - DNA, 13 bp, Homo sapiens
actgaaaaaatat

SEQ ID NO: 983990 - DNA, 14 bp, Homo sapiens
actgaaaaatgtca

SEQ ID NO: 983991 - DNA, 16 bp, Homo sapiens
actgaaaacatctgga

SEQ ID NO: 983992 - DNA, 17 bp, Homo sapiens
actgaaaacatctggaa

SEQ ID NO: 983993 - DNA, 22 bp, Homo sapiens
actgaaaacatttcaaagctga

SEQ ID NO: 983994 - DNA, 16 bp, Homo sapiens
actgaaaacctctcct

SEQ ID NO: 983995 - DNA, 13 bp, Homo sapiens
actggttgtcaga

SEQ ID NO: 983996 - DNA, 14 bp, Homo sapiens
actggttgtcagaa

SEQ ID NO: 983997 - DNA, 20 bp, Homo sapiens
actggttgttgccaaacagc

SEQ ID NO: 983998 - DNA, 18 bp, Homo sapiens
actggtttacaggccctg

SEQ ID NO: 983999 - DNA, 20 bp, Homo sapiens
actggtttatccacccacaa

SEQ ID NO: 984000 - DNA, 23 bp, Homo sapiens
actggtttccccagggaaggaaa

SEQ ID NO: 984001 - DNA, 15 bp, Homo sapiens
actgtaaaagttata

SEQ ID NO: 984002 - DNA, 21 bp, Homo sapiens
actgtaaaagttataataact

SEQ ID NO: 984003 - DNA, 13 bp, Homo sapiens
actgtaaacacag

SEQ ID NO: 984004 - DNA, 16 bp, Homo sapiens
actgtaaacacagaca

SEQ ID NO: 984005 - DNA, 21 bp, Homo sapiens
actgtaaacttggaatcaagg

SEQ ID NO: 984006 - DNA, 21 bp, Homo sapiens
actgtaaagacaaataaatga

SEQ ID NO: 984007 - DNA, 22 bp, Homo sapiens
actgtaaagacaaataaatgat

SEQ ID NO: 984008 - DNA, 16 bp, Homo sapiens
actgtaaagatttgtt

SEQ ID NO: 984009 - DNA, 14 bp, Homo sapiens
actgtaaagcaaat

SEQ ID NO: 984010 - DNA, 22 bp, Homo sapiens
actgtaaataaaatgtgtacag

SEQ ID NO: 984011 - DNA, 18 bp, Homo sapiens
actgtaacctcaaactct

SEQ ID NO: 984012 - DNA, 20 bp, Homo sapiens
actgtaactgctcagagctt

SEQ ID NO: 984013 - DNA, 14 bp, Homo sapiens
actgtaactgtcag

SEQ ID NO: 984014 - DNA, 17 bp, Homo sapiens
actgtaacttttttaaa

SEQ ID NO: 984015 - DNA, 13 bp, Homo sapiens
actgtaagatgtt

SEQ ID NO: 984016 - DNA, 18 bp, Homo sapiens
actgtaatataaagtatt

SEQ ID NO: 984017 - DNA, 14 bp, Homo sapiens
actgtaatcttaaa

SEQ ID NO: 984018 - DNA, 15 bp, Homo sapiens
actgtaatcttaaaa

SEQ ID NO: 984019 - DNA, 21 bp, Homo sapiens
actgtaatgggtaattctgac

SEQ ID NO: 984020 - DNA, 17 bp, Homo sapiens
actgtacaataaaaaca

SEQ ID NO: 984021 - DNA, 11 bp, Homo sapiens
actgtacagtg

SEQ ID NO: 984022 - DNA, 17 bp, Homo sapiens
actgtacagtgtctttt

SEQ ID NO: 984023 - DNA, 15 bp, Homo sapiens
actgtacataaattc

SEQ ID NO: 984024 - DNA, 21 bp, Homo sapiens
actgtacataaattccagagg

SEQ ID NO: 984025 - DNA, 20 bp, Homo sapiens
actgtacatgaaaacacatt

SEQ ID NO: 984026 - DNA, 18 bp, Homo sapiens
actgtacatgctatgctg

SEQ ID NO: 984027 - DNA, 16 bp, Homo sapiens
actgtacatttaaaat

SEQ ID NO: 984028 - DNA, 22 bp, Homo sapiens
actgtacatttaaaattgctat

SEQ ID NO: 984029 - DNA, 16 bp, Homo sapiens
actgtacccaaatgga

SEQ ID NO: 984030 - DNA, 12 bp, Homo sapiens
actgtactgcat

SEQ ID NO: 984031 - DNA, 14 bp, Homo sapiens
actgtactggccag

SEQ ID NO: 984032 - DNA, 23 bp, Homo sapiens
actgtactggccagtgtcatttt

SEQ ID NO: 984033 - DNA, 18 bp, Homo sapiens
actgtacttaataaattc

SEQ ID NO: 984034 - DNA, 17 bp, Homo sapiens
actgtactttgccattt

SEQ ID NO: 984035 - DNA, 12 bp, Homo sapiens
actgtacttttt

SEQ ID NO: 984036 - DNA, 15 bp, Homo sapiens
actgtagaaatgatg

SEQ ID NO: 984037 - DNA, 14 bp, Homo sapiens
actgtagaacctgt

SEQ ID NO: 984038 - DNA, 17 bp, Homo sapiens
actgtagattgcttctg

SEQ ID NO: 984039 - DNA, 15 bp, Homo sapiens
actgtagcaggggaa

SEQ ID NO: 984040 - DNA, 16 bp, Homo sapiens
actgtagcgaccccag

SEQ ID NO: 984041 - DNA, 19 bp, Homo sapiens
actgtagcgaccccagact

SEQ ID NO: 984042 - DNA, 16 bp, Homo sapiens
actgtagctcaagttt

SEQ ID NO: 984043 - DNA, 19 bp, Homo sapiens
actgtagctcaagtttaaa

SEQ ID NO: 984044 - DNA, 21 bp, Homo sapiens
actgtagtttagttctgttga

SEQ ID NO: 984045 - DNA, 21 bp, Homo sapiens
actgtagtttttcttcaacat

SEQ ID NO: 984046 - DNA, 19 bp, Homo sapiens
actgtagtttttgaaaatt

SEQ ID NO: 984047 - DNA, 15 bp, Homo sapiens
actgtataagtacta

SEQ ID NO: 984048 - DNA, 20 bp, Homo sapiens
actgtataggtagatccaga

SEQ ID NO: 984049 - DNA, 21 bp, Homo sapiens
actgtataggtagatccagat

SEQ ID NO: 984050 - DNA, 14 bp, Homo sapiens
actgtatataaaca

SEQ ID NO: 984051 - DNA, 17 bp, Homo sapiens
actgtatataaacatat

SEQ ID NO: 984052 - DNA, 18 bp, Homo sapiens
actgtatataaacatatt

SEQ ID NO: 984053 - DNA, 13 bp, Homo sapiens
actgtatatgtat

SEQ ID NO: 984054 - DNA, 19 bp, Homo sapiens
actgtatatgtattccctt

SEQ ID NO: 984055 - DNA, 14 bp, Homo sapiens
actgtatattgcta

SEQ ID NO: 984056 - DNA, 15 bp, Homo sapiens
actgtatattgctaa

SEQ ID NO: 984057 - DNA, 13 bp, Homo sapiens
actgtatatttgt

SEQ ID NO: 984058 - DNA, 14 bp, Homo sapiens
actgtatatttgta

SEQ ID NO: 984059 - DNA, 22 bp, Homo sapiens
actgtatcaaatctgtatatgt

SEQ ID NO: 984060 - DNA, 20 bp, Homo sapiens
actgtatcatgacaaagact

SEQ ID NO: 984061 - DNA, 17 bp, Homo sapiens
actgtatctaggcattt

SEQ ID NO: 984062 - DNA, 15 bp, Homo sapiens
actgtatctgtgtag

SEQ ID NO: 984063 - DNA, 22 bp, Homo sapiens
actgtatgtgtgtaggttatct

SEQ ID NO: 984064 - DNA, 12 bp, Homo sapiens
actgtatgttat

SEQ ID NO: 984065 - DNA, 15 bp, Homo sapiens
actgtattaaatctt

SEQ ID NO: 984066 - DNA, 16 bp, Homo sapiens
actgtattaaatctta

SEQ ID NO: 984067 - DNA, 20 bp, Homo sapiens
actgtattacataaataaat

SEQ ID NO: 984068 - DNA, 20 bp, Homo sapiens
actgtattcgtgcatttttg

SEQ ID NO: 984069 - DNA, 17 bp, Homo sapiens
actgtattctagtggct

SEQ ID NO: 984070 - DNA, 20 bp, Homo sapiens
actgtattctagtggctgtt

SEQ ID NO: 984071 - DNA, 21 bp, Homo sapiens
actgtatttaaggaatcaaat

SEQ ID NO: 984072 - DNA, 22 bp, Homo sapiens
actgtatttaaggaatcaaatc

SEQ ID NO: 984073 - DNA, 14 bp, Homo sapiens
actgtatttcagta

SEQ ID NO: 984074 - DNA, 22 bp, Homo sapiens
actgtatttcagtattttccag

SEQ ID NO: 984075 - DNA, 13 bp, Homo sapiens
actgtatttctaa

SEQ ID NO: 984076 - DNA, 19 bp, Homo sapiens
actgtcaaatgaactttta

SEQ ID NO: 984077 - DNA, 22 bp, Homo sapiens
actgtcaaatgatgtgcaaaac

SEQ ID NO: 984078 - DNA, 12 bp, Homo sapiens
actgtcaataaa

SEQ ID NO: 984079 - DNA, 17 bp, Homo sapiens
actgtcaccctccacct

SEQ ID NO: 984080 - DNA, 20 bp, Homo sapiens
actgtcacgcggcagcttca

SEQ ID NO: 984081 - DNA, 21 bp, Homo sapiens
actgtcacggggttccctcct

SEQ ID NO: 984082 - DNA, 23 bp, Homo sapiens
actgtcactcattgctgagcctc

SEQ ID NO: 984083 - DNA, 24 bp, Homo sapiens
actgtcactcattgctgagcctct

SEQ ID NO: 984084 - DNA, 22 bp, Homo sapiens
actgtcactgccgacatccctc

SEQ ID NO: 984085 - DNA, 18 bp, Homo sapiens
actgtcagccgggccctg

SEQ ID NO: 984086 - DNA, 14 bp, Homo sapiens
actgtcaggaatgg

SEQ ID NO: 984087 - DNA, 14 bp, Homo sapiens
actgtcagggaggg

SEQ ID NO: 984088 - DNA, 23 bp, Homo sapiens
actgtcagggagggccagggagg

SEQ ID NO: 984089 - DNA, 22 bp, Homo sapiens
actgtcagttgtacttctgctc

SEQ ID NO: 984090 - DNA, 24 bp, Homo sapiens
actgtcatgcttcatcattccctc

SEQ ID NO: 984091 - DNA, 17 bp, Homo sapiens
actgtccacatctgcct

SEQ ID NO: 984092 - DNA, 18 bp, Homo sapiens
actgtccacatctgcctc

SEQ ID NO: 984093 - DNA, 22 bp, Homo sapiens
actgtccaccagtttatacaga

SEQ ID NO: 984094 - DNA, 14 bp, Homo sapiens
actgtccaggagct

SEQ ID NO: 984095 - DNA, 23 bp, Homo sapiens
actgtccaggagctaatctgacc

SEQ ID NO: 984096 - DNA, 16 bp, Homo sapiens
actgtcccgacacagc

SEQ ID NO: 984097 - DNA, 17 bp, Homo sapiens
actgtcccgacacagcg

SEQ ID NO: 984098 - DNA, 21 bp, Homo sapiens
actgtccctgccaatgctcca

SEQ ID NO: 984099 - DNA, 18 bp, Homo sapiens
actgtcctcaaataagtc

SEQ ID NO: 984100 - DNA, 16 bp, Homo sapiens
actgtcctccaagcca

SEQ ID NO: 984101 - DNA, 15 bp, Homo sapiens
actgtcctcccacag

SEQ ID NO: 984102 - DNA, 19 bp, Homo sapiens
actgtcctcccacagacct

SEQ ID NO: 984103 - DNA, 18 bp, Homo sapiens
actgtcctccttggcggc

SEQ ID NO: 984104 - DNA, 12 bp, Homo sapiens
actgtcctgagg

SEQ ID NO: 984105 - DNA, 18 bp, Homo sapiens
actgtcctgaggagccct

SEQ ID NO: 984106 - DNA, 13 bp, Homo sapiens
actgtcctggaac

SEQ ID NO: 984107 - DNA, 20 bp, Homo sapiens
actgtcctgggcgccctgga

SEQ ID NO: 984108 - DNA, 17 bp, Homo sapiens
actgtcctgttgattaa

SEQ ID NO: 984109 - DNA, 14 bp, Homo sapiens
actgtcggagaggc

SEQ ID NO: 984110 - DNA, 16 bp, Homo sapiens
actgtcggagaggctg

SEQ ID NO: 984111 - DNA, 21 bp, Homo sapiens
actgtctagccactccctccc

SEQ ID NO: 984112 - DNA, 20 bp, Homo sapiens
actgtctatatcataactat

SEQ ID NO: 984113 - DNA, 15 bp, Homo sapiens
actgtctatttaagt

SEQ ID NO: 984114 - DNA, 16 bp, Homo sapiens
actgtctcaaaaggat

SEQ ID NO: 984115 - DNA, 20 bp, Homo sapiens
actgtctcaagagggcactg

SEQ ID NO: 984116 - DNA, 12 bp, Homo sapiens
actgtctcactg

SEQ ID NO: 984117 - DNA, 22 bp, Homo sapiens
actgtctccatggccctgcaaa

SEQ ID NO: 984118 - DNA, 18 bp, Homo sapiens
actgtctcctccctgggc

SEQ ID NO: 984119 - DNA, 19 bp, Homo sapiens
actggcagagcacagccca

SEQ ID NO: 984120 - DNA, 22 bp, Homo sapiens
actggcaggggagacaggagcc

SEQ ID NO: 984121 - DNA, 16 bp, Homo sapiens
actggcagttttccat

SEQ ID NO: 984122 - DNA, 22 bp, Homo sapiens
actggcagttttccattggttt

SEQ ID NO: 984123 - DNA, 21 bp, Homo sapiens
actggcatctgacacaaaaaa

SEQ ID NO: 984124 - DNA, 13 bp, Homo sapiens
actggcatggatt

SEQ ID NO: 984125 - DNA, 17 bp, Homo sapiens
actggcattaattatta

SEQ ID NO: 984126 - DNA, 18 bp, Homo sapiens
actggcattaattattaa

SEQ ID NO: 984127 - DNA, 16 bp, Homo sapiens
actggccacagttgtt

SEQ ID NO: 984128 - DNA, 15 bp, Homo sapiens
actggccaccaggct

SEQ ID NO: 984129 - DNA, 17 bp, Homo sapiens
actggccaccaggctgg

SEQ ID NO: 984130 - DNA, 22 bp, Homo sapiens
actggccaccaggctggcgcag

SEQ ID NO: 984131 - DNA, 13 bp, Homo sapiens
actggccagagag

SEQ ID NO: 984132 - DNA, 19 bp, Homo sapiens
actggccagagagggccca

SEQ ID NO: 984133 - DNA, 22 bp, Homo sapiens
actggccagagagggcccagct

SEQ ID NO: 984134 - DNA, 14 bp, Homo sapiens
actggccagccata

SEQ ID NO: 984135 - DNA, 22 bp, Homo sapiens
actggccatttgccaattttcc

SEQ ID NO: 984136 - DNA, 20 bp, Homo sapiens
actggccccggatcagagca

SEQ ID NO: 984137 - DNA, 21 bp, Homo sapiens
actggccccggatcagagcag

SEQ ID NO: 984138 - DNA, 21 bp, Homo sapiens
actggcccctactttgtggca

SEQ ID NO: 984139 - DNA, 13 bp, Homo sapiens
actggcctgactt

SEQ ID NO: 984140 - DNA, 18 bp, Homo sapiens
actggcctgacttggggg

SEQ ID NO: 984141 - DNA, 16 bp, Homo sapiens
actggcgttcacctcc

SEQ ID NO: 984142 - DNA, 19 bp, Homo sapiens
actggcgttcacctccctg

SEQ ID NO: 984143 - DNA, 17 bp, Homo sapiens
actggctagctatatta

SEQ ID NO: 984144 - DNA, 13 bp, Homo sapiens
actggctctccaa

SEQ ID NO: 984145 - DNA, 15 bp, Homo sapiens
actggctctccaagt

SEQ ID NO: 984146 - DNA, 14 bp, Homo sapiens
actggctctctcca

SEQ ID NO: 984147 - DNA, 9 bp, Homo sapiens
actggctga

SEQ ID NO: 984148 - DNA, 21 bp, Homo sapiens
actggctgggagtccttacct

SEQ ID NO: 984149 - DNA, 15 bp, Homo sapiens
actggctgggcccct

SEQ ID NO: 984150 - DNA, 16 bp, Homo sapiens
actggctgggcccctg

SEQ ID NO: 984151 - DNA, 13 bp, Homo sapiens
acccaccctctgg

SEQ ID NO: 984152 - DNA, 16 bp, Homo sapiens
acccaccctctggtcc

SEQ ID NO: 984153 - DNA, 18 bp, Homo sapiens
acccacccttacttcctg

SEQ ID NO: 984154 - DNA, 22 bp, Homo sapiens
acccaccctttttttggggtgc

SEQ ID NO: 984155 - DNA, 22 bp, Homo sapiens
acccaccgatggagcccccaga

SEQ ID NO: 984156 - DNA, 19 bp, Homo sapiens
acccaccgtccgccctgct

SEQ ID NO: 984157 - DNA, 18 bp, Homo sapiens
acccacctccacccagcc

SEQ ID NO: 984158 - DNA, 19 bp, Homo sapiens
acccacctccacccagccc

SEQ ID NO: 984159 - DNA, 20 bp, Homo sapiens
acccacctccacccagcccc

SEQ ID NO: 984160 - DNA, 12 bp, Homo sapiens
acccacctcctg

SEQ ID NO: 984161 - DNA, 19 bp, Homo sapiens
acccacctcctgcggctca

SEQ ID NO: 984162 - DNA, 19 bp, Homo sapiens
acccacctgcgcttctgct

SEQ ID NO: 984163 - DNA, 11 bp, Homo sapiens
acccacctgct

SEQ ID NO: 984164 - DNA, 21 bp, Homo sapiens
acccacctgctagtgtgaatt

SEQ ID NO: 984165 - DNA, 17 bp, Homo sapiens
acccacctgctgagaga

SEQ ID NO: 984166 - DNA, 16 bp, Homo sapiens
acccacctgttttctg

SEQ ID NO: 984167 - DNA, 17 bp, Homo sapiens
acccacctgttttctga

SEQ ID NO: 984168 - DNA, 19 bp, Homo sapiens
acccacctgttttctgaaa

SEQ ID NO: 984169 - DNA, 20 bp, Homo sapiens
acccaccttgttggagcctg

SEQ ID NO: 984170 - DNA, 17 bp, Homo sapiens
acccacgattttctcca

SEQ ID NO: 984171 - DNA, 22 bp, Homo sapiens
acccacgtgagagaatctgcct

SEQ ID NO: 984172 - DNA, 20 bp, Homo sapiens
acccacgtgtaactgtcagc

SEQ ID NO: 984173 - DNA, 23 bp, Homo sapiens
acccacgtttgttcgcttcctga

SEQ ID NO: 984174 - DNA, 18 bp, Homo sapiens
acccactcaccagggtcc

SEQ ID NO: 984175 - DNA, 12 bp, Homo sapiens
acccactcagga

SEQ ID NO: 984176 - DNA, 13 bp, Homo sapiens
acccactcaggat

SEQ ID NO: 984177 - DNA, 18 bp, Homo sapiens
acccactctgcggcccgg

SEQ ID NO: 984178 - DNA, 23 bp, Homo sapiens
acccactctgcggcccgggccga

SEQ ID NO: 984179 - DNA, 21 bp, Homo sapiens
acccactgccccgtgtgaatg

SEQ ID NO: 984180 - DNA, 21 bp, Homo sapiens
acccactggactcacctcccc

SEQ ID NO: 984181 - DNA, 20 bp, Homo sapiens
acccacttctggcctccagc

SEQ ID NO: 984182 - DNA, 16 bp, Homo sapiens
acccagaagaaaatag

SEQ ID NO: 984183 - DNA, 14 bp, Homo sapiens
acccagaatggagc

SEQ ID NO: 984184 - DNA, 18 bp, Homo sapiens
acccagaatggagcctgc

SEQ ID NO: 984185 - DNA, 24 bp, Homo sapiens
acccagagcaccccctgctccacc

SEQ ID NO: 984186 - DNA, 17 bp, Homo sapiens
acccagaggccctgaag

SEQ ID NO: 984187 - DNA, 18 bp, Homo sapiens
acccagaggccctgaagc

SEQ ID NO: 984188 - DNA, 21 bp, Homo sapiens
acccagaggccctgaagcctc

SEQ ID NO: 984189 - DNA, 13 bp, Homo sapiens
acccagaggtgga

SEQ ID NO: 984190 - DNA, 21 bp, Homo sapiens
acccagatcaggaaccagggc

SEQ ID NO: 984191 - DNA, 19 bp, Homo sapiens
acccagattttgctgtata

SEQ ID NO: 984192 - DNA, 20 bp, Homo sapiens
acccagattttgctgtatat

SEQ ID NO: 984193 - DNA, 14 bp, Homo sapiens
acccagcaatagag

SEQ ID NO: 984194 - DNA, 12 bp, Homo sapiens
acccagcaggca

SEQ ID NO: 984195 - DNA, 15 bp, Homo sapiens
acccagcaggcagag

SEQ ID NO: 984196 - DNA, 20 bp, Homo sapiens
acccagcatctcccagcaag

SEQ ID NO: 984197 - DNA, 22 bp, Homo sapiens
acccagcatctcccagcaagac

SEQ ID NO: 984198 - DNA, 12 bp, Homo sapiens
acccagccagct

SEQ ID NO: 984199 - DNA, 17 bp, Homo sapiens
acccagccagctgcagg

SEQ ID NO: 984200 - DNA, 20 bp, Homo sapiens
acccagccagctgcagggca

SEQ ID NO: 984201 - DNA, 15 bp, Homo sapiens
acccagccatctgcc

SEQ ID NO: 984202 - DNA, 15 bp, Homo sapiens
acccagccatgtgtt

SEQ ID NO: 984203 - DNA, 20 bp, Homo sapiens
acccagcccaacccggccca

SEQ ID NO: 984204 - DNA, 16 bp, Homo sapiens
acccagcccagcccag

SEQ ID NO: 984205 - DNA, 11 bp, Homo sapiens
acccagcccat

SEQ ID NO: 984206 - DNA, 18 bp, Homo sapiens
acccagcccctctcccct

SEQ ID NO: 984207 - DNA, 14 bp, Homo sapiens
acccagcccctggc

SEQ ID NO: 984208 - DNA, 14 bp, Homo sapiens
acccagcccgcggc

SEQ ID NO: 984209 - DNA, 12 bp, Homo sapiens
acccagcccttc

SEQ ID NO: 984210 - DNA, 14 bp, Homo sapiens
acccagcccttcct

SEQ ID NO: 984211 - DNA, 11 bp, Homo sapiens
acccagcctga

SEQ ID NO: 984212 - DNA, 12 bp, Homo sapiens
acccagcctgaa

SEQ ID NO: 984213 - DNA, 20 bp, Homo sapiens
acccagcggcttagccaagc

SEQ ID NO: 984214 - DNA, 21 bp, Homo sapiens
acccagcggcttagccaagcc

SEQ ID NO: 984215 - DNA, 23 bp, Homo sapiens
acccagcggcttagccaagccct

SEQ ID NO: 984216 - DNA, 19 bp, Homo sapiens
acccagcgtggcccaggcc

SEQ ID NO: 984217 - DNA, 14 bp, Homo sapiens
acccagctactctg

SEQ ID NO: 984218 - DNA, 17 bp, Homo sapiens
acccagctactctgtcc

SEQ ID NO: 984219 - DNA, 21 bp, Homo sapiens
acccagctccaggggcccttg

SEQ ID NO: 984220 - DNA, 11 bp, Homo sapiens
acccagctcct

SEQ ID NO: 984221 - DNA, 19 bp, Homo sapiens
acccagctcctctgagcca

SEQ ID NO: 984222 - DNA, 18 bp, Homo sapiens
acccagctggtcctgtgg

SEQ ID NO: 984223 - DNA, 21 bp, Homo sapiens
acccaggaagggaaagcgggc

SEQ ID NO: 984224 - DNA, 14 bp, Homo sapiens
acccaggacaggat

SEQ ID NO: 984225 - DNA, 14 bp, Homo sapiens
acccaggaccaagc

SEQ ID NO: 984226 - DNA, 12 bp, Homo sapiens
acccaggaggcg

SEQ ID NO: 984227 - DNA, 22 bp, Homo sapiens
acccaggcagtaccattcagga

SEQ ID NO: 984228 - DNA, 14 bp, Homo sapiens
acccaggccctcca

SEQ ID NO: 984229 - DNA, 22 bp, Homo sapiens
acccaggccgcagctcttgccc

SEQ ID NO: 984230 - DNA, 23 bp, Homo sapiens
acccaggccgcagctcttgccct

SEQ ID NO: 984231 - DNA, 11 bp, Homo sapiens
acccaggctcc

SEQ ID NO: 984232 - DNA, 16 bp, Homo sapiens
acccaggctccgccct

SEQ ID NO: 984233 - DNA, 20 bp, Homo sapiens
acccaggctccgcccttagt

SEQ ID NO: 984234 - DNA, 14 bp, Homo sapiens
accagctctgtggc

SEQ ID NO: 984235 - DNA, 20 bp, Homo sapiens
accagctctgtggcctgtgt

SEQ ID NO: 984236 - DNA, 16 bp, Homo sapiens
accagctgcctcttct

SEQ ID NO: 984237 - DNA, 19 bp, Homo sapiens
accagctgcgcttgctttt

SEQ ID NO: 984238 - DNA, 14 bp, Homo sapiens
accagctgctctgc

SEQ ID NO: 984239 - DNA, 16 bp, Homo sapiens
accagctgctctgccc

SEQ ID NO: 984240 - DNA, 19 bp, Homo sapiens
accagctgctctgcccctt

SEQ ID NO: 984241 - DNA, 21 bp, Homo sapiens
accagctgctgtgccccacca

SEQ ID NO: 984242 - DNA, 19 bp, Homo sapiens
accagctggagtgagggcc

SEQ ID NO: 984243 - DNA, 13 bp, Homo sapiens
accagctggcctg

SEQ ID NO: 984244 - DNA, 15 bp, Homo sapiens
accagctggcctggg

SEQ ID NO: 984245 - DNA, 21 bp, Homo sapiens
accagctggcctggggtccct

SEQ ID NO: 984246 - DNA, 21 bp, Homo sapiens
accagctggggcgtggggagg

SEQ ID NO: 984247 - DNA, 17 bp, Homo sapiens
accagcttaaaggcagt

SEQ ID NO: 984248 - DNA, 24 bp, Homo sapiens
accagcttaagcgttcatatgctc

SEQ ID NO: 984249 - DNA, 15 bp, Homo sapiens
accagcttctccagg

SEQ ID NO: 984250 - DNA, 18 bp, Homo sapiens
accagcttctccaggctc

SEQ ID NO: 984251 - DNA, 12 bp, Homo sapiens
accaggaagccg

SEQ ID NO: 984252 - DNA, 14 bp, Homo sapiens
accaggacaggacc

SEQ ID NO: 984253 - DNA, 17 bp, Homo sapiens
accaggacaggaccaga

SEQ ID NO: 984254 - DNA, 13 bp, Homo sapiens
accaggacccagg

SEQ ID NO: 984255 - DNA, 22 bp, Homo sapiens
accaggactagggctggagtga

SEQ ID NO: 984256 - DNA, 15 bp, Homo sapiens
accaggactccctcc

SEQ ID NO: 984257 - DNA, 19 bp, Homo sapiens
accaggagaaccactacat

SEQ ID NO: 984258 - DNA, 21 bp, Homo sapiens
accaggagaagggctggggcc

SEQ ID NO: 984259 - DNA, 23 bp, Homo sapiens
accaggagaagggctggggccgg

SEQ ID NO: 984260 - DNA, 14 bp, Homo sapiens
accaggagcacctg

SEQ ID NO: 984261 - DNA, 18 bp, Homo sapiens
accaggagcagcagccag

SEQ ID NO: 984262 - DNA, 19 bp, Homo sapiens
accaaacttgttcatttag

SEQ ID NO: 984263 - DNA, 22 bp, Homo sapiens
accaaagagactggagcatctg

SEQ ID NO: 984264 - DNA, 11 bp, Homo sapiens
accaaagcaca

SEQ ID NO: 984265 - DNA, 14 bp, Homo sapiens
accaaagccaccag

SEQ ID NO: 984266 - DNA, 12 bp, Homo sapiens
accaaagctgcc

SEQ ID NO: 984267 - DNA, 13 bp, Homo sapiens
accaaagctgccc

SEQ ID NO: 984268 - DNA, 19 bp, Homo sapiens
accaaagctgcctgtgcca

SEQ ID NO: 984269 - DNA, 19 bp, Homo sapiens
accaaaggaaaatgtctgt

SEQ ID NO: 984270 - DNA, 21 bp, Homo sapiens
accaaagggaaaactcttcat

SEQ ID NO: 984271 - DNA, 22 bp, Homo sapiens
accaaagggaagtgaggcccaa

SEQ ID NO: 984272 - DNA, 13 bp, Homo sapiens
accaaaggtcaat

SEQ ID NO: 984273 - DNA, 17 bp, Homo sapiens
accaaaggtgaaggaat

SEQ ID NO: 984274 - DNA, 20 bp, Homo sapiens
accaaaggtgaaggaatata

SEQ ID NO: 984275 - DNA, 21 bp, Homo sapiens
accaaagtcctttttttccat

SEQ ID NO: 984276 - DNA, 15 bp, Homo sapiens
accaaagtctaaact

SEQ ID NO: 984277 - DNA, 19 bp, Homo sapiens
accaaagtctgccgcccac

SEQ ID NO: 984278 - DNA, 19 bp, Homo sapiens
accaaagtgtcttttgaca

SEQ ID NO: 984279 - DNA, 21 bp, Homo sapiens
accaaagtgtcttttgacatt

SEQ ID NO: 984280 - DNA, 13 bp, Homo sapiens
accaaataagact

SEQ ID NO: 984281 - DNA, 22 bp, Homo sapiens
accaaatacctcaatttttgtt

SEQ ID NO: 984282 - DNA, 23 bp, Homo sapiens
accaaatacctcaatttttgttt

SEQ ID NO: 984283 - DNA, 16 bp, Homo sapiens
accaaatagtgtgaaa

SEQ ID NO: 984284 - DNA, 16 bp, Homo sapiens
accaaatcagctgcta

SEQ ID NO: 984285 - DNA, 17 bp, Homo sapiens
accaaatctcagttgtt

SEQ ID NO: 984286 - DNA, 13 bp, Homo sapiens
accaaatctggaa

SEQ ID NO: 984287 - DNA, 17 bp, Homo sapiens
accaaatgcctgttgta

SEQ ID NO: 984288 - DNA, 13 bp, Homo sapiens
accaaatgtagtt

SEQ ID NO: 984289 - DNA, 18 bp, Homo sapiens
accaaatgtgccatacta

SEQ ID NO: 984290 - DNA, 16 bp, Homo sapiens
accaaattagcaggtg

SEQ ID NO: 984291 - DNA, 16 bp, Homo sapiens
accaaattatcttgat

SEQ ID NO: 984292 - DNA, 15 bp, Homo sapiens
accaaattctccctg

SEQ ID NO: 984293 - DNA, 14 bp, Homo sapiens
accaaattgcttct

SEQ ID NO: 984294 - DNA, 18 bp, Homo sapiens
accaacaggtttatctga

SEQ ID NO: 984295 - DNA, 20 bp, Homo sapiens
accaacaggtttatctgaag

SEQ ID NO: 984296 - DNA, 15 bp, Homo sapiens
accaacataaaaatg

SEQ ID NO: 984297 - DNA, 18 bp, Homo sapiens
accaacattaaaactcat

SEQ ID NO: 984298 - DNA, 15 bp, Homo sapiens
accaaccctgggacc

SEQ ID NO: 984299 - DNA, 13 bp, Homo sapiens
accaacctgacca

SEQ ID NO: 984300 - DNA, 17 bp, Homo sapiens
accaacgttactcaggg

SEQ ID NO: 984301 - DNA, 19 bp, Homo sapiens
accaactatttttgaggaa

SEQ ID NO: 984302 - DNA, 14 bp, Homo sapiens
accaactctgcact

SEQ ID NO: 984303 - DNA, 15 bp, Homo sapiens
accaactgccccagg

SEQ ID NO: 984304 - DNA, 17 bp, Homo sapiens
accaactgccccagggg

SEQ ID NO: 984305 - DNA, 19 bp, Homo sapiens
accaactggcttctgtgca

SEQ ID NO: 984306 - DNA, 23 bp, Homo sapiens
accaactgtcactcattgctgag

SEQ ID NO: 984307 - DNA, 13 bp, Homo sapiens
accaacttgccac

SEQ ID NO: 984308 - DNA, 20 bp, Homo sapiens
accaacttggttctgcttca

SEQ ID NO: 984309 - DNA, 15 bp, Homo sapiens
accaagaactgaagg

SEQ ID NO: 984310 - DNA, 14 bp, Homo sapiens
accaagaactgcat

SEQ ID NO: 984311 - DNA, 21 bp, Homo sapiens
accaagaattctccaaaacaa

SEQ ID NO: 984312 - DNA, 22 bp, Homo sapiens
accaagaattctccaaaacaat

SEQ ID NO: 984313 - DNA, 16 bp, Homo sapiens
accaagactctgaaat

SEQ ID NO: 984314 - DNA, 23 bp, Homo sapiens
accaagacttttgtctgatcaag

SEQ ID NO: 984315 - DNA, 19 bp, Homo sapiens
accaagagcaatttacctg

SEQ ID NO: 984316 - DNA, 13 bp, Homo sapiens
accaagaggctgg

SEQ ID NO: 984317 - DNA, 15 bp, Homo sapiens
accaagaggctggtt

SEQ ID NO: 984318 - DNA, 15 bp, Homo sapiens
accaagagtaacttt

SEQ ID NO: 984319 - DNA, 14 bp, Homo sapiens
accaagcacagcag

SEQ ID NO: 984320 - DNA, 23 bp, Homo sapiens
accaagccaagggaacctgtgtc

SEQ ID NO: 984321 - DNA, 20 bp, Homo sapiens
accaagcccgcctccagcac

SEQ ID NO: 984322 - DNA, 16 bp, Homo sapiens
accaagccgtggcttc

SEQ ID NO: 984323 - DNA, 15 bp, Homo sapiens
accaagcgaccaagg

SEQ ID NO: 984324 - DNA, 14 bp, Homo sapiens
accaagctattcct

SEQ ID NO: 984325 - DNA, 12 bp, Homo sapiens
accaaggaagga

SEQ ID NO: 984326 - DNA, 14 bp, Homo sapiens
accaaggaaggagc

SEQ ID NO: 984327 - DNA, 19 bp, Homo sapiens
accaaggaaggagcccctg

SEQ ID NO: 984328 - DNA, 13 bp, Homo sapiens
accaaggaggggc

SEQ ID NO: 984329 - DNA, 18 bp, Homo sapiens
accaaggcaaggcaggtg

SEQ ID NO: 984330 - DNA, 12 bp, Homo sapiens
accaaggcagcc

SEQ ID NO: 984331 - DNA, 15 bp, Homo sapiens
accaaggcagtgcat

SEQ ID NO: 984332 - DNA, 20 bp, Homo sapiens
accaagggggcggggactgc

SEQ ID NO: 984333 - DNA, 24 bp, Homo sapiens
accaagtaaaacaaaaccactggg

SEQ ID NO: 984334 - DNA, 15 bp, Homo sapiens
accaagtatttatta

SEQ ID NO: 984335 - DNA, 17 bp, Homo sapiens
accaagtcaggccaggt

SEQ ID NO: 984336 - DNA, 20 bp, Homo sapiens
accaagtcaggccaggtggg

SEQ ID NO: 984337 - DNA, 23 bp, Homo sapiens
accaagtcctggctacatcccag

SEQ ID NO: 984338 - DNA, 12 bp, Homo sapiens
accaagtggctg

SEQ ID NO: 984339 - DNA, 23 bp, Homo sapiens
accaagtggctgggtgccctctc

SEQ ID NO: 984340 - DNA, 18 bp, Homo sapiens
accaagtgtgctaaaaat

SEQ ID NO: 984341 - DNA, 12 bp, Homo sapiens
accaatacagaa

SEQ ID NO: 984342 - DNA, 16 bp, Homo sapiens
accaatattgtacagt

SEQ ID NO: 984343 - DNA, 17 bp, Homo sapiens
accaatattgtacagtt

SEQ ID NO: 984344 - DNA, 18 bp, Homo sapiens
accaatattgtacagttt

SEQ ID NO: 984345 - DNA, 19 bp, Homo sapiens
accaatattgtacagtttt

SEQ ID NO: 984346 - DNA, 19 bp, Homo sapiens
accaatatttcttcacaaa

SEQ ID NO: 984347 - DNA, 21 bp, Homo sapiens
accaatcacaaggataataga

SEQ ID NO: 984348 - DNA, 15 bp, Homo sapiens
accaatcagagagcc

SEQ ID NO: 984349 - DNA, 16 bp, Homo sapiens
accaatcagagagcct

SEQ ID NO: 984350 - DNA, 16 bp, Homo sapiens
accaatccccagccta

SEQ ID NO: 984351 - DNA, 22 bp, Homo sapiens
accaatcccgtgaaagaattat

SEQ ID NO: 984352 - DNA, 17 bp, Homo sapiens
accaatgaaaaaatgta

SEQ ID NO: 984353 - DNA, 20 bp, Homo sapiens
accaatgcatgcagccactg

SEQ ID NO: 984354 - DNA, 16 bp, Homo sapiens
accaatgcctttttag

SEQ ID NO: 984355 - DNA, 18 bp, Homo sapiens
accaatgctgttgtaaac

SEQ ID NO: 984356 - DNA, 18 bp, Homo sapiens
accaatgcttttatcaaa

SEQ ID NO: 984357 - DNA, 16 bp, Homo sapiens
accaatgtgttttctg

SEQ ID NO: 984358 - DNA, 20 bp, Homo sapiens
accaattacatggaactttt

SEQ ID NO: 984359 - DNA, 20 bp, Homo sapiens
accaattagtcactgctgct

SEQ ID NO: 984360 - DNA, 16 bp, Homo sapiens
accaattcaacccttt

SEQ ID NO: 984361 - DNA, 15 bp, Homo sapiens
accaattgtgctgcc

SEQ ID NO: 984362 - DNA, 12 bp, Homo sapiens
accaatttcttc

SEQ ID NO: 984363 - DNA, 17 bp, Homo sapiens
accaatttcttccttcc

SEQ ID NO: 984364 - DNA, 22 bp, Homo sapiens
accaatttggtaaaaatgctgc

SEQ ID NO: 984365 - DNA, 14 bp, Homo sapiens
accacaaaatatac

SEQ ID NO: 984366 - DNA, 17 bp, Homo sapiens
accacaaaccctgctga

SEQ ID NO: 984367 - DNA, 15 bp, Homo sapiens
accacaagctgagca

SEQ ID NO: 984368 - DNA, 23 bp, Homo sapiens
accacaaggtccactccctgctc

SEQ ID NO: 984369 - DNA, 22 bp, Homo sapiens
accacaagtgaatctttctcct

SEQ ID NO: 984370 - DNA, 11 bp, Homo sapiens
accacacaaag

SEQ ID NO: 984371 - DNA, 15 bp, Homo sapiens
acactgtcttcccga

SEQ ID NO: 984372 - DNA, 11 bp, Homo sapiens
acactgtgaag

SEQ ID NO: 984373 - DNA, 19 bp, Homo sapiens
acactgtgagagttgtctc

SEQ ID NO: 984374 - DNA, 21 bp, Homo sapiens
acactgtgagagttgtctctg

SEQ ID NO: 984375 - DNA, 18 bp, Homo sapiens
acactgtgcacatctgtg

SEQ ID NO: 984376 - DNA, 15 bp, Homo sapiens
acactgtgccccaca

SEQ ID NO: 984377 - DNA, 12 bp, Homo sapiens
acactgtgccct

SEQ ID NO: 984378 - DNA, 14 bp, Homo sapiens
acactgtgccctgg

SEQ ID NO: 984379 - DNA, 16 bp, Homo sapiens
acactgtggccaggcc

SEQ ID NO: 984380 - DNA, 17 bp, Homo sapiens
acactgtggccaggcct

SEQ ID NO: 984381 - DNA, 13 bp, Homo sapiens
acactgtgtcctg

SEQ ID NO: 984382 - DNA, 19 bp, Homo sapiens
acactgttgataaaaactc

SEQ ID NO: 984383 - DNA, 21 bp, Homo sapiens
acactgtttacaagaaaaaat

SEQ ID NO: 984384 - DNA, 13 bp, Homo sapiens
acactgttttcct

SEQ ID NO: 984385 - DNA, 11 bp, Homo sapiens
acacttaacag

SEQ ID NO: 984386 - DNA, 18 bp, Homo sapiens
acacttacactttatgca

SEQ ID NO: 984387 - DNA, 21 bp, Homo sapiens
acacttacactttatgcacaa

SEQ ID NO: 984388 - DNA, 20 bp, Homo sapiens
acacttagattaagatttta

SEQ ID NO: 984389 - DNA, 17 bp, Homo sapiens
acacttagccattgaaa

SEQ ID NO: 984390 - DNA, 18 bp, Homo sapiens
acacttagccattgaaat

SEQ ID NO: 984391 - DNA, 19 bp, Homo sapiens
acacttagtgatcatttaa

SEQ ID NO: 984392 - DNA, 22 bp, Homo sapiens
acacttatattttatgaacatt

SEQ ID NO: 984393 - DNA, 24 bp, Homo sapiens
acacttatattttatgaacattgt

SEQ ID NO: 984394 - DNA, 15 bp, Homo sapiens
acacttatattttga

SEQ ID NO: 984395 - DNA, 16 bp, Homo sapiens
acacttatttatgaat

SEQ ID NO: 984396 - DNA, 19 bp, Homo sapiens
acacttcaggctcttctcc

SEQ ID NO: 984397 - DNA, 22 bp, Homo sapiens
acacttcaggctcttctccttt

SEQ ID NO: 984398 - DNA, 14 bp, Homo sapiens
acacttccataatc

SEQ ID NO: 984399 - DNA, 17 bp, Homo sapiens
acacttcccacccccag

SEQ ID NO: 984400 - DNA, 20 bp, Homo sapiens
acacttccccatctttgatc

SEQ ID NO: 984401 - DNA, 20 bp, Homo sapiens
acacttccccttgtctccct

SEQ ID NO: 984402 - DNA, 15 bp, Homo sapiens
acacttccctgggcc

SEQ ID NO: 984403 - DNA, 13 bp, Homo sapiens
acacttcctgcct

SEQ ID NO: 984404 - DNA, 12 bp, Homo sapiens
acacttccttta

SEQ ID NO: 984405 - DNA, 18 bp, Homo sapiens
acacttctgtatgcatca

SEQ ID NO: 984406 - DNA, 20 bp, Homo sapiens
acacttctgtgagaccccca

SEQ ID NO: 984407 - DNA, 23 bp, Homo sapiens
acacttctgtgagacccccacac

SEQ ID NO: 984408 - DNA, 19 bp, Homo sapiens
acacttcttgaaacagcct

SEQ ID NO: 984409 - DNA, 16 bp, Homo sapiens
acacttgagaggatga

SEQ ID NO: 984410 - DNA, 16 bp, Homo sapiens
acacttgagatgattt

SEQ ID NO: 984411 - DNA, 21 bp, Homo sapiens
acacttgcaggggtccctgct

SEQ ID NO: 984412 - DNA, 22 bp, Homo sapiens
acacttgcaggggtccctgcta

SEQ ID NO: 984413 - DNA, 20 bp, Homo sapiens
acacttgcatacatatatat

SEQ ID NO: 984414 - DNA, 14 bp, Homo sapiens
acacttgctcccaa

SEQ ID NO: 984415 - DNA, 13 bp, Homo sapiens
acacttgctgggg

SEQ ID NO: 984416 - DNA, 15 bp, Homo sapiens
acacttggagcccgt

SEQ ID NO: 984417 - DNA, 15 bp, Homo sapiens
acattgctgcctttg

SEQ ID NO: 984418 - DNA, 22 bp, Homo sapiens
acattgcttaaaatatatagtg

SEQ ID NO: 984419 - DNA, 14 bp, Homo sapiens
acattgcttttgaa

SEQ ID NO: 984420 - DNA, 17 bp, Homo sapiens
acattggaatgccttgg

SEQ ID NO: 984421 - DNA, 23 bp, Homo sapiens
acattgggaaggggacccccgcc

SEQ ID NO: 984422 - DNA, 21 bp, Homo sapiens
acctatatccagaaggggagc

SEQ ID NO: 984423 - DNA, 17 bp, Homo sapiens
acctatatgatttatag

SEQ ID NO: 984424 - DNA, 17 bp, Homo sapiens
acctatctcgtgggaga

SEQ ID NO: 984425 - DNA, 14 bp, Homo sapiens
acctatctgtggaa

SEQ ID NO: 984426 - DNA, 22 bp, Homo sapiens
acctatgagatggccatgctca

SEQ ID NO: 984427 - DNA, 19 bp, Homo sapiens
acctatgagtgagaatatg

SEQ ID NO: 984428 - DNA, 19 bp, Homo sapiens
acctatgatattttctgtg

SEQ ID NO: 984429 - DNA, 17 bp, Homo sapiens
acctattaggtggaaat

SEQ ID NO: 984430 - DNA, 14 bp, Homo sapiens
acctattatcagaa

SEQ ID NO: 984431 - DNA, 23 bp, Homo sapiens
acctattatccttctacttgtcc

SEQ ID NO: 984432 - DNA, 19 bp, Homo sapiens
acctatttctgatgatgtc

SEQ ID NO: 984433 - DNA, 17 bp, Homo sapiens
acctattttcatttgta

SEQ ID NO: 984434 - DNA, 15 bp, Homo sapiens
acctcaaaatttaac

SEQ ID NO: 984435 - DNA, 14 bp, Homo sapiens
acctcaaagggcag

SEQ ID NO: 984436 - DNA, 22 bp, Homo sapiens
acctcaaagtaaaaattgaact

SEQ ID NO: 984437 - DNA, 17 bp, Homo sapiens
acctcaacaagaagaat

SEQ ID NO: 984438 - DNA, 17 bp, Homo sapiens
acctcaaccatcctggc

SEQ ID NO: 984439 - DNA, 16 bp, Homo sapiens
acctcaacctgtgatg

SEQ ID NO: 984440 - DNA, 15 bp, Homo sapiens
acctcaactaaccct

SEQ ID NO: 984441 - DNA, 21 bp, Homo sapiens
acctcaagggggactgtcttt

SEQ ID NO: 984442 - DNA, 23 bp, Homo sapiens
acctcaagtgatctgtccacctc

SEQ ID NO: 984443 - DNA, 13 bp, Homo sapiens
acctcaccaaact

SEQ ID NO: 984444 - DNA, 24 bp, Homo sapiens
acctcaccaaactagtatcatttt

SEQ ID NO: 984445 - DNA, 11 bp, Homo sapiens
acctcaccatt

SEQ ID NO: 984446 - DNA, 15 bp, Homo sapiens
acctcacctagaaat

SEQ ID NO: 984447 - DNA, 16 bp, Homo sapiens
acctcacctctttgtt

SEQ ID NO: 984448 - DNA, 17 bp, Homo sapiens
acctcaccttcctgtgg

SEQ ID NO: 984449 - DNA, 19 bp, Homo sapiens
acctcaccttcctgtgggt

SEQ ID NO: 984450 - DNA, 16 bp, Homo sapiens
acctcactatggtatg

SEQ ID NO: 984451 - DNA, 20 bp, Homo sapiens
acctcactgaaaacatctgg

SEQ ID NO: 984452 - DNA, 20 bp, Homo sapiens
acctcactgagaggcctgga

SEQ ID NO: 984453 - DNA, 21 bp, Homo sapiens
acctcactgagaggcctggag

SEQ ID NO: 984454 - DNA, 20 bp, Homo sapiens
acctcactgccctccctcgg

SEQ ID NO: 984455 - DNA, 19 bp, Homo sapiens
acctcagagtccaggcccc

SEQ ID NO: 984456 - DNA, 23 bp, Homo sapiens
acctcagccatgaggagttgctg

SEQ ID NO: 984457 - DNA, 13 bp, Homo sapiens
acctcagcctccc

SEQ ID NO: 984458 - DNA, 15 bp, Homo sapiens
acctcagcctcccaa

SEQ ID NO: 984459 - DNA, 20 bp, Homo sapiens
acctcagccttccccttgcc

SEQ ID NO: 984460 - DNA, 12 bp, Homo sapiens
acctcagctctg

SEQ ID NO: 984461 - DNA, 17 bp, Homo sapiens
acctcagctctgggaga

SEQ ID NO: 984462 - DNA, 12 bp, Homo sapiens
acctcagctgca

SEQ ID NO: 984463 - DNA, 17 bp, Homo sapiens
acctcagctgcacattc

SEQ ID NO: 984464 - DNA, 16 bp, Homo sapiens
acctcctcttctgacg

SEQ ID NO: 984465 - DNA, 17 bp, Homo sapiens
acctcctgacaacgtct

SEQ ID NO: 984466 - DNA, 12 bp, Homo sapiens
acctcctgccca

SEQ ID NO: 984467 - DNA, 17 bp, Homo sapiens
acctcctgcccaggaga

SEQ ID NO: 984468 - DNA, 18 bp, Homo sapiens
acctcctgcccaggagag

SEQ ID NO: 984469 - DNA, 17 bp, Homo sapiens
acctcctgcggctcagc

SEQ ID NO: 984470 - DNA, 23 bp, Homo sapiens
acctcctgcggctcagccttgca

SEQ ID NO: 984471 - DNA, 12 bp, Homo sapiens
acctcctgtcac

SEQ ID NO: 984472 - DNA, 13 bp, Homo sapiens
acctcctgtcact

SEQ ID NO: 984473 - DNA, 22 bp, Homo sapiens
acctcctgtcactcactgaggc

SEQ ID NO: 984474 - DNA, 17 bp, Homo sapiens
acctccttagccctgtc

SEQ ID NO: 984475 - DNA, 19 bp, Homo sapiens
acctcctttcatcacactg

SEQ ID NO: 984476 - DNA, 22 bp, Homo sapiens
acctcgagaagtaattatcagt

SEQ ID NO: 984477 - DNA, 20 bp, Homo sapiens
acctcgaggaactccaggac

SEQ ID NO: 984478 - DNA, 15 bp, Homo sapiens
acctcgctcccctct

SEQ ID NO: 984479 - DNA, 18 bp, Homo sapiens
acctcgctcccctctgga

SEQ ID NO: 984480 - DNA, 20 bp, Homo sapiens
acctcgctcccctctggaat

SEQ ID NO: 984481 - DNA, 21 bp, Homo sapiens
acctcgctcccctctggaatc

SEQ ID NO: 984482 - DNA, 14 bp, Homo sapiens
acctcgctggactc

SEQ ID NO: 984483 - DNA, 23 bp, Homo sapiens
acctcggagggatggagaaagaa

SEQ ID NO: 984484 - DNA, 16 bp, Homo sapiens
acctcggcacacactg

SEQ ID NO: 984485 - DNA, 17 bp, Homo sapiens
acctcggcacacactgt

SEQ ID NO: 984486 - DNA, 15 bp, Homo sapiens
acctcggcctcccaa

SEQ ID NO: 984487 - DNA, 17 bp, Homo sapiens
acctcggcttgtgggct

SEQ ID NO: 984488 - DNA, 15 bp, Homo sapiens
acctcgggcctgctg

SEQ ID NO: 984489 - DNA, 21 bp, Homo sapiens
acctcggggacaccagagctg

SEQ ID NO: 984490 - DNA, 23 bp, Homo sapiens
acctcggggacaccagagctgcc

SEQ ID NO: 984491 - DNA, 19 bp, Homo sapiens
acctcggtgccttcctctt

SEQ ID NO: 984492 - DNA, 23 bp, Homo sapiens
acctcgtctccctggtgcctctg

SEQ ID NO: 984493 - DNA, 21 bp, Homo sapiens
acctcgtggggttcagtagag

SEQ ID NO: 984494 - DNA, 20 bp, Homo sapiens
acctctacccaaaccctagg

SEQ ID NO: 984495 - DNA, 23 bp, Homo sapiens
acctctactaaaaagaaggaaaa

SEQ ID NO: 984496 - DNA, 14 bp, Homo sapiens
acctctactgtctc

SEQ ID NO: 984497 - DNA, 16 bp, Homo sapiens
acctctactgtctcct

SEQ ID NO: 984498 - DNA, 22 bp, Homo sapiens
acctctattcttgggaaacacc

SEQ ID NO: 984499 - DNA, 16 bp, Homo sapiens
acctctcaagctagtg

SEQ ID NO: 984500 - DNA, 22 bp, Homo sapiens
acctctcaagctagtgtttcta

SEQ ID NO: 984501 - DNA, 21 bp, Homo sapiens
acctctcacgggccctgcccc

SEQ ID NO: 984502 - DNA, 18 bp, Homo sapiens
acctctcatcagtgtcct

SEQ ID NO: 984503 - DNA, 10 bp, Homo sapiens
acctctccaa

SEQ ID NO: 984504 - DNA, 20 bp, Homo sapiens
acctctccaagggcttctgc

SEQ ID NO: 984505 - DNA, 22 bp, Homo sapiens
acctctccaagggcttctgcac

SEQ ID NO: 984506 - DNA, 22 bp, Homo sapiens
acctctccaagtctctctgtga

SEQ ID NO: 984507 - DNA, 22 bp, Homo sapiens
acctctccagctctggcttcct

SEQ ID NO: 984508 - DNA, 12 bp, Homo sapiens
acctctccctca

SEQ ID NO: 984509 - DNA, 15 bp, Homo sapiens
acctctccctcaaca

SEQ ID NO: 984510 - DNA, 17 bp, Homo sapiens
acctctccctgaccctg

SEQ ID NO: 984511 - DNA, 22 bp, Homo sapiens
acctctccctgaccctgtatat

SEQ ID NO: 984512 - DNA, 23 bp, Homo sapiens
acctctccctgaccctgtatata

SEQ ID NO: 984513 - DNA, 15 bp, Homo sapiens
acctctccctgcatc

SEQ ID NO: 984514 - DNA, 22 bp, Homo sapiens
acctctccctgcatcctgaggc

SEQ ID NO: 984515 - DNA, 17 bp, Homo sapiens
acctctcctgacccctg

SEQ ID NO: 984516 - DNA, 20 bp, Homo sapiens
acctctcggccccatcgccc

SEQ ID NO: 984517 - DNA, 15 bp, Homo sapiens
acctctctaagccac

SEQ ID NO: 984518 - DNA, 19 bp, Homo sapiens
acctctctaagccacagct

SEQ ID NO: 984519 - DNA, 14 bp, Homo sapiens
acctctctcagccc

SEQ ID NO: 984520 - DNA, 14 bp, Homo sapiens
acctctctcggccc

SEQ ID NO: 984521 - DNA, 19 bp, Homo sapiens
acctctctgaactgcaaca

SEQ ID NO: 984522 - DNA, 15 bp, Homo sapiens
acctctctgggacct

SEQ ID NO: 984523 - DNA, 17 bp, Homo sapiens
acctctctgggacctag

SEQ ID NO: 984524 - DNA, 19 bp, Homo sapiens
acctctctgtagtttatgg

SEQ ID NO: 984525 - DNA, 13 bp, Homo sapiens
acctctcttcagc

SEQ ID NO: 984526 - DNA, 14 bp, Homo sapiens
acctctctttctca

SEQ ID NO: 984527 - DNA, 22 bp, Homo sapiens
acctctcttttcctctctgtct

SEQ ID NO: 984528 - DNA, 13 bp, Homo sapiens
acctctgatacct

SEQ ID NO: 984529 - DNA, 18 bp, Homo sapiens
acctctgatagactttgt

SEQ ID NO: 984530 - DNA, 12 bp, Homo sapiens
acctctgcacaa

SEQ ID NO: 984531 - DNA, 18 bp, Homo sapiens
acctctgcagcaataaag

SEQ ID NO: 984532 - DNA, 21 bp, Homo sapiens
acctctgcagcaataaagcag

SEQ ID NO: 984533 - DNA, 14 bp, Homo sapiens
acctctgcccttcc

SEQ ID NO: 984534 - DNA, 20 bp, Homo sapiens
acctctgcccttcccctccc

SEQ ID NO: 984535 - DNA, 14 bp, Homo sapiens
acctctgcctcaat

SEQ ID NO: 984536 - DNA, 23 bp, Homo sapiens
acctctgctgagtgctgggcact

SEQ ID NO: 984537 - DNA, 12 bp, Homo sapiens
acctctgctggg

SEQ ID NO: 984538 - DNA, 15 bp, Homo sapiens
acctctgcttttatc

SEQ ID NO: 984539 - DNA, 10 bp, Homo sapiens
acctctggaa

SEQ ID NO: 984540 - DNA, 11 bp, Homo sapiens
acctctggaac

SEQ ID NO: 984541 - DNA, 23 bp, Homo sapiens
acctctggccaaatatgcacttt

SEQ ID NO: 984542 - DNA, 12 bp, Homo sapiens
acctctggccct

SEQ ID NO: 984543 - DNA, 20 bp, Homo sapiens
acctctggcccttggaataa

SEQ ID NO: 984544 - DNA, 18 bp, Homo sapiens
acctctggtggctcctcc

SEQ ID NO: 984545 - DNA, 17 bp, Homo sapiens
acctctgtatagaaatc

SEQ ID NO: 984546 - DNA, 12 bp, Homo sapiens
acctctgtctca

SEQ ID NO: 984547 - DNA, 13 bp, Homo sapiens
acctctgtctcat

SEQ ID NO: 984548 - DNA, 15 bp, Homo sapiens
acctctgtctcatcc

SEQ ID NO: 984549 - DNA, 16 bp, Homo sapiens
acctctgtctcatcct

SEQ ID NO: 984550 - DNA, 17 bp, Homo sapiens
acctctgtgaccaactg

SEQ ID NO: 984551 - DNA, 15 bp, Homo sapiens
acctctgttcatttc

SEQ ID NO: 984552 - DNA, 20 bp, Homo sapiens
accccccactcagtgcctcc

SEQ ID NO: 984553 - DNA, 20 bp, Homo sapiens
acccccccttttctccccac

SEQ ID NO: 984554 - DNA, 12 bp, Homo sapiens
acccccctcctc

SEQ ID NO: 984555 - DNA, 13 bp, Homo sapiens
acccccctcctcc

SEQ ID NO: 984556 - DNA, 16 bp, Homo sapiens
acccccctcctccccc

SEQ ID NO: 984557 - DNA, 20 bp, Homo sapiens
acccccctcctgctcctccc

SEQ ID NO: 984558 - DNA, 21 bp, Homo sapiens
acccccctcctgctcctccct

SEQ ID NO: 984559 - DNA, 19 bp, Homo sapiens
acccccctctctttctctg

SEQ ID NO: 984560 - DNA, 17 bp, Homo sapiens
acccccgaggggagggc

SEQ ID NO: 984561 - DNA, 13 bp, Homo sapiens
acccccgcagagg

SEQ ID NO: 984562 - DNA, 15 bp, Homo sapiens
acccccgccacctca

SEQ ID NO: 984563 - DNA, 15 bp, Homo sapiens
acccccgccacggcc

SEQ ID NO: 984564 - DNA, 20 bp, Homo sapiens
acccccgccacggccaccct

SEQ ID NO: 984565 - DNA, 16 bp, Homo sapiens
acccccgccaggcgca

SEQ ID NO: 984566 - DNA, 21 bp, Homo sapiens
acccccgccccctgccctccc

SEQ ID NO: 984567 - DNA, 18 bp, Homo sapiens
acccccgggatcctgccc

SEQ ID NO: 984568 - DNA, 21 bp, Homo sapiens
acccccgggatcctgccccca

SEQ ID NO: 984569 - DNA, 19 bp, Homo sapiens
accccctcaagccaatccc

SEQ ID NO: 984570 - DNA, 16 bp, Homo sapiens
accccctcattcccct

SEQ ID NO: 984571 - DNA, 16 bp, Homo sapiens
accccctcattgttta

SEQ ID NO: 984572 - DNA, 23 bp, Homo sapiens
accccctccaccccccactcagt

SEQ ID NO: 984573 - DNA, 13 bp, Homo sapiens
accccctccccag

SEQ ID NO: 984574 - DNA, 16 bp, Homo sapiens
accccctccccagggg

SEQ ID NO: 984575 - DNA, 23 bp, Homo sapiens
accccctccccgcccctgtggcc

SEQ ID NO: 984576 - DNA, 11 bp, Homo sapiens
accccctcctc

SEQ ID NO: 984577 - DNA, 13 bp, Homo sapiens
accccctcctctc

SEQ ID NO: 984578 - DNA, 11 bp, Homo sapiens
accccctcctt

SEQ ID NO: 984579 - DNA, 19 bp, Homo sapiens
accccctccttcagacacc

SEQ ID NO: 984580 - DNA, 14 bp, Homo sapiens
accccctcgccagc

SEQ ID NO: 984581 - DNA, 21 bp, Homo sapiens
accccctcgccagcttggctc

SEQ ID NO: 984582 - DNA, 14 bp, Homo sapiens
accccctctagaaa

SEQ ID NO: 984583 - DNA, 16 bp, Homo sapiens
accccctctgctctgt

SEQ ID NO: 984584 - DNA, 13 bp, Homo sapiens
accccctcttcaa

SEQ ID NO: 984585 - DNA, 18 bp, Homo sapiens
accccctcttcaaagcag

SEQ ID NO: 984586 - DNA, 20 bp, Homo sapiens
accccctcttcaaagcagag

SEQ ID NO: 984587 - DNA, 22 bp, Homo sapiens
accccctgagatcccctgagcc

SEQ ID NO: 984588 - DNA, 22 bp, Homo sapiens
accccctgagtcaactggagca

SEQ ID NO: 984589 - DNA, 20 bp, Homo sapiens
accccctgcaaagcccagct

SEQ ID NO: 984590 - DNA, 15 bp, Homo sapiens
accccctgcccgcca

SEQ ID NO: 984591 - DNA, 15 bp, Homo sapiens
accccctgccctgca

SEQ ID NO: 984592 - DNA, 18 bp, Homo sapiens
accccctgctccaccagc

SEQ ID NO: 984593 - DNA, 22 bp, Homo sapiens
accccctgctccaccagcagca

SEQ ID NO: 984594 - DNA, 14 bp, Homo sapiens
accccctgggcaga

SEQ ID NO: 984595 - DNA, 21 bp, Homo sapiens
accccctgtcccattctagat

SEQ ID NO: 984596 - DNA, 13 bp, Homo sapiens
accccctgttccc

SEQ ID NO: 984597 - DNA, 11 bp, Homo sapiens
acccccttccc

SEQ ID NO: 984598 - DNA, 18 bp, Homo sapiens
acccccttctccatccac

SEQ ID NO: 984599 - DNA, 23 bp, Homo sapiens
acccccttctctgctccaccaca

SEQ ID NO: 984600 - DNA, 19 bp, Homo sapiens
acccccttgattcccaccg

SEQ ID NO: 984601 - DNA, 18 bp, Homo sapiens
accccctttgctgtgagg

SEQ ID NO: 984602 - DNA, 19 bp, Homo sapiens
accccgaaatcagccccca

SEQ ID NO: 984603 - DNA, 23 bp, Homo sapiens
accccgaaatcagcccccagcct

SEQ ID NO: 984604 - DNA, 18 bp, Homo sapiens
accccgaccacctgccca

SEQ ID NO: 984605 - DNA, 22 bp, Homo sapiens
accccgagaagtgctcttggct

SEQ ID NO: 984606 - DNA, 13 bp, Homo sapiens
accccgagggctg

SEQ ID NO: 984607 - DNA, 14 bp, Homo sapiens
accccgaggtaggg

SEQ ID NO: 984608 - DNA, 22 bp, Homo sapiens
accccgaggtaggggtggggag

SEQ ID NO: 984609 - DNA, 15 bp, Homo sapiens
accccgcactgcaga

SEQ ID NO: 984610 - DNA, 12 bp, Homo sapiens
accccgcagccc

SEQ ID NO: 984611 - DNA, 13 bp, Homo sapiens
accccgcagcccg

SEQ ID NO: 984612 - DNA, 14 bp, Homo sapiens
accccgcagcccgt

SEQ ID NO: 984613 - DNA, 23 bp, Homo sapiens
accccgccccagtatcatgcgat

SEQ ID NO: 984614 - DNA, 16 bp, Homo sapiens
accccgccgttccctg

SEQ ID NO: 984615 - DNA, 13 bp, Homo sapiens
accccgcggccca

SEQ ID NO: 984616 - DNA, 17 bp, Homo sapiens
accccgcggtgctctgg

SEQ ID NO: 984617 - DNA, 21 bp, Homo sapiens
accccgcttttgcagcagagg

SEQ ID NO: 984618 - DNA, 23 bp, Homo sapiens
accccgggcccgggcccccgccc

SEQ ID NO: 984619 - DNA, 16 bp, Homo sapiens
accccgggctctctgc

SEQ ID NO: 984620 - DNA, 21 bp, Homo sapiens
accccgggctctctgctgtac

SEQ ID NO: 984621 - DNA, 16 bp, Homo sapiens
accccggggaccctgt

SEQ ID NO: 984622 - DNA, 23 bp, Homo sapiens
accccggggtgcccacaggccgc

SEQ ID NO: 984623 - DNA, 14 bp, Homo sapiens
acccctaaactcca

SEQ ID NO: 984624 - DNA, 22 bp, Homo sapiens
accctttctgttgccagtcagc

SEQ ID NO: 984625 - DNA, 17 bp, Homo sapiens
accctttgggggttgaa

SEQ ID NO: 984626 - DNA, 23 bp, Homo sapiens
accctttggtttttttcttctgt

SEQ ID NO: 984627 - DNA, 16 bp, Homo sapiens
acccttttctcaggac

SEQ ID NO: 984628 - DNA, 13 bp, Homo sapiens
acccttttctgat

SEQ ID NO: 984629 - DNA, 23 bp, Homo sapiens
acccttttctgatcgtctcggcc

SEQ ID NO: 984630 - DNA, 23 bp, Homo sapiens
acccttttggcccccgagctggg

SEQ ID NO: 984631 - DNA, 15 bp, Homo sapiens
acccttttttctaag

SEQ ID NO: 984632 - DNA, 18 bp, Homo sapiens
accctttttttggggtgc

SEQ ID NO: 984633 - DNA, 15 bp, Homo sapiens
accgaaaatggacat

SEQ ID NO: 984634 - DNA, 23 bp, Homo sapiens
accgaacatatcatttgtgaaga

SEQ ID NO: 984635 - DNA, 12 bp, Homo sapiens
accgaataaatg

SEQ ID NO: 984636 - DNA, 21 bp, Homo sapiens
accgaatatattactgattta

SEQ ID NO: 984637 - DNA, 22 bp, Homo sapiens
accgaatgtgtctttagatagc

SEQ ID NO: 984638 - DNA, 16 bp, Homo sapiens
accgacccgaggccca

SEQ ID NO: 984639 - DNA, 20 bp, Homo sapiens
accgactaccccagtcccag

SEQ ID NO: 984640 - DNA, 17 bp, Homo sapiens
accgactagccaggaag

SEQ ID NO: 984641 - DNA, 23 bp, Homo sapiens
accgagagtagccgagagcctgc

SEQ ID NO: 984642 - DNA, 17 bp, Homo sapiens
accgagataggggaggg

SEQ ID NO: 984643 - DNA, 21 bp, Homo sapiens
accgagataggggagggggga

SEQ ID NO: 984644 - DNA, 17 bp, Homo sapiens
accgagatgtgagtcct

SEQ ID NO: 984645 - DNA, 15 bp, Homo sapiens
accgagcaaagatca

SEQ ID NO: 984646 - DNA, 17 bp, Homo sapiens
accgaggctggagctgg

SEQ ID NO: 984647 - DNA, 17 bp, Homo sapiens
accgaggggctcaggaa

SEQ ID NO: 984648 - DNA, 19 bp, Homo sapiens
accgaggggctcaggaaaa

SEQ ID NO: 984649 - DNA, 16 bp, Homo sapiens
accgagtctcttctcc

SEQ ID NO: 984650 - DNA, 14 bp, Homo sapiens
accgagtgaaccta

SEQ ID NO: 984651 - DNA, 15 bp, Homo sapiens
accgatgctccagcc

SEQ ID NO: 984652 - DNA, 14 bp, Homo sapiens
accgatggtcccag

SEQ ID NO: 984653 - DNA, 18 bp, Homo sapiens
accgcacagctcaggagg

SEQ ID NO: 984654 - DNA, 15 bp, Homo sapiens
accgcaccccatccc

SEQ ID NO: 984655 - DNA, 13 bp, Homo sapiens
accgcatatgcat

SEQ ID NO: 984656 - DNA, 14 bp, Homo sapiens
accgcatatgcatg

SEQ ID NO: 984657 - DNA, 15 bp, Homo sapiens
accgcatatgcatgc

SEQ ID NO: 984658 - DNA, 17 bp, Homo sapiens
accgccaaggctggggg

SEQ ID NO: 984659 - DNA, 15 bp, Homo sapiens
accgcccagctctcc

SEQ ID NO: 984660 - DNA, 11 bp, Homo sapiens
accgcccatca

SEQ ID NO: 984661 - DNA, 14 bp, Homo sapiens
accgccccagggct

SEQ ID NO: 984662 - DNA, 14 bp, Homo sapiens
accgcccccacccc

SEQ ID NO: 984663 - DNA, 14 bp, Homo sapiens
accgccccctcctc

SEQ ID NO: 984664 - DNA, 14 bp, Homo sapiens
accgccctcctcca

SEQ ID NO: 984665 - DNA, 16 bp, Homo sapiens
accgccctgcgggcca

SEQ ID NO: 984666 - DNA, 19 bp, Homo sapiens
accgccctgcgggccacag

SEQ ID NO: 984667 - DNA, 13 bp, Homo sapiens
accgccctgggct

SEQ ID NO: 984668 - DNA, 15 bp, Homo sapiens
accgccctgggctgg

SEQ ID NO: 984669 - DNA, 16 bp, Homo sapiens
accgccctgggctgga

SEQ ID NO: 984670 - DNA, 20 bp, Homo sapiens
accgccctgggctggactgg

SEQ ID NO: 984671 - DNA, 16 bp, Homo sapiens
accgccgcagaagcag

SEQ ID NO: 984672 - DNA, 19 bp, Homo sapiens
accgccgcagaagcagccc

SEQ ID NO: 984673 - DNA, 22 bp, Homo sapiens
accgcctcgtgccagcagcctc

SEQ ID NO: 984674 - DNA, 19 bp, Homo sapiens
accgcctctggccgccacc

SEQ ID NO: 984675 - DNA, 15 bp, Homo sapiens
accgcctgccctccc

SEQ ID NO: 984676 - DNA, 17 bp, Homo sapiens
accgcctgccctgcctg

SEQ ID NO: 984677 - DNA, 16 bp, Homo sapiens
accgcgactaatttca

SEQ ID NO: 984678 - DNA, 20 bp, Homo sapiens
accgcgactaatttcaaaat

SEQ ID NO: 984679 - DNA, 19 bp, Homo sapiens
accgcgccctcctgcccac

SEQ ID NO: 984680 - DNA, 15 bp, Homo sapiens
accgcgtctggtgac

SEQ ID NO: 984681 - DNA, 15 bp, Homo sapiens
accgctcacctagag

SEQ ID NO: 984682 - DNA, 17 bp, Homo sapiens
accgctcacctagagcc

SEQ ID NO: 984683 - DNA, 17 bp, Homo sapiens
accgctcagtattactt

SEQ ID NO: 984684 - DNA, 12 bp, Homo sapiens
accgctcagtgt

SEQ ID NO: 984685 - DNA, 18 bp, Homo sapiens
accgctccccagcccagg

SEQ ID NO: 984686 - DNA, 20 bp, Homo sapiens
accgctcccctctcctccgc

SEQ ID NO: 984687 - DNA, 19 bp, Homo sapiens
accgctgcctaagtggctg

SEQ ID NO: 984688 - DNA, 21 bp, Homo sapiens
accgctgcctaagtggctgct

SEQ ID NO: 984689 - DNA, 17 bp, Homo sapiens
accgctgggtggttttt

SEQ ID NO: 984690 - DNA, 17 bp, Homo sapiens
accgcttcacccctgca

SEQ ID NO: 984691 - DNA, 18 bp, Homo sapiens
accgcttgtggggaccca

SEQ ID NO: 984692 - DNA, 11 bp, Homo sapiens
accgcttttgg

SEQ ID NO: 984693 - DNA, 15 bp, Homo sapiens
accggacttttctgc

SEQ ID NO: 984694 - DNA, 18 bp, Homo sapiens
accggatgctgtgcctgg

SEQ ID NO: 984695 - DNA, 12 bp, Homo sapiens
accggcagaaaa

SEQ ID NO: 984696 - DNA, 14 bp, Homo sapiens
accggcccctggca

SEQ ID NO: 984697 - DNA, 19 bp, Homo sapiens
acctgaaattaatttgtga

SEQ ID NO: 984698 - DNA, 21 bp, Homo sapiens
acctgaaattaatttgtgaat

SEQ ID NO: 984699 - DNA, 21 bp, Homo sapiens
acctgaaccccatgggcttgg

SEQ ID NO: 984700 - DNA, 14 bp, Homo sapiens
acctgaacttgcct

SEQ ID NO: 984701 - DNA, 19 bp, Homo sapiens
acctgaagactgaggacaa

SEQ ID NO: 984702 - DNA, 18 bp, Homo sapiens
acctgaagagcgctcctc

SEQ ID NO: 984703 - DNA, 22 bp, Homo sapiens
acctgaagagcgctcctctgcc

SEQ ID NO: 984704 - DNA, 18 bp, Homo sapiens
acctgaagatgtctcctc

SEQ ID NO: 984705 - DNA, 21 bp, Homo sapiens
acctgaagatgtctcctcaag

SEQ ID NO: 984706 - DNA, 23 bp, Homo sapiens
acctgaaggtattggcctgttca

SEQ ID NO: 984707 - DNA, 17 bp, Homo sapiens
acctgaatcagctggac

SEQ ID NO: 984708 - DNA, 21 bp, Homo sapiens
acctgaatcttttttttatat

SEQ ID NO: 984709 - DNA, 19 bp, Homo sapiens
acctgacaccgtccctcag

SEQ ID NO: 984710 - DNA, 20 bp, Homo sapiens
acctgacaccgtccctcagt

SEQ ID NO: 984711 - DNA, 22 bp, Homo sapiens
acctgacaccgtccctcagtga

SEQ ID NO: 984712 - DNA, 19 bp, Homo sapiens
acctgacactcccttgggc

SEQ ID NO: 984713 - DNA, 22 bp, Homo sapiens
acctgacagatgtcagccgagc

SEQ ID NO: 984714 - DNA, 19 bp, Homo sapiens
acctgaccaacatggagaa

SEQ ID NO: 984715 - DNA, 17 bp, Homo sapiens
acctgacccctgctcag

SEQ ID NO: 984716 - DNA, 23 bp, Homo sapiens
acctgacccctgctcagtaaagc

SEQ ID NO: 984717 - DNA, 21 bp, Homo sapiens
acctgacctcttgctgtctct

SEQ ID NO: 984718 - DNA, 17 bp, Homo sapiens
acctgacctgctgaatt

SEQ ID NO: 984719 - DNA, 15 bp, Homo sapiens
acctgagacgggcat

SEQ ID NO: 984720 - DNA, 21 bp, Homo sapiens
acctgagactcacactctctg

SEQ ID NO: 984721 - DNA, 22 bp, Homo sapiens
acctgagactgtcggagaggct

SEQ ID NO: 984722 - DNA, 12 bp, Homo sapiens
acctgagatgga

SEQ ID NO: 984723 - DNA, 15 bp, Homo sapiens
acctgagatggagct

SEQ ID NO: 984724 - DNA, 16 bp, Homo sapiens
acctgagatggagctg

SEQ ID NO: 984725 - DNA, 18 bp, Homo sapiens
acctgagcattcaggcag

SEQ ID NO: 984726 - DNA, 19 bp, Homo sapiens
acctgagcccgcagcccag

SEQ ID NO: 984727 - DNA, 21 bp, Homo sapiens
acctgagcgctgtggactgtc

SEQ ID NO: 984728 - DNA, 21 bp, Homo sapiens
acctgagcggcaccctggtct

SEQ ID NO: 984729 - DNA, 12 bp, Homo sapiens
acctgagctaaa

SEQ ID NO: 984730 - DNA, 22 bp, Homo sapiens
acctgagctaaataaagatatt

SEQ ID NO: 984731 - DNA, 17 bp, Homo sapiens
acctgagctattttcct

SEQ ID NO: 984732 - DNA, 19 bp, Homo sapiens
acctgagctattttcctct

SEQ ID NO: 984733 - DNA, 15 bp, Homo sapiens
acctgaggagacatc

SEQ ID NO: 984734 - DNA, 24 bp, Homo sapiens
acctgaggtgggcccaggaccagc

SEQ ID NO: 984735 - DNA, 17 bp, Homo sapiens
acctgaggtgggctggg

SEQ ID NO: 984736 - DNA, 21 bp, Homo sapiens
acctgaggtgggctggggctg

SEQ ID NO: 984737 - DNA, 22 bp, Homo sapiens
acctgagtcaccctacctgtgc

SEQ ID NO: 984738 - DNA, 21 bp, Homo sapiens
acctgagtcggccccacatgg

SEQ ID NO: 984739 - DNA, 12 bp, Homo sapiens
acctgatcactt

SEQ ID NO: 984740 - DNA, 17 bp, Homo sapiens
acctgatgccccttccc

SEQ ID NO: 984741 - DNA, 21 bp, Homo sapiens
acctgatgttaaaattccatc

SEQ ID NO: 984742 - DNA, 15 bp, Homo sapiens
acctgattgatcaca

SEQ ID NO: 984743 - DNA, 21 bp, Homo sapiens
acctgattgatcacacagtgt

SEQ ID NO: 984744 - DNA, 22 bp, Homo sapiens
acctgattgatcacacagtgtt

SEQ ID NO: 984745 - DNA, 15 bp, Homo sapiens
acctgattgtatttt

SEQ ID NO: 984746 - DNA, 17 bp, Homo sapiens
acctgatttcagaagag

SEQ ID NO: 984747 - DNA, 18 bp, Homo sapiens
acctgatttcagaagaga

SEQ ID NO: 984748 - DNA, 20 bp, Homo sapiens
acctgatttcagaagagact

SEQ ID NO: 984749 - DNA, 16 bp, Homo sapiens
acctgattttttttcc

SEQ ID NO: 984750 - DNA, 15 bp, Homo sapiens
acctgcaagccccag

SEQ ID NO: 984751 - DNA, 16 bp, Homo sapiens
acctgcaagccccagg

SEQ ID NO: 984752 - DNA, 20 bp, Homo sapiens
acctgcaagccccagggcct

SEQ ID NO: 984753 - DNA, 17 bp, Homo sapiens
acctgcacacaggacag

SEQ ID NO: 984754 - DNA, 19 bp, Homo sapiens
acctgcacacaggacagcg

SEQ ID NO: 984755 - DNA, 15 bp, Homo sapiens
acctgcacctccccc

SEQ ID NO: 984756 - DNA, 16 bp, Homo sapiens
acctgcacctcccccc

SEQ ID NO: 984757 - DNA, 21 bp, Homo sapiens
acctgcacctccccccactgc

SEQ ID NO: 984758 - DNA, 18 bp, Homo sapiens
acctgcactaacagagtg

SEQ ID NO: 984759 - DNA, 10 bp, Homo sapiens
acctgcactg

SEQ ID NO: 984760 - DNA, 15 bp, Homo sapiens
acctgcaggccaaga

SEQ ID NO: 984761 - DNA, 14 bp, Homo sapiens
acctgcagtgaggg

SEQ ID NO: 984762 - DNA, 16 bp, Homo sapiens
acctgcagtgaggggc

SEQ ID NO: 984763 - DNA, 18 bp, Homo sapiens
acctgcagttaacaggat

SEQ ID NO: 984764 - DNA, 19 bp, Homo sapiens
acctgcatccgtagttccc

SEQ ID NO: 984765 - DNA, 21 bp, Homo sapiens
acctgcatccgtagttccctg

SEQ ID NO: 984766 - DNA, 22 bp, Homo sapiens
acctgcatggtgtttatgcaca

SEQ ID NO: 984767 - DNA, 15 bp, Homo sapiens
acctgcattgtaaat

SEQ ID NO: 984768 - DNA, 20 bp, Homo sapiens
acctgccacaaaccaccagg

SEQ ID NO: 984769 - DNA, 17 bp, Homo sapiens
acctgccaccagggagc

SEQ ID NO: 984770 - DNA, 23 bp, Homo sapiens
acctgccaccagggagcttcctg

SEQ ID NO: 984771 - DNA, 14 bp, Homo sapiens
acctgccaccccca

SEQ ID NO: 984772 - DNA, 24 bp, Homo sapiens
acctgccacccccaggtcttcctg

SEQ ID NO: 984773 - DNA, 16 bp, Homo sapiens
acctgccagcctggct

SEQ ID NO: 984774 - DNA, 18 bp, Homo sapiens
acctgccaggcaggggtg

SEQ ID NO: 984775 - DNA, 14 bp, Homo sapiens
acctgccagtccca

SEQ ID NO: 984776 - DNA, 19 bp, Homo sapiens
acctgccatgccaggaacc

SEQ ID NO: 984777 - DNA, 13 bp, Homo sapiens
acctgcccaacct

SEQ ID NO: 984778 - DNA, 15 bp, Homo sapiens
acctgcccccttctc

SEQ ID NO: 984779 - DNA, 20 bp, Homo sapiens
acctgcccccttctcccaca

SEQ ID NO: 984780 - DNA, 17 bp, Homo sapiens
acctgccccgcccagct

SEQ ID NO: 984781 - DNA, 19 bp, Homo sapiens
acctgccccggacctacct

SEQ ID NO: 984782 - DNA, 14 bp, Homo sapiens
acctgcccctctgt

SEQ ID NO: 984783 - DNA, 15 bp, Homo sapiens
acctgcccctctgtt

SEQ ID NO: 984784 - DNA, 20 bp, Homo sapiens
acctgcccctctgttctctc

SEQ ID NO: 984785 - DNA, 15 bp, Homo sapiens
acctgcccctgcctg

SEQ ID NO: 984786 - DNA, 14 bp, Homo sapiens
acctgccctcaagg

SEQ ID NO: 984787 - DNA, 17 bp, Homo sapiens
acctgccctgcccccac

SEQ ID NO: 984788 - DNA, 18 bp, Homo sapiens
acctgccctgcctgaggg

SEQ ID NO: 984789 - DNA, 14 bp, Homo sapiens
accatccaccttcc

SEQ ID NO: 984790 - DNA, 23 bp, Homo sapiens
accatccactctaccctcccacc

SEQ ID NO: 984791 - DNA, 17 bp, Homo sapiens
accatccatccctagaa

SEQ ID NO: 984792 - DNA, 17 bp, Homo sapiens
accatccccaactccat

SEQ ID NO: 984793 - DNA, 15 bp, Homo sapiens
accatccccagctgg

SEQ ID NO: 984794 - DNA, 19 bp, Homo sapiens
accatccccagctggtggc

SEQ ID NO: 984795 - DNA, 18 bp, Homo sapiens
accatcccctcctagcac

SEQ ID NO: 984796 - DNA, 15 bp, Homo sapiens
accatccctttttga

SEQ ID NO: 984797 - DNA, 18 bp, Homo sapiens
accatccctttttgaagt

SEQ ID NO: 984798 - DNA, 14 bp, Homo sapiens
accatcctcagagg

SEQ ID NO: 984799 - DNA, 16 bp, Homo sapiens
accatcctgcagcctc

SEQ ID NO: 984800 - DNA, 19 bp, Homo sapiens
accatcctggccaacatga

SEQ ID NO: 984801 - DNA, 13 bp, Homo sapiens
accatcctggctg

SEQ ID NO: 984802 - DNA, 14 bp, Homo sapiens
accatcctggctgc

SEQ ID NO: 984803 - DNA, 15 bp, Homo sapiens
accatcgtccagccc

SEQ ID NO: 984804 - DNA, 23 bp, Homo sapiens
accatctacctgcttggtctttc

SEQ ID NO: 984805 - DNA, 17 bp, Homo sapiens
accatctcaggccacct

SEQ ID NO: 984806 - DNA, 16 bp, Homo sapiens
accatctgatgtttca

SEQ ID NO: 984807 - DNA, 18 bp, Homo sapiens
accatctggggcacctgc

SEQ ID NO: 984808 - DNA, 20 bp, Homo sapiens
accatcttaaatgacagtga

SEQ ID NO: 984809 - DNA, 17 bp, Homo sapiens
accatcttttattcttt

SEQ ID NO: 984810 - DNA, 15 bp, Homo sapiens
accatgaaacaaagc

SEQ ID NO: 984811 - DNA, 14 bp, Homo sapiens
accatgaacttgat

SEQ ID NO: 984812 - DNA, 17 bp, Homo sapiens
accatgaagaacataaa

SEQ ID NO: 984813 - DNA, 14 bp, Homo sapiens
accatgaagacagg

SEQ ID NO: 984814 - DNA, 20 bp, Homo sapiens
accatgaagtaaattatgta

SEQ ID NO: 984815 - DNA, 12 bp, Homo sapiens
accatgacaaac

SEQ ID NO: 984816 - DNA, 18 bp, Homo sapiens
accatgacaaacctagct

SEQ ID NO: 984817 - DNA, 16 bp, Homo sapiens
accatgaccccttctc

SEQ ID NO: 984818 - DNA, 19 bp, Homo sapiens
accatgagaatttgcaaca

SEQ ID NO: 984819 - DNA, 16 bp, Homo sapiens
accatgcactgtaaat

SEQ ID NO: 984820 - DNA, 17 bp, Homo sapiens
accatgcactgtaaata

SEQ ID NO: 984821 - DNA, 17 bp, Homo sapiens
accatgcagcccctggg

SEQ ID NO: 984822 - DNA, 13 bp, Homo sapiens
aatccttctagtt

SEQ ID NO: 984823 - DNA, 14 bp, Homo sapiens
aatccttctagttt

SEQ ID NO: 984824 - DNA, 16 bp, Homo sapiens
aatccttctagtttcc

SEQ ID NO: 984825 - DNA, 22 bp, Homo sapiens
aatccttctattctagcctgca

SEQ ID NO: 984826 - DNA, 20 bp, Homo sapiens
aatccttggctgaattaaaa

SEQ ID NO: 984827 - DNA, 17 bp, Homo sapiens
aatccttgggagtcatt

SEQ ID NO: 984828 - DNA, 15 bp, Homo sapiens
aatcctttctgcccc

SEQ ID NO: 984829 - DNA, 23 bp, Homo sapiens
aatcctttctgccccccagggct

SEQ ID NO: 984830 - DNA, 21 bp, Homo sapiens
aatcctttgagaatgtgattc

SEQ ID NO: 984831 - DNA, 14 bp, Homo sapiens
aatcctttgcctgc

SEQ ID NO: 984832 - DNA, 18 bp, Homo sapiens
aatcgaggaaccagagcc

SEQ ID NO: 984833 - DNA, 12 bp, Homo sapiens
aatcggactgcc

SEQ ID NO: 984834 - DNA, 14 bp, Homo sapiens
aatcggactgccaa

SEQ ID NO: 984835 - DNA, 20 bp, Homo sapiens
aatcggactgccaaattctc

SEQ ID NO: 984836 - DNA, 21 bp, Homo sapiens
aatcggatctggggctctggg

SEQ ID NO: 984837 - DNA, 13 bp, Homo sapiens
aatcgtgtgccat

SEQ ID NO: 984838 - DNA, 20 bp, Homo sapiens
aatctaaaacaaaatctgaa

SEQ ID NO: 984839 - DNA, 15 bp, Homo sapiens
aatctaaaatgattg

SEQ ID NO: 984840 - DNA, 13 bp, Homo sapiens
aatctaaaatttc

SEQ ID NO: 984841 - DNA, 14 bp, Homo sapiens
aatctaaaatttca

SEQ ID NO: 984842 - DNA, 20 bp, Homo sapiens
aatctaaacgtggtcacctt

SEQ ID NO: 984843 - DNA, 16 bp, Homo sapiens
aatctaaatctattta

SEQ ID NO: 984844 - DNA, 17 bp, Homo sapiens
aatctaaatctatttat

SEQ ID NO: 984845 - DNA, 12 bp, Homo sapiens
aatctaaatgga

SEQ ID NO: 984846 - DNA, 20 bp, Homo sapiens
aatctaagaaaaggggagag

SEQ ID NO: 984847 - DNA, 14 bp, Homo sapiens
aatctaagctgttt

SEQ ID NO: 984848 - DNA, 16 bp, Homo sapiens
aatctaagctgtttgc

SEQ ID NO: 984849 - DNA, 17 bp, Homo sapiens
aatctaagctgtttgcc

SEQ ID NO: 984850 - DNA, 22 bp, Homo sapiens
aatctaagctgtttgccaagct

SEQ ID NO: 984851 - DNA, 23 bp, Homo sapiens
aatctaaggaaaattaatcctca

SEQ ID NO: 984852 - DNA, 14 bp, Homo sapiens
aatctaaggataat

SEQ ID NO: 984853 - DNA, 15 bp, Homo sapiens
aatctaagtgatata

SEQ ID NO: 984854 - DNA, 17 bp, Homo sapiens
aatctaatatttctagt

SEQ ID NO: 984855 - DNA, 14 bp, Homo sapiens
aatctaatctgaac

SEQ ID NO: 984856 - DNA, 16 bp, Homo sapiens
aatctacaaaagtgaa

SEQ ID NO: 984857 - DNA, 17 bp, Homo sapiens
aatctactaattccaca

SEQ ID NO: 984858 - DNA, 23 bp, Homo sapiens
aatctactggaaatgtagcactt

SEQ ID NO: 984859 - DNA, 13 bp, Homo sapiens
aatctagaagagt

SEQ ID NO: 984860 - DNA, 22 bp, Homo sapiens
aatctagatatcgacttgtttt

SEQ ID NO: 984861 - DNA, 19 bp, Homo sapiens
aatctagccgatggaaaat

SEQ ID NO: 984862 - DNA, 15 bp, Homo sapiens
aatctaggaaaatta

SEQ ID NO: 984863 - DNA, 17 bp, Homo sapiens
aatctaggtgtggctgt

SEQ ID NO: 984864 - DNA, 18 bp, Homo sapiens
aatctagtttacagaaaa

SEQ ID NO: 984865 - DNA, 17 bp, Homo sapiens
aatctataaacaatgaa

SEQ ID NO: 984866 - DNA, 16 bp, Homo sapiens
aatctatattaaatga

SEQ ID NO: 984867 - DNA, 21 bp, Homo sapiens
aatctatccaaatctgaagat

SEQ ID NO: 984868 - DNA, 17 bp, Homo sapiens
aatctatgccaaagatc

SEQ ID NO: 984869 - DNA, 20 bp, Homo sapiens
aatctatgccaaagatcact

SEQ ID NO: 984870 - DNA, 20 bp, Homo sapiens
aatctatggcttatttctat

SEQ ID NO: 984871 - DNA, 20 bp, Homo sapiens
aatctatggctttaaataaa

SEQ ID NO: 984872 - DNA, 18 bp, Homo sapiens
aatctatgtgtttctgta

SEQ ID NO: 984873 - DNA, 20 bp, Homo sapiens
aatctatgtgtttctgtaac

SEQ ID NO: 984874 - DNA, 21 bp, Homo sapiens
aatctatgtgtttctgtaaca

SEQ ID NO: 984875 - DNA, 22 bp, Homo sapiens
aatctatgtgtttctgtaacaa

SEQ ID NO: 984876 - DNA, 23 bp, Homo sapiens
aatctattacttttgcaaactgt

SEQ ID NO: 984877 - DNA, 16 bp, Homo sapiens
aatctattagatttta

SEQ ID NO: 984878 - DNA, 21 bp, Homo sapiens
aatctattcctgtaaataaga

SEQ ID NO: 984879 - DNA, 22 bp, Homo sapiens
aatctattcctgtaaataagag

SEQ ID NO: 984880 - DNA, 15 bp, Homo sapiens
aatctattgggttca

SEQ ID NO: 984881 - DNA, 17 bp, Homo sapiens
aatctattgggttcatt

SEQ ID NO: 984882 - DNA, 17 bp, Homo sapiens
aatctcaaaggagaaaa

SEQ ID NO: 984883 - DNA, 20 bp, Homo sapiens
aatctcaaattctcaaccta

SEQ ID NO: 984884 - DNA, 14 bp, Homo sapiens
aatctcaaatttct

SEQ ID NO: 984885 - DNA, 16 bp, Homo sapiens
aatctcaaatttctaa

SEQ ID NO: 984886 - DNA, 19 bp, Homo sapiens
aatctcaatgaagccagct

SEQ ID NO: 984887 - DNA, 13 bp, Homo sapiens
aatctcaccccat

SEQ ID NO: 984888 - DNA, 18 bp, Homo sapiens
aatctcatccccccaccc

SEQ ID NO: 984889 - DNA, 15 bp, Homo sapiens
aatctcatgctgtgt

SEQ ID NO: 984890 - DNA, 11 bp, Homo sapiens
aatctcattcc

SEQ ID NO: 984891 - DNA, 14 bp, Homo sapiens
aatctccaaaataa

SEQ ID NO: 984892 - DNA, 16 bp, Homo sapiens
aatctcccattttgga

SEQ ID NO: 984893 - DNA, 17 bp, Homo sapiens
aatctcctctgctcatt

SEQ ID NO: 984894 - DNA, 18 bp, Homo sapiens
aatctcctcttttatctt

SEQ ID NO: 984895 - DNA, 14 bp, Homo sapiens
aatctcctgctgat

SEQ ID NO: 984896 - DNA, 22 bp, Homo sapiens
aatctctacccctttcttctcg

SEQ ID NO: 984897 - DNA, 18 bp, Homo sapiens
aatctctccctcctcagt

SEQ ID NO: 984898 - DNA, 23 bp, Homo sapiens
aatctctcctgaactgctttcca

SEQ ID NO: 984899 - DNA, 19 bp, Homo sapiens
aatctctctgcagctgccg

SEQ ID NO: 984900 - DNA, 21 bp, Homo sapiens
aatctctgattccctgattta

SEQ ID NO: 984901 - DNA, 12 bp, Homo sapiens
aatctctgtaaa

SEQ ID NO: 984902 - DNA, 13 bp, Homo sapiens
aatctctgtaaag

SEQ ID NO: 984903 - DNA, 14 bp, Homo sapiens
aatctctgtaggaa

SEQ ID NO: 984904 - DNA, 13 bp, Homo sapiens
aatctctgtgcct

SEQ ID NO: 984905 - DNA, 21 bp, Homo sapiens
aatctctgttctgctcccaga

SEQ ID NO: 984906 - DNA, 15 bp, Homo sapiens
aatctcttcattatt

SEQ ID NO: 984907 - DNA, 21 bp, Homo sapiens
aatctcttcattattctctgc

SEQ ID NO: 984908 - DNA, 17 bp, Homo sapiens
aatctcttccagtgtaa

SEQ ID NO: 984909 - DNA, 15 bp, Homo sapiens
aatctgaactctcaa

SEQ ID NO: 984910 - DNA, 23 bp, Homo sapiens
aatctgaactgaccttgaatctt

SEQ ID NO: 984911 - DNA, 13 bp, Homo sapiens
aatctgaagaaag

SEQ ID NO: 984912 - DNA, 18 bp, Homo sapiens
aatctgaagaaagttatt

SEQ ID NO: 984913 - DNA, 21 bp, Homo sapiens
aatctgagaggtaagaagtaa

SEQ ID NO: 984914 - DNA, 18 bp, Homo sapiens
aatctgagggaaatgttt

SEQ ID NO: 984915 - DNA, 22 bp, Homo sapiens
aatctgagggaaatgttttgta

SEQ ID NO: 984916 - DNA, 13 bp, Homo sapiens
aatctgatgcctt

SEQ ID NO: 984917 - DNA, 17 bp, Homo sapiens
aatctgatggccttaat

SEQ ID NO: 984918 - DNA, 19 bp, Homo sapiens
aatctgatggccttaattt

SEQ ID NO: 984919 - DNA, 21 bp, Homo sapiens
aatctgatggccttaatttcc

SEQ ID NO: 984920 - DNA, 22 bp, Homo sapiens
aatctgatggccttaatttcct

SEQ ID NO: 984921 - DNA, 18 bp, Homo sapiens
aatctgatgtaacaaggt

SEQ ID NO: 984922 - DNA, 19 bp, Homo sapiens
aatctgattggacattttc

SEQ ID NO: 984923 - DNA, 12 bp, Homo sapiens
aatctgatttaa

SEQ ID NO: 984924 - DNA, 14 bp, Homo sapiens
aatctgatttcatt

SEQ ID NO: 984925 - DNA, 22 bp, Homo sapiens
aatctgatttcattacatttct

SEQ ID NO: 984926 - DNA, 17 bp, Homo sapiens
aatctgcagaaggaaaa

SEQ ID NO: 984927 - DNA, 20 bp, Homo sapiens
aatctgcagccattcttcag

SEQ ID NO: 984928 - DNA, 12 bp, Homo sapiens
aatctgcagtga

SEQ ID NO: 984929 - DNA, 17 bp, Homo sapiens
aatctgcattattggaa

SEQ ID NO: 984930 - DNA, 18 bp, Homo sapiens
aatctgcattattggaat

SEQ ID NO: 984931 - DNA, 21 bp, Homo sapiens
aatctggaccccatctgtgaa

SEQ ID NO: 984932 - DNA, 24 bp, Homo sapiens
aatctggaccccatctgtgaataa

SEQ ID NO: 984933 - DNA, 16 bp, Homo sapiens
aatctggactcctctg

SEQ ID NO: 984934 - DNA, 13 bp, Homo sapiens
aatctgggaggga

SEQ ID NO: 984935 - DNA, 14 bp, Homo sapiens
aatctggtctcttc

SEQ ID NO: 984936 - DNA, 14 bp, Homo sapiens
aatctggtcttgtt

SEQ ID NO: 984937 - DNA, 22 bp, Homo sapiens
aatctggtgacaaatattctct

SEQ ID NO: 984938 - DNA, 14 bp, Homo sapiens
aatctgtaaactgt

SEQ ID NO: 984939 - DNA, 15 bp, Homo sapiens
aatctgtaaactgtg

SEQ ID NO: 984940 - DNA, 16 bp, Homo sapiens
aatctgtaaactgtgt

SEQ ID NO: 984941 - DNA, 23 bp, Homo sapiens
aatctgtaaactgtgtattccaa

SEQ ID NO: 984942 - DNA, 15 bp, Homo sapiens
aatctgtaaagccag

SEQ ID NO: 984943 - DNA, 14 bp, Homo sapiens
aatctgtacatgtt

SEQ ID NO: 984944 - DNA, 21 bp, Homo sapiens
aatcagaagatagtcttggaa

SEQ ID NO: 984945 - DNA, 24 bp, Homo sapiens
aatcagaagtcatcttgctaccag

SEQ ID NO: 984946 - DNA, 18 bp, Homo sapiens
aatcagaatcatggagaa

SEQ ID NO: 984947 - DNA, 14 bp, Homo sapiens
aatcagaatggaag

SEQ ID NO: 984948 - DNA, 12 bp, Homo sapiens
aatcagactgac

SEQ ID NO: 984949 - DNA, 17 bp, Homo sapiens
aatcagagagcaaggca

SEQ ID NO: 984950 - DNA, 18 bp, Homo sapiens
aatcagagagcaaggcat

SEQ ID NO: 984951 - DNA, 22 bp, Homo sapiens
aatcagagagcctagaacatcc

SEQ ID NO: 984952 - DNA, 19 bp, Homo sapiens
aatcagaggagagacggtg

SEQ ID NO: 984953 - DNA, 19 bp, Homo sapiens
aatcagagttaccattatt

SEQ ID NO: 984954 - DNA, 14 bp, Homo sapiens
aatcagatagatat

SEQ ID NO: 984955 - DNA, 21 bp, Homo sapiens
aatcagatagatattcctatt

SEQ ID NO: 984956 - DNA, 14 bp, Homo sapiens
aatcagatcatttc

SEQ ID NO: 984957 - DNA, 15 bp, Homo sapiens
aatcagatctttatt

SEQ ID NO: 984958 - DNA, 22 bp, Homo sapiens
aatcagcatgacaaaaataaca

SEQ ID NO: 984959 - DNA, 19 bp, Homo sapiens
aatcagcattctcactcct

SEQ ID NO: 984960 - DNA, 15 bp, Homo sapiens
aatcagccaagtttt

SEQ ID NO: 984961 - DNA, 17 bp, Homo sapiens
aatcagccaagttttat

SEQ ID NO: 984962 - DNA, 13 bp, Homo sapiens
aatcagcccccag

SEQ ID NO: 984963 - DNA, 20 bp, Homo sapiens
aatcagctccttcctggaga

SEQ ID NO: 984964 - DNA, 12 bp, Homo sapiens
aatcagctctcc

SEQ ID NO: 984965 - DNA, 15 bp, Homo sapiens
aatcagctctcctgg

SEQ ID NO: 984966 - DNA, 11 bp, Homo sapiens
aatcagctgga

SEQ ID NO: 984967 - DNA, 14 bp, Homo sapiens
aatcagctggacat

SEQ ID NO: 984968 - DNA, 22 bp, Homo sapiens
aatcagctggacatactgctgg

SEQ ID NO: 984969 - DNA, 19 bp, Homo sapiens
aatcagcttttgttctaga

SEQ ID NO: 984970 - DNA, 20 bp, Homo sapiens
aatcagcttttgttctagac

SEQ ID NO: 984971 - DNA, 13 bp, Homo sapiens
aatcaggaaaaat

SEQ ID NO: 984972 - DNA, 18 bp, Homo sapiens
aatcaggaatattttcca

SEQ ID NO: 984973 - DNA, 19 bp, Homo sapiens
aatcagggaggtcattttg

SEQ ID NO: 984974 - DNA, 21 bp, Homo sapiens
aatcaggggccagagagcagg

SEQ ID NO: 984975 - DNA, 20 bp, Homo sapiens
aatcaggtagacttttaata

SEQ ID NO: 984976 - DNA, 14 bp, Homo sapiens
aatcagtaagaggt

SEQ ID NO: 984977 - DNA, 22 bp, Homo sapiens
aatcagtaagaggtgttatttg

SEQ ID NO: 984978 - DNA, 21 bp, Homo sapiens
aatcagtaatatttatatatt

SEQ ID NO: 984979 - DNA, 11 bp, Homo sapiens
aatcagtaatt

SEQ ID NO: 984980 - DNA, 14 bp, Homo sapiens
aatcagtataaaca

SEQ ID NO: 984981 - DNA, 17 bp, Homo sapiens
aatcagtataaacaaag

SEQ ID NO: 984982 - DNA, 15 bp, Homo sapiens
aatcagtatttcctt

SEQ ID NO: 984983 - DNA, 17 bp, Homo sapiens
aatcagtatttccttcc

SEQ ID NO: 984984 - DNA, 13 bp, Homo sapiens
aatcagtcccctc

SEQ ID NO: 984985 - DNA, 17 bp, Homo sapiens
aatcagtctcagaatgt

SEQ ID NO: 984986 - DNA, 14 bp, Homo sapiens
aatcagtgtttaaa

SEQ ID NO: 984987 - DNA, 21 bp, Homo sapiens
aatcagtgtttaaataaagac

SEQ ID NO: 984988 - DNA, 22 bp, Homo sapiens
aatcagtgtttaaataaagacc

SEQ ID NO: 984989 - DNA, 17 bp, Homo sapiens
aatcagttcattagaaa

SEQ ID NO: 984990 - DNA, 18 bp, Homo sapiens
aatcagttcattagaaat

SEQ ID NO: 984991 - DNA, 13 bp, Homo sapiens
aatcagtttttca

SEQ ID NO: 984992 - DNA, 13 bp, Homo sapiens
aatcataaagtca

SEQ ID NO: 984993 - DNA, 14 bp, Homo sapiens
aatcatacaaactc

SEQ ID NO: 984994 - DNA, 19 bp, Homo sapiens
aatcatacaaactctcacc

SEQ ID NO: 984995 - DNA, 21 bp, Homo sapiens
aatcatacaaactctcaccat

SEQ ID NO: 984996 - DNA, 16 bp, Homo sapiens
aatcatactgcctact

SEQ ID NO: 984997 - DNA, 19 bp, Homo sapiens
aatcatagattattataaa

SEQ ID NO: 984998 - DNA, 20 bp, Homo sapiens
aatcatagctggttcacact

SEQ ID NO: 984999 - DNA, 15 bp, Homo sapiens
aatcatagctgtctg

SEQ ID NO: 985000 - DNA, 16 bp, Homo sapiens
aatcatagctgtctga

SEQ ID NO: 985001 - DNA, 13 bp, Homo sapiens
aatcatatataat

SEQ ID NO: 985002 - DNA, 17 bp, Homo sapiens
aatcatatataataaat

SEQ ID NO: 985003 - DNA, 22 bp, Homo sapiens
aatcatcaaaaagtaattataa

SEQ ID NO: 985004 - DNA, 12 bp, Homo sapiens
aatcatcaagaa

SEQ ID NO: 985005 - DNA, 20 bp, Homo sapiens
aatcatccatccttgccaat

SEQ ID NO: 985006 - DNA, 13 bp, Homo sapiens
aatcatcctgaat

SEQ ID NO: 985007 - DNA, 15 bp, Homo sapiens
aatcatctataaaga

SEQ ID NO: 985008 - DNA, 15 bp, Homo sapiens
aatcatctgtgtgaa

SEQ ID NO: 985009 - DNA, 17 bp, Homo sapiens
aatcatgaaatatgcat

SEQ ID NO: 985010 - DNA, 17 bp, Homo sapiens
aatcatgaacagctctg

SEQ ID NO: 985011 - DNA, 19 bp, Homo sapiens
aatcatgaacagctctgag

SEQ ID NO: 985012 - DNA, 16 bp, Homo sapiens
aatcatgctcatgtat

SEQ ID NO: 985013 - DNA, 19 bp, Homo sapiens
aatcatgctcatgtatatt

SEQ ID NO: 985014 - DNA, 20 bp, Homo sapiens
aatcatggcggaaggtgaaa

SEQ ID NO: 985015 - DNA, 21 bp, Homo sapiens
aatcatggctgattgcagcct

SEQ ID NO: 985016 - DNA, 18 bp, Homo sapiens
aatcattccagtgctaga

SEQ ID NO: 985017 - DNA, 17 bp, Homo sapiens
aatcattctcgatttaa

SEQ ID NO: 985018 - DNA, 16 bp, Homo sapiens
aatcattctttcccct

SEQ ID NO: 985019 - DNA, 12 bp, Homo sapiens
aatcattgctta

SEQ ID NO: 985020 - DNA, 14 bp, Homo sapiens
aatcattgtagaaa

SEQ ID NO: 985021 - DNA, 14 bp, Homo sapiens
aatcatttattcat

SEQ ID NO: 985022 - DNA, 12 bp, Homo sapiens
aatcatttctat

SEQ ID NO: 985023 - DNA, 14 bp, Homo sapiens
aatcatttgctttt

SEQ ID NO: 985024 - DNA, 20 bp, Homo sapiens
aatcatttggttaagttttt

SEQ ID NO: 985025 - DNA, 17 bp, Homo sapiens
aatcatttgtttaaaaa

SEQ ID NO: 985026 - DNA, 16 bp, Homo sapiens
aatcatttgtttacat

SEQ ID NO: 985027 - DNA, 20 bp, Homo sapiens
aatcattttacccttggctc

SEQ ID NO: 985028 - DNA, 20 bp, Homo sapiens
aatcattttatatgtcaaag

SEQ ID NO: 985029 - DNA, 21 bp, Homo sapiens
aatcattttatgctgtttatg

SEQ ID NO: 985030 - DNA, 20 bp, Homo sapiens
aatcattttgagtttgcctc

SEQ ID NO: 985031 - DNA, 16 bp, Homo sapiens
aatcatttttcactgt

SEQ ID NO: 985032 - DNA, 19 bp, Homo sapiens
aatcatttttcactgtaca

SEQ ID NO: 985033 - DNA, 20 bp, Homo sapiens
aatcatttttcactgtacat

SEQ ID NO: 985034 - DNA, 15 bp, Homo sapiens
aatccaaaagacaaa

SEQ ID NO: 985035 - DNA, 14 bp, Homo sapiens
aatccaaacttgga

SEQ ID NO: 985036 - DNA, 21 bp, Homo sapiens
aatccaaacttggatttttga

SEQ ID NO: 985037 - DNA, 19 bp, Homo sapiens
aatccaaatctgtcctctg

SEQ ID NO: 985038 - DNA, 13 bp, Homo sapiens
aatccaaatggcg

SEQ ID NO: 985039 - DNA, 13 bp, Homo sapiens
aatccaaatttct

SEQ ID NO: 985040 - DNA, 15 bp, Homo sapiens
aatccaaatttctca

SEQ ID NO: 985041 - DNA, 17 bp, Homo sapiens
aatccaagcctccacag

SEQ ID NO: 985042 - DNA, 23 bp, Homo sapiens
aatccaagggttgagagccagtg

SEQ ID NO: 985043 - DNA, 18 bp, Homo sapiens
aatccacaagccattttt

SEQ ID NO: 985044 - DNA, 18 bp, Homo sapiens
aatccacatgtttcagag

SEQ ID NO: 985045 - DNA, 23 bp, Homo sapiens
aatccacccatcctaccaatgca

SEQ ID NO: 985046 - DNA, 22 bp, Homo sapiens
aatccacccccaggtgcagccc

SEQ ID NO: 985047 - DNA, 15 bp, Homo sapiens
aatccactaacactt

SEQ ID NO: 985048 - DNA, 23 bp, Homo sapiens
aatccagaagttttaacttccag

SEQ ID NO: 985049 - DNA, 17 bp, Homo sapiens
aatccaggcacagctga

SEQ ID NO: 985050 - DNA, 18 bp, Homo sapiens
aatccaggcacagctgag

SEQ ID NO: 985051 - DNA, 20 bp, Homo sapiens
aatccaggccaaagccccat

SEQ ID NO: 985052 - DNA, 13 bp, Homo sapiens
aatccagtattgc

SEQ ID NO: 985053 - DNA, 18 bp, Homo sapiens
aatccataaatgtgttcc

SEQ ID NO: 985054 - DNA, 21 bp, Homo sapiens
aatccatagatttattttaca

SEQ ID NO: 985055 - DNA, 22 bp, Homo sapiens
aatccatcctgcaaaggccctt

SEQ ID NO: 985056 - DNA, 11 bp, Homo sapiens
aatccatgctt

SEQ ID NO: 985057 - DNA, 14 bp, Homo sapiens
aatccatgtgacca

SEQ ID NO: 985058 - DNA, 15 bp, Homo sapiens
aatccatgtgaccat

SEQ ID NO: 985059 - DNA, 20 bp, Homo sapiens
aatccatgtgaccattctgc

SEQ ID NO: 985060 - DNA, 21 bp, Homo sapiens
aatccattcacaagcctcctg

SEQ ID NO: 985061 - DNA, 14 bp, Homo sapiens
aatccattccaaaa

SEQ ID NO: 985062 - DNA, 21 bp, Homo sapiens
aatcccaaaccattactgagg

SEQ ID NO: 985063 - DNA, 20 bp, Homo sapiens
aatcccaatctttctatata

SEQ ID NO: 985064 - DNA, 14 bp, Homo sapiens
aatcccaattctgt

SEQ ID NO: 985065 - DNA, 23 bp, Homo sapiens
aatcccagccggccaatggaaac

SEQ ID NO: 985066 - DNA, 13 bp, Homo sapiens
aatcccagcgcac

SEQ ID NO: 985067 - DNA, 17 bp, Homo sapiens
aatcccatttaaaaaaa

SEQ ID NO: 985068 - DNA, 15 bp, Homo sapiens
aatcccatttcccaa

SEQ ID NO: 985069 - DNA, 16 bp, Homo sapiens
aatatttaagtatata

SEQ ID NO: 985070 - DNA, 13 bp, Homo sapiens
aatatttaagtga

SEQ ID NO: 985071 - DNA, 19 bp, Homo sapiens
aatatttaagtgaaggaga

SEQ ID NO: 985072 - DNA, 20 bp, Homo sapiens
aatatttaagtgaaggagaa

SEQ ID NO: 985073 - DNA, 17 bp, Homo sapiens
aatatttacataaagac

SEQ ID NO: 985074 - DNA, 18 bp, Homo sapiens
aatatttacataaagact

SEQ ID NO: 985075 - DNA, 11 bp, Homo sapiens
aatatttataa

SEQ ID NO: 985076 - DNA, 17 bp, Homo sapiens
aatatttataaaacttc

SEQ ID NO: 985077 - DNA, 19 bp, Homo sapiens
aatatttataaaacttctc

SEQ ID NO: 985078 - DNA, 17 bp, Homo sapiens
aatatttataacagcat

SEQ ID NO: 985079 - DNA, 19 bp, Homo sapiens
aatatttatgtctatttaa

SEQ ID NO: 985080 - DNA, 23 bp, Homo sapiens
aatatttatgtctatttaagcct

SEQ ID NO: 985081 - DNA, 17 bp, Homo sapiens
aatatttattacctctg

SEQ ID NO: 985082 - DNA, 15 bp, Homo sapiens
aatatttattatgag

SEQ ID NO: 985083 - DNA, 20 bp, Homo sapiens
aatatttattattttcacct

SEQ ID NO: 985084 - DNA, 14 bp, Homo sapiens
aatatttattcatt

SEQ ID NO: 985085 - DNA, 22 bp, Homo sapiens
aatatttattcattatttgtca

SEQ ID NO: 985086 - DNA, 11 bp, Homo sapiens
aatatttattt

SEQ ID NO: 985087 - DNA, 13 bp, Homo sapiens
aatatttatttat

SEQ ID NO: 985088 - DNA, 18 bp, Homo sapiens
aatatttatttccagagt

SEQ ID NO: 985089 - DNA, 16 bp, Homo sapiens
aatatttccatatgga

SEQ ID NO: 985090 - DNA, 23 bp, Homo sapiens
aatatttccatatggattttcta

SEQ ID NO: 985091 - DNA, 13 bp, Homo sapiens
aatatttcctttt

SEQ ID NO: 985092 - DNA, 12 bp, Homo sapiens
aatatttctagt

SEQ ID NO: 985093 - DNA, 17 bp, Homo sapiens
aatatttcttttgttgt

SEQ ID NO: 985094 - DNA, 19 bp, Homo sapiens
aatatttcttttgttgtac

SEQ ID NO: 985095 - DNA, 21 bp, Homo sapiens
aatatttcttttgttgtactt

SEQ ID NO: 985096 - DNA, 15 bp, Homo sapiens
aatatttgaatgaaa

SEQ ID NO: 985097 - DNA, 21 bp, Homo sapiens
aatatttgacttgcatgaaga

SEQ ID NO: 985098 - DNA, 11 bp, Homo sapiens
aatatttgctt

SEQ ID NO: 985099 - DNA, 15 bp, Homo sapiens
aatatttgctttata

SEQ ID NO: 985100 - DNA, 17 bp, Homo sapiens
aatatttgtgacaaaaa

SEQ ID NO: 985101 - DNA, 13 bp, Homo sapiens
aatattttaaaga

SEQ ID NO: 985102 - DNA, 14 bp, Homo sapiens
aatattttaagaaa

SEQ ID NO: 985103 - DNA, 15 bp, Homo sapiens
aatattttaagtatt

SEQ ID NO: 985104 - DNA, 17 bp, Homo sapiens
aatattttaagtattgc

SEQ ID NO: 985105 - DNA, 13 bp, Homo sapiens
aatattttatcct

SEQ ID NO: 985106 - DNA, 22 bp, Homo sapiens
aatattttatcctgtattcttg

SEQ ID NO: 985107 - DNA, 16 bp, Homo sapiens
aatattttctatttta

SEQ ID NO: 985108 - DNA, 22 bp, Homo sapiens
aatattttctctgtacttttca

SEQ ID NO: 985109 - DNA, 15 bp, Homo sapiens
aatattttctgggtt

SEQ ID NO: 985110 - DNA, 14 bp, Homo sapiens
aatattttcttttc

SEQ ID NO: 985111 - DNA, 13 bp, Homo sapiens
aatattttgaatc

SEQ ID NO: 985112 - DNA, 15 bp, Homo sapiens
aatattttgaatcaa

SEQ ID NO: 985113 - DNA, 11 bp, Homo sapiens
aatattttgat

SEQ ID NO: 985114 - DNA, 17 bp, Homo sapiens
aatattttgatacaaat

SEQ ID NO: 985115 - DNA, 14 bp, Homo sapiens
aatattttgccttt

SEQ ID NO: 985116 - DNA, 16 bp, Homo sapiens
aatattttggaaactg

SEQ ID NO: 985117 - DNA, 13 bp, Homo sapiens
aatattttggatg

SEQ ID NO: 985118 - DNA, 18 bp, Homo sapiens
aatattttgtaatattct

SEQ ID NO: 985119 - DNA, 22 bp, Homo sapiens
aatattttgtaatattctgttt

SEQ ID NO: 985120 - DNA, 21 bp, Homo sapiens
aatattttgtctaaaatgcct

SEQ ID NO: 985121 - DNA, 14 bp, Homo sapiens
aatatttttagata

SEQ ID NO: 985122 - DNA, 23 bp, Homo sapiens
aatatttttatatcatgcaaaat

SEQ ID NO: 985123 - DNA, 18 bp, Homo sapiens
aatatttttatatttcct

SEQ ID NO: 985124 - DNA, 16 bp, Homo sapiens
aatatttttccctccg

SEQ ID NO: 985125 - DNA, 23 bp, Homo sapiens
aatatttttgaaaggcatgttcc

SEQ ID NO: 985126 - DNA, 17 bp, Homo sapiens
aatatttttgtatttct

SEQ ID NO: 985127 - DNA, 15 bp, Homo sapiens
aatattttttgaagg

SEQ ID NO: 985128 - DNA, 23 bp, Homo sapiens
aatattttttgaaggtttcagat

SEQ ID NO: 985129 - DNA, 13 bp, Homo sapiens
aatattttttgca

SEQ ID NO: 985130 - DNA, 14 bp, Homo sapiens
aatattttttgcaa

SEQ ID NO: 985131 - DNA, 16 bp, Homo sapiens
aatattttttgcaagt

SEQ ID NO: 985132 - DNA, 13 bp, Homo sapiens
aatcaaacatttt

SEQ ID NO: 985133 - DNA, 15 bp, Homo sapiens
aatcaaacattttga

SEQ ID NO: 985134 - DNA, 15 bp, Homo sapiens
aatcaaagaattaca

SEQ ID NO: 985135 - DNA, 18 bp, Homo sapiens
aatcaaagaattacagta

SEQ ID NO: 985136 - DNA, 13 bp, Homo sapiens
aatcaaagcaagg

SEQ ID NO: 985137 - DNA, 17 bp, Homo sapiens
aatcaaagccagggtct

SEQ ID NO: 985138 - DNA, 19 bp, Homo sapiens
aatcaaataagtatttata

SEQ ID NO: 985139 - DNA, 18 bp, Homo sapiens
aatcaaatctcctgctga

SEQ ID NO: 985140 - DNA, 16 bp, Homo sapiens
aatcaaatctgtgctc

SEQ ID NO: 985141 - DNA, 21 bp, Homo sapiens
aatcaaatcttacaaaatcct

SEQ ID NO: 985142 - DNA, 12 bp, Homo sapiens
aatcaacagaag

SEQ ID NO: 985143 - DNA, 13 bp, Homo sapiens
aatcaacagaagc

SEQ ID NO: 985144 - DNA, 17 bp, Homo sapiens
aatcaacagcagtgagt

SEQ ID NO: 985145 - DNA, 16 bp, Homo sapiens
aatcaacatgactggt

SEQ ID NO: 985146 - DNA, 13 bp, Homo sapiens
aatcaaccctctc

SEQ ID NO: 985147 - DNA, 19 bp, Homo sapiens
aatcaaccctgcaatcact

SEQ ID NO: 985148 - DNA, 21 bp, Homo sapiens
aatcaaccctgcaatcacttt

SEQ ID NO: 985149 - DNA, 20 bp, Homo sapiens
aatcaactttatcatatgct

SEQ ID NO: 985150 - DNA, 13 bp, Homo sapiens
aatcaagagaaac

SEQ ID NO: 985151 - DNA, 23 bp, Homo sapiens
aatcaagcctttatggctgctgg

SEQ ID NO: 985152 - DNA, 22 bp, Homo sapiens
aatcaaggaaaggctcatttaa

SEQ ID NO: 985153 - DNA, 23 bp, Homo sapiens
aatcaaggaaaggctcatttaaa

SEQ ID NO: 985154 - DNA, 17 bp, Homo sapiens
aatcaaggttataattt

SEQ ID NO: 985155 - DNA, 18 bp, Homo sapiens
aatcaaggttataatttt

SEQ ID NO: 985156 - DNA, 14 bp, Homo sapiens
aatcaagtaatgaa

SEQ ID NO: 985157 - DNA, 15 bp, Homo sapiens
aatcaataaagaaaa

SEQ ID NO: 985158 - DNA, 19 bp, Homo sapiens
aatcaatacactagttgtt

SEQ ID NO: 985159 - DNA, 20 bp, Homo sapiens
aatcaatacactagttgttt

SEQ ID NO: 985160 - DNA, 14 bp, Homo sapiens
aatcaatacagctt

SEQ ID NO: 985161 - DNA, 14 bp, Homo sapiens
aatcaatcaatggt

SEQ ID NO: 985162 - DNA, 13 bp, Homo sapiens
aatcaatggtgca

SEQ ID NO: 985163 - DNA, 16 bp, Homo sapiens
aatcaatggtgcaaaa

SEQ ID NO: 985164 - DNA, 18 bp, Homo sapiens
aatcaatggtgcaaaaaa

SEQ ID NO: 985165 - DNA, 20 bp, Homo sapiens
aatcaattactggtccaaaa

SEQ ID NO: 985166 - DNA, 17 bp, Homo sapiens
aatcacaaaaacaaaaa

SEQ ID NO: 985167 - DNA, 18 bp, Homo sapiens
aatcacaacaaactgaat

SEQ ID NO: 985168 - DNA, 16 bp, Homo sapiens
aatcacagtgttgcat

SEQ ID NO: 985169 - DNA, 23 bp, Homo sapiens
aatcacatattttaaaatttgtt

SEQ ID NO: 985170 - DNA, 11 bp, Homo sapiens
aatcacatcct

SEQ ID NO: 985171 - DNA, 13 bp, Homo sapiens
aatcacatcctgg

SEQ ID NO: 985172 - DNA, 22 bp, Homo sapiens
aatcacatttttttatgctctt

SEQ ID NO: 985173 - DNA, 12 bp, Homo sapiens
aatcaccaaagt

SEQ ID NO: 985174 - DNA, 13 bp, Homo sapiens
aatcaccaaagta

SEQ ID NO: 985175 - DNA, 14 bp, Homo sapiens
aatcaccatgtaag

SEQ ID NO: 985176 - DNA, 14 bp, Homo sapiens
aatcacgctttttg

SEQ ID NO: 985177 - DNA, 17 bp, Homo sapiens
aatcacgctttttgaaa

SEQ ID NO: 985178 - DNA, 20 bp, Homo sapiens
aatcacgctttttgaaaaag

SEQ ID NO: 985179 - DNA, 19 bp, Homo sapiens
aatcactaggtaacttatt

SEQ ID NO: 985180 - DNA, 14 bp, Homo sapiens
aatcactattctta

SEQ ID NO: 985181 - DNA, 22 bp, Homo sapiens
aatcactattcttaagcacttt

SEQ ID NO: 985182 - DNA, 14 bp, Homo sapiens
aatcactctgagtc

SEQ ID NO: 985183 - DNA, 20 bp, Homo sapiens
aatcactggggatggtggca

SEQ ID NO: 985184 - DNA, 14 bp, Homo sapiens
aatcactgtcaata

SEQ ID NO: 985185 - DNA, 13 bp, Homo sapiens
aatcactgtgaaa

SEQ ID NO: 985186 - DNA, 15 bp, Homo sapiens
aatcactgtgaaatt

SEQ ID NO: 985187 - DNA, 19 bp, Homo sapiens
aatcactgttgagttctga

SEQ ID NO: 985188 - DNA, 22 bp, Homo sapiens
aatcactgttgagttctgattg

SEQ ID NO: 985189 - DNA, 16 bp, Homo sapiens
aatcacttaggaaatg

SEQ ID NO: 985190 - DNA, 20 bp, Homo sapiens
aatcacttcagatctctaat

SEQ ID NO: 985191 - DNA, 13 bp, Homo sapiens
aatcactttgtct

SEQ ID NO: 985192 - DNA, 17 bp, Homo sapiens
aatcacttttctagaca

SEQ ID NO: 985193 - DNA, 14 bp, Homo sapiens
aatcactttttgga

SEQ ID NO: 985194 - DNA, 13 bp, Homo sapiens
aatcagaaagtaa

SEQ ID NO: 985195 - DNA, 18 bp, Homo sapiens
aatatctaataaaaagtc

SEQ ID NO: 985196 - DNA, 14 bp, Homo sapiens
aatatctaatatat

SEQ ID NO: 985197 - DNA, 23 bp, Homo sapiens
aatatctctatttaattttgaca

SEQ ID NO: 985198 - DNA, 21 bp, Homo sapiens
aatatctgcagcgttgcttgg

SEQ ID NO: 985199 - DNA, 14 bp, Homo sapiens
aatatctggcactg

SEQ ID NO: 985200 - DNA, 15 bp, Homo sapiens
aatatctggcactgt

SEQ ID NO: 985201 - DNA, 22 bp, Homo sapiens
aatatctggcactgttaataca

SEQ ID NO: 985202 - DNA, 17 bp, Homo sapiens
aatatctgtaatggtac

SEQ ID NO: 985203 - DNA, 18 bp, Homo sapiens
aatatcttcagctctttt

SEQ ID NO: 985204 - DNA, 17 bp, Homo sapiens
aatatcttcctttgggg

SEQ ID NO: 985205 - DNA, 18 bp, Homo sapiens
aatatcttcgttagtaat

SEQ ID NO: 985206 - DNA, 18 bp, Homo sapiens
aatatgaaaaatgtaaat

SEQ ID NO: 985207 - DNA, 20 bp, Homo sapiens
aatatgaaattccagcaata

SEQ ID NO: 985208 - DNA, 14 bp, Homo sapiens
aatatgaacaaact

SEQ ID NO: 985209 - DNA, 15 bp, Homo sapiens
aatatgaacctattt

SEQ ID NO: 985210 - DNA, 18 bp, Homo sapiens
aatatgaacctattttca

SEQ ID NO: 985211 - DNA, 16 bp, Homo sapiens
aatatgaagcctttgg

SEQ ID NO: 985212 - DNA, 13 bp, Homo sapiens
aatatgaatctat

SEQ ID NO: 985213 - DNA, 22 bp, Homo sapiens
aatatgacagctgtccctgtca

SEQ ID NO: 985214 - DNA, 17 bp, Homo sapiens
aatatgacggaagaaca

SEQ ID NO: 985215 - DNA, 21 bp, Homo sapiens
aatatgagcttcaatataaga

SEQ ID NO: 985216 - DNA, 23 bp, Homo sapiens
aatatgagcttcaatataagaag

SEQ ID NO: 985217 - DNA, 11 bp, Homo sapiens
aatatgatgac

SEQ ID NO: 985218 - DNA, 16 bp, Homo sapiens
aatatgatgacaatca

SEQ ID NO: 985219 - DNA, 21 bp, Homo sapiens
aatatgcaagcagctttttat

SEQ ID NO: 985220 - DNA, 18 bp, Homo sapiens
aatatgcacacagtgctt

SEQ ID NO: 985221 - DNA, 15 bp, Homo sapiens
aatatgcacacattt

SEQ ID NO: 985222 - DNA, 19 bp, Homo sapiens
aatatgcactttccctaga

SEQ ID NO: 985223 - DNA, 20 bp, Homo sapiens
aatatgcctagtaacacata

SEQ ID NO: 985224 - DNA, 15 bp, Homo sapiens
aatatggaacatatg

SEQ ID NO: 985225 - DNA, 18 bp, Homo sapiens
aatatggaacatatgcac

SEQ ID NO: 985226 - DNA, 21 bp, Homo sapiens
aatatggaaccttccctccaa

SEQ ID NO: 985227 - DNA, 17 bp, Homo sapiens
aatatggacacttaata

SEQ ID NO: 985228 - DNA, 15 bp, Homo sapiens
aatatggctataaat

SEQ ID NO: 985229 - DNA, 21 bp, Homo sapiens
aatatgggggccttttgggaa

SEQ ID NO: 985230 - DNA, 15 bp, Homo sapiens
aatatggttacattt

SEQ ID NO: 985231 - DNA, 16 bp, Homo sapiens
aatatgtaatacttaa

SEQ ID NO: 985232 - DNA, 18 bp, Homo sapiens
aatatgtaatacttaaat

SEQ ID NO: 985233 - DNA, 23 bp, Homo sapiens
aatatgtaatacttaaataaaca

SEQ ID NO: 985234 - DNA, 15 bp, Homo sapiens
aatatgtaatataaa

SEQ ID NO: 985235 - DNA, 18 bp, Homo sapiens
aatatgtaatataaattt

SEQ ID NO: 985236 - DNA, 19 bp, Homo sapiens
aatatgtaatttcaaaata

SEQ ID NO: 985237 - DNA, 22 bp, Homo sapiens
aatatgtaatttcaaaatacat

SEQ ID NO: 985238 - DNA, 19 bp, Homo sapiens
aatatgtatatgacattta

SEQ ID NO: 985239 - DNA, 13 bp, Homo sapiens
aatatgtatgcac

SEQ ID NO: 985240 - DNA, 22 bp, Homo sapiens
aatatgtatgcctgcaatatgg

SEQ ID NO: 985241 - DNA, 15 bp, Homo sapiens
aatatgtattgtaaa

SEQ ID NO: 985242 - DNA, 13 bp, Homo sapiens
aatatgtcctggg

SEQ ID NO: 985243 - DNA, 17 bp, Homo sapiens
aatatgtcgtagaattc

SEQ ID NO: 985244 - DNA, 12 bp, Homo sapiens
aatatgtgaaga

SEQ ID NO: 985245 - DNA, 15 bp, Homo sapiens
aatatgtgaagaaaa

SEQ ID NO: 985246 - DNA, 22 bp, Homo sapiens
aatatgttaacctcagtgtcat

SEQ ID NO: 985247 - DNA, 20 bp, Homo sapiens
aatatgttctttaaaaatat

SEQ ID NO: 985248 - DNA, 15 bp, Homo sapiens
aatatgtttagtttt

SEQ ID NO: 985249 - DNA, 16 bp, Homo sapiens
aatatgtttgtgcctt

SEQ ID NO: 985250 - DNA, 22 bp, Homo sapiens
aatatgtttgtgccttaaaagg

SEQ ID NO: 985251 - DNA, 21 bp, Homo sapiens
aatattaaaaaacttcatgta

SEQ ID NO: 985252 - DNA, 16 bp, Homo sapiens
aatattaaaatcactg

SEQ ID NO: 985253 - DNA, 13 bp, Homo sapiens
aatattaaagatt

SEQ ID NO: 985254 - DNA, 14 bp, Homo sapiens
aatattaaatacag

SEQ ID NO: 985255 - DNA, 17 bp, Homo sapiens
aatattaaatacagaca

SEQ ID NO: 985256 - DNA, 20 bp, Homo sapiens
aatattaaatacagacacta

SEQ ID NO: 985257 - DNA, 13 bp, Homo sapiens
aatattaaatctg

SEQ ID NO: 985258 - DNA, 21 bp, Homo sapiens
aatattaaatctgctggagtt

SEQ ID NO: 985259 - DNA, 13 bp, Homo sapiens
aatattaacattc

SEQ ID NO: 985260 - DNA, 22 bp, Homo sapiens
aatattaacctaatcaccatgt

SEQ ID NO: 985261 - DNA, 16 bp, Homo sapiens
aatattaacttttaat

SEQ ID NO: 985262 - DNA, 19 bp, Homo sapiens
aatattaacttttaatggt

SEQ ID NO: 985263 - DNA, 20 bp, Homo sapiens
aatattaattagtttatatt

SEQ ID NO: 985264 - DNA, 22 bp, Homo sapiens
aatattaccaactacattggaa

SEQ ID NO: 985265 - DNA, 18 bp, Homo sapiens
aatattactctagtttat

SEQ ID NO: 985266 - DNA, 15 bp, Homo sapiens
aatattagctttact

SEQ ID NO: 985267 - DNA, 19 bp, Homo sapiens
aatattagctttactgttt

SEQ ID NO: 985268 - DNA, 14 bp, Homo sapiens
aatattagtgattc

SEQ ID NO: 985269 - DNA, 20 bp, Homo sapiens
aatattagtgattctgattt

SEQ ID NO: 985270 - DNA, 20 bp, Homo sapiens
aatattagttggctttcata

SEQ ID NO: 985271 - DNA, 22 bp, Homo sapiens
aatattatactaagaaaagata

SEQ ID NO: 985272 - DNA, 11 bp, Homo sapiens
aatattattat

SEQ ID NO: 985273 - DNA, 16 bp, Homo sapiens
aatattatttgatatc

SEQ ID NO: 985274 - DNA, 16 bp, Homo sapiens
aatattcaagtaacac

SEQ ID NO: 985275 - DNA, 15 bp, Homo sapiens
aatattcagaatctt

SEQ ID NO: 985276 - DNA, 13 bp, Homo sapiens
aatattcccaagc

SEQ ID NO: 985277 - DNA, 15 bp, Homo sapiens
aatattcctgcattt

SEQ ID NO: 985278 - DNA, 13 bp, Homo sapiens
aatattcctttat

SEQ ID NO: 985279 - DNA, 18 bp, Homo sapiens
aatattctacacatgtaa

SEQ ID NO: 985280 - DNA, 21 bp, Homo sapiens
aatattctacacatgtaaaat

SEQ ID NO: 985281 - DNA, 14 bp, Homo sapiens
aatattctctattt

SEQ ID NO: 985282 - DNA, 12 bp, Homo sapiens
aatattctgttt

SEQ ID NO: 985283 - DNA, 13 bp, Homo sapiens
aatattcttttgt

SEQ ID NO: 985284 - DNA, 17 bp, Homo sapiens
aatattcttttgtttcc

SEQ ID NO: 985285 - DNA, 14 bp, Homo sapiens
aatattgaaaattg

SEQ ID NO: 985286 - DNA, 15 bp, Homo sapiens
aatattgaaaattga

SEQ ID NO: 985287 - DNA, 16 bp, Homo sapiens
aatattgaaaattgaa

SEQ ID NO: 985288 - DNA, 14 bp, Homo sapiens
aatattgaagttgt

SEQ ID NO: 985289 - DNA, 15 bp, Homo sapiens
aatattgaagttgtt

SEQ ID NO: 985290 - DNA, 17 bp, Homo sapiens
aatattgaagttgttta

SEQ ID NO: 985291 - DNA, 15 bp, Homo sapiens
aatattgacatttgt

SEQ ID NO: 985292 - DNA, 14 bp, Homo sapiens
aatattgacttgta

SEQ ID NO: 985293 - DNA, 16 bp, Homo sapiens
aatattgagaaagaaa

SEQ ID NO: 985294 - DNA, 15 bp, Homo sapiens
aatattgagaatcag

SEQ ID NO: 985295 - DNA, 14 bp, Homo sapiens
aatattgagcaata

SEQ ID NO: 985296 - DNA, 19 bp, Homo sapiens
aatattgaggctgcagcag

SEQ ID NO: 985297 - DNA, 20 bp, Homo sapiens
aatattgaggctgcagcagg

SEQ ID NO: 985298 - DNA, 17 bp, Homo sapiens
aatattgatatgcttat

SEQ ID NO: 985299 - DNA, 13 bp, Homo sapiens
aatattgcaaaat

SEQ ID NO: 985300 - DNA, 16 bp, Homo sapiens
aatattgcaaaataca

SEQ ID NO: 985301 - DNA, 20 bp, Homo sapiens
aatattgcaaaatacatgaa

SEQ ID NO: 985302 - DNA, 12 bp, Homo sapiens
aatattgctaaa

SEQ ID NO: 985303 - DNA, 19 bp, Homo sapiens
aatattggtaattaaaaga

SEQ ID NO: 985304 - DNA, 17 bp, Homo sapiens
aatattgtaaatactgg

SEQ ID NO: 985305 - DNA, 23 bp, Homo sapiens
aatattgtacagtttttattgct

SEQ ID NO: 985306 - DNA, 20 bp, Homo sapiens
aatattgtatatttttatct

SEQ ID NO: 985307 - DNA, 15 bp, Homo sapiens
aatattgtattgtta

SEQ ID NO: 985308 - DNA, 20 bp, Homo sapiens
aatattgtcatctttttcta

SEQ ID NO: 985309 - DNA, 9 bp, Homo sapiens
aatattgtg

SEQ ID NO: 985310 - DNA, 23 bp, Homo sapiens
aatattgtgaagaaaaataaagt

SEQ ID NO: 985311 - DNA, 22 bp, Homo sapiens
aatattgttgacaactgtgact

SEQ ID NO: 985312 - DNA, 14 bp, Homo sapiens
aatattgtttctgc

SEQ ID NO: 985313 - DNA, 17 bp, Homo sapiens
aatatttaaaaatgtct

SEQ ID NO: 985314 - DNA, 17 bp, Homo sapiens
aatatttaaacagcagt

SEQ ID NO: 985315 - DNA, 15 bp, Homo sapiens
aatatttaaacatgg

SEQ ID NO: 985316 - DNA, 15 bp, Homo sapiens
aatatttaaaccttt

SEQ ID NO: 985317 - DNA, 15 bp, Homo sapiens
aatatttaacttttt

SEQ ID NO: 985318 - DNA, 12 bp, Homo sapiens
aatatttaagac

SEQ ID NO: 985319 - DNA, 13 bp, Homo sapiens
aatatttaagtat

SEQ ID NO: 985320 - DNA, 13 bp, Homo sapiens
aatagtagatgtg

SEQ ID NO: 985321 - DNA, 18 bp, Homo sapiens
aatagtcattccaaatat

SEQ ID NO: 985322 - DNA, 14 bp, Homo sapiens
aatagtctagatgg

SEQ ID NO: 985323 - DNA, 13 bp, Homo sapiens
aatagtctgtgtg

SEQ ID NO: 985324 - DNA, 16 bp, Homo sapiens
aatagtctttgccagt

SEQ ID NO: 985325 - DNA, 19 bp, Homo sapiens
aatagtgcagaatctcata

SEQ ID NO: 985326 - DNA, 15 bp, Homo sapiens
aatagtgtaagaact

SEQ ID NO: 985327 - DNA, 18 bp, Homo sapiens
aatagtgtaagaactgta

SEQ ID NO: 985328 - DNA, 19 bp, Homo sapiens
aatagtgtggaaattaaga

SEQ ID NO: 985329 - DNA, 17 bp, Homo sapiens
aatagtgtgttctgatt

SEQ ID NO: 985330 - DNA, 22 bp, Homo sapiens
aatagtgtgttctgattagaaa

SEQ ID NO: 985331 - DNA, 23 bp, Homo sapiens
aatagtgtgttctgattagaaat

SEQ ID NO: 985332 - DNA, 21 bp, Homo sapiens
aatagttaagacatgatttcc

SEQ ID NO: 985333 - DNA, 18 bp, Homo sapiens
aatagttcagtagaatta

SEQ ID NO: 985334 - DNA, 15 bp, Homo sapiens
aatagttctatcctt

SEQ ID NO: 985335 - DNA, 22 bp, Homo sapiens
aatagttctatccttttgcctg

SEQ ID NO: 985336 - DNA, 19 bp, Homo sapiens
aatagttcttagctttgaa

SEQ ID NO: 985337 - DNA, 12 bp, Homo sapiens
aatagttgaatt

SEQ ID NO: 985338 - DNA, 15 bp, Homo sapiens
aatagttgaattagt

SEQ ID NO: 985339 - DNA, 14 bp, Homo sapiens
aatagttgagcccc

SEQ ID NO: 985340 - DNA, 23 bp, Homo sapiens
aatagtttaggaaaatgagagga

SEQ ID NO: 985341 - DNA, 22 bp, Homo sapiens
aatagtttgaacagatatgttt

SEQ ID NO: 985342 - DNA, 19 bp, Homo sapiens
aatagtttgtctattttaa

SEQ ID NO: 985343 - DNA, 15 bp, Homo sapiens
aatataaaaagcaga

SEQ ID NO: 985344 - DNA, 15 bp, Homo sapiens
aatataaaacagtca

SEQ ID NO: 985345 - DNA, 14 bp, Homo sapiens
aatataaaaggcaa

SEQ ID NO: 985346 - DNA, 23 bp, Homo sapiens
aatataaaaggcaaatgtgtaca

SEQ ID NO: 985347 - DNA, 14 bp, Homo sapiens
aatataaaatatga

SEQ ID NO: 985348 - DNA, 13 bp, Homo sapiens
aatataaactgaa

SEQ ID NO: 985349 - DNA, 16 bp, Homo sapiens
aatataaatagctgaa

SEQ ID NO: 985350 - DNA, 21 bp, Homo sapiens
aatataaatagctgaaaacta

SEQ ID NO: 985351 - DNA, 16 bp, Homo sapiens
aatataaatgtgtgta

SEQ ID NO: 985352 - DNA, 17 bp, Homo sapiens
aatataaattcactttc

SEQ ID NO: 985353 - DNA, 15 bp, Homo sapiens
aatataaattgtaca

SEQ ID NO: 985354 - DNA, 16 bp, Homo sapiens
aatataaatttaagca

SEQ ID NO: 985355 - DNA, 17 bp, Homo sapiens
aatataaatttaagcaa

SEQ ID NO: 985356 - DNA, 20 bp, Homo sapiens
aatataaatttaagcaaacg

SEQ ID NO: 985357 - DNA, 12 bp, Homo sapiens
aatataacatgt

SEQ ID NO: 985358 - DNA, 12 bp, Homo sapiens
aatataagaaaa

SEQ ID NO: 985359 - DNA, 20 bp, Homo sapiens
aatataagaaaagtaatgaa

SEQ ID NO: 985360 - DNA, 13 bp, Homo sapiens
aatataagaagca

SEQ ID NO: 985361 - DNA, 22 bp, Homo sapiens
aatataagaataaaatgttgaa

SEQ ID NO: 985362 - DNA, 17 bp, Homo sapiens
aatataagacatttgtt

SEQ ID NO: 985363 - DNA, 18 bp, Homo sapiens
aatataaggaaagcaata

SEQ ID NO: 985364 - DNA, 16 bp, Homo sapiens
aatataagtaaagtga

SEQ ID NO: 985365 - DNA, 17 bp, Homo sapiens
aatataagtaaagtgat

SEQ ID NO: 985366 - DNA, 22 bp, Homo sapiens
aatataagtctatactaatgct

SEQ ID NO: 985367 - DNA, 12 bp, Homo sapiens
aatataatgttg

SEQ ID NO: 985368 - DNA, 11 bp, Homo sapiens
aatataattat

SEQ ID NO: 985369 - DNA, 14 bp, Homo sapiens
aatataattatcgg

SEQ ID NO: 985370 - DNA, 20 bp, Homo sapiens
aatataattgtgtaaacaaa

SEQ ID NO: 985371 - DNA, 15 bp, Homo sapiens
aatataattgtttta

SEQ ID NO: 985372 - DNA, 12 bp, Homo sapiens
aatatacagttt

SEQ ID NO: 985373 - DNA, 23 bp, Homo sapiens
aatatacatgaagaatagaaaca

SEQ ID NO: 985374 - DNA, 20 bp, Homo sapiens
aatatacattttctaaataa

SEQ ID NO: 985375 - DNA, 20 bp, Homo sapiens
aatataccccaaattgtgta

SEQ ID NO: 985376 - DNA, 16 bp, Homo sapiens
aatatacctggtttac

SEQ ID NO: 985377 - DNA, 14 bp, Homo sapiens
aatataccttattt

SEQ ID NO: 985378 - DNA, 15 bp, Homo sapiens
aatataccttattta

SEQ ID NO: 985379 - DNA, 20 bp, Homo sapiens
aatatactcattagaattac

SEQ ID NO: 985380 - DNA, 16 bp, Homo sapiens
aatatactttttttgt

SEQ ID NO: 985381 - DNA, 13 bp, Homo sapiens
aatatagaaaaaa

SEQ ID NO: 985382 - DNA, 21 bp, Homo sapiens
aatatagaaaaaaacattcta

SEQ ID NO: 985383 - DNA, 22 bp, Homo sapiens
aatatagaaaaaaacattctat

SEQ ID NO: 985384 - DNA, 22 bp, Homo sapiens
aatatagaaagttgatattcaa

SEQ ID NO: 985385 - DNA, 18 bp, Homo sapiens
aatatagacattctcaca

SEQ ID NO: 985386 - DNA, 20 bp, Homo sapiens
aatatagagacaggacagaa

SEQ ID NO: 985387 - DNA, 15 bp, Homo sapiens
aatatagcctttaaa

SEQ ID NO: 985388 - DNA, 20 bp, Homo sapiens
aatatagctgtacaaatata

SEQ ID NO: 985389 - DNA, 16 bp, Homo sapiens
aatataggaacttaaa

SEQ ID NO: 985390 - DNA, 23 bp, Homo sapiens
aatatagtaggggttgaagaaaa

SEQ ID NO: 985391 - DNA, 13 bp, Homo sapiens
aatatataaacaa

SEQ ID NO: 985392 - DNA, 14 bp, Homo sapiens
aatatataaacact

SEQ ID NO: 985393 - DNA, 17 bp, Homo sapiens
aatatataaatatatat

SEQ ID NO: 985394 - DNA, 13 bp, Homo sapiens
aatatatacattt

SEQ ID NO: 985395 - DNA, 15 bp, Homo sapiens
aatatatacattttt

SEQ ID NO: 985396 - DNA, 22 bp, Homo sapiens
aatatatagtgggtacatcaag

SEQ ID NO: 985397 - DNA, 20 bp, Homo sapiens
aatatatatctatctatttg

SEQ ID NO: 985398 - DNA, 18 bp, Homo sapiens
aatatatatgtcaatatt

SEQ ID NO: 985399 - DNA, 23 bp, Homo sapiens
aatatatattaagtgtgccaaat

SEQ ID NO: 985400 - DNA, 18 bp, Homo sapiens
aatatatatttttcaaat

SEQ ID NO: 985401 - DNA, 16 bp, Homo sapiens
aatatatcccagaaat

SEQ ID NO: 985402 - DNA, 21 bp, Homo sapiens
aatatatcttataaagtggaa

SEQ ID NO: 985403 - DNA, 21 bp, Homo sapiens
aatatatgtctatatacacag

SEQ ID NO: 985404 - DNA, 14 bp, Homo sapiens
aatatatgtctgat

SEQ ID NO: 985405 - DNA, 13 bp, Homo sapiens
aatatatgtgaaa

SEQ ID NO: 985406 - DNA, 17 bp, Homo sapiens
aatatatgtgtgcctat

SEQ ID NO: 985407 - DNA, 22 bp, Homo sapiens
aatatatgttctgcaagaatta

SEQ ID NO: 985408 - DNA, 20 bp, Homo sapiens
aatatattaccagcaagaat

SEQ ID NO: 985409 - DNA, 23 bp, Homo sapiens
aatatattaccagcaagaataaa

SEQ ID NO: 985410 - DNA, 16 bp, Homo sapiens
aatatattataatctt

SEQ ID NO: 985411 - DNA, 14 bp, Homo sapiens
aatatattatatat

SEQ ID NO: 985412 - DNA, 13 bp, Homo sapiens
aatatattgaact

SEQ ID NO: 985413 - DNA, 18 bp, Homo sapiens
aatatattgaacttttgt

SEQ ID NO: 985414 - DNA, 20 bp, Homo sapiens
aatatattgaacttttgtac

SEQ ID NO: 985415 - DNA, 14 bp, Homo sapiens
aatatattgaataa

SEQ ID NO: 985416 - DNA, 16 bp, Homo sapiens
aatatattgaataaaa

SEQ ID NO: 985417 - DNA, 11 bp, Homo sapiens
aatatattgta

SEQ ID NO: 985418 - DNA, 20 bp, Homo sapiens
aatatattgtacaaatgtaa

SEQ ID NO: 985419 - DNA, 14 bp, Homo sapiens
aatatatttaaaaa

SEQ ID NO: 985420 - DNA, 16 bp, Homo sapiens
aatatatttaaaaata

SEQ ID NO: 985421 - DNA, 14 bp, Homo sapiens
aatatatttaatat

SEQ ID NO: 985422 - DNA, 15 bp, Homo sapiens
aatatatttaatata

SEQ ID NO: 985423 - DNA, 21 bp, Homo sapiens
aatatatttataaggaaattt

SEQ ID NO: 985424 - DNA, 15 bp, Homo sapiens
aatatatttcagata

SEQ ID NO: 985425 - DNA, 14 bp, Homo sapiens
aatatatttcttct

SEQ ID NO: 985426 - DNA, 13 bp, Homo sapiens
aatatatttgtgt

SEQ ID NO: 985427 - DNA, 21 bp, Homo sapiens
aatatatttgtgtatttaaca

SEQ ID NO: 985428 - DNA, 24 bp, Homo sapiens
aatatatttgtgtatttaacaggg

SEQ ID NO: 985429 - DNA, 24 bp, Homo sapiens
aatatcaaagagaagatgcctgtt

SEQ ID NO: 985430 - DNA, 21 bp, Homo sapiens
aatatcaaagtcattaaagac

SEQ ID NO: 985431 - DNA, 13 bp, Homo sapiens
aatatcactcatt

SEQ ID NO: 985432 - DNA, 22 bp, Homo sapiens
aatatcagacaagcactatttt

SEQ ID NO: 985433 - DNA, 19 bp, Homo sapiens
aatatcatgtcttgtgcat

SEQ ID NO: 985434 - DNA, 14 bp, Homo sapiens
aatatccaaagact

SEQ ID NO: 985435 - DNA, 20 bp, Homo sapiens
aatatccaaagactgtactg

SEQ ID NO: 985436 - DNA, 16 bp, Homo sapiens
aatatcccaacattct

SEQ ID NO: 985437 - DNA, 19 bp, Homo sapiens
aatatcccagagaacaatc

SEQ ID NO: 985438 - DNA, 20 bp, Homo sapiens
aatatccctcccctctctcc

SEQ ID NO: 985439 - DNA, 14 bp, Homo sapiens
aatatcctgtaact

SEQ ID NO: 985440 - DNA, 15 bp, Homo sapiens
aatatcctgtaataa

SEQ ID NO: 985441 - DNA, 14 bp, Homo sapiens
aatatcctgtgtaa

SEQ ID NO: 985442 - DNA, 21 bp, Homo sapiens
aatatcggatgggtgtgggag

SEQ ID NO: 985443 - DNA, 16 bp, Homo sapiens
aatatcgttagggtga

SEQ ID NO: 985444 - DNA, 16 bp, Homo sapiens
aatatctaaagttata

SEQ ID NO: 985445 - DNA, 23 bp, Homo sapiens
aatacccccgtcggaatggtaac

SEQ ID NO: 985446 - DNA, 15 bp, Homo sapiens
aataccctactgtgg

SEQ ID NO: 985447 - DNA, 21 bp, Homo sapiens
aataccctagaagaaaacccg

SEQ ID NO: 985448 - DNA, 15 bp, Homo sapiens
aataccgctcagtat

SEQ ID NO: 985449 - DNA, 16 bp, Homo sapiens
aatacgaagccctctt

SEQ ID NO: 985450 - DNA, 14 bp, Homo sapiens
aatacgtattacaa

SEQ ID NO: 985451 - DNA, 18 bp, Homo sapiens
aatacgtgccagatataa

SEQ ID NO: 985452 - DNA, 16 bp, Homo sapiens
aatactaaaactcaga

SEQ ID NO: 985453 - DNA, 15 bp, Homo sapiens
aatactactcctgta

SEQ ID NO: 985454 - DNA, 22 bp, Homo sapiens
aatactatccatgtaataagca

SEQ ID NO: 985455 - DNA, 18 bp, Homo sapiens
aatactatgcagtatctc

SEQ ID NO: 985456 - DNA, 21 bp, Homo sapiens
aatactatgcagtatctctta

SEQ ID NO: 985457 - DNA, 19 bp, Homo sapiens
aatactcatgaatgaaaat

SEQ ID NO: 985458 - DNA, 15 bp, Homo sapiens
aatactccagagaca

SEQ ID NO: 985459 - DNA, 19 bp, Homo sapiens
aatactccctttaaagaga

SEQ ID NO: 985460 - DNA, 12 bp, Homo sapiens
aatactctattt

SEQ ID NO: 985461 - DNA, 17 bp, Homo sapiens
aatactctatttttaca

SEQ ID NO: 985462 - DNA, 13 bp, Homo sapiens
aatactctgccct

SEQ ID NO: 985463 - DNA, 22 bp, Homo sapiens
aatactctgttgtactatggaa

SEQ ID NO: 985464 - DNA, 20 bp, Homo sapiens
aatactggactcaggaactt

SEQ ID NO: 985465 - DNA, 18 bp, Homo sapiens
aatactgggttcttagtt

SEQ ID NO: 985466 - DNA, 11 bp, Homo sapiens
aatactggtct

SEQ ID NO: 985467 - DNA, 15 bp, Homo sapiens
aatactggtctcagg

SEQ ID NO: 985468 - DNA, 19 bp, Homo sapiens
aatactgtatgccttctgt

SEQ ID NO: 985469 - DNA, 22 bp, Homo sapiens
aatactgtgcagaataatggaa

SEQ ID NO: 985470 - DNA, 15 bp, Homo sapiens
aatactgttctatac

SEQ ID NO: 985471 - DNA, 18 bp, Homo sapiens
aatacttaaaaatagtct

SEQ ID NO: 985472 - DNA, 15 bp, Homo sapiens
aatacttccagaagt

SEQ ID NO: 985473 - DNA, 14 bp, Homo sapiens
aatacttctcattt

SEQ ID NO: 985474 - DNA, 16 bp, Homo sapiens
aatacttctcattttt

SEQ ID NO: 985475 - DNA, 18 bp, Homo sapiens
aatacttgacctctgtga

SEQ ID NO: 985476 - DNA, 17 bp, Homo sapiens
aatacttgactcagtga

SEQ ID NO: 985477 - DNA, 15 bp, Homo sapiens
aatacttgcagttgt

SEQ ID NO: 985478 - DNA, 18 bp, Homo sapiens
aatactttgcataaatta

SEQ ID NO: 985479 - DNA, 19 bp, Homo sapiens
aatactttgcataaattaa

SEQ ID NO: 985480 - DNA, 20 bp, Homo sapiens
aatactttgcataaattaat

SEQ ID NO: 985481 - DNA, 22 bp, Homo sapiens
aatactttgtcctaagagattt

SEQ ID NO: 985482 - DNA, 15 bp, Homo sapiens
aatacttttactctg

SEQ ID NO: 985483 - DNA, 21 bp, Homo sapiens
aatacttttgtccaatgtggt

SEQ ID NO: 985484 - DNA, 16 bp, Homo sapiens
aatactttttctaatg

SEQ ID NO: 985485 - DNA, 17 bp, Homo sapiens
aatagaaaaaaagtatt

SEQ ID NO: 985486 - DNA, 17 bp, Homo sapiens
aatagaaaactgaaaat

SEQ ID NO: 985487 - DNA, 19 bp, Homo sapiens
aatagaaaactgaaaatct

SEQ ID NO: 985488 - DNA, 14 bp, Homo sapiens
aatagaaaagttat

SEQ ID NO: 985489 - DNA, 13 bp, Homo sapiens
aatagaaaatggt

SEQ ID NO: 985490 - DNA, 15 bp, Homo sapiens
aatagaaaatggtcc

SEQ ID NO: 985491 - DNA, 13 bp, Homo sapiens
aatagaaactcac

SEQ ID NO: 985492 - DNA, 19 bp, Homo sapiens
aatagaaagttgcaaggca

SEQ ID NO: 985493 - DNA, 20 bp, Homo sapiens
aatagaaataaattcctaaa

SEQ ID NO: 985494 - DNA, 18 bp, Homo sapiens
aatagaaattttgtaaga

SEQ ID NO: 985495 - DNA, 21 bp, Homo sapiens
aatagaacactgcctctgagt

SEQ ID NO: 985496 - DNA, 14 bp, Homo sapiens
aatagaactatctg

SEQ ID NO: 985497 - DNA, 17 bp, Homo sapiens
aatagaactatctgcat

SEQ ID NO: 985498 - DNA, 16 bp, Homo sapiens
aatagaacttgccttt

SEQ ID NO: 985499 - DNA, 20 bp, Homo sapiens
aatagaaggatgtacatttc

SEQ ID NO: 985500 - DNA, 13 bp, Homo sapiens
aatagaaggtgat

SEQ ID NO: 985501 - DNA, 14 bp, Homo sapiens
aatagaaggtgatg

SEQ ID NO: 985502 - DNA, 19 bp, Homo sapiens
aatagaagttttcctgata

SEQ ID NO: 985503 - DNA, 16 bp, Homo sapiens
aatagaataaaggcag

SEQ ID NO: 985504 - DNA, 17 bp, Homo sapiens
aatagaataatctatta

SEQ ID NO: 985505 - DNA, 17 bp, Homo sapiens
aatagaatataattatc

SEQ ID NO: 985506 - DNA, 18 bp, Homo sapiens
aatagacaatttattatg

SEQ ID NO: 985507 - DNA, 23 bp, Homo sapiens
aatagacaatttattatggcaca

SEQ ID NO: 985508 - DNA, 16 bp, Homo sapiens
aatagacagtaaaata

SEQ ID NO: 985509 - DNA, 20 bp, Homo sapiens
aatagacagtatatttatag

SEQ ID NO: 985510 - DNA, 15 bp, Homo sapiens
aatagacatcaaact

SEQ ID NO: 985511 - DNA, 16 bp, Homo sapiens
aatagacttctcttac

SEQ ID NO: 985512 - DNA, 16 bp, Homo sapiens
aatagagcaaaatcaa

SEQ ID NO: 985513 - DNA, 18 bp, Homo sapiens
aatagagccaactgattt

SEQ ID NO: 985514 - DNA, 16 bp, Homo sapiens
aatagagcctgaggga

SEQ ID NO: 985515 - DNA, 13 bp, Homo sapiens
aatagagctgcca

SEQ ID NO: 985516 - DNA, 22 bp, Homo sapiens
aatagaggtgatgctgctaaag

SEQ ID NO: 985517 - DNA, 17 bp, Homo sapiens
aatagagtatatgcact

SEQ ID NO: 985518 - DNA, 13 bp, Homo sapiens
aatagatatataa

SEQ ID NO: 985519 - DNA, 14 bp, Homo sapiens
aatagatctgaata

SEQ ID NO: 985520 - DNA, 21 bp, Homo sapiens
aatagattactgatgtgatat

SEQ ID NO: 985521 - DNA, 19 bp, Homo sapiens
aatagattgctcaaatcag

SEQ ID NO: 985522 - DNA, 18 bp, Homo sapiens
aatagattttctctggaa

SEQ ID NO: 985523 - DNA, 13 bp, Homo sapiens
aatagcaaaagaa

SEQ ID NO: 985524 - DNA, 20 bp, Homo sapiens
aatagcaaaagaagaagttt

SEQ ID NO: 985525 - DNA, 14 bp, Homo sapiens
aatagcaaagaatt

SEQ ID NO: 985526 - DNA, 19 bp, Homo sapiens
aatagcaacttttgtgtaa

SEQ ID NO: 985527 - DNA, 20 bp, Homo sapiens
aatagcaagagtgtgaaatc

SEQ ID NO: 985528 - DNA, 19 bp, Homo sapiens
aatagcatactgtgtatgt

SEQ ID NO: 985529 - DNA, 19 bp, Homo sapiens
aatagcatgacaggctgtt

SEQ ID NO: 985530 - DNA, 20 bp, Homo sapiens
aatagccacatttggaatac

SEQ ID NO: 985531 - DNA, 20 bp, Homo sapiens
aatagccactaaccttgcct

SEQ ID NO: 985532 - DNA, 21 bp, Homo sapiens
aatagccactaaccttgcctg

SEQ ID NO: 985533 - DNA, 16 bp, Homo sapiens
aatagccccagactgg

SEQ ID NO: 985534 - DNA, 11 bp, Homo sapiens
aatagcctaaa

SEQ ID NO: 985535 - DNA, 20 bp, Homo sapiens
aatagcctgcctcttctcta

SEQ ID NO: 985536 - DNA, 12 bp, Homo sapiens
aatagcctggcc

SEQ ID NO: 985537 - DNA, 15 bp, Homo sapiens
aatagcgttcttgta

SEQ ID NO: 985538 - DNA, 16 bp, Homo sapiens
aatagcgttcttgtaa

SEQ ID NO: 985539 - DNA, 18 bp, Homo sapiens
aatagcgttcttgtaatt

SEQ ID NO: 985540 - DNA, 16 bp, Homo sapiens
aatagctacagtgcat

SEQ ID NO: 985541 - DNA, 17 bp, Homo sapiens
aatagctatatccatgt

SEQ ID NO: 985542 - DNA, 15 bp, Homo sapiens
aatagctgtagtttt

SEQ ID NO: 985543 - DNA, 19 bp, Homo sapiens
aatagctgttttgtgtata

SEQ ID NO: 985544 - DNA, 21 bp, Homo sapiens
aatagctttaccctcaggcat

SEQ ID NO: 985545 - DNA, 20 bp, Homo sapiens
aatagctttactgtttctca

SEQ ID NO: 985546 - DNA, 23 bp, Homo sapiens
aatagctttactgtttctcaagt

SEQ ID NO: 985547 - DNA, 11 bp, Homo sapiens
aataggaaaac

SEQ ID NO: 985548 - DNA, 11 bp, Homo sapiens
aataggaataa

SEQ ID NO: 985549 - DNA, 10 bp, Homo sapiens
aataggaatt

SEQ ID NO: 985550 - DNA, 15 bp, Homo sapiens
aataggaccagagcg

SEQ ID NO: 985551 - DNA, 23 bp, Homo sapiens
aataggaccagagcggtatctct

SEQ ID NO: 985552 - DNA, 19 bp, Homo sapiens
aataggagggaaacctttg

SEQ ID NO: 985553 - DNA, 16 bp, Homo sapiens
aataggatcctggagg

SEQ ID NO: 985554 - DNA, 15 bp, Homo sapiens
aataggcactttaaa

SEQ ID NO: 985555 - DNA, 18 bp, Homo sapiens
aatagggagacagggtag

SEQ ID NO: 985556 - DNA, 16 bp, Homo sapiens
aataggggatatttaa

SEQ ID NO: 985557 - DNA, 17 bp, Homo sapiens
aatagggtagaatgatt

SEQ ID NO: 985558 - DNA, 19 bp, Homo sapiens
aatagggtagaatgattaa

SEQ ID NO: 985559 - DNA, 23 bp, Homo sapiens
aatagggtagaatgattaatcaa

SEQ ID NO: 985560 - DNA, 20 bp, Homo sapiens
aataggtagcctgctgtggg

SEQ ID NO: 985561 - DNA, 21 bp, Homo sapiens
aataggtagcctgctgtgggg

SEQ ID NO: 985562 - DNA, 22 bp, Homo sapiens
aataggtagcctgctgtggggt

SEQ ID NO: 985563 - DNA, 19 bp, Homo sapiens
aataggtagggggctttca

SEQ ID NO: 985564 - DNA, 14 bp, Homo sapiens
aataggtagtttgg

SEQ ID NO: 985565 - DNA, 21 bp, Homo sapiens
aataggtagtttggatatttt

SEQ ID NO: 985566 - DNA, 16 bp, Homo sapiens
aataggtgtgatttcc

SEQ ID NO: 985567 - DNA, 22 bp, Homo sapiens
aatagtaaaagataacaagatc

SEQ ID NO: 985568 - DNA, 15 bp, Homo sapiens
aatagtaaacattaa

SEQ ID NO: 985569 - DNA, 13 bp, Homo sapiens
aatagtaatgttt

SEQ ID NO: 985570 - DNA, 16 bp, Homo sapiens
aataaggcacccatct

SEQ ID NO: 985571 - DNA, 18 bp, Homo sapiens
aataaggcacccatctgt

SEQ ID NO: 985572 - DNA, 19 bp, Homo sapiens
aataaggtgtggtctgttt

SEQ ID NO: 985573 - DNA, 16 bp, Homo sapiens
aataagtatttataat

SEQ ID NO: 985574 - DNA, 15 bp, Homo sapiens
aataagtcaacagta

SEQ ID NO: 985575 - DNA, 12 bp, Homo sapiens
aataagtctgat

SEQ ID NO: 985576 - DNA, 21 bp, Homo sapiens
aataagtgtgtggtagaaaca

SEQ ID NO: 985577 - DNA, 23 bp, Homo sapiens
aataagtgtgtggtagaaacaaa

SEQ ID NO: 985578 - DNA, 13 bp, Homo sapiens
aataagttattgc

SEQ ID NO: 985579 - DNA, 18 bp, Homo sapiens
aataagttattgcagttt

SEQ ID NO: 985580 - DNA, 13 bp, Homo sapiens
aataagtttgtgt

SEQ ID NO: 985581 - DNA, 14 bp, Homo sapiens
aataagttttgata

SEQ ID NO: 985582 - DNA, 15 bp, Homo sapiens
aataagttttgatat

SEQ ID NO: 985583 - DNA, 18 bp, Homo sapiens
aataagttttgatataat

SEQ ID NO: 985584 - DNA, 15 bp, Homo sapiens
aataataaaatgcaa

SEQ ID NO: 985585 - DNA, 12 bp, Homo sapiens
aataataaagaa

SEQ ID NO: 985586 - DNA, 18 bp, Homo sapiens
aataataaagatgctctt

SEQ ID NO: 985587 - DNA, 21 bp, Homo sapiens
aataataaagtagcaaaacaa

SEQ ID NO: 985588 - DNA, 17 bp, Homo sapiens
aataataaattcatcag

SEQ ID NO: 985589 - DNA, 18 bp, Homo sapiens
aataataaattcatcaga

SEQ ID NO: 985590 - DNA, 14 bp, Homo sapiens
aataataataaagt

SEQ ID NO: 985591 - DNA, 13 bp, Homo sapiens
aataatagactgt

SEQ ID NO: 985592 - DNA, 14 bp, Homo sapiens
aataatagactgta

SEQ ID NO: 985593 - DNA, 22 bp, Homo sapiens
aataataggtagggggctttca

SEQ ID NO: 985594 - DNA, 11 bp, Homo sapiens
aataatatgca

SEQ ID NO: 985595 - DNA, 13 bp, Homo sapiens
aataatatgcatt

SEQ ID NO: 985596 - DNA, 11 bp, Homo sapiens
aataatcaaga

SEQ ID NO: 985597 - DNA, 15 bp, Homo sapiens
aataatcacattgac

SEQ ID NO: 985598 - DNA, 20 bp, Homo sapiens
aataatcattctttcccctc

SEQ ID NO: 985599 - DNA, 20 bp, Homo sapiens
aataatccattccaaaatac

SEQ ID NO: 985600 - DNA, 13 bp, Homo sapiens
aataatcggccca

SEQ ID NO: 985601 - DNA, 14 bp, Homo sapiens
aataatctatatta

SEQ ID NO: 985602 - DNA, 20 bp, Homo sapiens
aataatctcatccccccacc

SEQ ID NO: 985603 - DNA, 12 bp, Homo sapiens
aataatgaagta

SEQ ID NO: 985604 - DNA, 16 bp, Homo sapiens
aataatgaataaactg

SEQ ID NO: 985605 - DNA, 22 bp, Homo sapiens
aataatggaaaaatagtaaaca

SEQ ID NO: 985606 - DNA, 18 bp, Homo sapiens
aataatggagaatcactt

SEQ ID NO: 985607 - DNA, 15 bp, Homo sapiens
aataatgtattgtaa

SEQ ID NO: 985608 - DNA, 16 bp, Homo sapiens
aataatgtgaaactgg

SEQ ID NO: 985609 - DNA, 17 bp, Homo sapiens
aataatgtgaaactgga

SEQ ID NO: 985610 - DNA, 23 bp, Homo sapiens
aataatgtgcaaatctgacaata

SEQ ID NO: 985611 - DNA, 18 bp, Homo sapiens
aataatgtgcaaattttg

SEQ ID NO: 985612 - DNA, 18 bp, Homo sapiens
aataattatccagagttt

SEQ ID NO: 985613 - DNA, 16 bp, Homo sapiens
aataattatttattac

SEQ ID NO: 985614 - DNA, 18 bp, Homo sapiens
aataattatttatttaat

SEQ ID NO: 985615 - DNA, 19 bp, Homo sapiens
aataattctgagttttgtg

SEQ ID NO: 985616 - DNA, 16 bp, Homo sapiens
aataattcttttctga

SEQ ID NO: 985617 - DNA, 17 bp, Homo sapiens
aataattcttttctgag

SEQ ID NO: 985618 - DNA, 14 bp, Homo sapiens
aataattggttctt

SEQ ID NO: 985619 - DNA, 17 bp, Homo sapiens
aataattgttgtgtgta

SEQ ID NO: 985620 - DNA, 13 bp, Homo sapiens
aataattgtttcc

SEQ ID NO: 985621 - DNA, 12 bp, Homo sapiens
aataatttagac

SEQ ID NO: 985622 - DNA, 15 bp, Homo sapiens
aataatttctctaca

SEQ ID NO: 985623 - DNA, 10 bp, Homo sapiens
aataatttga

SEQ ID NO: 985624 - DNA, 14 bp, Homo sapiens
aataatttgcactg

SEQ ID NO: 985625 - DNA, 14 bp, Homo sapiens
aataatttgtaaat

SEQ ID NO: 985626 - DNA, 23 bp, Homo sapiens
aataatttgtaaatgattttaat

SEQ ID NO: 985627 - DNA, 19 bp, Homo sapiens
aataatttgtgtctgtgtt

SEQ ID NO: 985628 - DNA, 17 bp, Homo sapiens
aataattttctaagaca

SEQ ID NO: 985629 - DNA, 21 bp, Homo sapiens
aatacaaaaaattagccgggc

SEQ ID NO: 985630 - DNA, 14 bp, Homo sapiens
aatacaaaaagtaa

SEQ ID NO: 985631 - DNA, 17 bp, Homo sapiens
aatacaaaaattagctg

SEQ ID NO: 985632 - DNA, 23 bp, Homo sapiens
aatacaaaaggcattttatatga

SEQ ID NO: 985633 - DNA, 17 bp, Homo sapiens
aatacaaaattataaag

SEQ ID NO: 985634 - DNA, 13 bp, Homo sapiens
aatacaaagatga

SEQ ID NO: 985635 - DNA, 14 bp, Homo sapiens
aatacaaagatgac

SEQ ID NO: 985636 - DNA, 18 bp, Homo sapiens
aatacaaagtggaaactt

SEQ ID NO: 985637 - DNA, 18 bp, Homo sapiens
aatacaaatggattttgg

SEQ ID NO: 985638 - DNA, 14 bp, Homo sapiens
aatacaaattttgt

SEQ ID NO: 985639 - DNA, 22 bp, Homo sapiens
aatacaacatgtagctgagttt

SEQ ID NO: 985640 - DNA, 18 bp, Homo sapiens
aatacaacttaaataata

SEQ ID NO: 985641 - DNA, 16 bp, Homo sapiens
aatacaactttaccat

SEQ ID NO: 985642 - DNA, 12 bp, Homo sapiens
aatacaatgtac

SEQ ID NO: 985643 - DNA, 15 bp, Homo sapiens
aatacaatgtacaat

SEQ ID NO: 985644 - DNA, 16 bp, Homo sapiens
aatacaatgtacaatt

SEQ ID NO: 985645 - DNA, 18 bp, Homo sapiens
aatacaatgtacaattat

SEQ ID NO: 985646 - DNA, 13 bp, Homo sapiens
aatacaattaaag

SEQ ID NO: 985647 - DNA, 14 bp, Homo sapiens
aatacaattaaagg

SEQ ID NO: 985648 - DNA, 21 bp, Homo sapiens
aatacacagtactttattgta

SEQ ID NO: 985649 - DNA, 20 bp, Homo sapiens
aatacaccacctcactcctg

SEQ ID NO: 985650 - DNA, 22 bp, Homo sapiens
aatacaccacctcactcctgtt

SEQ ID NO: 985651 - DNA, 15 bp, Homo sapiens
aatacaccactacat

SEQ ID NO: 985652 - DNA, 21 bp, Homo sapiens
aatacacgcgtgtgctcctct

SEQ ID NO: 985653 - DNA, 16 bp, Homo sapiens
aatacactagttgttt

SEQ ID NO: 985654 - DNA, 19 bp, Homo sapiens
aatacactgaattgaatct

SEQ ID NO: 985655 - DNA, 14 bp, Homo sapiens
aatacacttctttt

SEQ ID NO: 985656 - DNA, 19 bp, Homo sapiens
aatacagaaattagccggg

SEQ ID NO: 985657 - DNA, 15 bp, Homo sapiens
aatacagacactaag

SEQ ID NO: 985658 - DNA, 20 bp, Homo sapiens
aatacagacactaagttata

SEQ ID NO: 985659 - DNA, 17 bp, Homo sapiens
aatacagcatacttcaa

SEQ ID NO: 985660 - DNA, 16 bp, Homo sapiens
aatacagctggctatc

SEQ ID NO: 985661 - DNA, 16 bp, Homo sapiens
aatacaggaaacagtt

SEQ ID NO: 985662 - DNA, 23 bp, Homo sapiens
aatacaggaaacagttgcatgta

SEQ ID NO: 985663 - DNA, 16 bp, Homo sapiens
aatacagggcatgcat

SEQ ID NO: 985664 - DNA, 16 bp, Homo sapiens
aatacagggcattttg

SEQ ID NO: 985665 - DNA, 19 bp, Homo sapiens
aatacagtaagctgctcta

SEQ ID NO: 985666 - DNA, 20 bp, Homo sapiens
aatacagtatctcagggcct

SEQ ID NO: 985667 - DNA, 18 bp, Homo sapiens
aatacagtcttccacaaa

SEQ ID NO: 985668 - DNA, 21 bp, Homo sapiens
aatacagtcttccacaaagaa

SEQ ID NO: 985669 - DNA, 15 bp, Homo sapiens
aatacagtgagctct

SEQ ID NO: 985670 - DNA, 15 bp, Homo sapiens
aatacatacggtcag

SEQ ID NO: 985671 - DNA, 18 bp, Homo sapiens
aatacatatggatgttac

SEQ ID NO: 985672 - DNA, 17 bp, Homo sapiens
aatacatgaagcttcat

SEQ ID NO: 985673 - DNA, 23 bp, Homo sapiens
aatacatgacatttatttttcat

SEQ ID NO: 985674 - DNA, 17 bp, Homo sapiens
aatacatgagaaagatg

SEQ ID NO: 985675 - DNA, 20 bp, Homo sapiens
aatacatgcaacagaagtga

SEQ ID NO: 985676 - DNA, 13 bp, Homo sapiens
aatacatgcatct

SEQ ID NO: 985677 - DNA, 23 bp, Homo sapiens
aatacatgctaagagaagtagaa

SEQ ID NO: 985678 - DNA, 14 bp, Homo sapiens
aatacatgctgcta

SEQ ID NO: 985679 - DNA, 22 bp, Homo sapiens
aatacatgtaagtgtggttttg

SEQ ID NO: 985680 - DNA, 19 bp, Homo sapiens
aatacattaacggtgctaa

SEQ ID NO: 985681 - DNA, 12 bp, Homo sapiens
aatacattcttg

SEQ ID NO: 985682 - DNA, 19 bp, Homo sapiens
aatacattgatacaaagta

SEQ ID NO: 985683 - DNA, 17 bp, Homo sapiens
aatacatttaaaacatt

SEQ ID NO: 985684 - DNA, 12 bp, Homo sapiens
aatacatttgta

SEQ ID NO: 985685 - DNA, 21 bp, Homo sapiens
aataccaaatgcctgttgtat

SEQ ID NO: 985686 - DNA, 20 bp, Homo sapiens
aataccacagctatttagaa

SEQ ID NO: 985687 - DNA, 22 bp, Homo sapiens
aataccaccatttaaaaatgtt

SEQ ID NO: 985688 - DNA, 19 bp, Homo sapiens
aataccactctgtaattgc

SEQ ID NO: 985689 - DNA, 21 bp, Homo sapiens
aataccactctgtaattgcaa

SEQ ID NO: 985690 - DNA, 18 bp, Homo sapiens
aataccattaaaactgct

SEQ ID NO: 985691 - DNA, 15 bp, Homo sapiens
aataccattgaaatc

SEQ ID NO: 985692 - DNA, 16 bp, Homo sapiens
aataccattgaaatca

SEQ ID NO: 985693 - DNA, 22 bp, Homo sapiens
aataccattttttaaggaaaca

SEQ ID NO: 985694 - DNA, 23 bp, Homo sapiens
aataccattttttaaggaaacaa

SEQ ID NO: 985695 - DNA, 15 bp, Homo sapiens
acactcctgggctct

SEQ ID NO: 985696 - DNA, 20 bp, Homo sapiens
acactcctgggctctgaaca

SEQ ID NO: 985697 - DNA, 16 bp, Homo sapiens
acactctaactgtata

SEQ ID NO: 985698 - DNA, 22 bp, Homo sapiens
acactctagtgacttcctggtg

SEQ ID NO: 985699 - DNA, 23 bp, Homo sapiens
acactctagtgacttcctggtga

SEQ ID NO: 985700 - DNA, 22 bp, Homo sapiens
acactctatatgtagtgcattt

SEQ ID NO: 985701 - DNA, 20 bp, Homo sapiens
acactctctgcagcccagcc

SEQ ID NO: 985702 - DNA, 23 bp, Homo sapiens
acactctctggaagccctggaga

SEQ ID NO: 985703 - DNA, 17 bp, Homo sapiens
acactctgctgtttgac

SEQ ID NO: 985704 - DNA, 20 bp, Homo sapiens
acactcttcttgagcagacc

SEQ ID NO: 985705 - DNA, 15 bp, Homo sapiens
acactgaaaccaaaa

SEQ ID NO: 985706 - DNA, 17 bp, Homo sapiens
acactgaaaccaaaaca

SEQ ID NO: 985707 - DNA, 19 bp, Homo sapiens
acactgaaaccaaaacata

SEQ ID NO: 985708 - DNA, 13 bp, Homo sapiens
acactgaaagttt

SEQ ID NO: 985709 - DNA, 20 bp, Homo sapiens
acactgaaagttttgtaaaa

SEQ ID NO: 985710 - DNA, 18 bp, Homo sapiens
acactgaagtgcttgcag

SEQ ID NO: 985711 - DNA, 22 bp, Homo sapiens
acactgacaaagtcatcccctc

SEQ ID NO: 985712 - DNA, 13 bp, Homo sapiens
acactgacttgag

SEQ ID NO: 985713 - DNA, 14 bp, Homo sapiens
acactgaggactgt

SEQ ID NO: 985714 - DNA, 21 bp, Homo sapiens
acactgaggcttaggcctctc

SEQ ID NO: 985715 - DNA, 18 bp, Homo sapiens
acactgatacataaaaat

SEQ ID NO: 985716 - DNA, 21 bp, Homo sapiens
acactgatgagtttcactgta

SEQ ID NO: 985717 - DNA, 15 bp, Homo sapiens
acactgatggctcaa

SEQ ID NO: 985718 - DNA, 17 bp, Homo sapiens
acactgatggctcaaga

SEQ ID NO: 985719 - DNA, 22 bp, Homo sapiens
acactgatggctcaagacaagg

SEQ ID NO: 985720 - DNA, 22 bp, Homo sapiens
acactgcacacagtgacttcct

SEQ ID NO: 985721 - DNA, 11 bp, Homo sapiens
acactgcacag

SEQ ID NO: 985722 - DNA, 18 bp, Homo sapiens
acactgcactttgtttag

SEQ ID NO: 985723 - DNA, 20 bp, Homo sapiens
acactgcactttgtttagaa

SEQ ID NO: 985724 - DNA, 22 bp, Homo sapiens
acactgcagagactaatgttgg

SEQ ID NO: 985725 - DNA, 17 bp, Homo sapiens
acactgcagtttcctgg

SEQ ID NO: 985726 - DNA, 14 bp, Homo sapiens
acactgccaagagc

SEQ ID NO: 985727 - DNA, 15 bp, Homo sapiens
acactgccagaagag

SEQ ID NO: 985728 - DNA, 23 bp, Homo sapiens
acactgccagaagagaattcagt

SEQ ID NO: 985729 - DNA, 14 bp, Homo sapiens
acactgcctctgag

SEQ ID NO: 985730 - DNA, 18 bp, Homo sapiens
acactgccttagcctctt

SEQ ID NO: 985731 - DNA, 17 bp, Homo sapiens
acactgctctaacagcc

SEQ ID NO: 985732 - DNA, 15 bp, Homo sapiens
acactgctcttaaga

SEQ ID NO: 985733 - DNA, 11 bp, Homo sapiens
acactgctgca

SEQ ID NO: 985734 - DNA, 13 bp, Homo sapiens
acactgctgcacc

SEQ ID NO: 985735 - DNA, 14 bp, Homo sapiens
acactgctgcacca

SEQ ID NO: 985736 - DNA, 17 bp, Homo sapiens
acactgctgtcctctcc

SEQ ID NO: 985737 - DNA, 22 bp, Homo sapiens
acactgctgtcctctccccctt

SEQ ID NO: 985738 - DNA, 14 bp, Homo sapiens
acactgctgttaaa

SEQ ID NO: 985739 - DNA, 16 bp, Homo sapiens
acactgctgttaaaga

SEQ ID NO: 985740 - DNA, 21 bp, Homo sapiens
acactgcttctcggccagccc

SEQ ID NO: 985741 - DNA, 19 bp, Homo sapiens
acactggaacatggctagc

SEQ ID NO: 985742 - DNA, 23 bp, Homo sapiens
acactggaatataaaacagtcat

SEQ ID NO: 985743 - DNA, 11 bp, Homo sapiens
acactggaccc

SEQ ID NO: 985744 - DNA, 16 bp, Homo sapiens
acactggacctttggg

SEQ ID NO: 985745 - DNA, 16 bp, Homo sapiens
acactggactccggcc

SEQ ID NO: 985746 - DNA, 19 bp, Homo sapiens
acactggaggagagaagaa

SEQ ID NO: 985747 - DNA, 20 bp, Homo sapiens
acactggaggagagaagaat

SEQ ID NO: 985748 - DNA, 21 bp, Homo sapiens
acactggaggagagaagaatg

SEQ ID NO: 985749 - DNA, 13 bp, Homo sapiens
acactggccccta

SEQ ID NO: 985750 - DNA, 20 bp, Homo sapiens
acactggcttgaaggactgc

SEQ ID NO: 985751 - DNA, 18 bp, Homo sapiens
acactgggcagcaaggct

SEQ ID NO: 985752 - DNA, 15 bp, Homo sapiens
acactgggggagggg

SEQ ID NO: 985753 - DNA, 13 bp, Homo sapiens
acactgggtggtg

SEQ ID NO: 985754 - DNA, 20 bp, Homo sapiens
acactgggtggtggcctggt

SEQ ID NO: 985755 - DNA, 17 bp, Homo sapiens
acactggtatttatatt

SEQ ID NO: 985756 - DNA, 16 bp, Homo sapiens
acactggtctgctgtc

SEQ ID NO: 985757 - DNA, 15 bp, Homo sapiens
acactggtgtgtccc

SEQ ID NO: 985758 - DNA, 19 bp, Homo sapiens
acactggttctcaatgaaa

SEQ ID NO: 985759 - DNA, 14 bp, Homo sapiens
acactgtaatctta

SEQ ID NO: 985760 - DNA, 19 bp, Homo sapiens
acactgtagtttttgaaaa

SEQ ID NO: 985761 - DNA, 22 bp, Homo sapiens
acactgtagtttttgaaaatta

SEQ ID NO: 985762 - DNA, 23 bp, Homo sapiens
acactgtattgtaagtggaaaat

SEQ ID NO: 985763 - DNA, 16 bp, Homo sapiens
acactgtcatcaatgt

SEQ ID NO: 985764 - DNA, 17 bp, Homo sapiens
acactgtcatcaatgtt

SEQ ID NO: 985765 - DNA, 18 bp, Homo sapiens
acactgtctggggcccca

SEQ ID NO: 985766 - DNA, 18 bp, Homo sapiens
acaatggtttttaaattt

SEQ ID NO: 985767 - DNA, 12 bp, Homo sapiens
acaatgtaaagt

SEQ ID NO: 985768 - DNA, 13 bp, Homo sapiens
acaatgtacaatt

SEQ ID NO: 985769 - DNA, 15 bp, Homo sapiens
acaatgtataaagat

SEQ ID NO: 985770 - DNA, 18 bp, Homo sapiens
acaatgtataaagattgt

SEQ ID NO: 985771 - DNA, 19 bp, Homo sapiens
acaatgtataaagattgta

SEQ ID NO: 985772 - DNA, 15 bp, Homo sapiens
acaatgtatctttat

SEQ ID NO: 985773 - DNA, 14 bp, Homo sapiens
acaatgtatgtaca

SEQ ID NO: 985774 - DNA, 23 bp, Homo sapiens
acaatgtggacgtgcactgacag

SEQ ID NO: 985775 - DNA, 15 bp, Homo sapiens
acaatgttgagaagt

SEQ ID NO: 985776 - DNA, 21 bp, Homo sapiens
acaatgttgtccaacaataaa

SEQ ID NO: 985777 - DNA, 22 bp, Homo sapiens
acaatgttgtccaacaataaac

SEQ ID NO: 985778 - DNA, 23 bp, Homo sapiens
acaatgttgtccaacaataaaca

SEQ ID NO: 985779 - DNA, 17 bp, Homo sapiens
acaattatgtctcttga

SEQ ID NO: 985780 - DNA, 20 bp, Homo sapiens
acaattatgtctcttgagca

SEQ ID NO: 985781 - DNA, 22 bp, Homo sapiens
acaattattccaaaccaaattt

SEQ ID NO: 985782 - DNA, 18 bp, Homo sapiens
acaattcaagctgagaaa

SEQ ID NO: 985783 - DNA, 20 bp, Homo sapiens
acaattcaagctgagaaaag

SEQ ID NO: 985784 - DNA, 13 bp, Homo sapiens
acaattcagtggt

SEQ ID NO: 985785 - DNA, 15 bp, Homo sapiens
acaattccctgctgt

SEQ ID NO: 985786 - DNA, 20 bp, Homo sapiens
acaattcccttctttttcat

SEQ ID NO: 985787 - DNA, 19 bp, Homo sapiens
acaattcctagataaaaag

SEQ ID NO: 985788 - DNA, 23 bp, Homo sapiens
acaattcctagataaaaagatgg

SEQ ID NO: 985789 - DNA, 17 bp, Homo sapiens
acaattcctctgataat

SEQ ID NO: 985790 - DNA, 22 bp, Homo sapiens
acaattcgaatggggtagaaac

SEQ ID NO: 985791 - DNA, 12 bp, Homo sapiens
acaattctaaaa

SEQ ID NO: 985792 - DNA, 14 bp, Homo sapiens
acaattctaaaatg

SEQ ID NO: 985793 - DNA, 15 bp, Homo sapiens
acaattctacattgt

SEQ ID NO: 985794 - DNA, 23 bp, Homo sapiens
acaattctgtccctgtccctgcc

SEQ ID NO: 985795 - DNA, 15 bp, Homo sapiens
acaattctgttttta

SEQ ID NO: 985796 - DNA, 22 bp, Homo sapiens
acaattgaagtaaactttttgt

SEQ ID NO: 985797 - DNA, 22 bp, Homo sapiens
acaattgaggtaagttttttga

SEQ ID NO: 985798 - DNA, 20 bp, Homo sapiens
acaattgatacttcaggtgc

SEQ ID NO: 985799 - DNA, 21 bp, Homo sapiens
acaattgcttactcattaaaa

SEQ ID NO: 985800 - DNA, 13 bp, Homo sapiens
acaattgggagct

SEQ ID NO: 985801 - DNA, 15 bp, Homo sapiens
acaattggtaaaact

SEQ ID NO: 985802 - DNA, 21 bp, Homo sapiens
acaattgtgtgaattaatttc

SEQ ID NO: 985803 - DNA, 21 bp, Homo sapiens
acaattgtttggggttgaaaa

SEQ ID NO: 985804 - DNA, 12 bp, Homo sapiens
acaattgtttgt

SEQ ID NO: 985805 - DNA, 13 bp, Homo sapiens
acaatttacaaag

SEQ ID NO: 985806 - DNA, 17 bp, Homo sapiens
acaatttagcaggtaga

SEQ ID NO: 985807 - DNA, 12 bp, Homo sapiens
acaatttatttt

SEQ ID NO: 985808 - DNA, 15 bp, Homo sapiens
acaatttcatcctcc

SEQ ID NO: 985809 - DNA, 13 bp, Homo sapiens
acaatttgataca

SEQ ID NO: 985810 - DNA, 15 bp, Homo sapiens
acaatttgatacata

SEQ ID NO: 985811 - DNA, 18 bp, Homo sapiens
acaatttgtttttgcatt

SEQ ID NO: 985812 - DNA, 19 bp, Homo sapiens
acaatttgtttttgcattt

SEQ ID NO: 985813 - DNA, 21 bp, Homo sapiens
acaatttgtttttgcattttt

SEQ ID NO: 985814 - DNA, 17 bp, Homo sapiens
acaattttaaagttctt

SEQ ID NO: 985815 - DNA, 22 bp, Homo sapiens
acaattttagtcactaagactt

SEQ ID NO: 985816 - DNA, 19 bp, Homo sapiens
acaatttttatttctttta

SEQ ID NO: 985817 - DNA, 21 bp, Homo sapiens
acaatttttatttcttttact

SEQ ID NO: 985818 - DNA, 24 bp, Homo sapiens
acaattttttttattagtattgtt

SEQ ID NO: 985819 - DNA, 17 bp, Homo sapiens
acaattttttttttcct

SEQ ID NO: 985820 - DNA, 16 bp, Homo sapiens
acacaaaaaggagcgg

SEQ ID NO: 985821 - DNA, 13 bp, Homo sapiens
acacaaaacaaca

SEQ ID NO: 985822 - DNA, 19 bp, Homo sapiens
acacaaaacattcatgtaa

SEQ ID NO: 985823 - DNA, 20 bp, Homo sapiens
acacaaaacattcatgtaac

SEQ ID NO: 985824 - DNA, 22 bp, Homo sapiens
acacaaaccattttattttttg

SEQ ID NO: 985825 - DNA, 19 bp, Homo sapiens
acacaaactatgggatcca

SEQ ID NO: 985826 - DNA, 16 bp, Homo sapiens
acacaaactgtaaata

SEQ ID NO: 985827 - DNA, 19 bp, Homo sapiens
acacaaactgtaaataaaa

SEQ ID NO: 985828 - DNA, 22 bp, Homo sapiens
acacaaatgctcaaagaaatct

SEQ ID NO: 985829 - DNA, 15 bp, Homo sapiens
acacaaatgtctagt

SEQ ID NO: 985830 - DNA, 22 bp, Homo sapiens
acacaaatgtctagtttctagt

SEQ ID NO: 985831 - DNA, 13 bp, Homo sapiens
acacaaattttca

SEQ ID NO: 985832 - DNA, 23 bp, Homo sapiens
acacaaattttcaagtttacact

SEQ ID NO: 985833 - DNA, 13 bp, Homo sapiens
acacaacacacac

SEQ ID NO: 985834 - DNA, 14 bp, Homo sapiens
acacaacacagata

SEQ ID NO: 985835 - DNA, 17 bp, Homo sapiens
acacaacggcagtgaag

SEQ ID NO: 985836 - DNA, 16 bp, Homo sapiens
acacagtcacccctcc

SEQ ID NO: 985837 - DNA, 13 bp, Homo sapiens
acacagtgaaacg

SEQ ID NO: 985838 - DNA, 22 bp, Homo sapiens
acacagtgaaacgcaattttac

SEQ ID NO: 985839 - DNA, 17 bp, Homo sapiens
acacagtgaccatacta

SEQ ID NO: 985840 - DNA, 20 bp, Homo sapiens
acacagtgacttcctgggga

SEQ ID NO: 985841 - DNA, 20 bp, Homo sapiens
acacagtgggtggtggatct

SEQ ID NO: 985842 - DNA, 17 bp, Homo sapiens
acacagtgtctgttcag

SEQ ID NO: 985843 - DNA, 14 bp, Homo sapiens
acacagtgttagtg

SEQ ID NO: 985844 - DNA, 15 bp, Homo sapiens
acacagtgtttcaat

SEQ ID NO: 985845 - DNA, 18 bp, Homo sapiens
acacagttcctgggaaca

SEQ ID NO: 985846 - DNA, 20 bp, Homo sapiens
acacagttgggacccaaaac

SEQ ID NO: 985847 - DNA, 21 bp, Homo sapiens
acacatacagaaagaagcagt

SEQ ID NO: 985848 - DNA, 16 bp, Homo sapiens
acacatacatacacat

SEQ ID NO: 985849 - DNA, 14 bp, Homo sapiens
acacatacatacat

SEQ ID NO: 985850 - DNA, 17 bp, Homo sapiens
acacatacgtgcacagg

SEQ ID NO: 985851 - DNA, 17 bp, Homo sapiens
acacatagcatgtaatg

SEQ ID NO: 985852 - DNA, 16 bp, Homo sapiens
acacatatacatatga

SEQ ID NO: 985853 - DNA, 19 bp, Homo sapiens
acacatatacatatgagaa

SEQ ID NO: 985854 - DNA, 16 bp, Homo sapiens
acacatatatattaca

SEQ ID NO: 985855 - DNA, 20 bp, Homo sapiens
acacatcaagactatctaca

SEQ ID NO: 985856 - DNA, 14 bp, Homo sapiens
acacatcaagcttt

SEQ ID NO: 985857 - DNA, 20 bp, Homo sapiens
acacatccagctgcccctcc

SEQ ID NO: 985858 - DNA, 22 bp, Homo sapiens
acacatcccggcctcttccacc

SEQ ID NO: 985859 - DNA, 16 bp, Homo sapiens
acacatctggccctga

SEQ ID NO: 985860 - DNA, 17 bp, Homo sapiens
acacatctgggtgccct

SEQ ID NO: 985861 - DNA, 22 bp, Homo sapiens
acacatctgggtgccctgaaag

SEQ ID NO: 985862 - DNA, 20 bp, Homo sapiens
acacatcttacctctcatgc

SEQ ID NO: 985863 - DNA, 21 bp, Homo sapiens
acacatcttacctctcatgcg

SEQ ID NO: 985864 - DNA, 19 bp, Homo sapiens
acacatgaaggtaaataaa

SEQ ID NO: 985865 - DNA, 18 bp, Homo sapiens
acacatgcaaggtcattt

SEQ ID NO: 985866 - DNA, 21 bp, Homo sapiens
acacatgcacttttgggcctt

SEQ ID NO: 985867 - DNA, 14 bp, Homo sapiens
acacatgcccctcc

SEQ ID NO: 985868 - DNA, 14 bp, Homo sapiens
acacatgccctcct

SEQ ID NO: 985869 - DNA, 15 bp, Homo sapiens
acacatgccctcctg

SEQ ID NO: 985870 - DNA, 16 bp, Homo sapiens
acacatgccctcctgg

SEQ ID NO: 985871 - DNA, 23 bp, Homo sapiens
acacatgctgaggttttgaataa

SEQ ID NO: 985872 - DNA, 19 bp, Homo sapiens
acacatgctgccttcttgg

SEQ ID NO: 985873 - DNA, 18 bp, Homo sapiens
acacatggaaaacaccag

SEQ ID NO: 985874 - DNA, 14 bp, Homo sapiens
acacatgtaaaata

SEQ ID NO: 985875 - DNA, 18 bp, Homo sapiens
acacatgtaaaatatgta

SEQ ID NO: 985876 - DNA, 21 bp, Homo sapiens
acacatgtgctgatgtttaca

SEQ ID NO: 985877 - DNA, 14 bp, Homo sapiens
acacatgtgtatga

SEQ ID NO: 985878 - DNA, 14 bp, Homo sapiens
acacattaatgata

SEQ ID NO: 985879 - DNA, 18 bp, Homo sapiens
acacattacaaagttaaa

SEQ ID NO: 985880 - DNA, 22 bp, Homo sapiens
acacattacaaagttaaaattg

SEQ ID NO: 985881 - DNA, 23 bp, Homo sapiens
acacattagattttattttacta

SEQ ID NO: 985882 - DNA, 19 bp, Homo sapiens
acacattatgttagagagg

SEQ ID NO: 985883 - DNA, 16 bp, Homo sapiens
acacattccagccagg

SEQ ID NO: 985884 - DNA, 20 bp, Homo sapiens
acacattccagccaggccca

SEQ ID NO: 985885 - DNA, 21 bp, Homo sapiens
acacattccagccaggcccag

SEQ ID NO: 985886 - DNA, 13 bp, Homo sapiens
acacattccaggg

SEQ ID NO: 985887 - DNA, 20 bp, Homo sapiens
acacattccagggctggggt

SEQ ID NO: 985888 - DNA, 21 bp, Homo sapiens
acacattgaatgcgctttatt

SEQ ID NO: 985889 - DNA, 22 bp, Homo sapiens
acacattgaatgcgctttattg

SEQ ID NO: 985890 - DNA, 22 bp, Homo sapiens
acacattgagttggaatcactg

SEQ ID NO: 985891 - DNA, 12 bp, Homo sapiens
acacatttaaaa

SEQ ID NO: 985892 - DNA, 17 bp, Homo sapiens
acacatttaaaacattt

SEQ ID NO: 985893 - DNA, 15 bp, Homo sapiens
acacatttaccaaat

SEQ ID NO: 985894 - DNA, 14 bp, Homo sapiens
acaaccatgtcatt

SEQ ID NO: 985895 - DNA, 22 bp, Homo sapiens
acaaccatgtcatttcagaagt

SEQ ID NO: 985896 - DNA, 21 bp, Homo sapiens
acaacccataatcatgtaaat

SEQ ID NO: 985897 - DNA, 13 bp, Homo sapiens
acaaccccagcct

SEQ ID NO: 985898 - DNA, 16 bp, Homo sapiens
acaaccccctccaccc

SEQ ID NO: 985899 - DNA, 11 bp, Homo sapiens
acaaccctgac

SEQ ID NO: 985900 - DNA, 19 bp, Homo sapiens
acaaccctgcaaaggactg

SEQ ID NO: 985901 - DNA, 22 bp, Homo sapiens
acaaccgatgctccagccaacc

SEQ ID NO: 985902 - DNA, 21 bp, Homo sapiens
acaaccgtcctgctgtccctg

SEQ ID NO: 985903 - DNA, 14 bp, Homo sapiens
acaacctagaatgt

SEQ ID NO: 985904 - DNA, 15 bp, Homo sapiens
acaacctcaccaaac

SEQ ID NO: 985905 - DNA, 16 bp, Homo sapiens
acaacctcaccaaact

SEQ ID NO: 985906 - DNA, 18 bp, Homo sapiens
acaacctcaccaaactag

SEQ ID NO: 985907 - DNA, 15 bp, Homo sapiens
acaacctgaaattta

SEQ ID NO: 985908 - DNA, 12 bp, Homo sapiens
acaaccttgcag

SEQ ID NO: 985909 - DNA, 12 bp, Homo sapiens
acaacctttctg

SEQ ID NO: 985910 - DNA, 13 bp, Homo sapiens
acaacctttctgt

SEQ ID NO: 985911 - DNA, 19 bp, Homo sapiens
acaacgtgtatagtgccta

SEQ ID NO: 985912 - DNA, 13 bp, Homo sapiens
acaactaaaaaaa

SEQ ID NO: 985913 - DNA, 17 bp, Homo sapiens
acaactaaaaataaatt

SEQ ID NO: 985914 - DNA, 19 bp, Homo sapiens
acaactaaaaataaattaa

SEQ ID NO: 985915 - DNA, 13 bp, Homo sapiens
acaactaaataac

SEQ ID NO: 985916 - DNA, 12 bp, Homo sapiens
acaactagattt

SEQ ID NO: 985917 - DNA, 18 bp, Homo sapiens
acaactgcacatgaaagt

SEQ ID NO: 985918 - DNA, 21 bp, Homo sapiens
acaactgctcttacttttcca

SEQ ID NO: 985919 - DNA, 17 bp, Homo sapiens
acaactgctgtggcccc

SEQ ID NO: 985920 - DNA, 19 bp, Homo sapiens
acaactgctgtggccccct

SEQ ID NO: 985921 - DNA, 14 bp, Homo sapiens
acaactgtgactgt

SEQ ID NO: 985922 - DNA, 15 bp, Homo sapiens
acaacttaaataata

SEQ ID NO: 985923 - DNA, 22 bp, Homo sapiens
acaacttaagttggtcctttac

SEQ ID NO: 985924 - DNA, 20 bp, Homo sapiens
acaacttagctcaggtgcct

SEQ ID NO: 985925 - DNA, 18 bp, Homo sapiens
acaacttatttaaaaata

SEQ ID NO: 985926 - DNA, 20 bp, Homo sapiens
acaacttatttaaaaatatt

SEQ ID NO: 985927 - DNA, 22 bp, Homo sapiens
acaacttatttaaaaatatttc

SEQ ID NO: 985928 - DNA, 16 bp, Homo sapiens
acaacttctgtttctt

SEQ ID NO: 985929 - DNA, 13 bp, Homo sapiens
acaacttggcatt

SEQ ID NO: 985930 - DNA, 20 bp, Homo sapiens
acaactttattgattgaatt

SEQ ID NO: 985931 - DNA, 21 bp, Homo sapiens
acaactttattgattgaattt

SEQ ID NO: 985932 - DNA, 21 bp, Homo sapiens
acaactttgcaaattatttat

SEQ ID NO: 985933 - DNA, 23 bp, Homo sapiens
acaactttgcaaattatttatta

SEQ ID NO: 985934 - DNA, 13 bp, Homo sapiens
acaactttgccag

SEQ ID NO: 985935 - DNA, 23 bp, Homo sapiens
acaactttgtcgtggttcttaaa

SEQ ID NO: 985936 - DNA, 16 bp, Homo sapiens
acaacttttaaagaaa

SEQ ID NO: 985937 - DNA, 17 bp, Homo sapiens
acaacttttaaagaaaa

SEQ ID NO: 985938 - DNA, 20 bp, Homo sapiens
acaacttttaaagaaaaata

SEQ ID NO: 985939 - DNA, 17 bp, Homo sapiens
acaacttttgttttctg

SEQ ID NO: 985940 - DNA, 18 bp, Homo sapiens
acaacttttgttttctga

SEQ ID NO: 985941 - DNA, 20 bp, Homo sapiens
acaacttttgttttctgatg

SEQ ID NO: 985942 - DNA, 12 bp, Homo sapiens
acaagaaaacat

SEQ ID NO: 985943 - DNA, 20 bp, Homo sapiens
acaagaaaccaagtgggctg

SEQ ID NO: 985944 - DNA, 21 bp, Homo sapiens
acaagaaatccctgtttaata

SEQ ID NO: 985945 - DNA, 12 bp, Homo sapiens
acaagaaatctg

SEQ ID NO: 985946 - DNA, 13 bp, Homo sapiens
acaagaaatgctt

SEQ ID NO: 985947 - DNA, 18 bp, Homo sapiens
acaagaaatttgatttct

SEQ ID NO: 985948 - DNA, 13 bp, Homo sapiens
acaagaagaccag

SEQ ID NO: 985949 - DNA, 20 bp, Homo sapiens
acaagaagccacagacctag

SEQ ID NO: 985950 - DNA, 23 bp, Homo sapiens
acaagaagggttttccaccctgg

SEQ ID NO: 985951 - DNA, 14 bp, Homo sapiens
acaagaagtttatt

SEQ ID NO: 985952 - DNA, 21 bp, Homo sapiens
acaagaagtttattctcattt

SEQ ID NO: 985953 - DNA, 13 bp, Homo sapiens
acaagaatggatc

SEQ ID NO: 985954 - DNA, 23 bp, Homo sapiens
acaagaatggatcacaagatgga

SEQ ID NO: 985955 - DNA, 19 bp, Homo sapiens
acaagaccccgtctcaaaa

SEQ ID NO: 985956 - DNA, 14 bp, Homo sapiens
acaagactgccagg

SEQ ID NO: 985957 - DNA, 23 bp, Homo sapiens
acaagactgcctccctctcttcc

SEQ ID NO: 985958 - DNA, 14 bp, Homo sapiens
acaagagaaaaagc

SEQ ID NO: 985959 - DNA, 21 bp, Homo sapiens
acaagagacttaaaggacagg

SEQ ID NO: 985960 - DNA, 18 bp, Homo sapiens
acaagagcagcctgtggc

SEQ ID NO: 985961 - DNA, 16 bp, Homo sapiens
acaagaggaagagaga

SEQ ID NO: 985962 - DNA, 23 bp, Homo sapiens
acaagaggacacaatggcacctc

SEQ ID NO: 985963 - DNA, 23 bp, Homo sapiens
acaagaggttaaggtgggtccag

SEQ ID NO: 985964 - DNA, 21 bp, Homo sapiens
acaagagtgagactccacctc

SEQ ID NO: 985965 - DNA, 18 bp, Homo sapiens
acaagagtttatttccaa

SEQ ID NO: 985966 - DNA, 16 bp, Homo sapiens
acaagatctttcagga

SEQ ID NO: 985967 - DNA, 20 bp, Homo sapiens
acaagatctttcaggaaaga

SEQ ID NO: 985968 - DNA, 18 bp, Homo sapiens
acaagatggaatttatca

SEQ ID NO: 985969 - DNA, 22 bp, Homo sapiens
acaagatggcgaccaccaaagt

SEQ ID NO: 985970 - DNA, 15 bp, Homo sapiens
acaagattcccagag

SEQ ID NO: 985971 - DNA, 16 bp, Homo sapiens
acaagattcccagaga

SEQ ID NO: 985972 - DNA, 12 bp, Homo sapiens
acaagatttcct

SEQ ID NO: 985973 - DNA, 19 bp, Homo sapiens
acaatagtatagaagtctg

SEQ ID NO: 985974 - DNA, 14 bp, Homo sapiens
acaatagtcagaaa

SEQ ID NO: 985975 - DNA, 23 bp, Homo sapiens
acaatagttcttagctttgaaac

SEQ ID NO: 985976 - DNA, 14 bp, Homo sapiens
acaatatacaagct

SEQ ID NO: 985977 - DNA, 24 bp, Homo sapiens
acaatatgaaaaggatattatcta

SEQ ID NO: 985978 - DNA, 13 bp, Homo sapiens
acaatatgtatgc

SEQ ID NO: 985979 - DNA, 14 bp, Homo sapiens
acaatatgtatgct

SEQ ID NO: 985980 - DNA, 16 bp, Homo sapiens
acaatatgtatgcttt

SEQ ID NO: 985981 - DNA, 22 bp, Homo sapiens
acaatatgtatgctttttacct

SEQ ID NO: 985982 - DNA, 20 bp, Homo sapiens
acaatatgtgccaatcaata

SEQ ID NO: 985983 - DNA, 23 bp, Homo sapiens
acaatattgtatactaccatagt

SEQ ID NO: 985984 - DNA, 12 bp, Homo sapiens
acaatattttat

SEQ ID NO: 985985 - DNA, 13 bp, Homo sapiens
acaatcaaatctc

SEQ ID NO: 985986 - DNA, 23 bp, Homo sapiens
acaatcaactctaatagtgctta

SEQ ID NO: 985987 - DNA, 16 bp, Homo sapiens
acaatcactaaacttt

SEQ ID NO: 985988 - DNA, 13 bp, Homo sapiens
acaatcactattc

SEQ ID NO: 985989 - DNA, 15 bp, Homo sapiens
acaatcactattctt

SEQ ID NO: 985990 - DNA, 18 bp, Homo sapiens
acaatcagctccttcctg

SEQ ID NO: 985991 - DNA, 22 bp, Homo sapiens
acaatcagctccttcctggaga

SEQ ID NO: 985992 - DNA, 15 bp, Homo sapiens
acaatcagtcccctc

SEQ ID NO: 985993 - DNA, 18 bp, Homo sapiens
acaatcagttaaacacac

SEQ ID NO: 985994 - DNA, 21 bp, Homo sapiens
acaatcatggcggaaggtgaa

SEQ ID NO: 985995 - DNA, 20 bp, Homo sapiens
acaatcatggtcaagttccc

SEQ ID NO: 985996 - DNA, 18 bp, Homo sapiens
acaatccatgtgattaat

SEQ ID NO: 985997 - DNA, 15 bp, Homo sapiens
acaatccattcacaa

SEQ ID NO: 985998 - DNA, 15 bp, Homo sapiens
acaatccgagcagtg

SEQ ID NO: 985999 - DNA, 18 bp, Homo sapiens
acaatctggaagaaaaaa

SEQ ID NO: 986000 - DNA, 21 bp, Homo sapiens
acaatctggagatactaaatc

SEQ ID NO: 986001 - DNA, 16 bp, Homo sapiens
acaatctttcatgtct

SEQ ID NO: 986002 - DNA, 19 bp, Homo sapiens
acaatgaaaacaaataaaa

SEQ ID NO: 986003 - DNA, 18 bp, Homo sapiens
acaatgaaaactctttgc

SEQ ID NO: 986004 - DNA, 14 bp, Homo sapiens
acaatgaaattttt

SEQ ID NO: 986005 - DNA, 17 bp, Homo sapiens
acaatgaagaagtttct

SEQ ID NO: 986006 - DNA, 15 bp, Homo sapiens
acaatgaatgtatat

SEQ ID NO: 986007 - DNA, 20 bp, Homo sapiens
acaatgacttactgtacatg

SEQ ID NO: 986008 - DNA, 13 bp, Homo sapiens
acaatgactttat

SEQ ID NO: 986009 - DNA, 14 bp, Homo sapiens
acaatgactttatt

SEQ ID NO: 986010 - DNA, 19 bp, Homo sapiens
acaatgatgatgataatga

SEQ ID NO: 986011 - DNA, 21 bp, Homo sapiens
acaatgatgatgataatgatg

SEQ ID NO: 986012 - DNA, 20 bp, Homo sapiens
acaatgatgccgaacattag

SEQ ID NO: 986013 - DNA, 20 bp, Homo sapiens
acaatgatggtaaagccatg

SEQ ID NO: 986014 - DNA, 22 bp, Homo sapiens
acaatgatggtaaagccatgtt

SEQ ID NO: 986015 - DNA, 18 bp, Homo sapiens
acaatgcaatgaaacaga

SEQ ID NO: 986016 - DNA, 22 bp, Homo sapiens
acaatgcacctagctgtgcaag

SEQ ID NO: 986017 - DNA, 24 bp, Homo sapiens
acaatgcagtacaggacatatatt

SEQ ID NO: 986018 - DNA, 24 bp, Homo sapiens
acaatgctgtgccctaaagtgtat

SEQ ID NO: 986019 - DNA, 22 bp, Homo sapiens
acaatggcacctctgcccttcc

SEQ ID NO: 986020 - DNA, 19 bp, Homo sapiens
acaatggtcttacattgga

SEQ ID NO: 986021 - DNA, 17 bp, Homo sapiens
acaatggtttattccca

SEQ ID NO: 986022 - DNA, 14 bp, Homo sapiens
aattctatttgctg

SEQ ID NO: 986023 - DNA, 22 bp, Homo sapiens
aattctcaacctaccacccctt

SEQ ID NO: 986024 - DNA, 13 bp, Homo sapiens
aattctcagacga

SEQ ID NO: 986025 - DNA, 13 bp, Homo sapiens
aattctcatttgt

SEQ ID NO: 986026 - DNA, 14 bp, Homo sapiens
aattctcatttgtt

SEQ ID NO: 986027 - DNA, 23 bp, Homo sapiens
aattctccaggattttaatttca

SEQ ID NO: 986028 - DNA, 19 bp, Homo sapiens
aattctcctgcctcagcct

SEQ ID NO: 986029 - DNA, 12 bp, Homo sapiens
aattctcctgga

SEQ ID NO: 986030 - DNA, 13 bp, Homo sapiens
aattctcctggag

SEQ ID NO: 986031 - DNA, 14 bp, Homo sapiens
aattctccttccca

SEQ ID NO: 986032 - DNA, 20 bp, Homo sapiens
aattctctgtggaatgaata

SEQ ID NO: 986033 - DNA, 16 bp, Homo sapiens
aattctcttaaataaa

SEQ ID NO: 986034 - DNA, 21 bp, Homo sapiens
aattctcttaatcactactgt

SEQ ID NO: 986035 - DNA, 14 bp, Homo sapiens
aattctctttcaaa

SEQ ID NO: 986036 - DNA, 11 bp, Homo sapiens
aattctgaaac

SEQ ID NO: 986037 - DNA, 11 bp, Homo sapiens
aattctgaaat

SEQ ID NO: 986038 - DNA, 17 bp, Homo sapiens
aattctgaaatactttt

SEQ ID NO: 986039 - DNA, 10 bp, Homo sapiens
aattctgaat

SEQ ID NO: 986040 - DNA, 22 bp, Homo sapiens
aattctgactgtccaggagcta

SEQ ID NO: 986041 - DNA, 23 bp, Homo sapiens
aattctgagttttgtgtttgttg

SEQ ID NO: 986042 - DNA, 19 bp, Homo sapiens
aattctgatgttactgaga

SEQ ID NO: 986043 - DNA, 20 bp, Homo sapiens
aattctgatgttactgagat

SEQ ID NO: 986044 - DNA, 19 bp, Homo sapiens
aattctgcaatgttttcct

SEQ ID NO: 986045 - DNA, 15 bp, Homo sapiens
aattctgcatgtact

SEQ ID NO: 986046 - DNA, 21 bp, Homo sapiens
aattctgcctgcctcctccct

SEQ ID NO: 986047 - DNA, 22 bp, Homo sapiens
aattctgcctgcctcctccctc

SEQ ID NO: 986048 - DNA, 23 bp, Homo sapiens
aattctgcctgcctcctccctcc

SEQ ID NO: 986049 - DNA, 19 bp, Homo sapiens
aattctgctacctcactgg

SEQ ID NO: 986050 - DNA, 16 bp, Homo sapiens
aattctgctcagatag

SEQ ID NO: 986051 - DNA, 13 bp, Homo sapiens
aattctggtatac

SEQ ID NO: 986052 - DNA, 16 bp, Homo sapiens
aattctggtatacatt

SEQ ID NO: 986053 - DNA, 21 bp, Homo sapiens
aattctggtatacattgaatt

SEQ ID NO: 986054 - DNA, 12 bp, Homo sapiens
aattctgtaaat

SEQ ID NO: 986055 - DNA, 16 bp, Homo sapiens
aattctgtaattacat

SEQ ID NO: 986056 - DNA, 18 bp, Homo sapiens
aattctgtccctgtccct

SEQ ID NO: 986057 - DNA, 12 bp, Homo sapiens
aattctgtttct

SEQ ID NO: 986058 - DNA, 19 bp, Homo sapiens
aattctgtttttaatgcta

SEQ ID NO: 986059 - DNA, 22 bp, Homo sapiens
aattctgtttttaatgctattt

SEQ ID NO: 986060 - DNA, 14 bp, Homo sapiens
aattctgtttttct

SEQ ID NO: 986061 - DNA, 22 bp, Homo sapiens
aattcttatgactaaattttct

SEQ ID NO: 986062 - DNA, 23 bp, Homo sapiens
aattcttattttttaaaaagcta

SEQ ID NO: 986063 - DNA, 22 bp, Homo sapiens
aattcttcacctaagtctctgt

SEQ ID NO: 986064 - DNA, 15 bp, Homo sapiens
aattcttcctcctct

SEQ ID NO: 986065 - DNA, 15 bp, Homo sapiens
aattcttctgaactc

SEQ ID NO: 986066 - DNA, 23 bp, Homo sapiens
aattcttctgaactcaaactgag

SEQ ID NO: 986067 - DNA, 20 bp, Homo sapiens
aattcttctgttctctggtt

SEQ ID NO: 986068 - DNA, 18 bp, Homo sapiens
aattcttgatctctaatg

SEQ ID NO: 986069 - DNA, 15 bp, Homo sapiens
aattcttgtatatta

SEQ ID NO: 986070 - DNA, 22 bp, Homo sapiens
aattgaaaaaagtggaaaacat

SEQ ID NO: 986071 - DNA, 16 bp, Homo sapiens
aattgaaaagaagtag

SEQ ID NO: 986072 - DNA, 12 bp, Homo sapiens
aattgaaagtat

SEQ ID NO: 986073 - DNA, 13 bp, Homo sapiens
aattgaaatgtaa

SEQ ID NO: 986074 - DNA, 24 bp, Homo sapiens
aattgaaatgtaaggctgtgtaag

SEQ ID NO: 986075 - DNA, 18 bp, Homo sapiens
aattgaagaactgcactt

SEQ ID NO: 986076 - DNA, 17 bp, Homo sapiens
aattgaagtaaactttt

SEQ ID NO: 986077 - DNA, 17 bp, Homo sapiens
aattgaagtgtcttctg

SEQ ID NO: 986078 - DNA, 21 bp, Homo sapiens
aattgaatcagtataaacaaa

SEQ ID NO: 986079 - DNA, 18 bp, Homo sapiens
aattgaatgcaaaccata

SEQ ID NO: 986080 - DNA, 12 bp, Homo sapiens
aattgacaaaaa

SEQ ID NO: 986081 - DNA, 14 bp, Homo sapiens
aattgacaaatgat

SEQ ID NO: 986082 - DNA, 15 bp, Homo sapiens
aattgacaaatgatg

SEQ ID NO: 986083 - DNA, 23 bp, Homo sapiens
aattgacagatcaagctgtgaga

SEQ ID NO: 986084 - DNA, 16 bp, Homo sapiens
aattgacatgaccctc

SEQ ID NO: 986085 - DNA, 17 bp, Homo sapiens
aattgacccatgttccc

SEQ ID NO: 986086 - DNA, 15 bp, Homo sapiens
aattgactgcagttg

SEQ ID NO: 986087 - DNA, 19 bp, Homo sapiens
aattgagaaaaatatatac

SEQ ID NO: 986088 - DNA, 15 bp, Homo sapiens
aattgagaaggaaaa

SEQ ID NO: 986089 - DNA, 22 bp, Homo sapiens
aattgagagaatggaaaacaga

SEQ ID NO: 986090 - DNA, 21 bp, Homo sapiens
aattgaggagagggactgaat

SEQ ID NO: 986091 - DNA, 17 bp, Homo sapiens
aattgagggaagtttga

SEQ ID NO: 986092 - DNA, 16 bp, Homo sapiens
aattgagtatcacttt

SEQ ID NO: 986093 - DNA, 23 bp, Homo sapiens
aattgagtctcttttttattctg

SEQ ID NO: 986094 - DNA, 17 bp, Homo sapiens
aattgagttttcagtgg

SEQ ID NO: 986095 - DNA, 15 bp, Homo sapiens
aattgatcagatgct

SEQ ID NO: 986096 - DNA, 23 bp, Homo sapiens
aattgatgtatatgtttatatac

SEQ ID NO: 986097 - DNA, 15 bp, Homo sapiens
aattgattaaaatct

SEQ ID NO: 986098 - DNA, 22 bp, Homo sapiens
aattgattcctcgcgacatctt

SEQ ID NO: 986099 - DNA, 15 bp, Homo sapiens
aattgatttataaat

SEQ ID NO: 986100 - DNA, 13 bp, Homo sapiens
aattgatttgcat

SEQ ID NO: 986101 - DNA, 16 bp, Homo sapiens
aattgatttgcattga

SEQ ID NO: 986102 - DNA, 23 bp, Homo sapiens
aattgatttgcattgaacacaaa

SEQ ID NO: 986103 - DNA, 20 bp, Homo sapiens
aattgatttttataaatact

SEQ ID NO: 986104 - DNA, 23 bp, Homo sapiens
aattgatttttctcttcattttt

SEQ ID NO: 986105 - DNA, 14 bp, Homo sapiens
aattgcaaatcttg

SEQ ID NO: 986106 - DNA, 21 bp, Homo sapiens
aattgcacatttttttctatg

SEQ ID NO: 986107 - DNA, 17 bp, Homo sapiens
aattgcactcatgtgga

SEQ ID NO: 986108 - DNA, 21 bp, Homo sapiens
aattgcactcatgtggactgg

SEQ ID NO: 986109 - DNA, 20 bp, Homo sapiens
aattgcagataactttgact

SEQ ID NO: 986110 - DNA, 14 bp, Homo sapiens
aattgcagtttcat

SEQ ID NO: 986111 - DNA, 20 bp, Homo sapiens
aattgcagtttcatgtatgt

SEQ ID NO: 986112 - DNA, 14 bp, Homo sapiens
aattgcatgaaact

SEQ ID NO: 986113 - DNA, 19 bp, Homo sapiens
aattgcatgaaactaggct

SEQ ID NO: 986114 - DNA, 11 bp, Homo sapiens
aattgccaagt

SEQ ID NO: 986115 - DNA, 19 bp, Homo sapiens
aattgccagcaaataaata

SEQ ID NO: 986116 - DNA, 21 bp, Homo sapiens
aattgcctacaataaaaagaa

SEQ ID NO: 986117 - DNA, 17 bp, Homo sapiens
aattgcctataatactt

SEQ ID NO: 986118 - DNA, 13 bp, Homo sapiens
aattgcctgttaa

SEQ ID NO: 986119 - DNA, 15 bp, Homo sapiens
aattgctaatgttgc

SEQ ID NO: 986120 - DNA, 14 bp, Homo sapiens
aattgctcaagttc

SEQ ID NO: 986121 - DNA, 21 bp, Homo sapiens
aattgctcatgcatagtccca

SEQ ID NO: 986122 - DNA, 20 bp, Homo sapiens
aattgctccagatctggaat

SEQ ID NO: 986123 - DNA, 12 bp, Homo sapiens
aattgctttgaa

SEQ ID NO: 986124 - DNA, 17 bp, Homo sapiens
aattgcttttgttgtga

SEQ ID NO: 986125 - DNA, 20 bp, Homo sapiens
aattggaacagaatgtttta

SEQ ID NO: 986126 - DNA, 19 bp, Homo sapiens
aattggaatcttcacctca

SEQ ID NO: 986127 - DNA, 23 bp, Homo sapiens
aattggaatcttcacctcagagt

SEQ ID NO: 986128 - DNA, 17 bp, Homo sapiens
aattggactctgtcaca

SEQ ID NO: 986129 - DNA, 23 bp, Homo sapiens
aattggagggtcttgaggggaag

SEQ ID NO: 986130 - DNA, 13 bp, Homo sapiens
aatttacctaaga

SEQ ID NO: 986131 - DNA, 15 bp, Homo sapiens
aatttactttctgca

SEQ ID NO: 986132 - DNA, 14 bp, Homo sapiens
aatttactttcttc

SEQ ID NO: 986133 - DNA, 14 bp, Homo sapiens
aatttactttgtag

SEQ ID NO: 986134 - DNA, 13 bp, Homo sapiens
aatttagaaacta

SEQ ID NO: 986135 - DNA, 21 bp, Homo sapiens
aatttagaaactaattgactt

SEQ ID NO: 986136 - DNA, 22 bp, Homo sapiens
aatttagaaactaattgacttt

SEQ ID NO: 986137 - DNA, 19 bp, Homo sapiens
aatttagaaactgatttct

SEQ ID NO: 986138 - DNA, 17 bp, Homo sapiens
aatttagaaatataatt

SEQ ID NO: 986139 - DNA, 16 bp, Homo sapiens
aatttagaaatattca

SEQ ID NO: 986140 - DNA, 20 bp, Homo sapiens
aatttagaaatcattttgca

SEQ ID NO: 986141 - DNA, 20 bp, Homo sapiens
aatttaggtttttattagta

SEQ ID NO: 986142 - DNA, 16 bp, Homo sapiens
aatttagtaaatgtta

SEQ ID NO: 986143 - DNA, 18 bp, Homo sapiens
aatttagtggatggaata

SEQ ID NO: 986144 - DNA, 13 bp, Homo sapiens
aatttagtgtttt

SEQ ID NO: 986145 - DNA, 23 bp, Homo sapiens
aatttagtgtttttttatttcta

SEQ ID NO: 986146 - DNA, 15 bp, Homo sapiens
aatttagttattgat

SEQ ID NO: 986147 - DNA, 13 bp, Homo sapiens
aatttagttgttt

SEQ ID NO: 986148 - DNA, 12 bp, Homo sapiens
aatttagtttca

SEQ ID NO: 986149 - DNA, 21 bp, Homo sapiens
aatttagtttcatataaagta

SEQ ID NO: 986150 - DNA, 19 bp, Homo sapiens
aatttataaagaaaaatag

SEQ ID NO: 986151 - DNA, 14 bp, Homo sapiens
aattatttatattt

SEQ ID NO: 986152 - DNA, 23 bp, Homo sapiens
aattatttatatttcctgtattg

SEQ ID NO: 986153 - DNA, 20 bp, Homo sapiens
aattatttatttatggagga

SEQ ID NO: 986154 - DNA, 22 bp, Homo sapiens
aattatttcatgattagaaatt

SEQ ID NO: 986155 - DNA, 11 bp, Homo sapiens
aattatttctg

SEQ ID NO: 986156 - DNA, 12 bp, Homo sapiens
aattatttgcat

SEQ ID NO: 986157 - DNA, 13 bp, Homo sapiens
aattatttgctaa

SEQ ID NO: 986158 - DNA, 14 bp, Homo sapiens
aattatttgctaag

SEQ ID NO: 986159 - DNA, 18 bp, Homo sapiens
aattatttgtgtaataga

SEQ ID NO: 986160 - DNA, 12 bp, Homo sapiens
aattattttaaa

SEQ ID NO: 986161 - DNA, 21 bp, Homo sapiens
aattattttaaaatatttaaa

SEQ ID NO: 986162 - DNA, 20 bp, Homo sapiens
aattattttaatattttgta

SEQ ID NO: 986163 - DNA, 22 bp, Homo sapiens
aattattttgaatgtcacaaat

SEQ ID NO: 986164 - DNA, 17 bp, Homo sapiens
aattatttttacagttc

SEQ ID NO: 986165 - DNA, 19 bp, Homo sapiens
aattatttttgtgtttcta

SEQ ID NO: 986166 - DNA, 17 bp, Homo sapiens
aattattttttctatga

SEQ ID NO: 986167 - DNA, 15 bp, Homo sapiens
aattcaaaaagtgtt

SEQ ID NO: 986168 - DNA, 14 bp, Homo sapiens
aattcaaaaataaa

SEQ ID NO: 986169 - DNA, 18 bp, Homo sapiens
aattcaaaaataaattag

SEQ ID NO: 986170 - DNA, 20 bp, Homo sapiens
aattcaaactggggcctcca

SEQ ID NO: 986171 - DNA, 13 bp, Homo sapiens
aattcaaagcatg

SEQ ID NO: 986172 - DNA, 19 bp, Homo sapiens
aattcaaagcatggacatt

SEQ ID NO: 986173 - DNA, 18 bp, Homo sapiens
aattcaaccctttgcccc

SEQ ID NO: 986174 - DNA, 17 bp, Homo sapiens
aattcaaggaatttctt

SEQ ID NO: 986175 - DNA, 18 bp, Homo sapiens
aattcaaggccacaaaaa

SEQ ID NO: 986176 - DNA, 21 bp, Homo sapiens
aattcaaggccacaaaaacaa

SEQ ID NO: 986177 - DNA, 22 bp, Homo sapiens
aattcaaggccacaaaaacaat

SEQ ID NO: 986178 - DNA, 17 bp, Homo sapiens
aattcaatttggattta

SEQ ID NO: 986179 - DNA, 19 bp, Homo sapiens
aattcacaaacttttatac

SEQ ID NO: 986180 - DNA, 13 bp, Homo sapiens
aattcacaaagta

SEQ ID NO: 986181 - DNA, 17 bp, Homo sapiens
aattcacaaagtaattt

SEQ ID NO: 986182 - DNA, 14 bp, Homo sapiens
aattcacaagctaa

SEQ ID NO: 986183 - DNA, 15 bp, Homo sapiens
aattcacaagctaac

SEQ ID NO: 986184 - DNA, 18 bp, Homo sapiens
aattcacagatatttaaa

SEQ ID NO: 986185 - DNA, 21 bp, Homo sapiens
aattcacatgatgcacttcaa

SEQ ID NO: 986186 - DNA, 15 bp, Homo sapiens
aattcaccagtgttc

SEQ ID NO: 986187 - DNA, 23 bp, Homo sapiens
aattcaccagtgttcctgaagct

SEQ ID NO: 986188 - DNA, 21 bp, Homo sapiens
aattcaccccctttcctggac

SEQ ID NO: 986189 - DNA, 23 bp, Homo sapiens
aattcacctatgttattttgtgt

SEQ ID NO: 986190 - DNA, 19 bp, Homo sapiens
aattcacctcagcctggag

SEQ ID NO: 986191 - DNA, 15 bp, Homo sapiens
aattcagcaaaccat

SEQ ID NO: 986192 - DNA, 15 bp, Homo sapiens
aattcagcaccctgg

SEQ ID NO: 986193 - DNA, 20 bp, Homo sapiens
aattcagcactgatttcaca

SEQ ID NO: 986194 - DNA, 13 bp, Homo sapiens
aattcagcagttt

SEQ ID NO: 986195 - DNA, 16 bp, Homo sapiens
aattcagcagttttat

SEQ ID NO: 986196 - DNA, 20 bp, Homo sapiens
aattcaggcatattttaact

SEQ ID NO: 986197 - DNA, 15 bp, Homo sapiens
aattcagtctctgaa

SEQ ID NO: 986198 - DNA, 16 bp, Homo sapiens
aattcagtgacaaaat

SEQ ID NO: 986199 - DNA, 16 bp, Homo sapiens
aattcagtttttgtat

SEQ ID NO: 986200 - DNA, 18 bp, Homo sapiens
aattcagtttttgtatct

SEQ ID NO: 986201 - DNA, 24 bp, Homo sapiens
aattcatacaaagtactgtcctca

SEQ ID NO: 986202 - DNA, 13 bp, Homo sapiens
aattcatcagaat

SEQ ID NO: 986203 - DNA, 15 bp, Homo sapiens
aattcatcccctccc

SEQ ID NO: 986204 - DNA, 22 bp, Homo sapiens
aattcatgacattatgtggaat

SEQ ID NO: 986205 - DNA, 22 bp, Homo sapiens
aattcatggcatgcttaaattt

SEQ ID NO: 986206 - DNA, 17 bp, Homo sapiens
aattcatgggctgtgtg

SEQ ID NO: 986207 - DNA, 14 bp, Homo sapiens
aattcatgtttctt

SEQ ID NO: 986208 - DNA, 15 bp, Homo sapiens
aattcattataattt

SEQ ID NO: 986209 - DNA, 19 bp, Homo sapiens
aattcattcatacttaaaa

SEQ ID NO: 986210 - DNA, 22 bp, Homo sapiens
aattcattgagcagttagctca

SEQ ID NO: 986211 - DNA, 15 bp, Homo sapiens
aattcatttctagac

SEQ ID NO: 986212 - DNA, 18 bp, Homo sapiens
aattcatttctagactca

SEQ ID NO: 986213 - DNA, 22 bp, Homo sapiens
aattcatttgcttgcaatctaa

SEQ ID NO: 986214 - DNA, 15 bp, Homo sapiens
aattcatttgtattg

SEQ ID NO: 986215 - DNA, 17 bp, Homo sapiens
aattcattttcatcact

SEQ ID NO: 986216 - DNA, 18 bp, Homo sapiens
aattccaactcctgatgc

SEQ ID NO: 986217 - DNA, 14 bp, Homo sapiens
aattccaacttgaa

SEQ ID NO: 986218 - DNA, 22 bp, Homo sapiens
aattccaacttgaaggattgca

SEQ ID NO: 986219 - DNA, 14 bp, Homo sapiens
aattccaagaaaat

SEQ ID NO: 986220 - DNA, 18 bp, Homo sapiens
aattccaagaaaatatca

SEQ ID NO: 986221 - DNA, 16 bp, Homo sapiens
aattccacacctttta

SEQ ID NO: 986222 - DNA, 18 bp, Homo sapiens
aattccacagattatcaa

SEQ ID NO: 986223 - DNA, 14 bp, Homo sapiens
aattccactggact

SEQ ID NO: 986224 - DNA, 19 bp, Homo sapiens
aattccagcaataagaaat

SEQ ID NO: 986225 - DNA, 20 bp, Homo sapiens
aattccagcaataagaaatg

SEQ ID NO: 986226 - DNA, 22 bp, Homo sapiens
aattccagcaataagaaatgaa

SEQ ID NO: 986227 - DNA, 17 bp, Homo sapiens
aattccaggtgtgcaca

SEQ ID NO: 986228 - DNA, 13 bp, Homo sapiens
aattccagtaaat

SEQ ID NO: 986229 - DNA, 18 bp, Homo sapiens
aattccagtaaatcctca

SEQ ID NO: 986230 - DNA, 23 bp, Homo sapiens
aattccatattgatgaagatgtt

SEQ ID NO: 986231 - DNA, 15 bp, Homo sapiens
aattcccaacatttc

SEQ ID NO: 986232 - DNA, 17 bp, Homo sapiens
aattcccattttgcaaa

SEQ ID NO: 986233 - DNA, 22 bp, Homo sapiens
aattcccccttaaacttccaaa

SEQ ID NO: 986234 - DNA, 21 bp, Homo sapiens
aattcccgttttgtcactttt

SEQ ID NO: 986235 - DNA, 23 bp, Homo sapiens
aattccctatcttttagttttag

SEQ ID NO: 986236 - DNA, 13 bp, Homo sapiens
aattccctgctgt

SEQ ID NO: 986237 - DNA, 19 bp, Homo sapiens
aattcccttctttttcatc

SEQ ID NO: 986238 - DNA, 10 bp, Homo sapiens
aattcctaca

SEQ ID NO: 986239 - DNA, 22 bp, Homo sapiens
aattcctacaacttaatggaaa

SEQ ID NO: 986240 - DNA, 13 bp, Homo sapiens
aattcctacagca

SEQ ID NO: 986241 - DNA, 18 bp, Homo sapiens
aattcctacagcactact

SEQ ID NO: 986242 - DNA, 20 bp, Homo sapiens
aattcctactccctcttcca

SEQ ID NO: 986243 - DNA, 20 bp, Homo sapiens
aattcctagataaaaagatg

SEQ ID NO: 986244 - DNA, 12 bp, Homo sapiens
aattcctataag

SEQ ID NO: 986245 - DNA, 16 bp, Homo sapiens
aattcctcctctattt

SEQ ID NO: 986246 - DNA, 11 bp, Homo sapiens
aattcctcctt

SEQ ID NO: 986247 - DNA, 23 bp, Homo sapiens
aattcctccttccccccatctct

SEQ ID NO: 986248 - DNA, 13 bp, Homo sapiens
aattcctctggga

SEQ ID NO: 986249 - DNA, 17 bp, Homo sapiens
aattcctctttgctttg

SEQ ID NO: 986250 - DNA, 19 bp, Homo sapiens
aattcctctttgctttgct

SEQ ID NO: 986251 - DNA, 21 bp, Homo sapiens
aattcctgctatgacagctgg

SEQ ID NO: 986252 - DNA, 11 bp, Homo sapiens
aattcctgggc

SEQ ID NO: 986253 - DNA, 16 bp, Homo sapiens
aattcctgttgacctt

SEQ ID NO: 986254 - DNA, 13 bp, Homo sapiens
aattccttaaagt

SEQ ID NO: 986255 - DNA, 13 bp, Homo sapiens
aattccttagctt

SEQ ID NO: 986256 - DNA, 23 bp, Homo sapiens
aattccttagcttagacctcagc

SEQ ID NO: 986257 - DNA, 21 bp, Homo sapiens
aattccttcgaaaggccttca

SEQ ID NO: 986258 - DNA, 13 bp, Homo sapiens
aattcgatgcccc

SEQ ID NO: 986259 - DNA, 17 bp, Homo sapiens
aattcgatgccccccta

SEQ ID NO: 986260 - DNA, 20 bp, Homo sapiens
aattcgatgcgtattctgtg

SEQ ID NO: 986261 - DNA, 17 bp, Homo sapiens
aattcggggcctgctgg

SEQ ID NO: 986262 - DNA, 18 bp, Homo sapiens
aattcggggcctgctgga

SEQ ID NO: 986263 - DNA, 15 bp, Homo sapiens
aattcggtgtgcacc

SEQ ID NO: 986264 - DNA, 18 bp, Homo sapiens
aattcggtgtgctgccaa

SEQ ID NO: 986265 - DNA, 12 bp, Homo sapiens
aatgtgtcattg

SEQ ID NO: 986266 - DNA, 15 bp, Homo sapiens
aattaagactgaaaa

SEQ ID NO: 986267 - DNA, 22 bp, Homo sapiens
aattaagatacaaattaatttt

SEQ ID NO: 986268 - DNA, 15 bp, Homo sapiens
aatgaaaatgtcttg

SEQ ID NO: 986269 - DNA, 14 bp, Homo sapiens
aatgaaaattgtat

SEQ ID NO: 986270 - DNA, 17 bp, Homo sapiens
aatgaaacaccttctct

SEQ ID NO: 986271 - DNA, 20 bp, Homo sapiens
aatgaaacaccttctctgga

SEQ ID NO: 986272 - DNA, 14 bp, Homo sapiens
aatgaaacagatga

SEQ ID NO: 986273 - DNA, 17 bp, Homo sapiens
aatgaaagcatgtctca

SEQ ID NO: 986274 - DNA, 22 bp, Homo sapiens
aatgaaagcatgtggcatgttc

SEQ ID NO: 986275 - DNA, 18 bp, Homo sapiens
aatgaaagctactcatag

SEQ ID NO: 986276 - DNA, 17 bp, Homo sapiens
aatgaaaggtactatat

SEQ ID NO: 986277 - DNA, 17 bp, Homo sapiens
aatgaaagtataactga

SEQ ID NO: 986278 - DNA, 15 bp, Homo sapiens
aatgaaagtttgcac

SEQ ID NO: 986279 - DNA, 16 bp, Homo sapiens
aatgaaataatcagtg

SEQ ID NO: 986280 - DNA, 21 bp, Homo sapiens
aatgaaataatgtacatctgg

SEQ ID NO: 986281 - DNA, 19 bp, Homo sapiens
aatgaaatgataaagactt

SEQ ID NO: 986282 - DNA, 14 bp, Homo sapiens
aatgaaatgtatgc

SEQ ID NO: 986283 - DNA, 14 bp, Homo sapiens
aatgaaatgtatgt

SEQ ID NO: 986284 - DNA, 16 bp, Homo sapiens
aatgaaatgtatgtgc

SEQ ID NO: 986285 - DNA, 14 bp, Homo sapiens
aatgaaattaactg

SEQ ID NO: 986286 - DNA, 23 bp, Homo sapiens
aatgaaattactacaaaatttga

SEQ ID NO: 986287 - DNA, 16 bp, Homo sapiens
aatgaaattcctcctt

SEQ ID NO: 986288 - DNA, 14 bp, Homo sapiens
aatgaaattgacct

SEQ ID NO: 986289 - DNA, 16 bp, Homo sapiens
aatgaacaaaattatt

SEQ ID NO: 986290 - DNA, 12 bp, Homo sapiens
aatgaacagaac

SEQ ID NO: 986291 - DNA, 14 bp, Homo sapiens
aatgaacagaacat

SEQ ID NO: 986292 - DNA, 21 bp, Homo sapiens
aatgaacatccctttttcaat

SEQ ID NO: 986293 - DNA, 21 bp, Homo sapiens
aaacagcttcatgcctttgta

SEQ ID NO: 986294 - DNA, 18 bp, Homo sapiens
aaacagctttcaagtgcc

SEQ ID NO: 986295 - DNA, 19 bp, Homo sapiens
aaacaggaattttattttg

SEQ ID NO: 986296 - DNA, 11 bp, Homo sapiens
aaacaggacca

SEQ ID NO: 986297 - DNA, 17 bp, Homo sapiens
aaacaggagacaggaag

SEQ ID NO: 986298 - DNA, 11 bp, Homo sapiens
aaacaggcagt

SEQ ID NO: 986299 - DNA, 13 bp, Homo sapiens
aaacaggcccagc

SEQ ID NO: 986300 - DNA, 18 bp, Homo sapiens
aaacagggacaaagaaat

SEQ ID NO: 986301 - DNA, 11 bp, Homo sapiens
aaacagggcag

SEQ ID NO: 986302 - DNA, 22 bp, Homo sapiens
aaacagggctgccttctggcct

SEQ ID NO: 986303 - DNA, 18 bp, Homo sapiens
aaacaggtatatactttg

SEQ ID NO: 986304 - DNA, 21 bp, Homo sapiens
aaacaggtatatactttgaaa

SEQ ID NO: 986305 - DNA, 22 bp, Homo sapiens
aaacaggtatttttttaaatca

SEQ ID NO: 986306 - DNA, 23 bp, Homo sapiens
aaacaggtatttttttaaatcaa

SEQ ID NO: 986307 - DNA, 18 bp, Homo sapiens
aaacaggtgtgtgtgaac

SEQ ID NO: 986308 - DNA, 21 bp, Homo sapiens
aaacaggtgtgtgtgaactgg

SEQ ID NO: 986309 - DNA, 17 bp, Homo sapiens
aaacagtatttcattgc

SEQ ID NO: 986310 - DNA, 18 bp, Homo sapiens
aaacagtatttcattgcc

SEQ ID NO: 986311 - DNA, 15 bp, Homo sapiens
aaacagtgagcatat

SEQ ID NO: 986312 - DNA, 16 bp, Homo sapiens
aaacagtgagcatatc

SEQ ID NO: 986313 - DNA, 14 bp, Homo sapiens
aaacagtgctgttt

SEQ ID NO: 986314 - DNA, 23 bp, Homo sapiens
aaacagtggatcacaaagtggaa

SEQ ID NO: 986315 - DNA, 23 bp, Homo sapiens
aaacagttaactttcagaagaga

SEQ ID NO: 986316 - DNA, 22 bp, Homo sapiens
aaacagttctcactgggaagaa

SEQ ID NO: 986317 - DNA, 15 bp, Homo sapiens
aaacagttcttggac

SEQ ID NO: 986318 - DNA, 20 bp, Homo sapiens
aaacagttgcatgtagtaac

SEQ ID NO: 986319 - DNA, 24 bp, Homo sapiens
aaacagttgcatgtagtaacacta

SEQ ID NO: 986320 - DNA, 18 bp, Homo sapiens
aaacagttggtaactttt

SEQ ID NO: 986321 - DNA, 15 bp, Homo sapiens
aaacataaaaaccaa

SEQ ID NO: 986322 - DNA, 20 bp, Homo sapiens
aaacataaaaaccaaaccca

SEQ ID NO: 986323 - DNA, 20 bp, Homo sapiens
aaacataaaaagcagaattt

SEQ ID NO: 986324 - DNA, 14 bp, Homo sapiens
aaacataagtgcaa

SEQ ID NO: 986325 - DNA, 14 bp, Homo sapiens
aaacataattgtgg

SEQ ID NO: 986326 - DNA, 14 bp, Homo sapiens
aaacatagaaatgg

SEQ ID NO: 986327 - DNA, 17 bp, Homo sapiens
aaacatatcatggtaat

SEQ ID NO: 986328 - DNA, 19 bp, Homo sapiens
aaacatatccaagtttgaa

SEQ ID NO: 986329 - DNA, 14 bp, Homo sapiens
aaacatatggcttt

SEQ ID NO: 986330 - DNA, 23 bp, Homo sapiens
aaacatatttgtgaaaagagtat

SEQ ID NO: 986331 - DNA, 23 bp, Homo sapiens
aaacatatttttatactttattg

SEQ ID NO: 986332 - DNA, 18 bp, Homo sapiens
aaacatcaaataaatttc

SEQ ID NO: 986333 - DNA, 14 bp, Homo sapiens
aaacatcacacaca

SEQ ID NO: 986334 - DNA, 16 bp, Homo sapiens
aaacatcagttactct

SEQ ID NO: 986335 - DNA, 19 bp, Homo sapiens
aaacatcagttactctgaa

SEQ ID NO: 986336 - DNA, 22 bp, Homo sapiens
aaacatcagttactctgaaggg

SEQ ID NO: 986337 - DNA, 16 bp, Homo sapiens
aaacatcataaatctt

SEQ ID NO: 986338 - DNA, 12 bp, Homo sapiens
aaacatccactt

SEQ ID NO: 986339 - DNA, 22 bp, Homo sapiens
aaacatcccaaactttaaaatg

SEQ ID NO: 986340 - DNA, 23 bp, Homo sapiens
aaacatcccaaactttaaaatgc

SEQ ID NO: 986341 - DNA, 19 bp, Homo sapiens
aaacatctagcagtaaata

SEQ ID NO: 986342 - DNA, 15 bp, Homo sapiens
aaacatctcatcatg

SEQ ID NO: 986343 - DNA, 11 bp, Homo sapiens
aaacatctgga

SEQ ID NO: 986344 - DNA, 18 bp, Homo sapiens
aaacatgaagcataattt

SEQ ID NO: 986345 - DNA, 19 bp, Homo sapiens
aaacatgagtgaatagctt

SEQ ID NO: 986346 - DNA, 16 bp, Homo sapiens
aaacatgcatccattt

SEQ ID NO: 986347 - DNA, 21 bp, Homo sapiens
aaacatgcttgaataactgag

SEQ ID NO: 986348 - DNA, 23 bp, Homo sapiens
aaacatgcttgaataactgagct

SEQ ID NO: 986349 - DNA, 18 bp, Homo sapiens
aatattgttttacaatag

SEQ ID NO: 986350 - DNA, 15 bp, Homo sapiens
aatatttaaaaatgt

SEQ ID NO: 986351 - DNA, 16 bp, Homo sapiens
aatatttaaacagcag

SEQ ID NO: 986352 - DNA, 13 bp, Homo sapiens
aatatttaaacat

SEQ ID NO: 986353 - DNA, 22 bp, Homo sapiens
aatatttaaacatggttacaat

SEQ ID NO: 986354 - DNA, 21 bp, Homo sapiens
aatatttaacattatttatat

SEQ ID NO: 986355 - DNA, 19 bp, Homo sapiens
aatatttaagtatatagta

SEQ ID NO: 986356 - DNA, 20 bp, Homo sapiens
aatatttaagtatatagtat

SEQ ID NO: 986357 - DNA, 17 bp, Homo sapiens
aatatttaagtgaagga

SEQ ID NO: 986358 - DNA, 16 bp, Homo sapiens
aatatttacaatgtat

SEQ ID NO: 986359 - DNA, 17 bp, Homo sapiens
aatatttacaatgtatt

SEQ ID NO: 986360 - DNA, 17 bp, Homo sapiens
aatatttaccttgaaaa

SEQ ID NO: 986361 - DNA, 19 bp, Homo sapiens
aatatttactaactaaata

SEQ ID NO: 986362 - DNA, 20 bp, Homo sapiens
aatatttactaactaaatac

SEQ ID NO: 986363 - DNA, 17 bp, Homo sapiens
aatatttactctttgca

SEQ ID NO: 986364 - DNA, 21 bp, Homo sapiens
aatatttactgttagaattct

SEQ ID NO: 986365 - DNA, 22 bp, Homo sapiens
aatatttactgttagaattctt

SEQ ID NO: 986366 - DNA, 22 bp, Homo sapiens
aatatttaggagtctattttgt

SEQ ID NO: 986367 - DNA, 13 bp, Homo sapiens
aatatttataaaa

SEQ ID NO: 986368 - DNA, 16 bp, Homo sapiens
aatatttataaaactt

SEQ ID NO: 986369 - DNA, 15 bp, Homo sapiens
aatatttatgtaaac

SEQ ID NO: 986370 - DNA, 21 bp, Homo sapiens
aatatttatgtctatttaagc

SEQ ID NO: 986371 - DNA, 13 bp, Homo sapiens
aatatttattacc

SEQ ID NO: 986372 - DNA, 15 bp, Homo sapiens
aatatttattacctc

SEQ ID NO: 986373 - DNA, 16 bp, Homo sapiens
aatatttattacctct

SEQ ID NO: 986374 - DNA, 12 bp, Homo sapiens
aatatttattat

SEQ ID NO: 986375 - DNA, 20 bp, Homo sapiens
aatatttattcattatttgt

SEQ ID NO: 986376 - DNA, 19 bp, Homo sapiens
aatatttcttaatttggat

SEQ ID NO: 986377 - DNA, 20 bp, Homo sapiens
aatatttcttaatttggata

SEQ ID NO: 986378 - DNA, 15 bp, Homo sapiens
aatatttcttcaaat

SEQ ID NO: 986379 - DNA, 16 bp, Homo sapiens
aatatttcttcaaata

SEQ ID NO: 986380 - DNA, 22 bp, Homo sapiens
aatatttcttttgttgtacttt

SEQ ID NO: 986381 - DNA, 23 bp, Homo sapiens
aatatttcttttgttgtacttta

SEQ ID NO: 986382 - DNA, 11 bp, Homo sapiens
aatatttgaat

SEQ ID NO: 986383 - DNA, 16 bp, Homo sapiens
aatatttgaattttta

SEQ ID NO: 986384 - DNA, 22 bp, Homo sapiens
aatatttgacttgcatgaagag

SEQ ID NO: 986385 - DNA, 13 bp, Homo sapiens
aatatttggaatt

SEQ ID NO: 986386 - DNA, 14 bp, Homo sapiens
aatatttgttttaa

SEQ ID NO: 986387 - DNA, 16 bp, Homo sapiens
aatattttaaagaatt

SEQ ID NO: 986388 - DNA, 12 bp, Homo sapiens
aatattttaaga

SEQ ID NO: 986389 - DNA, 13 bp, Homo sapiens
aatattttaagaa

SEQ ID NO: 986390 - DNA, 19 bp, Homo sapiens
aatattttaagaaagagaa

SEQ ID NO: 986391 - DNA, 18 bp, Homo sapiens
aatattttaagtattgca

SEQ ID NO: 986392 - DNA, 15 bp, Homo sapiens
aatattttacataca

SEQ ID NO: 986393 - DNA, 21 bp, Homo sapiens
aatattttactttgttgagta

SEQ ID NO: 986394 - DNA, 17 bp, Homo sapiens
aatattttagccttaaa

SEQ ID NO: 986395 - DNA, 15 bp, Homo sapiens
aatattttatcctgt

SEQ ID NO: 986396 - DNA, 19 bp, Homo sapiens
aatattttatcctgtattc

SEQ ID NO: 986397 - DNA, 16 bp, Homo sapiens
aatattttcagcctac

SEQ ID NO: 986398 - DNA, 19 bp, Homo sapiens
aatattttctctgtacttt

SEQ ID NO: 986399 - DNA, 23 bp, Homo sapiens
aatattttctctgtacttttcat

SEQ ID NO: 986400 - DNA, 21 bp, Homo sapiens
aatattttctttaatgctttt

SEQ ID NO: 986401 - DNA, 12 bp, Homo sapiens
aatattttgtaa

SEQ ID NO: 986402 - DNA, 13 bp, Homo sapiens
aatattttgtaat

SEQ ID NO: 986403 - DNA, 17 bp, Homo sapiens
aatattttgtaatattc

SEQ ID NO: 986404 - DNA, 12 bp, Homo sapiens
aatattttgtat

SEQ ID NO: 986405 - DNA, 15 bp, Homo sapiens
aatattttgtatttt

SEQ ID NO: 986406 - DNA, 19 bp, Homo sapiens
aatattttgtattttcaac

SEQ ID NO: 986407 - DNA, 15 bp, Homo sapiens
aatattttgtctaaa

SEQ ID NO: 986408 - DNA, 20 bp, Homo sapiens
aatattttgtctaaaatgcc

SEQ ID NO: 986409 - DNA, 14 bp, Homo sapiens
aatattttgttctt

SEQ ID NO: 986410 - DNA, 17 bp, Homo sapiens
agaaggtttgtgttttt

SEQ ID NO: 986411 - DNA, 15 bp, Homo sapiens
agaagtaaaagcaaa

SEQ ID NO: 986412 - DNA, 22 bp, Homo sapiens
agaagtaaaagcaaaaaagaaa

SEQ ID NO: 986413 - DNA, 16 bp, Homo sapiens
agaagtaccagactag

SEQ ID NO: 986414 - DNA, 21 bp, Homo sapiens
agaagtactgcccttttgtgt

SEQ ID NO: 986415 - DNA, 14 bp, Homo sapiens
agaagtacttttct

SEQ ID NO: 986416 - DNA, 13 bp, Homo sapiens
agaagtagattaa

SEQ ID NO: 986417 - DNA, 21 bp, Homo sapiens
agaagtagctagtagcaatgt

SEQ ID NO: 986418 - DNA, 15 bp, Homo sapiens
agaagtaggaggaaa

SEQ ID NO: 986419 - DNA, 22 bp, Homo sapiens
agaagtaggaggaaacagttct

SEQ ID NO: 986420 - DNA, 17 bp, Homo sapiens
agaagtaggcatgaggg

SEQ ID NO: 986421 - DNA, 18 bp, Homo sapiens
agaagtaggggaagacat

SEQ ID NO: 986422 - DNA, 23 bp, Homo sapiens
agaagtagtgtctggatcagtaa

SEQ ID NO: 986423 - DNA, 21 bp, Homo sapiens
agaagtatttttagaataaga

SEQ ID NO: 986424 - DNA, 17 bp, Homo sapiens
agaagtcactgaacaaa

SEQ ID NO: 986425 - DNA, 19 bp, Homo sapiens
agaagtcactgaacaaaac

SEQ ID NO: 986426 - DNA, 22 bp, Homo sapiens
agaagtcagcccgaatgcctgt

SEQ ID NO: 986427 - DNA, 20 bp, Homo sapiens
agaagtcagctactctagtt

SEQ ID NO: 986428 - DNA, 15 bp, Homo sapiens
agaagtcatcttgct

SEQ ID NO: 986429 - DNA, 15 bp, Homo sapiens
agaagtccttatgtt

SEQ ID NO: 986430 - DNA, 13 bp, Homo sapiens
agaagtctcagct

SEQ ID NO: 986431 - DNA, 14 bp, Homo sapiens
agaagtctcagcta

SEQ ID NO: 986432 - DNA, 14 bp, Homo sapiens
agaagtctcattcg

SEQ ID NO: 986433 - DNA, 18 bp, Homo sapiens
agaagtctggctttgctc

SEQ ID NO: 986434 - DNA, 19 bp, Homo sapiens
agaagtcttagatgtatat

SEQ ID NO: 986435 - DNA, 22 bp, Homo sapiens
agaagtcttgaagttgggtgtt

SEQ ID NO: 986436 - DNA, 14 bp, Homo sapiens
agaagtctttcaga

SEQ ID NO: 986437 - DNA, 17 bp, Homo sapiens
agaagtctttcagatga

SEQ ID NO: 986438 - DNA, 18 bp, Homo sapiens
agaagtgaataactgcaa

SEQ ID NO: 986439 - DNA, 16 bp, Homo sapiens
agaagtgaatgctggg

SEQ ID NO: 986440 - DNA, 17 bp, Homo sapiens
agaagtgaatgctggga

SEQ ID NO: 986441 - DNA, 14 bp, Homo sapiens
agaagtgagcaagg

SEQ ID NO: 986442 - DNA, 23 bp, Homo sapiens
agaagtgagctttgctgctacag

SEQ ID NO: 986443 - DNA, 23 bp, Homo sapiens
agaagtgagtttgtaaatattct

SEQ ID NO: 986444 - DNA, 14 bp, Homo sapiens
agaagtgatttagt

SEQ ID NO: 986445 - DNA, 22 bp, Homo sapiens
agaagtgcccctgctgcctccc

SEQ ID NO: 986446 - DNA, 18 bp, Homo sapiens
agaagtggaccaggacag

SEQ ID NO: 986447 - DNA, 19 bp, Homo sapiens
agaagtggctactgactac

SEQ ID NO: 986448 - DNA, 17 bp, Homo sapiens
agaagtgggagcagctt

SEQ ID NO: 986449 - DNA, 17 bp, Homo sapiens
agaagtgggccaggaca

SEQ ID NO: 986450 - DNA, 19 bp, Homo sapiens
agaagtgggggcagcccag

SEQ ID NO: 986451 - DNA, 12 bp, Homo sapiens
agaagtggtttc

SEQ ID NO: 986452 - DNA, 14 bp, Homo sapiens
agaagtgtcaccct

SEQ ID NO: 986453 - DNA, 19 bp, Homo sapiens
agaagtgtcaccctgtggg

SEQ ID NO: 986454 - DNA, 17 bp, Homo sapiens
agaagtgtcgttttcat

SEQ ID NO: 986455 - DNA, 13 bp, Homo sapiens
agaagttactttt

SEQ ID NO: 986456 - DNA, 15 bp, Homo sapiens
agaagttattttctt

SEQ ID NO: 986457 - DNA, 18 bp, Homo sapiens
agaagttctcaaagttaa

SEQ ID NO: 986458 - DNA, 20 bp, Homo sapiens
agaagttgtttgaggcaaat

SEQ ID NO: 986459 - DNA, 17 bp, Homo sapiens
agaagtttattctcatt

SEQ ID NO: 986460 - DNA, 19 bp, Homo sapiens
agaagtttcatcatttttt

SEQ ID NO: 986461 - DNA, 15 bp, Homo sapiens
agaagtttgaacatt

SEQ ID NO: 986462 - DNA, 20 bp, Homo sapiens
agaagtttgtggtataaaaa

SEQ ID NO: 986463 - DNA, 21 bp, Homo sapiens
agaagtttgtggtataaaaag

SEQ ID NO: 986464 - DNA, 22 bp, Homo sapiens
agaagtttgtgtctttgtctgg

SEQ ID NO: 986465 - DNA, 20 bp, Homo sapiens
agaagttttttactttggtt

SEQ ID NO: 986466 - DNA, 14 bp, Homo sapiens
agaataaaagctat

SEQ ID NO: 986467 - DNA, 20 bp, Homo sapiens
agaataaaagctataaagta

SEQ ID NO: 986468 - DNA, 13 bp, Homo sapiens
agaataaaagttc

SEQ ID NO: 986469 - DNA, 16 bp, Homo sapiens
agaataaaagttcctc

SEQ ID NO: 986470 - DNA, 16 bp, Homo sapiens
agaataaaatgttgaa

SEQ ID NO: 986471 - DNA, 20 bp, Homo sapiens
agaataaaatgttgaaaagt

SEQ ID NO: 986472 - DNA, 18 bp, Homo sapiens
agaataaaattcctatct

SEQ ID NO: 986473 - DNA, 19 bp, Homo sapiens
agaataaaattcctatctc

SEQ ID NO: 986474 - DNA, 13 bp, Homo sapiens
agaataaaggcag

SEQ ID NO: 986475 - DNA, 15 bp, Homo sapiens
agaataaaggcagtt

SEQ ID NO: 986476 - DNA, 20 bp, Homo sapiens
agaataaaggcagttttcta

SEQ ID NO: 986477 - DNA, 17 bp, Homo sapiens
agaataaagttctgagt

SEQ ID NO: 986478 - DNA, 16 bp, Homo sapiens
agaataagagaaagaa

SEQ ID NO: 986479 - DNA, 21 bp, Homo sapiens
agaataagagaaagaaaatga

SEQ ID NO: 986480 - DNA, 17 bp, Homo sapiens
agaataaggcacaaaat

SEQ ID NO: 986481 - DNA, 15 bp, Homo sapiens
agaataaggcaggca

SEQ ID NO: 986482 - DNA, 20 bp, Homo sapiens
agaataagttattgcagttt

SEQ ID NO: 986483 - DNA, 14 bp, Homo sapiens
agaataatattgtg

SEQ ID NO: 986484 - DNA, 21 bp, Homo sapiens
acctcagggcacgcaggacca

SEQ ID NO: 986485 - DNA, 22 bp, Homo sapiens
acctcagggcacgcaggaccag

SEQ ID NO: 986486 - DNA, 13 bp, Homo sapiens
acctcagggctcc

SEQ ID NO: 986487 - DNA, 21 bp, Homo sapiens
acctcagggctgtcccagccc

SEQ ID NO: 986488 - DNA, 12 bp, Homo sapiens
acctcaggggca

SEQ ID NO: 986489 - DNA, 13 bp, Homo sapiens
acctcaggggcac

SEQ ID NO: 986490 - DNA, 15 bp, Homo sapiens
acctcaggggcacct

SEQ ID NO: 986491 - DNA, 17 bp, Homo sapiens
acctcaggggcacctcc

SEQ ID NO: 986492 - DNA, 22 bp, Homo sapiens
acctcaggtgatccgcccacct

SEQ ID NO: 986493 - DNA, 18 bp, Homo sapiens
acctcaggtgtgcctgtt

SEQ ID NO: 986494 - DNA, 15 bp, Homo sapiens
acctcagtaatttag

SEQ ID NO: 986495 - DNA, 12 bp, Homo sapiens
acctcagtagaa

SEQ ID NO: 986496 - DNA, 16 bp, Homo sapiens
acctcagtcaggcact

SEQ ID NO: 986497 - DNA, 16 bp, Homo sapiens
acctcagtcatatttc

SEQ ID NO: 986498 - DNA, 23 bp, Homo sapiens
acctcagtgccttcctgtttttc

SEQ ID NO: 986499 - DNA, 15 bp, Homo sapiens
acctcagtgggaaga

SEQ ID NO: 986500 - DNA, 16 bp, Homo sapiens
acctcagtgtcattta

SEQ ID NO: 986501 - DNA, 18 bp, Homo sapiens
acctcagttcattgtggt

SEQ ID NO: 986502 - DNA, 19 bp, Homo sapiens
acctcagttcccttggcct

SEQ ID NO: 986503 - DNA, 20 bp, Homo sapiens
acctcagttcccttggcctc

SEQ ID NO: 986504 - DNA, 21 bp, Homo sapiens
acctcagttcccttggcctca

SEQ ID NO: 986505 - DNA, 15 bp, Homo sapiens
acctcatcactggac

SEQ ID NO: 986506 - DNA, 22 bp, Homo sapiens
acctcatcactggactgcatgg

SEQ ID NO: 986507 - DNA, 16 bp, Homo sapiens
acctcatcatccaccc

SEQ ID NO: 986508 - DNA, 18 bp, Homo sapiens
acctcatcatccacccgc

SEQ ID NO: 986509 - DNA, 22 bp, Homo sapiens
acctcatcatccacccgctgcc

SEQ ID NO: 986510 - DNA, 13 bp, Homo sapiens
acctcatcctgct

SEQ ID NO: 986511 - DNA, 18 bp, Homo sapiens
acctcatctgtggagctg

SEQ ID NO: 986512 - DNA, 16 bp, Homo sapiens
acctcatctttctcct

SEQ ID NO: 986513 - DNA, 16 bp, Homo sapiens
acctcatgcccagctc

SEQ ID NO: 986514 - DNA, 21 bp, Homo sapiens
acctcatgcccagctctctga

SEQ ID NO: 986515 - DNA, 22 bp, Homo sapiens
acctcatggattgccacagctc

SEQ ID NO: 986516 - DNA, 23 bp, Homo sapiens
acctcatggtcatggacagatag

SEQ ID NO: 986517 - DNA, 19 bp, Homo sapiens
acctccaaagcttcccacg

SEQ ID NO: 986518 - DNA, 23 bp, Homo sapiens
acctccaacccaacccaatccct

SEQ ID NO: 986519 - DNA, 17 bp, Homo sapiens
acctccaagcatttcat

SEQ ID NO: 986520 - DNA, 22 bp, Homo sapiens
acctccaataaagtgccttctg

SEQ ID NO: 986521 - DNA, 14 bp, Homo sapiens
acctccacatcctc

SEQ ID NO: 986522 - DNA, 19 bp, Homo sapiens
acctccaccacatctgcca

SEQ ID NO: 986523 - DNA, 12 bp, Homo sapiens
acctccacccac

SEQ ID NO: 986524 - DNA, 18 bp, Homo sapiens
acctccacccactgtccg

SEQ ID NO: 986525 - DNA, 22 bp, Homo sapiens
acctccacccactgtccgcctc

SEQ ID NO: 986526 - DNA, 14 bp, Homo sapiens
acctccacccagcc

SEQ ID NO: 986527 - DNA, 16 bp, Homo sapiens
acctccacccagcccc

SEQ ID NO: 986528 - DNA, 17 bp, Homo sapiens
acctccagcccgggagc

SEQ ID NO: 986529 - DNA, 22 bp, Homo sapiens
acctccagcccgggagcctagg

SEQ ID NO: 986530 - DNA, 15 bp, Homo sapiens
acctccagcctccct

SEQ ID NO: 986531 - DNA, 23 bp, Homo sapiens
acctccagcctccctgtctccag

SEQ ID NO: 986532 - DNA, 14 bp, Homo sapiens
acctccaggcctgt

SEQ ID NO: 986533 - DNA, 15 bp, Homo sapiens
acctccaggcctgtt

SEQ ID NO: 986534 - DNA, 13 bp, Homo sapiens
acctccaggggct

SEQ ID NO: 986535 - DNA, 16 bp, Homo sapiens
acctccaggggctcct

SEQ ID NO: 986536 - DNA, 21 bp, Homo sapiens
acctccaggggctcctgggtt

SEQ ID NO: 986537 - DNA, 22 bp, Homo sapiens
acctccaggggctcctgggttg

SEQ ID NO: 986538 - DNA, 17 bp, Homo sapiens
acctccagtcacactcc

SEQ ID NO: 986539 - DNA, 19 bp, Homo sapiens
acctccatccctgctctgg

SEQ ID NO: 986540 - DNA, 19 bp, Homo sapiens
acctccattaaagtctgaa

SEQ ID NO: 986541 - DNA, 20 bp, Homo sapiens
acctcccagaggtccagccc

SEQ ID NO: 986542 - DNA, 15 bp, Homo sapiens
acctcccagccctat

SEQ ID NO: 986543 - DNA, 21 bp, Homo sapiens
acctcccagccctatggatgt

SEQ ID NO: 986544 - DNA, 14 bp, Homo sapiens
acctcccaggacaa

SEQ ID NO: 986545 - DNA, 16 bp, Homo sapiens
acctcccatttctgtt

SEQ ID NO: 986546 - DNA, 12 bp, Homo sapiens
acctccccaaag

SEQ ID NO: 986547 - DNA, 12 bp, Homo sapiens
agaatcccagcc

SEQ ID NO: 986548 - DNA, 16 bp, Homo sapiens
agaatccctgttcatt

SEQ ID NO: 986549 - DNA, 20 bp, Homo sapiens
agaatcccttaacagttgta

SEQ ID NO: 986550 - DNA, 22 bp, Homo sapiens
agaatcccttaacagttgtatt

SEQ ID NO: 986551 - DNA, 21 bp, Homo sapiens
agaatcctaggctccacccca

SEQ ID NO: 986552 - DNA, 15 bp, Homo sapiens
agaatcctgcctctc

SEQ ID NO: 986553 - DNA, 14 bp, Homo sapiens
agaatcctttacat

SEQ ID NO: 986554 - DNA, 21 bp, Homo sapiens
agaatcgatgggggatgcttc

SEQ ID NO: 986555 - DNA, 18 bp, Homo sapiens
agaatcgttttgtactgt

SEQ ID NO: 986556 - DNA, 10 bp, Homo sapiens
agaatctaaa

SEQ ID NO: 986557 - DNA, 14 bp, Homo sapiens
agaatctaaacctt

SEQ ID NO: 986558 - DNA, 19 bp, Homo sapiens
agaatctacccaaaggata

SEQ ID NO: 986559 - DNA, 17 bp, Homo sapiens
agaatctgctgcatagc

SEQ ID NO: 986560 - DNA, 18 bp, Homo sapiens
agaatctgctgttgccat

SEQ ID NO: 986561 - DNA, 12 bp, Homo sapiens
agaatctggggg

SEQ ID NO: 986562 - DNA, 12 bp, Homo sapiens
agaatcttaagg

SEQ ID NO: 986563 - DNA, 16 bp, Homo sapiens
agaatcttaaggtcta

SEQ ID NO: 986564 - DNA, 17 bp, Homo sapiens
agaatcttgactttctg

SEQ ID NO: 986565 - DNA, 19 bp, Homo sapiens
agaatctttattgagaaag

SEQ ID NO: 986566 - DNA, 16 bp, Homo sapiens
agaatgaaaactcatt

SEQ ID NO: 986567 - DNA, 18 bp, Homo sapiens
agaatgaaccctcctcct

SEQ ID NO: 986568 - DNA, 13 bp, Homo sapiens
agaatgaatttat

SEQ ID NO: 986569 - DNA, 18 bp, Homo sapiens
agaatgagaagggaaggc

SEQ ID NO: 986570 - DNA, 17 bp, Homo sapiens
agaatgagagcgacaca

SEQ ID NO: 986571 - DNA, 21 bp, Homo sapiens
agaatgagcctacgctgaaga

SEQ ID NO: 986572 - DNA, 12 bp, Homo sapiens
agaatgagcctc

SEQ ID NO: 986573 - DNA, 18 bp, Homo sapiens
agaatgaggaagcaaaga

SEQ ID NO: 986574 - DNA, 20 bp, Homo sapiens
agaatgagtgggaatccggg

SEQ ID NO: 986575 - DNA, 19 bp, Homo sapiens
agaatgatagaactttgcc

SEQ ID NO: 986576 - DNA, 13 bp, Homo sapiens
agaatgatgctca

SEQ ID NO: 986577 - DNA, 18 bp, Homo sapiens
agaatgattaatcaaagg

SEQ ID NO: 986578 - DNA, 13 bp, Homo sapiens
agaatgatttcat

SEQ ID NO: 986579 - DNA, 16 bp, Homo sapiens
agaatgatttttagat

SEQ ID NO: 986580 - DNA, 13 bp, Homo sapiens
agaatgcaagcag

SEQ ID NO: 986581 - DNA, 16 bp, Homo sapiens
agaatgcacaagaatg

SEQ ID NO: 986582 - DNA, 19 bp, Homo sapiens
agaatgcacaagaatggat

SEQ ID NO: 986583 - DNA, 19 bp, Homo sapiens
agaatgcacttgattcagg

SEQ ID NO: 986584 - DNA, 23 bp, Homo sapiens
agaatgcagattcctgggcctgt

SEQ ID NO: 986585 - DNA, 21 bp, Homo sapiens
agaatgcagcccaccaggagc

SEQ ID NO: 986586 - DNA, 21 bp, Homo sapiens
agaatgcattccagaacaaat

SEQ ID NO: 986587 - DNA, 12 bp, Homo sapiens
agaatgctcagg

SEQ ID NO: 986588 - DNA, 12 bp, Homo sapiens
agaatgctgaac

SEQ ID NO: 986589 - DNA, 20 bp, Homo sapiens
agaatgctgaactccttgtt

SEQ ID NO: 986590 - DNA, 22 bp, Homo sapiens
agaatgctgcaggacttgagaa

SEQ ID NO: 986591 - DNA, 18 bp, Homo sapiens
agaatgctggttttccta

SEQ ID NO: 986592 - DNA, 14 bp, Homo sapiens
agaatgctgtacat

SEQ ID NO: 986593 - DNA, 14 bp, Homo sapiens
agaatgcttaatca

SEQ ID NO: 986594 - DNA, 18 bp, Homo sapiens
agaatggaagagagaaag

SEQ ID NO: 986595 - DNA, 14 bp, Homo sapiens
agaatggaatagaa

SEQ ID NO: 986596 - DNA, 14 bp, Homo sapiens
agaatggaggcagg

SEQ ID NO: 986597 - DNA, 20 bp, Homo sapiens
agaatggatcacaagatgga

SEQ ID NO: 986598 - DNA, 22 bp, Homo sapiens
agaatggcccagtcctctccca

SEQ ID NO: 986599 - DNA, 18 bp, Homo sapiens
agaatggctgggtcaggg

SEQ ID NO: 986600 - DNA, 16 bp, Homo sapiens
agaatggctttcaata

SEQ ID NO: 986601 - DNA, 22 bp, Homo sapiens
agaatggctttcaatacccttt

SEQ ID NO: 986602 - DNA, 14 bp, Homo sapiens
agaatgggatgtgt

SEQ ID NO: 986603 - DNA, 18 bp, Homo sapiens
agaatggggttcctgctg

SEQ ID NO: 986604 - DNA, 19 bp, Homo sapiens
agaatggggttcctgctgt

SEQ ID NO: 986605 - DNA, 16 bp, Homo sapiens
agaatggtgctgttta

SEQ ID NO: 986606 - DNA, 17 bp, Homo sapiens
agaatgtaaaagaactt

SEQ ID NO: 986607 - DNA, 19 bp, Homo sapiens
agaatgtaactccagatag

SEQ ID NO: 986608 - DNA, 14 bp, Homo sapiens
agaatgtaagaaaa

SEQ ID NO: 986609 - DNA, 19 bp, Homo sapiens
agaatgtagtcagactgac

SEQ ID NO: 986610 - DNA, 21 bp, Homo sapiens
agaatgtatcagccagccttc

SEQ ID NO: 986611 - DNA, 16 bp, Homo sapiens
agaatgtatctgtgaa

SEQ ID NO: 986612 - DNA, 18 bp, Homo sapiens
agctgggttccgggaggc

SEQ ID NO: 986613 - DNA, 19 bp, Homo sapiens
agctggtagttagtagcat

SEQ ID NO: 986614 - DNA, 21 bp, Homo sapiens
agctggtagttagtagcatgt

SEQ ID NO: 986615 - DNA, 14 bp, Homo sapiens
agctggtcagtctt

SEQ ID NO: 986616 - DNA, 18 bp, Homo sapiens
agctggtcagtctttgct

SEQ ID NO: 986617 - DNA, 19 bp, Homo sapiens
agctggtcagtctttgctc

SEQ ID NO: 986618 - DNA, 23 bp, Homo sapiens
agctggtcagtctttgctcagtg

SEQ ID NO: 986619 - DNA, 12 bp, Homo sapiens
agctggtcctgt

SEQ ID NO: 986620 - DNA, 15 bp, Homo sapiens
agctggtcctgtgga

SEQ ID NO: 986621 - DNA, 18 bp, Homo sapiens
agctggtcttttctccta

SEQ ID NO: 986622 - DNA, 10 bp, Homo sapiens
agctggtgca

SEQ ID NO: 986623 - DNA, 13 bp, Homo sapiens
agctggtgcatta

SEQ ID NO: 986624 - DNA, 18 bp, Homo sapiens
agctggtgcattacagag

SEQ ID NO: 986625 - DNA, 20 bp, Homo sapiens
agctggtgcattacagagag

SEQ ID NO: 986626 - DNA, 16 bp, Homo sapiens
agctggtggccctgtg

SEQ ID NO: 986627 - DNA, 23 bp, Homo sapiens
agctggtggccctgtgcctgggc

SEQ ID NO: 986628 - DNA, 15 bp, Homo sapiens
agctggtggtgcagc

SEQ ID NO: 986629 - DNA, 21 bp, Homo sapiens
agctggtggtgcagccttccc

SEQ ID NO: 986630 - DNA, 22 bp, Homo sapiens
agctggtggtttgatcatttct

SEQ ID NO: 986631 - DNA, 18 bp, Homo sapiens
agctggtgtcagcccctc

SEQ ID NO: 986632 - DNA, 17 bp, Homo sapiens
agctgtaagaagagact

SEQ ID NO: 986633 - DNA, 18 bp, Homo sapiens
agctgtaagaagagactg

SEQ ID NO: 986634 - DNA, 23 bp, Homo sapiens
agctgtaagaagagactgggaag

SEQ ID NO: 986635 - DNA, 14 bp, Homo sapiens
agctgtaagcaagt

SEQ ID NO: 986636 - DNA, 18 bp, Homo sapiens
agctgtaaggcatgaagg

SEQ ID NO: 986637 - DNA, 19 bp, Homo sapiens
agctgtaaggcatgaagga

SEQ ID NO: 986638 - DNA, 16 bp, Homo sapiens
agctgtaagggcagtg

SEQ ID NO: 986639 - DNA, 17 bp, Homo sapiens
agctgtaagggcagtgc

SEQ ID NO: 986640 - DNA, 16 bp, Homo sapiens
atgttttttgtaagat

SEQ ID NO: 986641 - DNA, 17 bp, Homo sapiens
atgttttttgtaagata

SEQ ID NO: 986642 - DNA, 21 bp, Homo sapiens
attaaaaaaaaaaaaaaactc

SEQ ID NO: 986643 - DNA, 20 bp, Homo sapiens
attaaaaaaaaagatctgtt

SEQ ID NO: 986644 - DNA, 17 bp, Homo sapiens
attaaaaaaaaattgta

SEQ ID NO: 986645 - DNA, 20 bp, Homo sapiens
attaaaaaaaacaaaaagaa

SEQ ID NO: 986646 - DNA, 12 bp, Homo sapiens
attaaaaaacaa

SEQ ID NO: 986647 - DNA, 15 bp, Homo sapiens
attaaaaaatttgta

SEQ ID NO: 986648 - DNA, 14 bp, Homo sapiens
attaaaaacatgaa

SEQ ID NO: 986649 - DNA, 11 bp, Homo sapiens
attaaaaactt

SEQ ID NO: 986650 - DNA, 23 bp, Homo sapiens
attaaaaagtctgtatggcatga

SEQ ID NO: 986651 - DNA, 23 bp, Homo sapiens
attaaaaataccttctatgtatt

SEQ ID NO: 986652 - DNA, 15 bp, Homo sapiens
attaaaaatagatat

SEQ ID NO: 986653 - DNA, 14 bp, Homo sapiens
attaaaaatatgga

SEQ ID NO: 986654 - DNA, 14 bp, Homo sapiens
attaaaaatgctgt

SEQ ID NO: 986655 - DNA, 14 bp, Homo sapiens
attaaaaatgttct

SEQ ID NO: 986656 - DNA, 20 bp, Homo sapiens
attaaaaatgttctcaaata

SEQ ID NO: 986657 - DNA, 13 bp, Homo sapiens
attaaaaattacc

SEQ ID NO: 986658 - DNA, 13 bp, Homo sapiens
attaaaaattata

SEQ ID NO: 986659 - DNA, 13 bp, Homo sapiens
attaaaacaaata

SEQ ID NO: 986660 - DNA, 18 bp, Homo sapiens
attaaaacaatattgttt

SEQ ID NO: 986661 - DNA, 21 bp, Homo sapiens
attaaaacaatattgtttcta

SEQ ID NO: 986662 - DNA, 18 bp, Homo sapiens
attaaaacatatttcatt

SEQ ID NO: 986663 - DNA, 20 bp, Homo sapiens
attaaaactgagtccatgaa

SEQ ID NO: 986664 - DNA, 23 bp, Homo sapiens
attaaaagaaaataaaaaaaaga

SEQ ID NO: 986665 - DNA, 22 bp, Homo sapiens
attaaaagaaatatacagtttg

SEQ ID NO: 986666 - DNA, 22 bp, Homo sapiens
attaaaagcaaatcatttgttt

SEQ ID NO: 986667 - DNA, 17 bp, Homo sapiens
attaaaagttgcatttg

SEQ ID NO: 986668 - DNA, 14 bp, Homo sapiens
attaaaagtttggg

SEQ ID NO: 986669 - DNA, 13 bp, Homo sapiens
attaaaataaaac

SEQ ID NO: 986670 - DNA, 16 bp, Homo sapiens
attaaaataaaacaag

SEQ ID NO: 986671 - DNA, 17 bp, Homo sapiens
attaaaataaaacaagc

SEQ ID NO: 986672 - DNA, 21 bp, Homo sapiens
attaaaataaaacaagcctta

SEQ ID NO: 986673 - DNA, 19 bp, Homo sapiens
attaaaatactatgcagta

SEQ ID NO: 986674 - DNA, 15 bp, Homo sapiens
attaaaatagcatac

SEQ ID NO: 986675 - DNA, 20 bp, Homo sapiens
attaaaatagcatactgtgt

SEQ ID NO: 986676 - DNA, 21 bp, Homo sapiens
attaaaatagcatactgtgta

SEQ ID NO: 986677 - DNA, 13 bp, Homo sapiens
attaaaatataat

SEQ ID NO: 986678 - DNA, 18 bp, Homo sapiens
attaaaatataatctcta

SEQ ID NO: 986679 - DNA, 23 bp, Homo sapiens
attaaaatatagagacaggacag

SEQ ID NO: 986680 - DNA, 15 bp, Homo sapiens
attaaaatatatgtt

SEQ ID NO: 986681 - DNA, 21 bp, Homo sapiens
attaaaatatatgttctgcaa

SEQ ID NO: 986682 - DNA, 12 bp, Homo sapiens
attaaaatatta

SEQ ID NO: 986683 - DNA, 16 bp, Homo sapiens
attaaaatattatttg

SEQ ID NO: 986684 - DNA, 17 bp, Homo sapiens
attaaaatatttcaggt

SEQ ID NO: 986685 - DNA, 15 bp, Homo sapiens
attaaaatattttgg

SEQ ID NO: 986686 - DNA, 16 bp, Homo sapiens
attaaaatcctcaatc

SEQ ID NO: 986687 - DNA, 13 bp, Homo sapiens
attaacctctcac

SEQ ID NO: 986688 - DNA, 17 bp, Homo sapiens
attaacctctcacagtt

SEQ ID NO: 986689 - DNA, 14 bp, Homo sapiens
attaacctggtgct

SEQ ID NO: 986690 - DNA, 15 bp, Homo sapiens
attaacgatgtccaa

SEQ ID NO: 986691 - DNA, 16 bp, Homo sapiens
attaacgggcatgtat

SEQ ID NO: 986692 - DNA, 14 bp, Homo sapiens
attaactaaatgct

SEQ ID NO: 986693 - DNA, 13 bp, Homo sapiens
attaactccctcc

SEQ ID NO: 986694 - DNA, 14 bp, Homo sapiens
attaactccctcca

SEQ ID NO: 986695 - DNA, 19 bp, Homo sapiens
attaactccctccaccagc

SEQ ID NO: 986696 - DNA, 21 bp, Homo sapiens
attaactccctccaccagcct

SEQ ID NO: 986697 - DNA, 15 bp, Homo sapiens
attaactgtaaactt

SEQ ID NO: 986698 - DNA, 13 bp, Homo sapiens
attaactgtatgt

SEQ ID NO: 986699 - DNA, 16 bp, Homo sapiens
attaacttaactgaag

SEQ ID NO: 986700 - DNA, 18 bp, Homo sapiens
attaacttctctggaaag

SEQ ID NO: 986701 - DNA, 13 bp, Homo sapiens
attaactttaatg

SEQ ID NO: 986702 - DNA, 19 bp, Homo sapiens
attaacttttataaacttt

SEQ ID NO: 986703 - DNA, 14 bp, Homo sapiens
attaagaaaacatt

SEQ ID NO: 986704 - DNA, 14 bp, Homo sapiens
attaagaaaatcat

SEQ ID NO: 986705 - DNA, 20 bp, Homo sapiens
attaagaaaatcatattgct

SEQ ID NO: 986706 - DNA, 13 bp, Homo sapiens
attaagaaaggaa

SEQ ID NO: 986707 - DNA, 12 bp, Homo sapiens
attaagaaatag

SEQ ID NO: 986708 - DNA, 20 bp, Homo sapiens
attaagaacacttttaataa

SEQ ID NO: 986709 - DNA, 20 bp, Homo sapiens
attaagaatatgtttccttg

SEQ ID NO: 986710 - DNA, 21 bp, Homo sapiens
attaagacaatagcacttaaa

SEQ ID NO: 986711 - DNA, 13 bp, Homo sapiens
attaagacagcat

SEQ ID NO: 986712 - DNA, 16 bp, Homo sapiens
attaagacagtgtaca

SEQ ID NO: 986713 - DNA, 17 bp, Homo sapiens
attaagacagtgtacaa

SEQ ID NO: 986714 - DNA, 24 bp, Homo sapiens
attaagacttacttgcattgctgg

SEQ ID NO: 986715 - DNA, 18 bp, Homo sapiens
attaagaggtaagactta

SEQ ID NO: 986716 - DNA, 15 bp, Homo sapiens
attaagatacaaatt

SEQ ID NO: 986717 - DNA, 17 bp, Homo sapiens
attaagatacaaattaa

SEQ ID NO: 986718 - DNA, 21 bp, Homo sapiens
attaagatcctaaactctcta

SEQ ID NO: 986719 - DNA, 23 bp, Homo sapiens
attaagatggattctcagatatt

SEQ ID NO: 986720 - DNA, 24 bp, Homo sapiens
attaagatggattctcagatattt

SEQ ID NO: 986721 - DNA, 16 bp, Homo sapiens
attaagattggaaatg

SEQ ID NO: 986722 - DNA, 22 bp, Homo sapiens
attaagattttactttaacagt

SEQ ID NO: 986723 - DNA, 13 bp, Homo sapiens
attaagcacacac

SEQ ID NO: 986724 - DNA, 24 bp, Homo sapiens
attaagcacacacatctggccctg

SEQ ID NO: 986725 - DNA, 14 bp, Homo sapiens
attaagcagaaaca

SEQ ID NO: 986726 - DNA, 19 bp, Homo sapiens
attaagccaggaaacatga

SEQ ID NO: 986727 - DNA, 23 bp, Homo sapiens
attaagccaggaaacatgaagca

SEQ ID NO: 986728 - DNA, 19 bp, Homo sapiens
attaagcccacagtatatt

SEQ ID NO: 986729 - DNA, 21 bp, Homo sapiens
attaagcccttatttgttttg

SEQ ID NO: 986730 - DNA, 21 bp, Homo sapiens
attaagcctaccgtatttcag

SEQ ID NO: 986731 - DNA, 17 bp, Homo sapiens
attaagctttttggaat

SEQ ID NO: 986732 - DNA, 18 bp, Homo sapiens
attaagctttttggaatc

SEQ ID NO: 986733 - DNA, 14 bp, Homo sapiens
attaagggtaggat

SEQ ID NO: 986734 - DNA, 14 bp, Homo sapiens
attaaggtatttcg

SEQ ID NO: 986735 - DNA, 22 bp, Homo sapiens
attaaggtatttcgaaactgcc

SEQ ID NO: 986736 - DNA, 18 bp, Homo sapiens
attaagtaatcaataaag

SEQ ID NO: 986737 - DNA, 13 bp, Homo sapiens
attaagtaatctt

SEQ ID NO: 986738 - DNA, 14 bp, Homo sapiens
attaagtaatcttt

SEQ ID NO: 986739 - DNA, 16 bp, Homo sapiens
attaagtactatgtat

SEQ ID NO: 986740 - DNA, 20 bp, Homo sapiens
attaagtatctgggattatt

SEQ ID NO: 986741 - DNA, 18 bp, Homo sapiens
attaagtcattttgtaat

SEQ ID NO: 986742 - DNA, 21 bp, Homo sapiens
attaagtggggtagactgagg

SEQ ID NO: 986743 - DNA, 22 bp, Homo sapiens
attaagtggtagtaatttcctt

SEQ ID NO: 986744 - DNA, 14 bp, Homo sapiens
attaagttgaaaaa

SEQ ID NO: 986745 - DNA, 15 bp, Homo sapiens
attaagttgaaaaag

SEQ ID NO: 986746 - DNA, 14 bp, Homo sapiens
attaagttgttaat

SEQ ID NO: 986747 - DNA, 16 bp, Homo sapiens
attaataaaaaatgga

SEQ ID NO: 986748 - DNA, 16 bp, Homo sapiens
attaataaagaaaaag

SEQ ID NO: 986749 - DNA, 15 bp, Homo sapiens
attaataaatttata

SEQ ID NO: 986750 - DNA, 14 bp, Homo sapiens
attaataacctgcc

SEQ ID NO: 986751 - DNA, 12 bp, Homo sapiens
attaataatctt

SEQ ID NO: 986752 - DNA, 15 bp, Homo sapiens
attaataatgaagta

SEQ ID NO: 986753 - DNA, 15 bp, Homo sapiens
attaatacattctat

SEQ ID NO: 986754 - DNA, 16 bp, Homo sapiens
attaatacttcatttg

SEQ ID NO: 986755 - DNA, 23 bp, Homo sapiens
attaatagagttggagttttatt

SEQ ID NO: 986756 - DNA, 16 bp, Homo sapiens
attaatagctgccttc

SEQ ID NO: 986757 - DNA, 16 bp, Homo sapiens
attaatagtaatttgt

SEQ ID NO: 986758 - DNA, 12 bp, Homo sapiens
attaatagttca

SEQ ID NO: 986759 - DNA, 16 bp, Homo sapiens
attaatatatagtcca

SEQ ID NO: 986760 - DNA, 22 bp, Homo sapiens
attaatatatgtattatttata

SEQ ID NO: 986761 - DNA, 19 bp, Homo sapiens
attaatatccctacatgta

SEQ ID NO: 986762 - DNA, 20 bp, Homo sapiens
attaatatccctacatgtat

SEQ ID NO: 986763 - DNA, 19 bp, Homo sapiens
attaatatcctgtaataaa

SEQ ID NO: 986764 - DNA, 14 bp, Homo sapiens
attaatatcttgct

SEQ ID NO: 986765 - DNA, 23 bp, Homo sapiens
attaatatttaacattatttata

SEQ ID NO: 986766 - DNA, 17 bp, Homo sapiens
attaatatttgtttagt

SEQ ID NO: 986767 - DNA, 18 bp, Homo sapiens
attaatcaagagaaactt

SEQ ID NO: 986768 - DNA, 22 bp, Homo sapiens
attaatcaagtacctatattga

SEQ ID NO: 986769 - DNA, 16 bp, Homo sapiens
attaatcatacaaact

SEQ ID NO: 986770 - DNA, 22 bp, Homo sapiens
attaatcatacaaactctcacc

SEQ ID NO: 986771 - DNA, 22 bp, Homo sapiens
attaatcatagattattataaa

SEQ ID NO: 986772 - DNA, 19 bp, Homo sapiens
attaatcatctataaagaa

SEQ ID NO: 986773 - DNA, 17 bp, Homo sapiens
attaatccacatgtttc

SEQ ID NO: 986774 - DNA, 17 bp, Homo sapiens
attaatcttagtgtatg

SEQ ID NO: 986775 - DNA, 17 bp, Homo sapiens
attaatcttgtgtagtc

SEQ ID NO: 986776 - DNA, 20 bp, Homo sapiens
attaatgaaatgataaagac

SEQ ID NO: 986777 - DNA, 13 bp, Homo sapiens
attaatgcacttt

SEQ ID NO: 986778 - DNA, 16 bp, Homo sapiens
attaatgcactttcta

SEQ ID NO: 986779 - DNA, 13 bp, Homo sapiens
attaatgcccagc

SEQ ID NO: 986780 - DNA, 15 bp, Homo sapiens
attaatgcctttaaa

SEQ ID NO: 986781 - DNA, 17 bp, Homo sapiens
attaatgcctttaaagt

SEQ ID NO: 986782 - DNA, 22 bp, Homo sapiens
attaatgtttatttagctctga

SEQ ID NO: 986783 - DNA, 14 bp, Homo sapiens
attaatgtttctta

SEQ ID NO: 986784 - DNA, 15 bp, Homo sapiens
attaatgtttcttaa

SEQ ID NO: 986785 - DNA, 20 bp, Homo sapiens
attaatgtttcttaaatgga

SEQ ID NO: 986786 - DNA, 17 bp, Homo sapiens
attaatgttttcattat

SEQ ID NO: 986787 - DNA, 20 bp, Homo sapiens
attaatgttttcattatgtt

SEQ ID NO: 986788 - DNA, 18 bp, Homo sapiens
attaatgttttgtacaat

SEQ ID NO: 986789 - DNA, 14 bp, Homo sapiens
attaattaagtatc

SEQ ID NO: 986790 - DNA, 16 bp, Homo sapiens
attaattaatttggag

SEQ ID NO: 986791 - DNA, 16 bp, Homo sapiens
attaattacaattatg

SEQ ID NO: 986792 - DNA, 18 bp, Homo sapiens
attaattacatacagatt

SEQ ID NO: 986793 - DNA, 13 bp, Homo sapiens
attaattagttta

SEQ ID NO: 986794 - DNA, 13 bp, Homo sapiens
attaattgtaatc

SEQ ID NO: 986795 - DNA, 16 bp, Homo sapiens
attaattgtcctgtgt

SEQ ID NO: 986796 - DNA, 18 bp, Homo sapiens
attaattgttttgcactt

SEQ ID NO: 986797 - DNA, 19 bp, Homo sapiens
attaattgttttgcacttt

SEQ ID NO: 986798 - DNA, 14 bp, Homo sapiens
attaatttaaatga

SEQ ID NO: 986799 - DNA, 14 bp, Homo sapiens
attaatttattggg

SEQ ID NO: 986800 - DNA, 14 bp, Homo sapiens
attaatttatttgt

SEQ ID NO: 986801 - DNA, 15 bp, Homo sapiens
attaatttctgataa

SEQ ID NO: 986802 - DNA, 23 bp, Homo sapiens
attaatttctgataaagttcctt

SEQ ID NO: 986803 - DNA, 20 bp, Homo sapiens
attaatttctgccatttcat

SEQ ID NO: 986804 - DNA, 22 bp, Homo sapiens
attaatttctgccatttcatgt

SEQ ID NO: 986805 - DNA, 13 bp, Homo sapiens
ccgaagtcttttg

SEQ ID NO: 986806 - DNA, 11 bp, Homo sapiens
ccgaataaatg

SEQ ID NO: 986807 - DNA, 20 bp, Homo sapiens
ccgaatgtgcaggtttgtta

SEQ ID NO: 986808 - DNA, 19 bp, Homo sapiens
ccgacaatgccctgctggc

SEQ ID NO: 986809 - DNA, 16 bp, Homo sapiens
ccgacactgctgcacc

SEQ ID NO: 986810 - DNA, 18 bp, Homo sapiens
ccgacactgctgcaccag

SEQ ID NO: 986811 - DNA, 19 bp, Homo sapiens
ccgacaggtgggcctggga

SEQ ID NO: 986812 - DNA, 19 bp, Homo sapiens
ccgacagtcggtgacccca

SEQ ID NO: 986813 - DNA, 17 bp, Homo sapiens
ccgacattgtctcccgc

SEQ ID NO: 986814 - DNA, 16 bp, Homo sapiens
ccgacatttcttcata

SEQ ID NO: 986815 - DNA, 16 bp, Homo sapiens
ccgaccaactgcccta

SEQ ID NO: 986816 - DNA, 15 bp, Homo sapiens
ccgaccacctgccca

SEQ ID NO: 986817 - DNA, 20 bp, Homo sapiens
ccgacccccgcagaggcaga

SEQ ID NO: 986818 - DNA, 16 bp, Homo sapiens
ccgacccgaggcccag

SEQ ID NO: 986819 - DNA, 13 bp, Homo sapiens
ccgaccctcctgg

SEQ ID NO: 986820 - DNA, 14 bp, Homo sapiens
ccgaccctcctggc

SEQ ID NO: 986821 - DNA, 15 bp, Homo sapiens
ccgaccctcctggcc

SEQ ID NO: 986822 - DNA, 17 bp, Homo sapiens
ccgaccctctgggaacc

SEQ ID NO: 986823 - DNA, 21 bp, Homo sapiens
ccgaccgaggctggagctggc

SEQ ID NO: 986824 - DNA, 24 bp, Homo sapiens
ccgacgccgtcccaccagcttcac

SEQ ID NO: 986825 - DNA, 16 bp, Homo sapiens
ccgacgcgtctcctgt

SEQ ID NO: 986826 - DNA, 13 bp, Homo sapiens
ccgactcaggtcc

SEQ ID NO: 986827 - DNA, 12 bp, Homo sapiens
ccgactccagat

SEQ ID NO: 986828 - DNA, 15 bp, Homo sapiens
ccgactccagccagc

SEQ ID NO: 986829 - DNA, 16 bp, Homo sapiens
ccgactccagccagcg

SEQ ID NO: 986830 - DNA, 20 bp, Homo sapiens
ccgactcccccaaccaagga

SEQ ID NO: 986831 - DNA, 21 bp, Homo sapiens
ccgactcccccaaccaaggaa

SEQ ID NO: 986832 - DNA, 23 bp, Homo sapiens
ccgactcccccaaccaaggaagg

SEQ ID NO: 986833 - DNA, 12 bp, Homo sapiens
ccgactccctga

SEQ ID NO: 986834 - DNA, 13 bp, Homo sapiens
ccgactctggccc

SEQ ID NO: 986835 - DNA, 14 bp, Homo sapiens
ccgactctggccct

SEQ ID NO: 986836 - DNA, 19 bp, Homo sapiens
ccgactctggccctggccc

SEQ ID NO: 986837 - DNA, 17 bp, Homo sapiens
ccgactgaccctgagga

SEQ ID NO: 986838 - DNA, 23 bp, Homo sapiens
ccgactgaccctgaggaggccgc

SEQ ID NO: 986839 - DNA, 23 bp, Homo sapiens
ccgactgcacagcggcccctgca

SEQ ID NO: 986840 - DNA, 14 bp, Homo sapiens
ccgactgcccagcc

SEQ ID NO: 986841 - DNA, 13 bp, Homo sapiens
ccgactgcctgtc

SEQ ID NO: 986842 - DNA, 19 bp, Homo sapiens
ccgactgcctgtctccatg

SEQ ID NO: 986843 - DNA, 14 bp, Homo sapiens
ccgactgctttgga

SEQ ID NO: 986844 - DNA, 14 bp, Homo sapiens
ccgactgggctcaa

SEQ ID NO: 986845 - DNA, 12 bp, Homo sapiens
ccgactgtcttg

SEQ ID NO: 986846 - DNA, 18 bp, Homo sapiens
ccgacttcccctgggcaa

SEQ ID NO: 986847 - DNA, 22 bp, Homo sapiens
ccgacttgaatattcctggact

SEQ ID NO: 986848 - DNA, 19 bp, Homo sapiens
ccgacttggagactcctgg

SEQ ID NO: 986849 - DNA, 18 bp, Homo sapiens
ccgagaagggggtgacag

SEQ ID NO: 986850 - DNA, 15 bp, Homo sapiens
ccgagacactttata

SEQ ID NO: 986851 - DNA, 13 bp, Homo sapiens
ccgagaccgcaga

SEQ ID NO: 986852 - DNA, 23 bp, Homo sapiens
ccgagagagcacccctctctgca

SEQ ID NO: 986853 - DNA, 18 bp, Homo sapiens
ccgagagcagtgggcagg

SEQ ID NO: 986854 - DNA, 13 bp, Homo sapiens
ccgagagggagag

SEQ ID NO: 986855 - DNA, 21 bp, Homo sapiens
ccgagaggtgggccagtctgt

SEQ ID NO: 986856 - DNA, 20 bp, Homo sapiens
ccgagagtagccgagagcct

SEQ ID NO: 986857 - DNA, 15 bp, Homo sapiens
ccgagcaaagatcaa

SEQ ID NO: 986858 - DNA, 12 bp, Homo sapiens
ccgagcccagct

SEQ ID NO: 986859 - DNA, 13 bp, Homo sapiens
ccgagccctgact

SEQ ID NO: 986860 - DNA, 16 bp, Homo sapiens
ccgagccctgactcct

SEQ ID NO: 986861 - DNA, 19 bp, Homo sapiens
ccgagccctgactcctgga

SEQ ID NO: 986862 - DNA, 18 bp, Homo sapiens
ccgagcgacggctcctcc

SEQ ID NO: 986863 - DNA, 22 bp, Homo sapiens
ccgagctactctcttgccagca

SEQ ID NO: 986864 - DNA, 23 bp, Homo sapiens
ccgagctactctcttgccagcat

SEQ ID NO: 986865 - DNA, 16 bp, Homo sapiens
ccgagctcctcttcca

SEQ ID NO: 986866 - DNA, 18 bp, Homo sapiens
ccgagctcctcttccatg

SEQ ID NO: 986867 - DNA, 20 bp, Homo sapiens
ccgagctcgtgtatcctggg

SEQ ID NO: 986868 - DNA, 21 bp, Homo sapiens
ccgagctcgtgtatcctgggg

SEQ ID NO: 986869 - DNA, 14 bp, Homo sapiens
ccgagctggaaaac

SEQ ID NO: 986870 - DNA, 18 bp, Homo sapiens
ccgagctgggggccatga

SEQ ID NO: 986871 - DNA, 21 bp, Homo sapiens
ccgaggaagcacagcttgggt

SEQ ID NO: 986872 - DNA, 13 bp, Homo sapiens
ccgaggactggac

SEQ ID NO: 986873 - DNA, 19 bp, Homo sapiens
ccgaggactggactgtttt

SEQ ID NO: 986874 - DNA, 18 bp, Homo sapiens
ccgaggagctgggcccct

SEQ ID NO: 986875 - DNA, 23 bp, Homo sapiens
ccgaggagctgggcccctgcaca

SEQ ID NO: 986876 - DNA, 14 bp, Homo sapiens
ccgaggcaggtgga

SEQ ID NO: 986877 - DNA, 21 bp, Homo sapiens
ccgaggcccagatccaaggcc

SEQ ID NO: 986878 - DNA, 18 bp, Homo sapiens
ccgaggcgatgccacgct

SEQ ID NO: 986879 - DNA, 17 bp, Homo sapiens
ccgaggctggagctggc

SEQ ID NO: 986880 - DNA, 15 bp, Homo sapiens
ccgagggagctgctg

SEQ ID NO: 986881 - DNA, 15 bp, Homo sapiens
ccgagggccaggcag

SEQ ID NO: 986882 - DNA, 19 bp, Homo sapiens
ccgagggcgaaggccattg

SEQ ID NO: 986883 - DNA, 15 bp, Homo sapiens
ccgagggctgaggag

SEQ ID NO: 986884 - DNA, 17 bp, Homo sapiens
ccgagggctgaggagca

SEQ ID NO: 986885 - DNA, 18 bp, Homo sapiens
ccgagggctgaggagcag

SEQ ID NO: 986886 - DNA, 22 bp, Homo sapiens
ccgagggctgaggagcagccag

SEQ ID NO: 986887 - DNA, 17 bp, Homo sapiens
ccgaggtatggcagagg

SEQ ID NO: 986888 - DNA, 13 bp, Homo sapiens
ccgaggtgggcag

SEQ ID NO: 986889 - DNA, 14 bp, Homo sapiens
ccgaggttcccagg

SEQ ID NO: 986890 - DNA, 17 bp, Homo sapiens
ccgaggttgtggggagg

SEQ ID NO: 986891 - DNA, 23 bp, Homo sapiens
ccgaggttgtggggaggctgcac

SEQ ID NO: 986892 - DNA, 14 bp, Homo sapiens
ccgagtacagtctg

SEQ ID NO: 986893 - DNA, 14 bp, Homo sapiens
ccgagtacctccag

SEQ ID NO: 986894 - DNA, 14 bp, Homo sapiens
ccgagtagctggga

SEQ ID NO: 986895 - DNA, 15 bp, Homo sapiens
ccgagtagctgggat

SEQ ID NO: 986896 - DNA, 15 bp, Homo sapiens
ccgagtatctgtaac

SEQ ID NO: 986897 - DNA, 20 bp, Homo sapiens
ccgagtcattcgttctgtgg

SEQ ID NO: 986898 - DNA, 13 bp, Homo sapiens
ccgagtccaagct

SEQ ID NO: 986899 - DNA, 18 bp, Homo sapiens
ccgagtcctcaggtacag

SEQ ID NO: 986900 - DNA, 16 bp, Homo sapiens
ccgagtctcttctcca

SEQ ID NO: 986901 - DNA, 19 bp, Homo sapiens
ccgagtctcttctccactg

SEQ ID NO: 986902 - DNA, 21 bp, Homo sapiens
ccgagtctcttctccactgga

SEQ ID NO: 986903 - DNA, 22 bp, Homo sapiens
ccgagtctcttctccactggat

SEQ ID NO: 986904 - DNA, 13 bp, Homo sapiens
ccgagtgagtcag

SEQ ID NO: 986905 - DNA, 17 bp, Homo sapiens
ccgatatcagaatttgt

SEQ ID NO: 986906 - DNA, 22 bp, Homo sapiens
ccgatcccaggtgcgtgtgtct

SEQ ID NO: 986907 - DNA, 11 bp, Homo sapiens
ccgatgccacc

SEQ ID NO: 986908 - DNA, 17 bp, Homo sapiens
ccgatgctgctttcccc

SEQ ID NO: 986909 - DNA, 13 bp, Homo sapiens
ccgattctctgcc

SEQ ID NO: 986910 - DNA, 15 bp, Homo sapiens
ccgcaaaccacactg

SEQ ID NO: 986911 - DNA, 16 bp, Homo sapiens
ccgcaaaccacactgg

SEQ ID NO: 986912 - DNA, 21 bp, Homo sapiens
ccgcaaaccacactggactcc

SEQ ID NO: 986913 - DNA, 17 bp, Homo sapiens
ccgcaacctgcaggctc

SEQ ID NO: 986914 - DNA, 12 bp, Homo sapiens
ccgcaaggagca

SEQ ID NO: 986915 - DNA, 14 bp, Homo sapiens
ccgcaaggcctctc

SEQ ID NO: 986916 - DNA, 15 bp, Homo sapiens
ccgcaaggcctctca

SEQ ID NO: 986917 - DNA, 13 bp, Homo sapiens
ccgcaagggcctg

SEQ ID NO: 986918 - DNA, 14 bp, Homo sapiens
ccgcaagggcctgg

SEQ ID NO: 986919 - DNA, 16 bp, Homo sapiens
ccgcaagggcctggac

SEQ ID NO: 986920 - DNA, 15 bp, Homo sapiens
ccgcaatacaggaac

SEQ ID NO: 986921 - DNA, 18 bp, Homo sapiens
ccgcaatgtggagcagca

SEQ ID NO: 986922 - DNA, 12 bp, Homo sapiens
ccgcacagctca

SEQ ID NO: 986923 - DNA, 17 bp, Homo sapiens
ccgcacatggtgtgggg

SEQ ID NO: 986924 - DNA, 20 bp, Homo sapiens
ccgcacatggtgtggggggc

SEQ ID NO: 986925 - DNA, 13 bp, Homo sapiens
ccgcaccaagcag

SEQ ID NO: 986926 - DNA, 14 bp, Homo sapiens
ccgcaccaagcaga

SEQ ID NO: 986927 - DNA, 17 bp, Homo sapiens
cggtgtgcctgcagccc

SEQ ID NO: 986928 - DNA, 20 bp, Homo sapiens
cggtgtgcctgcagccccgc

SEQ ID NO: 986929 - DNA, 13 bp, Homo sapiens
cggtgtggagaag

SEQ ID NO: 986930 - DNA, 17 bp, Homo sapiens
cggttaacttgtatatt

SEQ ID NO: 986931 - DNA, 19 bp, Homo sapiens
cggttcagacccctgcctg

SEQ ID NO: 986932 - DNA, 18 bp, Homo sapiens
cggttccacgtccccctg

SEQ ID NO: 986933 - DNA, 14 bp, Homo sapiens
cggttcctcatctg

SEQ ID NO: 986934 - DNA, 11 bp, Homo sapiens
cggttgcagtc

SEQ ID NO: 986935 - DNA, 16 bp, Homo sapiens
cggttgcagtcactgt

SEQ ID NO: 986936 - DNA, 14 bp, Homo sapiens
cggttgccatggag

SEQ ID NO: 986937 - DNA, 21 bp, Homo sapiens
cggttggagcgagcatccccc

SEQ ID NO: 986938 - DNA, 21 bp, Homo sapiens
cggttgttctttcctcacatt

SEQ ID NO: 986939 - DNA, 18 bp, Homo sapiens
cggtttagtcatccaaca

SEQ ID NO: 986940 - DNA, 18 bp, Homo sapiens
cggtttccaaggtgcaca

SEQ ID NO: 986941 - DNA, 19 bp, Homo sapiens
cggtttccaaggtgcacat

SEQ ID NO: 986942 - DNA, 19 bp, Homo sapiens
cggtttctagcctctgaga

SEQ ID NO: 986943 - DNA, 12 bp, Homo sapiens
cggtttctgagc

SEQ ID NO: 986944 - DNA, 20 bp, Homo sapiens
cggtttctgagcataatgct

SEQ ID NO: 986945 - DNA, 19 bp, Homo sapiens
cggtttggataatcttaaa

SEQ ID NO: 986946 - DNA, 21 bp, Homo sapiens
cggtttggggagcagagacac

SEQ ID NO: 986947 - DNA, 18 bp, Homo sapiens
cggtttgtcagttcttgg

SEQ ID NO: 986948 - DNA, 23 bp, Homo sapiens
cgtaaaaaaatagaaaaaaagaa

SEQ ID NO: 986949 - DNA, 19 bp, Homo sapiens
cgtaaaagagataataaga

SEQ ID NO: 986950 - DNA, 13 bp, Homo sapiens
cgtaaaatttaca

SEQ ID NO: 986951 - DNA, 22 bp, Homo sapiens
cgtaagaccaaatgtagttttg

SEQ ID NO: 986952 - DNA, 21 bp, Homo sapiens
cgtaataggaatcaccctcct

SEQ ID NO: 986953 - DNA, 16 bp, Homo sapiens
cgtaatgggcctgccc

SEQ ID NO: 986954 - DNA, 13 bp, Homo sapiens
cgtaatttaatgg

SEQ ID NO: 986955 - DNA, 23 bp, Homo sapiens
cgtacaaccccctccacccccca

SEQ ID NO: 986956 - DNA, 12 bp, Homo sapiens
cgtacacagaga

SEQ ID NO: 986957 - DNA, 15 bp, Homo sapiens
cgtacacagagaagg

SEQ ID NO: 986958 - DNA, 20 bp, Homo sapiens
cgtacatctgcaatatgaat

SEQ ID NO: 986959 - DNA, 13 bp, Homo sapiens
cgtacatgtttat

SEQ ID NO: 986960 - DNA, 19 bp, Homo sapiens
cgtaccccactgggccagc

SEQ ID NO: 986961 - DNA, 15 bp, Homo sapiens
cgtaccgcttcctta

SEQ ID NO: 986962 - DNA, 16 bp, Homo sapiens
cgtaccgcttccttag

SEQ ID NO: 986963 - DNA, 17 bp, Homo sapiens
cgtaccgcttccttaga

SEQ ID NO: 986964 - DNA, 13 bp, Homo sapiens
cgtaccttcccac

SEQ ID NO: 986965 - DNA, 13 bp, Homo sapiens
cgtacgcccagga

SEQ ID NO: 986966 - DNA, 17 bp, Homo sapiens
cgtactctcacatgtgg

SEQ ID NO: 986967 - DNA, 13 bp, Homo sapiens
cgtagaaaatttg

SEQ ID NO: 986968 - DNA, 16 bp, Homo sapiens
cgtagaattccttcga

SEQ ID NO: 986969 - DNA, 16 bp, Homo sapiens
cgtagagaatgtgtgt

SEQ ID NO: 986970 - DNA, 23 bp, Homo sapiens
cgtagcctgggctcactgtgctg

SEQ ID NO: 986971 - DNA, 14 bp, Homo sapiens
cgtaggcagcctct

SEQ ID NO: 986972 - DNA, 20 bp, Homo sapiens
cgtaggcagcctctctgcta

SEQ ID NO: 986973 - DNA, 20 bp, Homo sapiens
cgtagtccatcaccatttct

SEQ ID NO: 986974 - DNA, 22 bp, Homo sapiens
cgtataaatatcagtattctga

SEQ ID NO: 986975 - DNA, 14 bp, Homo sapiens
cgtataatgctttc

SEQ ID NO: 986976 - DNA, 17 bp, Homo sapiens
cgtataatgctttctga

SEQ ID NO: 986977 - DNA, 15 bp, Homo sapiens
cgtataggcatgtaa

SEQ ID NO: 986978 - DNA, 22 bp, Homo sapiens
cgtatatgtctcaggtccctgc

SEQ ID NO: 986979 - DNA, 13 bp, Homo sapiens
cgtatcacagtgt

SEQ ID NO: 986980 - DNA, 14 bp, Homo sapiens
cgtatcacagtgtt

SEQ ID NO: 986981 - DNA, 16 bp, Homo sapiens
cgtatgtgtgcaggag

SEQ ID NO: 986982 - DNA, 18 bp, Homo sapiens
cgtatgtgtgcaggagcc

SEQ ID NO: 986983 - DNA, 21 bp, Homo sapiens
cgtatttaatagcaaagaatt

SEQ ID NO: 986984 - DNA, 22 bp, Homo sapiens
cgtatttagactgtggccatat

SEQ ID NO: 986985 - DNA, 17 bp, Homo sapiens
cgtatttagccattacc

SEQ ID NO: 986986 - DNA, 14 bp, Homo sapiens
cgtatttctccaga

SEQ ID NO: 986987 - DNA, 16 bp, Homo sapiens
cgtatttctccagacc

SEQ ID NO: 986988 - DNA, 22 bp, Homo sapiens
cgtcaaaacagattgtttgcaa

SEQ ID NO: 986989 - DNA, 19 bp, Homo sapiens
cgtcaacccaagctctggg

SEQ ID NO: 986990 - DNA, 21 bp, Homo sapiens
cgtcaacccaagctctgggga

SEQ ID NO: 986991 - DNA, 17 bp, Homo sapiens
cgtcaagagcatgcaca

SEQ ID NO: 986992 - DNA, 21 bp, Homo sapiens
cgtcaccaccacccctaccac

SEQ ID NO: 986993 - DNA, 16 bp, Homo sapiens
cgtcaccatctcaggc

SEQ ID NO: 986994 - DNA, 12 bp, Homo sapiens
cgtcactgccca

SEQ ID NO: 986995 - DNA, 19 bp, Homo sapiens
cgtcactgcccaccaaagg

SEQ ID NO: 986996 - DNA, 18 bp, Homo sapiens
cgtcactttttggccatg

SEQ ID NO: 986997 - DNA, 21 bp, Homo sapiens
cgtcagacagcaaggaactgt

SEQ ID NO: 986998 - DNA, 23 bp, Homo sapiens
cgtcaggcagaggcaactgactt

SEQ ID NO: 986999 - DNA, 22 bp, Homo sapiens
cgtcaggccctgactcctctgg

SEQ ID NO: 987000 - DNA, 22 bp, Homo sapiens
cgtcagggagaggtcaccagct

SEQ ID NO: 987001 - DNA, 15 bp, Homo sapiens
cgtcagtttcactcc

SEQ ID NO: 987002 - DNA, 16 bp, Homo sapiens
cgtcagtttcactccc

SEQ ID NO: 987003 - DNA, 18 bp, Homo sapiens
cgtcagtttcactccctc

SEQ ID NO: 987004 - DNA, 20 bp, Homo sapiens
cgtcagtttcactccctctt

SEQ ID NO: 987005 - DNA, 22 bp, Homo sapiens
cgtcatccatgccctcccagga

SEQ ID NO: 987006 - DNA, 18 bp, Homo sapiens
cgtcatcggaggctgggc

SEQ ID NO: 987007 - DNA, 16 bp, Homo sapiens
cgtccaaccccggggc

SEQ ID NO: 987008 - DNA, 17 bp, Homo sapiens
cgtccacaggggcaggc

SEQ ID NO: 987009 - DNA, 21 bp, Homo sapiens
cgtccacaggggcaggcctgg

SEQ ID NO: 987010 - DNA, 23 bp, Homo sapiens
cgtccacaggggcaggcctggga

SEQ ID NO: 987011 - DNA, 12 bp, Homo sapiens
cgtccaccaggc

SEQ ID NO: 987012 - DNA, 19 bp, Homo sapiens
cgtccaccaggcctcactg

SEQ ID NO: 987013 - DNA, 15 bp, Homo sapiens
cgtccacccaggctg

SEQ ID NO: 987014 - DNA, 16 bp, Homo sapiens
cgtccacccaggctgc

SEQ ID NO: 987015 - DNA, 23 bp, Homo sapiens
cgtccacccaggctgcactgcag

SEQ ID NO: 987016 - DNA, 17 bp, Homo sapiens
cgtccagctcagccctg

SEQ ID NO: 987017 - DNA, 22 bp, Homo sapiens
cgtccagctcagccctggcctg

SEQ ID NO: 987018 - DNA, 16 bp, Homo sapiens
cgtccagctgcccttc

SEQ ID NO: 987019 - DNA, 21 bp, Homo sapiens
cgtccaggggagatggggagg

SEQ ID NO: 987020 - DNA, 23 bp, Homo sapiens
cgtccatcacgttagctgtccca

SEQ ID NO: 987021 - DNA, 18 bp, Homo sapiens
cgtccatccgactgcccc

SEQ ID NO: 987022 - DNA, 13 bp, Homo sapiens
cgtcccaccagct

SEQ ID NO: 987023 - DNA, 17 bp, Homo sapiens
cgtcccagcatccctgg

SEQ ID NO: 987024 - DNA, 18 bp, Homo sapiens
cgtcccagcatccctgga

SEQ ID NO: 987025 - DNA, 19 bp, Homo sapiens
cgtcccagcatccctggag

SEQ ID NO: 987026 - DNA, 18 bp, Homo sapiens
ctcttgggctgagactgg

SEQ ID NO: 987027 - DNA, 18 bp, Homo sapiens
ctcttgggttcaagtgat

SEQ ID NO: 987028 - DNA, 19 bp, Homo sapiens
ctcttgggttcaagtgatt

SEQ ID NO: 987029 - DNA, 23 bp, Homo sapiens
ctcttggtgggtgtggccagcac

SEQ ID NO: 987030 - DNA, 14 bp, Homo sapiens
ctcttggtgtctgg

SEQ ID NO: 987031 - DNA, 21 bp, Homo sapiens
ctcttggtgtgattgcacaga

SEQ ID NO: 987032 - DNA, 12 bp, Homo sapiens
ctcttgtaaata

SEQ ID NO: 987033 - DNA, 13 bp, Homo sapiens
ctcttgtaagtca

SEQ ID NO: 987034 - DNA, 14 bp, Homo sapiens
ctcttgtacagtta

SEQ ID NO: 987035 - DNA, 23 bp, Homo sapiens
ctcttgtacagttaactctccca

SEQ ID NO: 987036 - DNA, 16 bp, Homo sapiens
ctcttgtaccatagaa

SEQ ID NO: 987037 - DNA, 23 bp, Homo sapiens
ctcttgtaccatagaaaaatgta

SEQ ID NO: 987038 - DNA, 20 bp, Homo sapiens
ctcttgtcatttttaatatt

SEQ ID NO: 987039 - DNA, 16 bp, Homo sapiens
ctcttgtcccacgtgt

SEQ ID NO: 987040 - DNA, 15 bp, Homo sapiens
ctcttgtcccttggc

SEQ ID NO: 987041 - DNA, 22 bp, Homo sapiens
ctcttgtcctgtgatctgtgta

SEQ ID NO: 987042 - DNA, 12 bp, Homo sapiens
ctcttgtctccc

SEQ ID NO: 987043 - DNA, 22 bp, Homo sapiens
ctcttgtctggcaaaagaaaaa

SEQ ID NO: 987044 - DNA, 22 bp, Homo sapiens
ctcttgtgatttctttaaaaga

SEQ ID NO: 987045 - DNA, 21 bp, Homo sapiens
ctcttgtgcaaggtggccttt

SEQ ID NO: 987046 - DNA, 18 bp, Homo sapiens
ctcttgttaccatgtatg

SEQ ID NO: 987047 - DNA, 24 bp, Homo sapiens
ctcttgtttacgatttcactagga

SEQ ID NO: 987048 - DNA, 17 bp, Homo sapiens
ctcttgtttctgtgccc

SEQ ID NO: 987049 - DNA, 19 bp, Homo sapiens
ctcttgtttttattaattt

SEQ ID NO: 987050 - DNA, 20 bp, Homo sapiens
ctcttgtttttattaattta

SEQ ID NO: 987051 - DNA, 23 bp, Homo sapiens
ctcttgtttttattaatttatat

SEQ ID NO: 987052 - DNA, 13 bp, Homo sapiens
ctctttaaaaaca

SEQ ID NO: 987053 - DNA, 15 bp, Homo sapiens
ctctttaaaaactca

SEQ ID NO: 987054 - DNA, 19 bp, Homo sapiens
ctctttaaaaggaaagaaa

SEQ ID NO: 987055 - DNA, 20 bp, Homo sapiens
ctctttaaaaggaaagaaaa

SEQ ID NO: 987056 - DNA, 15 bp, Homo sapiens
ctctttaaccctccc

SEQ ID NO: 987057 - DNA, 15 bp, Homo sapiens
ctctttaactgtgtg

SEQ ID NO: 987058 - DNA, 17 bp, Homo sapiens
ctctttaataaattgct

SEQ ID NO: 987059 - DNA, 18 bp, Homo sapiens
cgtcccagcggcctcagg

SEQ ID NO: 987060 - DNA, 13 bp, Homo sapiens
cgtcccaggccac

SEQ ID NO: 987061 - DNA, 12 bp, Homo sapiens
cgtcccagggct

SEQ ID NO: 987062 - DNA, 15 bp, Homo sapiens
cgtcccatatcctgc

SEQ ID NO: 987063 - DNA, 22 bp, Homo sapiens
cgtccccctctggctccagctg

SEQ ID NO: 987064 - DNA, 17 bp, Homo sapiens
cgtcccgcgttcaagac

SEQ ID NO: 987065 - DNA, 19 bp, Homo sapiens
cgtcccgcgttcaagactt

SEQ ID NO: 987066 - DNA, 13 bp, Homo sapiens
cgtccctgcccat

SEQ ID NO: 987067 - DNA, 11 bp, Homo sapiens
cgtccctggcg

SEQ ID NO: 987068 - DNA, 13 bp, Homo sapiens
cgtccctgtcccc

SEQ ID NO: 987069 - DNA, 17 bp, Homo sapiens
cgtccctgtcccccagc

SEQ ID NO: 987070 - DNA, 20 bp, Homo sapiens
cgtccgaggctgcttcccag

SEQ ID NO: 987071 - DNA, 12 bp, Homo sapiens
cgtccgccctgc

SEQ ID NO: 987072 - DNA, 15 bp, Homo sapiens
cgtccgccctgctcc

SEQ ID NO: 987073 - DNA, 15 bp, Homo sapiens
cgtccgcgcgccagc

SEQ ID NO: 987074 - DNA, 17 bp, Homo sapiens
cgtcctcccgggccctc

SEQ ID NO: 987075 - DNA, 18 bp, Homo sapiens
cgtcctcccgggccctcc

SEQ ID NO: 987076 - DNA, 13 bp, Homo sapiens
cgtcctccctcag

SEQ ID NO: 987077 - DNA, 17 bp, Homo sapiens
cgtcctccctcagcctc

SEQ ID NO: 987078 - DNA, 17 bp, Homo sapiens
cgtcctgacgccctgcg

SEQ ID NO: 987079 - DNA, 12 bp, Homo sapiens
cgtcctgaggaa

SEQ ID NO: 987080 - DNA, 13 bp, Homo sapiens
cgtcctgatccct

SEQ ID NO: 987081 - DNA, 19 bp, Homo sapiens
cgtcctgatccctccaccc

SEQ ID NO: 987082 - DNA, 15 bp, Homo sapiens
cgtcctgcagaggac

SEQ ID NO: 987083 - DNA, 15 bp, Homo sapiens
aatcacacctctggg

SEQ ID NO: 987084 - DNA, 13 bp, Homo sapiens
aatcacaggaaaa

SEQ ID NO: 987085 - DNA, 12 bp, Homo sapiens
aatcacagtgtt

SEQ ID NO: 987086 - DNA, 16 bp, Homo sapiens
aatcacagtgttatgt

SEQ ID NO: 987087 - DNA, 15 bp, Homo sapiens
atagtatatctggac

SEQ ID NO: 987088 - DNA, 16 bp, Homo sapiens
atagtatatctggaca

SEQ ID NO: 987089 - DNA, 18 bp, Homo sapiens
atagtatatttatactct

SEQ ID NO: 987090 - DNA, 22 bp, Homo sapiens
atagtatctgtatataagttgc

SEQ ID NO: 987091 - DNA, 19 bp, Homo sapiens
atagtatgagggttgaaga

SEQ ID NO: 987092 - DNA, 20 bp, Homo sapiens
atagtatgcactatatacat

SEQ ID NO: 987093 - DNA, 23 bp, Homo sapiens
atagtatgggaaaaaaactgaag

SEQ ID NO: 987094 - DNA, 21 bp, Homo sapiens
atagtattccattgtgtgagt

SEQ ID NO: 987095 - DNA, 22 bp, Homo sapiens
atagtattggaaaataaaaatg

SEQ ID NO: 987096 - DNA, 12 bp, Homo sapiens
atagtatttgat

SEQ ID NO: 987097 - DNA, 20 bp, Homo sapiens
atagtatttgattcaaaata

SEQ ID NO: 987098 - DNA, 14 bp, Homo sapiens
atagtcacaagagc

SEQ ID NO: 987099 - DNA, 16 bp, Homo sapiens
atagtccaatatttgg

SEQ ID NO: 987100 - DNA, 20 bp, Homo sapiens
atagtccagacacttaactc

SEQ ID NO: 987101 - DNA, 21 bp, Homo sapiens
atagtcgtgaatcttgttcaa

SEQ ID NO: 987102 - DNA, 19 bp, Homo sapiens
atagtctattcattaagta

SEQ ID NO: 987103 - DNA, 14 bp, Homo sapiens
atagtctctttaaa

SEQ ID NO: 987104 - DNA, 14 bp, Homo sapiens
atagtcttccacaa

SEQ ID NO: 987105 - DNA, 22 bp, Homo sapiens
atagtcttggaagctgtttgga

SEQ ID NO: 987106 - DNA, 17 bp, Homo sapiens
atagtcttttgcttttg

SEQ ID NO: 987107 - DNA, 16 bp, Homo sapiens
atagtgaatacttact

SEQ ID NO: 987108 - DNA, 23 bp, Homo sapiens
atagtgaatacttactataattt

SEQ ID NO: 987109 - DNA, 20 bp, Homo sapiens
atagtgacaagtgaagaaca

SEQ ID NO: 987110 - DNA, 19 bp, Homo sapiens
atagtgagagaggaggcct

SEQ ID NO: 987111 - DNA, 20 bp, Homo sapiens
atagtgcaaaactgtgtcac

SEQ ID NO: 987112 - DNA, 23 bp, Homo sapiens
atagtgcaacatctctgaatcct

SEQ ID NO: 987113 - DNA, 22 bp, Homo sapiens
atagtgccaggaaactaatttc

SEQ ID NO: 987114 - DNA, 20 bp, Homo sapiens
atagtgcctaaagtgctgca

SEQ ID NO: 987115 - DNA, 12 bp, Homo sapiens
atagtgcttttt

SEQ ID NO: 987116 - DNA, 19 bp, Homo sapiens
atagtggaccacttggaaa

SEQ ID NO: 987117 - DNA, 21 bp, Homo sapiens
atagtggatgatatacacagt

SEQ ID NO: 987118 - DNA, 12 bp, Homo sapiens
atagtggggcct

SEQ ID NO: 987119 - DNA, 17 bp, Homo sapiens
atagtggggcctgggag

SEQ ID NO: 987120 - DNA, 14 bp, Homo sapiens
atagtgtaaaataa

SEQ ID NO: 987121 - DNA, 14 bp, Homo sapiens
atagtgtaacttgc

SEQ ID NO: 987122 - DNA, 18 bp, Homo sapiens
atagtgtaacttgcttaa

SEQ ID NO: 987123 - DNA, 23 bp, Homo sapiens
atagtgtaagaactgtacattgt

SEQ ID NO: 987124 - DNA, 16 bp, Homo sapiens
atagtgtaataatgtt

SEQ ID NO: 987125 - DNA, 22 bp, Homo sapiens
atagtgtataccacctgtacat

SEQ ID NO: 987126 - DNA, 13 bp, Homo sapiens
atagtgtccaggc

SEQ ID NO: 987127 - DNA, 16 bp, Homo sapiens
atagtgtcctgcccac

SEQ ID NO: 987128 - DNA, 12 bp, Homo sapiens
atagtgtgttct

SEQ ID NO: 987129 - DNA, 13 bp, Homo sapiens
atagtgtgttctg

SEQ ID NO: 987130 - DNA, 19 bp, Homo sapiens
atagtgtgttctgattaga

SEQ ID NO: 987131 - DNA, 19 bp, Homo sapiens
atagtgttcacaaactgtg

SEQ ID NO: 987132 - DNA, 17 bp, Homo sapiens
atagtgttctgctcctg

SEQ ID NO: 987133 - DNA, 19 bp, Homo sapiens
atagtgttctgctcctgct

SEQ ID NO: 987134 - DNA, 15 bp, Homo sapiens
atagtgtttaactgg

SEQ ID NO: 987135 - DNA, 18 bp, Homo sapiens
atagtgttttattataaa

SEQ ID NO: 987136 - DNA, 19 bp, Homo sapiens
atagttaaaagactgcagc

SEQ ID NO: 987137 - DNA, 23 bp, Homo sapiens
atagttaaaagactgcagctgct

SEQ ID NO: 987138 - DNA, 15 bp, Homo sapiens
atagttaatattttg

SEQ ID NO: 987139 - DNA, 16 bp, Homo sapiens
atagttaatattttgt

SEQ ID NO: 987140 - DNA, 13 bp, Homo sapiens
atagttactgtgt

SEQ ID NO: 987141 - DNA, 14 bp, Homo sapiens
atagttactgtgta

SEQ ID NO: 987142 - DNA, 20 bp, Homo sapiens
atagttactgtgtaattagt

SEQ ID NO: 987143 - DNA, 16 bp, Homo sapiens
atagttagctaataaa

SEQ ID NO: 987144 - DNA, 15 bp, Homo sapiens
atagttatatgtaca

SEQ ID NO: 987145 - DNA, 21 bp, Homo sapiens
atagttcagaatttagtgtat

SEQ ID NO: 987146 - DNA, 18 bp, Homo sapiens
atagttcagtagaattac

SEQ ID NO: 987147 - DNA, 17 bp, Homo sapiens
atagttccttgccttaa

SEQ ID NO: 987148 - DNA, 21 bp, Homo sapiens
atagttccttgccttaataaa

SEQ ID NO: 987149 - DNA, 20 bp, Homo sapiens
atagttctaaacacattctt

SEQ ID NO: 987150 - DNA, 21 bp, Homo sapiens
atagttctatcaggaaaacaa

SEQ ID NO: 987151 - DNA, 16 bp, Homo sapiens
atagttctatcctttt

SEQ ID NO: 987152 - DNA, 14 bp, Homo sapiens
atagttctgcaggt

SEQ ID NO: 987153 - DNA, 21 bp, Homo sapiens
atagttcttagctttgaaact

SEQ ID NO: 987154 - DNA, 18 bp, Homo sapiens
atagttgcatagcagtat

SEQ ID NO: 987155 - DNA, 19 bp, Homo sapiens
atagttgtagacaaagtac

SEQ ID NO: 987156 - DNA, 18 bp, Homo sapiens
atagtttcaccactcctc

SEQ ID NO: 987157 - DNA, 19 bp, Homo sapiens
atagtttcaccactcctct

SEQ ID NO: 987158 - DNA, 21 bp, Homo sapiens
atagtttcaccactcctctcc

SEQ ID NO: 987159 - DNA, 12 bp, Homo sapiens
atagtttcctga

SEQ ID NO: 987160 - DNA, 17 bp, Homo sapiens
atagtttgaaatagaaa

SEQ ID NO: 987161 - DNA, 18 bp, Homo sapiens
atagtttggatatgtaaa

SEQ ID NO: 987162 - DNA, 19 bp, Homo sapiens
atagtttggatatgtaaaa

SEQ ID NO: 987163 - DNA, 23 bp, Homo sapiens
atagtttggatatgtaaaacatt

SEQ ID NO: 987164 - DNA, 13 bp, Homo sapiens
atagtttgtctat

SEQ ID NO: 987165 - DNA, 15 bp, Homo sapiens
atagtttgtctattt

SEQ ID NO: 987166 - DNA, 17 bp, Homo sapiens
atagttttataaaactc

SEQ ID NO: 987167 - DNA, 22 bp, Homo sapiens
atagttttcatccataactgaa

SEQ ID NO: 987168 - DNA, 19 bp, Homo sapiens
atagttttttacttctctt

SEQ ID NO: 987169 - DNA, 16 bp, Homo sapiens
atataaaaaatcatgc

SEQ ID NO: 987170 - DNA, 18 bp, Homo sapiens
atataaaaagcagcagag

SEQ ID NO: 987171 - DNA, 14 bp, Homo sapiens
atataaaactgaaa

SEQ ID NO: 987172 - DNA, 13 bp, Homo sapiens
atataaaactgcg

SEQ ID NO: 987173 - DNA, 22 bp, Homo sapiens
atataaaactgcgttaaaggct

SEQ ID NO: 987174 - DNA, 17 bp, Homo sapiens
atataaaactgtacttc

SEQ ID NO: 987175 - DNA, 20 bp, Homo sapiens
atataaaaggcaaatgtgta

SEQ ID NO: 987176 - DNA, 14 bp, Homo sapiens
atataaaatgtatt

SEQ ID NO: 987177 - DNA, 18 bp, Homo sapiens
atataaaatgtattcaag

SEQ ID NO: 987178 - DNA, 13 bp, Homo sapiens
atataaaatgtgc

SEQ ID NO: 987179 - DNA, 20 bp, Homo sapiens
atataaacagaactcccttc

SEQ ID NO: 987180 - DNA, 14 bp, Homo sapiens
atataaacatattt

SEQ ID NO: 987181 - DNA, 14 bp, Homo sapiens
atataaactcattt

SEQ ID NO: 987182 - DNA, 16 bp, Homo sapiens
atataaactcatttat

SEQ ID NO: 987183 - DNA, 22 bp, Homo sapiens
atataaaggaccctgtttctgt

SEQ ID NO: 987184 - DNA, 16 bp, Homo sapiens
atataaaggttatgaa

SEQ ID NO: 987185 - DNA, 19 bp, Homo sapiens
atataaaggttatgaaaca

SEQ ID NO: 987186 - DNA, 21 bp, Homo sapiens
atataaaggttatgaaacata

SEQ ID NO: 987187 - DNA, 19 bp, Homo sapiens
atataaagtagtcctgtga

SEQ ID NO: 987188 - DNA, 13 bp, Homo sapiens
atataaataagct

SEQ ID NO: 987189 - DNA, 16 bp, Homo sapiens
atataaatagctaatg

SEQ ID NO: 987190 - DNA, 20 bp, Homo sapiens
atataaatagctgaaaacta

SEQ ID NO: 987191 - DNA, 11 bp, Homo sapiens
atataaatata

SEQ ID NO: 987192 - DNA, 21 bp, Homo sapiens
atataaatatatatttttcaa

SEQ ID NO: 987193 - DNA, 23 bp, Homo sapiens
atataaatggctggtttttagaa

SEQ ID NO: 987194 - DNA, 12 bp, Homo sapiens
atataaatgtgt

SEQ ID NO: 987195 - DNA, 12 bp, Homo sapiens
atataaattgta

SEQ ID NO: 987196 - DNA, 14 bp, Homo sapiens
atataaatttaagc

SEQ ID NO: 987197 - DNA, 15 bp, Homo sapiens
atataaattttttgt

SEQ ID NO: 987198 - DNA, 14 bp, Homo sapiens
atataacacttaac

SEQ ID NO: 987199 - DNA, 23 bp, Homo sapiens
atataaccacaaagcacagtttg

SEQ ID NO: 987200 - DNA, 18 bp, Homo sapiens
atataaccctaggaattt

SEQ ID NO: 987201 - DNA, 12 bp, Homo sapiens
atataactcttt

SEQ ID NO: 987202 - DNA, 14 bp, Homo sapiens
atataactgtcttg

SEQ ID NO: 987203 - DNA, 19 bp, Homo sapiens
atataactgtcttgtttca

SEQ ID NO: 987204 - DNA, 20 bp, Homo sapiens
atataactgtcttgtttcag

SEQ ID NO: 987205 - DNA, 13 bp, Homo sapiens
aatctaaggataa

SEQ ID NO: 987206 - DNA, 21 bp, Homo sapiens
aatctaaggataatgaaataa

SEQ ID NO: 987207 - DNA, 14 bp, Homo sapiens
aatctaagtatatg

SEQ ID NO: 987208 - DNA, 17 bp, Homo sapiens
aatctaagtgatataaa

SEQ ID NO: 987209 - DNA, 19 bp, Homo sapiens
aatctaatattaaaaatat

SEQ ID NO: 987210 - DNA, 12 bp, Homo sapiens
aatctaatctct

SEQ ID NO: 987211 - DNA, 19 bp, Homo sapiens
aatctaatctcttattcta

SEQ ID NO: 987212 - DNA, 15 bp, Homo sapiens
aatctaatctgaact

SEQ ID NO: 987213 - DNA, 16 bp, Homo sapiens
aatctaatctgaactg

SEQ ID NO: 987214 - DNA, 23 bp, Homo sapiens
aatctaatgtgagtgtgaagctt

SEQ ID NO: 987215 - DNA, 15 bp, Homo sapiens
aatctactaattcca

SEQ ID NO: 987216 - DNA, 18 bp, Homo sapiens
aatctactggaaatgtag

SEQ ID NO: 987217 - DNA, 12 bp, Homo sapiens
aatctacttaac

SEQ ID NO: 987218 - DNA, 21 bp, Homo sapiens
aatctacttaaccctgacaaa

SEQ ID NO: 987219 - DNA, 21 bp, Homo sapiens
aatctactttttgtatttagt

SEQ ID NO: 987220 - DNA, 13 bp, Homo sapiens
atatatgatcatt

SEQ ID NO: 987221 - DNA, 12 bp, Homo sapiens
atatatgctgta

SEQ ID NO: 987222 - DNA, 13 bp, Homo sapiens
atatatgctgtat

SEQ ID NO: 987223 - DNA, 15 bp, Homo sapiens
atatatgcttacatt

SEQ ID NO: 987224 - DNA, 15 bp, Homo sapiens
atatatggacatggc

SEQ ID NO: 987225 - DNA, 12 bp, Homo sapiens
atatatggacct

SEQ ID NO: 987226 - DNA, 17 bp, Homo sapiens
atatatggatcagagga

SEQ ID NO: 987227 - DNA, 14 bp, Homo sapiens
atatatggcagagt

SEQ ID NO: 987228 - DNA, 16 bp, Homo sapiens
atatatggcatattta

SEQ ID NO: 987229 - DNA, 19 bp, Homo sapiens
atatatggcatatttatat

SEQ ID NO: 987230 - DNA, 13 bp, Homo sapiens
atatatgtacagt

SEQ ID NO: 987231 - DNA, 14 bp, Homo sapiens
atatatgtacagtt

SEQ ID NO: 987232 - DNA, 11 bp, Homo sapiens
atatatgtatg

SEQ ID NO: 987233 - DNA, 19 bp, Homo sapiens
atatatgtattatttataa

SEQ ID NO: 987234 - DNA, 15 bp, Homo sapiens
atatatgtatttaaa

SEQ ID NO: 987235 - DNA, 12 bp, Homo sapiens
atatatgtcaat

SEQ ID NO: 987236 - DNA, 13 bp, Homo sapiens
atatatgtgaaag

SEQ ID NO: 987237 - DNA, 16 bp, Homo sapiens
atatatgtgtatacat

SEQ ID NO: 987238 - DNA, 17 bp, Homo sapiens
atatatgtgtatacata

SEQ ID NO: 987239 - DNA, 16 bp, Homo sapiens
atatatgtgtgtgtat

SEQ ID NO: 987240 - DNA, 22 bp, Homo sapiens
atatatgtgtgtgtatataaat

SEQ ID NO: 987241 - DNA, 13 bp, Homo sapiens
atatatgtgtttt

SEQ ID NO: 987242 - DNA, 21 bp, Homo sapiens
atatatgtgtttttcacattt

SEQ ID NO: 987243 - DNA, 23 bp, Homo sapiens
atatatgtgtttttcacatttgc

SEQ ID NO: 987244 - DNA, 15 bp, Homo sapiens
atatatgttctgcaa

SEQ ID NO: 987245 - DNA, 20 bp, Homo sapiens
atatatgttctgcaagaatt

SEQ ID NO: 987246 - DNA, 18 bp, Homo sapiens
atatatgtttttgaaggc

SEQ ID NO: 987247 - DNA, 18 bp, Homo sapiens
atatattaaaaatataaa

SEQ ID NO: 987248 - DNA, 17 bp, Homo sapiens
atatattacaagggata

SEQ ID NO: 987249 - DNA, 14 bp, Homo sapiens
atatattattataa

SEQ ID NO: 987250 - DNA, 16 bp, Homo sapiens
atatattattataatc

SEQ ID NO: 987251 - DNA, 18 bp, Homo sapiens
atatattcatctaataaa

SEQ ID NO: 987252 - DNA, 17 bp, Homo sapiens
atatattcttataaaaa

SEQ ID NO: 987253 - DNA, 13 bp, Homo sapiens
atatattgaactt

SEQ ID NO: 987254 - DNA, 22 bp, Homo sapiens
atatattgaacttttgtactga

SEQ ID NO: 987255 - DNA, 14 bp, Homo sapiens
atatattgaattaa

SEQ ID NO: 987256 - DNA, 17 bp, Homo sapiens
atatattgacttgttac

SEQ ID NO: 987257 - DNA, 16 bp, Homo sapiens
atatattgctgcattt

SEQ ID NO: 987258 - DNA, 14 bp, Homo sapiens
atatattgtaaaga

SEQ ID NO: 987259 - DNA, 15 bp, Homo sapiens
atatattgtaaagaa

SEQ ID NO: 987260 - DNA, 14 bp, Homo sapiens
atatattgtacaaa

SEQ ID NO: 987261 - DNA, 16 bp, Homo sapiens
atatatttaatatgtc

SEQ ID NO: 987262 - DNA, 16 bp, Homo sapiens
atatatttacagaaga

SEQ ID NO: 987263 - DNA, 15 bp, Homo sapiens
atatatttataactc

SEQ ID NO: 987264 - DNA, 21 bp, Homo sapiens
atatatttataactcatcata

SEQ ID NO: 987265 - DNA, 17 bp, Homo sapiens
atatatttcacttttgt

SEQ ID NO: 987266 - DNA, 14 bp, Homo sapiens
atatatttcagata

SEQ ID NO: 987267 - DNA, 17 bp, Homo sapiens
atatatttctattatta

SEQ ID NO: 987268 - DNA, 13 bp, Homo sapiens
atatatttgcaga

SEQ ID NO: 987269 - DNA, 23 bp, Homo sapiens
atatatttgcagataattctgga

SEQ ID NO: 987270 - DNA, 15 bp, Homo sapiens
atatatttgcagtat

SEQ ID NO: 987271 - DNA, 15 bp, Homo sapiens
atatatttgtaacat

SEQ ID NO: 987272 - DNA, 17 bp, Homo sapiens
atatatttgtaacattg

SEQ ID NO: 987273 - DNA, 13 bp, Homo sapiens
atatatttgtgta

SEQ ID NO: 987274 - DNA, 17 bp, Homo sapiens
atatatttgtgtattta

SEQ ID NO: 987275 - DNA, 12 bp, Homo sapiens
atatattttata

SEQ ID NO: 987276 - DNA, 12 bp, Homo sapiens
atatattttcat

SEQ ID NO: 987277 - DNA, 16 bp, Homo sapiens
atatattttgtttaca

SEQ ID NO: 987278 - DNA, 21 bp, Homo sapiens
atatatttttatatttagtta

SEQ ID NO: 987279 - DNA, 16 bp, Homo sapiens
atatatttttctgaga

SEQ ID NO: 987280 - DNA, 18 bp, Homo sapiens
atatattttttaaaataa

SEQ ID NO: 987281 - DNA, 17 bp, Homo sapiens
atatcaaagagaagatg

SEQ ID NO: 987282 - DNA, 15 bp, Homo sapiens
atatcaaataaaata

SEQ ID NO: 987283 - DNA, 21 bp, Homo sapiens
atatcaaataaaatatcataa

SEQ ID NO: 987284 - DNA, 16 bp, Homo sapiens
atatcaaataataaag

SEQ ID NO: 987285 - DNA, 14 bp, Homo sapiens
atatcaatcacatt

SEQ ID NO: 987286 - DNA, 11 bp, Homo sapiens
atatcacctct

SEQ ID NO: 987287 - DNA, 12 bp, Homo sapiens
atatcacctctc

SEQ ID NO: 987288 - DNA, 14 bp, Homo sapiens
atatcactaaataa

SEQ ID NO: 987289 - DNA, 16 bp, Homo sapiens
atatcactcattaatt

SEQ ID NO: 987290 - DNA, 17 bp, Homo sapiens
atatcagaaaagggaag

SEQ ID NO: 987291 - DNA, 19 bp, Homo sapiens
atatcagacaagcactatt

SEQ ID NO: 987292 - DNA, 21 bp, Homo sapiens
atatcagagctcttaatgttg

SEQ ID NO: 987293 - DNA, 17 bp, Homo sapiens
atatcagagctgggaaa

SEQ ID NO: 987294 - DNA, 20 bp, Homo sapiens
atatcagcctgagtctcctg

SEQ ID NO: 987295 - DNA, 22 bp, Homo sapiens
atatcagcctgagtctcctgtg

SEQ ID NO: 987296 - DNA, 20 bp, Homo sapiens
atatcaggtgtataaatgta

SEQ ID NO: 987297 - DNA, 23 bp, Homo sapiens
atatcaggtgtataaatgtacat

SEQ ID NO: 987298 - DNA, 14 bp, Homo sapiens
atatcagtagtgta

SEQ ID NO: 987299 - DNA, 18 bp, Homo sapiens
atatcagtagtgtacatt

SEQ ID NO: 987300 - DNA, 22 bp, Homo sapiens
atatcagttactcagccctggg

SEQ ID NO: 987301 - DNA, 23 bp, Homo sapiens
atatcagttactcagccctgggc

SEQ ID NO: 987302 - DNA, 13 bp, Homo sapiens
atatcagtttgct

SEQ ID NO: 987303 - DNA, 14 bp, Homo sapiens
atatcatacagttt

SEQ ID NO: 987304 - DNA, 14 bp, Homo sapiens
atatcatgaaacac

SEQ ID NO: 987305 - DNA, 21 bp, Homo sapiens
atatcatgagtgaataaatgt

SEQ ID NO: 987306 - DNA, 13 bp, Homo sapiens
atatcatgcaaaa

SEQ ID NO: 987307 - DNA, 19 bp, Homo sapiens
atatcatggtaatgacaga

SEQ ID NO: 987308 - DNA, 13 bp, Homo sapiens
atatcatgtacct

SEQ ID NO: 987309 - DNA, 14 bp, Homo sapiens
atatcattaaacaa

SEQ ID NO: 987310 - DNA, 14 bp, Homo sapiens
atatcattatttag

SEQ ID NO: 987311 - DNA, 20 bp, Homo sapiens
atatcattcagcatctactc

SEQ ID NO: 987312 - DNA, 16 bp, Homo sapiens
atatcatttgtgaaga

SEQ ID NO: 987313 - DNA, 13 bp, Homo sapiens
atatcattttaaa

SEQ ID NO: 987314 - DNA, 21 bp, Homo sapiens
atatccacataaatgctcctt

SEQ ID NO: 987315 - DNA, 18 bp, Homo sapiens
atatccagaaggggagct

SEQ ID NO: 987316 - DNA, 18 bp, Homo sapiens
atatccagttcctgctct

SEQ ID NO: 987317 - DNA, 21 bp, Homo sapiens
atatccatgacctagttttcc

SEQ ID NO: 987318 - DNA, 14 bp, Homo sapiens
atatccatgtactg

SEQ ID NO: 987319 - DNA, 15 bp, Homo sapiens
atatccatgtactgt

SEQ ID NO: 987320 - DNA, 18 bp, Homo sapiens
atatccatgtactgtagt

SEQ ID NO: 987321 - DNA, 20 bp, Homo sapiens
atatcccaaacttcggaaac

SEQ ID NO: 987322 - DNA, 16 bp, Homo sapiens
atatcccaacattctg

SEQ ID NO: 987323 - DNA, 13 bp, Homo sapiens
atatcccactggg

SEQ ID NO: 987324 - DNA, 18 bp, Homo sapiens
atatccctaatgttttgc

SEQ ID NO: 987325 - DNA, 14 bp, Homo sapiens
atatccctcttgta

SEQ ID NO: 987326 - DNA, 15 bp, Homo sapiens
atatccctcttgtaa

SEQ ID NO: 987327 - DNA, 16 bp, Homo sapiens
atatccctgcccagcc

SEQ ID NO: 987328 - DNA, 19 bp, Homo sapiens
atatcctaggaggtaatga

SEQ ID NO: 987329 - DNA, 18 bp, Homo sapiens
cagctcctctaggggcag

SEQ ID NO: 987330 - DNA, 17 bp, Homo sapiens
cagctcctctccttggg

SEQ ID NO: 987331 - DNA, 19 bp, Homo sapiens
cagctcctctccttgggct

SEQ ID NO: 987332 - DNA, 21 bp, Homo sapiens
cagctcctctccttgggctcc

SEQ ID NO: 987333 - DNA, 23 bp, Homo sapiens
cagctcctctccttgggctcctg

SEQ ID NO: 987334 - DNA, 12 bp, Homo sapiens
cagctcctctga

SEQ ID NO: 987335 - DNA, 15 bp, Homo sapiens
cagctcctctgagcc

SEQ ID NO: 987336 - DNA, 21 bp, Homo sapiens
cagctcctgagtagctgggcc

SEQ ID NO: 987337 - DNA, 11 bp, Homo sapiens
cagctcctgcc

SEQ ID NO: 987338 - DNA, 13 bp, Homo sapiens
cagctcctgccag

SEQ ID NO: 987339 - DNA, 14 bp, Homo sapiens
cagctccttcctgg

SEQ ID NO: 987340 - DNA, 12 bp, Homo sapiens
cagctccttggc

SEQ ID NO: 987341 - DNA, 13 bp, Homo sapiens
cagctccttggct

SEQ ID NO: 987342 - DNA, 19 bp, Homo sapiens
cagctccttttgtccccag

SEQ ID NO: 987343 - DNA, 22 bp, Homo sapiens
cagctcgtttttcagcaccccc

SEQ ID NO: 987344 - DNA, 17 bp, Homo sapiens
cagctctaagcagccag

SEQ ID NO: 987345 - DNA, 19 bp, Homo sapiens
cagctctaagcagccagga

SEQ ID NO: 987346 - DNA, 21 bp, Homo sapiens
cagctctaagcagccaggagg

SEQ ID NO: 987347 - DNA, 20 bp, Homo sapiens
cagctctagacaaccctgca

SEQ ID NO: 987348 - DNA, 12 bp, Homo sapiens
cagctctccagt

SEQ ID NO: 987349 - DNA, 13 bp, Homo sapiens
cagctctcccaca

SEQ ID NO: 987350 - DNA, 20 bp, Homo sapiens
cagctctcccacatcccact

SEQ ID NO: 987351 - DNA, 17 bp, Homo sapiens
cagctctcccctccctt

SEQ ID NO: 987352 - DNA, 19 bp, Homo sapiens
cagctctccctctggccct

SEQ ID NO: 987353 - DNA, 23 bp, Homo sapiens
cagctctccctctggccctgcct

SEQ ID NO: 987354 - DNA, 13 bp, Homo sapiens
cagctctcctggc

SEQ ID NO: 987355 - DNA, 17 bp, Homo sapiens
cagctctcgttctcctt

SEQ ID NO: 987356 - DNA, 18 bp, Homo sapiens
cagctctcgttctccttc

SEQ ID NO: 987357 - DNA, 17 bp, Homo sapiens
cagctggcctggacagt

SEQ ID NO: 987358 - DNA, 23 bp, Homo sapiens
cagctggcctggggtccctctga

SEQ ID NO: 987359 - DNA, 18 bp, Homo sapiens
cagctggctatctactac

SEQ ID NO: 987360 - DNA, 20 bp, Homo sapiens
cagctggctctgacaagatg

SEQ ID NO: 987361 - DNA, 22 bp, Homo sapiens
cagctggctctgacaagatggt

SEQ ID NO: 987362 - DNA, 17 bp, Homo sapiens
cagctgggaagcccttt

SEQ ID NO: 987363 - DNA, 16 bp, Homo sapiens
cagctgggacccctcc

SEQ ID NO: 987364 - DNA, 23 bp, Homo sapiens
cagctgggacccctcccaacctc

SEQ ID NO: 987365 - DNA, 16 bp, Homo sapiens
cagctgggagcactgg

SEQ ID NO: 987366 - DNA, 16 bp, Homo sapiens
cagctgggagccagtg

SEQ ID NO: 987367 - DNA, 19 bp, Homo sapiens
cagctgggagccagtgtgc

SEQ ID NO: 987368 - DNA, 20 bp, Homo sapiens
cagctgggagccagtgtgcc

SEQ ID NO: 987369 - DNA, 14 bp, Homo sapiens
cagctgggcaaagc

SEQ ID NO: 987370 - DNA, 15 bp, Homo sapiens
cagctgggcaaagcc

SEQ ID NO: 987371 - DNA, 16 bp, Homo sapiens
cagctgggcaaagcca

SEQ ID NO: 987372 - DNA, 13 bp, Homo sapiens
cagctgggcaggg

SEQ ID NO: 987373 - DNA, 15 bp, Homo sapiens
cagctgggcagggtg

SEQ ID NO: 987374 - DNA, 16 bp, Homo sapiens
cagctgggcagggtga

SEQ ID NO: 987375 - DNA, 20 bp, Homo sapiens
cagctgggcagggtgagaag

SEQ ID NO: 987376 - DNA, 17 bp, Homo sapiens
cagctgggccccatgct

SEQ ID NO: 987377 - DNA, 19 bp, Homo sapiens
cagctgggccccatgctct

SEQ ID NO: 987378 - DNA, 21 bp, Homo sapiens
cagctgggccccatgctctgc

SEQ ID NO: 987379 - DNA, 22 bp, Homo sapiens
cagctgggccccatgctctgcc

SEQ ID NO: 987380 - DNA, 23 bp, Homo sapiens
cagctgggccccatgctctgccc

SEQ ID NO: 987381 - DNA, 17 bp, Homo sapiens
cagctgggctctgcaat

SEQ ID NO: 987382 - DNA, 15 bp, Homo sapiens
cagctgggctctgcc

SEQ ID NO: 987383 - DNA, 19 bp, Homo sapiens
cagctggggagatgggggc

SEQ ID NO: 987384 - DNA, 18 bp, Homo sapiens
cagctggggccagaggct

SEQ ID NO: 987385 - DNA, 21 bp, Homo sapiens
cagctggggccagaggctggg

SEQ ID NO: 987386 - DNA, 22 bp, Homo sapiens
cagctggggccagaggctggga

SEQ ID NO: 987387 - DNA, 20 bp, Homo sapiens
cagctggggtaggctgtctg

SEQ ID NO: 987388 - DNA, 18 bp, Homo sapiens
cagctggtcagtctttgc

SEQ ID NO: 987389 - DNA, 20 bp, Homo sapiens
cagctggtcagtctttgctc

SEQ ID NO: 987390 - DNA, 16 bp, Homo sapiens
cagctggtcctgtgga

SEQ ID NO: 987391 - DNA, 15 bp, Homo sapiens
cagctggtcttttct

SEQ ID NO: 987392 - DNA, 22 bp, Homo sapiens
cagctggtcttttctcctactc

SEQ ID NO: 987393 - DNA, 19 bp, Homo sapiens
cagctggtgcaaattcaga

SEQ ID NO: 987394 - DNA, 13 bp, Homo sapiens
cagctggtgccaa

SEQ ID NO: 987395 - DNA, 21 bp, Homo sapiens
cagctggtggccctgtgcctg

SEQ ID NO: 987396 - DNA, 20 bp, Homo sapiens
cagctggtgggaagcgtctg

SEQ ID NO: 987397 - DNA, 18 bp, Homo sapiens
cagctgtaacacagctga

SEQ ID NO: 987398 - DNA, 19 bp, Homo sapiens
cagctgtaagaagagactg

SEQ ID NO: 987399 - DNA, 17 bp, Homo sapiens
cagctgtacttcgtctt

SEQ ID NO: 987400 - DNA, 12 bp, Homo sapiens
cagctgtagcca

SEQ ID NO: 987401 - DNA, 16 bp, Homo sapiens
cagctgtagccatggc

SEQ ID NO: 987402 - DNA, 17 bp, Homo sapiens
cagctgtagccatggct

SEQ ID NO: 987403 - DNA, 22 bp, Homo sapiens
cagctgtagccatggctcaggc

SEQ ID NO: 987404 - DNA, 23 bp, Homo sapiens
cagctgtattttggctttctccc

SEQ ID NO: 987405 - DNA, 14 bp, Homo sapiens
cagctgtcacctgc

SEQ ID NO: 987406 - DNA, 20 bp, Homo sapiens
cagctgtcacctgctcacag

SEQ ID NO: 987407 - DNA, 17 bp, Homo sapiens
cagctgtcccctctccc

SEQ ID NO: 987408 - DNA, 15 bp, Homo sapiens
cagctgtccctgtca

SEQ ID NO: 987409 - DNA, 14 bp, Homo sapiens
cagctgtcctgaac

SEQ ID NO: 987410 - DNA, 22 bp, Homo sapiens
cagctgtcctgcagcaaacact

SEQ ID NO: 987411 - DNA, 21 bp, Homo sapiens
cagctgtcgtctgactctggg

SEQ ID NO: 987412 - DNA, 16 bp, Homo sapiens
cagctgtctgccaggc

SEQ ID NO: 987413 - DNA, 18 bp, Homo sapiens
cagctgtctgccaggcac

SEQ ID NO: 987414 - DNA, 21 bp, Homo sapiens
cagctgtctgccaggcactct

SEQ ID NO: 987415 - DNA, 20 bp, Homo sapiens
cagctgtgaaggcttcactc

SEQ ID NO: 987416 - DNA, 19 bp, Homo sapiens
cagctgtgagccatgcctc

SEQ ID NO: 987417 - DNA, 20 bp, Homo sapiens
cagctgtgagccatgcctcc

SEQ ID NO: 987418 - DNA, 10 bp, Homo sapiens
cagctgtgat

SEQ ID NO: 987419 - DNA, 18 bp, Homo sapiens
cagctgtgcatccaattt

SEQ ID NO: 987420 - DNA, 16 bp, Homo sapiens
cagctgtgctgtggag

SEQ ID NO: 987421 - DNA, 17 bp, Homo sapiens
cagctgtggcagagtta

SEQ ID NO: 987422 - DNA, 22 bp, Homo sapiens
cagctgtggtacaaatgtgata

SEQ ID NO: 987423 - DNA, 15 bp, Homo sapiens
cagctgtgtctgcca

SEQ ID NO: 987424 - DNA, 16 bp, Homo sapiens
cagctgttactttctt

SEQ ID NO: 987425 - DNA, 19 bp, Homo sapiens
cagctgttgagaaaacgaa

SEQ ID NO: 987426 - DNA, 21 bp, Homo sapiens
cagctgtttatgcatagataa

SEQ ID NO: 987427 - DNA, 13 bp, Homo sapiens
cagctgtttctca

SEQ ID NO: 987428 - DNA, 16 bp, Homo sapiens
cagctgtttctcatga

SEQ ID NO: 987429 - DNA, 23 bp, Homo sapiens
cagctgttttgttgacattctga

SEQ ID NO: 987430 - DNA, 19 bp, Homo sapiens
cagcttaaacccatacaat

SEQ ID NO: 987431 - DNA, 16 bp, Homo sapiens
cagcttaattctcctt

SEQ ID NO: 987432 - DNA, 19 bp, Homo sapiens
cagcttaattctccttccc

SEQ ID NO: 987433 - DNA, 20 bp, Homo sapiens
cagcttagggccctggaggc

SEQ ID NO: 987434 - DNA, 14 bp, Homo sapiens
cagcttataatgaa

SEQ ID NO: 987435 - DNA, 16 bp, Homo sapiens
cagcttatctctttta

SEQ ID NO: 987436 - DNA, 14 bp, Homo sapiens
caggaaggacatgg

SEQ ID NO: 987437 - DNA, 19 bp, Homo sapiens
caggaaggaccccacatcc

SEQ ID NO: 987438 - DNA, 16 bp, Homo sapiens
caggaaggactatgaa

SEQ ID NO: 987439 - DNA, 16 bp, Homo sapiens
caggaaggagagcctg

SEQ ID NO: 987440 - DNA, 17 bp, Homo sapiens
caggaaggagagcctgc

SEQ ID NO: 987441 - DNA, 16 bp, Homo sapiens
caggaaggaggggaga

SEQ ID NO: 987442 - DNA, 13 bp, Homo sapiens
caggaaggcagaa

SEQ ID NO: 987443 - DNA, 22 bp, Homo sapiens
caggaaggccaaaatcaagagt

SEQ ID NO: 987444 - DNA, 13 bp, Homo sapiens
caggaagggaagc

SEQ ID NO: 987445 - DNA, 14 bp, Homo sapiens
caggaagggaagcg

SEQ ID NO: 987446 - DNA, 21 bp, Homo sapiens
caggaagggagtgaggggctg

SEQ ID NO: 987447 - DNA, 21 bp, Homo sapiens
caggaagggcaggaaggagag

SEQ ID NO: 987448 - DNA, 18 bp, Homo sapiens
caggaagggggtccaccc

SEQ ID NO: 987449 - DNA, 22 bp, Homo sapiens
caggaaggtaaaaacccagcgg

SEQ ID NO: 987450 - DNA, 18 bp, Homo sapiens
caggaaggtgaggcagaa

SEQ ID NO: 987451 - DNA, 16 bp, Homo sapiens
caggaaggtgcctggc

SEQ ID NO: 987452 - DNA, 15 bp, Homo sapiens
caggaagtacttcca

SEQ ID NO: 987453 - DNA, 15 bp, Homo sapiens
caggaagtgtttatg

SEQ ID NO: 987454 - DNA, 22 bp, Homo sapiens
caggaagtgtttatgaggaaac

SEQ ID NO: 987455 - DNA, 17 bp, Homo sapiens
caggaagtttggagcct

SEQ ID NO: 987456 - DNA, 23 bp, Homo sapiens
caggaataaggccttaatatgtt

SEQ ID NO: 987457 - DNA, 14 bp, Homo sapiens
caggaatatgacac

SEQ ID NO: 987458 - DNA, 19 bp, Homo sapiens
caggaatattgtcatcctt

SEQ ID NO: 987459 - DNA, 19 bp, Homo sapiens
caggaatctgtatatattt

SEQ ID NO: 987460 - DNA, 14 bp, Homo sapiens
caggaatgatctct

SEQ ID NO: 987461 - DNA, 16 bp, Homo sapiens
caggaatgctgggccc

SEQ ID NO: 987462 - DNA, 17 bp, Homo sapiens
caggaatggaaagcgga

SEQ ID NO: 987463 - DNA, 19 bp, Homo sapiens
caggaatggctgcaccttt

SEQ ID NO: 987464 - DNA, 16 bp, Homo sapiens
caggaatgggggtcag

SEQ ID NO: 987465 - DNA, 17 bp, Homo sapiens
caggaatgggggtcaga

SEQ ID NO: 987466 - DNA, 19 bp, Homo sapiens
caggaatgtgtggcctgca

SEQ ID NO: 987467 - DNA, 23 bp, Homo sapiens
caggaatgtgtggcctgcacagt

SEQ ID NO: 987468 - DNA, 19 bp, Homo sapiens
caggaatgttaaagtcagt

SEQ ID NO: 987469 - DNA, 13 bp, Homo sapiens
caggaattatgtc

SEQ ID NO: 987470 - DNA, 18 bp, Homo sapiens
caggaattctcaagacct

SEQ ID NO: 987471 - DNA, 16 bp, Homo sapiens
caggaattttattttg

SEQ ID NO: 987472 - DNA, 21 bp, Homo sapiens
caggaattttattttgctgag

SEQ ID NO: 987473 - DNA, 23 bp, Homo sapiens
caggacaatgaaatactccagca

SEQ ID NO: 987474 - DNA, 24 bp, Homo sapiens
caggacaatgaaatactccagcac

SEQ ID NO: 987475 - DNA, 21 bp, Homo sapiens
caggacacgaaggctgcccct

SEQ ID NO: 987476 - DNA, 19 bp, Homo sapiens
caggacagcatcccttccc

SEQ ID NO: 987477 - DNA, 24 bp, Homo sapiens
caggacagcatcccttcccacatg

SEQ ID NO: 987478 - DNA, 12 bp, Homo sapiens
caggacagctct

SEQ ID NO: 987479 - DNA, 13 bp, Homo sapiens
caggacagctctt

SEQ ID NO: 987480 - DNA, 14 bp, Homo sapiens
caggacagctcttg

SEQ ID NO: 987481 - DNA, 12 bp, Homo sapiens
caggacagctgg

SEQ ID NO: 987482 - DNA, 20 bp, Homo sapiens
caggacagtgcttcagcctg

SEQ ID NO: 987483 - DNA, 12 bp, Homo sapiens
cagctgcctgca

SEQ ID NO: 987484 - DNA, 14 bp, Homo sapiens
cagctgcctggggc

SEQ ID NO: 987485 - DNA, 15 bp, Homo sapiens
cagctgcctggggcc

SEQ ID NO: 987486 - DNA, 17 bp, Homo sapiens
cagctgcctggggccca

SEQ ID NO: 987487 - DNA, 19 bp, Homo sapiens
cagctgcgcttgcttttct

SEQ ID NO: 987488 - DNA, 14 bp, Homo sapiens
cagctgcgggtctg

SEQ ID NO: 987489 - DNA, 18 bp, Homo sapiens
cagctgctatccccatct

SEQ ID NO: 987490 - DNA, 16 bp, Homo sapiens
cagctgctcccacact

SEQ ID NO: 987491 - DNA, 12 bp, Homo sapiens
cagctgctccta

SEQ ID NO: 987492 - DNA, 18 bp, Homo sapiens
cagctgctcctagaggga

SEQ ID NO: 987493 - DNA, 23 bp, Homo sapiens
cagctgctcctagagggaggggc

SEQ ID NO: 987494 - DNA, 12 bp, Homo sapiens
cagctgctctgc

SEQ ID NO: 987495 - DNA, 17 bp, Homo sapiens
cagctgctctgcccctt

SEQ ID NO: 987496 - DNA, 22 bp, Homo sapiens
cagctgctcttagtgcccgcct

SEQ ID NO: 987497 - DNA, 21 bp, Homo sapiens
cagctgctgaagttctgagcc

SEQ ID NO: 987498 - DNA, 15 bp, Homo sapiens
cagctgctggagaat

SEQ ID NO: 987499 - DNA, 22 bp, Homo sapiens
cagctgctggagaataaatttg

SEQ ID NO: 987500 - DNA, 12 bp, Homo sapiens
cagctgctgtct

SEQ ID NO: 987501 - DNA, 13 bp, Homo sapiens
cagctgctgtggg

SEQ ID NO: 987502 - DNA, 16 bp, Homo sapiens
cagctgctgttctcag

SEQ ID NO: 987503 - DNA, 18 bp, Homo sapiens
cagctgctgttctcagga

SEQ ID NO: 987504 - DNA, 22 bp, Homo sapiens
cagctgctgttctcaggacagc

SEQ ID NO: 987505 - DNA, 12 bp, Homo sapiens
cagctgcttctc

SEQ ID NO: 987506 - DNA, 21 bp, Homo sapiens
cagctgcttgtgggcccggag

SEQ ID NO: 987507 - DNA, 21 bp, Homo sapiens
cagctgctttgagctacagga

SEQ ID NO: 987508 - DNA, 15 bp, Homo sapiens
cagctggacagaggg

SEQ ID NO: 987509 - DNA, 24 bp, Homo sapiens
cagctggacagaggggactctggg

SEQ ID NO: 987510 - DNA, 18 bp, Homo sapiens
cagctggactctgcatcc

SEQ ID NO: 987511 - DNA, 18 bp, Homo sapiens
cagctggagaaatatggt

SEQ ID NO: 987512 - DNA, 21 bp, Homo sapiens
cagctggaggaatacatttta

SEQ ID NO: 987513 - DNA, 22 bp, Homo sapiens
cagctggaggaatacattttat

SEQ ID NO: 987514 - DNA, 14 bp, Homo sapiens
cagctggcccccag

SEQ ID NO: 987515 - DNA, 15 bp, Homo sapiens
cagctggcccccagc

SEQ ID NO: 987516 - DNA, 11 bp, Homo sapiens
cagctggccta

SEQ ID NO: 987517 - DNA, 23 bp, Homo sapiens
cagctggcctaatcactctgagt

SEQ ID NO: 987518 - DNA, 14 bp, Homo sapiens
cagctggcctggac

SEQ ID NO: 987519 - DNA, 16 bp, Homo sapiens
cagctggcctggacag

SEQ ID NO: 987520 - DNA, 19 bp, Homo sapiens
agcctagaacatccctggg

SEQ ID NO: 987521 - DNA, 17 bp, Homo sapiens
agcctagaagagcttct

SEQ ID NO: 987522 - DNA, 19 bp, Homo sapiens
agcctagaagagcttctga

SEQ ID NO: 987523 - DNA, 14 bp, Homo sapiens
agcctagaagctgg

SEQ ID NO: 987524 - DNA, 19 bp, Homo sapiens
agcctagacaacctttctg

SEQ ID NO: 987525 - DNA, 20 bp, Homo sapiens
agcctagacaacctttctgt

SEQ ID NO: 987526 - DNA, 18 bp, Homo sapiens
agcctagaccctcctcct

SEQ ID NO: 987527 - DNA, 17 bp, Homo sapiens
agcctagcacagcagct

SEQ ID NO: 987528 - DNA, 15 bp, Homo sapiens
agcctaggaccactc

SEQ ID NO: 987529 - DNA, 18 bp, Homo sapiens
agcctaggaccactcagc

SEQ ID NO: 987530 - DNA, 19 bp, Homo sapiens
agcctaggaccactcagcc

SEQ ID NO: 987531 - DNA, 23 bp, Homo sapiens
agcctaggaccactcagccccta

SEQ ID NO: 987532 - DNA, 21 bp, Homo sapiens
agcctaggacgccaacttctc

SEQ ID NO: 987533 - DNA, 14 bp, Homo sapiens
agcctaggggtcag

SEQ ID NO: 987534 - DNA, 23 bp, Homo sapiens
agcctaggggtcagggaccaagg

SEQ ID NO: 987535 - DNA, 22 bp, Homo sapiens
agcctagttcatccaatcctca

SEQ ID NO: 987536 - DNA, 23 bp, Homo sapiens
agcctagttcatccaatcctcac

SEQ ID NO: 987537 - DNA, 21 bp, Homo sapiens
agcctatacgtttctgtggag

SEQ ID NO: 987538 - DNA, 18 bp, Homo sapiens
agcctatagtaaatgtgt

SEQ ID NO: 987539 - DNA, 21 bp, Homo sapiens
agcctatgagcatcctgagcc

SEQ ID NO: 987540 - DNA, 20 bp, Homo sapiens
agcctatgatattccccatt

SEQ ID NO: 987541 - DNA, 15 bp, Homo sapiens
agcctatttttcaaa

SEQ ID NO: 987542 - DNA, 20 bp, Homo sapiens
agcctcaaaacaaaggccta

SEQ ID NO: 987543 - DNA, 24 bp, Homo sapiens
agcctcaaagtcccttgagactcc

SEQ ID NO: 987544 - DNA, 19 bp, Homo sapiens
agcctcaaggccctcggag

SEQ ID NO: 987545 - DNA, 21 bp, Homo sapiens
agcctcaatttcctcatctgg

SEQ ID NO: 987546 - DNA, 22 bp, Homo sapiens
agcctcacagcagtgagactgg

SEQ ID NO: 987547 - DNA, 16 bp, Homo sapiens
agcctcacggagggcc

SEQ ID NO: 987548 - DNA, 22 bp, Homo sapiens
agcctcacggagggccgtgtga

SEQ ID NO: 987549 - DNA, 21 bp, Homo sapiens
agcctcacggggttggctgtt

SEQ ID NO: 987550 - DNA, 21 bp, Homo sapiens
agcctcacgtatttcacagag

SEQ ID NO: 987551 - DNA, 23 bp, Homo sapiens
agcctcacgtatttcacagagca

SEQ ID NO: 987552 - DNA, 16 bp, Homo sapiens
agcctcacttgaatgt

SEQ ID NO: 987553 - DNA, 23 bp, Homo sapiens
agcctcacttttaatgaacaaat

SEQ ID NO: 987554 - DNA, 17 bp, Homo sapiens
agcctcagaaggcccca

SEQ ID NO: 987555 - DNA, 22 bp, Homo sapiens
agcctcagaaggccccagagag

SEQ ID NO: 987556 - DNA, 12 bp, Homo sapiens
agcctcagccat

SEQ ID NO: 987557 - DNA, 14 bp, Homo sapiens
agcctcagcccaac

SEQ ID NO: 987558 - DNA, 15 bp, Homo sapiens
agcctcagcccaact

SEQ ID NO: 987559 - DNA, 18 bp, Homo sapiens
agcctcagcccaacttct

SEQ ID NO: 987560 - DNA, 23 bp, Homo sapiens
agcctcaggcttgagggagggct

SEQ ID NO: 987561 - DNA, 16 bp, Homo sapiens
agcctcagtctccctc

SEQ ID NO: 987562 - DNA, 22 bp, Homo sapiens
agcctcagtctccctcccttgg

SEQ ID NO: 987563 - DNA, 14 bp, Homo sapiens
agcctcagtgccac

SEQ ID NO: 987564 - DNA, 23 bp, Homo sapiens
agcctcagtgccacttgacattc

SEQ ID NO: 987565 - DNA, 17 bp, Homo sapiens
agcctcatactcctggg

SEQ ID NO: 987566 - DNA, 18 bp, Homo sapiens
agcctcatactcctgggc

SEQ ID NO: 987567 - DNA, 19 bp, Homo sapiens
agcctcatactcctgggct

SEQ ID NO: 987568 - DNA, 16 bp, Homo sapiens
agcctcatatttaaag

SEQ ID NO: 987569 - DNA, 20 bp, Homo sapiens
agcctcatccgaggcagggt

SEQ ID NO: 987570 - DNA, 20 bp, Homo sapiens
agcctcatcctccccaggac

SEQ ID NO: 987571 - DNA, 12 bp, Homo sapiens
agcctcatctct

SEQ ID NO: 987572 - DNA, 22 bp, Homo sapiens
agcctcatgttctcttcccagg

SEQ ID NO: 987573 - DNA, 23 bp, Homo sapiens
agcctcatgttctcttcccaggc

SEQ ID NO: 987574 - DNA, 14 bp, Homo sapiens
agcctcatgttctg

SEQ ID NO: 987575 - DNA, 15 bp, Homo sapiens
agcctcatgttctgt

SEQ ID NO: 987576 - DNA, 17 bp, Homo sapiens
agcctcatgttctgtgg

SEQ ID NO: 987577 - DNA, 19 bp, Homo sapiens
agcctcattgtgccaagcc

SEQ ID NO: 987578 - DNA, 22 bp, Homo sapiens
agcctccaagcacagagcctgg

SEQ ID NO: 987579 - DNA, 13 bp, Homo sapiens
agcctccaagcct

SEQ ID NO: 987580 - DNA, 18 bp, Homo sapiens
agcctccaagcctgcctc

SEQ ID NO: 987581 - DNA, 12 bp, Homo sapiens
agcctccacagc

SEQ ID NO: 987582 - DNA, 23 bp, Homo sapiens
agcctccacagcgagggcagctg

SEQ ID NO: 987583 - DNA, 18 bp, Homo sapiens
agcctccaccttgctctt

SEQ ID NO: 987584 - DNA, 19 bp, Homo sapiens
agcctccaccttgctcttc

SEQ ID NO: 987585 - DNA, 20 bp, Homo sapiens
agcctccactgcctctggaa

SEQ ID NO: 987586 - DNA, 16 bp, Homo sapiens
agcctccagagaagcc

SEQ ID NO: 987587 - DNA, 15 bp, Homo sapiens
agcctccagagccag

SEQ ID NO: 987588 - DNA, 17 bp, Homo sapiens
agcctccagagccagcc

SEQ ID NO: 987589 - DNA, 21 bp, Homo sapiens
agcctccagagccagcctggg

SEQ ID NO: 987590 - DNA, 23 bp, Homo sapiens
agcctccagagccagcctgggac

SEQ ID NO: 987591 - DNA, 20 bp, Homo sapiens
agcctccaggcccccaactc

SEQ ID NO: 987592 - DNA, 17 bp, Homo sapiens
agcctccatgctgcctc

SEQ ID NO: 987593 - DNA, 15 bp, Homo sapiens
agcctccatttagtt

SEQ ID NO: 987594 - DNA, 20 bp, Homo sapiens
agcctccatttagttctttg

SEQ ID NO: 987595 - DNA, 12 bp, Homo sapiens
agcctcccaagt

SEQ ID NO: 987596 - DNA, 13 bp, Homo sapiens
agcctcccacccc

SEQ ID NO: 987597 - DNA, 18 bp, Homo sapiens
agcctcccatccagggcc

SEQ ID NO: 987598 - DNA, 18 bp, Homo sapiens
agcctcccccgccagccc

SEQ ID NO: 987599 - DNA, 23 bp, Homo sapiens
agcctccccctcagatgatctct

SEQ ID NO: 987600 - DNA, 21 bp, Homo sapiens
agcctcccctcccctggggac

SEQ ID NO: 987601 - DNA, 16 bp, Homo sapiens
agcctcccctgccagg

SEQ ID NO: 987602 - DNA, 17 bp, Homo sapiens
agcctcccctgccaggg

SEQ ID NO: 987603 - DNA, 14 bp, Homo sapiens
agcctccccttctt

SEQ ID NO: 987604 - DNA, 17 bp, Homo sapiens
cgtgcctgggcccctcc

SEQ ID NO: 987605 - DNA, 23 bp, Homo sapiens
cgtgcctgggcccctcccctcag

SEQ ID NO: 987606 - DNA, 14 bp, Homo sapiens
cgtgcctgtgtcca

SEQ ID NO: 987607 - DNA, 16 bp, Homo sapiens
cgtgccttcagctcta

SEQ ID NO: 987608 - DNA, 19 bp, Homo sapiens
cgtgccttttgcacccctc

SEQ ID NO: 987609 - DNA, 14 bp, Homo sapiens
cgtgcgagctgccg

SEQ ID NO: 987610 - DNA, 22 bp, Homo sapiens
cgtgcgtgttagtgtgtgtgca

SEQ ID NO: 987611 - DNA, 13 bp, Homo sapiens
cgtgctgggcagc

SEQ ID NO: 987612 - DNA, 16 bp, Homo sapiens
cgtgctgggcagcccg

SEQ ID NO: 987613 - DNA, 19 bp, Homo sapiens
cgtgctgggcggctgtgct

SEQ ID NO: 987614 - DNA, 13 bp, Homo sapiens
cgtgctgtaaata

SEQ ID NO: 987615 - DNA, 15 bp, Homo sapiens
cgtggaaagggtgct

SEQ ID NO: 987616 - DNA, 14 bp, Homo sapiens
cgtggaacattctg

SEQ ID NO: 987617 - DNA, 16 bp, Homo sapiens
cgtggaacctctgtct

SEQ ID NO: 987618 - DNA, 19 bp, Homo sapiens
cgtggaacctctgtctcat

SEQ ID NO: 987619 - DNA, 15 bp, Homo sapiens
cgtggaccttcctgc

SEQ ID NO: 987620 - DNA, 19 bp, Homo sapiens
cgtggactgagtgggaagc

SEQ ID NO: 987621 - DNA, 19 bp, Homo sapiens
cgtggactgtgctggtgca

SEQ ID NO: 987622 - DNA, 17 bp, Homo sapiens
cgtggagagctggtgcc

SEQ ID NO: 987623 - DNA, 16 bp, Homo sapiens
cgtggagatagtgcca

SEQ ID NO: 987624 - DNA, 22 bp, Homo sapiens
cgtggagatagtgccaggtggc

SEQ ID NO: 987625 - DNA, 16 bp, Homo sapiens
cgtggagccagggagc

SEQ ID NO: 987626 - DNA, 23 bp, Homo sapiens
cgtggagccattgaacagctgtg

SEQ ID NO: 987627 - DNA, 19 bp, Homo sapiens
cgtggagctcgcccctccc

SEQ ID NO: 987628 - DNA, 20 bp, Homo sapiens
cgtggagcttaagccactgc

SEQ ID NO: 987629 - DNA, 18 bp, Homo sapiens
cgtggaggaatgctcccc

SEQ ID NO: 987630 - DNA, 17 bp, Homo sapiens
cgtggaggaggaaggca

SEQ ID NO: 987631 - DNA, 18 bp, Homo sapiens
cgtggatacagagccacg

SEQ ID NO: 987632 - DNA, 18 bp, Homo sapiens
cgtggatcaagcttgtgt

SEQ ID NO: 987633 - DNA, 17 bp, Homo sapiens
cgtggattgcacgtggc

SEQ ID NO: 987634 - DNA, 14 bp, Homo sapiens
cgtggcacagctgg

SEQ ID NO: 987635 - DNA, 15 bp, Homo sapiens
cgtggcacagctggg

SEQ ID NO: 987636 - DNA, 22 bp, Homo sapiens
cgtggcacagctgggagcctgg

SEQ ID NO: 987637 - DNA, 15 bp, Homo sapiens
cgtggcactagaatg

SEQ ID NO: 987638 - DNA, 22 bp, Homo sapiens
cgtggcagataatcagcctctt

SEQ ID NO: 987639 - DNA, 20 bp, Homo sapiens
cgtggcatgttttgatttgt

SEQ ID NO: 987640 - DNA, 17 bp, Homo sapiens
cgtggccacgggggcag

SEQ ID NO: 987641 - DNA, 11 bp, Homo sapiens
cgtggccagcc

SEQ ID NO: 987642 - DNA, 15 bp, Homo sapiens
cgtggccagcccggc

SEQ ID NO: 987643 - DNA, 17 bp, Homo sapiens
cgtggcccgtggcctgg

SEQ ID NO: 987644 - DNA, 18 bp, Homo sapiens
cgtggcccgtggcctggc

SEQ ID NO: 987645 - DNA, 14 bp, Homo sapiens
cgtggcctctctct

SEQ ID NO: 987646 - DNA, 16 bp, Homo sapiens
cgtggcctcttgagca

SEQ ID NO: 987647 - DNA, 16 bp, Homo sapiens
cgtggcctggcatctg

SEQ ID NO: 987648 - DNA, 13 bp, Homo sapiens
cgtggcctgggct

SEQ ID NO: 987649 - DNA, 19 bp, Homo sapiens
cgtggcctgggcttggccc

SEQ ID NO: 987650 - DNA, 15 bp, Homo sapiens
cgtggccttgggagg

SEQ ID NO: 987651 - DNA, 14 bp, Homo sapiens
cgtggctcagccag

SEQ ID NO: 987652 - DNA, 15 bp, Homo sapiens
cgtggctcagccagc

SEQ ID NO: 987653 - DNA, 13 bp, Homo sapiens
cgtggctctgctg

SEQ ID NO: 987654 - DNA, 11 bp, Homo sapiens
cgtggctctgg

SEQ ID NO: 987655 - DNA, 13 bp, Homo sapiens
cgtggctctggga

SEQ ID NO: 987656 - DNA, 21 bp, Homo sapiens
cgtggctctgggagagccagc

SEQ ID NO: 987657 - DNA, 20 bp, Homo sapiens
cgtggcttcccgctcagccc

SEQ ID NO: 987658 - DNA, 21 bp, Homo sapiens
cgtggcttcccgctcagccct

SEQ ID NO: 987659 - DNA, 15 bp, Homo sapiens
cgtggcttggcatct

SEQ ID NO: 987660 - DNA, 19 bp, Homo sapiens
cgtggcttggcatctgtgt

SEQ ID NO: 987661 - DNA, 14 bp, Homo sapiens
cgtgggagccagcc

SEQ ID NO: 987662 - DNA, 19 bp, Homo sapiens
cgtgggccctgcaggctgc

SEQ ID NO: 987663 - DNA, 16 bp, Homo sapiens
cgtgggccgggaggca

SEQ ID NO: 987664 - DNA, 17 bp, Homo sapiens
cgtgggccgggaggcag

SEQ ID NO: 987665 - DNA, 12 bp, Homo sapiens
cgtgggctctgc

SEQ ID NO: 987666 - DNA, 13 bp, Homo sapiens
cgtgggctctgcc

SEQ ID NO: 987667 - DNA, 18 bp, Homo sapiens
cgtgggcttaaagcagaa

SEQ ID NO: 987668 - DNA, 13 bp, Homo sapiens
cgtggggaagggg

SEQ ID NO: 987669 - DNA, 18 bp, Homo sapiens
cgtggggaaggggtgcag

SEQ ID NO: 987670 - DNA, 23 bp, Homo sapiens
cgtggggagggccgtaccccacc

SEQ ID NO: 987671 - DNA, 23 bp, Homo sapiens
cgtggggtgacttccctggtcac

SEQ ID NO: 987672 - DNA, 15 bp, Homo sapiens
cgtggggtgtgctgg

SEQ ID NO: 987673 - DNA, 17 bp, Homo sapiens
cgtggggtgtgctggga

SEQ ID NO: 987674 - DNA, 21 bp, Homo sapiens
cgtgggtcactacagggagaa

SEQ ID NO: 987675 - DNA, 15 bp, Homo sapiens
cgtgggtctctgggg

SEQ ID NO: 987676 - DNA, 16 bp, Homo sapiens
cgtgggtctctgggga

SEQ ID NO: 987677 - DNA, 23 bp, Homo sapiens
cgtgggtttttgtatccagagct

SEQ ID NO: 987678 - DNA, 14 bp, Homo sapiens
cgtggtagaagcca

SEQ ID NO: 987679 - DNA, 17 bp, Homo sapiens
cgtggtatgtctgccat

SEQ ID NO: 987680 - DNA, 20 bp, Homo sapiens
cgtggtccatgctgatgatt

SEQ ID NO: 987681 - DNA, 23 bp, Homo sapiens
cgtggtgggggaggagcctctgg

SEQ ID NO: 987682 - DNA, 12 bp, Homo sapiens
cgtgtaaataat

SEQ ID NO: 987683 - DNA, 13 bp, Homo sapiens
cgtgtacagcaca

SEQ ID NO: 987684 - DNA, 16 bp, Homo sapiens
cgtgtacagcacagaa

SEQ ID NO: 987685 - DNA, 18 bp, Homo sapiens
cgtgtacatagccctggt

SEQ ID NO: 987686 - DNA, 18 bp, Homo sapiens
cgtgtagcgtcctgagga

SEQ ID NO: 987687 - DNA, 19 bp, Homo sapiens
cgtgtagcgtcctgaggaa

SEQ ID NO: 987688 - DNA, 15 bp, Homo sapiens
cgtgtatagtgccta

SEQ ID NO: 987689 - DNA, 22 bp, Homo sapiens
cgtgtattgagatttcttaaat

SEQ ID NO: 987690 - DNA, 16 bp, Homo sapiens
cgtgtatttattacat

SEQ ID NO: 987691 - DNA, 17 bp, Homo sapiens
cgtgtatttggctgggc

SEQ ID NO: 987692 - DNA, 14 bp, Homo sapiens
cgtgtcaagctgct

SEQ ID NO: 987693 - DNA, 15 bp, Homo sapiens
cgtgtcaagctgctc

SEQ ID NO: 987694 - DNA, 23 bp, Homo sapiens
cgtgtccaagggccgtgcccttg

SEQ ID NO: 987695 - DNA, 19 bp, Homo sapiens
cgtgtcccctgacagggcc

SEQ ID NO: 987696 - DNA, 15 bp, Homo sapiens
cgtgtccctctcgga

SEQ ID NO: 987697 - DNA, 13 bp, Homo sapiens
cgtgtccgtccac

SEQ ID NO: 987698 - DNA, 18 bp, Homo sapiens
cgtgtccgtccacccttc

SEQ ID NO: 987699 - DNA, 17 bp, Homo sapiens
cgtgtcctcctctgagg

SEQ ID NO: 987700 - DNA, 15 bp, Homo sapiens
cgtgtcgtgggtgtg

SEQ ID NO: 987701 - DNA, 15 bp, Homo sapiens
cgtgtctcagcctct

SEQ ID NO: 987702 - DNA, 16 bp, Homo sapiens
cgtgtctcagcctctg

SEQ ID NO: 987703 - DNA, 13 bp, Homo sapiens
cgtgtctctccca

SEQ ID NO: 987704 - DNA, 14 bp, Homo sapiens
cgtgtctctgagga

SEQ ID NO: 987705 - DNA, 20 bp, Homo sapiens
cgtgtcttccactttgcata

SEQ ID NO: 987706 - DNA, 13 bp, Homo sapiens
cgtgtgaatgtag

SEQ ID NO: 987707 - DNA, 23 bp, Homo sapiens
cgtgtgagaagtgaatgctggga

SEQ ID NO: 987708 - DNA, 21 bp, Homo sapiens
cgtgtgcatagcgtcctgccc

SEQ ID NO: 987709 - DNA, 22 bp, Homo sapiens
cgtgtgcatagcgtcctgccct

SEQ ID NO: 987710 - DNA, 16 bp, Homo sapiens
cgtgtgctgaagacat

SEQ ID NO: 987711 - DNA, 18 bp, Homo sapiens
cgtgtggagcagagctct

SEQ ID NO: 987712 - DNA, 16 bp, Homo sapiens
cgtgtggcagccacac

SEQ ID NO: 987713 - DNA, 20 bp, Homo sapiens
cgtgtggctcacgtgtgtga

SEQ ID NO: 987714 - DNA, 15 bp, Homo sapiens
cgtgtggctcctggt

SEQ ID NO: 987715 - DNA, 22 bp, Homo sapiens
cgtgtggtttccctgcccctgt

SEQ ID NO: 987716 - DNA, 15 bp, Homo sapiens
cgtgtgtatttctaa

SEQ ID NO: 987717 - DNA, 17 bp, Homo sapiens
cgtgtgtcccagatgct

SEQ ID NO: 987718 - DNA, 22 bp, Homo sapiens
cgtgtgtgcaagtgtctgtgtg

SEQ ID NO: 987719 - DNA, 20 bp, Homo sapiens
cgtgtgttcttttgagtcct

SEQ ID NO: 987720 - DNA, 17 bp, Homo sapiens
cgtgttacccactgcca

SEQ ID NO: 987721 - DNA, 20 bp, Homo sapiens
cgtgttagtgtgtgtgcatg

SEQ ID NO: 987722 - DNA, 22 bp, Homo sapiens
cgtgttagtgtgtgtgcatgtg

SEQ ID NO: 987723 - DNA, 22 bp, Homo sapiens
cgtgttatgaatctgtgctggc

SEQ ID NO: 987724 - DNA, 15 bp, Homo sapiens
cgtgttcaatatttt

SEQ ID NO: 987725 - DNA, 22 bp, Homo sapiens
cgtgttcaggacacatctattg

SEQ ID NO: 987726 - DNA, 22 bp, Homo sapiens
gtggatttgattcattttcctg

SEQ ID NO: 987727 - DNA, 20 bp, Homo sapiens
gtggattttctactgtaaga

SEQ ID NO: 987728 - DNA, 19 bp, Homo sapiens
gtggattttttattattat

SEQ ID NO: 987729 - DNA, 14 bp, Homo sapiens
gtggcaaagtgctg

SEQ ID NO: 987730 - DNA, 15 bp, Homo sapiens
gtggcaagaccaaaa

SEQ ID NO: 987731 - DNA, 16 bp, Homo sapiens
gtggcaatctgtgggc

SEQ ID NO: 987732 - DNA, 14 bp, Homo sapiens
gtggcacaaaaaaa

SEQ ID NO: 987733 - DNA, 22 bp, Homo sapiens
gtggcacagacttctggaaggc

SEQ ID NO: 987734 - DNA, 13 bp, Homo sapiens
gtggcacaggcac

SEQ ID NO: 987735 - DNA, 14 bp, Homo sapiens
gtggcaccagcagc

SEQ ID NO: 987736 - DNA, 16 bp, Homo sapiens
gtggcacctcctgaga

SEQ ID NO: 987737 - DNA, 17 bp, Homo sapiens
gtggcacctgtttcccg

SEQ ID NO: 987738 - DNA, 19 bp, Homo sapiens
gtggcacggagagaaggcc

SEQ ID NO: 987739 - DNA, 20 bp, Homo sapiens
gtggcacgggccctccctcc

SEQ ID NO: 987740 - DNA, 15 bp, Homo sapiens
gtggcactgagcccc

SEQ ID NO: 987741 - DNA, 16 bp, Homo sapiens
gtggcactgagccccc

SEQ ID NO: 987742 - DNA, 22 bp, Homo sapiens
gtggcactggtaggttgggaca

SEQ ID NO: 987743 - DNA, 15 bp, Homo sapiens
gtggcacttctgcct

SEQ ID NO: 987744 - DNA, 14 bp, Homo sapiens
gtggcagaaaagag

SEQ ID NO: 987745 - DNA, 20 bp, Homo sapiens
gtggcagaaaagaggagacc

SEQ ID NO: 987746 - DNA, 19 bp, Homo sapiens
gtggcagatgtcttccctg

SEQ ID NO: 987747 - DNA, 22 bp, Homo sapiens
gtggcagattttacaaaagatg

SEQ ID NO: 987748 - DNA, 13 bp, Homo sapiens
gtggcagcaacaa

SEQ ID NO: 987749 - DNA, 19 bp, Homo sapiens
gtggcagcaacggcacagc

SEQ ID NO: 987750 - DNA, 13 bp, Homo sapiens
gtggcagccatgc

SEQ ID NO: 987751 - DNA, 22 bp, Homo sapiens
gtggcagctgtcccctctccct

SEQ ID NO: 987752 - DNA, 13 bp, Homo sapiens
gtggcaggaccag

SEQ ID NO: 987753 - DNA, 14 bp, Homo sapiens
cttcctgcttgcca

SEQ ID NO: 987754 - DNA, 14 bp, Homo sapiens
cttcctggacacac

SEQ ID NO: 987755 - DNA, 15 bp, Homo sapiens
cttcctggacacact

SEQ ID NO: 987756 - DNA, 17 bp, Homo sapiens
cttcctggacacactct

SEQ ID NO: 987757 - DNA, 15 bp, Homo sapiens
cttcctggacctgag

SEQ ID NO: 987758 - DNA, 21 bp, Homo sapiens
cttcctggcccaggccttgct

SEQ ID NO: 987759 - DNA, 13 bp, Homo sapiens
cttcctggcctct

SEQ ID NO: 987760 - DNA, 19 bp, Homo sapiens
cttcctggctccttcactg

SEQ ID NO: 987761 - DNA, 16 bp, Homo sapiens
cttcctggctctgggg

SEQ ID NO: 987762 - DNA, 21 bp, Homo sapiens
cttcctgggaccccctcgcca

SEQ ID NO: 987763 - DNA, 16 bp, Homo sapiens
cttcctgggaggacag

SEQ ID NO: 987764 - DNA, 19 bp, Homo sapiens
cttcctgggaggacaggca

SEQ ID NO: 987765 - DNA, 16 bp, Homo sapiens
cttcctggggatgtca

SEQ ID NO: 987766 - DNA, 18 bp, Homo sapiens
cttcctggggatgtcata

SEQ ID NO: 987767 - DNA, 20 bp, Homo sapiens
cttcctggggcatctggcga

SEQ ID NO: 987768 - DNA, 17 bp, Homo sapiens
cttcctggggccccgct

SEQ ID NO: 987769 - DNA, 21 bp, Homo sapiens
cttcctggggccccgctggga

SEQ ID NO: 987770 - DNA, 23 bp, Homo sapiens
cttcctgggtcctgttccctacc

SEQ ID NO: 987771 - DNA, 18 bp, Homo sapiens
cttcctggtgaggcccag

SEQ ID NO: 987772 - DNA, 19 bp, Homo sapiens
cttcctggtgaggcccagc

SEQ ID NO: 987773 - DNA, 17 bp, Homo sapiens
cttcctgtcccacctct

SEQ ID NO: 987774 - DNA, 16 bp, Homo sapiens
cttcctgtccctgagg

SEQ ID NO: 987775 - DNA, 13 bp, Homo sapiens
cttcctgtcctgc

SEQ ID NO: 987776 - DNA, 15 bp, Homo sapiens
cttcctgtcctgcct

SEQ ID NO: 987777 - DNA, 16 bp, Homo sapiens
cttcctgtcctgcctc

SEQ ID NO: 987778 - DNA, 18 bp, Homo sapiens
cttcctgtcctgcctcct

SEQ ID NO: 987779 - DNA, 20 bp, Homo sapiens
cttcctgtcctgcctcctca

SEQ ID NO: 987780 - DNA, 14 bp, Homo sapiens
cttcctgtctgttt

SEQ ID NO: 987781 - DNA, 16 bp, Homo sapiens
cttcctgtctgtttat

SEQ ID NO: 987782 - DNA, 16 bp, Homo sapiens
cttcctgtgacttcag

SEQ ID NO: 987783 - DNA, 14 bp, Homo sapiens
cttcctgtgccctc

SEQ ID NO: 987784 - DNA, 15 bp, Homo sapiens
cttcctgtgccctca

SEQ ID NO: 987785 - DNA, 17 bp, Homo sapiens
cttcctgtgccctcacc

SEQ ID NO: 987786 - DNA, 16 bp, Homo sapiens
cttcctgtgccctgca

SEQ ID NO: 987787 - DNA, 14 bp, Homo sapiens
cttcctgtgtcctg

SEQ ID NO: 987788 - DNA, 15 bp, Homo sapiens
cttcctgtgtcctga

SEQ ID NO: 987789 - DNA, 15 bp, Homo sapiens
cttcctgtgtgtcca

SEQ ID NO: 987790 - DNA, 16 bp, Homo sapiens
cttcctgttacctgtc

SEQ ID NO: 987791 - DNA, 16 bp, Homo sapiens
cttcctgttccctcct

SEQ ID NO: 987792 - DNA, 19 bp, Homo sapiens
cttcctgttccctcctggt

SEQ ID NO: 987793 - DNA, 22 bp, Homo sapiens
cttcctgttccctcctggtcct

SEQ ID NO: 987794 - DNA, 23 bp, Homo sapiens
cttcctgtttcagacccccccat

SEQ ID NO: 987795 - DNA, 19 bp, Homo sapiens
cttccttaattcactccca

SEQ ID NO: 987796 - DNA, 15 bp, Homo sapiens
cttccttcaggactc

SEQ ID NO: 987797 - DNA, 18 bp, Homo sapiens
cttccttcaggactctgc

SEQ ID NO: 987798 - DNA, 13 bp, Homo sapiens
cttccttcagggt

SEQ ID NO: 987799 - DNA, 18 bp, Homo sapiens
cttccttcagggtttaat

SEQ ID NO: 987800 - DNA, 14 bp, Homo sapiens
cttccttcctgctt

SEQ ID NO: 987801 - DNA, 15 bp, Homo sapiens
cttccttctacccca

SEQ ID NO: 987802 - DNA, 22 bp, Homo sapiens
cttccttgacctgcattgtaaa

SEQ ID NO: 987803 - DNA, 15 bp, Homo sapiens
cttccttgactgtct

SEQ ID NO: 987804 - DNA, 20 bp, Homo sapiens
cttccttgagacacggagcc

SEQ ID NO: 987805 - DNA, 15 bp, Homo sapiens
cttccttgctctccc

SEQ ID NO: 987806 - DNA, 19 bp, Homo sapiens
cttccttgggcgtctcccc

SEQ ID NO: 987807 - DNA, 16 bp, Homo sapiens
cttcctttactttccc

SEQ ID NO: 987808 - DNA, 22 bp, Homo sapiens
cttcctttactttcccttgctt

SEQ ID NO: 987809 - DNA, 23 bp, Homo sapiens
cttcctttactttcccttgcttt

SEQ ID NO: 987810 - DNA, 18 bp, Homo sapiens
cttcctttaggtctggtt

SEQ ID NO: 987811 - DNA, 18 bp, Homo sapiens
cttcctttccctggagct

SEQ ID NO: 987812 - DNA, 17 bp, Homo sapiens
cttcctttcctactgtc

SEQ ID NO: 987813 - DNA, 20 bp, Homo sapiens
cttcctttcctactgtcctg

SEQ ID NO: 987814 - DNA, 16 bp, Homo sapiens
cttcctttctccagga

SEQ ID NO: 987815 - DNA, 17 bp, Homo sapiens
cttcctttctccaggac

SEQ ID NO: 987816 - DNA, 13 bp, Homo sapiens
cttcctttctctc

SEQ ID NO: 987817 - DNA, 14 bp, Homo sapiens
cttcctttctctcc

SEQ ID NO: 987818 - DNA, 15 bp, Homo sapiens
cttcctttctctcct

SEQ ID NO: 987819 - DNA, 17 bp, Homo sapiens
cttcctttctctcctgg

SEQ ID NO: 987820 - DNA, 21 bp, Homo sapiens
cttcctttggggaagtttatt

SEQ ID NO: 987821 - DNA, 17 bp, Homo sapiens
cttccttttatcagtag

SEQ ID NO: 987822 - DNA, 19 bp, Homo sapiens
cttccttttccctgcttcc

SEQ ID NO: 987823 - DNA, 22 bp, Homo sapiens
cttccttttccctgcttccagg

SEQ ID NO: 987824 - DNA, 17 bp, Homo sapiens
cttcgaaaggccttcag

SEQ ID NO: 987825 - DNA, 18 bp, Homo sapiens
cttcgacatgctgccagg

SEQ ID NO: 987826 - DNA, 19 bp, Homo sapiens
cttcgacatgctgccagga

SEQ ID NO: 987827 - DNA, 14 bp, Homo sapiens
cttcgactcaggat

SEQ ID NO: 987828 - DNA, 15 bp, Homo sapiens
cttcgactcaggatc

SEQ ID NO: 987829 - DNA, 16 bp, Homo sapiens
cttcgactcaggatcc

SEQ ID NO: 987830 - DNA, 16 bp, Homo sapiens
cttcgatacaccgggc

SEQ ID NO: 987831 - DNA, 16 bp, Homo sapiens
cttcgcaccttgctgt

SEQ ID NO: 987832 - DNA, 13 bp, Homo sapiens
cttcgctagaaaa

SEQ ID NO: 987833 - DNA, 15 bp, Homo sapiens
cttcgctcctcctct

SEQ ID NO: 987834 - DNA, 13 bp, Homo sapiens
cttcgctgaaatt

SEQ ID NO: 987835 - DNA, 13 bp, Homo sapiens
cttcgctgctcta

SEQ ID NO: 987836 - DNA, 15 bp, Homo sapiens
cttcgctgctctagc

SEQ ID NO: 987837 - DNA, 20 bp, Homo sapiens
cttcgcttcttgcctctgtg

SEQ ID NO: 987838 - DNA, 21 bp, Homo sapiens
cttcgcttcttgcctctgtgc

SEQ ID NO: 987839 - DNA, 15 bp, Homo sapiens
cttcggacaaaatat

SEQ ID NO: 987840 - DNA, 21 bp, Homo sapiens
cttcggaccgcttgtggggac

SEQ ID NO: 987841 - DNA, 15 bp, Homo sapiens
cttcggagggccgca

SEQ ID NO: 987842 - DNA, 19 bp, Homo sapiens
cttcggagggccgcagggc

SEQ ID NO: 987843 - DNA, 21 bp, Homo sapiens
cttcggagggccgcagggccc

SEQ ID NO: 987844 - DNA, 20 bp, Homo sapiens
cttcgggaggtcgaggcagg

SEQ ID NO: 987845 - DNA, 16 bp, Homo sapiens
cttcgggctgtgcccg

SEQ ID NO: 987846 - DNA, 17 bp, Homo sapiens
cttcggggccggtgagg

SEQ ID NO: 987847 - DNA, 20 bp, Homo sapiens
cttcgtacatagtctgttcc

SEQ ID NO: 987848 - DNA, 17 bp, Homo sapiens
gtggccttccccagcat

SEQ ID NO: 987849 - DNA, 21 bp, Homo sapiens
gtggccttccccagcatgcac

SEQ ID NO: 987850 - DNA, 22 bp, Homo sapiens
gtggccttccccttttgcctgg

SEQ ID NO: 987851 - DNA, 20 bp, Homo sapiens
gtggcgactctatagactct

SEQ ID NO: 987852 - DNA, 17 bp, Homo sapiens
gtggcgccgtctccagg

SEQ ID NO: 987853 - DNA, 21 bp, Homo sapiens
gtggcgctttctcctgtgccc

SEQ ID NO: 987854 - DNA, 22 bp, Homo sapiens
gtggcgctttctcctgtgccca

SEQ ID NO: 987855 - DNA, 14 bp, Homo sapiens
gtggcggggtgggg

SEQ ID NO: 987856 - DNA, 13 bp, Homo sapiens
gtggcggtgcctg

SEQ ID NO: 987857 - DNA, 14 bp, Homo sapiens
gtggcgtctccctc

SEQ ID NO: 987858 - DNA, 16 bp, Homo sapiens
gtggcgtctccctcgc

SEQ ID NO: 987859 - DNA, 16 bp, Homo sapiens
gtggcgtgagctgccc

SEQ ID NO: 987860 - DNA, 13 bp, Homo sapiens
gtggcgtggcctc

SEQ ID NO: 987861 - DNA, 16 bp, Homo sapiens
gtggcgttatggcagc

SEQ ID NO: 987862 - DNA, 14 bp, Homo sapiens
gtggctactgacat

SEQ ID NO: 987863 - DNA, 20 bp, Homo sapiens
gtggctcacgtgtgtgactc

SEQ ID NO: 987864 - DNA, 14 bp, Homo sapiens
gtggctcactactg

SEQ ID NO: 987865 - DNA, 15 bp, Homo sapiens
gtggctcactactga

SEQ ID NO: 987866 - DNA, 15 bp, Homo sapiens
gtggctcactggctg

SEQ ID NO: 987867 - DNA, 18 bp, Homo sapiens
gtggctcactggctggga

SEQ ID NO: 987868 - DNA, 18 bp, Homo sapiens
gtggctcaggggagcaag

SEQ ID NO: 987869 - DNA, 22 bp, Homo sapiens
gtggctcatggcgtaatgggcc

SEQ ID NO: 987870 - DNA, 23 bp, Homo sapiens
gtggctccccacctggacacaca

SEQ ID NO: 987871 - DNA, 14 bp, Homo sapiens
gtggctccccctct

SEQ ID NO: 987872 - DNA, 15 bp, Homo sapiens
gtggctccccctctg

SEQ ID NO: 987873 - DNA, 12 bp, Homo sapiens
gtggctcccctc

SEQ ID NO: 987874 - DNA, 14 bp, Homo sapiens
gtggctcccctcta

SEQ ID NO: 987875 - DNA, 22 bp, Homo sapiens
gtggctcccctctatttagcat

SEQ ID NO: 987876 - DNA, 20 bp, Homo sapiens
gtggctcctcccggtgccca

SEQ ID NO: 987877 - DNA, 20 bp, Homo sapiens
gtggctcctcctaggaaacc

SEQ ID NO: 987878 - DNA, 15 bp, Homo sapiens
gtggctctgggagag

SEQ ID NO: 987879 - DNA, 20 bp, Homo sapiens
gtggctctgggatcctgggg

SEQ ID NO: 987880 - DNA, 13 bp, Homo sapiens
gtggctctggggt

SEQ ID NO: 987881 - DNA, 21 bp, Homo sapiens
cttctaggggtagctggtggt

SEQ ID NO: 987882 - DNA, 20 bp, Homo sapiens
cttctagtgcttttcagtga

SEQ ID NO: 987883 - DNA, 23 bp, Homo sapiens
cttctagtttcacgtaaatattc

SEQ ID NO: 987884 - DNA, 14 bp, Homo sapiens
cttctagtttccca

SEQ ID NO: 987885 - DNA, 20 bp, Homo sapiens
cttctataattttgccttta

SEQ ID NO: 987886 - DNA, 16 bp, Homo sapiens
cttctatcattccaat

SEQ ID NO: 987887 - DNA, 15 bp, Homo sapiens
cttctatcctttctt

SEQ ID NO: 987888 - DNA, 13 bp, Homo sapiens
cttctatgtatta

SEQ ID NO: 987889 - DNA, 13 bp, Homo sapiens
cttctatgttggt

SEQ ID NO: 987890 - DNA, 16 bp, Homo sapiens
cttctatgttggtttc

SEQ ID NO: 987891 - DNA, 22 bp, Homo sapiens
cttctatgttggtttcagtggc

SEQ ID NO: 987892 - DNA, 23 bp, Homo sapiens
cttctattaatcaagagaaactt

SEQ ID NO: 987893 - DNA, 15 bp, Homo sapiens
cttctattttcccta

SEQ ID NO: 987894 - DNA, 14 bp, Homo sapiens
cttctattttgtaa

SEQ ID NO: 987895 - DNA, 15 bp, Homo sapiens
cttctattttgtaaa

SEQ ID NO: 987896 - DNA, 17 bp, Homo sapiens
cttctattttgtaaact

SEQ ID NO: 987897 - DNA, 20 bp, Homo sapiens
cttctatttttatcatgaat

SEQ ID NO: 987898 - DNA, 21 bp, Homo sapiens
cttctcaactccagagcccct

SEQ ID NO: 987899 - DNA, 15 bp, Homo sapiens
cttctcactgccatg

SEQ ID NO: 987900 - DNA, 19 bp, Homo sapiens
cttctcacttcaattaatg

SEQ ID NO: 987901 - DNA, 14 bp, Homo sapiens
cttctcagaagcac

SEQ ID NO: 987902 - DNA, 17 bp, Homo sapiens
cttctcagaagcacaga

SEQ ID NO: 987903 - DNA, 18 bp, Homo sapiens
cttctcagaatctaccca

SEQ ID NO: 987904 - DNA, 16 bp, Homo sapiens
cttctcagagtggtgg

SEQ ID NO: 987905 - DNA, 16 bp, Homo sapiens
cttctcagctcttcca

SEQ ID NO: 987906 - DNA, 13 bp, Homo sapiens
cttctcatagcat

SEQ ID NO: 987907 - DNA, 18 bp, Homo sapiens
cttctcatcgaagggatt

SEQ ID NO: 987908 - DNA, 17 bp, Homo sapiens
cttctcatcttttatct

SEQ ID NO: 987909 - DNA, 21 bp, Homo sapiens
cttctcattccaacagtgagt

SEQ ID NO: 987910 - DNA, 15 bp, Homo sapiens
cttctccaacactga

SEQ ID NO: 987911 - DNA, 22 bp, Homo sapiens
cttctccaagaatggaagcctg

SEQ ID NO: 987912 - DNA, 16 bp, Homo sapiens
cttctccaatgctctg

SEQ ID NO: 987913 - DNA, 19 bp, Homo sapiens
cttctccaattctgcccaa

SEQ ID NO: 987914 - DNA, 17 bp, Homo sapiens
cttctccaccgcacaga

SEQ ID NO: 987915 - DNA, 14 bp, Homo sapiens
cttctccatctggc

SEQ ID NO: 987916 - DNA, 17 bp, Homo sapiens
cttctccatctggcagg

SEQ ID NO: 987917 - DNA, 14 bp, Homo sapiens
cttctccatgctgc

SEQ ID NO: 987918 - DNA, 13 bp, Homo sapiens
cttctcccacact

SEQ ID NO: 987919 - DNA, 17 bp, Homo sapiens
cttctcccacatgaggc

SEQ ID NO: 987920 - DNA, 20 bp, Homo sapiens
cttctcccaccccttggccc

SEQ ID NO: 987921 - DNA, 16 bp, Homo sapiens
cttctcccagaatccc

SEQ ID NO: 987922 - DNA, 20 bp, Homo sapiens
cttctcccagaatcccagcc

SEQ ID NO: 987923 - DNA, 23 bp, Homo sapiens
cttctcccagaatcccagccggc

SEQ ID NO: 987924 - DNA, 13 bp, Homo sapiens
cttctcccagcac

SEQ ID NO: 987925 - DNA, 18 bp, Homo sapiens
cttctcccatttcctgat

SEQ ID NO: 987926 - DNA, 21 bp, Homo sapiens
cttctcccatttcctgatcta

SEQ ID NO: 987927 - DNA, 22 bp, Homo sapiens
cttctcccatttcctgatctag

SEQ ID NO: 987928 - DNA, 21 bp, Homo sapiens
cttctcccccacggtatccta

SEQ ID NO: 987929 - DNA, 21 bp, Homo sapiens
cttctccccccatcccagggt

SEQ ID NO: 987930 - DNA, 19 bp, Homo sapiens
cttctcccccttgtcttcc

SEQ ID NO: 987931 - DNA, 19 bp, Homo sapiens
cttctccccgcagcccgcc

SEQ ID NO: 987932 - DNA, 15 bp, Homo sapiens
cttctcccctgccct

SEQ ID NO: 987933 - DNA, 14 bp, Homo sapiens
cttctccccttcct

SEQ ID NO: 987934 - DNA, 16 bp, Homo sapiens
cttctccccttcctgg

SEQ ID NO: 987935 - DNA, 19 bp, Homo sapiens
cttctccccttcctggaca

SEQ ID NO: 987936 - DNA, 12 bp, Homo sapiens
cttctccctgga

SEQ ID NO: 987937 - DNA, 15 bp, Homo sapiens
cttctccgccagcct

SEQ ID NO: 987938 - DNA, 18 bp, Homo sapiens
cttctccgccagcctcct

SEQ ID NO: 987939 - DNA, 14 bp, Homo sapiens
cttctcctatgtgt

SEQ ID NO: 987940 - DNA, 19 bp, Homo sapiens
cttctcctcctctgtcttt

SEQ ID NO: 987941 - DNA, 14 bp, Homo sapiens
cttctcctctctgg

SEQ ID NO: 987942 - DNA, 16 bp, Homo sapiens
cttctcctctctgggc

SEQ ID NO: 987943 - DNA, 18 bp, Homo sapiens
cttctcctctctgggcct

SEQ ID NO: 987944 - DNA, 14 bp, Homo sapiens
cttctcctcttgta

SEQ ID NO: 987945 - DNA, 17 bp, Homo sapiens
cttctcctcttgtaaat

SEQ ID NO: 987946 - DNA, 19 bp, Homo sapiens
cttctccttagacactttg

SEQ ID NO: 987947 - DNA, 20 bp, Homo sapiens
cttctccttgccttgcttct

SEQ ID NO: 987948 - DNA, 15 bp, Homo sapiens
cttctcggccagccc

SEQ ID NO: 987949 - DNA, 19 bp, Homo sapiens
cttctcggggtccagtgca

SEQ ID NO: 987950 - DNA, 20 bp, Homo sapiens
cttctcggggtccagtgcat

SEQ ID NO: 987951 - DNA, 22 bp, Homo sapiens
cttctcgtgtttgcttaaaata

SEQ ID NO: 987952 - DNA, 11 bp, Homo sapiens
cttctctacag

SEQ ID NO: 987953 - DNA, 15 bp, Homo sapiens
cttctctacagactt

SEQ ID NO: 987954 - DNA, 12 bp, Homo sapiens
cttctctataaa

SEQ ID NO: 987955 - DNA, 14 bp, Homo sapiens
cttctctcacttct

SEQ ID NO: 987956 - DNA, 16 bp, Homo sapiens
cttctctcacttctaa

SEQ ID NO: 987957 - DNA, 14 bp, Homo sapiens
cttctctcagatgg

SEQ ID NO: 987958 - DNA, 22 bp, Homo sapiens
cttctctcagccagctgtttaa

SEQ ID NO: 987959 - DNA, 15 bp, Homo sapiens
cttctctccacttct

SEQ ID NO: 987960 - DNA, 16 bp, Homo sapiens
cttctctccagctgac

SEQ ID NO: 987961 - DNA, 17 bp, Homo sapiens
cttctctccagctgact

SEQ ID NO: 987962 - DNA, 15 bp, Homo sapiens
cttctctcctcagac

SEQ ID NO: 987963 - DNA, 13 bp, Homo sapiens
cttctctccttgc

SEQ ID NO: 987964 - DNA, 15 bp, Homo sapiens
cttctctccttgccc

SEQ ID NO: 987965 - DNA, 19 bp, Homo sapiens
cttctctcctttctccctg

SEQ ID NO: 987966 - DNA, 15 bp, Homo sapiens
cttctctctccctgt

SEQ ID NO: 987967 - DNA, 16 bp, Homo sapiens
cttctctctgtgggat

SEQ ID NO: 987968 - DNA, 17 bp, Homo sapiens
cttctctctgttccctt

SEQ ID NO: 987969 - DNA, 13 bp, Homo sapiens
cttctctgaatca

SEQ ID NO: 987970 - DNA, 12 bp, Homo sapiens
cttctctgactt

SEQ ID NO: 987971 - DNA, 15 bp, Homo sapiens
cttctctgacttctg

SEQ ID NO: 987972 - DNA, 20 bp, Homo sapiens
cttctctgcctccctaagtt

SEQ ID NO: 987973 - DNA, 11 bp, Homo sapiens
cttctctgctc

SEQ ID NO: 987974 - DNA, 22 bp, Homo sapiens
cttctctgctccaccacatcct

SEQ ID NO: 987975 - DNA, 12 bp, Homo sapiens
cttctctgctgc

SEQ ID NO: 987976 - DNA, 16 bp, Homo sapiens
cttctctgctgcctct

SEQ ID NO: 987977 - DNA, 19 bp, Homo sapiens
cttctctggaaagggggga

SEQ ID NO: 987978 - DNA, 21 bp, Homo sapiens
cttctctgggtctgattttct

SEQ ID NO: 987979 - DNA, 11 bp, Homo sapiens
cttctctgtaa

SEQ ID NO: 987980 - DNA, 13 bp, Homo sapiens
cttctctgtaagt

SEQ ID NO: 987981 - DNA, 22 bp, Homo sapiens
cttctctgtaagtaattgccac

SEQ ID NO: 987982 - DNA, 12 bp, Homo sapiens
cttctctgtctc

SEQ ID NO: 987983 - DNA, 13 bp, Homo sapiens
cttctctgtctct

SEQ ID NO: 987984 - DNA, 14 bp, Homo sapiens
cttctctgtctctg

SEQ ID NO: 987985 - DNA, 22 bp, Homo sapiens
cttctctgtgaacgatttagaa

SEQ ID NO: 987986 - DNA, 21 bp, Homo sapiens
cttctctgttcccttgcaggg

SEQ ID NO: 987987 - DNA, 20 bp, Homo sapiens
cttctcttgaaaagttcagg

SEQ ID NO: 987988 - DNA, 17 bp, Homo sapiens
cttctcttgctttctat

SEQ ID NO: 987989 - DNA, 20 bp, Homo sapiens
cttctcttgggaactccact

SEQ ID NO: 987990 - DNA, 20 bp, Homo sapiens
cttctgaaaacccaaggcca

SEQ ID NO: 987991 - DNA, 12 bp, Homo sapiens
cttctgaagact

SEQ ID NO: 987992 - DNA, 20 bp, Homo sapiens
cttctgaagactgagaactt

SEQ ID NO: 987993 - DNA, 16 bp, Homo sapiens
cttctgaagtgtgtcc

SEQ ID NO: 987994 - DNA, 14 bp, Homo sapiens
cttctgaatatttt

SEQ ID NO: 987995 - DNA, 11 bp, Homo sapiens
cttctgaatca

SEQ ID NO: 987996 - DNA, 15 bp, Homo sapiens
cttctgaatcactgt

SEQ ID NO: 987997 - DNA, 15 bp, Homo sapiens
cttctgaccacactt

SEQ ID NO: 987998 - DNA, 18 bp, Homo sapiens
cttctgaccacagcatca

SEQ ID NO: 987999 - DNA, 14 bp, Homo sapiens
cttctgaccccact

SEQ ID NO: 988000 - DNA, 21 bp, Homo sapiens
cttctgactgctgattctccc

SEQ ID NO: 988001 - DNA, 15 bp, Homo sapiens
cttctgagcactgtt

SEQ ID NO: 988002 - DNA, 23 bp, Homo sapiens
cttctgagcactgtttatacact

SEQ ID NO: 988003 - DNA, 18 bp, Homo sapiens
cttctgagctatttcatc

SEQ ID NO: 988004 - DNA, 20 bp, Homo sapiens
cttctgagctatttcatcta

SEQ ID NO: 988005 - DNA, 21 bp, Homo sapiens
cttctgagctccacctctggt

SEQ ID NO: 988006 - DNA, 20 bp, Homo sapiens
cttctgagtaattaataaag

SEQ ID NO: 988007 - DNA, 17 bp, Homo sapiens
gtggctctgggtgaggt

SEQ ID NO: 988008 - DNA, 14 bp, Homo sapiens
gtggctgccagccc

SEQ ID NO: 988009 - DNA, 18 bp, Homo sapiens
gtggctgccagcccactg

SEQ ID NO: 988010 - DNA, 19 bp, Homo sapiens
gtggctgccagcccactgc

SEQ ID NO: 988011 - DNA, 13 bp, Homo sapiens
gtggctgccccgg

SEQ ID NO: 988012 - DNA, 18 bp, Homo sapiens
gtggctgcgcccccagct

SEQ ID NO: 988013 - DNA, 17 bp, Homo sapiens
gtggctgctagcacttg

SEQ ID NO: 988014 - DNA, 20 bp, Homo sapiens
gtggctggaagatcctgcgg

SEQ ID NO: 988015 - DNA, 18 bp, Homo sapiens
gtggctggtgagaccccg

SEQ ID NO: 988016 - DNA, 15 bp, Homo sapiens
gtggctggtgtcccc

SEQ ID NO: 988017 - DNA, 19 bp, Homo sapiens
gtggctggtgtccccttcc

SEQ ID NO: 988018 - DNA, 12 bp, Homo sapiens
gtggctgtggca

SEQ ID NO: 988019 - DNA, 16 bp, Homo sapiens
gtggctgtggcacaga

SEQ ID NO: 988020 - DNA, 12 bp, Homo sapiens
gtggctgtgtct

SEQ ID NO: 988021 - DNA, 11 bp, Homo sapiens
gtggctgttca

SEQ ID NO: 988022 - DNA, 13 bp, Homo sapiens
gtggctgtttctt

SEQ ID NO: 988023 - DNA, 19 bp, Homo sapiens
gtggcttaagtgagcagaa

SEQ ID NO: 988024 - DNA, 20 bp, Homo sapiens
gtggcttaagtgagcagaac

SEQ ID NO: 988025 - DNA, 22 bp, Homo sapiens
gtggcttaagtgagcagaacag

SEQ ID NO: 988026 - DNA, 20 bp, Homo sapiens
gtggcttcccgctcagccct

SEQ ID NO: 988027 - DNA, 22 bp, Homo sapiens
gtggcttctctgtctctgtgga

SEQ ID NO: 988028 - DNA, 19 bp, Homo sapiens
gtggcttggcatctgtgtg

SEQ ID NO: 988029 - DNA, 21 bp, Homo sapiens
gtggcttgggacatggcacag

SEQ ID NO: 988030 - DNA, 15 bp, Homo sapiens
gtggctttaattgta

SEQ ID NO: 988031 - DNA, 18 bp, Homo sapiens
gtggctttaattgtataa

SEQ ID NO: 988032 - DNA, 19 bp, Homo sapiens
gtggctttaattgtataag

SEQ ID NO: 988033 - DNA, 19 bp, Homo sapiens
gtggctttaggagcagtgg

SEQ ID NO: 988034 - DNA, 18 bp, Homo sapiens
gtggctttcaaggctggg

SEQ ID NO: 988035 - DNA, 22 bp, Homo sapiens
gtggctttccaggcaccctcag

SEQ ID NO: 988036 - DNA, 19 bp, Homo sapiens
gtggctttggcagtgtttt

SEQ ID NO: 988037 - DNA, 22 bp, Homo sapiens
gtgggaagaccaaaggaaggaa

SEQ ID NO: 988038 - DNA, 15 bp, Homo sapiens
gtgggaaggacttgg

SEQ ID NO: 988039 - DNA, 15 bp, Homo sapiens
gtgggacagagtctg

SEQ ID NO: 988040 - DNA, 13 bp, Homo sapiens
gtgggacagccca

SEQ ID NO: 988041 - DNA, 14 bp, Homo sapiens
gtgggacagggagg

SEQ ID NO: 988042 - DNA, 22 bp, Homo sapiens
gtgggacccatagatcttctga

SEQ ID NO: 988043 - DNA, 16 bp, Homo sapiens
gtgggaccgcctggcc

SEQ ID NO: 988044 - DNA, 17 bp, Homo sapiens
gtgggaccgcctggccc

SEQ ID NO: 988045 - DNA, 19 bp, Homo sapiens
gtgggacggtgcccaagcc

SEQ ID NO: 988046 - DNA, 14 bp, Homo sapiens
gtgggagaggctgg

SEQ ID NO: 988047 - DNA, 18 bp, Homo sapiens
gtgggagaggctgggagg

SEQ ID NO: 988048 - DNA, 14 bp, Homo sapiens
gtgggagcagcttc

SEQ ID NO: 988049 - DNA, 18 bp, Homo sapiens
gtgggagcagcttcttgg

SEQ ID NO: 988050 - DNA, 14 bp, Homo sapiens
gtgggagctgagct

SEQ ID NO: 988051 - DNA, 17 bp, Homo sapiens
gtgggagctgagctgga

SEQ ID NO: 988052 - DNA, 15 bp, Homo sapiens
gtgggaggcgtgccc

SEQ ID NO: 988053 - DNA, 21 bp, Homo sapiens
gtgggagggcgtcaggcagag

SEQ ID NO: 988054 - DNA, 15 bp, Homo sapiens
gtgggaggggcaggc

SEQ ID NO: 988055 - DNA, 15 bp, Homo sapiens
gtgggagggtaccag

SEQ ID NO: 988056 - DNA, 16 bp, Homo sapiens
gtgggaggtcttgcta

SEQ ID NO: 988057 - DNA, 19 bp, Homo sapiens
gtgggagtaacagggcaga

SEQ ID NO: 988058 - DNA, 16 bp, Homo sapiens
gtgggagtgtgtctgc

SEQ ID NO: 988059 - DNA, 22 bp, Homo sapiens
gtgggatcattgcatttccaga

SEQ ID NO: 988060 - DNA, 18 bp, Homo sapiens
gtgggatccacttcttgg

SEQ ID NO: 988061 - DNA, 17 bp, Homo sapiens
gtgggattttttccctt

SEQ ID NO: 988062 - DNA, 18 bp, Homo sapiens
gtgggattttttcccttt

SEQ ID NO: 988063 - DNA, 17 bp, Homo sapiens
gtgggcaaacaggcagt

SEQ ID NO: 988064 - DNA, 16 bp, Homo sapiens
gtgggcaaaggcaggg

SEQ ID NO: 988065 - DNA, 18 bp, Homo sapiens
gtgggcaaaggcagggcc

SEQ ID NO: 988066 - DNA, 16 bp, Homo sapiens
gtgggcactggcccag

SEQ ID NO: 988067 - DNA, 15 bp, Homo sapiens
gtgggcactggtggg

SEQ ID NO: 988068 - DNA, 14 bp, Homo sapiens
gtgggcagcaccct

SEQ ID NO: 988069 - DNA, 15 bp, Homo sapiens
gtgggcagcaccctc

SEQ ID NO: 988070 - DNA, 17 bp, Homo sapiens
gtgggcagcaccctccc

SEQ ID NO: 988071 - DNA, 23 bp, Homo sapiens
gtgggcagcctatgggggctctc

SEQ ID NO: 988072 - DNA, 15 bp, Homo sapiens
gtgggcagctgagga

SEQ ID NO: 988073 - DNA, 23 bp, Homo sapiens
gtgggcagcttagggccctggag

SEQ ID NO: 988074 - DNA, 20 bp, Homo sapiens
gtgggcaggatctcaagcca

SEQ ID NO: 988075 - DNA, 19 bp, Homo sapiens
gtgggcagggaggggctgg

SEQ ID NO: 988076 - DNA, 12 bp, Homo sapiens
gtgggcaggtgg

SEQ ID NO: 988077 - DNA, 14 bp, Homo sapiens
gtgggcagtcacca

SEQ ID NO: 988078 - DNA, 21 bp, Homo sapiens
gtgggcagtcaccacccagcc

SEQ ID NO: 988079 - DNA, 22 bp, Homo sapiens
gtgggcagtcaccacccagccc

SEQ ID NO: 988080 - DNA, 19 bp, Homo sapiens
gtgggcagtgccacccgca

SEQ ID NO: 988081 - DNA, 21 bp, Homo sapiens
gtgggccacacccaggaaggg

SEQ ID NO: 988082 - DNA, 15 bp, Homo sapiens
gtgggccagcccctc

SEQ ID NO: 988083 - DNA, 19 bp, Homo sapiens
gtgggccagggctgccctg

SEQ ID NO: 988084 - DNA, 22 bp, Homo sapiens
gtgggcccagaactgcccccac

SEQ ID NO: 988085 - DNA, 20 bp, Homo sapiens
gtgggcccagcacatggcca

SEQ ID NO: 988086 - DNA, 23 bp, Homo sapiens
gtgggcccaggaccagctggggc

SEQ ID NO: 988087 - DNA, 16 bp, Homo sapiens
gtgggccgggaggcag

SEQ ID NO: 988088 - DNA, 23 bp, Homo sapiens
gtgggcctcctctgtccagggcc

SEQ ID NO: 988089 - DNA, 15 bp, Homo sapiens
gtgggcctgctgagg

SEQ ID NO: 988090 - DNA, 20 bp, Homo sapiens
gtgggcctgctgaggccttc

SEQ ID NO: 988091 - DNA, 14 bp, Homo sapiens
gtgggcctggcctg

SEQ ID NO: 988092 - DNA, 17 bp, Homo sapiens
gtgggcctggcctgagc

SEQ ID NO: 988093 - DNA, 20 bp, Homo sapiens
gtgggcctggcctgagctgg

SEQ ID NO: 988094 - DNA, 16 bp, Homo sapiens
gtgggccttttgctca

SEQ ID NO: 988095 - DNA, 14 bp, Homo sapiens
gtgggcgcaaaggt

SEQ ID NO: 988096 - DNA, 22 bp, Homo sapiens
gtgggcgcaaaggtgcctcata

SEQ ID NO: 988097 - DNA, 20 bp, Homo sapiens
gtgggcggatcacaaggtca

SEQ ID NO: 988098 - DNA, 20 bp, Homo sapiens
gtgggcgttgggagcctagc

SEQ ID NO: 988099 - DNA, 24 bp, Homo sapiens
gtgggcgtttggggccctctatgc

SEQ ID NO: 988100 - DNA, 19 bp, Homo sapiens
gtgggctcccctcttcctc

SEQ ID NO: 988101 - DNA, 13 bp, Homo sapiens
gtgggctccctga

SEQ ID NO: 988102 - DNA, 15 bp, Homo sapiens
gtgggctccctgact

SEQ ID NO: 988103 - DNA, 14 bp, Homo sapiens
gtgggctgagccct

SEQ ID NO: 988104 - DNA, 20 bp, Homo sapiens
gtgggctgggccctctcttc

SEQ ID NO: 988105 - DNA, 13 bp, Homo sapiens
gtgggctggggac

SEQ ID NO: 988106 - DNA, 20 bp, Homo sapiens
gtgggctggggactctggca

SEQ ID NO: 988107 - DNA, 22 bp, Homo sapiens
gtgggctggggactctggcaca

SEQ ID NO: 988108 - DNA, 15 bp, Homo sapiens
gtgggcttcagcact

SEQ ID NO: 988109 - DNA, 20 bp, Homo sapiens
gtgggcttcctgctgggact

SEQ ID NO: 988110 - DNA, 21 bp, Homo sapiens
gtgggcttcctgctgggactg

SEQ ID NO: 988111 - DNA, 16 bp, Homo sapiens
gtgggcttctgcgtcc

SEQ ID NO: 988112 - DNA, 18 bp, Homo sapiens
gtgggctttaaaagaaaa

SEQ ID NO: 988113 - DNA, 17 bp, Homo sapiens
gtggggaaggagggact

SEQ ID NO: 988114 - DNA, 18 bp, Homo sapiens
gtggggacacagcagtga

SEQ ID NO: 988115 - DNA, 19 bp, Homo sapiens
gtggggacacagcagtgag

SEQ ID NO: 988116 - DNA, 15 bp, Homo sapiens
gtggggacagggagg

SEQ ID NO: 988117 - DNA, 16 bp, Homo sapiens
gtggggacccaggctc

SEQ ID NO: 988118 - DNA, 18 bp, Homo sapiens
gtggggaccttggcagtg

SEQ ID NO: 988119 - DNA, 22 bp, Homo sapiens
gtggggagcacttgcgtcctgc

SEQ ID NO: 988120 - DNA, 21 bp, Homo sapiens
gtggggagcagttttcccctg

SEQ ID NO: 988121 - DNA, 16 bp, Homo sapiens
gtggggaggaaataga

SEQ ID NO: 988122 - DNA, 14 bp, Homo sapiens
gtggggaggaggaa

SEQ ID NO: 988123 - DNA, 17 bp, Homo sapiens
gtggggaggccctgcct

SEQ ID NO: 988124 - DNA, 13 bp, Homo sapiens
gtggggaggggcg

SEQ ID NO: 988125 - DNA, 18 bp, Homo sapiens
gtggggatctcaggggct

SEQ ID NO: 988126 - DNA, 19 bp, Homo sapiens
gtggggatctcaggggctg

SEQ ID NO: 988127 - DNA, 17 bp, Homo sapiens
gtggggatttctcccag

SEQ ID NO: 988128 - DNA, 21 bp, Homo sapiens
gtggggcaggagtgccaggac

SEQ ID NO: 988129 - DNA, 23 bp, Homo sapiens
gtggggcaggagtgccaggacca

SEQ ID NO: 988130 - DNA, 22 bp, Homo sapiens
gtggggccatgcctcctcagga

SEQ ID NO: 988131 - DNA, 14 bp, Homo sapiens
cttctgagtattct

SEQ ID NO: 988132 - DNA, 22 bp, Homo sapiens
cttctgcaaaaatggatattat

SEQ ID NO: 988133 - DNA, 12 bp, Homo sapiens
cttctgcaccct

SEQ ID NO: 988134 - DNA, 14 bp, Homo sapiens
cttctgcaccctcc

SEQ ID NO: 988135 - DNA, 15 bp, Homo sapiens
cttctgcaccctcca

SEQ ID NO: 988136 - DNA, 16 bp, Homo sapiens
cttctgcaccctccac

SEQ ID NO: 988137 - DNA, 16 bp, Homo sapiens
cttctgcagcctcggc

SEQ ID NO: 988138 - DNA, 12 bp, Homo sapiens
cttctgcctgca

SEQ ID NO: 988139 - DNA, 13 bp, Homo sapiens
cttctgcctggag

SEQ ID NO: 988140 - DNA, 18 bp, Homo sapiens
cttctgccttagtctcag

SEQ ID NO: 988141 - DNA, 19 bp, Homo sapiens
cttctgccttagtctcagt

SEQ ID NO: 988142 - DNA, 20 bp, Homo sapiens
cttctgccttagtctcagtt

SEQ ID NO: 988143 - DNA, 21 bp, Homo sapiens
cttctgccttagtctcagttt

SEQ ID NO: 988144 - DNA, 16 bp, Homo sapiens
cttctgccttctcatg

SEQ ID NO: 988145 - DNA, 14 bp, Homo sapiens
cttctgccttggcc

SEQ ID NO: 988146 - DNA, 13 bp, Homo sapiens
cttctgcgggctc

SEQ ID NO: 988147 - DNA, 18 bp, Homo sapiens
cttctgcgggctccctcc

SEQ ID NO: 988148 - DNA, 21 bp, Homo sapiens
cttctgcgggctccctcctct

SEQ ID NO: 988149 - DNA, 23 bp, Homo sapiens
cttctgcgggctccctcctctgg

SEQ ID NO: 988150 - DNA, 17 bp, Homo sapiens
cttctgcgtccaccagg

SEQ ID NO: 988151 - DNA, 13 bp, Homo sapiens
cttctgctccacc

SEQ ID NO: 988152 - DNA, 15 bp, Homo sapiens
cttctgctccaccct

SEQ ID NO: 988153 - DNA, 19 bp, Homo sapiens
cttctgctccacccttggc

SEQ ID NO: 988154 - DNA, 12 bp, Homo sapiens
cttctgctccag

SEQ ID NO: 988155 - DNA, 15 bp, Homo sapiens
cttctgctccagccc

SEQ ID NO: 988156 - DNA, 22 bp, Homo sapiens
cttctgctggaggaggggaagc

SEQ ID NO: 988157 - DNA, 17 bp, Homo sapiens
cttctgctggataaaat

SEQ ID NO: 988158 - DNA, 21 bp, Homo sapiens
cttctgctgttcttcacttct

SEQ ID NO: 988159 - DNA, 15 bp, Homo sapiens
cttctgcttaggaga

SEQ ID NO: 988160 - DNA, 16 bp, Homo sapiens
cttctgcttaggagag

SEQ ID NO: 988161 - DNA, 21 bp, Homo sapiens
cttctgcttttctgccctggc

SEQ ID NO: 988162 - DNA, 23 bp, Homo sapiens
cttctgcttttctgccctggctg

SEQ ID NO: 988163 - DNA, 15 bp, Homo sapiens
cttctggaaggctgg

SEQ ID NO: 988164 - DNA, 16 bp, Homo sapiens
cttctggaaggctggc

SEQ ID NO: 988165 - DNA, 22 bp, Homo sapiens
cttctggaaggctggctgagtg

SEQ ID NO: 988166 - DNA, 15 bp, Homo sapiens
cttctggacaggctc

SEQ ID NO: 988167 - DNA, 11 bp, Homo sapiens
cttctggagcc

SEQ ID NO: 988168 - DNA, 13 bp, Homo sapiens
cttctggagccct

SEQ ID NO: 988169 - DNA, 14 bp, Homo sapiens
cttctggagccctt

SEQ ID NO: 988170 - DNA, 18 bp, Homo sapiens
cttctggagtctccagtg

SEQ ID NO: 988171 - DNA, 20 bp, Homo sapiens
cttctggagtctccagtggt

SEQ ID NO: 988172 - DNA, 18 bp, Homo sapiens
cttctggagtttctctaa

SEQ ID NO: 988173 - DNA, 15 bp, Homo sapiens
cttctggatatagct

SEQ ID NO: 988174 - DNA, 20 bp, Homo sapiens
cttctggccacatcagcccc

SEQ ID NO: 988175 - DNA, 13 bp, Homo sapiens
cttctggcctcca

SEQ ID NO: 988176 - DNA, 14 bp, Homo sapiens
cttctggcctccag

SEQ ID NO: 988177 - DNA, 16 bp, Homo sapiens
cttctggcctcccaca

SEQ ID NO: 988178 - DNA, 19 bp, Homo sapiens
cttctggcctctgctgaat

SEQ ID NO: 988179 - DNA, 20 bp, Homo sapiens
cttctggcttccttctctca

SEQ ID NO: 988180 - DNA, 23 bp, Homo sapiens
cttctgggaaattgaagtgtctt

SEQ ID NO: 988181 - DNA, 17 bp, Homo sapiens
cttctgggacctgtgtt

SEQ ID NO: 988182 - DNA, 15 bp, Homo sapiens
cttctgggagggcag

SEQ ID NO: 988183 - DNA, 15 bp, Homo sapiens
cttctgggcaagggc

SEQ ID NO: 988184 - DNA, 18 bp, Homo sapiens
cttctgggcaagggctcc

SEQ ID NO: 988185 - DNA, 19 bp, Homo sapiens
cttctgggcaagggctcct

SEQ ID NO: 988186 - DNA, 16 bp, Homo sapiens
cttctgggcacagtgg

SEQ ID NO: 988187 - DNA, 15 bp, Homo sapiens
cttctgggcagagcc

SEQ ID NO: 988188 - DNA, 17 bp, Homo sapiens
cttctgggcagagcctg

SEQ ID NO: 988189 - DNA, 19 bp, Homo sapiens
cttctgggcagagcctgtc

SEQ ID NO: 988190 - DNA, 16 bp, Homo sapiens
cttctgggcctgacca

SEQ ID NO: 988191 - DNA, 21 bp, Homo sapiens
cttctgggcttcatctggcaa

SEQ ID NO: 988192 - DNA, 21 bp, Homo sapiens
cttctgggcttcattctggaa

SEQ ID NO: 988193 - DNA, 14 bp, Homo sapiens
cttctggggcaggc

SEQ ID NO: 988194 - DNA, 22 bp, Homo sapiens
cttctggggcaggctgggccat

SEQ ID NO: 988195 - DNA, 22 bp, Homo sapiens
cttctggggtcaggtgccactg

SEQ ID NO: 988196 - DNA, 17 bp, Homo sapiens
cttctgggttccttcct

SEQ ID NO: 988197 - DNA, 15 bp, Homo sapiens
cttctggtactctcc

SEQ ID NO: 988198 - DNA, 17 bp, Homo sapiens
cttctggtactctccta

SEQ ID NO: 988199 - DNA, 17 bp, Homo sapiens
cttctggttgcttcaga

SEQ ID NO: 988200 - DNA, 16 bp, Homo sapiens
cttctggttgtatttc

SEQ ID NO: 988201 - DNA, 18 bp, Homo sapiens
cttctggttgtatttcta

SEQ ID NO: 988202 - DNA, 16 bp, Homo sapiens
cttctggtttcttcca

SEQ ID NO: 988203 - DNA, 21 bp, Homo sapiens
cttctggttttctagcccctc

SEQ ID NO: 988204 - DNA, 14 bp, Homo sapiens
cttctgtaatcaat

SEQ ID NO: 988205 - DNA, 18 bp, Homo sapiens
cttctgtagtactcctta

SEQ ID NO: 988206 - DNA, 21 bp, Homo sapiens
cttctgtagtactccttaaga

SEQ ID NO: 988207 - DNA, 18 bp, Homo sapiens
cttctgtagtttttaatt

SEQ ID NO: 988208 - DNA, 14 bp, Homo sapiens
cttctgtatgcatc

SEQ ID NO: 988209 - DNA, 15 bp, Homo sapiens
cttctgtatttctag

SEQ ID NO: 988210 - DNA, 15 bp, Homo sapiens
cttctgtattttaat

SEQ ID NO: 988211 - DNA, 22 bp, Homo sapiens
cttctgtatttttttttctaag

SEQ ID NO: 988212 - DNA, 19 bp, Homo sapiens
cttctgtccaccagaccca

SEQ ID NO: 988213 - DNA, 15 bp, Homo sapiens
cttctgtccaggaca

SEQ ID NO: 988214 - DNA, 18 bp, Homo sapiens
cttctgtccaggacatga

SEQ ID NO: 988215 - DNA, 13 bp, Homo sapiens
cttgaaagtagga

SEQ ID NO: 988216 - DNA, 19 bp, Homo sapiens
cttgaaatatataatattc

SEQ ID NO: 988217 - DNA, 22 bp, Homo sapiens
cttgaaatatataatattcagc

SEQ ID NO: 988218 - DNA, 20 bp, Homo sapiens
cttgaaatctaatatttcta

SEQ ID NO: 988219 - DNA, 22 bp, Homo sapiens
cttgaaatgagtaaaaactaga

SEQ ID NO: 988220 - DNA, 20 bp, Homo sapiens
cttgaaattaagaaggcaaa

SEQ ID NO: 988221 - DNA, 16 bp, Homo sapiens
cttgaaattactgtgt

SEQ ID NO: 988222 - DNA, 19 bp, Homo sapiens
cttgaaattactgtgtaaa

SEQ ID NO: 988223 - DNA, 13 bp, Homo sapiens
cttgaaattttaa

SEQ ID NO: 988224 - DNA, 16 bp, Homo sapiens
cttgaaattttaacct

SEQ ID NO: 988225 - DNA, 18 bp, Homo sapiens
cttgaacatgttttgtat

SEQ ID NO: 988226 - DNA, 16 bp, Homo sapiens
cttgaacattaatcca

SEQ ID NO: 988227 - DNA, 14 bp, Homo sapiens
cttgaaccacttcc

SEQ ID NO: 988228 - DNA, 15 bp, Homo sapiens
cttgaaccacttccc

SEQ ID NO: 988229 - DNA, 14 bp, Homo sapiens
cttgaaccccctcc

SEQ ID NO: 988230 - DNA, 14 bp, Homo sapiens
cttgaacctgggaa

SEQ ID NO: 988231 - DNA, 17 bp, Homo sapiens
cttgaactcctggcctc

SEQ ID NO: 988232 - DNA, 18 bp, Homo sapiens
cttgaactcctggcctca

SEQ ID NO: 988233 - DNA, 13 bp, Homo sapiens
cttgaactgggcg

SEQ ID NO: 988234 - DNA, 14 bp, Homo sapiens
cttgaactgggctc

SEQ ID NO: 988235 - DNA, 15 bp, Homo sapiens
cttgaactgggctca

SEQ ID NO: 988236 - DNA, 22 bp, Homo sapiens
cttgaacttagatgttaaatgt

SEQ ID NO: 988237 - DNA, 21 bp, Homo sapiens
cttgaactttgacctctgcag

SEQ ID NO: 988238 - DNA, 21 bp, Homo sapiens
cttgaagaaaatgactttatt

SEQ ID NO: 988239 - DNA, 17 bp, Homo sapiens
cttgaagaaacagagtg

SEQ ID NO: 988240 - DNA, 22 bp, Homo sapiens
cttgaagaaacagagtggcctc

SEQ ID NO: 988241 - DNA, 23 bp, Homo sapiens
cttgaagaaacagagtggcctcc

SEQ ID NO: 988242 - DNA, 17 bp, Homo sapiens
cttgaagaactgcaggc

SEQ ID NO: 988243 - DNA, 15 bp, Homo sapiens
cttgaagacagagca

SEQ ID NO: 988244 - DNA, 20 bp, Homo sapiens
cttgaagatcgttagtatct

SEQ ID NO: 988245 - DNA, 15 bp, Homo sapiens
cttgaagcaaatgtg

SEQ ID NO: 988246 - DNA, 13 bp, Homo sapiens
cttgaagcaataa

SEQ ID NO: 988247 - DNA, 15 bp, Homo sapiens
cttgaagcaataact

SEQ ID NO: 988248 - DNA, 23 bp, Homo sapiens
cttgaagcaataactccaagcag

SEQ ID NO: 988249 - DNA, 16 bp, Homo sapiens
cttgaagcagccttga

SEQ ID NO: 988250 - DNA, 12 bp, Homo sapiens
cttgaagcagta

SEQ ID NO: 988251 - DNA, 12 bp, Homo sapiens
cttgaagcagtc

SEQ ID NO: 988252 - DNA, 20 bp, Homo sapiens
cttgaagcatttcaaagccc

SEQ ID NO: 988253 - DNA, 13 bp, Homo sapiens
cttgaagccaaag

SEQ ID NO: 988254 - DNA, 15 bp, Homo sapiens
cttgaagccaaagaa

SEQ ID NO: 988255 - DNA, 17 bp, Homo sapiens
cttgaagccactgaagc

SEQ ID NO: 988256 - DNA, 21 bp, Homo sapiens
cttgaagctgggctgtctctc

SEQ ID NO: 988257 - DNA, 13 bp, Homo sapiens
cttgaaggactgc

SEQ ID NO: 988258 - DNA, 17 bp, Homo sapiens
cttgaaggactgcagac

SEQ ID NO: 988259 - DNA, 14 bp, Homo sapiens
gtggggcccactgc

SEQ ID NO: 988260 - DNA, 17 bp, Homo sapiens
gtggggcccactgctcg

SEQ ID NO: 988261 - DNA, 14 bp, Homo sapiens
gtggggcctgatgg

SEQ ID NO: 988262 - DNA, 14 bp, Homo sapiens
gtggggcctgggag

SEQ ID NO: 988263 - DNA, 19 bp, Homo sapiens
gtggggcctgtggaatgag

SEQ ID NO: 988264 - DNA, 18 bp, Homo sapiens
gtggggctcgtggccttc

SEQ ID NO: 988265 - DNA, 12 bp, Homo sapiens
gtggggctgagc

SEQ ID NO: 988266 - DNA, 18 bp, Homo sapiens
gtggggctgagctgggga

SEQ ID NO: 988267 - DNA, 12 bp, Homo sapiens
gtggggctgctc

SEQ ID NO: 988268 - DNA, 16 bp, Homo sapiens
gtggggctgctcctcc

SEQ ID NO: 988269 - DNA, 13 bp, Homo sapiens
gtggggctgggca

SEQ ID NO: 988270 - DNA, 17 bp, Homo sapiens
gtgggggagattctggg

SEQ ID NO: 988271 - DNA, 13 bp, Homo sapiens
gtgggggccaggc

SEQ ID NO: 988272 - DNA, 16 bp, Homo sapiens
gtgggggcctcctcag

SEQ ID NO: 988273 - DNA, 14 bp, Homo sapiens
gtgggggcggggaa

SEQ ID NO: 988274 - DNA, 18 bp, Homo sapiens
gtgggggctgtggccctg

SEQ ID NO: 988275 - DNA, 13 bp, Homo sapiens
gtggggggtcctt

SEQ ID NO: 988276 - DNA, 19 bp, Homo sapiens
gtgggggtagagctgatcc

SEQ ID NO: 988277 - DNA, 15 bp, Homo sapiens
gtgggggtggaggct

SEQ ID NO: 988278 - DNA, 12 bp, Homo sapiens
gtgggggtggcc

SEQ ID NO: 988279 - DNA, 14 bp, Homo sapiens
gtgggggtggccat

SEQ ID NO: 988280 - DNA, 20 bp, Homo sapiens
gtgggggttctggcaggacc

SEQ ID NO: 988281 - DNA, 22 bp, Homo sapiens
gtggggtatacagcattgactc

SEQ ID NO: 988282 - DNA, 17 bp, Homo sapiens
gtggggtctccctctcc

SEQ ID NO: 988283 - DNA, 19 bp, Homo sapiens
gtggggtctccctctcctg

SEQ ID NO: 988284 - DNA, 21 bp, Homo sapiens
gtggggtctccctctcctgcc

SEQ ID NO: 988285 - DNA, 20 bp, Homo sapiens
gtggggtgaacagctggtgc

SEQ ID NO: 988286 - DNA, 18 bp, Homo sapiens
gtggggtgcagctgggtg

SEQ ID NO: 988287 - DNA, 21 bp, Homo sapiens
gtggggtgcagctgggtgggg

SEQ ID NO: 988288 - DNA, 15 bp, Homo sapiens
gtggggtgctctggt

SEQ ID NO: 988289 - DNA, 23 bp, Homo sapiens
gtggggtggagtcgcagaccaga

SEQ ID NO: 988290 - DNA, 12 bp, Homo sapiens
gtggggtggggg

SEQ ID NO: 988291 - DNA, 12 bp, Homo sapiens
gtggggtggggt

SEQ ID NO: 988292 - DNA, 16 bp, Homo sapiens
gtggggtggtgtcaga

SEQ ID NO: 988293 - DNA, 19 bp, Homo sapiens
gtggggtgtgctgggagct

SEQ ID NO: 988294 - DNA, 15 bp, Homo sapiens
gtggggttctaggca

SEQ ID NO: 988295 - DNA, 23 bp, Homo sapiens
gtggggttggggcaaagcctcct

SEQ ID NO: 988296 - DNA, 20 bp, Homo sapiens
gtgggtaggagcccttctct

SEQ ID NO: 988297 - DNA, 22 bp, Homo sapiens
gtgggtcacacacacgcactgc

SEQ ID NO: 988298 - DNA, 18 bp, Homo sapiens
gtgggtcagaacatgtta

SEQ ID NO: 988299 - DNA, 22 bp, Homo sapiens
gtgggtccaggaaggcagctgc

SEQ ID NO: 988300 - DNA, 23 bp, Homo sapiens
gtgggtccaggaaggcagctgct

SEQ ID NO: 988301 - DNA, 22 bp, Homo sapiens
gtgggtccatgggcagagccca

SEQ ID NO: 988302 - DNA, 13 bp, Homo sapiens
gtgggtctctgaa

SEQ ID NO: 988303 - DNA, 14 bp, Homo sapiens
gtgggtctctgaag

SEQ ID NO: 988304 - DNA, 14 bp, Homo sapiens
gtgggtctctgggg

SEQ ID NO: 988305 - DNA, 20 bp, Homo sapiens
gtgggtctggactaaccctg

SEQ ID NO: 988306 - DNA, 13 bp, Homo sapiens
gtgggtctgggag

SEQ ID NO: 988307 - DNA, 16 bp, Homo sapiens
gtgggtgacaagagcc

SEQ ID NO: 988308 - DNA, 15 bp, Homo sapiens
gtgggtgagagagac

SEQ ID NO: 988309 - DNA, 13 bp, Homo sapiens
gtgggtgctcaga

SEQ ID NO: 988310 - DNA, 16 bp, Homo sapiens
gtgggtgctgccctgt

SEQ ID NO: 988311 - DNA, 17 bp, Homo sapiens
gtgggtgggcagggagg

SEQ ID NO: 988312 - DNA, 16 bp, Homo sapiens
gtgggtgggcctgact

SEQ ID NO: 988313 - DNA, 17 bp, Homo sapiens
gtgggtgggcctgactg

SEQ ID NO: 988314 - DNA, 14 bp, Homo sapiens
gtgggtggggaggc

SEQ ID NO: 988315 - DNA, 20 bp, Homo sapiens
gtgggtggggaggccctgcc

SEQ ID NO: 988316 - DNA, 23 bp, Homo sapiens
gtgggtgtctccctcgggggctc

SEQ ID NO: 988317 - DNA, 13 bp, Homo sapiens
gtgggtgtggcca

SEQ ID NO: 988318 - DNA, 14 bp, Homo sapiens
gtgggtgtgtgcgc

SEQ ID NO: 988319 - DNA, 17 bp, Homo sapiens
gtgggtgtgtgcgcctg

SEQ ID NO: 988320 - DNA, 21 bp, Homo sapiens
gtgggtgttctttcctgccct

SEQ ID NO: 988321 - DNA, 23 bp, Homo sapiens
gtgggtgtttattacaagtggct

SEQ ID NO: 988322 - DNA, 15 bp, Homo sapiens
gtgggtttctctgtg

SEQ ID NO: 988323 - DNA, 12 bp, Homo sapiens
gtggtaaaaagg

SEQ ID NO: 988324 - DNA, 21 bp, Homo sapiens
gtggtaaatactgtgaaatac

SEQ ID NO: 988325 - DNA, 12 bp, Homo sapiens
gtggtaaccctg

SEQ ID NO: 988326 - DNA, 18 bp, Homo sapiens
gtggtacatacacaccag

SEQ ID NO: 988327 - DNA, 17 bp, Homo sapiens
gtggtaccttcagccct

SEQ ID NO: 988328 - DNA, 19 bp, Homo sapiens
gtggtaccttcagccctgg

SEQ ID NO: 988329 - DNA, 12 bp, Homo sapiens
gtggtagaaaca

SEQ ID NO: 988330 - DNA, 13 bp, Homo sapiens
gtggtagaaacaa

SEQ ID NO: 988331 - DNA, 13 bp, Homo sapiens
gtggtagagaagc

SEQ ID NO: 988332 - DNA, 14 bp, Homo sapiens
gtggtatagaaatg

SEQ ID NO: 988333 - DNA, 13 bp, Homo sapiens
gtggtattctgtc

SEQ ID NO: 988334 - DNA, 20 bp, Homo sapiens
gtggtcaacggagggagtgg

SEQ ID NO: 988335 - DNA, 16 bp, Homo sapiens
gtggtcactggtcagg

SEQ ID NO: 988336 - DNA, 19 bp, Homo sapiens
gtggtcactggtcagggca

SEQ ID NO: 988337 - DNA, 14 bp, Homo sapiens
gtggtcataaaata

SEQ ID NO: 988338 - DNA, 15 bp, Homo sapiens
tcctgagtggtgcca

SEQ ID NO: 988339 - DNA, 19 bp, Homo sapiens
tcctgataaacattaaaca

SEQ ID NO: 988340 - DNA, 18 bp, Homo sapiens
tcctgataataattgatc

SEQ ID NO: 988341 - DNA, 19 bp, Homo sapiens
tcctgataataattgatca

SEQ ID NO: 988342 - DNA, 18 bp, Homo sapiens
tcctgatccctccacccc

SEQ ID NO: 988343 - DNA, 11 bp, Homo sapiens
tcctgatctag

SEQ ID NO: 988344 - DNA, 22 bp, Homo sapiens
tcctgatctagcactcctcaag

SEQ ID NO: 988345 - DNA, 15 bp, Homo sapiens
tcctgatgcccctga

SEQ ID NO: 988346 - DNA, 18 bp, Homo sapiens
tcctgatggagtgtgcag

SEQ ID NO: 988347 - DNA, 14 bp, Homo sapiens
tcctgatggccaag

SEQ ID NO: 988348 - DNA, 21 bp, Homo sapiens
tcctgatggtcagctcccttc

SEQ ID NO: 988349 - DNA, 19 bp, Homo sapiens
tcctgatggtgtcattctg

SEQ ID NO: 988350 - DNA, 18 bp, Homo sapiens
tcctgattaccagtctga

SEQ ID NO: 988351 - DNA, 16 bp, Homo sapiens
tcctgatttctctgaa

SEQ ID NO: 988352 - DNA, 17 bp, Homo sapiens
tcctgatttctctgaac

SEQ ID NO: 988353 - DNA, 19 bp, Homo sapiens
tcctgatttctctgaacag

SEQ ID NO: 988354 - DNA, 15 bp, Homo sapiens
tcctgcaaaggccct

SEQ ID NO: 988355 - DNA, 18 bp, Homo sapiens
tcctgcaactcaaggact

SEQ ID NO: 988356 - DNA, 13 bp, Homo sapiens
tcctgcaatgaaa

SEQ ID NO: 988357 - DNA, 14 bp, Homo sapiens
tcctgcaatgaaag

SEQ ID NO: 988358 - DNA, 15 bp, Homo sapiens
tcctgcacacagaat

SEQ ID NO: 988359 - DNA, 13 bp, Homo sapiens
tcctgcacacagg

SEQ ID NO: 988360 - DNA, 18 bp, Homo sapiens
tcctgcacacagggcagt

SEQ ID NO: 988361 - DNA, 13 bp, Homo sapiens
tcctgcaccccag

SEQ ID NO: 988362 - DNA, 23 bp, Homo sapiens
tcctgcaccccagcattccagct

SEQ ID NO: 988363 - DNA, 11 bp, Homo sapiens
tcctgcagaca

SEQ ID NO: 988364 - DNA, 18 bp, Homo sapiens
tcctgcagacacctggac

SEQ ID NO: 988365 - DNA, 22 bp, Homo sapiens
tcctgcagcaaacactccaccc

SEQ ID NO: 988366 - DNA, 18 bp, Homo sapiens
gcctggacctatgcaggg

SEQ ID NO: 988367 - DNA, 20 bp, Homo sapiens
gcctggacctatgcagggag

SEQ ID NO: 988368 - DNA, 22 bp, Homo sapiens
gcctggacctatgcagggaggc

SEQ ID NO: 988369 - DNA, 11 bp, Homo sapiens
gcctggacctg

SEQ ID NO: 988370 - DNA, 18 bp, Homo sapiens
gcctggacctgcctcctg

SEQ ID NO: 988371 - DNA, 19 bp, Homo sapiens
gcctggacctgcctcctgc

SEQ ID NO: 988372 - DNA, 15 bp, Homo sapiens
gcctggacctgggat

SEQ ID NO: 988373 - DNA, 15 bp, Homo sapiens
gcctggactctaagc

SEQ ID NO: 988374 - DNA, 13 bp, Homo sapiens
gcctggactctgc

SEQ ID NO: 988375 - DNA, 15 bp, Homo sapiens
gcctggactctgccc

SEQ ID NO: 988376 - DNA, 16 bp, Homo sapiens
gcctggactttcctgc

SEQ ID NO: 988377 - DNA, 15 bp, Homo sapiens
gcctggagaagctga

SEQ ID NO: 988378 - DNA, 20 bp, Homo sapiens
gcctggagacaaggtgctaa

SEQ ID NO: 988379 - DNA, 17 bp, Homo sapiens
gcctggagacttagggc

SEQ ID NO: 988380 - DNA, 13 bp, Homo sapiens
gcctggagaggcc

SEQ ID NO: 988381 - DNA, 14 bp, Homo sapiens
gcctggagaggcct

SEQ ID NO: 988382 - DNA, 15 bp, Homo sapiens
gcctggagaggcctg

SEQ ID NO: 988383 - DNA, 20 bp, Homo sapiens
gcctggagatcctcctgcag

SEQ ID NO: 988384 - DNA, 18 bp, Homo sapiens
gcctggagccctgggcgg

SEQ ID NO: 988385 - DNA, 14 bp, Homo sapiens
gcctggagcgtttg

SEQ ID NO: 988386 - DNA, 15 bp, Homo sapiens
gcctggagggacttt

SEQ ID NO: 988387 - DNA, 17 bp, Homo sapiens
gcctggagggatgcccc

SEQ ID NO: 988388 - DNA, 19 bp, Homo sapiens
gcctggagggatgccccca

SEQ ID NO: 988389 - DNA, 23 bp, Homo sapiens
gcctggagggatgcccccaggca

SEQ ID NO: 988390 - DNA, 18 bp, Homo sapiens
gcctggagggcacttcct

SEQ ID NO: 988391 - DNA, 22 bp, Homo sapiens
gcctggagggcacttcctccac

SEQ ID NO: 988392 - DNA, 18 bp, Homo sapiens
gcctggatccctgccctt

SEQ ID NO: 988393 - DNA, 20 bp, Homo sapiens
gcctggatgcggatggccgg

SEQ ID NO: 988394 - DNA, 23 bp, Homo sapiens
gcctggatgggggtgcaggcagc

SEQ ID NO: 988395 - DNA, 16 bp, Homo sapiens
gcctggattcatttcc

SEQ ID NO: 988396 - DNA, 19 bp, Homo sapiens
gcctggattcatttcctgc

SEQ ID NO: 988397 - DNA, 18 bp, Homo sapiens
gcctggcaacagagcgag

SEQ ID NO: 988398 - DNA, 22 bp, Homo sapiens
gcctggcaaggcattcctcatc

SEQ ID NO: 988399 - DNA, 18 bp, Homo sapiens
gcctggcaagtgggtgaa

SEQ ID NO: 988400 - DNA, 21 bp, Homo sapiens
gcctggcacagaccaggcctt

SEQ ID NO: 988401 - DNA, 19 bp, Homo sapiens
gcctggcacagggcagtgg

SEQ ID NO: 988402 - DNA, 11 bp, Homo sapiens
gcctggcaccc

SEQ ID NO: 988403 - DNA, 14 bp, Homo sapiens
gcctggcacccacc

SEQ ID NO: 988404 - DNA, 15 bp, Homo sapiens
gcctggcacccaccg

SEQ ID NO: 988405 - DNA, 18 bp, Homo sapiens
gcctggcagaactgagct

SEQ ID NO: 988406 - DNA, 19 bp, Homo sapiens
gcctggcagaactgagctc

SEQ ID NO: 988407 - DNA, 22 bp, Homo sapiens
gcctggcagaactgagctcctc

SEQ ID NO: 988408 - DNA, 12 bp, Homo sapiens
gcctggcagccg

SEQ ID NO: 988409 - DNA, 20 bp, Homo sapiens
gcctggcagttgaacagagg

SEQ ID NO: 988410 - DNA, 15 bp, Homo sapiens
gcctggcatctgtgc

SEQ ID NO: 988411 - DNA, 18 bp, Homo sapiens
gcctggcatctgtgtgcg

SEQ ID NO: 988412 - DNA, 20 bp, Homo sapiens
gcctggcatctgtgtgcgtg

SEQ ID NO: 988413 - DNA, 16 bp, Homo sapiens
gcctggccaccagcca

SEQ ID NO: 988414 - DNA, 18 bp, Homo sapiens
gcctggccaccagccatc

SEQ ID NO: 988415 - DNA, 14 bp, Homo sapiens
gcctggccacctct

SEQ ID NO: 988416 - DNA, 19 bp, Homo sapiens
gcctggccacctctctcct

SEQ ID NO: 988417 - DNA, 12 bp, Homo sapiens
gcctggccaggc

SEQ ID NO: 988418 - DNA, 15 bp, Homo sapiens
gcctggccaggcaga

SEQ ID NO: 988419 - DNA, 17 bp, Homo sapiens
gcctggccaggcagatc

SEQ ID NO: 988420 - DNA, 18 bp, Homo sapiens
gcctggccagtcctggtc

SEQ ID NO: 988421 - DNA, 22 bp, Homo sapiens
gcctggccatgtcacctggctg

SEQ ID NO: 988422 - DNA, 13 bp, Homo sapiens
gcctggccccagc

SEQ ID NO: 988423 - DNA, 17 bp, Homo sapiens
gcctggccccagcctgg

SEQ ID NO: 988424 - DNA, 17 bp, Homo sapiens
gcctggccccaggcccc

SEQ ID NO: 988425 - DNA, 13 bp, Homo sapiens
gcctggcccccaa

SEQ ID NO: 988426 - DNA, 20 bp, Homo sapiens
gcctggccccggcctttatg

SEQ ID NO: 988427 - DNA, 17 bp, Homo sapiens
gcctggcctcgcctgcc

SEQ ID NO: 988428 - DNA, 18 bp, Homo sapiens
gcctggcctcgcctgcct

SEQ ID NO: 988429 - DNA, 20 bp, Homo sapiens
gcctggcctgagctggggcc

SEQ ID NO: 988430 - DNA, 22 bp, Homo sapiens
gcctggcctgagctggggccac

SEQ ID NO: 988431 - DNA, 12 bp, Homo sapiens
gcctggcctgat

SEQ ID NO: 988432 - DNA, 14 bp, Homo sapiens
gcctggcctggctc

SEQ ID NO: 988433 - DNA, 15 bp, Homo sapiens
gcctggcctggctcc

SEQ ID NO: 988434 - DNA, 16 bp, Homo sapiens
gcctggcgtcggccag

SEQ ID NO: 988435 - DNA, 17 bp, Homo sapiens
gcctggcgtcggccaga

SEQ ID NO: 988436 - DNA, 13 bp, Homo sapiens
gcctggctcccca

SEQ ID NO: 988437 - DNA, 23 bp, Homo sapiens
gcctggctccccacgagtcacct

SEQ ID NO: 988438 - DNA, 16 bp, Homo sapiens
gcctggctccgtccag

SEQ ID NO: 988439 - DNA, 13 bp, Homo sapiens
gcctggctctgcc

SEQ ID NO: 988440 - DNA, 22 bp, Homo sapiens
gcctggctctgccccctccccc

SEQ ID NO: 988441 - DNA, 17 bp, Homo sapiens
gcctggctggaggagca

SEQ ID NO: 988442 - DNA, 23 bp, Homo sapiens
gcctggctggaggagcagcagct

SEQ ID NO: 988443 - DNA, 18 bp, Homo sapiens
gcctggctgtggaggcct

SEQ ID NO: 988444 - DNA, 19 bp, Homo sapiens
gcctggctgtggaggcctg

SEQ ID NO: 988445 - DNA, 21 bp, Homo sapiens
gcctggcttacctatctgtgg

SEQ ID NO: 988446 - DNA, 13 bp, Homo sapiens
gcctggcttctgg

SEQ ID NO: 988447 - DNA, 14 bp, Homo sapiens
gcctggcttctgga

SEQ ID NO: 988448 - DNA, 22 bp, Homo sapiens
gcctggcttctggagcccttgg

SEQ ID NO: 988449 - DNA, 15 bp, Homo sapiens
gcctggcttgctcca

SEQ ID NO: 988450 - DNA, 19 bp, Homo sapiens
gcctggcttgctccagggt

SEQ ID NO: 988451 - DNA, 21 bp, Homo sapiens
gcctggcttgctccagggtct

SEQ ID NO: 988452 - DNA, 22 bp, Homo sapiens
gcctggctttggtccccagcat

SEQ ID NO: 988453 - DNA, 16 bp, Homo sapiens
gcctgggactcccagt

SEQ ID NO: 988454 - DNA, 21 bp, Homo sapiens
gcctgggagggttcccctggc

SEQ ID NO: 988455 - DNA, 22 bp, Homo sapiens
gcctgggagggttcccctggcc

SEQ ID NO: 988456 - DNA, 19 bp, Homo sapiens
gcctgggatcgtgcatttg

SEQ ID NO: 988457 - DNA, 22 bp, Homo sapiens
gcctgggatctggcacactccc

SEQ ID NO: 988458 - DNA, 16 bp, Homo sapiens
gcctgggcaacagagc

SEQ ID NO: 988459 - DNA, 18 bp, Homo sapiens
gcctgggcaacagagcaa

SEQ ID NO: 988460 - DNA, 18 bp, Homo sapiens
gcctgtgccttcctcccc

SEQ ID NO: 988461 - DNA, 17 bp, Homo sapiens
gcctgtggagctcagcc

SEQ ID NO: 988462 - DNA, 22 bp, Homo sapiens
gcctgtggcagaaaagaggaga

SEQ ID NO: 988463 - DNA, 14 bp, Homo sapiens
gcctgtggcctgtg

SEQ ID NO: 988464 - DNA, 19 bp, Homo sapiens
gcctgtggcgccgtctcca

SEQ ID NO: 988465 - DNA, 23 bp, Homo sapiens
gcctgtggcgccgtctccagggg

SEQ ID NO: 988466 - DNA, 16 bp, Homo sapiens
gcctgtggcttggagt

SEQ ID NO: 988467 - DNA, 14 bp, Homo sapiens
gcctgtgggcctca

SEQ ID NO: 988468 - DNA, 20 bp, Homo sapiens
gcctgtgggcctcacctgcc

SEQ ID NO: 988469 - DNA, 22 bp, Homo sapiens
gcctgtgggtccccactcaccc

SEQ ID NO: 988470 - DNA, 13 bp, Homo sapiens
gcctgtgggtctc

SEQ ID NO: 988471 - DNA, 14 bp, Homo sapiens
gcctgtgggtctct

SEQ ID NO: 988472 - DNA, 17 bp, Homo sapiens
gcctgtgggtctctgaa

SEQ ID NO: 988473 - DNA, 14 bp, Homo sapiens
gcctgtggtgaagt

SEQ ID NO: 988474 - DNA, 19 bp, Homo sapiens
gcctgtggtgaagtgtggc

SEQ ID NO: 988475 - DNA, 20 bp, Homo sapiens
gcctgtggtgaagtgtggct

SEQ ID NO: 988476 - DNA, 12 bp, Homo sapiens
gcctgtggtgct

SEQ ID NO: 988477 - DNA, 21 bp, Homo sapiens
gcctgtggttacagtgcagac

SEQ ID NO: 988478 - DNA, 16 bp, Homo sapiens
gcctgtgtccagcagc

SEQ ID NO: 988479 - DNA, 18 bp, Homo sapiens
gcctgtgtccagcagctg

SEQ ID NO: 988480 - DNA, 22 bp, Homo sapiens
gcctgtgtcccatgacccaccc

SEQ ID NO: 988481 - DNA, 23 bp, Homo sapiens
gcctgtgtcccatgacccacccc

SEQ ID NO: 988482 - DNA, 15 bp, Homo sapiens
gcctgtgtgactcca

SEQ ID NO: 988483 - DNA, 17 bp, Homo sapiens
gcctgtgtgtgggtggg

SEQ ID NO: 988484 - DNA, 22 bp, Homo sapiens
gcctgttaatttataatgtatt

SEQ ID NO: 988485 - DNA, 19 bp, Homo sapiens
gcctgttcccattcttgca

SEQ ID NO: 988486 - DNA, 14 bp, Homo sapiens
gcctgttctgcttc

SEQ ID NO: 988487 - DNA, 15 bp, Homo sapiens
gcctgttctgcttcg

SEQ ID NO: 988488 - DNA, 19 bp, Homo sapiens
gcctgttgctgaagtcatt

SEQ ID NO: 988489 - DNA, 20 bp, Homo sapiens
gcctgttgctttcttcctgc

SEQ ID NO: 988490 - DNA, 16 bp, Homo sapiens
gcctgttggcaggccc

SEQ ID NO: 988491 - DNA, 14 bp, Homo sapiens
gcctgttgtattta

SEQ ID NO: 988492 - DNA, 22 bp, Homo sapiens
gcctgtttctgcagcccttggg

SEQ ID NO: 988493 - DNA, 14 bp, Homo sapiens
gcctgtttggcctc

SEQ ID NO: 988494 - DNA, 17 bp, Homo sapiens
gcctgtttgggagtgcg

SEQ ID NO: 988495 - DNA, 17 bp, Homo sapiens
tcctggaacctgtctcc

SEQ ID NO: 988496 - DNA, 17 bp, Homo sapiens
tcctggaaccttgctgt

SEQ ID NO: 988497 - DNA, 18 bp, Homo sapiens
tcctggaaccttgctgtc

SEQ ID NO: 988498 - DNA, 12 bp, Homo sapiens
tcctggaagaca

SEQ ID NO: 988499 - DNA, 18 bp, Homo sapiens
tcctggaagccagctttc

SEQ ID NO: 988500 - DNA, 20 bp, Homo sapiens
tcctggaagccagctttccc

SEQ ID NO: 988501 - DNA, 22 bp, Homo sapiens
tcctggaagcgcgagggcctca

SEQ ID NO: 988502 - DNA, 14 bp, Homo sapiens
tcctggacacactc

SEQ ID NO: 988503 - DNA, 13 bp, Homo sapiens
tcctggacacctc

SEQ ID NO: 988504 - DNA, 19 bp, Homo sapiens
tcctggacacctcccaggg

SEQ ID NO: 988505 - DNA, 20 bp, Homo sapiens
tcctggacacctcccagggg

SEQ ID NO: 988506 - DNA, 23 bp, Homo sapiens
tcctggacacctcccaggggact

SEQ ID NO: 988507 - DNA, 19 bp, Homo sapiens
tcctggacactcagacctg

SEQ ID NO: 988508 - DNA, 18 bp, Homo sapiens
tcctggacatcaccagtc

SEQ ID NO: 988509 - DNA, 21 bp, Homo sapiens
tcctggacatgaagattcttt

SEQ ID NO: 988510 - DNA, 22 bp, Homo sapiens
tcctggacatgaagattctttc

SEQ ID NO: 988511 - DNA, 14 bp, Homo sapiens
tcctggacattttt

SEQ ID NO: 988512 - DNA, 19 bp, Homo sapiens
tcctggacattttttcagt

SEQ ID NO: 988513 - DNA, 21 bp, Homo sapiens
tcctggaccttgacagagcag

SEQ ID NO: 988514 - DNA, 15 bp, Homo sapiens
tcctggactccggag

SEQ ID NO: 988515 - DNA, 16 bp, Homo sapiens
tcctggactccggagg

SEQ ID NO: 988516 - DNA, 17 bp, Homo sapiens
tcctggactccggagga

SEQ ID NO: 988517 - DNA, 20 bp, Homo sapiens
tcctggactccggaggactg

SEQ ID NO: 988518 - DNA, 20 bp, Homo sapiens
tcctggacttacaaaatgcc

SEQ ID NO: 988519 - DNA, 21 bp, Homo sapiens
tcctggagaggtggctgcgcc

SEQ ID NO: 988520 - DNA, 18 bp, Homo sapiens
tcctggagatagctgggg

SEQ ID NO: 988521 - DNA, 20 bp, Homo sapiens
tcctggagatagctggggct

SEQ ID NO: 988522 - DNA, 19 bp, Homo sapiens
tcctggagcagaaagtgcc

SEQ ID NO: 988523 - DNA, 16 bp, Homo sapiens
tcctggagcatcccag

SEQ ID NO: 988524 - DNA, 19 bp, Homo sapiens
tcctggagcatcccaggcg

SEQ ID NO: 988525 - DNA, 14 bp, Homo sapiens
tcctggaggcaggg

SEQ ID NO: 988526 - DNA, 19 bp, Homo sapiens
tcctggaggggctggggac

SEQ ID NO: 988527 - DNA, 14 bp, Homo sapiens
tcctggatttatag

SEQ ID NO: 988528 - DNA, 21 bp, Homo sapiens
tcctggcaatagtgtgttctg

SEQ ID NO: 988529 - DNA, 22 bp, Homo sapiens
tcctggcaatagtgtgttctga

SEQ ID NO: 988530 - DNA, 17 bp, Homo sapiens
tcctggcacgccctact

SEQ ID NO: 988531 - DNA, 13 bp, Homo sapiens
tcctggcagccca

SEQ ID NO: 988532 - DNA, 16 bp, Homo sapiens
tcctggcagcccagag

SEQ ID NO: 988533 - DNA, 19 bp, Homo sapiens
tcctggcagcccagagact

SEQ ID NO: 988534 - DNA, 13 bp, Homo sapiens
tcctggcagctgc

SEQ ID NO: 988535 - DNA, 15 bp, Homo sapiens
tcctggcagctgctg

SEQ ID NO: 988536 - DNA, 16 bp, Homo sapiens
tcctggcagctgctgt

SEQ ID NO: 988537 - DNA, 17 bp, Homo sapiens
tcctggcagctgctgtg

SEQ ID NO: 988538 - DNA, 18 bp, Homo sapiens
tcctggcagctgctgtgg

SEQ ID NO: 988539 - DNA, 16 bp, Homo sapiens
tcctggcagctggacc

SEQ ID NO: 988540 - DNA, 23 bp, Homo sapiens
tcctggcagggccacctgcagga

SEQ ID NO: 988541 - DNA, 10 bp, Homo sapiens
tcctggccag

SEQ ID NO: 988542 - DNA, 14 bp, Homo sapiens
tcctggcccaggcc

SEQ ID NO: 988543 - DNA, 15 bp, Homo sapiens
tcctggcccaggcct

SEQ ID NO: 988544 - DNA, 20 bp, Homo sapiens
tcctggccccctcattcaga

SEQ ID NO: 988545 - DNA, 21 bp, Homo sapiens
tcctggccccgggctctggcc

SEQ ID NO: 988546 - DNA, 22 bp, Homo sapiens
tcctggccccgggctctggcca

SEQ ID NO: 988547 - DNA, 23 bp, Homo sapiens
tcctggccccgggctctggccac

SEQ ID NO: 988548 - DNA, 22 bp, Homo sapiens
tcctggcccctccagaccctgc

SEQ ID NO: 988549 - DNA, 16 bp, Homo sapiens
tcctggcccgccctca

SEQ ID NO: 988550 - DNA, 22 bp, Homo sapiens
tcctggccctgggggtctgggc

SEQ ID NO: 988551 - DNA, 23 bp, Homo sapiens
tcctggcccttcagtctgctcca

SEQ ID NO: 988552 - DNA, 14 bp, Homo sapiens
tcctggcctatccg

SEQ ID NO: 988553 - DNA, 22 bp, Homo sapiens
tcctggcctatccgctgccagc

SEQ ID NO: 988554 - DNA, 22 bp, Homo sapiens
tcctggcctcactggctggggc

SEQ ID NO: 988555 - DNA, 13 bp, Homo sapiens
tcctggcctcctt

SEQ ID NO: 988556 - DNA, 13 bp, Homo sapiens
tcctggcctgaga

SEQ ID NO: 988557 - DNA, 15 bp, Homo sapiens
tcctggccttctgaa

SEQ ID NO: 988558 - DNA, 18 bp, Homo sapiens
tcctggccttctgaactc

SEQ ID NO: 988559 - DNA, 19 bp, Homo sapiens
tcctggcgggggtgggccg

SEQ ID NO: 988560 - DNA, 18 bp, Homo sapiens
tcctggctacatcccagc

SEQ ID NO: 988561 - DNA, 21 bp, Homo sapiens
tcctggctacatcccagcctg

SEQ ID NO: 988562 - DNA, 16 bp, Homo sapiens
tcctggctcctgaggg

SEQ ID NO: 988563 - DNA, 14 bp, Homo sapiens
tcctggctcgcagg

SEQ ID NO: 988564 - DNA, 23 bp, Homo sapiens
tcctggctcggggtaaaaagtgg

SEQ ID NO: 988565 - DNA, 22 bp, Homo sapiens
tcctggctctaccctgtctgtc

SEQ ID NO: 988566 - DNA, 23 bp, Homo sapiens
tcctggctctaccctgtctgtcc

SEQ ID NO: 988567 - DNA, 11 bp, Homo sapiens
tcctggctctg

SEQ ID NO: 988568 - DNA, 14 bp, Homo sapiens
tcctggctgccagg

SEQ ID NO: 988569 - DNA, 14 bp, Homo sapiens
tcctggctgtaaat

SEQ ID NO: 988570 - DNA, 18 bp, Homo sapiens
tcctggctgtgcccagca

SEQ ID NO: 988571 - DNA, 19 bp, Homo sapiens
tcctggctgtgcccagcag

SEQ ID NO: 988572 - DNA, 21 bp, Homo sapiens
tcctggctgtgcccagcaggc

SEQ ID NO: 988573 - DNA, 18 bp, Homo sapiens
tcctggctttccaggaga

SEQ ID NO: 988574 - DNA, 18 bp, Homo sapiens
tcctgggaatggaataac

SEQ ID NO: 988575 - DNA, 23 bp, Homo sapiens
tcctgggaccccctcgccagctt

SEQ ID NO: 988576 - DNA, 20 bp, Homo sapiens
tcctgggagaacctcaggct

SEQ ID NO: 988577 - DNA, 19 bp, Homo sapiens
tcctgggcaatcagacacc

SEQ ID NO: 988578 - DNA, 23 bp, Homo sapiens
tcctgggcagcctttccagcctc

SEQ ID NO: 988579 - DNA, 12 bp, Homo sapiens
tcctgggcaggt

SEQ ID NO: 988580 - DNA, 21 bp, Homo sapiens
tcctgggcaggtgggagctga

SEQ ID NO: 988581 - DNA, 18 bp, Homo sapiens
tcctgttacttacctaaa

SEQ ID NO: 988582 - DNA, 16 bp, Homo sapiens
tcctgttacttgcttc

SEQ ID NO: 988583 - DNA, 17 bp, Homo sapiens
tcctgttacttgcttca

SEQ ID NO: 988584 - DNA, 15 bp, Homo sapiens
tcctgttcacaccag

SEQ ID NO: 988585 - DNA, 15 bp, Homo sapiens
tcctgttcagtgaga

SEQ ID NO: 988586 - DNA, 20 bp, Homo sapiens
tcctgttccctcctggtcct

SEQ ID NO: 988587 - DNA, 13 bp, Homo sapiens
tcctgttcttcct

SEQ ID NO: 988588 - DNA, 17 bp, Homo sapiens
tcctgttgaagacttcc

SEQ ID NO: 988589 - DNA, 21 bp, Homo sapiens
tcctgttgaagacttcctctc

SEQ ID NO: 988590 - DNA, 22 bp, Homo sapiens
tcctgttgaccttcccacacaa

SEQ ID NO: 988591 - DNA, 22 bp, Homo sapiens
tcctgtttataatctgaagata

SEQ ID NO: 988592 - DNA, 12 bp, Homo sapiens
tcctgtttcaga

SEQ ID NO: 988593 - DNA, 21 bp, Homo sapiens
tcctgtttgaaatatcatgtt

SEQ ID NO: 988594 - DNA, 20 bp, Homo sapiens
tcctgtttggtggggtggca

SEQ ID NO: 988595 - DNA, 15 bp, Homo sapiens
tcctgttttctccct

SEQ ID NO: 988596 - DNA, 19 bp, Homo sapiens
tcctgttttctccctctca

SEQ ID NO: 988597 - DNA, 17 bp, Homo sapiens
tcctgttttctctgtga

SEQ ID NO: 988598 - DNA, 16 bp, Homo sapiens
tcctgtttttctgggt

SEQ ID NO: 988599 - DNA, 20 bp, Homo sapiens
tcctgtttttctgggtggcc

SEQ ID NO: 988600 - DNA, 20 bp, Homo sapiens
tccttaaaattaagttgaaa

SEQ ID NO: 988601 - DNA, 21 bp, Homo sapiens
tccttaaaattaagttgaaaa

SEQ ID NO: 988602 - DNA, 15 bp, Homo sapiens
tccttaaactgtgtg

SEQ ID NO: 988603 - DNA, 23 bp, Homo sapiens
tccttaaactgtgtggactgtga

SEQ ID NO: 988604 - DNA, 15 bp, Homo sapiens
tccttaaatatatat

SEQ ID NO: 988605 - DNA, 21 bp, Homo sapiens
tccttaaatcttaatgttcct

SEQ ID NO: 988606 - DNA, 19 bp, Homo sapiens
tccttaaatttttagccat

SEQ ID NO: 988607 - DNA, 22 bp, Homo sapiens
tccttaaccaccgcatatgcat

SEQ ID NO: 988608 - DNA, 13 bp, Homo sapiens
tccttaagagatt

SEQ ID NO: 988609 - DNA, 14 bp, Homo sapiens
tccttaagcatctg

SEQ ID NO: 988610 - DNA, 17 bp, Homo sapiens
tccttaagtcagaacag

SEQ ID NO: 988611 - DNA, 18 bp, Homo sapiens
tccttaattcactcccac

SEQ ID NO: 988612 - DNA, 11 bp, Homo sapiens
tccttacctcg

SEQ ID NO: 988613 - DNA, 14 bp, Homo sapiens
tccttacctctgga

SEQ ID NO: 988614 - DNA, 21 bp, Homo sapiens
tccttacctctggaacccccc

SEQ ID NO: 988615 - DNA, 17 bp, Homo sapiens
tccttacctcttccgga

SEQ ID NO: 988616 - DNA, 20 bp, Homo sapiens
tccttacgctttgtcacaca

SEQ ID NO: 988617 - DNA, 19 bp, Homo sapiens
tccttactcccccaccact

SEQ ID NO: 988618 - DNA, 23 bp, Homo sapiens
tccttactcccccaccactcagg

SEQ ID NO: 988619 - DNA, 17 bp, Homo sapiens
tccttactctgagccca

SEQ ID NO: 988620 - DNA, 18 bp, Homo sapiens
tccttactctgagcccag

SEQ ID NO: 988621 - DNA, 16 bp, Homo sapiens
tccttacttgcactgt

SEQ ID NO: 988622 - DNA, 21 bp, Homo sapiens
tccttacttgcactgttactc

SEQ ID NO: 988623 - DNA, 16 bp, Homo sapiens
gccttgccgctcccct

SEQ ID NO: 988624 - DNA, 15 bp, Homo sapiens
gccttgcggaagcca

SEQ ID NO: 988625 - DNA, 16 bp, Homo sapiens
gccttgcggaagccat

SEQ ID NO: 988626 - DNA, 18 bp, Homo sapiens
gccttgcggaagccatag

SEQ ID NO: 988627 - DNA, 19 bp, Homo sapiens
gccttgcggaagccatagg

SEQ ID NO: 988628 - DNA, 14 bp, Homo sapiens
gccttgctcactca

SEQ ID NO: 988629 - DNA, 18 bp, Homo sapiens
gccttgctctgagcacag

SEQ ID NO: 988630 - DNA, 21 bp, Homo sapiens
gccttgctgactctctgagct

SEQ ID NO: 988631 - DNA, 18 bp, Homo sapiens
gccttgctgggccaggga

SEQ ID NO: 988632 - DNA, 12 bp, Homo sapiens
gccttgctgggg

SEQ ID NO: 988633 - DNA, 13 bp, Homo sapiens
gccttgctggggt

SEQ ID NO: 988634 - DNA, 20 bp, Homo sapiens
gccttgctggggtccagggc

SEQ ID NO: 988635 - DNA, 17 bp, Homo sapiens
gccttgctgtttgtcct

SEQ ID NO: 988636 - DNA, 23 bp, Homo sapiens
gccttgcttctcccatttcctga

SEQ ID NO: 988637 - DNA, 22 bp, Homo sapiens
gccttgctttgggctttgcagg

SEQ ID NO: 988638 - DNA, 18 bp, Homo sapiens
gccttggaaccagcccca

SEQ ID NO: 988639 - DNA, 19 bp, Homo sapiens
gccttggataatgctgttg

SEQ ID NO: 988640 - DNA, 23 bp, Homo sapiens
gccttggataatgctgttgcctc

SEQ ID NO: 988641 - DNA, 23 bp, Homo sapiens
gccttggatcgctaagctggctc

SEQ ID NO: 988642 - DNA, 17 bp, Homo sapiens
gccttggcatgggcgca

SEQ ID NO: 988643 - DNA, 19 bp, Homo sapiens
gccttggcatgggcgcagg

SEQ ID NO: 988644 - DNA, 15 bp, Homo sapiens
gccttggccggctgt

SEQ ID NO: 988645 - DNA, 17 bp, Homo sapiens
gccttggcctcccaaag

SEQ ID NO: 988646 - DNA, 20 bp, Homo sapiens
gccttggcctcccctgctga

SEQ ID NO: 988647 - DNA, 17 bp, Homo sapiens
gccttggctcgttctct

SEQ ID NO: 988648 - DNA, 18 bp, Homo sapiens
gccttggctgggcctctg

SEQ ID NO: 988649 - DNA, 23 bp, Homo sapiens
gccttgggaggacatgcgtgtgt

SEQ ID NO: 988650 - DNA, 22 bp, Homo sapiens
gccttgggccggtgctgggggc

SEQ ID NO: 988651 - DNA, 15 bp, Homo sapiens
gccttgggcctttca

SEQ ID NO: 988652 - DNA, 22 bp, Homo sapiens
gccttgggcctttcagtcccaa

SEQ ID NO: 988653 - DNA, 18 bp, Homo sapiens
gccttgggctgctcctca

SEQ ID NO: 988654 - DNA, 22 bp, Homo sapiens
gccttgggctgctcctcatggt

SEQ ID NO: 988655 - DNA, 19 bp, Homo sapiens
gccttggggaatttcctct

SEQ ID NO: 988656 - DNA, 18 bp, Homo sapiens
gccttgggggggctgcct

SEQ ID NO: 988657 - DNA, 20 bp, Homo sapiens
gccttgggggggctgccttt

SEQ ID NO: 988658 - DNA, 15 bp, Homo sapiens
gccttggggtggggg

SEQ ID NO: 988659 - DNA, 16 bp, Homo sapiens
gccttggtatcatttt

SEQ ID NO: 988660 - DNA, 17 bp, Homo sapiens
gccttggtatgtgccag

SEQ ID NO: 988661 - DNA, 18 bp, Homo sapiens
gccttggtatgtgccagg

SEQ ID NO: 988662 - DNA, 21 bp, Homo sapiens
gccttggtatgtgccaggctt

SEQ ID NO: 988663 - DNA, 20 bp, Homo sapiens
gccttggtggagcagccaga

SEQ ID NO: 988664 - DNA, 16 bp, Homo sapiens
gccttggtgtccacct

SEQ ID NO: 988665 - DNA, 18 bp, Homo sapiens
gccttggtgtccacctgg

SEQ ID NO: 988666 - DNA, 22 bp, Homo sapiens
gccttggtttttactgctctga

SEQ ID NO: 988667 - DNA, 17 bp, Homo sapiens
gccttgtaattctaaat

SEQ ID NO: 988668 - DNA, 21 bp, Homo sapiens
gccttgtataatattgaaaat

SEQ ID NO: 988669 - DNA, 22 bp, Homo sapiens
gccttgtataatattgaaaatt

SEQ ID NO: 988670 - DNA, 14 bp, Homo sapiens
gccttgtcatcctc

SEQ ID NO: 988671 - DNA, 14 bp, Homo sapiens
gccttgtccaggaa

SEQ ID NO: 988672 - DNA, 18 bp, Homo sapiens
gccttgtggataagggag

SEQ ID NO: 988673 - DNA, 20 bp, Homo sapiens
gccttgtgtggcttggagga

SEQ ID NO: 988674 - DNA, 22 bp, Homo sapiens
gccttgtgtggcttggaggaaa

SEQ ID NO: 988675 - DNA, 21 bp, Homo sapiens
gccttgtgtgtcaggccctct

SEQ ID NO: 988676 - DNA, 18 bp, Homo sapiens
gccttgttgtgacacatc

SEQ ID NO: 988677 - DNA, 13 bp, Homo sapiens
gccttgtttctga

SEQ ID NO: 988678 - DNA, 15 bp, Homo sapiens
gccttgtttctgatg

SEQ ID NO: 988679 - DNA, 14 bp, Homo sapiens
gcctttaaaaccag

SEQ ID NO: 988680 - DNA, 15 bp, Homo sapiens
gcctttaaaaccagt

SEQ ID NO: 988681 - DNA, 23 bp, Homo sapiens
gcctttaaaaccagtaacgtgct

SEQ ID NO: 988682 - DNA, 23 bp, Homo sapiens
gcctttaaaacgcgtctgcctgg

SEQ ID NO: 988683 - DNA, 24 bp, Homo sapiens
gcctttaaaacgcgtctgcctggg

SEQ ID NO: 988684 - DNA, 17 bp, Homo sapiens
gcctttaaaggttttta

SEQ ID NO: 988685 - DNA, 18 bp, Homo sapiens
gcctttaaaggtttttaa

SEQ ID NO: 988686 - DNA, 15 bp, Homo sapiens
gcctttaaagtatga

SEQ ID NO: 988687 - DNA, 18 bp, Homo sapiens
gcctttaaagtatgaatc

SEQ ID NO: 988688 - DNA, 14 bp, Homo sapiens
gcctttaacagaaa

SEQ ID NO: 988689 - DNA, 20 bp, Homo sapiens
gcctttacgttcatcacctg

SEQ ID NO: 988690 - DNA, 20 bp, Homo sapiens
gcctttagcctggaccaaag

SEQ ID NO: 988691 - DNA, 20 bp, Homo sapiens
gcctttaggggtgtgtattc

SEQ ID NO: 988692 - DNA, 16 bp, Homo sapiens
gcctttaggtctttag

SEQ ID NO: 988693 - DNA, 22 bp, Homo sapiens
gcctttatctcagccatccgca

SEQ ID NO: 988694 - DNA, 23 bp, Homo sapiens
gcctttcaagcggtgcctaagaa

SEQ ID NO: 988695 - DNA, 22 bp, Homo sapiens
gcctttccataaggaatgtagc

SEQ ID NO: 988696 - DNA, 18 bp, Homo sapiens
gcctttcccaactctagc

SEQ ID NO: 988697 - DNA, 21 bp, Homo sapiens
gcctttcctgtagccttctgt

SEQ ID NO: 988698 - DNA, 12 bp, Homo sapiens
gcctttcctgtg

SEQ ID NO: 988699 - DNA, 21 bp, Homo sapiens
gcctttcctgtgccaacctga

SEQ ID NO: 988700 - DNA, 16 bp, Homo sapiens
gcctttcgaggcctga

SEQ ID NO: 988701 - DNA, 14 bp, Homo sapiens
actcactgaagcct

SEQ ID NO: 988702 - DNA, 19 bp, Homo sapiens
actcactgaagcctgcgtt

SEQ ID NO: 988703 - DNA, 10 bp, Homo sapiens
actcactgct

SEQ ID NO: 988704 - DNA, 20 bp, Homo sapiens
actcactgggaagctcccac

SEQ ID NO: 988705 - DNA, 16 bp, Homo sapiens
actcacttacatcttc

SEQ ID NO: 988706 - DNA, 14 bp, Homo sapiens
actcacttctcagc

SEQ ID NO: 988707 - DNA, 12 bp, Homo sapiens
actcacttgcca

SEQ ID NO: 988708 - DNA, 21 bp, Homo sapiens
actcacttgccattgccagga

SEQ ID NO: 988709 - DNA, 13 bp, Homo sapiens
actcacttttcac

SEQ ID NO: 988710 - DNA, 15 bp, Homo sapiens
actcacttttcactt

SEQ ID NO: 988711 - DNA, 13 bp, Homo sapiens
actcagaaagcca

SEQ ID NO: 988712 - DNA, 15 bp, Homo sapiens
actcagaactgtccc

SEQ ID NO: 988713 - DNA, 23 bp, Homo sapiens
actcagaactgtcccatccccag

SEQ ID NO: 988714 - DNA, 14 bp, Homo sapiens
actcagaagagaaa

SEQ ID NO: 988715 - DNA, 23 bp, Homo sapiens
actcagaagagaaatacagctgg

SEQ ID NO: 988716 - DNA, 17 bp, Homo sapiens
actcagaatataacatg

SEQ ID NO: 988717 - DNA, 23 bp, Homo sapiens
actcagaatataacatgtaaaat

SEQ ID NO: 988718 - DNA, 18 bp, Homo sapiens
actcagaattatttttaa

SEQ ID NO: 988719 - DNA, 21 bp, Homo sapiens
actcagaattctctagtttga

SEQ ID NO: 988720 - DNA, 22 bp, Homo sapiens
actcagaattctctagtttgat

SEQ ID NO: 988721 - DNA, 20 bp, Homo sapiens
ctgtgttcgggggagcagag

SEQ ID NO: 988722 - DNA, 23 bp, Homo sapiens
ctgtgttcgggggagcagagaga

SEQ ID NO: 988723 - DNA, 14 bp, Homo sapiens
ctgtgttgactgct

SEQ ID NO: 988724 - DNA, 17 bp, Homo sapiens
ctgtgttgactgctgct

SEQ ID NO: 988725 - DNA, 18 bp, Homo sapiens
ctgtgttgactgctgctc

SEQ ID NO: 988726 - DNA, 13 bp, Homo sapiens
ctgtgttgccaag

SEQ ID NO: 988727 - DNA, 16 bp, Homo sapiens
ctgtgttgccaagctc

SEQ ID NO: 988728 - DNA, 21 bp, Homo sapiens
ctgtgttgccaagctccaagc

SEQ ID NO: 988729 - DNA, 22 bp, Homo sapiens
ctgtgttgccacagtagaactg

SEQ ID NO: 988730 - DNA, 18 bp, Homo sapiens
ctgtgttgcgtgtcgtgg

SEQ ID NO: 988731 - DNA, 13 bp, Homo sapiens
ctgtgttgtatta

SEQ ID NO: 988732 - DNA, 19 bp, Homo sapiens
ctgtgttgtattaacaaaa

SEQ ID NO: 988733 - DNA, 13 bp, Homo sapiens
ctgtgtttagttg

SEQ ID NO: 988734 - DNA, 19 bp, Homo sapiens
ctgtgtttcaagtggggct

SEQ ID NO: 988735 - DNA, 18 bp, Homo sapiens
ctgtgtttcacttaatgt

SEQ ID NO: 988736 - DNA, 21 bp, Homo sapiens
ctgtgtttccaaaggttcccc

SEQ ID NO: 988737 - DNA, 20 bp, Homo sapiens
ctgtgtttgcagcctgctct

SEQ ID NO: 988738 - DNA, 23 bp, Homo sapiens
ctgttaaaaaagaaatctgtttc

SEQ ID NO: 988739 - DNA, 17 bp, Homo sapiens
ctgttaaaatgtacact

SEQ ID NO: 988740 - DNA, 23 bp, Homo sapiens
ctgttaaacagtagttgtattct

SEQ ID NO: 988741 - DNA, 14 bp, Homo sapiens
ctgttaaactgtta

SEQ ID NO: 988742 - DNA, 23 bp, Homo sapiens
ctgttaaactgttagcactgttg

SEQ ID NO: 988743 - DNA, 14 bp, Homo sapiens
ctgttaaatataca

SEQ ID NO: 988744 - DNA, 16 bp, Homo sapiens
ctgttaaatatacact

SEQ ID NO: 988745 - DNA, 15 bp, Homo sapiens
ctgttaactgaatac

SEQ ID NO: 988746 - DNA, 21 bp, Homo sapiens
ctgttaatacacagtacttta

SEQ ID NO: 988747 - DNA, 18 bp, Homo sapiens
ctgttacacgtgcctgta

SEQ ID NO: 988748 - DNA, 19 bp, Homo sapiens
ctgttacacgtgcctgtag

SEQ ID NO: 988749 - DNA, 15 bp, Homo sapiens
ctgttacagtaatgt

SEQ ID NO: 988750 - DNA, 16 bp, Homo sapiens
ctgttaccatgtcact

SEQ ID NO: 988751 - DNA, 17 bp, Homo sapiens
ctgttacccaggctgga

SEQ ID NO: 988752 - DNA, 22 bp, Homo sapiens
ctgttaccccatcctccctccc

SEQ ID NO: 988753 - DNA, 22 bp, Homo sapiens
ctgttacctcaacaagaagaat

SEQ ID NO: 988754 - DNA, 21 bp, Homo sapiens
ctgttactaaatccttttgtt

SEQ ID NO: 988755 - DNA, 23 bp, Homo sapiens
ctgttactctaaatagaaatata

SEQ ID NO: 988756 - DNA, 20 bp, Homo sapiens
ctgttactgcttctctttgt

SEQ ID NO: 988757 - DNA, 13 bp, Homo sapiens
ctgttactgtctt

SEQ ID NO: 988758 - DNA, 21 bp, Homo sapiens
ctgttacttgaaataccagtg

SEQ ID NO: 988759 - DNA, 15 bp, Homo sapiens
ctgttacttgcttca

SEQ ID NO: 988760 - DNA, 13 bp, Homo sapiens
ctgttagatgctg

SEQ ID NO: 988761 - DNA, 15 bp, Homo sapiens
ctgttagcactgttg

SEQ ID NO: 988762 - DNA, 17 bp, Homo sapiens
ctgttagcactgttgat

SEQ ID NO: 988763 - DNA, 20 bp, Homo sapiens
ctgttagcactgttgatgta

SEQ ID NO: 988764 - DNA, 13 bp, Homo sapiens
ctgttagcagaca

SEQ ID NO: 988765 - DNA, 14 bp, Homo sapiens
ctgttagcagagtc

SEQ ID NO: 988766 - DNA, 23 bp, Homo sapiens
ctgttagcagagtctgtctcttg

SEQ ID NO: 988767 - DNA, 12 bp, Homo sapiens
ctgttagccagg

SEQ ID NO: 988768 - DNA, 14 bp, Homo sapiens
ctgttagggccttg

SEQ ID NO: 988769 - DNA, 14 bp, Homo sapiens
ctgttagtcatttg

SEQ ID NO: 988770 - DNA, 12 bp, Homo sapiens
ctgttagttttg

SEQ ID NO: 988771 - DNA, 17 bp, Homo sapiens
ctgttatatatctcttt

SEQ ID NO: 988772 - DNA, 19 bp, Homo sapiens
ctgttatcaaaactttctt

SEQ ID NO: 988773 - DNA, 15 bp, Homo sapiens
ctgttatgattctga

SEQ ID NO: 988774 - DNA, 14 bp, Homo sapiens
ctgttatgctgtga

SEQ ID NO: 988775 - DNA, 19 bp, Homo sapiens
ctgttattatatttgacat

SEQ ID NO: 988776 - DNA, 23 bp, Homo sapiens
ctgttcaatgtttttaaaaatct

SEQ ID NO: 988777 - DNA, 22 bp, Homo sapiens
ctgttcacaaactacctctgga

SEQ ID NO: 988778 - DNA, 14 bp, Homo sapiens
ctgttcacactgca

SEQ ID NO: 988779 - DNA, 20 bp, Homo sapiens
ctgttcacactgcagagact

SEQ ID NO: 988780 - DNA, 13 bp, Homo sapiens
ctgttcactctac

SEQ ID NO: 988781 - DNA, 17 bp, Homo sapiens
ctgttcagaaagcaata

SEQ ID NO: 988782 - DNA, 14 bp, Homo sapiens
ctgttcagatgtgc

SEQ ID NO: 988783 - DNA, 15 bp, Homo sapiens
ctgttcagatgtgca

SEQ ID NO: 988784 - DNA, 17 bp, Homo sapiens
ctgttcagatgtgcatt

SEQ ID NO: 988785 - DNA, 21 bp, Homo sapiens
ctgttcagctggttgaggttt

SEQ ID NO: 988786 - DNA, 20 bp, Homo sapiens
ctgttcagggcatcggcagc

SEQ ID NO: 988787 - DNA, 16 bp, Homo sapiens
ctgttcagtaataaaa

SEQ ID NO: 988788 - DNA, 20 bp, Homo sapiens
ctgttcagtgtcccgggccc

SEQ ID NO: 988789 - DNA, 14 bp, Homo sapiens
ctgttccaaattca

SEQ ID NO: 988790 - DNA, 17 bp, Homo sapiens
ctgttccaaattcagtt

SEQ ID NO: 988791 - DNA, 22 bp, Homo sapiens
ctgttccaaattcagtttcata

SEQ ID NO: 988792 - DNA, 15 bp, Homo sapiens
ctgttccagactcag

SEQ ID NO: 988793 - DNA, 17 bp, Homo sapiens
ctgttccaggccctcca

SEQ ID NO: 988794 - DNA, 13 bp, Homo sapiens
ctgttcccaagga

SEQ ID NO: 988795 - DNA, 16 bp, Homo sapiens
ctgttccccaaatggc

SEQ ID NO: 988796 - DNA, 15 bp, Homo sapiens
ctgttcccccaccct

SEQ ID NO: 988797 - DNA, 19 bp, Homo sapiens
ctgttccccctgccgcagg

SEQ ID NO: 988798 - DNA, 17 bp, Homo sapiens
ctgttccccctgtgcag

SEQ ID NO: 988799 - DNA, 17 bp, Homo sapiens
ctgttcccccttcacaa

SEQ ID NO: 988800 - DNA, 17 bp, Homo sapiens
ctgttcccctcacccaa

SEQ ID NO: 988801 - DNA, 17 bp, Homo sapiens
ctgttcccctcactgga

SEQ ID NO: 988802 - DNA, 17 bp, Homo sapiens
ctgttccctctgctcct

SEQ ID NO: 988803 - DNA, 20 bp, Homo sapiens
ctgttccctctgctcctgga

SEQ ID NO: 988804 - DNA, 13 bp, Homo sapiens
ctgttccctctgg

SEQ ID NO: 988805 - DNA, 17 bp, Homo sapiens
ctgttccctctggcttc

SEQ ID NO: 988806 - DNA, 18 bp, Homo sapiens
ctgttcccttgtggcttg

SEQ ID NO: 988807 - DNA, 14 bp, Homo sapiens
ctgttccctttgcc

SEQ ID NO: 988808 - DNA, 14 bp, Homo sapiens
ctgttcctgtgttc

SEQ ID NO: 988809 - DNA, 15 bp, Homo sapiens
ctgttccttagacct

SEQ ID NO: 988810 - DNA, 21 bp, Homo sapiens
ctgttccttatttctctctcc

SEQ ID NO: 988811 - DNA, 23 bp, Homo sapiens
ctgttccttatttctctctcctg

SEQ ID NO: 988812 - DNA, 15 bp, Homo sapiens
ctgttccttcacatc

SEQ ID NO: 988813 - DNA, 21 bp, Homo sapiens
ctgttccttcacatcctgtgt

SEQ ID NO: 988814 - DNA, 18 bp, Homo sapiens
ctgttccttcctccactg

SEQ ID NO: 988815 - DNA, 14 bp, Homo sapiens
ctgttccttttata

SEQ ID NO: 988816 - DNA, 16 bp, Homo sapiens
ctgttcgctcctccca

SEQ ID NO: 988817 - DNA, 17 bp, Homo sapiens
ctgttcgctcctcccag

SEQ ID NO: 988818 - DNA, 13 bp, Homo sapiens
ctgttcggaaggg

SEQ ID NO: 988819 - DNA, 15 bp, Homo sapiens
ctgttctaacatgta

SEQ ID NO: 988820 - DNA, 19 bp, Homo sapiens
ctgttctacatagatgctt

SEQ ID NO: 988821 - DNA, 14 bp, Homo sapiens
ctgttctagttttt

SEQ ID NO: 988822 - DNA, 16 bp, Homo sapiens
cattgatacaaagtac

SEQ ID NO: 988823 - DNA, 15 bp, Homo sapiens
cattgatagaactac

SEQ ID NO: 988824 - DNA, 23 bp, Homo sapiens
cattgatcatttttatatgaaat

SEQ ID NO: 988825 - DNA, 21 bp, Homo sapiens
cattgatgtaatttaaaactt

SEQ ID NO: 988826 - DNA, 18 bp, Homo sapiens
cattgattgtcagctact

SEQ ID NO: 988827 - DNA, 14 bp, Homo sapiens
cattgcacctatct

SEQ ID NO: 988828 - DNA, 21 bp, Homo sapiens
cattgcacctatctcagccat

SEQ ID NO: 988829 - DNA, 18 bp, Homo sapiens
cattgcactcccgcctgg

SEQ ID NO: 988830 - DNA, 18 bp, Homo sapiens
cattgcactctagcctgg

SEQ ID NO: 988831 - DNA, 19 bp, Homo sapiens
cattgcagccttgcgctgt

SEQ ID NO: 988832 - DNA, 22 bp, Homo sapiens
cattgcagccttgcgctgtccc

SEQ ID NO: 988833 - DNA, 13 bp, Homo sapiens
cattgccaccagg

SEQ ID NO: 988834 - DNA, 14 bp, Homo sapiens
cattgccaccagga

SEQ ID NO: 988835 - DNA, 15 bp, Homo sapiens
cattgccaccaggag

SEQ ID NO: 988836 - DNA, 16 bp, Homo sapiens
cattgccaccaggaga

SEQ ID NO: 988837 - DNA, 20 bp, Homo sapiens
cattgccaccaggagaacca

SEQ ID NO: 988838 - DNA, 20 bp, Homo sapiens
cattgccatgaatttctacc

SEQ ID NO: 988839 - DNA, 21 bp, Homo sapiens
cattgccccagacctggaaga

SEQ ID NO: 988840 - DNA, 12 bp, Homo sapiens
cattgccctggt

SEQ ID NO: 988841 - DNA, 21 bp, Homo sapiens
cattgccgtggcatcttaaaa

SEQ ID NO: 988842 - DNA, 17 bp, Homo sapiens
cattgcctgttctgctt

SEQ ID NO: 988843 - DNA, 16 bp, Homo sapiens
cggtttagatgaatgc

SEQ ID NO: 988844 - DNA, 16 bp, Homo sapiens
cggtttcccggccctt

SEQ ID NO: 988845 - DNA, 17 bp, Homo sapiens
cggtttctagcctctga

SEQ ID NO: 988846 - DNA, 11 bp, Homo sapiens
cggtttctcca

SEQ ID NO: 988847 - DNA, 13 bp, Homo sapiens
cggtttctgagca

SEQ ID NO: 988848 - DNA, 20 bp, Homo sapiens
cggtttgccatgttgccaga

SEQ ID NO: 988849 - DNA, 12 bp, Homo sapiens
cggtttgtgaga

SEQ ID NO: 988850 - DNA, 16 bp, Homo sapiens
cggttttactgcagct

SEQ ID NO: 988851 - DNA, 14 bp, Homo sapiens
cgtaaagaattttc

SEQ ID NO: 988852 - DNA, 20 bp, Homo sapiens
cgtaaatacacaacacacac

SEQ ID NO: 988853 - DNA, 13 bp, Homo sapiens
cgtaagcagtata

SEQ ID NO: 988854 - DNA, 23 bp, Homo sapiens
cgtaagcagtatattagtattat

SEQ ID NO: 988855 - DNA, 14 bp, Homo sapiens
cgtaataattatta

SEQ ID NO: 988856 - DNA, 19 bp, Homo sapiens
cgtaataggaatcaccctc

SEQ ID NO: 988857 - DNA, 13 bp, Homo sapiens
cgtaatgcttaga

SEQ ID NO: 988858 - DNA, 21 bp, Homo sapiens
cgtaatgcttagagaatgttc

SEQ ID NO: 988859 - DNA, 17 bp, Homo sapiens
cgtaatgggcctgccca

SEQ ID NO: 988860 - DNA, 16 bp, Homo sapiens
cgtaattaaaagaatt

SEQ ID NO: 988861 - DNA, 13 bp, Homo sapiens
cgtacacagagaa

SEQ ID NO: 988862 - DNA, 17 bp, Homo sapiens
cgtacattcaatgttta

SEQ ID NO: 988863 - DNA, 15 bp, Homo sapiens
cgtaccccaccctca

SEQ ID NO: 988864 - DNA, 15 bp, Homo sapiens
cgtacgcccaggaca

SEQ ID NO: 988865 - DNA, 18 bp, Homo sapiens
cgtactacggagaaactc

SEQ ID NO: 988866 - DNA, 21 bp, Homo sapiens
cgtactaggttggacagcccc

SEQ ID NO: 988867 - DNA, 22 bp, Homo sapiens
cgtactaggttggacagccccc

SEQ ID NO: 988868 - DNA, 13 bp, Homo sapiens
cgtactccactgg

SEQ ID NO: 988869 - DNA, 18 bp, Homo sapiens
cgtactcggcttcctgtg

SEQ ID NO: 988870 - DNA, 12 bp, Homo sapiens
cgtactgtaact

SEQ ID NO: 988871 - DNA, 14 bp, Homo sapiens
cgtacttataaaga

SEQ ID NO: 988872 - DNA, 13 bp, Homo sapiens
cgtagaagctctt

SEQ ID NO: 988873 - DNA, 14 bp, Homo sapiens
cgtagaagctcttg

SEQ ID NO: 988874 - DNA, 13 bp, Homo sapiens
cgtagagaatgtg

SEQ ID NO: 988875 - DNA, 22 bp, Homo sapiens
cgtagcttctaccatgaacaga

SEQ ID NO: 988876 - DNA, 21 bp, Homo sapiens
cgtaggcagcctctctgctat

SEQ ID NO: 988877 - DNA, 12 bp, Homo sapiens
cgtaggtaaact

SEQ ID NO: 988878 - DNA, 13 bp, Homo sapiens
cgtagtctcctgg

SEQ ID NO: 988879 - DNA, 14 bp, Homo sapiens
cgtagttccctgaa

SEQ ID NO: 988880 - DNA, 22 bp, Homo sapiens
cgtagttccctgaaaacccaga

SEQ ID NO: 988881 - DNA, 16 bp, Homo sapiens
cgtataatgctttctg

SEQ ID NO: 988882 - DNA, 16 bp, Homo sapiens
cgtataggcatgtaaa

SEQ ID NO: 988883 - DNA, 16 bp, Homo sapiens
cgtatcccgagtctgg

SEQ ID NO: 988884 - DNA, 19 bp, Homo sapiens
cgtatctccctggagaagc

SEQ ID NO: 988885 - DNA, 21 bp, Homo sapiens
cgtatctccctggagaagcac

SEQ ID NO: 988886 - DNA, 20 bp, Homo sapiens
cgtatctgtcacaataaatg

SEQ ID NO: 988887 - DNA, 14 bp, Homo sapiens
cgtatgaatgatat

SEQ ID NO: 988888 - DNA, 17 bp, Homo sapiens
cgtatgaatgatatctt

SEQ ID NO: 988889 - DNA, 16 bp, Homo sapiens
cgtatgtctgttacca

SEQ ID NO: 988890 - DNA, 23 bp, Homo sapiens
cgtatttaatagcaaagaattga

SEQ ID NO: 988891 - DNA, 16 bp, Homo sapiens
cgtatttatatttgga

SEQ ID NO: 988892 - DNA, 21 bp, Homo sapiens
cgtcaaaacagattgtttgca

SEQ ID NO: 988893 - DNA, 12 bp, Homo sapiens
cgtcaagacatt

SEQ ID NO: 988894 - DNA, 13 bp, Homo sapiens
cgtcaccaccacc

SEQ ID NO: 988895 - DNA, 14 bp, Homo sapiens
cgtcaccacctctc

SEQ ID NO: 988896 - DNA, 18 bp, Homo sapiens
cgtcaccacgactggcca

SEQ ID NO: 988897 - DNA, 19 bp, Homo sapiens
cgtcaccatccaccttccc

SEQ ID NO: 988898 - DNA, 16 bp, Homo sapiens
cgtcacgctccctgac

SEQ ID NO: 988899 - DNA, 19 bp, Homo sapiens
cgtcacgctttcatgacca

SEQ ID NO: 988900 - DNA, 20 bp, Homo sapiens
cgtcactgcccaccaaaggt

SEQ ID NO: 988901 - DNA, 21 bp, Homo sapiens
cgtcagccacctgggaacaca

SEQ ID NO: 988902 - DNA, 19 bp, Homo sapiens
cgtcagcgggcgctgctgg

SEQ ID NO: 988903 - DNA, 20 bp, Homo sapiens
cgtcagctgcttctgctgcc

SEQ ID NO: 988904 - DNA, 14 bp, Homo sapiens
cgtcaggccctgac

SEQ ID NO: 988905 - DNA, 21 bp, Homo sapiens
cgtcagggagaggtcaccagc

SEQ ID NO: 988906 - DNA, 19 bp, Homo sapiens
cgtcagtttcactccctct

SEQ ID NO: 988907 - DNA, 22 bp, Homo sapiens
cgtcagtttcactccctcttgg

SEQ ID NO: 988908 - DNA, 16 bp, Homo sapiens
cgtcatccatgccctc

SEQ ID NO: 988909 - DNA, 19 bp, Homo sapiens
cgtcatccatgccctccca

SEQ ID NO: 988910 - DNA, 13 bp, Homo sapiens
cgtcatgtctcta

SEQ ID NO: 988911 - DNA, 15 bp, Homo sapiens
cgtcatgttcctcaa

SEQ ID NO: 988912 - DNA, 15 bp, Homo sapiens
cgtcattgctgctgc

SEQ ID NO: 988913 - DNA, 16 bp, Homo sapiens
cgtcattgctgctgct

SEQ ID NO: 988914 - DNA, 20 bp, Homo sapiens
cgtcattgctgctgctacca

SEQ ID NO: 988915 - DNA, 19 bp, Homo sapiens
cgtccacaggggcaggcct

SEQ ID NO: 988916 - DNA, 20 bp, Homo sapiens
cgtccacaggggcaggcctg

SEQ ID NO: 988917 - DNA, 22 bp, Homo sapiens
cgtccacaggggcaggcctggg

SEQ ID NO: 988918 - DNA, 13 bp, Homo sapiens
cgtccacccaggc

SEQ ID NO: 988919 - DNA, 12 bp, Homo sapiens
cgtccaccccag

SEQ ID NO: 988920 - DNA, 14 bp, Homo sapiens
cgtccacccttcca

SEQ ID NO: 988921 - DNA, 21 bp, Homo sapiens
cgtccagccgccattgccacc

SEQ ID NO: 988922 - DNA, 17 bp, Homo sapiens
cgtccagctgcccttcc

SEQ ID NO: 988923 - DNA, 21 bp, Homo sapiens
cgtccaggttcaacccacagc

SEQ ID NO: 988924 - DNA, 19 bp, Homo sapiens
cgtccatccgactgcccct

SEQ ID NO: 988925 - DNA, 16 bp, Homo sapiens
cgtccatggcaccagc

SEQ ID NO: 988926 - DNA, 17 bp, Homo sapiens
cgtccatggcaccagcc

SEQ ID NO: 988927 - DNA, 18 bp, Homo sapiens
cgtccatggcaccagccc

SEQ ID NO: 988928 - DNA, 15 bp, Homo sapiens
cgtcccagcatccct

SEQ ID NO: 988929 - DNA, 14 bp, Homo sapiens
cgtcccagcggcct

SEQ ID NO: 988930 - DNA, 15 bp, Homo sapiens
cgtcccagggctctg

SEQ ID NO: 988931 - DNA, 17 bp, Homo sapiens
cgtcccatatcctgcct

SEQ ID NO: 988932 - DNA, 16 bp, Homo sapiens
cgtccccaaacctagc

SEQ ID NO: 988933 - DNA, 14 bp, Homo sapiens
cgtccccactccct

SEQ ID NO: 988934 - DNA, 17 bp, Homo sapiens
cgtccccccccaacctt

SEQ ID NO: 988935 - DNA, 22 bp, Homo sapiens
cgtccccccccaacctttccct

SEQ ID NO: 988936 - DNA, 21 bp, Homo sapiens
cgtccccccccaggccctccc

SEQ ID NO: 988937 - DNA, 13 bp, Homo sapiens
cgtccccctccct

SEQ ID NO: 988938 - DNA, 16 bp, Homo sapiens
cgtccccctccctgcc

SEQ ID NO: 988939 - DNA, 14 bp, Homo sapiens
cgtcccctctcccc

SEQ ID NO: 988940 - DNA, 13 bp, Homo sapiens
cgtcccctgcagc

SEQ ID NO: 988941 - DNA, 14 bp, Homo sapiens
cgtcccctgcagcc

SEQ ID NO: 988942 - DNA, 18 bp, Homo sapiens
cgtcccctgcagcctggg

SEQ ID NO: 988943 - DNA, 13 bp, Homo sapiens
cgtcccctgctac

SEQ ID NO: 988944 - DNA, 15 bp, Homo sapiens
cgtcccgcacagtgg

SEQ ID NO: 988945 - DNA, 14 bp, Homo sapiens
cgtcccgccagtgc

SEQ ID NO: 988946 - DNA, 18 bp, Homo sapiens
cgtcccgctgcctcctgc

SEQ ID NO: 988947 - DNA, 14 bp, Homo sapiens
cgtcccgctgctgt

SEQ ID NO: 988948 - DNA, 15 bp, Homo sapiens
cgtcctccccctgcc

SEQ ID NO: 988949 - DNA, 17 bp, Homo sapiens
cgtcctccccctgccag

SEQ ID NO: 988950 - DNA, 14 bp, Homo sapiens
cgtcctccctcagc

SEQ ID NO: 988951 - DNA, 18 bp, Homo sapiens
cgtcctccctcagcctcc

SEQ ID NO: 988952 - DNA, 19 bp, Homo sapiens
cgtcctccctcagcctccc

SEQ ID NO: 988953 - DNA, 21 bp, Homo sapiens
cgtcctccctgatcccacccc

SEQ ID NO: 988954 - DNA, 12 bp, Homo sapiens
cgtcctcctctg

SEQ ID NO: 988955 - DNA, 14 bp, Homo sapiens
cgtcctcctctgtg

SEQ ID NO: 988956 - DNA, 20 bp, Homo sapiens
cgtcctgacgccctgcgttg

SEQ ID NO: 988957 - DNA, 14 bp, Homo sapiens
gttggcaaaaaggc

SEQ ID NO: 988958 - DNA, 14 bp, Homo sapiens
gttggcaagctgca

SEQ ID NO: 988959 - DNA, 15 bp, Homo sapiens
gttggcaagctgcag

SEQ ID NO: 988960 - DNA, 20 bp, Homo sapiens
gttggcactcacagacctgg

SEQ ID NO: 988961 - DNA, 22 bp, Homo sapiens
gttggcagagcttttgcatttc

SEQ ID NO: 988962 - DNA, 12 bp, Homo sapiens
gttggcaggccc

SEQ ID NO: 988963 - DNA, 14 bp, Homo sapiens
gttggcaggcccac

SEQ ID NO: 988964 - DNA, 16 bp, Homo sapiens
gttggcaggcccactc

SEQ ID NO: 988965 - DNA, 16 bp, Homo sapiens
gttggcaggctggcca

SEQ ID NO: 988966 - DNA, 20 bp, Homo sapiens
gttggcaggctggccagtcc

SEQ ID NO: 988967 - DNA, 19 bp, Homo sapiens
gttggcatagctctggggt

SEQ ID NO: 988968 - DNA, 16 bp, Homo sapiens
gttggccaagcagaaa

SEQ ID NO: 988969 - DNA, 19 bp, Homo sapiens
gttggccagattgtggggt

SEQ ID NO: 988970 - DNA, 21 bp, Homo sapiens
gttggccagattgtggggtgc

SEQ ID NO: 988971 - DNA, 13 bp, Homo sapiens
gttggccaggagg

SEQ ID NO: 988972 - DNA, 14 bp, Homo sapiens
gttggccaggctgg

SEQ ID NO: 988973 - DNA, 14 bp, Homo sapiens
gttggccatggtga

SEQ ID NO: 988974 - DNA, 18 bp, Homo sapiens
gttggcccttgtcttttc

SEQ ID NO: 988975 - DNA, 18 bp, Homo sapiens
gttggcgtgccctggagg

SEQ ID NO: 988976 - DNA, 14 bp, Homo sapiens
gttggctcaggcag

SEQ ID NO: 988977 - DNA, 15 bp, Homo sapiens
gttggctcaggcaga

SEQ ID NO: 988978 - DNA, 16 bp, Homo sapiens
gttggctgggcccaga

SEQ ID NO: 988979 - DNA, 19 bp, Homo sapiens
gttggctgtgtgacagaat

SEQ ID NO: 988980 - DNA, 12 bp, Homo sapiens
gttggctgtgtt

SEQ ID NO: 988981 - DNA, 13 bp, Homo sapiens
gttggctgttcca

SEQ ID NO: 988982 - DNA, 16 bp, Homo sapiens
gttggctttcataaat

SEQ ID NO: 988983 - DNA, 20 bp, Homo sapiens
gttggctttgcccacccctc

SEQ ID NO: 988984 - DNA, 17 bp, Homo sapiens
gttgggaaggggtcctg

SEQ ID NO: 988985 - DNA, 14 bp, Homo sapiens
gttgggactcagga

SEQ ID NO: 988986 - DNA, 14 bp, Homo sapiens
gttgggagcactgg

SEQ ID NO: 988987 - DNA, 15 bp, Homo sapiens
gttgggagcactgga

SEQ ID NO: 988988 - DNA, 18 bp, Homo sapiens
gttgggaggatacagagg

SEQ ID NO: 988989 - DNA, 19 bp, Homo sapiens
gttgggattcctgacccag

SEQ ID NO: 988990 - DNA, 21 bp, Homo sapiens
gttgggattgggggctggtgc

SEQ ID NO: 988991 - DNA, 19 bp, Homo sapiens
gttgggcagccagaccagc

SEQ ID NO: 988992 - DNA, 19 bp, Homo sapiens
gttgggccgaaagagagag

SEQ ID NO: 988993 - DNA, 12 bp, Homo sapiens
gttggggaaggc

SEQ ID NO: 988994 - DNA, 14 bp, Homo sapiens
gttggggcaaagcc

SEQ ID NO: 988995 - DNA, 17 bp, Homo sapiens
gttggggcaaagcctcc

SEQ ID NO: 988996 - DNA, 16 bp, Homo sapiens
tgtgttgccaagctcc

SEQ ID NO: 988997 - DNA, 13 bp, Homo sapiens
tgtgttggaaact

SEQ ID NO: 988998 - DNA, 12 bp, Homo sapiens
tgtgttgtatta

SEQ ID NO: 988999 - DNA, 21 bp, Homo sapiens
tgtgttgtgtgagcgtggcct

SEQ ID NO: 989000 - DNA, 13 bp, Homo sapiens
tgtgttgttgctt

SEQ ID NO: 989001 - DNA, 13 bp, Homo sapiens
tgtgttgtttaat

SEQ ID NO: 989002 - DNA, 19 bp, Homo sapiens
tgtgttgttttttgttcaa

SEQ ID NO: 989003 - DNA, 23 bp, Homo sapiens
tgtgtttaaaaattgaaaaaagt

SEQ ID NO: 989004 - DNA, 13 bp, Homo sapiens
tgtgtttactttt

SEQ ID NO: 989005 - DNA, 15 bp, Homo sapiens
tgtgtttaggcctca

SEQ ID NO: 989006 - DNA, 21 bp, Homo sapiens
tgtgtttcaaaaccatgcctg

SEQ ID NO: 989007 - DNA, 22 bp, Homo sapiens
tgtgtttcgcattaagcacaca

SEQ ID NO: 989008 - DNA, 10 bp, Homo sapiens
tgtgtttcta

SEQ ID NO: 989009 - DNA, 14 bp, Homo sapiens
tgtgtttctgacac

SEQ ID NO: 989010 - DNA, 12 bp, Homo sapiens
tgtgtttgacat

SEQ ID NO: 989011 - DNA, 15 bp, Homo sapiens
tgtgtttgctgcctt

SEQ ID NO: 989012 - DNA, 17 bp, Homo sapiens
tgtgtttggcttggcct

SEQ ID NO: 989013 - DNA, 18 bp, Homo sapiens
tgtgtttggcttggcctt

SEQ ID NO: 989014 - DNA, 16 bp, Homo sapiens
tgtgtttgtcctgggt

SEQ ID NO: 989015 - DNA, 14 bp, Homo sapiens
tgtgtttgttccta

SEQ ID NO: 989016 - DNA, 20 bp, Homo sapiens
tgtgtttgttctttttattg

SEQ ID NO: 989017 - DNA, 21 bp, Homo sapiens
tgtgttttaaaaaaactgaag

SEQ ID NO: 989018 - DNA, 20 bp, Homo sapiens
tgtgttttaattttctttat

SEQ ID NO: 989019 - DNA, 21 bp, Homo sapiens
tgtgttttaattttctttatg

SEQ ID NO: 989020 - DNA, 20 bp, Homo sapiens
tgtgttttcccaaagcactt

SEQ ID NO: 989021 - DNA, 13 bp, Homo sapiens
tgtgttttctgta

SEQ ID NO: 989022 - DNA, 15 bp, Homo sapiens
tgtgttttctttggt

SEQ ID NO: 989023 - DNA, 23 bp, Homo sapiens
tgtgttttgcacgtcttgctatt

SEQ ID NO: 989024 - DNA, 16 bp, Homo sapiens
tgtgttttggttaata

SEQ ID NO: 989025 - DNA, 18 bp, Homo sapiens
tgtgttttgtcctgcctc

SEQ ID NO: 989026 - DNA, 15 bp, Homo sapiens
tgtgtttttaataaa

SEQ ID NO: 989027 - DNA, 14 bp, Homo sapiens
tgtgtttttattgt

SEQ ID NO: 989028 - DNA, 13 bp, Homo sapiens
tgtgtttttgaaa

SEQ ID NO: 989029 - DNA, 17 bp, Homo sapiens
tgtgttttttaagatag

SEQ ID NO: 989030 - DNA, 19 bp, Homo sapiens
tgttaaaaaatttttgaaa

SEQ ID NO: 989031 - DNA, 15 bp, Homo sapiens
tgttaaaagattttt

SEQ ID NO: 989032 - DNA, 15 bp, Homo sapiens
tgttaaaatgtacac

SEQ ID NO: 989033 - DNA, 21 bp, Homo sapiens
tgttaaaattatcaatatcta

SEQ ID NO: 989034 - DNA, 20 bp, Homo sapiens
tgttaaacagtagttgtatt

SEQ ID NO: 989035 - DNA, 19 bp, Homo sapiens
tgttaaagctggaacattt

SEQ ID NO: 989036 - DNA, 17 bp, Homo sapiens
tgttaaagctgtacacc

SEQ ID NO: 989037 - DNA, 12 bp, Homo sapiens
tgttaaagctta

SEQ ID NO: 989038 - DNA, 16 bp, Homo sapiens
tgttaaatacaggaaa

SEQ ID NO: 989039 - DNA, 18 bp, Homo sapiens
tgttaaatacaggaaaca

SEQ ID NO: 989040 - DNA, 12 bp, Homo sapiens
tgttaaatactg

SEQ ID NO: 989041 - DNA, 14 bp, Homo sapiens
tgttaaatactgtg

SEQ ID NO: 989042 - DNA, 16 bp, Homo sapiens
tgttaaatactgtgca

SEQ ID NO: 989043 - DNA, 14 bp, Homo sapiens
tgttaaatgaaacc

SEQ ID NO: 989044 - DNA, 12 bp, Homo sapiens
tgttaaattcat

SEQ ID NO: 989045 - DNA, 16 bp, Homo sapiens
tgttaaattcatttta

SEQ ID NO: 989046 - DNA, 21 bp, Homo sapiens
tgttaacaagaggggaaaaca

SEQ ID NO: 989047 - DNA, 14 bp, Homo sapiens
tgttaacaatgcct

SEQ ID NO: 989048 - DNA, 15 bp, Homo sapiens
tgttaacagtatttc

SEQ ID NO: 989049 - DNA, 21 bp, Homo sapiens
tgttaacatggacatgatctt

SEQ ID NO: 989050 - DNA, 15 bp, Homo sapiens
tgttaacctcagtgt

SEQ ID NO: 989051 - DNA, 17 bp, Homo sapiens
tgttaaccttaaataca

SEQ ID NO: 989052 - DNA, 14 bp, Homo sapiens
tgttaactgaatac

SEQ ID NO: 989053 - DNA, 22 bp, Homo sapiens
tgttaactgaataccactctgt

SEQ ID NO: 989054 - DNA, 13 bp, Homo sapiens
tgttaactgccaa

SEQ ID NO: 989055 - DNA, 15 bp, Homo sapiens
tgttaacttattcaa

SEQ ID NO: 989056 - DNA, 23 bp, Homo sapiens
tgttaacttattcaaagagaaaa

SEQ ID NO: 989057 - DNA, 19 bp, Homo sapiens
tgttaagaaaaactacagc

SEQ ID NO: 989058 - DNA, 23 bp, Homo sapiens
tgttaagaattgaccatctgctt

SEQ ID NO: 989059 - DNA, 17 bp, Homo sapiens
tgttaagacttgacagt

SEQ ID NO: 989060 - DNA, 21 bp, Homo sapiens
tgttaagataacttactgtat

SEQ ID NO: 989061 - DNA, 23 bp, Homo sapiens
tgttaagcagctaaattttctga

SEQ ID NO: 989062 - DNA, 20 bp, Homo sapiens
tgttaaggacttctgcagct

SEQ ID NO: 989063 - DNA, 16 bp, Homo sapiens
tgttaagggcattttt

SEQ ID NO: 989064 - DNA, 19 bp, Homo sapiens
tgttaatacacagtacttt

SEQ ID NO: 989065 - DNA, 20 bp, Homo sapiens
tgttaatacacagtacttta

SEQ ID NO: 989066 - DNA, 21 bp, Homo sapiens
tgttaatacacagtactttat

SEQ ID NO: 989067 - DNA, 20 bp, Homo sapiens
tgttaatataccccaaattg

SEQ ID NO: 989068 - DNA, 16 bp, Homo sapiens
tgttaatatcttcaca

SEQ ID NO: 989069 - DNA, 17 bp, Homo sapiens
tgttaatcttaatgtat

SEQ ID NO: 989070 - DNA, 16 bp, Homo sapiens
tgttaatgctctatgt

SEQ ID NO: 989071 - DNA, 17 bp, Homo sapiens
tgttaatgtcattgcta

SEQ ID NO: 989072 - DNA, 18 bp, Homo sapiens
tgttaattataggagcct

SEQ ID NO: 989073 - DNA, 22 bp, Homo sapiens
tgttaattcagcactgatttca

SEQ ID NO: 989074 - DNA, 15 bp, Homo sapiens
tgttaatttagaaaa

SEQ ID NO: 989075 - DNA, 18 bp, Homo sapiens
tgttaatttagaaaactt

SEQ ID NO: 989076 - DNA, 20 bp, Homo sapiens
tgttaatttagaaaacttta

SEQ ID NO: 989077 - DNA, 14 bp, Homo sapiens
tgttaatttataat

SEQ ID NO: 989078 - DNA, 18 bp, Homo sapiens
tgttaatttataatgtat

SEQ ID NO: 989079 - DNA, 19 bp, Homo sapiens
tgttaatttataatgtatt

SEQ ID NO: 989080 - DNA, 21 bp, Homo sapiens
tctcctgctgccttttctgga

SEQ ID NO: 989081 - DNA, 15 bp, Homo sapiens
tctcctgctgctcct

SEQ ID NO: 989082 - DNA, 17 bp, Homo sapiens
tctcctggaggcagggg

SEQ ID NO: 989083 - DNA, 18 bp, Homo sapiens
tctcctggaggcaggggc

SEQ ID NO: 989084 - DNA, 23 bp, Homo sapiens
tctcctggaggctggttctgctg

SEQ ID NO: 989085 - DNA, 21 bp, Homo sapiens
tctcctggcctatccgctgcc

SEQ ID NO: 989086 - DNA, 23 bp, Homo sapiens
tctcctggcctatccgctgccag

SEQ ID NO: 989087 - DNA, 21 bp, Homo sapiens
tctcctgggaaacctgccttt

SEQ ID NO: 989088 - DNA, 18 bp, Homo sapiens
tctcctgggggtggcagg

SEQ ID NO: 989089 - DNA, 22 bp, Homo sapiens
tctcctgggggtggcaggcaca

SEQ ID NO: 989090 - DNA, 15 bp, Homo sapiens
tctcctggtgttctg

SEQ ID NO: 989091 - DNA, 22 bp, Homo sapiens
tctcctgtcttatggtccagaa

SEQ ID NO: 989092 - DNA, 23 bp, Homo sapiens
tctcctgtcttatggtccagaaa

SEQ ID NO: 989093 - DNA, 12 bp, Homo sapiens
tctcctgtgacc

SEQ ID NO: 989094 - DNA, 23 bp, Homo sapiens
tctcctgtgcatgggtgaaggga

SEQ ID NO: 989095 - DNA, 17 bp, Homo sapiens
tctcctgtgcccacatc

SEQ ID NO: 989096 - DNA, 20 bp, Homo sapiens
tctcctgtttattcccatct

SEQ ID NO: 989097 - DNA, 13 bp, Homo sapiens
tctcctgtttgtt

SEQ ID NO: 989098 - DNA, 19 bp, Homo sapiens
tctcctgtttttctgggtg

SEQ ID NO: 989099 - DNA, 16 bp, Homo sapiens
tctccttacctctgga

SEQ ID NO: 989100 - DNA, 17 bp, Homo sapiens
tctccttacctctggaa

SEQ ID NO: 989101 - DNA, 18 bp, Homo sapiens
tctccttactctgagccc

SEQ ID NO: 989102 - DNA, 19 bp, Homo sapiens
tctccttactctgagccca

SEQ ID NO: 989103 - DNA, 21 bp, Homo sapiens
tctccttactctgagcccagg

SEQ ID NO: 989104 - DNA, 22 bp, Homo sapiens
tctccttactctgagcccaggc

SEQ ID NO: 989105 - DNA, 15 bp, Homo sapiens
tctccttagttggct

SEQ ID NO: 989106 - DNA, 18 bp, Homo sapiens
tctccttagttggctgga

SEQ ID NO: 989107 - DNA, 21 bp, Homo sapiens
tctccttcatgacagcctcca

SEQ ID NO: 989108 - DNA, 14 bp, Homo sapiens
tctccttccattca

SEQ ID NO: 989109 - DNA, 19 bp, Homo sapiens
tctccttcccctttcccca

SEQ ID NO: 989110 - DNA, 16 bp, Homo sapiens
tctccttctcctagct

SEQ ID NO: 989111 - DNA, 16 bp, Homo sapiens
tctccttggccacaga

SEQ ID NO: 989112 - DNA, 16 bp, Homo sapiens
tctccttgggctcctg

SEQ ID NO: 989113 - DNA, 19 bp, Homo sapiens
tctccttgggctcctggct

SEQ ID NO: 989114 - DNA, 21 bp, Homo sapiens
tctccttgggctcctggctgc

SEQ ID NO: 989115 - DNA, 22 bp, Homo sapiens
tctccttgggctcctggctgcc

SEQ ID NO: 989116 - DNA, 23 bp, Homo sapiens
tctccttgggctcctggctgcca

SEQ ID NO: 989117 - DNA, 21 bp, Homo sapiens
tctccttgtgttactaagttt

SEQ ID NO: 989118 - DNA, 14 bp, Homo sapiens
tctcctttcaggga

SEQ ID NO: 989119 - DNA, 14 bp, Homo sapiens
tctcctttcagggc

SEQ ID NO: 989120 - DNA, 14 bp, Homo sapiens
tctcctttctgact

SEQ ID NO: 989121 - DNA, 15 bp, Homo sapiens
tctcctttctgactg

SEQ ID NO: 989122 - DNA, 19 bp, Homo sapiens
tctcctttctgactgtccc

SEQ ID NO: 989123 - DNA, 22 bp, Homo sapiens
tctccttttatctggtgcctcc

SEQ ID NO: 989124 - DNA, 14 bp, Homo sapiens
tctccttttgaact

SEQ ID NO: 989125 - DNA, 17 bp, Homo sapiens
tctccttttgaacttgt

SEQ ID NO: 989126 - DNA, 19 bp, Homo sapiens
tctccttttgaacttgtca

SEQ ID NO: 989127 - DNA, 22 bp, Homo sapiens
tctcctttttattttaggcact

SEQ ID NO: 989128 - DNA, 14 bp, Homo sapiens
tctcgaactcctgg

SEQ ID NO: 989129 - DNA, 15 bp, Homo sapiens
tctcgagccccctgg

SEQ ID NO: 989130 - DNA, 14 bp, Homo sapiens
tctcgatctcctga

SEQ ID NO: 989131 - DNA, 13 bp, Homo sapiens
tctcgcagcctga

SEQ ID NO: 989132 - DNA, 15 bp, Homo sapiens
tctcgccatgatcag

SEQ ID NO: 989133 - DNA, 14 bp, Homo sapiens
tctcgcgccctccc

SEQ ID NO: 989134 - DNA, 17 bp, Homo sapiens
tctcgcgccctccccca

SEQ ID NO: 989135 - DNA, 17 bp, Homo sapiens
tctcgctctgttgccca

SEQ ID NO: 989136 - DNA, 17 bp, Homo sapiens
tctcggaaggctggctg

SEQ ID NO: 989137 - DNA, 16 bp, Homo sapiens
tctcggagccctcaga

SEQ ID NO: 989138 - DNA, 18 bp, Homo sapiens
tctcggatgaccaaacca

SEQ ID NO: 989139 - DNA, 20 bp, Homo sapiens
tctcggatgaccaaaccagc

SEQ ID NO: 989140 - DNA, 23 bp, Homo sapiens
tctcggccagcccgtcctcctct

SEQ ID NO: 989141 - DNA, 18 bp, Homo sapiens
tctcggccccatcgcccc

SEQ ID NO: 989142 - DNA, 14 bp, Homo sapiens
tctcgggagaggat

SEQ ID NO: 989143 - DNA, 14 bp, Homo sapiens
tctcgggtgcattt

SEQ ID NO: 989144 - DNA, 16 bp, Homo sapiens
tctcgtccccctccct

SEQ ID NO: 989145 - DNA, 22 bp, Homo sapiens
tctcgtccccctccctgcccaa

SEQ ID NO: 989146 - DNA, 14 bp, Homo sapiens
tctcgtctttactt

SEQ ID NO: 989147 - DNA, 17 bp, Homo sapiens
tctcgtggtagaagcca

SEQ ID NO: 989148 - DNA, 15 bp, Homo sapiens
tctcgtgtacagctc

SEQ ID NO: 989149 - DNA, 23 bp, Homo sapiens
tctcgtgtacagctcccttccct

SEQ ID NO: 989150 - DNA, 19 bp, Homo sapiens
tctcgtgtcagtaatttat

SEQ ID NO: 989151 - DNA, 15 bp, Homo sapiens
tctcgtgtttgctta

SEQ ID NO: 989152 - DNA, 12 bp, Homo sapiens
tctcgtttttct

SEQ ID NO: 989153 - DNA, 16 bp, Homo sapiens
tctctaaactggtaca

SEQ ID NO: 989154 - DNA, 14 bp, Homo sapiens
tctctaacagtgga

SEQ ID NO: 989155 - DNA, 20 bp, Homo sapiens
tctctaacagtggacaaagt

SEQ ID NO: 989156 - DNA, 22 bp, Homo sapiens
tctctaactcagaaacatcagt

SEQ ID NO: 989157 - DNA, 19 bp, Homo sapiens
tctctaacttcaccatatt

SEQ ID NO: 989158 - DNA, 13 bp, Homo sapiens
tctctaagccaca

SEQ ID NO: 989159 - DNA, 16 bp, Homo sapiens
tctctaagccacagct

SEQ ID NO: 989160 - DNA, 17 bp, Homo sapiens
tctctaagccacagctt

SEQ ID NO: 989161 - DNA, 16 bp, Homo sapiens
tctctaagttccactg

SEQ ID NO: 989162 - DNA, 15 bp, Homo sapiens
tctctaataataaat

SEQ ID NO: 989163 - DNA, 22 bp, Homo sapiens
tctctaataataaatagttctt

SEQ ID NO: 989164 - DNA, 23 bp, Homo sapiens
tctctaatgagctagtgtcttat

SEQ ID NO: 989165 - DNA, 15 bp, Homo sapiens
tctctacaaaaagca

SEQ ID NO: 989166 - DNA, 22 bp, Homo sapiens
tctctacaggcctcttcctgtt

SEQ ID NO: 989167 - DNA, 14 bp, Homo sapiens
tctctacagtgcca

SEQ ID NO: 989168 - DNA, 20 bp, Homo sapiens
tctctaccactgctgatatt

SEQ ID NO: 989169 - DNA, 12 bp, Homo sapiens
tctctacctcca

SEQ ID NO: 989170 - DNA, 17 bp, Homo sapiens
tctctacctccaccctg

SEQ ID NO: 989171 - DNA, 15 bp, Homo sapiens
tctctactaaaaata

SEQ ID NO: 989172 - DNA, 17 bp, Homo sapiens
tctctactaaaaatgca

SEQ ID NO: 989173 - DNA, 17 bp, Homo sapiens
tctctactaccacaagg

SEQ ID NO: 989174 - DNA, 20 bp, Homo sapiens
tctctactaccacaaggaaa

SEQ ID NO: 989175 - DNA, 12 bp, Homo sapiens
tctctactgaaa

SEQ ID NO: 989176 - DNA, 15 bp, Homo sapiens
tctctactggagtgg

SEQ ID NO: 989177 - DNA, 15 bp, Homo sapiens
tctctacttcccctt

SEQ ID NO: 989178 - DNA, 22 bp, Homo sapiens
tctctacttccccttcttgcca

SEQ ID NO: 989179 - DNA, 17 bp, Homo sapiens
tctctagaattttaagt

SEQ ID NO: 989180 - DNA, 14 bp, Homo sapiens
tctctagctcccca

SEQ ID NO: 989181 - DNA, 19 bp, Homo sapiens
tctctagctgttctggact

SEQ ID NO: 989182 - DNA, 19 bp, Homo sapiens
tctctgcatctactcccaa

SEQ ID NO: 989183 - DNA, 15 bp, Homo sapiens
tctctgcatctgacc

SEQ ID NO: 989184 - DNA, 16 bp, Homo sapiens
tctctgcatctgacca

SEQ ID NO: 989185 - DNA, 20 bp, Homo sapiens
tctctgcatttaaaaaaatc

SEQ ID NO: 989186 - DNA, 12 bp, Homo sapiens
tctctgccaccc

SEQ ID NO: 989187 - DNA, 13 bp, Homo sapiens
tctctgccaccca

SEQ ID NO: 989188 - DNA, 15 bp, Homo sapiens
tctctgccagtgaca

SEQ ID NO: 989189 - DNA, 23 bp, Homo sapiens
tctctgcctccctcaccctgagc

SEQ ID NO: 989190 - DNA, 15 bp, Homo sapiens
tctctgcctctcttc

SEQ ID NO: 989191 - DNA, 14 bp, Homo sapiens
tctctgcctgtaaa

SEQ ID NO: 989192 - DNA, 13 bp, Homo sapiens
tctctgctatata

SEQ ID NO: 989193 - DNA, 14 bp, Homo sapiens
tctctgctcatggg

SEQ ID NO: 989194 - DNA, 16 bp, Homo sapiens
tctctgctcatgggtg

SEQ ID NO: 989195 - DNA, 19 bp, Homo sapiens
tctctgctccaccacatcc

SEQ ID NO: 989196 - DNA, 22 bp, Homo sapiens
tctctgctcgccctcctttctg

SEQ ID NO: 989197 - DNA, 16 bp, Homo sapiens
tctctgctctagccag

SEQ ID NO: 989198 - DNA, 17 bp, Homo sapiens
tctctgctctagccagg

SEQ ID NO: 989199 - DNA, 21 bp, Homo sapiens
tctctgctctgcgtgtcacct

SEQ ID NO: 989200 - DNA, 21 bp, Homo sapiens
tctctgctgagctgggcccag

SEQ ID NO: 989201 - DNA, 14 bp, Homo sapiens
tctctgctgagggc

SEQ ID NO: 989202 - DNA, 15 bp, Homo sapiens
tctctgctgagggcc

SEQ ID NO: 989203 - DNA, 19 bp, Homo sapiens
tctctgctggcccagccaa

SEQ ID NO: 989204 - DNA, 17 bp, Homo sapiens
tctctgctggggaaggg

SEQ ID NO: 989205 - DNA, 15 bp, Homo sapiens
tctctgcttaccctt

SEQ ID NO: 989206 - DNA, 13 bp, Homo sapiens
tctctgcttaccg

SEQ ID NO: 989207 - DNA, 15 bp, Homo sapiens
tctctgcttgcctag

SEQ ID NO: 989208 - DNA, 14 bp, Homo sapiens
tctctgctttaaag

SEQ ID NO: 989209 - DNA, 13 bp, Homo sapiens
tctctgctttcct

SEQ ID NO: 989210 - DNA, 17 bp, Homo sapiens
tctcttctgctccaccc

SEQ ID NO: 989211 - DNA, 19 bp, Homo sapiens
tctcttctgctccaccctt

SEQ ID NO: 989212 - DNA, 20 bp, Homo sapiens
tctcttctgggttccttcct

SEQ ID NO: 989213 - DNA, 13 bp, Homo sapiens
tctcttctgtcca

SEQ ID NO: 989214 - DNA, 22 bp, Homo sapiens
tctcttcttccctgtcagcctg

SEQ ID NO: 989215 - DNA, 12 bp, Homo sapiens
tctcttcttgtt

SEQ ID NO: 989216 - DNA, 18 bp, Homo sapiens
tctcttctttattgcact

SEQ ID NO: 989217 - DNA, 13 bp, Homo sapiens
tctcttctttcca

SEQ ID NO: 989218 - DNA, 18 bp, Homo sapiens
tctcttcttttggcttcc

SEQ ID NO: 989219 - DNA, 14 bp, Homo sapiens
tctcttgagcctgg

SEQ ID NO: 989220 - DNA, 16 bp, Homo sapiens
tctcttgagctggcct

SEQ ID NO: 989221 - DNA, 14 bp, Homo sapiens
tctcttgaggcctg

SEQ ID NO: 989222 - DNA, 17 bp, Homo sapiens
tctcttgaggcctgtgc

SEQ ID NO: 989223 - DNA, 14 bp, Homo sapiens
tctcttgagtttgt

SEQ ID NO: 989224 - DNA, 15 bp, Homo sapiens
tctcttgcacccgcc

SEQ ID NO: 989225 - DNA, 13 bp, Homo sapiens
tctcttgcccctt

SEQ ID NO: 989226 - DNA, 15 bp, Homo sapiens
tctcttgccccttgt

SEQ ID NO: 989227 - DNA, 18 bp, Homo sapiens
tctcttgccccttgtcct

SEQ ID NO: 989228 - DNA, 12 bp, Homo sapiens
tctcttgccctt

SEQ ID NO: 989229 - DNA, 18 bp, Homo sapiens
tctcttgcccttcctact

SEQ ID NO: 989230 - DNA, 16 bp, Homo sapiens
tctcttgcctcagcct

SEQ ID NO: 989231 - DNA, 16 bp, Homo sapiens
tctcttggctttgtca

SEQ ID NO: 989232 - DNA, 23 bp, Homo sapiens
tctcttgggaactgaactcactt

SEQ ID NO: 989233 - DNA, 19 bp, Homo sapiens
tctcttgggagtcttgggt

SEQ ID NO: 989234 - DNA, 15 bp, Homo sapiens
tctcttgggcaggca

SEQ ID NO: 989235 - DNA, 17 bp, Homo sapiens
tctcttgggcaggcaga

SEQ ID NO: 989236 - DNA, 21 bp, Homo sapiens
tctcttggtgaaataataaaa

SEQ ID NO: 989237 - DNA, 16 bp, Homo sapiens
tctcttgtcctgtgat

SEQ ID NO: 989238 - DNA, 17 bp, Homo sapiens
tctcttgtgatttggtt

SEQ ID NO: 989239 - DNA, 16 bp, Homo sapiens
tctcttgtttgtctta

SEQ ID NO: 989240 - DNA, 18 bp, Homo sapiens
tctctttaaaaggaaaga

SEQ ID NO: 989241 - DNA, 21 bp, Homo sapiens
tctctttaaaaggaaagaaaa

SEQ ID NO: 989242 - DNA, 18 bp, Homo sapiens
ttaaattttttgttgaca

SEQ ID NO: 989243 - DNA, 22 bp, Homo sapiens
ttaacaaaaaacagattctata

SEQ ID NO: 989244 - DNA, 15 bp, Homo sapiens
ttaacaaaagcaaga

SEQ ID NO: 989245 - DNA, 18 bp, Homo sapiens
ttaacaaactcttcagtt

SEQ ID NO: 989246 - DNA, 22 bp, Homo sapiens
ttaacaaggaatgcctgtgcca

SEQ ID NO: 989247 - DNA, 21 bp, Homo sapiens
ttaacaatgcctattgtaata

SEQ ID NO: 989248 - DNA, 21 bp, Homo sapiens
ttaacaattgtcttaaaacca

SEQ ID NO: 989249 - DNA, 15 bp, Homo sapiens
ttaacactttgtatt

SEQ ID NO: 989250 - DNA, 17 bp, Homo sapiens
ttaacactttgtattac

SEQ ID NO: 989251 - DNA, 12 bp, Homo sapiens
ttaacagaaatg

SEQ ID NO: 989252 - DNA, 14 bp, Homo sapiens
ttaacagaaatgta

SEQ ID NO: 989253 - DNA, 15 bp, Homo sapiens
ttaacagaaattgta

SEQ ID NO: 989254 - DNA, 16 bp, Homo sapiens
ttaacagaaattgtat

SEQ ID NO: 989255 - DNA, 21 bp, Homo sapiens
ttaacagaaattgtatattgt

SEQ ID NO: 989256 - DNA, 18 bp, Homo sapiens
ttaacagtatttctcttt

SEQ ID NO: 989257 - DNA, 17 bp, Homo sapiens
ttaacagtcatttaaaa

SEQ ID NO: 989258 - DNA, 15 bp, Homo sapiens
ttaacagttgtattt

SEQ ID NO: 989259 - DNA, 21 bp, Homo sapiens
ttaacagttttccatgaaaac

SEQ ID NO: 989260 - DNA, 13 bp, Homo sapiens
ttaacataatggt

SEQ ID NO: 989261 - DNA, 22 bp, Homo sapiens
ttaacatacctaagaagtacat

SEQ ID NO: 989262 - DNA, 18 bp, Homo sapiens
ttaacatctttgttttta

SEQ ID NO: 989263 - DNA, 15 bp, Homo sapiens
ttaacatgaactctt

SEQ ID NO: 989264 - DNA, 16 bp, Homo sapiens
ttaacatgatttcaaa

SEQ ID NO: 989265 - DNA, 16 bp, Homo sapiens
ttaacattagatgtca

SEQ ID NO: 989266 - DNA, 21 bp, Homo sapiens
ttaacattctttttctgttga

SEQ ID NO: 989267 - DNA, 19 bp, Homo sapiens
ttaacattgaccaagaact

SEQ ID NO: 989268 - DNA, 21 bp, Homo sapiens
ttaacattgaccaagaactgc

SEQ ID NO: 989269 - DNA, 16 bp, Homo sapiens
ttaacattgtttttgt

SEQ ID NO: 989270 - DNA, 18 bp, Homo sapiens
ttaacatttcattgtaca

SEQ ID NO: 989271 - DNA, 12 bp, Homo sapiens
ttaacatttgcc

SEQ ID NO: 989272 - DNA, 14 bp, Homo sapiens
ttaaccaaaggtga

SEQ ID NO: 989273 - DNA, 18 bp, Homo sapiens
ttaaccactctacagact

SEQ ID NO: 989274 - DNA, 21 bp, Homo sapiens
ttaaccagtctgaagtttcat

SEQ ID NO: 989275 - DNA, 14 bp, Homo sapiens
ttaaccataaatca

SEQ ID NO: 989276 - DNA, 16 bp, Homo sapiens
ttaaccatccttaaat

SEQ ID NO: 989277 - DNA, 21 bp, Homo sapiens
ttaaccatttaataaagaaat

SEQ ID NO: 989278 - DNA, 18 bp, Homo sapiens
ttaaccccataattagat

SEQ ID NO: 989279 - DNA, 18 bp, Homo sapiens
ttaacccccctgtacaca

SEQ ID NO: 989280 - DNA, 20 bp, Homo sapiens
ttaacccccctgtacacaac

SEQ ID NO: 989281 - DNA, 15 bp, Homo sapiens
ttaaccctaatcttt

SEQ ID NO: 989282 - DNA, 15 bp, Homo sapiens
ttaacccttcatctt

SEQ ID NO: 989283 - DNA, 15 bp, Homo sapiens
ttaaccctttttcca

SEQ ID NO: 989284 - DNA, 19 bp, Homo sapiens
ttaacctctctaagccaca

SEQ ID NO: 989285 - DNA, 15 bp, Homo sapiens
ttaacctctgcacta

SEQ ID NO: 989286 - DNA, 15 bp, Homo sapiens
ttaacctctgctttt

SEQ ID NO: 989287 - DNA, 20 bp, Homo sapiens
ttaacctgggcattgttgag

SEQ ID NO: 989288 - DNA, 13 bp, Homo sapiens
ttaacctggtgct

SEQ ID NO: 989289 - DNA, 17 bp, Homo sapiens
ttaacctgttttgttaa

SEQ ID NO: 989290 - DNA, 23 bp, Homo sapiens
ttaaccttccaagactgaagact

SEQ ID NO: 989291 - DNA, 12 bp, Homo sapiens
ttaacctttgat

SEQ ID NO: 989292 - DNA, 21 bp, Homo sapiens
ttaacctttttgtaaatactg

SEQ ID NO: 989293 - DNA, 13 bp, Homo sapiens
ttaacgctgccta

SEQ ID NO: 989294 - DNA, 17 bp, Homo sapiens
ttaacgggcatgtatta

SEQ ID NO: 989295 - DNA, 13 bp, Homo sapiens
ttaacggtgctaa

SEQ ID NO: 989296 - DNA, 14 bp, Homo sapiens
ttaacggtgctaaa

SEQ ID NO: 989297 - DNA, 19 bp, Homo sapiens
ttaacgtggcttgtagaat

SEQ ID NO: 989298 - DNA, 14 bp, Homo sapiens
ttaacgtttctcat

SEQ ID NO: 989299 - DNA, 21 bp, Homo sapiens
ttaactaaataaacagatgta

SEQ ID NO: 989300 - DNA, 16 bp, Homo sapiens
ttaactaaatgctcat

SEQ ID NO: 989301 - DNA, 17 bp, Homo sapiens
ttaactaaattttaaag

SEQ ID NO: 989302 - DNA, 20 bp, Homo sapiens
ttaactaaattttaaagcca

SEQ ID NO: 989303 - DNA, 23 bp, Homo sapiens
ttaactaatatgggcattgtagt

SEQ ID NO: 989304 - DNA, 23 bp, Homo sapiens
ttaactaatctattgggttcatt

SEQ ID NO: 989305 - DNA, 15 bp, Homo sapiens
ttaactaatttgaat

SEQ ID NO: 989306 - DNA, 20 bp, Homo sapiens
ttaactaatttgaatgtggt

SEQ ID NO: 989307 - DNA, 18 bp, Homo sapiens
ttaactactatattgatt

SEQ ID NO: 989308 - DNA, 21 bp, Homo sapiens
ttaactactttactaaattaa

SEQ ID NO: 989309 - DNA, 19 bp, Homo sapiens
ttaactataaggtgcctca

SEQ ID NO: 989310 - DNA, 23 bp, Homo sapiens
ttaactcatctgttatcctgcta

SEQ ID NO: 989311 - DNA, 22 bp, Homo sapiens
ttaactcccattaccatgtaat

SEQ ID NO: 989312 - DNA, 23 bp, Homo sapiens
ttaactcccattaccatgtaatg

SEQ ID NO: 989313 - DNA, 13 bp, Homo sapiens
ttaactccctcca

SEQ ID NO: 989314 - DNA, 14 bp, Homo sapiens
ttaactccctccac

SEQ ID NO: 989315 - DNA, 18 bp, Homo sapiens
ttaactctggattttgaa

SEQ ID NO: 989316 - DNA, 19 bp, Homo sapiens
ttaactgaaaatgtaaatt

SEQ ID NO: 989317 - DNA, 22 bp, Homo sapiens
ttaactgaataccactctgtaa

SEQ ID NO: 989318 - DNA, 19 bp, Homo sapiens
ttaactgatttaacacttt

SEQ ID NO: 989319 - DNA, 17 bp, Homo sapiens
ttaactgccaatcctta

SEQ ID NO: 989320 - DNA, 21 bp, Homo sapiens
ttaactgccaatccttaaata

SEQ ID NO: 989321 - DNA, 19 bp, Homo sapiens
ttaactgccgtaatttaac

SEQ ID NO: 989322 - DNA, 17 bp, Homo sapiens
ttaactggcatggatta

SEQ ID NO: 989323 - DNA, 22 bp, Homo sapiens
ttaactggtgcactttgtaaat

SEQ ID NO: 989324 - DNA, 12 bp, Homo sapiens
ttaactgtattt

SEQ ID NO: 989325 - DNA, 14 bp, Homo sapiens
ttaactgtgaataa

SEQ ID NO: 989326 - DNA, 15 bp, Homo sapiens
ttaactgtggatatt

SEQ ID NO: 989327 - DNA, 22 bp, Homo sapiens
ttaacttaaattttaatttatt

SEQ ID NO: 989328 - DNA, 13 bp, Homo sapiens
ttaacttaactga

SEQ ID NO: 989329 - DNA, 14 bp, Homo sapiens
ttaacttaactgaa

SEQ ID NO: 989330 - DNA, 15 bp, Homo sapiens
ttaacttaactgaag

SEQ ID NO: 989331 - DNA, 15 bp, Homo sapiens
gattggattattcat

SEQ ID NO: 989332 - DNA, 16 bp, Homo sapiens
gattggatttgctgtg

SEQ ID NO: 989333 - DNA, 20 bp, Homo sapiens
gattggcaagtaacttctga

SEQ ID NO: 989334 - DNA, 23 bp, Homo sapiens
gattggcctgtagagttgctgag

SEQ ID NO: 989335 - DNA, 12 bp, Homo sapiens
gattggctcacc

SEQ ID NO: 989336 - DNA, 18 bp, Homo sapiens
gattggctcacccaagca

SEQ ID NO: 989337 - DNA, 17 bp, Homo sapiens
gattggctggattgcct

SEQ ID NO: 989338 - DNA, 22 bp, Homo sapiens
gattggcttaaagtgaaggaaa

SEQ ID NO: 989339 - DNA, 23 bp, Homo sapiens
gattggcttaaagtgaaggaaat

SEQ ID NO: 989340 - DNA, 22 bp, Homo sapiens
gattgggaggtgcgtgttcagc

SEQ ID NO: 989341 - DNA, 20 bp, Homo sapiens
gattggtgattcaaagtgtt

SEQ ID NO: 989342 - DNA, 15 bp, Homo sapiens
gattggttaaaatgt

SEQ ID NO: 989343 - DNA, 15 bp, Homo sapiens
gattgtattgttgaa

SEQ ID NO: 989344 - DNA, 12 bp, Homo sapiens
gattgtccctgt

SEQ ID NO: 989345 - DNA, 16 bp, Homo sapiens
gattgtctcagggccg

SEQ ID NO: 989346 - DNA, 15 bp, Homo sapiens
gattgtcttaatatt

SEQ ID NO: 989347 - DNA, 12 bp, Homo sapiens
gattgtcttgca

SEQ ID NO: 989348 - DNA, 21 bp, Homo sapiens
gattgtgaatatttccatatg

SEQ ID NO: 989349 - DNA, 18 bp, Homo sapiens
gattgtggaaaaccagga

SEQ ID NO: 989350 - DNA, 16 bp, Homo sapiens
gattgtggaatgttgg

SEQ ID NO: 989351 - DNA, 21 bp, Homo sapiens
gattgtggggtgcagctgggt

SEQ ID NO: 989352 - DNA, 14 bp, Homo sapiens
gattgttaaaataa

SEQ ID NO: 989353 - DNA, 18 bp, Homo sapiens
gattgttcgggtgtgcaa

SEQ ID NO: 989354 - DNA, 13 bp, Homo sapiens
gattgttgtttgc

SEQ ID NO: 989355 - DNA, 11 bp, Homo sapiens
gattgtttaag

SEQ ID NO: 989356 - DNA, 16 bp, Homo sapiens
gatttaaaaactggaa

SEQ ID NO: 989357 - DNA, 16 bp, Homo sapiens
gatttaaaagcctgct

SEQ ID NO: 989358 - DNA, 16 bp, Homo sapiens
gatttaaacacacaga

SEQ ID NO: 989359 - DNA, 13 bp, Homo sapiens
gatttaacacttt

SEQ ID NO: 989360 - DNA, 13 bp, Homo sapiens
gatttaacagaaa

SEQ ID NO: 989361 - DNA, 16 bp, Homo sapiens
gatttaacagaaatgt

SEQ ID NO: 989362 - DNA, 23 bp, Homo sapiens
gatttaacagaaatgtacagcaa

SEQ ID NO: 989363 - DNA, 15 bp, Homo sapiens
gatttaactgtgaac

SEQ ID NO: 989364 - DNA, 16 bp, Homo sapiens
gatttaacttgtattt

SEQ ID NO: 989365 - DNA, 22 bp, Homo sapiens
gatttaagggatggaaaaggaa

SEQ ID NO: 989366 - DNA, 13 bp, Homo sapiens
gatttaatgtttt

SEQ ID NO: 989367 - DNA, 22 bp, Homo sapiens
gatttaatgttttctgctgttt

SEQ ID NO: 989368 - DNA, 16 bp, Homo sapiens
gatttaatttgaaata

SEQ ID NO: 989369 - DNA, 10 bp, Homo sapiens
gatttacatt

SEQ ID NO: 989370 - DNA, 12 bp, Homo sapiens
gatttagaaaaa

SEQ ID NO: 989371 - DNA, 20 bp, Homo sapiens
gatttagaaaaaagtttaca

SEQ ID NO: 989372 - DNA, 20 bp, Homo sapiens
gatttagaggtaaaagtaca

SEQ ID NO: 989373 - DNA, 16 bp, Homo sapiens
gatttagggaagcagg

SEQ ID NO: 989374 - DNA, 14 bp, Homo sapiens
gatttataaagcaa

SEQ ID NO: 989375 - DNA, 13 bp, Homo sapiens
gatttataaatgc

SEQ ID NO: 989376 - DNA, 17 bp, Homo sapiens
gatttatagtttgtaca

SEQ ID NO: 989377 - DNA, 11 bp, Homo sapiens
gatttatcttt

SEQ ID NO: 989378 - DNA, 18 bp, Homo sapiens
gatttatttcatcatatt

SEQ ID NO: 989379 - DNA, 22 bp, Homo sapiens
gatttatttcatcatattatac

SEQ ID NO: 989380 - DNA, 17 bp, Homo sapiens
gatttatttgcttcttc

SEQ ID NO: 989381 - DNA, 22 bp, Homo sapiens
gatttattttacatttagagta

SEQ ID NO: 989382 - DNA, 20 bp, Homo sapiens
gatttatttttcagttccaa

SEQ ID NO: 989383 - DNA, 15 bp, Homo sapiens
gatttcaagatcctc

SEQ ID NO: 989384 - DNA, 19 bp, Homo sapiens
gatttcactaggactcaga

SEQ ID NO: 989385 - DNA, 21 bp, Homo sapiens
gatttcagaaagagcaagtct

SEQ ID NO: 989386 - DNA, 20 bp, Homo sapiens
gatttcagtttttcatttgt

SEQ ID NO: 989387 - DNA, 21 bp, Homo sapiens
gatttcagtttttcatttgtt

SEQ ID NO: 989388 - DNA, 11 bp, Homo sapiens
gatttcataat

SEQ ID NO: 989389 - DNA, 16 bp, Homo sapiens
gatttcatacctcaga

SEQ ID NO: 989390 - DNA, 17 bp, Homo sapiens
gatttcatcttctggaa

SEQ ID NO: 989391 - DNA, 13 bp, Homo sapiens
gatttcatgattt

SEQ ID NO: 989392 - DNA, 12 bp, Homo sapiens
gatttccaggcc

SEQ ID NO: 989393 - DNA, 15 bp, Homo sapiens
gatttccctgcagac

SEQ ID NO: 989394 - DNA, 18 bp, Homo sapiens
gatttccgttaaaatacc

SEQ ID NO: 989395 - DNA, 21 bp, Homo sapiens
gatttcctggagtgccctgca

SEQ ID NO: 989396 - DNA, 20 bp, Homo sapiens
gatttccttttttcttttct

SEQ ID NO: 989397 - DNA, 15 bp, Homo sapiens
gatttctaattgtaa

SEQ ID NO: 989398 - DNA, 22 bp, Homo sapiens
gatttctaattgtaagtgaaat

SEQ ID NO: 989399 - DNA, 18 bp, Homo sapiens
gatttctaggtaggaaat

SEQ ID NO: 989400 - DNA, 11 bp, Homo sapiens
gatttctccca

SEQ ID NO: 989401 - DNA, 10 bp, Homo sapiens
gatttctctg

SEQ ID NO: 989402 - DNA, 21 bp, Homo sapiens
gatttctgtttagataataca

SEQ ID NO: 989403 - DNA, 20 bp, Homo sapiens
gatttcttattgaatttgtt

SEQ ID NO: 989404 - DNA, 15 bp, Homo sapiens
gatttcttcagaatt

SEQ ID NO: 989405 - DNA, 14 bp, Homo sapiens
gatttcttctccct

SEQ ID NO: 989406 - DNA, 17 bp, Homo sapiens
gatttctttgaaaaaaa

SEQ ID NO: 989407 - DNA, 14 bp, Homo sapiens
gatttgaaaaactt

SEQ ID NO: 989408 - DNA, 13 bp, Homo sapiens
gatttgaaaattg

SEQ ID NO: 989409 - DNA, 14 bp, Homo sapiens
gatttgaattctgt

SEQ ID NO: 989410 - DNA, 13 bp, Homo sapiens
gatttgacattgc

SEQ ID NO: 989411 - DNA, 14 bp, Homo sapiens
gatttgaccaaatc

SEQ ID NO: 989412 - DNA, 14 bp, Homo sapiens
gatttgatctttgt

SEQ ID NO: 989413 - DNA, 15 bp, Homo sapiens
gatttgatgtgactt

SEQ ID NO: 989414 - DNA, 18 bp, Homo sapiens
gatttgattcattttcct

SEQ ID NO: 989415 - DNA, 14 bp, Homo sapiens
gatttgcaaaaaaa

SEQ ID NO: 989416 - DNA, 22 bp, Homo sapiens
gatttgcacgttggggagctgg

SEQ ID NO: 989417 - DNA, 22 bp, Homo sapiens
gatttgcaggattcccttctgg

SEQ ID NO: 989418 - DNA, 17 bp, Homo sapiens
gatttgcattgaacaca

SEQ ID NO: 989419 - DNA, 15 bp, Homo sapiens
gatttgcctgtgcca

SEQ ID NO: 989420 - DNA, 12 bp, Homo sapiens
gatttggaaaaa

SEQ ID NO: 989421 - DNA, 21 bp, Homo sapiens
gatttggaagagaggcacctg

SEQ ID NO: 989422 - DNA, 15 bp, Homo sapiens
gatttgggaaccaag

SEQ ID NO: 989423 - DNA, 15 bp, Homo sapiens
gatttgggggctcgg

SEQ ID NO: 989424 - DNA, 18 bp, Homo sapiens
gatttgggggctcgggga

SEQ ID NO: 989425 - DNA, 23 bp, Homo sapiens
gatttgggtggaaaacagggtgc

SEQ ID NO: 989426 - DNA, 22 bp, Homo sapiens
gatttggtgtaggtaggtctgt

SEQ ID NO: 989427 - DNA, 16 bp, Homo sapiens
gatttgtaccattcct

SEQ ID NO: 989428 - DNA, 19 bp, Homo sapiens
gatttgtagcactgagggt

SEQ ID NO: 989429 - DNA, 18 bp, Homo sapiens
gatttgtagcataactgt

SEQ ID NO: 989430 - DNA, 17 bp, Homo sapiens
gatttgtatgttaaagt

SEQ ID NO: 989431 - DNA, 14 bp, Homo sapiens
gatttgtcccaggt

SEQ ID NO: 989432 - DNA, 18 bp, Homo sapiens
gatttgtgcccattccta

SEQ ID NO: 989433 - DNA, 16 bp, Homo sapiens
gatttgttttgaattt

SEQ ID NO: 989434 - DNA, 16 bp, Homo sapiens
gatttgtttttaaact

SEQ ID NO: 989435 - DNA, 22 bp, Homo sapiens
gatttgtttttaaactgtacag

SEQ ID NO: 989436 - DNA, 16 bp, Homo sapiens
gattttaaaaaatcaa

SEQ ID NO: 989437 - DNA, 20 bp, Homo sapiens
gattttaaaaaatcaatcaa

SEQ ID NO: 989438 - DNA, 21 bp, Homo sapiens
gattttaaaaaatcaatcaat

SEQ ID NO: 989439 - DNA, 12 bp, Homo sapiens
gattttaacaat

SEQ ID NO: 989440 - DNA, 15 bp, Homo sapiens
gattttaacaataac

SEQ ID NO: 989441 - DNA, 16 bp, Homo sapiens
gattttaatacattga

SEQ ID NO: 989442 - DNA, 18 bp, Homo sapiens
gattttaatttatttgtt

SEQ ID NO: 989443 - DNA, 19 bp, Homo sapiens
gattttaatttatttgttt

SEQ ID NO: 989444 - DNA, 13 bp, Homo sapiens
gattttaattttg

SEQ ID NO: 989445 - DNA, 17 bp, Homo sapiens
gattttacagagcgcac

SEQ ID NO: 989446 - DNA, 15 bp, Homo sapiens
gattttaccaaagca

SEQ ID NO: 989447 - DNA, 16 bp, Homo sapiens
gattttagacttacct

SEQ ID NO: 989448 - DNA, 18 bp, Homo sapiens
gattttatgcacagccta

SEQ ID NO: 989449 - DNA, 12 bp, Homo sapiens
gattttattaca

SEQ ID NO: 989450 - DNA, 13 bp, Homo sapiens
gattttccaaatg

SEQ ID NO: 989451 - DNA, 14 bp, Homo sapiens
gattttctccagct

SEQ ID NO: 989452 - DNA, 15 bp, Homo sapiens
gattttcttttgcct

SEQ ID NO: 989453 - DNA, 21 bp, Homo sapiens
gattttgaaatttttattaaa

SEQ ID NO: 989454 - DNA, 14 bp, Homo sapiens
gcaagaattaaaac

SEQ ID NO: 989455 - DNA, 21 bp, Homo sapiens
gcaagaattaaaactgagtcc

SEQ ID NO: 989456 - DNA, 13 bp, Homo sapiens
gcaagacagaaaa

SEQ ID NO: 989457 - DNA, 15 bp, Homo sapiens
gcaagacagaaaagt

SEQ ID NO: 989458 - DNA, 19 bp, Homo sapiens
gcaagacagaaaagtgcct

SEQ ID NO: 989459 - DNA, 14 bp, Homo sapiens
gcaagacctcatct

SEQ ID NO: 989460 - DNA, 21 bp, Homo sapiens
gcaagacctcatctgtggagc

SEQ ID NO: 989461 - DNA, 24 bp, Homo sapiens
gcaagacctcatctgtggagctgc

SEQ ID NO: 989462 - DNA, 15 bp, Homo sapiens
gcaagacctgaaaat

SEQ ID NO: 989463 - DNA, 14 bp, Homo sapiens
gcaagagagatgtt

SEQ ID NO: 989464 - DNA, 18 bp, Homo sapiens
gcaagagagcagcgccca

SEQ ID NO: 989465 - DNA, 17 bp, Homo sapiens
gcaagagatgggacaag

SEQ ID NO: 989466 - DNA, 15 bp, Homo sapiens
gcaagagcagatact

SEQ ID NO: 989467 - DNA, 13 bp, Homo sapiens
gcaagagggaggg

SEQ ID NO: 989468 - DNA, 21 bp, Homo sapiens
gcaagagggaggggacagagg

SEQ ID NO: 989469 - DNA, 23 bp, Homo sapiens
gcaagagggaggggacagaggcc

SEQ ID NO: 989470 - DNA, 23 bp, Homo sapiens
gcaagagggggtggaggggtgtg

SEQ ID NO: 989471 - DNA, 13 bp, Homo sapiens
gcaagaggggtgg

SEQ ID NO: 989472 - DNA, 22 bp, Homo sapiens
gcaagagggtctctttgttcaa

SEQ ID NO: 989473 - DNA, 23 bp, Homo sapiens
gcaagagggtctctttgttcaat

SEQ ID NO: 989474 - DNA, 18 bp, Homo sapiens
gcaagagtgattgcagct

SEQ ID NO: 989475 - DNA, 19 bp, Homo sapiens
gcaagatagatttggaata

SEQ ID NO: 989476 - DNA, 13 bp, Homo sapiens
gcaagatatttat

SEQ ID NO: 989477 - DNA, 15 bp, Homo sapiens
gcaagatatttatat

SEQ ID NO: 989478 - DNA, 16 bp, Homo sapiens
gcaagatatttatata

SEQ ID NO: 989479 - DNA, 14 bp, Homo sapiens
gcaagatgaaataa

SEQ ID NO: 989480 - DNA, 15 bp, Homo sapiens
gcaagatgagctgtg

SEQ ID NO: 989481 - DNA, 16 bp, Homo sapiens
gcaagatgagctgtgc

SEQ ID NO: 989482 - DNA, 23 bp, Homo sapiens
gcaagatggggagtgagaggctg

SEQ ID NO: 989483 - DNA, 14 bp, Homo sapiens
gcaagatgtgaatt

SEQ ID NO: 989484 - DNA, 14 bp, Homo sapiens
gcaagatgtttctt

SEQ ID NO: 989485 - DNA, 13 bp, Homo sapiens
gcaagattgctta

SEQ ID NO: 989486 - DNA, 16 bp, Homo sapiens
gcaagcagctggtcag

SEQ ID NO: 989487 - DNA, 17 bp, Homo sapiens
gcaagcagctggtcagt

SEQ ID NO: 989488 - DNA, 11 bp, Homo sapiens
gcaagcagctt

SEQ ID NO: 989489 - DNA, 13 bp, Homo sapiens
gcaagcagggaaa

SEQ ID NO: 989490 - DNA, 22 bp, Homo sapiens
gcaagcagggaaagctccacgg

SEQ ID NO: 989491 - DNA, 13 bp, Homo sapiens
gcaagccacagga

SEQ ID NO: 989492 - DNA, 17 bp, Homo sapiens
gcaagccacaggaagga

SEQ ID NO: 989493 - DNA, 13 bp, Homo sapiens
gcaagccagggcc

SEQ ID NO: 989494 - DNA, 20 bp, Homo sapiens
gcaagccagggcccagagcc

SEQ ID NO: 989495 - DNA, 21 bp, Homo sapiens
gcaagccagggcccagagccc

SEQ ID NO: 989496 - DNA, 18 bp, Homo sapiens
gcaagccataacgtgccc

SEQ ID NO: 989497 - DNA, 13 bp, Homo sapiens
gcaagccccaggg

SEQ ID NO: 989498 - DNA, 15 bp, Homo sapiens
gcaagcccctcagcc

SEQ ID NO: 989499 - DNA, 16 bp, Homo sapiens
gcaagcccctcagccc

SEQ ID NO: 989500 - DNA, 17 bp, Homo sapiens
gcaagcccctcagccct

SEQ ID NO: 989501 - DNA, 19 bp, Homo sapiens
gcaagcctaagggatcctg

SEQ ID NO: 989502 - DNA, 13 bp, Homo sapiens
gcaagcgggagcc

SEQ ID NO: 989503 - DNA, 9 bp, Homo sapiens
gcaaggaaa

SEQ ID NO: 989504 - DNA, 16 bp, Homo sapiens
gcaaggaaaaacaggt

SEQ ID NO: 989505 - DNA, 18 bp, Homo sapiens
gcaaggaaatgtcctgca

SEQ ID NO: 989506 - DNA, 21 bp, Homo sapiens
gcaaggaaatgtcctgcatgg

SEQ ID NO: 989507 - DNA, 13 bp, Homo sapiens
gcaaggaaggaaa

SEQ ID NO: 989508 - DNA, 14 bp, Homo sapiens
gcaaggaccaggac

SEQ ID NO: 989509 - DNA, 17 bp, Homo sapiens
gcaaggacctaaaacat

SEQ ID NO: 989510 - DNA, 16 bp, Homo sapiens
gcaaggagaaaatata

SEQ ID NO: 989511 - DNA, 21 bp, Homo sapiens
gcaaggagtttattacaatgt

SEQ ID NO: 989512 - DNA, 19 bp, Homo sapiens
gcaaggatatcagagctgg

SEQ ID NO: 989513 - DNA, 20 bp, Homo sapiens
gcaaggatatcagagctggg

SEQ ID NO: 989514 - DNA, 18 bp, Homo sapiens
gcaaggcaggtgcctcca

SEQ ID NO: 989515 - DNA, 15 bp, Homo sapiens
gcaaggcaggttgga

SEQ ID NO: 989516 - DNA, 19 bp, Homo sapiens
gcaaggcaggttggatggg

SEQ ID NO: 989517 - DNA, 21 bp, Homo sapiens
gcaaggccttggtggagcagc

SEQ ID NO: 989518 - DNA, 23 bp, Homo sapiens
gcaaggccttggtggagcagcca

SEQ ID NO: 989519 - DNA, 12 bp, Homo sapiens
gcaaggctgact

SEQ ID NO: 989520 - DNA, 13 bp, Homo sapiens
gcaaggctgctgc

SEQ ID NO: 989521 - DNA, 17 bp, Homo sapiens
gcaaggctgctgccgga

SEQ ID NO: 989522 - DNA, 20 bp, Homo sapiens
gcaagggcatcaggcactgg

SEQ ID NO: 989523 - DNA, 16 bp, Homo sapiens
gcaagggcccagagtg

SEQ ID NO: 989524 - DNA, 13 bp, Homo sapiens
gcaagggcctgga

SEQ ID NO: 989525 - DNA, 14 bp, Homo sapiens
gcaagggctccagc

SEQ ID NO: 989526 - DNA, 15 bp, Homo sapiens
gcaagggctccagca

SEQ ID NO: 989527 - DNA, 22 bp, Homo sapiens
gcaagggctccagcatccagcc

SEQ ID NO: 989528 - DNA, 21 bp, Homo sapiens
gcaagggggtgtcatctgagg

SEQ ID NO: 989529 - DNA, 22 bp, Homo sapiens
gcaagggggtgtcatctgagga

SEQ ID NO: 989530 - DNA, 22 bp, Homo sapiens
gcaaggggttcccttgagggct

SEQ ID NO: 989531 - DNA, 16 bp, Homo sapiens
gcaagggttccctcaa

SEQ ID NO: 989532 - DNA, 22 bp, Homo sapiens
gcaagggttggaggcaatgtgg

SEQ ID NO: 989533 - DNA, 17 bp, Homo sapiens
gcaaggtactctggtga

SEQ ID NO: 989534 - DNA, 21 bp, Homo sapiens
gcaaggtatttctccagttgg

SEQ ID NO: 989535 - DNA, 23 bp, Homo sapiens
gcaaggtctccttactctgagcc

SEQ ID NO: 989536 - DNA, 22 bp, Homo sapiens
gcaaggtgctcttgaacctgtg

SEQ ID NO: 989537 - DNA, 18 bp, Homo sapiens
gcaaggtggcctctgcct

SEQ ID NO: 989538 - DNA, 20 bp, Homo sapiens
gcaaggtggcctctgcctgg

SEQ ID NO: 989539 - DNA, 22 bp, Homo sapiens
gcaaggtggcctttgtgctgcg

SEQ ID NO: 989540 - DNA, 17 bp, Homo sapiens
gcaaggtttaagttatt

SEQ ID NO: 989541 - DNA, 19 bp, Homo sapiens
gcaaggtttaagttattaa

SEQ ID NO: 989542 - DNA, 22 bp, Homo sapiens
gcaaggtttaagttattaagag

SEQ ID NO: 989543 - DNA, 20 bp, Homo sapiens
gcaaggtttaggctggtggc

SEQ ID NO: 989544 - DNA, 24 bp, Homo sapiens
gcaaggtttaggctggtggcccag

SEQ ID NO: 989545 - DNA, 18 bp, Homo sapiens
gcaagtagataaatattt

SEQ ID NO: 989546 - DNA, 19 bp, Homo sapiens
gcaagtagataaatatttg

SEQ ID NO: 989547 - DNA, 14 bp, Homo sapiens
gcaagtatgtgagt

SEQ ID NO: 989548 - DNA, 23 bp, Homo sapiens
gcaagtatgttttagcatgtgtt

SEQ ID NO: 989549 - DNA, 21 bp, Homo sapiens
gcaagtcccagacaaggagag

SEQ ID NO: 989550 - DNA, 22 bp, Homo sapiens
gcaagtcccagacaaggagagc

SEQ ID NO: 989551 - DNA, 11 bp, Homo sapiens
gcaagtcttaa

SEQ ID NO: 989552 - DNA, 18 bp, Homo sapiens
gcaagtgagaggggaggg

SEQ ID NO: 989553 - DNA, 22 bp, Homo sapiens
gcaagtgagaggggagggaggg

SEQ ID NO: 989554 - DNA, 15 bp, Homo sapiens
gcaagtgctggagtc

SEQ ID NO: 989555 - DNA, 14 bp, Homo sapiens
gcaagtggatggcc

SEQ ID NO: 989556 - DNA, 22 bp, Homo sapiens
gcaagtgtggggggtccttctc

SEQ ID NO: 989557 - DNA, 19 bp, Homo sapiens
gcaagtgtgtgcatgtgtg

SEQ ID NO: 989558 - DNA, 15 bp, Homo sapiens
gcaagtgtttgtggg

SEQ ID NO: 989559 - DNA, 17 bp, Homo sapiens
gcaagttattttatttg

SEQ ID NO: 989560 - DNA, 17 bp, Homo sapiens
gcaagttctagagaaga

SEQ ID NO: 989561 - DNA, 13 bp, Homo sapiens
gcaagtttctgtt

SEQ ID NO: 989562 - DNA, 11 bp, Homo sapiens
gcaataaagca

SEQ ID NO: 989563 - DNA, 15 bp, Homo sapiens
gcaataaagtggaaa

SEQ ID NO: 989564 - DNA, 16 bp, Homo sapiens
gcaataacagctgcaa

SEQ ID NO: 989565 - DNA, 17 bp, Homo sapiens
gcaataactccaagcag

SEQ ID NO: 989566 - DNA, 23 bp, Homo sapiens
gcaataactccaagcagactcca

SEQ ID NO: 989567 - DNA, 16 bp, Homo sapiens
gcaataactctgggag

SEQ ID NO: 989568 - DNA, 21 bp, Homo sapiens
gcaataacttctatattttaa

SEQ ID NO: 989569 - DNA, 22 bp, Homo sapiens
gcaataacttctatattttaat

SEQ ID NO: 989570 - DNA, 23 bp, Homo sapiens
gcaataagaaatgaacaaaagat

SEQ ID NO: 989571 - DNA, 17 bp, Homo sapiens
gcaataagctggactag

SEQ ID NO: 989572 - DNA, 20 bp, Homo sapiens
gcaataagctggactagtgt

SEQ ID NO: 989573 - DNA, 16 bp, Homo sapiens
gcaataataataaatt

SEQ ID NO: 989574 - DNA, 17 bp, Homo sapiens
gcaataatccaccccca

SEQ ID NO: 989575 - DNA, 22 bp, Homo sapiens
gcaataatggtcccatccaggc

SEQ ID NO: 989576 - DNA, 17 bp, Homo sapiens
tccaaggtcactcttgg

SEQ ID NO: 989577 - DNA, 16 bp, Homo sapiens
tccaaggtgatgttgt

SEQ ID NO: 989578 - DNA, 18 bp, Homo sapiens
tccaaggtttataaagca

SEQ ID NO: 989579 - DNA, 16 bp, Homo sapiens
tccaagtaccaatgct

SEQ ID NO: 989580 - DNA, 17 bp, Homo sapiens
tccaagtaccaatgctg

SEQ ID NO: 989581 - DNA, 20 bp, Homo sapiens
tccaagtaccaatgctgttg

SEQ ID NO: 989582 - DNA, 22 bp, Homo sapiens
tccaagtcaacactcttcttga

SEQ ID NO: 989583 - DNA, 20 bp, Homo sapiens
tccaagtcactagaagtcct

SEQ ID NO: 989584 - DNA, 20 bp, Homo sapiens
tccaagtccaacctgcctgt

SEQ ID NO: 989585 - DNA, 18 bp, Homo sapiens
tccaagtctctctgtgaa

SEQ ID NO: 989586 - DNA, 21 bp, Homo sapiens
tccaagtgaacactagccaga

SEQ ID NO: 989587 - DNA, 15 bp, Homo sapiens
tccaagtgccaatat

SEQ ID NO: 989588 - DNA, 14 bp, Homo sapiens
tccaagtggctgtg

SEQ ID NO: 989589 - DNA, 15 bp, Homo sapiens
tccaagtggctgtga

SEQ ID NO: 989590 - DNA, 20 bp, Homo sapiens
tccaagttcttcacctctat

SEQ ID NO: 989591 - DNA, 22 bp, Homo sapiens
tccaataaaaacattttgaagt

SEQ ID NO: 989592 - DNA, 17 bp, Homo sapiens
tccaataaagcagcctc

SEQ ID NO: 989593 - DNA, 22 bp, Homo sapiens
tccaataccctagaagaaaacc

SEQ ID NO: 989594 - DNA, 11 bp, Homo sapiens
tccaatactgc

SEQ ID NO: 989595 - DNA, 17 bp, Homo sapiens
tccaatactgcccaagg

SEQ ID NO: 989596 - DNA, 13 bp, Homo sapiens
tccaatagaaaga

SEQ ID NO: 989597 - DNA, 16 bp, Homo sapiens
tccaatattttgcctt

SEQ ID NO: 989598 - DNA, 20 bp, Homo sapiens
tccaatcaacagcagtgagt

SEQ ID NO: 989599 - DNA, 16 bp, Homo sapiens
tccaatccacaatgag

SEQ ID NO: 989600 - DNA, 22 bp, Homo sapiens
tccaatcccatagatgggtctg

SEQ ID NO: 989601 - DNA, 16 bp, Homo sapiens
tccaatcctcactggg

SEQ ID NO: 989602 - DNA, 17 bp, Homo sapiens
tccaatcctcactgggt

SEQ ID NO: 989603 - DNA, 14 bp, Homo sapiens
tccaatgaaggaaa

SEQ ID NO: 989604 - DNA, 17 bp, Homo sapiens
tccaatgaaggaaacat

SEQ ID NO: 989605 - DNA, 21 bp, Homo sapiens
tccaatgatacccaacagttt

SEQ ID NO: 989606 - DNA, 17 bp, Homo sapiens
tccaatgtcctgaaaca

SEQ ID NO: 989607 - DNA, 18 bp, Homo sapiens
tccaatgtggcaaggaaa

SEQ ID NO: 989608 - DNA, 15 bp, Homo sapiens
tccaattagtttcct

SEQ ID NO: 989609 - DNA, 23 bp, Homo sapiens
tccaattagtttcctttttaata

SEQ ID NO: 989610 - DNA, 20 bp, Homo sapiens
tccaattcccccttaaactt

SEQ ID NO: 989611 - DNA, 17 bp, Homo sapiens
tccaattctaaatccga

SEQ ID NO: 989612 - DNA, 11 bp, Homo sapiens
tccaattctat

SEQ ID NO: 989613 - DNA, 19 bp, Homo sapiens
tccaattgatgtatatgtt

SEQ ID NO: 989614 - DNA, 13 bp, Homo sapiens
tccaattggtgct

SEQ ID NO: 989615 - DNA, 18 bp, Homo sapiens
tccaatttacatactctg

SEQ ID NO: 989616 - DNA, 22 bp, Homo sapiens
tccaattttctggaatacatga

SEQ ID NO: 989617 - DNA, 17 bp, Homo sapiens
tccaattttttcttaaa

SEQ ID NO: 989618 - DNA, 21 bp, Homo sapiens
tccacaaacctggatttttta

SEQ ID NO: 989619 - DNA, 14 bp, Homo sapiens
tccacaaagaaaat

SEQ ID NO: 989620 - DNA, 16 bp, Homo sapiens
tccacaacagcctggg

SEQ ID NO: 989621 - DNA, 21 bp, Homo sapiens
tccacaagacagaagctgaag

SEQ ID NO: 989622 - DNA, 21 bp, Homo sapiens
tccacaagattcccagagaca

SEQ ID NO: 989623 - DNA, 18 bp, Homo sapiens
tccacaagttaaataaat

SEQ ID NO: 989624 - DNA, 16 bp, Homo sapiens
tccacaatgactgctt

SEQ ID NO: 989625 - DNA, 14 bp, Homo sapiens
tccacaattcttct

SEQ ID NO: 989626 - DNA, 15 bp, Homo sapiens
tccacaattcttctg

SEQ ID NO: 989627 - DNA, 17 bp, Homo sapiens
tccacaattcttctgtc

SEQ ID NO: 989628 - DNA, 20 bp, Homo sapiens
tccacaattcttctgtcaag

SEQ ID NO: 989629 - DNA, 14 bp, Homo sapiens
tccacacacagagg

SEQ ID NO: 989630 - DNA, 15 bp, Homo sapiens
tccacacacagagga

SEQ ID NO: 989631 - DNA, 22 bp, Homo sapiens
tccacacacagaggaagagcag

SEQ ID NO: 989632 - DNA, 20 bp, Homo sapiens
tccacacattccagccaggc

SEQ ID NO: 989633 - DNA, 18 bp, Homo sapiens
tccacacatttaaaacat

SEQ ID NO: 989634 - DNA, 17 bp, Homo sapiens
tccacaccaagcagcaa

SEQ ID NO: 989635 - DNA, 16 bp, Homo sapiens
tccacacccgtgagaa

SEQ ID NO: 989636 - DNA, 15 bp, Homo sapiens
tccacagaggacaca

SEQ ID NO: 989637 - DNA, 16 bp, Homo sapiens
tccacagccgcagcct

SEQ ID NO: 989638 - DNA, 18 bp, Homo sapiens
tccacagccgcagcctcc

SEQ ID NO: 989639 - DNA, 18 bp, Homo sapiens
tccacagcctgcaagtca

SEQ ID NO: 989640 - DNA, 18 bp, Homo sapiens
tccacagcgagggcagct

SEQ ID NO: 989641 - DNA, 12 bp, Homo sapiens
tccacaggatat

SEQ ID NO: 989642 - DNA, 20 bp, Homo sapiens
tccacagggagcaaacactt

SEQ ID NO: 989643 - DNA, 21 bp, Homo sapiens
tccacagggcttgttttccaa

SEQ ID NO: 989644 - DNA, 16 bp, Homo sapiens
tccacaggggcaggcc

SEQ ID NO: 989645 - DNA, 17 bp, Homo sapiens
tccacaggggcaggcct

SEQ ID NO: 989646 - DNA, 21 bp, Homo sapiens
tccacaggtcatcagatgcct

SEQ ID NO: 989647 - DNA, 15 bp, Homo sapiens
tccacagtcccccac

SEQ ID NO: 989648 - DNA, 13 bp, Homo sapiens
tccacagtgctgc

SEQ ID NO: 989649 - DNA, 15 bp, Homo sapiens
tccacagtgtttata

SEQ ID NO: 989650 - DNA, 19 bp, Homo sapiens
tccacagttatcttagctg

SEQ ID NO: 989651 - DNA, 21 bp, Homo sapiens
tccacagttgccaccacctct

SEQ ID NO: 989652 - DNA, 14 bp, Homo sapiens
tccacataaatgct

SEQ ID NO: 989653 - DNA, 19 bp, Homo sapiens
tccacatcccagcagccca

SEQ ID NO: 989654 - DNA, 16 bp, Homo sapiens
tccacatccccagagc

SEQ ID NO: 989655 - DNA, 17 bp, Homo sapiens
tccacatccccagagcc

SEQ ID NO: 989656 - DNA, 23 bp, Homo sapiens
tccacatccccagagcccagctc

SEQ ID NO: 989657 - DNA, 13 bp, Homo sapiens
tccacatctgcct

SEQ ID NO: 989658 - DNA, 15 bp, Homo sapiens
tccacatctgcctcc

SEQ ID NO: 989659 - DNA, 16 bp, Homo sapiens
tccacatctgcctcct

SEQ ID NO: 989660 - DNA, 17 bp, Homo sapiens
tccacatgctgcctggc

SEQ ID NO: 989661 - DNA, 19 bp, Homo sapiens
tccacatgctgcctggcac

SEQ ID NO: 989662 - DNA, 15 bp, Homo sapiens
tccacatgggagccg

SEQ ID NO: 989663 - DNA, 14 bp, Homo sapiens
tccacatgtacata

SEQ ID NO: 989664 - DNA, 22 bp, Homo sapiens
tccacattctacttcagctttg

SEQ ID NO: 989665 - DNA, 16 bp, Homo sapiens
tccacatttgtcacag

SEQ ID NO: 989666 - DNA, 21 bp, Homo sapiens
tccacattttacaggcaagga

SEQ ID NO: 989667 - DNA, 16 bp, Homo sapiens
tccaccaacccatcag

SEQ ID NO: 989668 - DNA, 20 bp, Homo sapiens
tccaccaaccccgcggccca

SEQ ID NO: 989669 - DNA, 17 bp, Homo sapiens
tccaccaagaaagcagg

SEQ ID NO: 989670 - DNA, 24 bp, Homo sapiens
tccaccacccaacccaaaccatga

SEQ ID NO: 989671 - DNA, 22 bp, Homo sapiens
tccaccacctccctcaccaaca

SEQ ID NO: 989672 - DNA, 14 bp, Homo sapiens
tccaccagcagcat

SEQ ID NO: 989673 - DNA, 15 bp, Homo sapiens
tccaccagcagcatg

SEQ ID NO: 989674 - DNA, 16 bp, Homo sapiens
tccaccagccctactc

SEQ ID NO: 989675 - DNA, 20 bp, Homo sapiens
tccaccagccctactcctgc

SEQ ID NO: 989676 - DNA, 12 bp, Homo sapiens
tccaccagcctg

SEQ ID NO: 989677 - DNA, 18 bp, Homo sapiens
tccaccagcctgctgaca

SEQ ID NO: 989678 - DNA, 19 bp, Homo sapiens
tccaccagcctgctgacag

SEQ ID NO: 989679 - DNA, 12 bp, Homo sapiens
tccaccaggcct

SEQ ID NO: 989680 - DNA, 21 bp, Homo sapiens
tccaccaggcctcactggctc

SEQ ID NO: 989681 - DNA, 15 bp, Homo sapiens
tccaccagtttatac

SEQ ID NO: 989682 - DNA, 17 bp, Homo sapiens
tccaccatccccacccc

SEQ ID NO: 989683 - DNA, 19 bp, Homo sapiens
tccacccaaccctatctcc

SEQ ID NO: 989684 - DNA, 14 bp, Homo sapiens
tccacccagcaggc

SEQ ID NO: 989685 - DNA, 14 bp, Homo sapiens
tccacccagcccat

SEQ ID NO: 989686 - DNA, 15 bp, Homo sapiens
tccacccaggctgca

SEQ ID NO: 989687 - DNA, 24 bp, Homo sapiens
tccacccaggctgcactgcagtga

SEQ ID NO: 989688 - DNA, 15 bp, Homo sapiens
tccacccagtgctgc

SEQ ID NO: 989689 - DNA, 17 bp, Homo sapiens
tccacccagtgctgcca

SEQ ID NO: 989690 - DNA, 18 bp, Homo sapiens
tccacccagtgctgccat

SEQ ID NO: 989691 - DNA, 19 bp, Homo sapiens
tccacccagtgctgccatg

SEQ ID NO: 989692 - DNA, 24 bp, Homo sapiens
tccacccattcccccatgtggctg

SEQ ID NO: 989693 - DNA, 18 bp, Homo sapiens
tccaccccaagagaactc

SEQ ID NO: 989694 - DNA, 19 bp, Homo sapiens
tccaccccaggacgccact

SEQ ID NO: 989695 - DNA, 22 bp, Homo sapiens
tccaccccataataaccctgcc

SEQ ID NO: 989696 - DNA, 20 bp, Homo sapiens
tccaccccatccctccccag

SEQ ID NO: 989697 - DNA, 20 bp, Homo sapiens
tccacccccatgtggcagcc

SEQ ID NO: 989698 - DNA, 23 bp, Homo sapiens
tccagggtctggcagagcctctg

SEQ ID NO: 989699 - DNA, 13 bp, Homo sapiens
tccagggtcttgg

SEQ ID NO: 989700 - DNA, 16 bp, Homo sapiens
tccagggtcttgggct

SEQ ID NO: 989701 - DNA, 20 bp, Homo sapiens
tccagggtggcagcaacaat

SEQ ID NO: 989702 - DNA, 21 bp, Homo sapiens
tccaggtcatgcagttcctgg

SEQ ID NO: 989703 - DNA, 20 bp, Homo sapiens
tccaggtccaaacccttcaa

SEQ ID NO: 989704 - DNA, 16 bp, Homo sapiens
tccaggtcttgactca

SEQ ID NO: 989705 - DNA, 23 bp, Homo sapiens
tccaggtcttgactcatggcagc

SEQ ID NO: 989706 - DNA, 18 bp, Homo sapiens
tccaggtgagaacatcca

SEQ ID NO: 989707 - DNA, 18 bp, Homo sapiens
tccaggtgagtgtgaggg

SEQ ID NO: 989708 - DNA, 18 bp, Homo sapiens
tccaggtgttactgtaat

SEQ ID NO: 989709 - DNA, 17 bp, Homo sapiens
tccaggttccctcccag

SEQ ID NO: 989710 - DNA, 20 bp, Homo sapiens
tccaggttccctcccagagg

SEQ ID NO: 989711 - DNA, 20 bp, Homo sapiens
tccaggtttaagctgttact

SEQ ID NO: 989712 - DNA, 15 bp, Homo sapiens
tccagtaactttttt

SEQ ID NO: 989713 - DNA, 18 bp, Homo sapiens
tccagtaacttttttgtg

SEQ ID NO: 989714 - DNA, 20 bp, Homo sapiens
tccagtaacttttttgtgta

SEQ ID NO: 989715 - DNA, 15 bp, Homo sapiens
tccagtaccttgctt

SEQ ID NO: 989716 - DNA, 21 bp, Homo sapiens
tccagtacgtcccgctgctgt

SEQ ID NO: 989717 - DNA, 21 bp, Homo sapiens
tccagtataagactactgaat

SEQ ID NO: 989718 - DNA, 14 bp, Homo sapiens
tccagtatcttgtt

SEQ ID NO: 989719 - DNA, 16 bp, Homo sapiens
tccagtcatcctgccc

SEQ ID NO: 989720 - DNA, 23 bp, Homo sapiens
tccagtcatctgtaagagcttgc

SEQ ID NO: 989721 - DNA, 15 bp, Homo sapiens
tccagtcatggtact

SEQ ID NO: 989722 - DNA, 19 bp, Homo sapiens
tccagtcatggtactaccc

SEQ ID NO: 989723 - DNA, 16 bp, Homo sapiens
tccagtctcttgtaca

SEQ ID NO: 989724 - DNA, 22 bp, Homo sapiens
tccagtctcttgtacagcgttt

SEQ ID NO: 989725 - DNA, 20 bp, Homo sapiens
tccagtctgaagtgcctact

SEQ ID NO: 989726 - DNA, 16 bp, Homo sapiens
tccagtctgctgccct

SEQ ID NO: 989727 - DNA, 18 bp, Homo sapiens
tccagtctgctgccctcc

SEQ ID NO: 989728 - DNA, 14 bp, Homo sapiens
tccagtctggaaaa

SEQ ID NO: 989729 - DNA, 21 bp, Homo sapiens
tccagtctggaaaacagaaac

SEQ ID NO: 989730 - DNA, 15 bp, Homo sapiens
tccagtgaacattcc

SEQ ID NO: 989731 - DNA, 23 bp, Homo sapiens
tccagtgacatgattctgaactt

SEQ ID NO: 989732 - DNA, 18 bp, Homo sapiens
tccagtgacttgttctga

SEQ ID NO: 989733 - DNA, 19 bp, Homo sapiens
tccagtgacttgttctgag

SEQ ID NO: 989734 - DNA, 22 bp, Homo sapiens
tccagtgacttgttctgagtaa

SEQ ID NO: 989735 - DNA, 12 bp, Homo sapiens
tccagtgaggaa

SEQ ID NO: 989736 - DNA, 15 bp, Homo sapiens
tccagtgagtgtaaa

SEQ ID NO: 989737 - DNA, 20 bp, Homo sapiens
tccagtgagtgtaaataatt

SEQ ID NO: 989738 - DNA, 14 bp, Homo sapiens
tccagtgcaattgt

SEQ ID NO: 989739 - DNA, 16 bp, Homo sapiens
tccagtgctctgcctc

SEQ ID NO: 989740 - DNA, 17 bp, Homo sapiens
tccagtgctctgcctca

SEQ ID NO: 989741 - DNA, 12 bp, Homo sapiens
tccagtggaccc

SEQ ID NO: 989742 - DNA, 20 bp, Homo sapiens
tccagtggctggtttctgag

SEQ ID NO: 989743 - DNA, 13 bp, Homo sapiens
tccagtgggctga

SEQ ID NO: 989744 - DNA, 23 bp, Homo sapiens
tccagtggtttgagacactggtt

SEQ ID NO: 989745 - DNA, 13 bp, Homo sapiens
tccagtgttgcct

SEQ ID NO: 989746 - DNA, 17 bp, Homo sapiens
tccagtgttgcctcctc

SEQ ID NO: 989747 - DNA, 17 bp, Homo sapiens
tccagtgttggctgtgt

SEQ ID NO: 989748 - DNA, 19 bp, Homo sapiens
tccagttaaaaaaaatttt

SEQ ID NO: 989749 - DNA, 21 bp, Homo sapiens
tccagttaaaaaaaattttaa

SEQ ID NO: 989750 - DNA, 20 bp, Homo sapiens
tccagttcatcgattttcta

SEQ ID NO: 989751 - DNA, 16 bp, Homo sapiens
tccagttcatgagaat

SEQ ID NO: 989752 - DNA, 16 bp, Homo sapiens
tccagttccagttccc

SEQ ID NO: 989753 - DNA, 21 bp, Homo sapiens
tccagttcctgctctctgctc

SEQ ID NO: 989754 - DNA, 15 bp, Homo sapiens
tccagttcctttaga

SEQ ID NO: 989755 - DNA, 15 bp, Homo sapiens
tccagttgctgtgga

SEQ ID NO: 989756 - DNA, 16 bp, Homo sapiens
tccagttgggactcag

SEQ ID NO: 989757 - DNA, 17 bp, Homo sapiens
tccagtttgcacctgtc

SEQ ID NO: 989758 - DNA, 19 bp, Homo sapiens
tccagtttgcacctgtccc

SEQ ID NO: 989759 - DNA, 19 bp, Homo sapiens
tccagtttgttctccgggt

SEQ ID NO: 989760 - DNA, 20 bp, Homo sapiens
tccagttttttgttatatag

SEQ ID NO: 989761 - DNA, 16 bp, Homo sapiens
tccataaacatgaaaa

SEQ ID NO: 989762 - DNA, 24 bp, Homo sapiens
tccataaagtacaaatgaagaaag

SEQ ID NO: 989763 - DNA, 15 bp, Homo sapiens
tccataaatgtgttc

SEQ ID NO: 989764 - DNA, 16 bp, Homo sapiens
tccataaatgtgttcc

SEQ ID NO: 989765 - DNA, 19 bp, Homo sapiens
tccataagtttaactttaa

SEQ ID NO: 989766 - DNA, 22 bp, Homo sapiens
tccataatctggactcctctgt

SEQ ID NO: 989767 - DNA, 22 bp, Homo sapiens
tccataatgcattcttctctgt

SEQ ID NO: 989768 - DNA, 16 bp, Homo sapiens
tccataatgctactgt

SEQ ID NO: 989769 - DNA, 14 bp, Homo sapiens
tccatacacagagg

SEQ ID NO: 989770 - DNA, 14 bp, Homo sapiens
tccatacagcctct

SEQ ID NO: 989771 - DNA, 13 bp, Homo sapiens
tccatacagctct

SEQ ID NO: 989772 - DNA, 18 bp, Homo sapiens
tccatactatgacaatct

SEQ ID NO: 989773 - DNA, 19 bp, Homo sapiens
tccatagatttattttaca

SEQ ID NO: 989774 - DNA, 16 bp, Homo sapiens
tccatagcaacaggaa

SEQ ID NO: 989775 - DNA, 21 bp, Homo sapiens
tccatagcctaatccctgggc

SEQ ID NO: 989776 - DNA, 19 bp, Homo sapiens
tccataggtttctctccct

SEQ ID NO: 989777 - DNA, 24 bp, Homo sapiens
tccatatctccttcccctacacct

SEQ ID NO: 989778 - DNA, 14 bp, Homo sapiens
tccatatttattca

SEQ ID NO: 989779 - DNA, 16 bp, Homo sapiens
tccatatttgatttct

SEQ ID NO: 989780 - DNA, 17 bp, Homo sapiens
tccatattttattactg

SEQ ID NO: 989781 - DNA, 19 bp, Homo sapiens
tccatattttattactgtt

SEQ ID NO: 989782 - DNA, 20 bp, Homo sapiens
tccatattttattactgttt

SEQ ID NO: 989783 - DNA, 17 bp, Homo sapiens
tccatcaactaaaacat

SEQ ID NO: 989784 - DNA, 17 bp, Homo sapiens
tccatcaccctcttcct

SEQ ID NO: 989785 - DNA, 23 bp, Homo sapiens
tccatcacctgaaacactggacc

SEQ ID NO: 989786 - DNA, 22 bp, Homo sapiens
tccatcagcgggtctcctccca

SEQ ID NO: 989787 - DNA, 18 bp, Homo sapiens
tccatcaggttccatccc

SEQ ID NO: 989788 - DNA, 21 bp, Homo sapiens
tccatcatatgcctgacccct

SEQ ID NO: 989789 - DNA, 15 bp, Homo sapiens
tccatcatcactgta

SEQ ID NO: 989790 - DNA, 17 bp, Homo sapiens
tccatcatcactgtaaa

SEQ ID NO: 989791 - DNA, 19 bp, Homo sapiens
tccatcatcactgtaaaga

SEQ ID NO: 989792 - DNA, 13 bp, Homo sapiens
tccatcatcatgt

SEQ ID NO: 989793 - DNA, 15 bp, Homo sapiens
tccatcatgtctgta

SEQ ID NO: 989794 - DNA, 23 bp, Homo sapiens
tccatcatgtctgtatactcctg

SEQ ID NO: 989795 - DNA, 13 bp, Homo sapiens
tccatcattcatc

SEQ ID NO: 989796 - DNA, 21 bp, Homo sapiens
tccatccacctcatcactgga

SEQ ID NO: 989797 - DNA, 18 bp, Homo sapiens
tccatccacctttcccaa

SEQ ID NO: 989798 - DNA, 15 bp, Homo sapiens
tccatccacgtggcc

SEQ ID NO: 989799 - DNA, 15 bp, Homo sapiens
tccatccatctccag

SEQ ID NO: 989800 - DNA, 15 bp, Homo sapiens
tccatccatctgtcc

SEQ ID NO: 989801 - DNA, 19 bp, Homo sapiens
tccatcccaacagccatgc

SEQ ID NO: 989802 - DNA, 16 bp, Homo sapiens
tccatcccccttcttc

SEQ ID NO: 989803 - DNA, 23 bp, Homo sapiens
tccatcccccttcttcctcccct

SEQ ID NO: 989804 - DNA, 21 bp, Homo sapiens
tccatccccttcccccatccc

SEQ ID NO: 989805 - DNA, 14 bp, Homo sapiens
tccatccctacccc

SEQ ID NO: 989806 - DNA, 18 bp, Homo sapiens
tccatccctaccccctaa

SEQ ID NO: 989807 - DNA, 12 bp, Homo sapiens
tccatccctcta

SEQ ID NO: 989808 - DNA, 15 bp, Homo sapiens
tccatccctctaatg

SEQ ID NO: 989809 - DNA, 14 bp, Homo sapiens
tccatccctgctct

SEQ ID NO: 989810 - DNA, 24 bp, Homo sapiens
tccatcgcccaggcctgggatgca

SEQ ID NO: 989811 - DNA, 19 bp, Homo sapiens
tccatctagcagctggcct

SEQ ID NO: 989812 - DNA, 14 bp, Homo sapiens
tccatctctcatcc

SEQ ID NO: 989813 - DNA, 15 bp, Homo sapiens
tccatctggcagggt

SEQ ID NO: 989814 - DNA, 16 bp, Homo sapiens
tccatctgtccgtcca

SEQ ID NO: 989815 - DNA, 17 bp, Homo sapiens
tccatctgtctgtccta

SEQ ID NO: 989816 - DNA, 21 bp, Homo sapiens
tccatcttgagatggtgaggc

SEQ ID NO: 989817 - DNA, 22 bp, Homo sapiens
tccatcttggtagttctgtgcc

SEQ ID NO: 989818 - DNA, 18 bp, Homo sapiens
tccatcttgtggggccag

SEQ ID NO: 989819 - DNA, 19 bp, Homo sapiens
tccatcttgtggggccagg

SEQ ID NO: 989820 - DNA, 20 bp, Homo sapiens
tccatcttgtggggccagga

SEQ ID NO: 989821 - DNA, 15 bp, Homo sapiens
tccatctttatagaa

SEQ ID NO: 989822 - DNA, 21 bp, Homo sapiens
tccatgaagaccacatccaca

SEQ ID NO: 989823 - DNA, 17 bp, Homo sapiens
tccatgacctcccctcc

SEQ ID NO: 989824 - DNA, 14 bp, Homo sapiens
tccatgactggctg

SEQ ID NO: 989825 - DNA, 15 bp, Homo sapiens
tccatgagcacccca

SEQ ID NO: 989826 - DNA, 19 bp, Homo sapiens
tccatgagcaccccaaggc

SEQ ID NO: 989827 - DNA, 15 bp, Homo sapiens
tccatgaggtactgg

SEQ ID NO: 989828 - DNA, 22 bp, Homo sapiens
tccatgagttatcatgaatttt

SEQ ID NO: 989829 - DNA, 16 bp, Homo sapiens
tccatgatgatagttg

SEQ ID NO: 989830 - DNA, 15 bp, Homo sapiens
tccatgatggagtca

SEQ ID NO: 989831 - DNA, 20 bp, Homo sapiens
tccatgatgtaatggaagct

SEQ ID NO: 989832 - DNA, 16 bp, Homo sapiens
tccatgcagccttggg

SEQ ID NO: 989833 - DNA, 14 bp, Homo sapiens
tccatgccccagct

SEQ ID NO: 989834 - DNA, 15 bp, Homo sapiens
tccatgccccagctc

SEQ ID NO: 989835 - DNA, 17 bp, Homo sapiens
tccatgccctcccagga

SEQ ID NO: 989836 - DNA, 18 bp, Homo sapiens
tccatgcctctggaggcc

SEQ ID NO: 989837 - DNA, 12 bp, Homo sapiens
tccatgcctgag

SEQ ID NO: 989838 - DNA, 14 bp, Homo sapiens
tccatgcctgaggg

SEQ ID NO: 989839 - DNA, 21 bp, Homo sapiens
tccatgcctgagggtggagac

SEQ ID NO: 989840 - DNA, 21 bp, Homo sapiens
tccatgccttaaacctacctc

SEQ ID NO: 989841 - DNA, 16 bp, Homo sapiens
tccatgcgctcagggc

SEQ ID NO: 989842 - DNA, 17 bp, Homo sapiens
tccatgctataaaaact

SEQ ID NO: 989843 - DNA, 16 bp, Homo sapiens
tccatgctccttgaga

SEQ ID NO: 989844 - DNA, 14 bp, Homo sapiens
tccatgctgcctcc

SEQ ID NO: 989845 - DNA, 21 bp, Homo sapiens
tccatgctgtgcgcccagggc

SEQ ID NO: 989846 - DNA, 19 bp, Homo sapiens
tccatgcttagtcactgcc

SEQ ID NO: 989847 - DNA, 20 bp, Homo sapiens
tccatgcttagtcactgcct

SEQ ID NO: 989848 - DNA, 22 bp, Homo sapiens
tccatgcttagtcactgcctgc

SEQ ID NO: 989849 - DNA, 23 bp, Homo sapiens
tccatgcttagtcactgcctgca

SEQ ID NO: 989850 - DNA, 23 bp, Homo sapiens
tccatggaaataaaaagtatgtt

SEQ ID NO: 989851 - DNA, 16 bp, Homo sapiens
tccatggaatttctag

SEQ ID NO: 989852 - DNA, 16 bp, Homo sapiens
tccatggcaattttgt

SEQ ID NO: 989853 - DNA, 15 bp, Homo sapiens
tccatggcaccagcc

SEQ ID NO: 989854 - DNA, 17 bp, Homo sapiens
tccatggcaccagcccc

SEQ ID NO: 989855 - DNA, 19 bp, Homo sapiens
tccatggcactaaaccact

SEQ ID NO: 989856 - DNA, 14 bp, Homo sapiens
tccatggccacccc

SEQ ID NO: 989857 - DNA, 16 bp, Homo sapiens
tccatggcttcctgag

SEQ ID NO: 989858 - DNA, 18 bp, Homo sapiens
tccatgggagaaaataga

SEQ ID NO: 989859 - DNA, 14 bp, Homo sapiens
tccatgggagccag

SEQ ID NO: 989860 - DNA, 15 bp, Homo sapiens
tccatgggagccagc

SEQ ID NO: 989861 - DNA, 22 bp, Homo sapiens
tccatgggagccagctgctttt

SEQ ID NO: 989862 - DNA, 17 bp, Homo sapiens
tccatgggcagagccca

SEQ ID NO: 989863 - DNA, 22 bp, Homo sapiens
tccatgggcagagcccaaggga

SEQ ID NO: 989864 - DNA, 19 bp, Homo sapiens
tccatgggcccgctgcctc

SEQ ID NO: 989865 - DNA, 21 bp, Homo sapiens
tccatgggcccgctgcctctt

SEQ ID NO: 989866 - DNA, 20 bp, Homo sapiens
tccatgtaataagcacttgc

SEQ ID NO: 989867 - DNA, 20 bp, Homo sapiens
tccatgtactgtagtttttc

SEQ ID NO: 989868 - DNA, 17 bp, Homo sapiens
tccatgtacttgtttgc

SEQ ID NO: 989869 - DNA, 17 bp, Homo sapiens
tccatgtagcaggactg

SEQ ID NO: 989870 - DNA, 21 bp, Homo sapiens
tccatgtataagtgtaaatat

SEQ ID NO: 989871 - DNA, 14 bp, Homo sapiens
tccatgtcagataa

SEQ ID NO: 989872 - DNA, 18 bp, Homo sapiens
tccatgtcgcctctgcat

SEQ ID NO: 989873 - DNA, 11 bp, Homo sapiens
tccatgtgtgt

SEQ ID NO: 989874 - DNA, 14 bp, Homo sapiens
tccatgtgtgtgca

SEQ ID NO: 989875 - DNA, 18 bp, Homo sapiens
tccatgtgtgtgcaagtg

SEQ ID NO: 989876 - DNA, 15 bp, Homo sapiens
tccatgttgctgcca

SEQ ID NO: 989877 - DNA, 18 bp, Homo sapiens
tccatgttggcctgtcac

SEQ ID NO: 989878 - DNA, 13 bp, Homo sapiens
tccatgtttgtaa

SEQ ID NO: 989879 - DNA, 18 bp, Homo sapiens
tccattaaatcaatcagg

SEQ ID NO: 989880 - DNA, 15 bp, Homo sapiens
tccattaacagcaat

SEQ ID NO: 989881 - DNA, 15 bp, Homo sapiens
tccattaactgcttt

SEQ ID NO: 989882 - DNA, 19 bp, Homo sapiens
tccattaactgctttccac

SEQ ID NO: 989883 - DNA, 20 bp, Homo sapiens
tccattaacttagcatgtgt

SEQ ID NO: 989884 - DNA, 22 bp, Homo sapiens
tccattaacttagcatgtgttg

SEQ ID NO: 989885 - DNA, 15 bp, Homo sapiens
tccattaatttaaat

SEQ ID NO: 989886 - DNA, 22 bp, Homo sapiens
tccattaatttaaatgatttaa

SEQ ID NO: 989887 - DNA, 17 bp, Homo sapiens
tccattacgtgcattta

SEQ ID NO: 989888 - DNA, 23 bp, Homo sapiens
tccattacgtgcatttaaactct

SEQ ID NO: 989889 - DNA, 17 bp, Homo sapiens
tccattaggccagcaac

SEQ ID NO: 989890 - DNA, 15 bp, Homo sapiens
tccattatcctttat

SEQ ID NO: 989891 - DNA, 20 bp, Homo sapiens
tccattattgagttcctcct

SEQ ID NO: 989892 - DNA, 15 bp, Homo sapiens
tccattatttatatt

SEQ ID NO: 989893 - DNA, 15 bp, Homo sapiens
tccattattttgtat

SEQ ID NO: 989894 - DNA, 14 bp, Homo sapiens
tccattcagaaagc

SEQ ID NO: 989895 - DNA, 14 bp, Homo sapiens
tccattcagatgaa

SEQ ID NO: 989896 - DNA, 23 bp, Homo sapiens
tccattcattaattagttccagt

SEQ ID NO: 989897 - DNA, 13 bp, Homo sapiens
tccattcctcagg

SEQ ID NO: 989898 - DNA, 12 bp, Homo sapiens
tccattctcatt

SEQ ID NO: 989899 - DNA, 13 bp, Homo sapiens
tccattcttcagt

SEQ ID NO: 989900 - DNA, 16 bp, Homo sapiens
tccattggatctcatt

SEQ ID NO: 989901 - DNA, 23 bp, Homo sapiens
tccattggatctgcaagaacact

SEQ ID NO: 989902 - DNA, 20 bp, Homo sapiens
tccattgggcacagtccaga

SEQ ID NO: 989903 - DNA, 23 bp, Homo sapiens
tccattgtaaaccacaaggctgt

SEQ ID NO: 989904 - DNA, 18 bp, Homo sapiens
tccattgtgtggcctggt

SEQ ID NO: 989905 - DNA, 19 bp, Homo sapiens
tccattgtgtggcctggtg

SEQ ID NO: 989906 - DNA, 20 bp, Homo sapiens
tccattgtgtggcctggtgg

SEQ ID NO: 989907 - DNA, 14 bp, Homo sapiens
tccattgtttaaag

SEQ ID NO: 989908 - DNA, 20 bp, Homo sapiens
tccattgtttgaaacaaaga

SEQ ID NO: 989909 - DNA, 14 bp, Homo sapiens
tccatttaagacac

SEQ ID NO: 989910 - DNA, 19 bp, Homo sapiens
tccatttacagtctctttc

SEQ ID NO: 989911 - DNA, 16 bp, Homo sapiens
tccatttatttatgaa

SEQ ID NO: 989912 - DNA, 18 bp, Homo sapiens
tccatttcccacatcttt

SEQ ID NO: 989913 - DNA, 12 bp, Homo sapiens
tccatttcctaa

SEQ ID NO: 989914 - DNA, 19 bp, Homo sapiens
tccatttctcaatcagtgc

SEQ ID NO: 989915 - DNA, 12 bp, Homo sapiens
tccatttctgat

SEQ ID NO: 989916 - DNA, 17 bp, Homo sapiens
tccatttcttcagaggg

SEQ ID NO: 989917 - DNA, 15 bp, Homo sapiens
tccatttctttcttc

SEQ ID NO: 989918 - DNA, 16 bp, Homo sapiens
tccatttctttcttcc

SEQ ID NO: 989919 - DNA, 13 bp, Homo sapiens
tccatttgagaaa

SEQ ID NO: 989920 - DNA, 12 bp, Homo sapiens
tccatttgcatt

SEQ ID NO: 989921 - DNA, 17 bp, Homo sapiens
tccatttggtcctttct

SEQ ID NO: 989922 - DNA, 14 bp, Homo sapiens
tccatttgttcctg

SEQ ID NO: 989923 - DNA, 14 bp, Homo sapiens
tccattttaaaaac

SEQ ID NO: 989924 - DNA, 13 bp, Homo sapiens
tccattttatgca

SEQ ID NO: 989925 - DNA, 14 bp, Homo sapiens
tccattttccccca

SEQ ID NO: 989926 - DNA, 21 bp, Homo sapiens
tccattttcccccactactgc

SEQ ID NO: 989927 - DNA, 12 bp, Homo sapiens
tccattttctaa

SEQ ID NO: 989928 - DNA, 15 bp, Homo sapiens
tccatttttacaagt

SEQ ID NO: 989929 - DNA, 18 bp, Homo sapiens
tccatttttcctctgttc

SEQ ID NO: 989930 - DNA, 20 bp, Homo sapiens
tccatttttcctctgttcac

SEQ ID NO: 989931 - DNA, 14 bp, Homo sapiens
tcccaaaaaactac

SEQ ID NO: 989932 - DNA, 23 bp, Homo sapiens
tcccaaaacattttaaatgaaag

SEQ ID NO: 989933 - DNA, 16 bp, Homo sapiens
tcccaaaatcccctca

SEQ ID NO: 989934 - DNA, 17 bp, Homo sapiens
tcccaaaatcccctcag

SEQ ID NO: 989935 - DNA, 20 bp, Homo sapiens
tcccaaaatcccctcagcct

SEQ ID NO: 989936 - DNA, 23 bp, Homo sapiens
tcccaaaatcccctcagcctctt

SEQ ID NO: 989937 - DNA, 20 bp, Homo sapiens
tcccaaaatgttgaaatatg

SEQ ID NO: 989938 - DNA, 22 bp, Homo sapiens
tcccaaacgccctttcctcctc

SEQ ID NO: 989939 - DNA, 15 bp, Homo sapiens
tcccaaacgcctccc

SEQ ID NO: 989940 - DNA, 21 bp, Homo sapiens
tcccaaacgcctcccctgccc

SEQ ID NO: 989941 - DNA, 12 bp, Homo sapiens
agcccgggctgc

SEQ ID NO: 989942 - DNA, 14 bp, Homo sapiens
agcccgggctgcct

SEQ ID NO: 989943 - DNA, 20 bp, Homo sapiens
agcccgggctgcctgggctg

SEQ ID NO: 989944 - DNA, 21 bp, Homo sapiens
agcccgggctgcctgggctgt

SEQ ID NO: 989945 - DNA, 14 bp, Homo sapiens
agcccgtctcagtg

SEQ ID NO: 989946 - DNA, 21 bp, Homo sapiens
agcccgtgacagatgccaact

SEQ ID NO: 989947 - DNA, 18 bp, Homo sapiens
agcccgttagccccaggg

SEQ ID NO: 989948 - DNA, 14 bp, Homo sapiens
agccctaaacatca

SEQ ID NO: 989949 - DNA, 15 bp, Homo sapiens
agccctaagcctgtc

SEQ ID NO: 989950 - DNA, 16 bp, Homo sapiens
agccctaagcctgtcc

SEQ ID NO: 989951 - DNA, 19 bp, Homo sapiens
agccctaagcctgtcccca

SEQ ID NO: 989952 - DNA, 20 bp, Homo sapiens
agccctaagcctgtccccag

SEQ ID NO: 989953 - DNA, 22 bp, Homo sapiens
agccctaagcctgtccccagac

SEQ ID NO: 989954 - DNA, 24 bp, Homo sapiens
agccctaagcctgtccccagacca

SEQ ID NO: 989955 - DNA, 15 bp, Homo sapiens
agccctacagagctg

SEQ ID NO: 989956 - DNA, 17 bp, Homo sapiens
agccctacagagctgtg

SEQ ID NO: 989957 - DNA, 21 bp, Homo sapiens
agccctactccctgcagatgc

SEQ ID NO: 989958 - DNA, 19 bp, Homo sapiens
agccctagggtgctctgaa

SEQ ID NO: 989959 - DNA, 17 bp, Homo sapiens
agccctagggtggagag

SEQ ID NO: 989960 - DNA, 13 bp, Homo sapiens
agccctatggatg

SEQ ID NO: 989961 - DNA, 19 bp, Homo sapiens
agccctcacctctgaggac

SEQ ID NO: 989962 - DNA, 20 bp, Homo sapiens
agccctcacctctgaggaca

SEQ ID NO: 989963 - DNA, 21 bp, Homo sapiens
agccctcacctctgaggacag

SEQ ID NO: 989964 - DNA, 23 bp, Homo sapiens
agccctcacctctgaggacagag

SEQ ID NO: 989965 - DNA, 18 bp, Homo sapiens
agccctcagacatttata

SEQ ID NO: 989966 - DNA, 13 bp, Homo sapiens
agccctcaggctc

SEQ ID NO: 989967 - DNA, 16 bp, Homo sapiens
agccctcaggctcccc

SEQ ID NO: 989968 - DNA, 17 bp, Homo sapiens
agccctcaggctcccca

SEQ ID NO: 989969 - DNA, 20 bp, Homo sapiens
agccctcaggctccccagaa

SEQ ID NO: 989970 - DNA, 23 bp, Homo sapiens
agccctcaggctccccagaactg

SEQ ID NO: 989971 - DNA, 14 bp, Homo sapiens
agccctcagtcacc

SEQ ID NO: 989972 - DNA, 16 bp, Homo sapiens
agccctcagtcacccc

SEQ ID NO: 989973 - DNA, 23 bp, Homo sapiens
agccctcagtcagttcccggagc

SEQ ID NO: 989974 - DNA, 23 bp, Homo sapiens
agccctcagttccttcatttcca

SEQ ID NO: 989975 - DNA, 17 bp, Homo sapiens
agccctcatcccacttc

SEQ ID NO: 989976 - DNA, 19 bp, Homo sapiens
agccctcatcccacttcct

SEQ ID NO: 989977 - DNA, 15 bp, Homo sapiens
agccctcatttttat

SEQ ID NO: 989978 - DNA, 17 bp, Homo sapiens
agccctccaaaagcact

SEQ ID NO: 989979 - DNA, 22 bp, Homo sapiens
agccctcccactttgctgttcc

SEQ ID NO: 989980 - DNA, 12 bp, Homo sapiens
agccctccccat

SEQ ID NO: 989981 - DNA, 20 bp, Homo sapiens
agccctccccatggagccag

SEQ ID NO: 989982 - DNA, 12 bp, Homo sapiens
agccctccccct

SEQ ID NO: 989983 - DNA, 14 bp, Homo sapiens
agccctccccctca

SEQ ID NO: 989984 - DNA, 16 bp, Homo sapiens
agccctccccctcaac

SEQ ID NO: 989985 - DNA, 16 bp, Homo sapiens
agccctcccccttccc

SEQ ID NO: 989986 - DNA, 12 bp, Homo sapiens
agccctccctgc

SEQ ID NO: 989987 - DNA, 13 bp, Homo sapiens
agccctccctgcc

SEQ ID NO: 989988 - DNA, 20 bp, Homo sapiens
agccctccctgtcctcctcg

SEQ ID NO: 989989 - DNA, 21 bp, Homo sapiens
agccctccctgtcctcctcgg

SEQ ID NO: 989990 - DNA, 14 bp, Homo sapiens
agccctcctcaccc

SEQ ID NO: 989991 - DNA, 17 bp, Homo sapiens
agccctcctctgcactc

SEQ ID NO: 989992 - DNA, 11 bp, Homo sapiens
agccctccttc

SEQ ID NO: 989993 - DNA, 12 bp, Homo sapiens
agccctccttcc

SEQ ID NO: 989994 - DNA, 13 bp, Homo sapiens
agccctcctttgg

SEQ ID NO: 989995 - DNA, 22 bp, Homo sapiens
agccctcgaaccaaggcagcct

SEQ ID NO: 989996 - DNA, 24 bp, Homo sapiens
agccctcgaaccaaggcagcctcc

SEQ ID NO: 989997 - DNA, 13 bp, Homo sapiens
agccctcggcctc

SEQ ID NO: 989998 - DNA, 16 bp, Homo sapiens
agccctctagggcagg

SEQ ID NO: 989999 - DNA, 19 bp, Homo sapiens
agccctctagggcagggtg

SEQ ID NO: 990000 - DNA, 21 bp, Homo sapiens
agccctctcactccagccaaa

SEQ ID NO: 990001 - DNA, 17 bp, Homo sapiens
agccctctgagccgcca

SEQ ID NO: 990002 - DNA, 16 bp, Homo sapiens
agccctctgcctcctc

SEQ ID NO: 990003 - DNA, 19 bp, Homo sapiens
agccctctttaatgctgtc

SEQ ID NO: 990004 - DNA, 13 bp, Homo sapiens
agccctgaccctg

SEQ ID NO: 990005 - DNA, 23 bp, Homo sapiens
agccctgaccttggctgactggg

SEQ ID NO: 990006 - DNA, 11 bp, Homo sapiens
agccctgactc

SEQ ID NO: 990007 - DNA, 15 bp, Homo sapiens
agccctgactcctgg

SEQ ID NO: 990008 - DNA, 16 bp, Homo sapiens
agccctgactcctgga

SEQ ID NO: 990009 - DNA, 19 bp, Homo sapiens
agccctgagcccggccctc

SEQ ID NO: 990010 - DNA, 20 bp, Homo sapiens
agccctgaggacctctcagc

SEQ ID NO: 990011 - DNA, 22 bp, Homo sapiens
agccctgagtggtcactggtca

SEQ ID NO: 990012 - DNA, 23 bp, Homo sapiens
agccctgagtggtcactggtcag

SEQ ID NO: 990013 - DNA, 16 bp, Homo sapiens
agccctgcataatgtt

SEQ ID NO: 990014 - DNA, 14 bp, Homo sapiens
agccctgcccaccc

SEQ ID NO: 990015 - DNA, 13 bp, Homo sapiens
agccctgccctgc

SEQ ID NO: 990016 - DNA, 14 bp, Homo sapiens
agccctgccctgca

SEQ ID NO: 990017 - DNA, 19 bp, Homo sapiens
agccctgctggggatcccc

SEQ ID NO: 990018 - DNA, 17 bp, Homo sapiens
agccctgctttgggctg

SEQ ID NO: 990019 - DNA, 20 bp, Homo sapiens
agccctgctttgggctgccc

SEQ ID NO: 990020 - DNA, 21 bp, Homo sapiens
agccctgctttgggctgccct

SEQ ID NO: 990021 - DNA, 19 bp, Homo sapiens
agccctggacacccctgct

SEQ ID NO: 990022 - DNA, 18 bp, Homo sapiens
agccctggattaggaggg

SEQ ID NO: 990023 - DNA, 23 bp, Homo sapiens
agccctggatttcagaaagagca

SEQ ID NO: 990024 - DNA, 12 bp, Homo sapiens
agccctggcagg

SEQ ID NO: 990025 - DNA, 13 bp, Homo sapiens
agccctggcagga

SEQ ID NO: 990026 - DNA, 17 bp, Homo sapiens
agccctggcaggatgac

SEQ ID NO: 990027 - DNA, 15 bp, Homo sapiens
agccctggccaagct

SEQ ID NO: 990028 - DNA, 15 bp, Homo sapiens
agccctggcctggct

SEQ ID NO: 990029 - DNA, 12 bp, Homo sapiens
agccctggctcc

SEQ ID NO: 990030 - DNA, 14 bp, Homo sapiens
agccctggctccca

SEQ ID NO: 990031 - DNA, 16 bp, Homo sapiens
agccctggctctgccc

SEQ ID NO: 990032 - DNA, 23 bp, Homo sapiens
agccctggctctgcccctcaggg

SEQ ID NO: 990033 - DNA, 14 bp, Homo sapiens
agccctggctgggt

SEQ ID NO: 990034 - DNA, 18 bp, Homo sapiens
agccctgggatcactgtg

SEQ ID NO: 990035 - DNA, 19 bp, Homo sapiens
agccctgggccccaccacc

SEQ ID NO: 990036 - DNA, 23 bp, Homo sapiens
agccctgggccccaccacctagg

SEQ ID NO: 990037 - DNA, 11 bp, Homo sapiens
agccctgggct

SEQ ID NO: 990038 - DNA, 15 bp, Homo sapiens
agccctgggcttggc

SEQ ID NO: 990039 - DNA, 17 bp, Homo sapiens
agccctgggcttggctc

SEQ ID NO: 990040 - DNA, 23 bp, Homo sapiens
agccctgggtgacttcaggtgga

SEQ ID NO: 990041 - DNA, 22 bp, Homo sapiens
agccctggtgctacttgcttga

SEQ ID NO: 990042 - DNA, 16 bp, Homo sapiens
agccctggtgtgtttc

SEQ ID NO: 990043 - DNA, 15 bp, Homo sapiens
agccctggttctggc

SEQ ID NO: 990044 - DNA, 15 bp, Homo sapiens
agccctgtacccacc

SEQ ID NO: 990045 - DNA, 16 bp, Homo sapiens
agccctgtacccaccc

SEQ ID NO: 990046 - DNA, 18 bp, Homo sapiens
agccctgtacccacccca

SEQ ID NO: 990047 - DNA, 21 bp, Homo sapiens
agccctgtacccaccccagca

SEQ ID NO: 990048 - DNA, 23 bp, Homo sapiens
agccctgtacccaccccagcaca

SEQ ID NO: 990049 - DNA, 16 bp, Homo sapiens
agccctgtcctggtgg

SEQ ID NO: 990050 - DNA, 19 bp, Homo sapiens
agccctgtcctggttcctt

SEQ ID NO: 990051 - DNA, 18 bp, Homo sapiens
agccctgtcgagacactt

SEQ ID NO: 990052 - DNA, 12 bp, Homo sapiens
agccctgtgtct

SEQ ID NO: 990053 - DNA, 21 bp, Homo sapiens
agccctgttgacacaggtctt

SEQ ID NO: 990054 - DNA, 18 bp, Homo sapiens
agccctgttggcagctct

SEQ ID NO: 990055 - DNA, 16 bp, Homo sapiens
agcccttagcacagag

SEQ ID NO: 990056 - DNA, 19 bp, Homo sapiens
agcccttagcacagagagg

SEQ ID NO: 990057 - DNA, 22 bp, Homo sapiens
agcccttagcacagagagggac

SEQ ID NO: 990058 - DNA, 23 bp, Homo sapiens
agcccttagcacagagagggaca

SEQ ID NO: 990059 - DNA, 16 bp, Homo sapiens
agcccttatggccaat

SEQ ID NO: 990060 - DNA, 17 bp, Homo sapiens
agcccttcactgccatg

SEQ ID NO: 990061 - DNA, 15 bp, Homo sapiens
agcccttccagcctg

SEQ ID NO: 990062 - DNA, 17 bp, Homo sapiens
agcccttccagcctggg

SEQ ID NO: 990063 - DNA, 19 bp, Homo sapiens
ccatctcagcctcctgagc

SEQ ID NO: 990064 - DNA, 22 bp, Homo sapiens
ccatctcagcctcctgagcctg

SEQ ID NO: 990065 - DNA, 23 bp, Homo sapiens
ccatctcagcctcctgagcctgt

SEQ ID NO: 990066 - DNA, 21 bp, Homo sapiens
ccatctcaggacacttccgta

SEQ ID NO: 990067 - DNA, 23 bp, Homo sapiens
ccatctcaggagatggagggctt

SEQ ID NO: 990068 - DNA, 18 bp, Homo sapiens
ccatctcaggccacctgc

SEQ ID NO: 990069 - DNA, 22 bp, Homo sapiens
ccatctcaggccacctgccccc

SEQ ID NO: 990070 - DNA, 17 bp, Homo sapiens
ccatctcaggtgccact

SEQ ID NO: 990071 - DNA, 14 bp, Homo sapiens
ccatctcaggttgg

SEQ ID NO: 990072 - DNA, 14 bp, Homo sapiens
ccatctcatcctgg

SEQ ID NO: 990073 - DNA, 20 bp, Homo sapiens
ccatctcatgaggggagagg

SEQ ID NO: 990074 - DNA, 15 bp, Homo sapiens
ccatctccagggaag

SEQ ID NO: 990075 - DNA, 21 bp, Homo sapiens
ccatctccagggagcaagaca

SEQ ID NO: 990076 - DNA, 14 bp, Homo sapiens
ccatctccccaggc

SEQ ID NO: 990077 - DNA, 16 bp, Homo sapiens
ccatctccccaggcct

SEQ ID NO: 990078 - DNA, 16 bp, Homo sapiens
ccatctccctccccag

SEQ ID NO: 990079 - DNA, 22 bp, Homo sapiens
ccatctccctccccagaaacag

SEQ ID NO: 990080 - DNA, 16 bp, Homo sapiens
ccatctccctgctttg

SEQ ID NO: 990081 - DNA, 19 bp, Homo sapiens
ccatctccttacctctgga

SEQ ID NO: 990082 - DNA, 20 bp, Homo sapiens
ccatctcgggcacaggccca

SEQ ID NO: 990083 - DNA, 16 bp, Homo sapiens
ccatctcggggctgct

SEQ ID NO: 990084 - DNA, 15 bp, Homo sapiens
ccatctctcccactt

SEQ ID NO: 990085 - DNA, 19 bp, Homo sapiens
ccatctctcccacttcctc

SEQ ID NO: 990086 - DNA, 20 bp, Homo sapiens
ccatctctcccacttcctcc

SEQ ID NO: 990087 - DNA, 21 bp, Homo sapiens
ccatctctcccacttcctcct

SEQ ID NO: 990088 - DNA, 23 bp, Homo sapiens
ccatctctccctcccctgccatt

SEQ ID NO: 990089 - DNA, 22 bp, Homo sapiens
ccatctgatgtgatgtgaatac

SEQ ID NO: 990090 - DNA, 19 bp, Homo sapiens
ccatctgatgtttcatatt

SEQ ID NO: 990091 - DNA, 23 bp, Homo sapiens
ccatctgcaccccttctctcctc

SEQ ID NO: 990092 - DNA, 12 bp, Homo sapiens
ccatctgcccag

SEQ ID NO: 990093 - DNA, 21 bp, Homo sapiens
ccatctgcccaggggtgcccc

SEQ ID NO: 990094 - DNA, 22 bp, Homo sapiens
ccatctgcgtgacaataaaaca

SEQ ID NO: 990095 - DNA, 14 bp, Homo sapiens
ccatctgctgcagt

SEQ ID NO: 990096 - DNA, 16 bp, Homo sapiens
ccatctgggagtcccc

SEQ ID NO: 990097 - DNA, 12 bp, Homo sapiens
ccatctgggctc

SEQ ID NO: 990098 - DNA, 22 bp, Homo sapiens
ccatctgggtccttgcacccct

SEQ ID NO: 990099 - DNA, 15 bp, Homo sapiens
ccatctgtaaatatc

SEQ ID NO: 990100 - DNA, 13 bp, Homo sapiens
ccatctgtccaca

SEQ ID NO: 990101 - DNA, 23 bp, Homo sapiens
ccatctgtccacatccccagagc

SEQ ID NO: 990102 - DNA, 20 bp, Homo sapiens
ccatctgtccagctggggcc

SEQ ID NO: 990103 - DNA, 23 bp, Homo sapiens
ccatctgtccgtccagagccggc

SEQ ID NO: 990104 - DNA, 12 bp, Homo sapiens
ccatctgtctgt

SEQ ID NO: 990105 - DNA, 16 bp, Homo sapiens
ccatctgtctgtccta

SEQ ID NO: 990106 - DNA, 14 bp, Homo sapiens
ccatctgtcttcag

SEQ ID NO: 990107 - DNA, 15 bp, Homo sapiens
ccatctgtcttcagc

SEQ ID NO: 990108 - DNA, 20 bp, Homo sapiens
ccatcttaaatgacagtgaa

SEQ ID NO: 990109 - DNA, 18 bp, Homo sapiens
ccatcttactctgcccta

SEQ ID NO: 990110 - DNA, 22 bp, Homo sapiens
ccatcttccacctcacctcttt

SEQ ID NO: 990111 - DNA, 15 bp, Homo sapiens
ccatcttccacctgt

SEQ ID NO: 990112 - DNA, 19 bp, Homo sapiens
ccatcttccacctgtgccc

SEQ ID NO: 990113 - DNA, 15 bp, Homo sapiens
ccatcttccaggatg

SEQ ID NO: 990114 - DNA, 22 bp, Homo sapiens
ccatcttcttcccttaactcca

SEQ ID NO: 990115 - DNA, 22 bp, Homo sapiens
ccatcttgagatggtgaggctg

SEQ ID NO: 990116 - DNA, 21 bp, Homo sapiens
ccatcttgcttccctaatcta

SEQ ID NO: 990117 - DNA, 17 bp, Homo sapiens
ccatcttggtagttctg

SEQ ID NO: 990118 - DNA, 21 bp, Homo sapiens
ccatcttggtagttctgtgcc

SEQ ID NO: 990119 - DNA, 16 bp, Homo sapiens
ccatcttgtggggcca

SEQ ID NO: 990120 - DNA, 17 bp, Homo sapiens
ccatcttgtggggccag

SEQ ID NO: 990121 - DNA, 19 bp, Homo sapiens
ccatcttgtggggccagga

SEQ ID NO: 990122 - DNA, 15 bp, Homo sapiens
ccatctttactccca

SEQ ID NO: 990123 - DNA, 24 bp, Homo sapiens
ccatctttatagaaggaatttgta

SEQ ID NO: 990124 - DNA, 14 bp, Homo sapiens
ccatctttgatcct

SEQ ID NO: 990125 - DNA, 12 bp, Homo sapiens
ccatctttttct

SEQ ID NO: 990126 - DNA, 19 bp, Homo sapiens
ccatgaaaacgttttattg

SEQ ID NO: 990127 - DNA, 21 bp, Homo sapiens
ccatgaaaacgttttattgtg

SEQ ID NO: 990128 - DNA, 23 bp, Homo sapiens
ccatgaaaataccataggaagac

SEQ ID NO: 990129 - DNA, 16 bp, Homo sapiens
ccatgaacagaaaaca

SEQ ID NO: 990130 - DNA, 22 bp, Homo sapiens
ccatgaacagaaaacattctga

SEQ ID NO: 990131 - DNA, 14 bp, Homo sapiens
ccatgaacttgata

SEQ ID NO: 990132 - DNA, 22 bp, Homo sapiens
ccatgaacttgatacgtccgtg

SEQ ID NO: 990133 - DNA, 17 bp, Homo sapiens
ccatgaagacaggacag

SEQ ID NO: 990134 - DNA, 13 bp, Homo sapiens
ccatgaagcatta

SEQ ID NO: 990135 - DNA, 18 bp, Homo sapiens
ccatgaatctctgcctct

SEQ ID NO: 990136 - DNA, 20 bp, Homo sapiens
ccatgaatctctgcctctcc

SEQ ID NO: 990137 - DNA, 19 bp, Homo sapiens
ccatgaatgtatcaggaaa

SEQ ID NO: 990138 - DNA, 17 bp, Homo sapiens
ccatgacaaacctagct

SEQ ID NO: 990139 - DNA, 20 bp, Homo sapiens
ccatgacagaggctgcaccc

SEQ ID NO: 990140 - DNA, 18 bp, Homo sapiens
ccatgacatttcatctgg

SEQ ID NO: 990141 - DNA, 17 bp, Homo sapiens
ccatgacccacccctgt

SEQ ID NO: 990142 - DNA, 21 bp, Homo sapiens
ccatgaccctacataaggctg

SEQ ID NO: 990143 - DNA, 17 bp, Homo sapiens
ccatgacctcccctccc

SEQ ID NO: 990144 - DNA, 21 bp, Homo sapiens
ccatgacctcccctccccagc

SEQ ID NO: 990145 - DNA, 16 bp, Homo sapiens
ccatgactgcacccag

SEQ ID NO: 990146 - DNA, 21 bp, Homo sapiens
ccatgactgcacccagctcca

SEQ ID NO: 990147 - DNA, 17 bp, Homo sapiens
ccatgactgcattttac

SEQ ID NO: 990148 - DNA, 14 bp, Homo sapiens
ccatgactggctgt

SEQ ID NO: 990149 - DNA, 17 bp, Homo sapiens
ccatgagaagagggcct

SEQ ID NO: 990150 - DNA, 19 bp, Homo sapiens
ccatgagaagagggcctgt

SEQ ID NO: 990151 - DNA, 21 bp, Homo sapiens
ccatgagaagagggcctgtgg

SEQ ID NO: 990152 - DNA, 20 bp, Homo sapiens
ccatgagactgatccctggc

SEQ ID NO: 990153 - DNA, 21 bp, Homo sapiens
ccatgagcaccccaaggctgc

SEQ ID NO: 990154 - DNA, 22 bp, Homo sapiens
ccatgagcaccccaaggctgcg

SEQ ID NO: 990155 - DNA, 23 bp, Homo sapiens
ccatgagcctgcccgctgcaatg

SEQ ID NO: 990156 - DNA, 19 bp, Homo sapiens
ccatgagctccagaccccc

SEQ ID NO: 990157 - DNA, 19 bp, Homo sapiens
ccatgagctcggggtccac

SEQ ID NO: 990158 - DNA, 21 bp, Homo sapiens
ccatgagctcggggtccacca

SEQ ID NO: 990159 - DNA, 22 bp, Homo sapiens
ccatgagctcggggtccaccag

SEQ ID NO: 990160 - DNA, 22 bp, Homo sapiens
ccatgaggtactggtcccttcc

SEQ ID NO: 990161 - DNA, 17 bp, Homo sapiens
ccatgagtccttgaaaa

SEQ ID NO: 990162 - DNA, 21 bp, Homo sapiens
ccatgagttggggtctggcag

SEQ ID NO: 990163 - DNA, 16 bp, Homo sapiens
ccatgataagaacaga

SEQ ID NO: 990164 - DNA, 13 bp, Homo sapiens
ccatgatagctgg

SEQ ID NO: 990165 - DNA, 16 bp, Homo sapiens
ccatgatccctgtgtt

SEQ ID NO: 990166 - DNA, 17 bp, Homo sapiens
ccatgatccctgtgttg

SEQ ID NO: 990167 - DNA, 22 bp, Homo sapiens
ccatgatccctgtgttgtctct

SEQ ID NO: 990168 - DNA, 15 bp, Homo sapiens
ccatgatctgtattt

SEQ ID NO: 990169 - DNA, 14 bp, Homo sapiens
ccatgatgtatatc

SEQ ID NO: 990170 - DNA, 21 bp, Homo sapiens
ccatgattaaccacttcagct

SEQ ID NO: 990171 - DNA, 14 bp, Homo sapiens
ccatgattcgccca

SEQ ID NO: 990172 - DNA, 19 bp, Homo sapiens
ccatgatttgtcccagcct

SEQ ID NO: 990173 - DNA, 20 bp, Homo sapiens
ccatgatttgtcccagcctg

SEQ ID NO: 990174 - DNA, 22 bp, Homo sapiens
ccatgatttgtcccagcctggg

SEQ ID NO: 990175 - DNA, 21 bp, Homo sapiens
ccatgatttttggtatttatg

SEQ ID NO: 990176 - DNA, 18 bp, Homo sapiens
ccatgcacctcagggcca

SEQ ID NO: 990177 - DNA, 19 bp, Homo sapiens
ccatgcactttaattgaag

SEQ ID NO: 990178 - DNA, 14 bp, Homo sapiens
ccatgcagaacacc

SEQ ID NO: 990179 - DNA, 21 bp, Homo sapiens
ccatgcagacctcatgcccag

SEQ ID NO: 990180 - DNA, 22 bp, Homo sapiens
ccatgcagacctcatgcccagc

SEQ ID NO: 990181 - DNA, 20 bp, Homo sapiens
ccatgcagcccctgggccct

SEQ ID NO: 990182 - DNA, 16 bp, Homo sapiens
ccatgcaggaagaggc

SEQ ID NO: 990183 - DNA, 22 bp, Homo sapiens
cccaaaggggacaggcctcacc

SEQ ID NO: 990184 - DNA, 22 bp, Homo sapiens
cccaaagtaccacactgagttc

SEQ ID NO: 990185 - DNA, 19 bp, Homo sapiens
cccaaagtcctctgctcca

SEQ ID NO: 990186 - DNA, 21 bp, Homo sapiens
cccaaagtcctctgctccagc

SEQ ID NO: 990187 - DNA, 19 bp, Homo sapiens
cccaaatatgtattttcct

SEQ ID NO: 990188 - DNA, 18 bp, Homo sapiens
cccaaatggccattttaa

SEQ ID NO: 990189 - DNA, 13 bp, Homo sapiens
cccaacactgtgc

SEQ ID NO: 990190 - DNA, 15 bp, Homo sapiens
cccaacactgtgccc

SEQ ID NO: 990191 - DNA, 18 bp, Homo sapiens
cccaacactgtgccctgg

SEQ ID NO: 990192 - DNA, 20 bp, Homo sapiens
cccaacactgtgccctggtg

SEQ ID NO: 990193 - DNA, 18 bp, Homo sapiens
cccaacagaaggaaggag

SEQ ID NO: 990194 - DNA, 19 bp, Homo sapiens
cccaacaggaatttttaaa

SEQ ID NO: 990195 - DNA, 23 bp, Homo sapiens
cccaacatgggagggatcagccc

SEQ ID NO: 990196 - DNA, 17 bp, Homo sapiens
cccaaccaaccagcagg

SEQ ID NO: 990197 - DNA, 16 bp, Homo sapiens
cccaaccaaggaagga

SEQ ID NO: 990198 - DNA, 16 bp, Homo sapiens
cccaacccaaaccatg

SEQ ID NO: 990199 - DNA, 12 bp, Homo sapiens
cccaacccccac

SEQ ID NO: 990200 - DNA, 13 bp, Homo sapiens
cccaacccccacc

SEQ ID NO: 990201 - DNA, 23 bp, Homo sapiens
cccaacccccagaggtggccctt

SEQ ID NO: 990202 - DNA, 18 bp, Homo sapiens
cccaacccccctcctgct

SEQ ID NO: 990203 - DNA, 22 bp, Homo sapiens
cccaacccccgcaccaagcaga

SEQ ID NO: 990204 - DNA, 20 bp, Homo sapiens
cccaaccccgcggtgctctg

SEQ ID NO: 990205 - DNA, 21 bp, Homo sapiens
cccaaccccgcggtgctctgg

SEQ ID NO: 990206 - DNA, 20 bp, Homo sapiens
cccaaccctatctcctgaca

SEQ ID NO: 990207 - DNA, 15 bp, Homo sapiens
cccaacctcaatgcc

SEQ ID NO: 990208 - DNA, 18 bp, Homo sapiens
cccaacctcaatgccctg

SEQ ID NO: 990209 - DNA, 21 bp, Homo sapiens
cccaacctcaatgccctgcca

SEQ ID NO: 990210 - DNA, 20 bp, Homo sapiens
cccaacctcagggctcccag

SEQ ID NO: 990211 - DNA, 14 bp, Homo sapiens
cccaacctgctctc

SEQ ID NO: 990212 - DNA, 21 bp, Homo sapiens
cccaacctgctctcctcttgc

SEQ ID NO: 990213 - DNA, 23 bp, Homo sapiens
cccaacctgctctcctcttgcca

SEQ ID NO: 990214 - DNA, 14 bp, Homo sapiens
cccaacctgctgaa

SEQ ID NO: 990215 - DNA, 16 bp, Homo sapiens
cccaacctttccctca

SEQ ID NO: 990216 - DNA, 16 bp, Homo sapiens
cccaacggccctgcag

SEQ ID NO: 990217 - DNA, 20 bp, Homo sapiens
cccaacggccctgcagccag

SEQ ID NO: 990218 - DNA, 17 bp, Homo sapiens
cccaacggggtggggag

SEQ ID NO: 990219 - DNA, 19 bp, Homo sapiens
cccaacgtcccctccgccg

SEQ ID NO: 990220 - DNA, 18 bp, Homo sapiens
cccaactccaggaaagag

SEQ ID NO: 990221 - DNA, 18 bp, Homo sapiens
cccaactccaggggcacc

SEQ ID NO: 990222 - DNA, 19 bp, Homo sapiens
cccaactccaggggcacct

SEQ ID NO: 990223 - DNA, 16 bp, Homo sapiens
cccaactccctgccat

SEQ ID NO: 990224 - DNA, 22 bp, Homo sapiens
cccaactccctgccatttttta

SEQ ID NO: 990225 - DNA, 16 bp, Homo sapiens
cccaactccgcccagc

SEQ ID NO: 990226 - DNA, 16 bp, Homo sapiens
cccaactctccccagt

SEQ ID NO: 990227 - DNA, 17 bp, Homo sapiens
cccaactctccccagtg

SEQ ID NO: 990228 - DNA, 15 bp, Homo sapiens
cccaactctgagccc

SEQ ID NO: 990229 - DNA, 18 bp, Homo sapiens
cccaactctgagcccatg

SEQ ID NO: 990230 - DNA, 19 bp, Homo sapiens
cccaactctgagcccatgt

SEQ ID NO: 990231 - DNA, 23 bp, Homo sapiens
cccaactcttgcacagtcactgc

SEQ ID NO: 990232 - DNA, 23 bp, Homo sapiens
cccaactgagtcatcttgtgagt

SEQ ID NO: 990233 - DNA, 13 bp, Homo sapiens
cccaactgtcttt

SEQ ID NO: 990234 - DNA, 16 bp, Homo sapiens
cccaacttcaccaccc

SEQ ID NO: 990235 - DNA, 19 bp, Homo sapiens
cccaacttcaccaccccct

SEQ ID NO: 990236 - DNA, 20 bp, Homo sapiens
cccaactttgtggatgtctt

SEQ ID NO: 990237 - DNA, 17 bp, Homo sapiens
cccaagaaaccaaagtc

SEQ ID NO: 990238 - DNA, 19 bp, Homo sapiens
cccaagaaaggaaaccttt

SEQ ID NO: 990239 - DNA, 21 bp, Homo sapiens
cccaagaatagatgctgactg

SEQ ID NO: 990240 - DNA, 16 bp, Homo sapiens
cccaagacacttcccc

SEQ ID NO: 990241 - DNA, 18 bp, Homo sapiens
cccaagacacttcccctt

SEQ ID NO: 990242 - DNA, 14 bp, Homo sapiens
cccaagagaactcg

SEQ ID NO: 990243 - DNA, 16 bp, Homo sapiens
cccaagagcagagtct

SEQ ID NO: 990244 - DNA, 21 bp, Homo sapiens
cccaagagcagagtctgggcc

SEQ ID NO: 990245 - DNA, 12 bp, Homo sapiens
cccaagagccat

SEQ ID NO: 990246 - DNA, 20 bp, Homo sapiens
cccaagaggggcgggctcag

SEQ ID NO: 990247 - DNA, 21 bp, Homo sapiens
cccaagaggggcgggctcaga

SEQ ID NO: 990248 - DNA, 23 bp, Homo sapiens
cccaagaggtcaaggctgcagtg

SEQ ID NO: 990249 - DNA, 20 bp, Homo sapiens
cccaagaggtctgagccctg

SEQ ID NO: 990250 - DNA, 18 bp, Homo sapiens
cccaagatgagctgcagc

SEQ ID NO: 990251 - DNA, 22 bp, Homo sapiens
cccaagatgggcatcttttgta

SEQ ID NO: 990252 - DNA, 15 bp, Homo sapiens
cccaagcagccagcc

SEQ ID NO: 990253 - DNA, 12 bp, Homo sapiens
cccaagcagccg

SEQ ID NO: 990254 - DNA, 14 bp, Homo sapiens
cccaagccagaggc

SEQ ID NO: 990255 - DNA, 20 bp, Homo sapiens
cccaagccccatctcatcct

SEQ ID NO: 990256 - DNA, 12 bp, Homo sapiens
cccaagcctggg

SEQ ID NO: 990257 - DNA, 16 bp, Homo sapiens
cccaagctgcctctgg

SEQ ID NO: 990258 - DNA, 11 bp, Homo sapiens
cccaagctggc

SEQ ID NO: 990259 - DNA, 14 bp, Homo sapiens
cccaagctgtggca

SEQ ID NO: 990260 - DNA, 21 bp, Homo sapiens
cccaagctgtggcagccgtcc

SEQ ID NO: 990261 - DNA, 18 bp, Homo sapiens
cccaagcttggcagccga

SEQ ID NO: 990262 - DNA, 22 bp, Homo sapiens
cccaaggaagctccttcctgtt

SEQ ID NO: 990263 - DNA, 23 bp, Homo sapiens
cccaaggacatgagtctgtagga

SEQ ID NO: 990264 - DNA, 16 bp, Homo sapiens
cccaaggactgagggc

SEQ ID NO: 990265 - DNA, 23 bp, Homo sapiens
cccaaggactgagggcagtgccc

SEQ ID NO: 990266 - DNA, 22 bp, Homo sapiens
cccaaggagcacaggtcccacc

SEQ ID NO: 990267 - DNA, 22 bp, Homo sapiens
cccaaggagctgatttccaggc

SEQ ID NO: 990268 - DNA, 23 bp, Homo sapiens
cccaaggagctgatttccaggcc

SEQ ID NO: 990269 - DNA, 14 bp, Homo sapiens
cccaaggaggaaaa

SEQ ID NO: 990270 - DNA, 22 bp, Homo sapiens
cccaaggaggaaaaacagacaa

SEQ ID NO: 990271 - DNA, 11 bp, Homo sapiens
cccaaggccag

SEQ ID NO: 990272 - DNA, 19 bp, Homo sapiens
cccaaggctcactgcagcg

SEQ ID NO: 990273 - DNA, 19 bp, Homo sapiens
cccaaggctcccggaattc

SEQ ID NO: 990274 - DNA, 13 bp, Homo sapiens
cccaagggatctg

SEQ ID NO: 990275 - DNA, 22 bp, Homo sapiens
cccaaggggtctgtatatacat

SEQ ID NO: 990276 - DNA, 11 bp, Homo sapiens
cccaaggttcc

SEQ ID NO: 990277 - DNA, 13 bp, Homo sapiens
cccaaggttccag

SEQ ID NO: 990278 - DNA, 15 bp, Homo sapiens
cccaaggttggagcc

SEQ ID NO: 990279 - DNA, 19 bp, Homo sapiens
cccaaggttggagcccagg

SEQ ID NO: 990280 - DNA, 20 bp, Homo sapiens
cccaagtagctgggattaca

SEQ ID NO: 990281 - DNA, 17 bp, Homo sapiens
cccaagtatgccttaag

SEQ ID NO: 990282 - DNA, 21 bp, Homo sapiens
cccaagtcaaagatgccccat

SEQ ID NO: 990283 - DNA, 22 bp, Homo sapiens
cccaagtcatttccgtcccccc

SEQ ID NO: 990284 - DNA, 16 bp, Homo sapiens
cccaagtcctgaagag

SEQ ID NO: 990285 - DNA, 23 bp, Homo sapiens
cccaagtgatccttccacctcag

SEQ ID NO: 990286 - DNA, 12 bp, Homo sapiens
cccaagtgcctc

SEQ ID NO: 990287 - DNA, 17 bp, Homo sapiens
cccaagtgggcagtcac

SEQ ID NO: 990288 - DNA, 18 bp, Homo sapiens
cccaagtgggcagtcacc

SEQ ID NO: 990289 - DNA, 20 bp, Homo sapiens
cccaagtgggcagtcaccac

SEQ ID NO: 990290 - DNA, 14 bp, Homo sapiens
cccaagtgggggca

SEQ ID NO: 990291 - DNA, 15 bp, Homo sapiens
cccaagtgtgaacaa

SEQ ID NO: 990292 - DNA, 13 bp, Homo sapiens
cccaagttgcagt

SEQ ID NO: 990293 - DNA, 17 bp, Homo sapiens
cccaagttgcagtgagc

SEQ ID NO: 990294 - DNA, 15 bp, Homo sapiens
cccaagttgggggtc

SEQ ID NO: 990295 - DNA, 11 bp, Homo sapiens
cccaataaaag

SEQ ID NO: 990296 - DNA, 12 bp, Homo sapiens
cccaataaaagt

SEQ ID NO: 990297 - DNA, 13 bp, Homo sapiens
cccaataaaggca

SEQ ID NO: 990298 - DNA, 16 bp, Homo sapiens
cccaataaaggcagct

SEQ ID NO: 990299 - DNA, 20 bp, Homo sapiens
cccaataaaggcagctgcct

SEQ ID NO: 990300 - DNA, 20 bp, Homo sapiens
cccaatcagcttttgttcta

SEQ ID NO: 990301 - DNA, 19 bp, Homo sapiens
cccaatcccagctacctca

SEQ ID NO: 990302 - DNA, 17 bp, Homo sapiens
cccaatccctctccact

SEQ ID NO: 990303 - DNA, 15 bp, Homo sapiens
cccaatccctgccac

SEQ ID NO: 990304 - DNA, 18 bp, Homo sapiens
tgggcaggcaagcccttc

SEQ ID NO: 990305 - DNA, 13 bp, Homo sapiens
tgggcagggaggg

SEQ ID NO: 990306 - DNA, 15 bp, Homo sapiens
tgggcagggaggggc

SEQ ID NO: 990307 - DNA, 15 bp, Homo sapiens
tgggcaggtggtggc

SEQ ID NO: 990308 - DNA, 16 bp, Homo sapiens
tgggcaggtggtggca

SEQ ID NO: 990309 - DNA, 16 bp, Homo sapiens
tgggcaggttcctggg

SEQ ID NO: 990310 - DNA, 18 bp, Homo sapiens
tgggcaggttcctggggc

SEQ ID NO: 990311 - DNA, 20 bp, Homo sapiens
tgggcaggttcctggggccg

SEQ ID NO: 990312 - DNA, 23 bp, Homo sapiens
tgggcaggttcctggggccgcct

SEQ ID NO: 990313 - DNA, 15 bp, Homo sapiens
tgggcagtcaccacc

SEQ ID NO: 990314 - DNA, 20 bp, Homo sapiens
tgggcagtcaccacccagcc

SEQ ID NO: 990315 - DNA, 21 bp, Homo sapiens
tgggcagtcaccacccagccc

SEQ ID NO: 990316 - DNA, 12 bp, Homo sapiens
tgggcagtgcca

SEQ ID NO: 990317 - DNA, 18 bp, Homo sapiens
tgggcagtgccacccgca

SEQ ID NO: 990318 - DNA, 23 bp, Homo sapiens
tgggcagtgccccagggagtcca

SEQ ID NO: 990319 - DNA, 24 bp, Homo sapiens
tgggcagtgccccagggagtccag

SEQ ID NO: 990320 - DNA, 17 bp, Homo sapiens
tgggcagttctcccagg

SEQ ID NO: 990321 - DNA, 18 bp, Homo sapiens
tgggcagttctcccaggg

SEQ ID NO: 990322 - DNA, 15 bp, Homo sapiens
tgggcagttttttga

SEQ ID NO: 990323 - DNA, 23 bp, Homo sapiens
tgggcatccacccagtgctgcca

SEQ ID NO: 990324 - DNA, 19 bp, Homo sapiens
tgggcatcttttgtattaa

SEQ ID NO: 990325 - DNA, 22 bp, Homo sapiens
tgggcatgccaccctcacacac

SEQ ID NO: 990326 - DNA, 18 bp, Homo sapiens
tgggcatgggtccagggc

SEQ ID NO: 990327 - DNA, 16 bp, Homo sapiens
tgggcattgcagcctt

SEQ ID NO: 990328 - DNA, 19 bp, Homo sapiens
tgggcattgcagccttgcg

SEQ ID NO: 990329 - DNA, 23 bp, Homo sapiens
tgggcattgcagccttgcgctgt

SEQ ID NO: 990330 - DNA, 18 bp, Homo sapiens
tgggcattgggctgacac

SEQ ID NO: 990331 - DNA, 13 bp, Homo sapiens
tgggcatttattt

SEQ ID NO: 990332 - DNA, 16 bp, Homo sapiens
tgggcatttattttat

SEQ ID NO: 990333 - DNA, 22 bp, Homo sapiens
tgggcatttattttataacatg

SEQ ID NO: 990334 - DNA, 15 bp, Homo sapiens
tgggcatttggtgag

SEQ ID NO: 990335 - DNA, 16 bp, Homo sapiens
tgggcatttggtgaga

SEQ ID NO: 990336 - DNA, 14 bp, Homo sapiens
tgggcattttcctc

SEQ ID NO: 990337 - DNA, 19 bp, Homo sapiens
tgggcattttcctcctctg

SEQ ID NO: 990338 - DNA, 21 bp, Homo sapiens
tgggccaaatccgctctcttc

SEQ ID NO: 990339 - DNA, 18 bp, Homo sapiens
tgggccaaggtgtttcca

SEQ ID NO: 990340 - DNA, 21 bp, Homo sapiens
tgggccaagtccactgtcctc

SEQ ID NO: 990341 - DNA, 22 bp, Homo sapiens
tgggccacacccaggaagggaa

SEQ ID NO: 990342 - DNA, 15 bp, Homo sapiens
tgggccacaggggac

SEQ ID NO: 990343 - DNA, 22 bp, Homo sapiens
tgggccacaggggacagggctg

SEQ ID NO: 990344 - DNA, 18 bp, Homo sapiens
tgggccaccgcccagctc

SEQ ID NO: 990345 - DNA, 17 bp, Homo sapiens
tgggccacctcctaccc

SEQ ID NO: 990346 - DNA, 20 bp, Homo sapiens
tgggccactctcccctccct

SEQ ID NO: 990347 - DNA, 14 bp, Homo sapiens
tgggccactgggga

SEQ ID NO: 990348 - DNA, 15 bp, Homo sapiens
tgggccactgtggtg

SEQ ID NO: 990349 - DNA, 13 bp, Homo sapiens
tgggccagagaag

SEQ ID NO: 990350 - DNA, 11 bp, Homo sapiens
tgggccagagc

SEQ ID NO: 990351 - DNA, 22 bp, Homo sapiens
tgggccagcataggggggaggg

SEQ ID NO: 990352 - DNA, 18 bp, Homo sapiens
tgggccagccacagagca

SEQ ID NO: 990353 - DNA, 15 bp, Homo sapiens
tgggccagcccctcc

SEQ ID NO: 990354 - DNA, 18 bp, Homo sapiens
tgggccagcccctcccac

SEQ ID NO: 990355 - DNA, 13 bp, Homo sapiens
tgggccagccctg

SEQ ID NO: 990356 - DNA, 17 bp, Homo sapiens
tgggccagcggggctgc

SEQ ID NO: 990357 - DNA, 20 bp, Homo sapiens
tgggccagcggggctgctca

SEQ ID NO: 990358 - DNA, 17 bp, Homo sapiens
tgggccaggacaggccc

SEQ ID NO: 990359 - DNA, 18 bp, Homo sapiens
tgggccaggacaggcccg

SEQ ID NO: 990360 - DNA, 19 bp, Homo sapiens
tgggccaggatccccctct

SEQ ID NO: 990361 - DNA, 13 bp, Homo sapiens
tgggccaggcagg

SEQ ID NO: 990362 - DNA, 16 bp, Homo sapiens
tgggccaggcaggcga

SEQ ID NO: 990363 - DNA, 13 bp, Homo sapiens
tgggccagggaaa

SEQ ID NO: 990364 - DNA, 21 bp, Homo sapiens
tgggccagggctgccctgaga

SEQ ID NO: 990365 - DNA, 23 bp, Homo sapiens
tgggagtcacacagtgttggagg

SEQ ID NO: 990366 - DNA, 16 bp, Homo sapiens
tgggagtcagagccct

SEQ ID NO: 990367 - DNA, 21 bp, Homo sapiens
tgggagtcagagccctggctg

SEQ ID NO: 990368 - DNA, 22 bp, Homo sapiens
tgggagtcagagccctggctgg

SEQ ID NO: 990369 - DNA, 23 bp, Homo sapiens
tgggagtcaggcctgggcaggac

SEQ ID NO: 990370 - DNA, 14 bp, Homo sapiens
tgggagtccaggca

SEQ ID NO: 990371 - DNA, 17 bp, Homo sapiens
tgggagtcttaataaaa

SEQ ID NO: 990372 - DNA, 15 bp, Homo sapiens
tgggagtcttgggtg

SEQ ID NO: 990373 - DNA, 23 bp, Homo sapiens
tgggagtgaggggttacctccct

SEQ ID NO: 990374 - DNA, 13 bp, Homo sapiens
tgggagtgggcac

SEQ ID NO: 990375 - DNA, 19 bp, Homo sapiens
tgggagtgggcacctcaga

SEQ ID NO: 990376 - DNA, 15 bp, Homo sapiens
tgggagtgtgtctgc

SEQ ID NO: 990377 - DNA, 17 bp, Homo sapiens
tgggagttcagctgctt

SEQ ID NO: 990378 - DNA, 19 bp, Homo sapiens
tgggagttcagctgcttct

SEQ ID NO: 990379 - DNA, 22 bp, Homo sapiens
tgggagttgatcgcctttccca

SEQ ID NO: 990380 - DNA, 20 bp, Homo sapiens
tgggagtttttatgagaaac

SEQ ID NO: 990381 - DNA, 21 bp, Homo sapiens
tgggataaacatcacatgaga

SEQ ID NO: 990382 - DNA, 23 bp, Homo sapiens
tgggataaagatgcaaggaccag

SEQ ID NO: 990383 - DNA, 15 bp, Homo sapiens
tgggataaagcaagg

SEQ ID NO: 990384 - DNA, 22 bp, Homo sapiens
tgggatacttagtggtatgtct

SEQ ID NO: 990385 - DNA, 18 bp, Homo sapiens
tgggatagtgttctgctc

SEQ ID NO: 990386 - DNA, 19 bp, Homo sapiens
tgggatagtgttctgctcc

SEQ ID NO: 990387 - DNA, 23 bp, Homo sapiens
tgggatagtgttctgctcctgct

SEQ ID NO: 990388 - DNA, 16 bp, Homo sapiens
tgggatatcattttaa

SEQ ID NO: 990389 - DNA, 15 bp, Homo sapiens
tgggatatggctgcc

SEQ ID NO: 990390 - DNA, 15 bp, Homo sapiens
tgggatatgtggtgt

SEQ ID NO: 990391 - DNA, 15 bp, Homo sapiens
tgggatcaataggaa

SEQ ID NO: 990392 - DNA, 13 bp, Homo sapiens
tgggatcagcctc

SEQ ID NO: 990393 - DNA, 22 bp, Homo sapiens
tgggatcatttttccaggactc

SEQ ID NO: 990394 - DNA, 17 bp, Homo sapiens
tgggatccaaggggcag

SEQ ID NO: 990395 - DNA, 23 bp, Homo sapiens
tgggatccacttcttggttcctg

SEQ ID NO: 990396 - DNA, 19 bp, Homo sapiens
tgggatcctccctcatggc

SEQ ID NO: 990397 - DNA, 21 bp, Homo sapiens
tgggatccttgggcccatcac

SEQ ID NO: 990398 - DNA, 22 bp, Homo sapiens
tgggatcgtgcatttgaggggc

SEQ ID NO: 990399 - DNA, 15 bp, Homo sapiens
tgggatctaggagag

SEQ ID NO: 990400 - DNA, 18 bp, Homo sapiens
tgggatctgtcttggcat

SEQ ID NO: 990401 - DNA, 18 bp, Homo sapiens
tgggatgcagtgatgtga

SEQ ID NO: 990402 - DNA, 23 bp, Homo sapiens
tgggatgccaatttcctctccac

SEQ ID NO: 990403 - DNA, 16 bp, Homo sapiens
tgggatgctgacccag

SEQ ID NO: 990404 - DNA, 19 bp, Homo sapiens
tgggatgctgacccaggaa

SEQ ID NO: 990405 - DNA, 18 bp, Homo sapiens
tgggatggaacctcagga

SEQ ID NO: 990406 - DNA, 13 bp, Homo sapiens
tgggatggaggag

SEQ ID NO: 990407 - DNA, 23 bp, Homo sapiens
tgggatggcatttggtctcaggc

SEQ ID NO: 990408 - DNA, 12 bp, Homo sapiens
tgggatggcgat

SEQ ID NO: 990409 - DNA, 15 bp, Homo sapiens
tgggatggcgatggg

SEQ ID NO: 990410 - DNA, 13 bp, Homo sapiens
tgggatgggctct

SEQ ID NO: 990411 - DNA, 17 bp, Homo sapiens
tgggatgggctctacct

SEQ ID NO: 990412 - DNA, 20 bp, Homo sapiens
tgggatgggctctacctctc

SEQ ID NO: 990413 - DNA, 12 bp, Homo sapiens
tgggatggggag

SEQ ID NO: 990414 - DNA, 19 bp, Homo sapiens
tgggatggtcggatctcac

SEQ ID NO: 990415 - DNA, 20 bp, Homo sapiens
tgggatggtcggatctcaca

SEQ ID NO: 990416 - DNA, 20 bp, Homo sapiens
tgggatgttcagcactgtcc

SEQ ID NO: 990417 - DNA, 15 bp, Homo sapiens
tgggattaagggcaa

SEQ ID NO: 990418 - DNA, 12 bp, Homo sapiens
tgggattacagg

SEQ ID NO: 990419 - DNA, 20 bp, Homo sapiens
tgggattacaggcgtgagcc

SEQ ID NO: 990420 - DNA, 19 bp, Homo sapiens
tgggattacaggcttgagc

SEQ ID NO: 990421 - DNA, 20 bp, Homo sapiens
tgggattataggcatgagcc

SEQ ID NO: 990422 - DNA, 14 bp, Homo sapiens
tgggattattcttt

SEQ ID NO: 990423 - DNA, 18 bp, Homo sapiens
tgggattattctttgaaa

SEQ ID NO: 990424 - DNA, 17 bp, Homo sapiens
tgggattcaggaatgtg

SEQ ID NO: 990425 - DNA, 23 bp, Homo sapiens
tgggattcccaccaaggtcttca

SEQ ID NO: 990426 - DNA, 16 bp, Homo sapiens
tgggattcctgaccca

SEQ ID NO: 990427 - DNA, 20 bp, Homo sapiens
tgggattcctgacccaggcc

SEQ ID NO: 990428 - DNA, 24 bp, Homo sapiens
tgggattcctgacccaggccgcag

SEQ ID NO: 990429 - DNA, 22 bp, Homo sapiens
tgggattctactttaagcacta

SEQ ID NO: 990430 - DNA, 16 bp, Homo sapiens
tgggattgagtctgtg

SEQ ID NO: 990431 - DNA, 10 bp, Homo sapiens
tgggattgct

SEQ ID NO: 990432 - DNA, 19 bp, Homo sapiens
tgggattgggggctggtgc

SEQ ID NO: 990433 - DNA, 21 bp, Homo sapiens
tgggattggggggaaagaggg

SEQ ID NO: 990434 - DNA, 16 bp, Homo sapiens
taaagttgataaagat

SEQ ID NO: 990435 - DNA, 21 bp, Homo sapiens
taaagttgattttgaactttt

SEQ ID NO: 990436 - DNA, 15 bp, Homo sapiens
taaagttggccatgt

SEQ ID NO: 990437 - DNA, 20 bp, Homo sapiens
taaagttggtattaataaaa

SEQ ID NO: 990438 - DNA, 21 bp, Homo sapiens
taaagttgtaaataattttct

SEQ ID NO: 990439 - DNA, 12 bp, Homo sapiens
taaagtttatta

SEQ ID NO: 990440 - DNA, 14 bp, Homo sapiens
taaagtttccatta

SEQ ID NO: 990441 - DNA, 14 bp, Homo sapiens
taaagtttgcttag

SEQ ID NO: 990442 - DNA, 17 bp, Homo sapiens
taaagtttgcttagaaa

SEQ ID NO: 990443 - DNA, 18 bp, Homo sapiens
taaagtttggtattgtaa

SEQ ID NO: 990444 - DNA, 16 bp, Homo sapiens
taaagtttgttcactt

SEQ ID NO: 990445 - DNA, 15 bp, Homo sapiens
taaagtttgttgaaa

SEQ ID NO: 990446 - DNA, 13 bp, Homo sapiens
taaagttttgcaa

SEQ ID NO: 990447 - DNA, 17 bp, Homo sapiens
taaataaaaagtacaaa

SEQ ID NO: 990448 - DNA, 17 bp, Homo sapiens
taaataaaaatatgtaa

SEQ ID NO: 990449 - DNA, 19 bp, Homo sapiens
taaataaaaatatgtaatt

SEQ ID NO: 990450 - DNA, 21 bp, Homo sapiens
taaataaaagaaaaaatatct

SEQ ID NO: 990451 - DNA, 14 bp, Homo sapiens
taaataaaagcaca

SEQ ID NO: 990452 - DNA, 22 bp, Homo sapiens
taaataaaagcacaagtacttt

SEQ ID NO: 990453 - DNA, 15 bp, Homo sapiens
taaataaaatgtgta

SEQ ID NO: 990454 - DNA, 16 bp, Homo sapiens
taaataaaatgtgtac

SEQ ID NO: 990455 - DNA, 20 bp, Homo sapiens
taaataaaatgtgtacagtg

SEQ ID NO: 990456 - DNA, 22 bp, Homo sapiens
taaataaaatgtgtacagtgaa

SEQ ID NO: 990457 - DNA, 13 bp, Homo sapiens
taaataaaatttg

SEQ ID NO: 990458 - DNA, 14 bp, Homo sapiens
taaataaaatttgt

SEQ ID NO: 990459 - DNA, 17 bp, Homo sapiens
taaataaacagatgtat

SEQ ID NO: 990460 - DNA, 14 bp, Homo sapiens
taaataaaccactg

SEQ ID NO: 990461 - DNA, 13 bp, Homo sapiens
taaataaactgtt

SEQ ID NO: 990462 - DNA, 21 bp, Homo sapiens
taaataaactgttttcaagtc

SEQ ID NO: 990463 - DNA, 14 bp, Homo sapiens
taaataaatatttt

SEQ ID NO: 990464 - DNA, 13 bp, Homo sapiens
taaataaatttga

SEQ ID NO: 990465 - DNA, 14 bp, Homo sapiens
taaataaatttgac

SEQ ID NO: 990466 - DNA, 18 bp, Homo sapiens
taaataacacagatattg

SEQ ID NO: 990467 - DNA, 22 bp, Homo sapiens
taaataacaggcatttgttcac

SEQ ID NO: 990468 - DNA, 22 bp, Homo sapiens
taaataacctctggcccttgga

SEQ ID NO: 990469 - DNA, 13 bp, Homo sapiens
taaataacttttt

SEQ ID NO: 990470 - DNA, 22 bp, Homo sapiens
taaataagaaacaactctttga

SEQ ID NO: 990471 - DNA, 15 bp, Homo sapiens
taaataagagatttg

SEQ ID NO: 990472 - DNA, 16 bp, Homo sapiens
taaataagcccagtgc

SEQ ID NO: 990473 - DNA, 12 bp, Homo sapiens
taaataatgaaa

SEQ ID NO: 990474 - DNA, 21 bp, Homo sapiens
taaataatgaataaactgaat

SEQ ID NO: 990475 - DNA, 17 bp, Homo sapiens
taaataatgcttcagat

SEQ ID NO: 990476 - DNA, 15 bp, Homo sapiens
taaataattggaaaa

SEQ ID NO: 990477 - DNA, 17 bp, Homo sapiens
taaataatttatttaat

SEQ ID NO: 990478 - DNA, 16 bp, Homo sapiens
taaataatttcctaca

SEQ ID NO: 990479 - DNA, 14 bp, Homo sapiens
taaataatttctac

SEQ ID NO: 990480 - DNA, 17 bp, Homo sapiens
taaataatttgcactga

SEQ ID NO: 990481 - DNA, 13 bp, Homo sapiens
taaataattttaa

SEQ ID NO: 990482 - DNA, 17 bp, Homo sapiens
taaataattttctaaga

SEQ ID NO: 990483 - DNA, 17 bp, Homo sapiens
taaatacaaaacttcca

SEQ ID NO: 990484 - DNA, 15 bp, Homo sapiens
taaatacaaattttg

SEQ ID NO: 990485 - DNA, 18 bp, Homo sapiens
taaatacacaacacacac

SEQ ID NO: 990486 - DNA, 21 bp, Homo sapiens
taaatacacttcctgcttaaa

SEQ ID NO: 990487 - DNA, 15 bp, Homo sapiens
taaatacagacacta

SEQ ID NO: 990488 - DNA, 18 bp, Homo sapiens
taaatacagacactaagt

SEQ ID NO: 990489 - DNA, 20 bp, Homo sapiens
taaatacatgcacacacttg

SEQ ID NO: 990490 - DNA, 21 bp, Homo sapiens
taaatacatgcatataatgaa

SEQ ID NO: 990491 - DNA, 14 bp, Homo sapiens
taaataccaagagc

SEQ ID NO: 990492 - DNA, 18 bp, Homo sapiens
taaataccaagagcaatt

SEQ ID NO: 990493 - DNA, 17 bp, Homo sapiens
taaataccagacacgta

SEQ ID NO: 990494 - DNA, 13 bp, Homo sapiens
taaatacctctta

SEQ ID NO: 990495 - DNA, 23 bp, Homo sapiens
taaatacctcttagctgagtgga

SEQ ID NO: 990496 - DNA, 18 bp, Homo sapiens
taaatactcatgaatgaa

SEQ ID NO: 990497 - DNA, 16 bp, Homo sapiens
taaatactgcaaatca

SEQ ID NO: 990498 - DNA, 14 bp, Homo sapiens
taaatactggactc

SEQ ID NO: 990499 - DNA, 17 bp, Homo sapiens
taaatactggactcagg

SEQ ID NO: 990500 - DNA, 17 bp, Homo sapiens
taaatactgtgcagaat

SEQ ID NO: 990501 - DNA, 16 bp, Homo sapiens
taaatacttgcagttg

SEQ ID NO: 990502 - DNA, 12 bp, Homo sapiens
taaatacttttt

SEQ ID NO: 990503 - DNA, 16 bp, Homo sapiens
taaatagaaattttca

SEQ ID NO: 990504 - DNA, 18 bp, Homo sapiens
taaatagaagagtttaaa

SEQ ID NO: 990505 - DNA, 22 bp, Homo sapiens
taaatagaagagtttaaaagca

SEQ ID NO: 990506 - DNA, 16 bp, Homo sapiens
taaatagcctaaatga

SEQ ID NO: 990507 - DNA, 14 bp, Homo sapiens
taaatagctatatc

SEQ ID NO: 990508 - DNA, 18 bp, Homo sapiens
taaatagctatatccatg

SEQ ID NO: 990509 - DNA, 19 bp, Homo sapiens
taaatagctatatccatgt

SEQ ID NO: 990510 - DNA, 20 bp, Homo sapiens
taaatagctatatccatgta

SEQ ID NO: 990511 - DNA, 16 bp, Homo sapiens
taaatagctgaaaact

SEQ ID NO: 990512 - DNA, 19 bp, Homo sapiens
taaatagctgaaaactaat

SEQ ID NO: 990513 - DNA, 17 bp, Homo sapiens
taaatataaatgtttaa

SEQ ID NO: 990514 - DNA, 19 bp, Homo sapiens
taaatataccactctttac

SEQ ID NO: 990515 - DNA, 21 bp, Homo sapiens
taaatatactcaagtttcagg

SEQ ID NO: 990516 - DNA, 12 bp, Homo sapiens
taaatatataaa

SEQ ID NO: 990517 - DNA, 13 bp, Homo sapiens
taaatatataaat

SEQ ID NO: 990518 - DNA, 16 bp, Homo sapiens
taaatatataaatata

SEQ ID NO: 990519 - DNA, 14 bp, Homo sapiens
taaatatatataaa

SEQ ID NO: 990520 - DNA, 15 bp, Homo sapiens
taaatatatataaac

SEQ ID NO: 990521 - DNA, 19 bp, Homo sapiens
taaatatatataaacctaa

SEQ ID NO: 990522 - DNA, 14 bp, Homo sapiens
taaatatatatgat

SEQ ID NO: 990523 - DNA, 16 bp, Homo sapiens
taaatatatatgtcaa

SEQ ID NO: 990524 - DNA, 17 bp, Homo sapiens
taaatatatatttctaa

SEQ ID NO: 990525 - DNA, 14 bp, Homo sapiens
taaatatatatttt

SEQ ID NO: 990526 - DNA, 23 bp, Homo sapiens
taaatatatatttttcaaataga

SEQ ID NO: 990527 - DNA, 18 bp, Homo sapiens
taaatatatctaccccag

SEQ ID NO: 990528 - DNA, 20 bp, Homo sapiens
taaatatatctaccccagac

SEQ ID NO: 990529 - DNA, 22 bp, Homo sapiens
taaatatatctagaactatcat

SEQ ID NO: 990530 - DNA, 14 bp, Homo sapiens
taaatatatgtatg

SEQ ID NO: 990531 - DNA, 16 bp, Homo sapiens
taaatatatgtatgta

SEQ ID NO: 990532 - DNA, 12 bp, Homo sapiens
taaatatccaaa

SEQ ID NO: 990533 - DNA, 21 bp, Homo sapiens
taaatatccaaagactgtact

SEQ ID NO: 990534 - DNA, 23 bp, Homo sapiens
taaatatccaaagactgtactgg

SEQ ID NO: 990535 - DNA, 22 bp, Homo sapiens
taaatatctgtacttcttcgat

SEQ ID NO: 990536 - DNA, 18 bp, Homo sapiens
taaatatcttctgatttg

SEQ ID NO: 990537 - DNA, 17 bp, Homo sapiens
taaatatggactgctca

SEQ ID NO: 990538 - DNA, 22 bp, Homo sapiens
gtggagagggacagcccactga

SEQ ID NO: 990539 - DNA, 20 bp, Homo sapiens
gtggagagggagactcctgg

SEQ ID NO: 990540 - DNA, 20 bp, Homo sapiens
gtggagatagtgccaggtgg

SEQ ID NO: 990541 - DNA, 21 bp, Homo sapiens
gtggagatcagaaagtgacat

SEQ ID NO: 990542 - DNA, 15 bp, Homo sapiens
gtggagcactggact

SEQ ID NO: 990543 - DNA, 16 bp, Homo sapiens
gtggagcactggactc

SEQ ID NO: 990544 - DNA, 16 bp, Homo sapiens
gtggagcagccagagc

SEQ ID NO: 990545 - DNA, 22 bp, Homo sapiens
gtggagcagccagagctgtgcc

SEQ ID NO: 990546 - DNA, 17 bp, Homo sapiens
gtggagcatgggcctgg

SEQ ID NO: 990547 - DNA, 22 bp, Homo sapiens
gtggagccattgaacagctgtg

SEQ ID NO: 990548 - DNA, 14 bp, Homo sapiens
gtggagctcagccc

SEQ ID NO: 990549 - DNA, 15 bp, Homo sapiens
gtggagctcagcccc

SEQ ID NO: 990550 - DNA, 18 bp, Homo sapiens
gtggagctcgcccctccc

SEQ ID NO: 990551 - DNA, 23 bp, Homo sapiens
gtggagctcgcccctcccctcag

SEQ ID NO: 990552 - DNA, 16 bp, Homo sapiens
gtggagcttgcagtga

SEQ ID NO: 990553 - DNA, 17 bp, Homo sapiens
gtggaggaagagccacc

SEQ ID NO: 990554 - DNA, 20 bp, Homo sapiens
gtggaggaagagccacctgc

SEQ ID NO: 990555 - DNA, 17 bp, Homo sapiens
gtggaggaaggctctgt

SEQ ID NO: 990556 - DNA, 12 bp, Homo sapiens
gtggaggaaggt

SEQ ID NO: 990557 - DNA, 12 bp, Homo sapiens
gtggaggagagg

SEQ ID NO: 990558 - DNA, 15 bp, Homo sapiens
gtggaggagaggaga

SEQ ID NO: 990559 - DNA, 22 bp, Homo sapiens
gtggaggagctgagggagggag

SEQ ID NO: 990560 - DNA, 19 bp, Homo sapiens
gggctgagtggggagcagt

SEQ ID NO: 990561 - DNA, 17 bp, Homo sapiens
gggctgatggcctggct

SEQ ID NO: 990562 - DNA, 18 bp, Homo sapiens
gggctgcacgctcccctc

SEQ ID NO: 990563 - DNA, 23 bp, Homo sapiens
gggctgcacgctcccctccatcc

SEQ ID NO: 990564 - DNA, 18 bp, Homo sapiens
gggctgcagcagccggaa

SEQ ID NO: 990565 - DNA, 19 bp, Homo sapiens
gggctgcagcatgttgctg

SEQ ID NO: 990566 - DNA, 15 bp, Homo sapiens
gggctgcaggcaggc

SEQ ID NO: 990567 - DNA, 16 bp, Homo sapiens
gggctgcatgatgttt

SEQ ID NO: 990568 - DNA, 17 bp, Homo sapiens
gggctgcccagctgctc

SEQ ID NO: 990569 - DNA, 20 bp, Homo sapiens
gggctgcccctaatctctgt

SEQ ID NO: 990570 - DNA, 20 bp, Homo sapiens
gggctgccggatctgggctg

SEQ ID NO: 990571 - DNA, 11 bp, Homo sapiens
gggctgctcct

SEQ ID NO: 990572 - DNA, 14 bp, Homo sapiens
gggctgctcctcat

SEQ ID NO: 990573 - DNA, 19 bp, Homo sapiens
gggctgctcctccagggcc

SEQ ID NO: 990574 - DNA, 12 bp, Homo sapiens
gggctgctgcct

SEQ ID NO: 990575 - DNA, 14 bp, Homo sapiens
gggctgctgcttct

SEQ ID NO: 990576 - DNA, 23 bp, Homo sapiens
gggctgctgcttctgctccagcc

SEQ ID NO: 990577 - DNA, 14 bp, Homo sapiens
gggctgctgggcgt

SEQ ID NO: 990578 - DNA, 14 bp, Homo sapiens
gggctgctggggca

SEQ ID NO: 990579 - DNA, 16 bp, Homo sapiens
gggctgctggggcatg

SEQ ID NO: 990580 - DNA, 11 bp, Homo sapiens
gggctgctgtg
